United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 52

SEQ ID NO: 2340780 - RNA, 12 nt, Human
ggcugccuccac

SEQ ID NO: 2340781 - RNA, 16 nt, Human
ggcugccuccacuccc

SEQ ID NO: 2340782 - RNA, 17 nt, Human
ggcugccuccacuccca

SEQ ID NO: 2340783 - RNA, 16 nt, Human
ggcuggccaguccagg

SEQ ID NO: 2340784 - RNA, 20 nt, Human
ggcuggccagccccacagcc

SEQ ID NO: 2340785 - RNA, 20 nt, Human
ggcuggccaguccaggcugc

SEQ ID NO: 2340786 - RNA, 21 nt, Human
ggcuggccaguccaggcugcc

SEQ ID NO: 2340787 - RNA, 23 nt, Human
ggcuggccacugcacagagcucu

SEQ ID NO: 2340788 - RNA, 11 nt, Human
ggcuggccagc

SEQ ID NO: 2340789 - RNA, 12 nt, Human
ggcuggccagcc

SEQ ID NO: 2340790 - RNA, 13 nt, Human
ggcuggccagccc

SEQ ID NO: 2340791 - RNA, 14 nt, Human
ggcuggccagcccc

SEQ ID NO: 2340792 - RNA, 15 nt, Human
ggcuggccagcccca

SEQ ID NO: 2340793 - RNA, 17 nt, Human
ggcuggccagccccaca

SEQ ID NO: 2340794 - RNA, 18 nt, Human
ggcuggccagccccacag

SEQ ID NO: 2340795 - RNA, 12 nt, Human
ggcugcccuggu

SEQ ID NO: 2340796 - RNA, 19 nt, Human
ggcugcccuggcccugagg

SEQ ID NO: 2340797 - RNA, 20 nt, Human
ggcugcccuggcccugaggu

SEQ ID NO: 2340798 - RNA, 21 nt, Human
ggcugcccuggcccugaggug

SEQ ID NO: 2340799 - RNA, 22 nt, Human
ggcugcccuggcccugaggugu

SEQ ID NO: 2340800 - RNA, 11 nt, Human
ggcugcccuuu

SEQ ID NO: 2340801 - RNA, 10 nt, Human
ggcugcccuu

SEQ ID NO: 2340802 - RNA, 18 nt, Human
ggcugcccuuucugggca

SEQ ID NO: 2340803 - RNA, 14 nt, Human
ggcugcccuuucug

SEQ ID NO: 2340804 - RNA, 21 nt, Human
ggcugccggguucuagucucc

SEQ ID NO: 2340805 - RNA, 16 nt, Human
ggcugccguggggccg

SEQ ID NO: 2340806 - RNA, 23 nt, Human
ggcugccguggggccgccgccuc

SEQ ID NO: 2340807 - RNA, 12 nt, Human
ggcugcccuggc

SEQ ID NO: 2340808 - RNA, 11 nt, Human
ggcugcccugg

SEQ ID NO: 2340809 - RNA, 13 nt, Human
ggcugcccugcca

SEQ ID NO: 2340810 - RNA, 14 nt, Human
ggcugcccuggccc

SEQ ID NO: 2340811 - RNA, 15 nt, Human
ggcugcccuggcccu

SEQ ID NO: 2340812 - RNA, 16 nt, Human
ggcugcccuggcccug

SEQ ID NO: 2340813 - RNA, 17 nt, Human
ggcugcccuggcccuga

SEQ ID NO: 2340814 - RNA, 12 nt, Human
ggcugcccugcc

SEQ ID NO: 2340815 - RNA, 21 nt, Human
ggcugagacugcgggaugguc

SEQ ID NO: 2340816 - RNA, 14 nt, Human
ggcugagaacacug

SEQ ID NO: 2340817 - RNA, 17 nt, Human
ggcugagaacccugcgu

SEQ ID NO: 2340818 - RNA, 15 nt, Human
ggcugagacaggaga

SEQ ID NO: 2340819 - RNA, 18 nt, Human
ggcugagacaggagaauc

SEQ ID NO: 2340820 - RNA, 22 nt, Human
ggcugcccgcucccagugucuu

SEQ ID NO: 2340821 - RNA, 18 nt, Human
ggcugcccgcucccagug

SEQ ID NO: 2340822 - RNA, 21 nt, Human
ggcugcccgcucccagugucu

SEQ ID NO: 2340823 - RNA, 13 nt, Human
ggcugcccgcucc

SEQ ID NO: 2340824 - RNA, 14 nt, Human
ggcugcccgcuccc

SEQ ID NO: 2340825 - RNA, 16 nt, Human
ggcugcccgcucccag

SEQ ID NO: 2340826 - RNA, 17 nt, Human
ggcugcccgcucccagu

SEQ ID NO: 2340827 - RNA, 15 nt, Human
ggcugaccaugcuca

SEQ ID NO: 2340828 - RNA, 16 nt, Human
ggcucuuuccuugcuc

SEQ ID NO: 2340829 - RNA, 17 nt, Human
ggcucuuuccuugcuca

SEQ ID NO: 2340830 - RNA, 22 nt, Human
ggcucuuuggggucagccaggg

SEQ ID NO: 2340831 - RNA, 24 nt, Human
ggcugaaagaacauggacuuguau

SEQ ID NO: 2340832 - RNA, 22 nt, Human
ggcugacccagucccuggggga

SEQ ID NO: 2340833 - RNA, 18 nt, Human
ggcugaccccaaagagcc

SEQ ID NO: 2340834 - RNA, 19 nt, Human
ggcugaccccaaagagccu

SEQ ID NO: 2340835 - RNA, 20 nt, Human
ggcugaccccaaagagccug

SEQ ID NO: 2340836 - RNA, 19 nt, Human
ggcugacccagucccuggg

SEQ ID NO: 2340837 - RNA, 18 nt, Human
ggcugacccagucccugg

SEQ ID NO: 2340838 - RNA, 17 nt, Human
ggcugacccagucccug

SEQ ID NO: 2340839 - RNA, 22 nt, Human
ggcugaccacagcacagccaac

SEQ ID NO: 2340840 - RNA, 21 nt, Human
ggcugaccuugaacuccuggg

SEQ ID NO: 2340841 - RNA, 23 nt, Human
ggcugaccuuccucgcagagagg

SEQ ID NO: 2340842 - RNA, 22 nt, Human
ggcugacggugcagucugggug

SEQ ID NO: 2340843 - RNA, 22 nt, Human
ggcugaccccaaagagccugga

SEQ ID NO: 2340844 - RNA, 20 nt, Human
ggcugaccuuccucgcagag

SEQ ID NO: 2340845 - RNA, 22 nt, Human
ggcugacuagaagggccagucc

SEQ ID NO: 2340846 - RNA, 19 nt, Human
ggcugacuagaagggccag

SEQ ID NO: 2340847 - RNA, 24 nt, Human
ggcugacuagaagggccaguccug

SEQ ID NO: 2340848 - RNA, 22 nt, Human
ggcucgucggggggacagcucc

SEQ ID NO: 2340849 - RNA, 17 nt, Human
ggcucggaggcugcccc

SEQ ID NO: 2340850 - RNA, 23 nt, Human
ggcucgccucaggaaugggcugu

SEQ ID NO: 2340851 - RNA, 22 nt, Human
ggcucgccucaggaaugggcug

SEQ ID NO: 2340852 - RNA, 16 nt, Human
ggcucggaggcugccc

SEQ ID NO: 2340853 - RNA, 21 nt, Human
ggcucccuguaaccucuucag

SEQ ID NO: 2340854 - RNA, 21 nt, Human
ggcucccuucaucuccaggga

SEQ ID NO: 2340855 - RNA, 20 nt, Human
ggcucgauuuuguaucugca

SEQ ID NO: 2340856 - RNA, 22 nt, Human
ggcucgauuuuguaucugcagg

SEQ ID NO: 2340857 - RNA, 16 nt, Human
ggcucgccaugccggg

SEQ ID NO: 2340858 - RNA, 17 nt, Human
ggcucgccaugccgggg

SEQ ID NO: 2340859 - RNA, 18 nt, Human
ggcucguugacuggcugu

SEQ ID NO: 2340860 - RNA, 13 nt, Human
ggcucccuuccca

SEQ ID NO: 2340861 - RNA, 20 nt, Human
ggcucccuguaaccucuuca

SEQ ID NO: 2340862 - RNA, 11 nt, Human
ggcucccugga

SEQ ID NO: 2340863 - RNA, 18 nt, Human
ggcucccugacugggagu

SEQ ID NO: 2340864 - RNA, 17 nt, Human
ggcucccugacugggag

SEQ ID NO: 2340865 - RNA, 14 nt, Human
ggcucuuccaggcu

SEQ ID NO: 2340866 - RNA, 18 nt, Human
ggcucuacaacugagucc

SEQ ID NO: 2340867 - RNA, 15 nt, Human
ggcucuuccaggcug

SEQ ID NO: 2340868 - RNA, 17 nt, Human
ggcucuuccaggcuggg

SEQ ID NO: 2340869 - RNA, 18 nt, Human
ggcucuuccaggcuggga

SEQ ID NO: 2340870 - RNA, 13 nt, Human
ggcucuucugacu

SEQ ID NO: 2340871 - RNA, 19 nt, Human
ggcucuacaacugaguccu

SEQ ID NO: 2340872 - RNA, 23 nt, Human
ggcucuucuccuuucacaaccuu

SEQ ID NO: 2340873 - RNA, 19 nt, Human
ggcucuugaacugagcuug

SEQ ID NO: 2340874 - RNA, 18 nt, Human
ggcucuugaacugagcuu

SEQ ID NO: 2340875 - RNA, 20 nt, Human
ggcucuugaacugagcuugg

SEQ ID NO: 2340876 - RNA, 19 nt, Human
ggcucuugauaccccccuc

SEQ ID NO: 2340877 - RNA, 20 nt, Human
ggcucuugauaccccccucu

SEQ ID NO: 2340878 - RNA, 21 nt, Human
ggcucuugauaccccccucug

SEQ ID NO: 2340879 - RNA, 14 nt, Human
ggcucuucugacua

SEQ ID NO: 2340880 - RNA, 20 nt, Human
ggcucuugugcuggauggag

SEQ ID NO: 2340881 - RNA, 23 nt, Human
ggcucuugugcuggauggagccc

SEQ ID NO: 2340882 - RNA, 13 nt, Human
ggcucuuuccuug

SEQ ID NO: 2340883 - RNA, 14 nt, Human
ggcucuuuccuugc

SEQ ID NO: 2340884 - RNA, 15 nt, Human
ggcucuuuccuugcu

SEQ ID NO: 2340885 - RNA, 17 nt, Human
gguguugacaugugcuu

SEQ ID NO: 2340886 - RNA, 21 nt, Human
gguguugccaaauauguccug

SEQ ID NO: 2340887 - RNA, 22 nt, Human
gguguugccaaauauguccugg

SEQ ID NO: 2340888 - RNA, 23 nt, Human
gguguuccgaaaccaaagaagaa

SEQ ID NO: 2340889 - RNA, 21 nt, Human
gguguuaucaccgugggcucc

SEQ ID NO: 2340890 - RNA, 14 nt, Human
gguguguguagcca

SEQ ID NO: 2340891 - RNA, 18 nt, Human
gguguguggagaugcaga

SEQ ID NO: 2340892 - RNA, 18 nt, Human
gguguguuccaacugccc

SEQ ID NO: 2340893 - RNA, 19 nt, Human
gguguguuccaacugcccc

SEQ ID NO: 2340894 - RNA, 17 nt, Human
gguguggugcaguguga

SEQ ID NO: 2340895 - RNA, 15 nt, Human
gguguggugcagugu

SEQ ID NO: 2340896 - RNA, 23 nt, Human
ggugugucccccucuguccaggc

SEQ ID NO: 2340897 - RNA, 12 nt, Human
ggugugucugcu

SEQ ID NO: 2340898 - RNA, 13 nt, Human
ggugugggggaag

SEQ ID NO: 2340899 - RNA, 11 nt, Human
gguguggggga

SEQ ID NO: 2340900 - RNA, 19 nt, Human
gguguggcccugccaucuu

SEQ ID NO: 2340901 - RNA, 12 nt, Human
gguguggcuccu

SEQ ID NO: 2340902 - RNA, 16 nt, Human
gguguggagccgaggc

SEQ ID NO: 2340903 - RNA, 15 nt, Human
gguguggcccugcca

SEQ ID NO: 2340904 - RNA, 18 nt, Human
gguguggcccugccaucu

SEQ ID NO: 2340905 - RNA, 12 nt, Human
gguguggagaag

SEQ ID NO: 2340906 - RNA, 20 nt, Human
gguggggggaucacaagguc

SEQ ID NO: 2340907 - RNA, 23 nt, Human
gguguggagaagcggcuggcagc

SEQ ID NO: 2340908 - RNA, 14 nt, Human
gguguggagaagcg

SEQ ID NO: 2340909 - RNA, 13 nt, Human
ggugggggccucg

SEQ ID NO: 2340910 - RNA, 18 nt, Human
gguggggggcuucauaca

SEQ ID NO: 2340911 - RNA, 16 nt, Human
gguggggggcuucaua

SEQ ID NO: 2340912 - RNA, 22 nt, Human
gguggggcugcuccuccagggc

SEQ ID NO: 2340913 - RNA, 18 nt, Human
gguggggcugcuccucca

SEQ ID NO: 2340914 - RNA, 17 nt, Human
gguggggcugcuccucc

SEQ ID NO: 2340915 - RNA, 13 nt, Human
gguggggcugcuc

SEQ ID NO: 2340916 - RNA, 17 nt, Human
gguggggcgggaaagcc

SEQ ID NO: 2340917 - RNA, 13 nt, Human
gguggggaauguu

SEQ ID NO: 2340918 - RNA, 20 nt, Human
ggugggcuucccaguggcug

SEQ ID NO: 2340919 - RNA, 14 nt, Human
ggugggcuucccag

SEQ ID NO: 2340920 - RNA, 21 nt, Human
gguuccggaauccuguccuca

SEQ ID NO: 2340921 - RNA, 23 nt, Human
gguuccgcuuggagcagaggggc

SEQ ID NO: 2340922 - RNA, 20 nt, Human
gguucggauuugggguggau

SEQ ID NO: 2340923 - RNA, 23 nt, Human
gguucguggaaagggugcugcuu

SEQ ID NO: 2340924 - RNA, 23 nt, Human
gguucuagucuccuuugcacuga

SEQ ID NO: 2340925 - RNA, 13 nt, Human
gguucuauuugga

SEQ ID NO: 2340926 - RNA, 16 nt, Human
gguucuauuuggaauu

SEQ ID NO: 2340927 - RNA, 13 nt, Human
gguucccccagcc

SEQ ID NO: 2340928 - RNA, 12 nt, Human
gguuccccaccg

SEQ ID NO: 2340929 - RNA, 16 nt, Human
gguucccaagcucaga

SEQ ID NO: 2340930 - RNA, 23 nt, Human
gguucccuuugacgccaucccag

SEQ ID NO: 2340931 - RNA, 15 nt, Human
gguucccccagcccu

SEQ ID NO: 2340932 - RNA, 14 nt, Human
gguucccccagccc

SEQ ID NO: 2340933 - RNA, 15 nt, Human
gguuccgcuuggagc

SEQ ID NO: 2340934 - RNA, 22 nt, Human
gguuccgcuuggagcagagggg

SEQ ID NO: 2340935 - RNA, 21 nt, Human
gguuccgcuuggagcagaggg

SEQ ID NO: 2340936 - RNA, 22 nt, Human
gguucccuuuuuuggcugcuga

SEQ ID NO: 2340937 - RNA, 13 nt, Human
gguguuuauacag

SEQ ID NO: 2340938 - RNA, 15 nt, Human
gguguuguaugccuu

SEQ ID NO: 2340939 - RNA, 17 nt, Human
gguguuguaugccuuua

SEQ ID NO: 2340940 - RNA, 18 nt, Human
gguguuucuagcacuggc

SEQ ID NO: 2340941 - RNA, 21 nt, Human
gguguuucuagcacuggccug

SEQ ID NO: 2340942 - RNA, 22 nt, Human
gguguuucucccucucacuguc

SEQ ID NO: 2340943 - RNA, 23 nt, Human
gguguuucucccucucacugucu

SEQ ID NO: 2340944 - RNA, 19 nt, Human
gguguuuccuggcacugcu

SEQ ID NO: 2340945 - RNA, 17 nt, Human
gguguuuccuggcacug

SEQ ID NO: 2340946 - RNA, 17 nt, Human
gguucccauuugcuccu

SEQ ID NO: 2340947 - RNA, 13 nt, Human
gguuccaugccug

SEQ ID NO: 2340948 - RNA, 14 nt, Human
gguuccaugccuga

SEQ ID NO: 2340949 - RNA, 15 nt, Human
gguuccaugccugag

SEQ ID NO: 2340950 - RNA, 13 nt, Human
gguucccaagcuc

SEQ ID NO: 2340951 - RNA, 16 nt, Human
gguuccaugccugagg

SEQ ID NO: 2340952 - RNA, 18 nt, Human
gguuccaugccugagggu

SEQ ID NO: 2340953 - RNA, 14 nt, Human
gguuccagccugcc

SEQ ID NO: 2340954 - RNA, 17 nt, Human
gguguuuuaaaaaaucu

SEQ ID NO: 2340955 - RNA, 16 nt, Human
gguuccagccugccac

SEQ ID NO: 2340956 - RNA, 15 nt, Human
gguuccagccugcca

SEQ ID NO: 2340957 - RNA, 16 nt, Human
aaagugguauagaaau

SEQ ID NO: 2340958 - RNA, 21 nt, Human
aaaguggguuauucuggaguu

SEQ ID NO: 2340959 - RNA, 17 nt, Human
aaagugguauagaaaug

SEQ ID NO: 2340960 - RNA, 20 nt, Human
aaagugguauagaaaugcug

SEQ ID NO: 2340961 - RNA, 21 nt, Human
aaaguguauuuuuuuacuaau

SEQ ID NO: 2340962 - RNA, 14 nt, Human
aaaguguauuuuuu

SEQ ID NO: 2340963 - RNA, 21 nt, Human
aaaguauccugcuucugauau

SEQ ID NO: 2340964 - RNA, 12 nt, Human
aaaguaugaauc

SEQ ID NO: 2340965 - RNA, 14 nt, Human
aaaguagauuaaga

SEQ ID NO: 2340966 - RNA, 19 nt, Human
aaaguaugguauugaaacu

SEQ ID NO: 2340967 - RNA, 19 nt, Human
aaaguauguaaaguaugua

SEQ ID NO: 2340968 - RNA, 20 nt, Human
aaaguauguaaaguauguaa

SEQ ID NO: 2340969 - RNA, 17 nt, Human
aaagugggcuugauucu

SEQ ID NO: 2340970 - RNA, 17 nt, Human
aaaguauguuagugcaa

SEQ ID NO: 2340971 - RNA, 14 nt, Human
aaaguaaggugcag

SEQ ID NO: 2340972 - RNA, 18 nt, Human
aaaguacacuguuucaaa

SEQ ID NO: 2340973 - RNA, 19 nt, Human
aaaguacacuguuucaaac

SEQ ID NO: 2340974 - RNA, 22 nt, Human
aaaguagaagucuuagauguau

SEQ ID NO: 2340975 - RNA, 20 nt, Human
aaaguagaagucuuagaugu

SEQ ID NO: 2340976 - RNA, 21 nt, Human
aaaguaucccuacuguaauuu

SEQ ID NO: 2340977 - RNA, 14 nt, Human
gguuugggaccccu

SEQ ID NO: 2340978 - RNA, 15 nt, Human
gguuucgagaagcug

SEQ ID NO: 2340979 - RNA, 22 nt, Human
gguuucuaaagcugccagccga

SEQ ID NO: 2340980 - RNA, 19 nt, Human
gguuuccugcccugggagg

SEQ ID NO: 2340981 - RNA, 16 nt, Human
gguuuccugcccuggg

SEQ ID NO: 2340982 - RNA, 16 nt, Human
gguuucuaaagcugcc

SEQ ID NO: 2340983 - RNA, 15 nt, Human
gguuuccugcccugg

SEQ ID NO: 2340984 - RNA, 13 nt, Human
gguuuccugcccu

SEQ ID NO: 2340985 - RNA, 12 nt, Human
gguuuccugccc

SEQ ID NO: 2340986 - RNA, 12 nt, Human
gguuuccaaagg

SEQ ID NO: 2340987 - RNA, 17 nt, Human
gguuucauacucuagau

SEQ ID NO: 2340988 - RNA, 17 nt, Human
gguuucauauuucuuau

SEQ ID NO: 2340989 - RNA, 15 nt, Human
gguuucagaaaugug

SEQ ID NO: 2340990 - RNA, 15 nt, Human
gguuuuauauuuuua

SEQ ID NO: 2340991 - RNA, 17 nt, Human
gguuuuauaaggcugau

SEQ ID NO: 2340992 - RNA, 21 nt, Human
gguuuuaggucucuuccccuc

SEQ ID NO: 2340993 - RNA, 19 nt, Human
gguuuuauuguuuaaaauc

SEQ ID NO: 2340994 - RNA, 19 nt, Human
aaaguaaguaccacucagg

SEQ ID NO: 2340995 - RNA, 19 nt, Human
aaaguaagcccuugaagau

SEQ ID NO: 2340996 - RNA, 20 nt, Human
gguuuuauuuuguaauuauu

SEQ ID NO: 2340997 - RNA, 16 nt, Human
gguuuuauacugaagg

SEQ ID NO: 2340998 - RNA, 12 nt, Human
gguuuuaaugua

SEQ ID NO: 2340999 - RNA, 16 nt, Human
gguuuuaaagugauua

SEQ ID NO: 2341000 - RNA, 17 nt, Human
gguuuuaaguuguuugc

SEQ ID NO: 2341001 - RNA, 19 nt, Human
gguuuguguuugaguuuua

SEQ ID NO: 2341002 - RNA, 22 nt, Human
gguuuguuuagaagaagugugu

SEQ ID NO: 2341003 - RNA, 19 nt, Human
gguuuggggagcagagaca

SEQ ID NO: 2341004 - RNA, 17 nt, Human
gguuucguuucuguaua

SEQ ID NO: 2341005 - RNA, 15 nt, Human
gguuuggucugggac

SEQ ID NO: 2341006 - RNA, 13 nt, Human
gguuuguauauug

SEQ ID NO: 2341007 - RNA, 20 nt, Human
gguuuguaaauuaacuuuua

SEQ ID NO: 2341008 - RNA, 17 nt, Human
aaagguucacuaaagca

SEQ ID NO: 2341009 - RNA, 18 nt, Human
aaagguguugucccuucu

SEQ ID NO: 2341010 - RNA, 14 nt, Human
aaagguguuguccc

SEQ ID NO: 2341011 - RNA, 16 nt, Human
aaaggugucuuccucc

SEQ ID NO: 2341012 - RNA, 18 nt, Human
aaaggugucuuccuccca

SEQ ID NO: 2341013 - RNA, 18 nt, Human
aaagguucaugcaaacuu

SEQ ID NO: 2341014 - RNA, 19 nt, Human
aaagguggacuggaagggg

SEQ ID NO: 2341015 - RNA, 21 nt, Human
aaaggugccugugaggcaggg

SEQ ID NO: 2341016 - RNA, 14 nt, Human
aaaggugauaucca

SEQ ID NO: 2341017 - RNA, 22 nt, Human
aaaggugguauguguguguaug

SEQ ID NO: 2341018 - RNA, 12 nt, Human
aaaggugucuuc

SEQ ID NO: 2341019 - RNA, 18 nt, Human
aaagguggugaggcaaua

SEQ ID NO: 2341020 - RNA, 21 nt, Human
aaaggugguauguguguguau

SEQ ID NO: 2341021 - RNA, 19 nt, Human
aaaggugguaugugugugu

SEQ ID NO: 2341022 - RNA, 17 nt, Human
aaaggugguaugugugu

SEQ ID NO: 2341023 - RNA, 18 nt, Human
aaaggggucccauagagg

SEQ ID NO: 2341024 - RNA, 15 nt, Human
aaaggugaaggaaua

SEQ ID NO: 2341025 - RNA, 16 nt, Human
aaaggugaaggaauau

SEQ ID NO: 2341026 - RNA, 21 nt, Human
aaaggugaaggaauauauggc

SEQ ID NO: 2341027 - RNA, 23 nt, Human
aaaggggucggcugaccaugcuc

SEQ ID NO: 2341028 - RNA, 24 nt, Human
aaaggggucggcugaccaugcuca

SEQ ID NO: 2341029 - RNA, 23 nt, Human
aaaggugaguuugagcugccuuc

SEQ ID NO: 2341030 - RNA, 21 nt, Human
aaaggugaguuugagcugccu

SEQ ID NO: 2341031 - RNA, 22 nt, Human
aaaggugaguuugagcugccuu

SEQ ID NO: 2341032 - RNA, 22 nt, Human
aaaggugaccuugcaacuucau

SEQ ID NO: 2341033 - RNA, 24 nt, Human
aaaggugaaggaauauauggcaga

SEQ ID NO: 2341034 - RNA, 20 nt, Human
aaaggugaguuugagcugcc

SEQ ID NO: 2341035 - RNA, 16 nt, Human
aaagggggucccagug

SEQ ID NO: 2341036 - RNA, 20 nt, Human
aaagggggucccagugggag

SEQ ID NO: 2341037 - RNA, 21 nt, Human
aaagggggucccagugggagg

SEQ ID NO: 2341038 - RNA, 23 nt, Human
aaagggggucccagugggagggg

SEQ ID NO: 2341039 - RNA, 18 nt, Human
aaaggggcagaaaaacuc

SEQ ID NO: 2341040 - RNA, 16 nt, Human
aaaggggagagccugc

SEQ ID NO: 2341041 - RNA, 19 nt, Human
aaaggggagagccugcugg

SEQ ID NO: 2341042 - RNA, 14 nt, Human
aaaggggagagccu

SEQ ID NO: 2341043 - RNA, 20 nt, Human
aaagggcuguuauaaucuuu

SEQ ID NO: 2341044 - RNA, 22 nt, Human
aaagggcuguuauaaucuuuca

SEQ ID NO: 2341045 - RNA, 20 nt, Human
aaagggcagggcaucuccug

SEQ ID NO: 2341046 - RNA, 16 nt, Human
aaagggcucuuuagcc

SEQ ID NO: 2341047 - RNA, 19 nt, Human
aaagggauuacccaagcaa

SEQ ID NO: 2341048 - RNA, 23 nt, Human
aaagggcccacagugacuuuugc

SEQ ID NO: 2341049 - RNA, 20 nt, Human
aaagggcccagagagggugg

SEQ ID NO: 2341050 - RNA, 16 nt, Human
aaagcuguugauggua

SEQ ID NO: 2341051 - RNA, 15 nt, Human
aaagcuuagcaggag

SEQ ID NO: 2341052 - RNA, 13 nt, Human
aaagcuuauuaaa

SEQ ID NO: 2341053 - RNA, 14 nt, Human
aaagguuuuccucu

SEQ ID NO: 2341054 - RNA, 17 nt, Human
aaagguuuuauuuugua

SEQ ID NO: 2341055 - RNA, 16 nt, Human
aaagguuuuauuuugu

SEQ ID NO: 2341056 - RNA, 12 nt, Human
aaaguaaagcua

SEQ ID NO: 2341057 - RNA, 18 nt, Human
aaagguuuuauuuuguaa

SEQ ID NO: 2341058 - RNA, 21 nt, Human
aaaguaaaaacaaagaaauua

SEQ ID NO: 2341059 - RNA, 18 nt, Human
gguggcuggguuggaggg

SEQ ID NO: 2341060 - RNA, 12 nt, Human
gguggcuggguu

SEQ ID NO: 2341061 - RNA, 21 nt, Human
ggugggaaccaugaagacagg

SEQ ID NO: 2341062 - RNA, 22 nt, Human
ggugggaaaugguaugagcuga

SEQ ID NO: 2341063 - RNA, 13 nt, Human
aaaguaaagcuaa

SEQ ID NO: 2341064 - RNA, 23 nt, Human
aaaguaaagcuaaaaugauuuua

SEQ ID NO: 2341065 - RNA, 20 nt, Human
ggugggaggaucucuugagc

SEQ ID NO: 2341066 - RNA, 17 nt, Human
ggugggacacccuguga

SEQ ID NO: 2341067 - RNA, 13 nt, Human
ggugggacacccu

SEQ ID NO: 2341068 - RNA, 16 nt, Human
ggugggacacccugug

SEQ ID NO: 2341069 - RNA, 13 nt, Human
ggugggcugagcc

SEQ ID NO: 2341070 - RNA, 13 nt, Human
ggugggcucugug

SEQ ID NO: 2341071 - RNA, 16 nt, Human
ggugggcucugugcag

SEQ ID NO: 2341072 - RNA, 16 nt, Human
ggugggagcaggagau

SEQ ID NO: 2341073 - RNA, 20 nt, Human
ggugggcggcacagccuucu

SEQ ID NO: 2341074 - RNA, 20 nt, Human
ggugggcgggcagcacagca

SEQ ID NO: 2341075 - RNA, 21 nt, Human
ggugggcguggucacugcugu

SEQ ID NO: 2341076 - RNA, 16 nt, Human
ggugggagagcccagc

SEQ ID NO: 2341077 - RNA, 15 nt, Human
ggugggagagcccag

SEQ ID NO: 2341078 - RNA, 15 nt, Human
ggugggccuugcugg

SEQ ID NO: 2341079 - RNA, 13 nt, Human
ggugggagcagga

SEQ ID NO: 2341080 - RNA, 17 nt, Human
ggugggcugagcccugg

SEQ ID NO: 2341081 - RNA, 15 nt, Human
ggugggcugagcccu

SEQ ID NO: 2341082 - RNA, 18 nt, Human
ggugggcugagcccuggc

SEQ ID NO: 2341083 - RNA, 19 nt, Human
gguggggaccucaggccug

SEQ ID NO: 2341084 - RNA, 20 nt, Human
aaagcugaucugguuugacu

SEQ ID NO: 2341085 - RNA, 22 nt, Human
aaagcugccagccgagauagcc

SEQ ID NO: 2341086 - RNA, 23 nt, Human
aaagcuguggccagcuuguuauu

SEQ ID NO: 2341087 - RNA, 14 nt, Human
aaagcuguguggca

SEQ ID NO: 2341088 - RNA, 12 nt, Human
aaagcugccagc

SEQ ID NO: 2341089 - RNA, 13 nt, Human
aaagcugccagcc

SEQ ID NO: 2341090 - RNA, 14 nt, Human
aaagcuagaaauga

SEQ ID NO: 2341091 - RNA, 13 nt, Human
aaagcuagaaaug

SEQ ID NO: 2341092 - RNA, 13 nt, Human
aaagcagugcaug

SEQ ID NO: 2341093 - RNA, 14 nt, Human
aaagcuaggccugg

SEQ ID NO: 2341094 - RNA, 16 nt, Human
aaagcuaggccuggcc

SEQ ID NO: 2341095 - RNA, 17 nt, Human
aaagcaguaacugacaa

SEQ ID NO: 2341096 - RNA, 22 nt, Human
aaagcaguagaaauaauaugca

SEQ ID NO: 2341097 - RNA, 17 nt, Human
aaagcagguggcaucuc

SEQ ID NO: 2341098 - RNA, 21 nt, Human
aaagcaggggaguaugcaaaa

SEQ ID NO: 2341099 - RNA, 18 nt, Human
aaagcaggggcuacaaga

SEQ ID NO: 2341100 - RNA, 21 nt, Human
aaagcaggggcuacaagaggg

SEQ ID NO: 2341101 - RNA, 22 nt, Human
aaagcaggggcuacaagaggga

SEQ ID NO: 2341102 - RNA, 13 nt, Human
aaagcagaaaaua

SEQ ID NO: 2341103 - RNA, 13 nt, Human
aaagcagcaucug

SEQ ID NO: 2341104 - RNA, 15 nt, Human
aaagcagccacgagg

SEQ ID NO: 2341105 - RNA, 12 nt, Human
aaagcagccacg

SEQ ID NO: 2341106 - RNA, 18 nt, Human
aaagcagcccuuggccag

SEQ ID NO: 2341107 - RNA, 20 nt, Human
aaagcaggggaguaugcaaa

SEQ ID NO: 2341108 - RNA, 12 nt, Human
gguggacccagg

SEQ ID NO: 2341109 - RNA, 13 nt, Human
gguggacacacaa

SEQ ID NO: 2341110 - RNA, 15 nt, Human
gguggacauggcccc

SEQ ID NO: 2341111 - RNA, 18 nt, Human
gguggacaguccugggag

SEQ ID NO: 2341112 - RNA, 17 nt, Human
gguggacaguccuggga

SEQ ID NO: 2341113 - RNA, 16 nt, Human
gguggacaguccuggg

SEQ ID NO: 2341114 - RNA, 15 nt, Human
gguggacaguccugg

SEQ ID NO: 2341115 - RNA, 14 nt, Human
gguggacaguccug

SEQ ID NO: 2341116 - RNA, 15 nt, Human
ggugcugggaggagg

SEQ ID NO: 2341117 - RNA, 16 nt, Human
ggugcuggauauuuuc

SEQ ID NO: 2341118 - RNA, 16 nt, Human
ggugcuggagguggga

SEQ ID NO: 2341119 - RNA, 21 nt, Human
ggugcuggaggugggagcagg

SEQ ID NO: 2341120 - RNA, 21 nt, Human
ggugcugcuucccucugccug

SEQ ID NO: 2341121 - RNA, 20 nt, Human
ggugcugggacugagccagu

SEQ ID NO: 2341122 - RNA, 24 nt, Human
ggugcugggacugagccaguccca

SEQ ID NO: 2341123 - RNA, 22 nt, Human
ggugcuggaggugggagcagga

SEQ ID NO: 2341124 - RNA, 12 nt, Human
ggugcugggacu

SEQ ID NO: 2341125 - RNA, 14 nt, Human
ggugcugggacuga

SEQ ID NO: 2341126 - RNA, 19 nt, Human
ggugcugggacugagccag

SEQ ID NO: 2341127 - RNA, 14 nt, Human
ggugcugcuucccu

SEQ ID NO: 2341128 - RNA, 23 nt, Human
ggugcugcuacccucccugcugu

SEQ ID NO: 2341129 - RNA, 20 nt, Human
ggugcugcuacccucccugc

SEQ ID NO: 2341130 - RNA, 22 nt, Human
ggugcugcuacccucccugcug

SEQ ID NO: 2341131 - RNA, 13 nt, Human
ggugcugcuaccc

SEQ ID NO: 2341132 - RNA, 16 nt, Human
ggugcugcuacccucc

SEQ ID NO: 2341133 - RNA, 17 nt, Human
ggugcugcuacccuccc

SEQ ID NO: 2341134 - RNA, 19 nt, Human
ggugcugcuacccucccug

SEQ ID NO: 2341135 - RNA, 17 nt, Human
ggugcugccucuaccug

SEQ ID NO: 2341136 - RNA, 19 nt, Human
aaacuuuaugcuaagugaa

SEQ ID NO: 2341137 - RNA, 12 nt, Human
aaacuuuaugcu

SEQ ID NO: 2341138 - RNA, 15 nt, Human
gguggcagcccugua

SEQ ID NO: 2341139 - RNA, 18 nt, Human
gguggcagcccuguaggg

SEQ ID NO: 2341140 - RNA, 11 nt, Human
gguggagaagc

SEQ ID NO: 2341141 - RNA, 12 nt, Human
gguggagaagcc

SEQ ID NO: 2341142 - RNA, 23 nt, Human
gguggcaccagcgaagggagugc

SEQ ID NO: 2341143 - RNA, 15 nt, Human
gguggcacugagccc

SEQ ID NO: 2341144 - RNA, 16 nt, Human
gguggcacugagcccc

SEQ ID NO: 2341145 - RNA, 20 nt, Human
gguggcacugagccccccca

SEQ ID NO: 2341146 - RNA, 13 nt, Human
gguggcacugcca

SEQ ID NO: 2341147 - RNA, 22 nt, Human
aaagcagauaccucacccugcu

SEQ ID NO: 2341148 - RNA, 16 nt, Human
gguggcacuuuuucau

SEQ ID NO: 2341149 - RNA, 21 nt, Human
aaagcacuuggacucuugcuc

SEQ ID NO: 2341150 - RNA, 22 nt, Human
aaagcacuuggacucuugcucu

SEQ ID NO: 2341151 - RNA, 16 nt, Human
aaagcagaacagugau

SEQ ID NO: 2341152 - RNA, 20 nt, Human
gguggcaccagcagccugga

SEQ ID NO: 2341153 - RNA, 14 nt, Human
gguggcaccagcag

SEQ ID NO: 2341154 - RNA, 14 nt, Human
gguggacccaggga

SEQ ID NO: 2341155 - RNA, 15 nt, Human
gguggacucgccugu

SEQ ID NO: 2341156 - RNA, 17 nt, Human
gguggacuuagaaagca

SEQ ID NO: 2341157 - RNA, 18 nt, Human
gguggacuuagaaagcag

SEQ ID NO: 2341158 - RNA, 21 nt, Human
gguggagaaagcacugaccug

SEQ ID NO: 2341159 - RNA, 21 nt, Human
gguggacuuagaaagcagggg

SEQ ID NO: 2341160 - RNA, 16 nt, Human
gguggagaaagcacug

SEQ ID NO: 2341161 - RNA, 19 nt, Human
gguggacuuagaaagcagg

SEQ ID NO: 2341162 - RNA, 20 nt, Human
gguggacuuagaaagcaggg

SEQ ID NO: 2341163 - RNA, 23 nt, Human
gguggacuuagaaagcaggggcu

SEQ ID NO: 2341164 - RNA, 13 nt, Human
aaauauugcuggg

SEQ ID NO: 2341165 - RNA, 22 nt, Human
aaauauucuauuuucauuuucu

SEQ ID NO: 2341166 - RNA, 14 nt, Human
aaauauucuauaug

SEQ ID NO: 2341167 - RNA, 18 nt, Human
aaauauucuauaugaauu

SEQ ID NO: 2341168 - RNA, 20 nt, Human
aaauauucuauaugaauuua

SEQ ID NO: 2341169 - RNA, 18 nt, Human
aaauauucuauuuucauu

SEQ ID NO: 2341170 - RNA, 19 nt, Human
aaauauuaagaaagacuau

SEQ ID NO: 2341171 - RNA, 23 nt, Human
aaauauguuuuuuagaucaaaua

SEQ ID NO: 2341172 - RNA, 20 nt, Human
aaauauuccugcauuuguga

SEQ ID NO: 2341173 - RNA, 13 nt, Human
aaauauucuauau

SEQ ID NO: 2341174 - RNA, 23 nt, Human
aaaucagccugcuccagcuguuc

SEQ ID NO: 2341175 - RNA, 20 nt, Human
aaauauuguguugugaaugu

SEQ ID NO: 2341176 - RNA, 21 nt, Human
aaaucagccugcuccagcugu

SEQ ID NO: 2341177 - RNA, 19 nt, Human
aaaucagccugcuccagcu

SEQ ID NO: 2341178 - RNA, 12 nt, Human
aaauaugcaucu

SEQ ID NO: 2341179 - RNA, 23 nt, Human
aaauaugcagugauauggcagaa

SEQ ID NO: 2341180 - RNA, 18 nt, Human
aaauaugcagugauaugg

SEQ ID NO: 2341181 - RNA, 22 nt, Human
aaauaugcagugauauggcaga

SEQ ID NO: 2341182 - RNA, 13 nt, Human
aaauaugccucuc

SEQ ID NO: 2341183 - RNA, 14 nt, Human
aaauaugccucucc

SEQ ID NO: 2341184 - RNA, 20 nt, Human
aaauaugccucuccuuugua

SEQ ID NO: 2341185 - RNA, 21 nt, Human
aaauaugccucuccuuuguau

SEQ ID NO: 2341186 - RNA, 10 nt, Human
aaauaugcaa

SEQ ID NO: 2341187 - RNA, 20 nt, Human
aaauaugauuuuauuugaca

SEQ ID NO: 2341188 - RNA, 14 nt, Human
aaauaugcagugau

SEQ ID NO: 2341189 - RNA, 21 nt, Human
aaauauggaacuuacauuguu

SEQ ID NO: 2341190 - RNA, 16 nt, Human
aaauauggaacuucua

SEQ ID NO: 2341191 - RNA, 18 nt, Human
aaauauggaacuuacauu

SEQ ID NO: 2341192 - RNA, 17 nt, Human
aaauauggaacuuacau

SEQ ID NO: 2341193 - RNA, 17 nt, Human
aaauauggaacuucuaa

SEQ ID NO: 2341194 - RNA, 18 nt, Human
aaauauggaacuucuaau

SEQ ID NO: 2341195 - RNA, 19 nt, Human
aaauauggaacuucuaaua

SEQ ID NO: 2341196 - RNA, 20 nt, Human
aaauauggaacuucuaauau

SEQ ID NO: 2341197 - RNA, 16 nt, Human
aaauauggaacuuaca

SEQ ID NO: 2341198 - RNA, 13 nt, Human
aaauauggaacuu

SEQ ID NO: 2341199 - RNA, 22 nt, Human
aaauaugccucuccuuuguaua

SEQ ID NO: 2341200 - RNA, 23 nt, Human
aaauaugccucuccuuuguauau

SEQ ID NO: 2341201 - RNA, 16 nt, Human
aaauaugccuuuuuga

SEQ ID NO: 2341202 - RNA, 12 nt, Human
aaauauguacaa

SEQ ID NO: 2341203 - RNA, 20 nt, Human
aaauauggacacuuaauacu

SEQ ID NO: 2341204 - RNA, 19 nt, Human
aaauauggcuauaaauaua

SEQ ID NO: 2341205 - RNA, 16 nt, Human
aaauauggacacuuaa

SEQ ID NO: 2341206 - RNA, 15 nt, Human
aaauauggacacuua

SEQ ID NO: 2341207 - RNA, 19 nt, Human
aaauauguugaugaaaaau

SEQ ID NO: 2341208 - RNA, 16 nt, Human
aaauauguugaugaaa

SEQ ID NO: 2341209 - RNA, 19 nt, Human
aaauauguuuuuuagauca

SEQ ID NO: 2341210 - RNA, 21 nt, Human
aaauauguuuuuuagaucaaa

SEQ ID NO: 2341211 - RNA, 20 nt, Human
aaauauguuagcaaagaguu

SEQ ID NO: 2341212 - RNA, 16 nt, Human
aaauauguccuggggu

SEQ ID NO: 2341213 - RNA, 12 nt, Human
aaauaucuguau

SEQ ID NO: 2341214 - RNA, 13 nt, Human
aaauaucuguauu

SEQ ID NO: 2341215 - RNA, 15 nt, Human
aaauaucuguauuua

SEQ ID NO: 2341216 - RNA, 15 nt, Human
aaauaucuugaaagg

SEQ ID NO: 2341217 - RNA, 19 nt, Human
aaauaugauauugcauaug

SEQ ID NO: 2341218 - RNA, 19 nt, Human
aaauaugauuuuauuugac

SEQ ID NO: 2341219 - RNA, 16 nt, Human
aaauaucuuuugaccu

SEQ ID NO: 2341220 - RNA, 12 nt, Human
aaauaugaagcu

SEQ ID NO: 2341221 - RNA, 12 nt, Human
aaauaugaaugc

SEQ ID NO: 2341222 - RNA, 23 nt, Human
aaauaugagugguuauugaaaau

SEQ ID NO: 2341223 - RNA, 17 nt, Human
aaauaugaagaacugag

SEQ ID NO: 2341224 - RNA, 20 nt, Human
aaauaugaagacauaaaccc

SEQ ID NO: 2341225 - RNA, 22 nt, Human
aaauaucuguauuuaauuuuga

SEQ ID NO: 2341226 - RNA, 17 nt, Human
aaauaucuuuugaccug

SEQ ID NO: 2341227 - RNA, 17 nt, Human
aaauaugcaaagcacug

SEQ ID NO: 2341228 - RNA, 16 nt, Human
aaauaugcaaagcacu

SEQ ID NO: 2341229 - RNA, 15 nt, Human
aaauaugcaaagcac

SEQ ID NO: 2341230 - RNA, 13 nt, Human
aaauaugcaaagc

SEQ ID NO: 2341231 - RNA, 23 nt, Human
aaauaucugaaaauguaugugua

SEQ ID NO: 2341232 - RNA, 22 nt, Human
aaauaucugaaaauguaugugu

SEQ ID NO: 2341233 - RNA, 21 nt, Human
aaauaucugaaaauguaugug

SEQ ID NO: 2341234 - RNA, 19 nt, Human
aaauaucugaaaauguaug

SEQ ID NO: 2341235 - RNA, 18 nt, Human
aaauaucugaaaauguau

SEQ ID NO: 2341236 - RNA, 17 nt, Human
aaauaucugaaaaugua

SEQ ID NO: 2341237 - RNA, 14 nt, Human
aaauaucugaaaau

SEQ ID NO: 2341238 - RNA, 12 nt, Human
aaauaucugaaa

SEQ ID NO: 2341239 - RNA, 18 nt, Human
aaauaccucuuagcugag

SEQ ID NO: 2341240 - RNA, 16 nt, Human
aaauauagcuguacaa

SEQ ID NO: 2341241 - RNA, 17 nt, Human
aaauauagcuguacaaa

SEQ ID NO: 2341242 - RNA, 20 nt, Human
aaauauagcuguacaaauau

SEQ ID NO: 2341243 - RNA, 18 nt, Human
aaauauagaucaguuaua

SEQ ID NO: 2341244 - RNA, 18 nt, Human
aaauaccccaucauucau

SEQ ID NO: 2341245 - RNA, 19 nt, Human
aaauaccccaucauucaug

SEQ ID NO: 2341246 - RNA, 15 nt, Human
aaauauaggaacuua

SEQ ID NO: 2341247 - RNA, 21 nt, Human
aaauauagcuguacaaauaua

SEQ ID NO: 2341248 - RNA, 9 nt, Human
aaauauaua

SEQ ID NO: 2341249 - RNA, 21 nt, Human
aaauauauaaaaagaaaagau

SEQ ID NO: 2341250 - RNA, 12 nt, Human
aaauauauaaau

SEQ ID NO: 2341251 - RNA, 14 nt, Human
aaauauauaaauau

SEQ ID NO: 2341252 - RNA, 15 nt, Human
aaauauauaaauaua

SEQ ID NO: 2341253 - RNA, 16 nt, Human
aaauauauaaauauau

SEQ ID NO: 2341254 - RNA, 10 nt, Human
aaauauauau

SEQ ID NO: 2341255 - RNA, 18 nt, Human
aaauauauaaauauauau

SEQ ID NO: 2341256 - RNA, 17 nt, Human
aaauauauaaauauaua

SEQ ID NO: 2341257 - RNA, 14 nt, Human
aaauauauauaaac

SEQ ID NO: 2341258 - RNA, 16 nt, Human
aaauauauauaaaccu

SEQ ID NO: 2341259 - RNA, 14 nt, Human
aaauauauauaaau

SEQ ID NO: 2341260 - RNA, 21 nt, Human
aaauauauauaaauauauaua

SEQ ID NO: 2341261 - RNA, 17 nt, Human
aaauaccagugugguuu

SEQ ID NO: 2341262 - RNA, 21 nt, Human
aaauaccagugaaccaaagag

SEQ ID NO: 2341263 - RNA, 18 nt, Human
aaauaccagugaaccaaa

SEQ ID NO: 2341264 - RNA, 21 nt, Human
aaauaccaugccauuuaaagc

SEQ ID NO: 2341265 - RNA, 21 nt, Human
aaauaccagccaguaaauggg

SEQ ID NO: 2341266 - RNA, 20 nt, Human
aaauaccagccaguaaaugg

SEQ ID NO: 2341267 - RNA, 16 nt, Human
guacacacacauacac

SEQ ID NO: 2341268 - RNA, 19 nt, Human
aaauaccagccaguaaaug

SEQ ID NO: 2341269 - RNA, 14 nt, Human
guacaaucucaaau

SEQ ID NO: 2341270 - RNA, 18 nt, Human
guacaauauuuaaaauuu

SEQ ID NO: 2341271 - RNA, 14 nt, Human
guacaauauuuaaa

SEQ ID NO: 2341272 - RNA, 20 nt, Human
guacaaugacuuuauugcau

SEQ ID NO: 2341273 - RNA, 21 nt, Human
guacaaugacuuuauugcauc

SEQ ID NO: 2341274 - RNA, 12 nt, Human
aaauauauuuaa

SEQ ID NO: 2341275 - RNA, 20 nt, Human
aaauauauuuaagauaauua

SEQ ID NO: 2341276 - RNA, 21 nt, Human
aaauauauuuaagauaauuau

SEQ ID NO: 2341277 - RNA, 14 nt, Human
aaauauauuuaaug

SEQ ID NO: 2341278 - RNA, 23 nt, Human
aaauauauauguguguguauguu

SEQ ID NO: 2341279 - RNA, 23 nt, Human
aaauauaugauuaacuaauuuua

SEQ ID NO: 2341280 - RNA, 18 nt, Human
aaauauaugcuaagucuu

SEQ ID NO: 2341281 - RNA, 14 nt, Human
aaauauauaucaaa

SEQ ID NO: 2341282 - RNA, 17 nt, Human
aaauauauauaaauaua

SEQ ID NO: 2341283 - RNA, 19 nt, Human
aaauauauauaaauauaua

SEQ ID NO: 2341284 - RNA, 20 nt, Human
aaauauauauaaauauauau

SEQ ID NO: 2341285 - RNA, 12 nt, Human
aaauauauauau

SEQ ID NO: 2341286 - RNA, 19 nt, Human
aaauauauauauauauaaa

SEQ ID NO: 2341287 - RNA, 20 nt, Human
aaauauauauauauauaaaa

SEQ ID NO: 2341288 - RNA, 15 nt, Human
aaauauauauauccu

SEQ ID NO: 2341289 - RNA, 22 nt, Human
aaauauauaucuaaauuuagaa

SEQ ID NO: 2341290 - RNA, 22 nt, Human
aaauauauuuaagauaauuaua

SEQ ID NO: 2341291 - RNA, 15 nt, Human
aaauauauuuaauga

SEQ ID NO: 2341292 - RNA, 16 nt, Human
aaauauauuuuaagac

SEQ ID NO: 2341293 - RNA, 22 nt, Human
aaauauauuuuaagacgaaaca

SEQ ID NO: 2341294 - RNA, 18 nt, Human
aaauaucauuuauuuuuu

SEQ ID NO: 2341295 - RNA, 20 nt, Human
aaauaucaguuacucagccc

SEQ ID NO: 2341296 - RNA, 18 nt, Human
aaauaucaguuacucagc

SEQ ID NO: 2341297 - RNA, 15 nt, Human
aaauaucagacuagu

SEQ ID NO: 2341298 - RNA, 22 nt, Human
aaauaucacuugucaauaaaau

SEQ ID NO: 2341299 - RNA, 16 nt, Human
guaaacgcugucccua

SEQ ID NO: 2341300 - RNA, 19 nt, Human
guaaacagauggcacuuug

SEQ ID NO: 2341301 - RNA, 20 nt, Human
guaaacgcugucccuaguaa

SEQ ID NO: 2341302 - RNA, 13 nt, Human
guaaaccuuuuau

SEQ ID NO: 2341303 - RNA, 17 nt, Human
guaaacaaaauuuaguu

SEQ ID NO: 2341304 - RNA, 23 nt, Human
guaaacaaaauuuaguuuuuguu

SEQ ID NO: 2341305 - RNA, 22 nt, Human
guaaacacgccugcaaacgcug

SEQ ID NO: 2341306 - RNA, 15 nt, Human
guaaaauuguauaga

SEQ ID NO: 2341307 - RNA, 21 nt, Human
guaaaauugccauauugcaca

SEQ ID NO: 2341308 - RNA, 19 nt, Human
guaaaauugccauauugca

SEQ ID NO: 2341309 - RNA, 20 nt, Human
guaaaauugccauauugcac

SEQ ID NO: 2341310 - RNA, 16 nt, Human
guaaaauugaaaggca

SEQ ID NO: 2341311 - RNA, 16 nt, Human
guaaaauguugaauaa

SEQ ID NO: 2341312 - RNA, 15 nt, Human
guaaaauguugaaua

SEQ ID NO: 2341313 - RNA, 14 nt, Human
guaaaauugccaua

SEQ ID NO: 2341314 - RNA, 15 nt, Human
guaaaauugccauau

SEQ ID NO: 2341315 - RNA, 16 nt, Human
guaaaauugccauauu

SEQ ID NO: 2341316 - RNA, 18 nt, Human
guaaaauugccauauugc

SEQ ID NO: 2341317 - RNA, 15 nt, Human
aaauaauucuaaagg

SEQ ID NO: 2341318 - RNA, 13 nt, Human
aaauaauucuaaa

SEQ ID NO: 2341319 - RNA, 14 nt, Human
aaauaauucuaaag

SEQ ID NO: 2341320 - RNA, 22 nt, Human
aaaguguauuuuuuuacuaaua

SEQ ID NO: 2341321 - RNA, 15 nt, Human
aaaguguuucuguua

SEQ ID NO: 2341322 - RNA, 21 nt, Human
aaaguguuuauuuuucauauu

SEQ ID NO: 2341323 - RNA, 13 nt, Human
aaaguguuugccu

SEQ ID NO: 2341324 - RNA, 19 nt, Human
aaaguguuggcuaaugaag

SEQ ID NO: 2341325 - RNA, 17 nt, Human
aaaguguuuauuuuuca

SEQ ID NO: 2341326 - RNA, 18 nt, Human
aaaguguuuauuuuucau

SEQ ID NO: 2341327 - RNA, 20 nt, Human
aaaguguuuauuuuucauau

SEQ ID NO: 2341328 - RNA, 16 nt, Human
aaaguguccauugaca

SEQ ID NO: 2341329 - RNA, 17 nt, Human
aaaguuacaaauugcuu

SEQ ID NO: 2341330 - RNA, 14 nt, Human
aaauaaugugaaac

SEQ ID NO: 2341331 - RNA, 22 nt, Human
aaauaaugugaaacuggauuaa

SEQ ID NO: 2341332 - RNA, 16 nt, Human
aaaguuaaacauugaa

SEQ ID NO: 2341333 - RNA, 22 nt, Human
aaaguuaaacauugaaguaaug

SEQ ID NO: 2341334 - RNA, 16 nt, Human
aaaguuaacagauuuu

SEQ ID NO: 2341335 - RNA, 20 nt, Human
guaaauuuccccaacagugu

SEQ ID NO: 2341336 - RNA, 16 nt, Human
guaaaguauguaaaca

SEQ ID NO: 2341337 - RNA, 21 nt, Human
guaaaguauguaaacaggaga

SEQ ID NO: 2341338 - RNA, 22 nt, Human
guaaaguaucaggauacuauau

SEQ ID NO: 2341339 - RNA, 21 nt, Human
guaaauuuccccaacagugug

SEQ ID NO: 2341340 - RNA, 23 nt, Human
guaaauuuccccaacagugugaa

SEQ ID NO: 2341341 - RNA, 18 nt, Human
guaaauuuuguaugaaaa

SEQ ID NO: 2341342 - RNA, 16 nt, Human
guaaagcuagaaauga

SEQ ID NO: 2341343 - RNA, 20 nt, Human
guaaagcuaaaaugauuuua

SEQ ID NO: 2341344 - RNA, 15 nt, Human
guaaagcuagaaaug

SEQ ID NO: 2341345 - RNA, 21 nt, Human
guaaacuauuuaucuguguuu

SEQ ID NO: 2341346 - RNA, 16 nt, Human
guaaacuauuuaucug

SEQ ID NO: 2341347 - RNA, 15 nt, Human
guaaacucaaaacuu

SEQ ID NO: 2341348 - RNA, 21 nt, Human
guaaacucaaaacuuaacaua

SEQ ID NO: 2341349 - RNA, 15 nt, Human
guaaacuauuuaucu

SEQ ID NO: 2341350 - RNA, 22 nt, Human
guaaacuaucuuggugaauuuu

SEQ ID NO: 2341351 - RNA, 12 nt, Human
guaaacuccugu

SEQ ID NO: 2341352 - RNA, 23 nt, Human
guaaacucaaaauauuuguacau

SEQ ID NO: 2341353 - RNA, 16 nt, Human
guaaacucaaaauauu

SEQ ID NO: 2341354 - RNA, 19 nt, Human
guaacaggaaaauuuuaaa

SEQ ID NO: 2341355 - RNA, 22 nt, Human
guaacagaacagcuucagguua

SEQ ID NO: 2341356 - RNA, 12 nt, Human
guaacagacauu

SEQ ID NO: 2341357 - RNA, 13 nt, Human
guaacagacauug

SEQ ID NO: 2341358 - RNA, 14 nt, Human
guaacagacauugu

SEQ ID NO: 2341359 - RNA, 15 nt, Human
guaacagacauuguu

SEQ ID NO: 2341360 - RNA, 16 nt, Human
guaacagacauuguuu

SEQ ID NO: 2341361 - RNA, 12 nt, Human
guaacagcuccu

SEQ ID NO: 2341362 - RNA, 13 nt, Human
guaacagcuccuu

SEQ ID NO: 2341363 - RNA, 16 nt, Human
guaacaagccacccca

SEQ ID NO: 2341364 - RNA, 18 nt, Human
guaacagaacagcuucag

SEQ ID NO: 2341365 - RNA, 21 nt, Human
guaacagaacagcuucagguu

SEQ ID NO: 2341366 - RNA, 16 nt, Human
guaacagcugaggucu

SEQ ID NO: 2341367 - RNA, 23 nt, Human
guaacagcuccuugggaggaagc

SEQ ID NO: 2341368 - RNA, 22 nt, Human
guaacaguucauguuugcuuca

SEQ ID NO: 2341369 - RNA, 20 nt, Human
guaacaggaaaauuuuaaaa

SEQ ID NO: 2341370 - RNA, 16 nt, Human
guaacagcuccuuggg

SEQ ID NO: 2341371 - RNA, 17 nt, Human
guaacagcuccuuggga

SEQ ID NO: 2341372 - RNA, 18 nt, Human
guaacagcuccuugggag

SEQ ID NO: 2341373 - RNA, 21 nt, Human
guaacagcuccuugggaggaa

SEQ ID NO: 2341374 - RNA, 12 nt, Human
guaacauguuua

SEQ ID NO: 2341375 - RNA, 18 nt, Human
guaacauuggguccuggg

SEQ ID NO: 2341376 - RNA, 23 nt, Human
guaacauuggguccugggucuuu

SEQ ID NO: 2341377 - RNA, 11 nt, Human
guaaccagcca

SEQ ID NO: 2341378 - RNA, 23 nt, Human
guaacauguguuaaguauuuuca

SEQ ID NO: 2341379 - RNA, 22 nt, Human
guaacauguuuacuuuucaggg

SEQ ID NO: 2341380 - RNA, 15 nt, Human
guaacaucagggacc

SEQ ID NO: 2341381 - RNA, 11 nt, Human
guaacauccuu

SEQ ID NO: 2341382 - RNA, 13 nt, Human
guaacauccuuuc

SEQ ID NO: 2341383 - RNA, 17 nt, Human
guaacauccuuucuauu

SEQ ID NO: 2341384 - RNA, 18 nt, Human
guaaccucagcucuggga

SEQ ID NO: 2341385 - RNA, 16 nt, Human
guaacgcgucuuccug

SEQ ID NO: 2341386 - RNA, 15 nt, Human
guaacguugcugugg

SEQ ID NO: 2341387 - RNA, 17 nt, Human
guaacgcgucuuccuga

SEQ ID NO: 2341388 - RNA, 14 nt, Human
guaacccugguggu

SEQ ID NO: 2341389 - RNA, 23 nt, Human
guaacccagauuuugcuguauau

SEQ ID NO: 2341390 - RNA, 17 nt, Human
guaacccaacucuccug

SEQ ID NO: 2341391 - RNA, 18 nt, Human
guaacccaacucuccugg

SEQ ID NO: 2341392 - RNA, 12 nt, Human
guaaccagccag

SEQ ID NO: 2341393 - RNA, 13 nt, Human
guaaccagccaga

SEQ ID NO: 2341394 - RNA, 20 nt, Human
guaaccagccagauccucuu

SEQ ID NO: 2341395 - RNA, 21 nt, Human
guaacccuggugguugcuguu

SEQ ID NO: 2341396 - RNA, 12 nt, Human
guaaccucagcu

SEQ ID NO: 2341397 - RNA, 15 nt, Human
guaaccucagcucug

SEQ ID NO: 2341398 - RNA, 17 nt, Human
guaaccucagcucuggg

SEQ ID NO: 2341399 - RNA, 20 nt, Human
guaaccucuucagaggcccu

SEQ ID NO: 2341400 - RNA, 18 nt, Human
guaaccucuucagaggcc

SEQ ID NO: 2341401 - RNA, 23 nt, Human
guaaguugaauggccugccuuga

SEQ ID NO: 2341402 - RNA, 14 nt, Human
guaaguuccuacua

SEQ ID NO: 2341403 - RNA, 21 nt, Human
guaaguuccuacuaggcaaaa

SEQ ID NO: 2341404 - RNA, 21 nt, Human
guaaguuuaaaggauguuggu

SEQ ID NO: 2341405 - RNA, 16 nt, Human
guaaguuucaggugac

SEQ ID NO: 2341406 - RNA, 22 nt, Human
guaaguuucaggugacauguga

SEQ ID NO: 2341407 - RNA, 19 nt, Human
guaaguuuaugucuaaaga

SEQ ID NO: 2341408 - RNA, 13 nt, Human
guaaguuucaggu

SEQ ID NO: 2341409 - RNA, 14 nt, Human
guaaguuucaggug

SEQ ID NO: 2341410 - RNA, 20 nt, Human
guaagugugaguaagagcug

SEQ ID NO: 2341411 - RNA, 17 nt, Human
guaacuaggcucagaga

SEQ ID NO: 2341412 - RNA, 21 nt, Human
guaagugugaguaagagcugg

SEQ ID NO: 2341413 - RNA, 17 nt, Human
guaacguugcuguggga

SEQ ID NO: 2341414 - RNA, 17 nt, Human
guaauaaugugaaucau

SEQ ID NO: 2341415 - RNA, 16 nt, Human
guaauaaugugaauca

SEQ ID NO: 2341416 - RNA, 19 nt, Human
guaauaaugcuaaagaaaa

SEQ ID NO: 2341417 - RNA, 16 nt, Human
guaauaaacuguguuu

SEQ ID NO: 2341418 - RNA, 18 nt, Human
guaauauuuauauauuua

SEQ ID NO: 2341419 - RNA, 18 nt, Human
guaaucaauaaacgauuu

SEQ ID NO: 2341420 - RNA, 20 nt, Human
guaaucaauaaacgauuuaa

SEQ ID NO: 2341421 - RNA, 13 nt, Human
guaaucaauaaac

SEQ ID NO: 2341422 - RNA, 17 nt, Human
guaaucaauaaacgauu

SEQ ID NO: 2341423 - RNA, 19 nt, Human
guaauagagcaaaauugau

SEQ ID NO: 2341424 - RNA, 15 nt, Human
guaauagaaaacuga

SEQ ID NO: 2341425 - RNA, 15 nt, Human
guaauagagcaaaau

SEQ ID NO: 2341426 - RNA, 16 nt, Human
guaauauugacuugua

SEQ ID NO: 2341427 - RNA, 19 nt, Human
guaauagaaaacugaaaau

SEQ ID NO: 2341428 - RNA, 19 nt, Human
guaauauugacuuguauau

SEQ ID NO: 2341429 - RNA, 20 nt, Human
guaauauugacuuguauauu

SEQ ID NO: 2341430 - RNA, 20 nt, Human
guacaaaauccagcuaugaa

SEQ ID NO: 2341431 - RNA, 16 nt, Human
guacaaaauaaacaaa

SEQ ID NO: 2341432 - RNA, 14 nt, Human
guacaaaauaaaca

SEQ ID NO: 2341433 - RNA, 12 nt, Human
guacaaaauaaa

SEQ ID NO: 2341434 - RNA, 20 nt, Human
guacaaaaaaaaaguuuuau

SEQ ID NO: 2341435 - RNA, 16 nt, Human
guaauuuuuuucuuau

SEQ ID NO: 2341436 - RNA, 19 nt, Human
guacaaaaaaaaaguuuua

SEQ ID NO: 2341437 - RNA, 21 nt, Human
guaauuuuuuuaucgucacug

SEQ ID NO: 2341438 - RNA, 20 nt, Human
guacaaauaaagucccaggu

SEQ ID NO: 2341439 - RNA, 13 nt, Human
guacaaauauaag

SEQ ID NO: 2341440 - RNA, 17 nt, Human
guacaaauauaagaaua

SEQ ID NO: 2341441 - RNA, 20 nt, Human
guacaaauauaagaauaaaa

SEQ ID NO: 2341442 - RNA, 23 nt, Human
guacaaauauaagaauaaaaugu

SEQ ID NO: 2341443 - RNA, 22 nt, Human
guacaaccuguucugcuuuccu

SEQ ID NO: 2341444 - RNA, 22 nt, Human
guacaaauauaagaauaaaaug

SEQ ID NO: 2341445 - RNA, 13 nt, Human
guacaauauuuaa

SEQ ID NO: 2341446 - RNA, 12 nt, Human
guacaauauuua

SEQ ID NO: 2341447 - RNA, 22 nt, Human
guacaauaaguguuuuuguauu

SEQ ID NO: 2341448 - RNA, 17 nt, Human
guacaaggcgaucccau

SEQ ID NO: 2341449 - RNA, 23 nt, Human
guaauccuagcacuuugggaggc

SEQ ID NO: 2341450 - RNA, 15 nt, Human
guaaucgaccugccu

SEQ ID NO: 2341451 - RNA, 22 nt, Human
guaauccucaagaaauaaaagg

SEQ ID NO: 2341452 - RNA, 20 nt, Human
guaaucauuucuugggcccu

SEQ ID NO: 2341453 - RNA, 20 nt, Human
guaaucccagcuacuuggga

SEQ ID NO: 2341454 - RNA, 18 nt, Human
guaaucccgccaccuauc

SEQ ID NO: 2341455 - RNA, 16 nt, Human
guaaucccagcuacuu

SEQ ID NO: 2341456 - RNA, 14 nt, Human
guaaucaauguuuc

SEQ ID NO: 2341457 - RNA, 20 nt, Human
guaauuugugauacaaugcu

SEQ ID NO: 2341458 - RNA, 17 nt, Human
guaauuugugauacaau

SEQ ID NO: 2341459 - RNA, 17 nt, Human
guaaucgaccugccucg

SEQ ID NO: 2341460 - RNA, 13 nt, Human
guaauuuguaucu

SEQ ID NO: 2341461 - RNA, 14 nt, Human
guaauuuguaucug

SEQ ID NO: 2341462 - RNA, 15 nt, Human
guaauuuguaucuga

SEQ ID NO: 2341463 - RNA, 21 nt, Human
guaauuuguaucugaaggaga

SEQ ID NO: 2341464 - RNA, 15 nt, Human
guaauuugugauaca

SEQ ID NO: 2341465 - RNA, 22 nt, Human
aaacauuuucacacaauacaau

SEQ ID NO: 2341466 - RNA, 16 nt, Human
aaacauuuucacacaa

SEQ ID NO: 2341467 - RNA, 14 nt, Human
aaacauuuucacac

SEQ ID NO: 2341468 - RNA, 13 nt, Human
aaacauuuucaca

SEQ ID NO: 2341469 - RNA, 19 nt, Human
aaacauuuugucauauaag

SEQ ID NO: 2341470 - RNA, 18 nt, Human
ggguccuucccucucccc

SEQ ID NO: 2341471 - RNA, 16 nt, Human
ggguccuucccucucc

SEQ ID NO: 2341472 - RNA, 20 nt, Human
ggguccuguggcaggcagcg

SEQ ID NO: 2341473 - RNA, 23 nt, Human
ggguccuguggcaggcagcgcca

SEQ ID NO: 2341474 - RNA, 18 nt, Human
ggguccuggcuccugagg

SEQ ID NO: 2341475 - RNA, 18 nt, Human
ggguccuguggcaggcag

SEQ ID NO: 2341476 - RNA, 19 nt, Human
ggguccuguggcaggcagc

SEQ ID NO: 2341477 - RNA, 23 nt, Human
ggguccuucccucuccccaagac

SEQ ID NO: 2341478 - RNA, 15 nt, Human
aaacauuuuaaaugg

SEQ ID NO: 2341479 - RNA, 20 nt, Human
aaacauuuuaaauggacaga

SEQ ID NO: 2341480 - RNA, 21 nt, Human
gggucaugcccuccucuccca

SEQ ID NO: 2341481 - RNA, 12 nt, Human
ggguccaaauaa

SEQ ID NO: 2341482 - RNA, 13 nt, Human
ggguccaaauaaa

SEQ ID NO: 2341483 - RNA, 20 nt, Human
ggguccacccagcaaagagu

SEQ ID NO: 2341484 - RNA, 13 nt, Human
ggguccuggcucc

SEQ ID NO: 2341485 - RNA, 17 nt, Human
ggguccuggccauccca

SEQ ID NO: 2341486 - RNA, 16 nt, Human
ggguccuggccauccc

SEQ ID NO: 2341487 - RNA, 15 nt, Human
ggguccuggccaucc

SEQ ID NO: 2341488 - RNA, 13 nt, Human
ggguccuggccau

SEQ ID NO: 2341489 - RNA, 16 nt, Human
gggucaugcccuccuc

SEQ ID NO: 2341490 - RNA, 14 nt, Human
gggucaugcccucc

SEQ ID NO: 2341491 - RNA, 18 nt, Human
gggucauucauggccugg

SEQ ID NO: 2341492 - RNA, 21 nt, Human
gggucagucuggugggaggac

SEQ ID NO: 2341493 - RNA, 21 nt, Human
gggucaucuguaccucugccu

SEQ ID NO: 2341494 - RNA, 12 nt, Human
gggucaaggaau

SEQ ID NO: 2341495 - RNA, 22 nt, Human
gggucacucuggcagcucagag

SEQ ID NO: 2341496 - RNA, 18 nt, Human
gggucagggaccaaggac

SEQ ID NO: 2341497 - RNA, 12 nt, Human
gggucaggcucc

SEQ ID NO: 2341498 - RNA, 19 nt, Human
gggguccuguggcaggcag

SEQ ID NO: 2341499 - RNA, 14 nt, Human
gggguccuggccau

SEQ ID NO: 2341500 - RNA, 15 nt, Human
gggguccuguggcag

SEQ ID NO: 2341501 - RNA, 13 nt, Human
gggguccuggcca

SEQ ID NO: 2341502 - RNA, 11 nt, Human
gggguccuggc

SEQ ID NO: 2341503 - RNA, 23 nt, Human
gggguccccaucaucccagcugc

SEQ ID NO: 2341504 - RNA, 13 nt, Human
ggggucccagugg

SEQ ID NO: 2341505 - RNA, 19 nt, Human
gggguccuggagcagacca

SEQ ID NO: 2341506 - RNA, 14 nt, Human
gggucacucuggca

SEQ ID NO: 2341507 - RNA, 20 nt, Human
gggucacucuggcagcucag

SEQ ID NO: 2341508 - RNA, 14 nt, Human
aaaccuugccuuuc

SEQ ID NO: 2341509 - RNA, 20 nt, Human
aaaccuuauuuuuucccaaa

SEQ ID NO: 2341510 - RNA, 14 nt, Human
aaaccuugguguag

SEQ ID NO: 2341511 - RNA, 22 nt, Human
aaaccuugguguaguugaacug

SEQ ID NO: 2341512 - RNA, 16 nt, Human
aaaccuuuagggcagc

SEQ ID NO: 2341513 - RNA, 17 nt, Human
aaaccuuuagggcagcu

SEQ ID NO: 2341514 - RNA, 19 nt, Human
aaaccuuuuuuaagauuuu

SEQ ID NO: 2341515 - RNA, 20 nt, Human
aaaccuuuuuuaagauuuuu

SEQ ID NO: 2341516 - RNA, 21 nt, Human
aaaccuuuuuuaagauuuuuc

SEQ ID NO: 2341517 - RNA, 22 nt, Human
aaaccuuuuuuaagauuuuucu

SEQ ID NO: 2341518 - RNA, 23 nt, Human
aaaccuuuuuuaagauuuuucuc

SEQ ID NO: 2341519 - RNA, 19 nt, Human
aaacgagucaauccccuca

SEQ ID NO: 2341520 - RNA, 15 nt, Human
aaacgauuuaauucu

SEQ ID NO: 2341521 - RNA, 16 nt, Human
aaacgauuuaauucuc

SEQ ID NO: 2341522 - RNA, 17 nt, Human
aaacgauuuaauucucu

SEQ ID NO: 2341523 - RNA, 19 nt, Human
aaacgcaaagggcugaaag

SEQ ID NO: 2341524 - RNA, 18 nt, Human
aaacgauuuaauucucuu

SEQ ID NO: 2341525 - RNA, 19 nt, Human
aaacgauuuaauucucuug

SEQ ID NO: 2341526 - RNA, 16 nt, Human
aaaccuuauuguaccu

SEQ ID NO: 2341527 - RNA, 17 nt, Human
aaaccuuauuguaccuc

SEQ ID NO: 2341528 - RNA, 21 nt, Human
aaaccuguuuaaauauuucaa

SEQ ID NO: 2341529 - RNA, 18 nt, Human
aaaccuuauuguaccucu

SEQ ID NO: 2341530 - RNA, 19 nt, Human
aaaccuuauuuuuucccaa

SEQ ID NO: 2341531 - RNA, 17 nt, Human
aaaccuucacuuaggaa

SEQ ID NO: 2341532 - RNA, 18 nt, Human
aaaccugucaaugauaca

SEQ ID NO: 2341533 - RNA, 16 nt, Human
aaaccuguuuaaauau

SEQ ID NO: 2341534 - RNA, 19 nt, Human
aaaccuguuuaaauauuuc

SEQ ID NO: 2341535 - RNA, 22 nt, Human
aaaccugugucucugagaguag

SEQ ID NO: 2341536 - RNA, 19 nt, Human
aaaccugauguuaaaauuc

SEQ ID NO: 2341537 - RNA, 14 nt, Human
aaaccugauguuaa

SEQ ID NO: 2341538 - RNA, 12 nt, Human
aaaccugccugg

SEQ ID NO: 2341539 - RNA, 16 nt, Human
aaaccugccuggguuu

SEQ ID NO: 2341540 - RNA, 12 nt, Human
aaaccugcccug

SEQ ID NO: 2341541 - RNA, 14 nt, Human
aaaccugcccugcc

SEQ ID NO: 2341542 - RNA, 16 nt, Human
aaaccugcccugccug

SEQ ID NO: 2341543 - RNA, 17 nt, Human
aaaccugcccugccuga

SEQ ID NO: 2341544 - RNA, 15 nt, Human
aaaccuggaugucac

SEQ ID NO: 2341545 - RNA, 18 nt, Human
aaaccugggauucaggaa

SEQ ID NO: 2341546 - RNA, 21 nt, Human
aaaccugggauucaggaaugu

SEQ ID NO: 2341547 - RNA, 21 nt, Human
aaacauuuuguggucauuaag

SEQ ID NO: 2341548 - RNA, 18 nt, Human
aaaccaccagaagcccag

SEQ ID NO: 2341549 - RNA, 15 nt, Human
aaaccaccagaagcc

SEQ ID NO: 2341550 - RNA, 12 nt, Human
aaaccagaagca

SEQ ID NO: 2341551 - RNA, 16 nt, Human
aaaccacuagaacucu

SEQ ID NO: 2341552 - RNA, 23 nt, Human
aaaccaccagugcccaaagucug

SEQ ID NO: 2341553 - RNA, 19 nt, Human
aaaccaccagaagcccaga

SEQ ID NO: 2341554 - RNA, 17 nt, Human
ggggcccaugaaagagg

SEQ ID NO: 2341555 - RNA, 22 nt, Human
ggggcccaaggcggccccuccc

SEQ ID NO: 2341556 - RNA, 14 nt, Human
ggggccccagggcu

SEQ ID NO: 2341557 - RNA, 16 nt, Human
ggggccccagucagcc

SEQ ID NO: 2341558 - RNA, 18 nt, Human
ggggccccagucagccuc

SEQ ID NO: 2341559 - RNA, 16 nt, Human
ggggccaugaggccuc

SEQ ID NO: 2341560 - RNA, 19 nt, Human
ggggcccaaggcggccccu

SEQ ID NO: 2341561 - RNA, 23 nt, Human
ggggcccgccuggcagaacugag

SEQ ID NO: 2341562 - RNA, 21 nt, Human
ggggcccgccuggcagaacug

SEQ ID NO: 2341563 - RNA, 15 nt, Human
ggggcccgcuugccu

SEQ ID NO: 2341564 - RNA, 16 nt, Human
ggggcccgccuggcag

SEQ ID NO: 2341565 - RNA, 22 nt, Human
ggggccccuuuuuacuccccuu

SEQ ID NO: 2341566 - RNA, 21 nt, Human
ggggccccuuuuuacuccccu

SEQ ID NO: 2341567 - RNA, 10 nt, Human
ggggccccuu

SEQ ID NO: 2341568 - RNA, 19 nt, Human
ggggccccagucagccucu

SEQ ID NO: 2341569 - RNA, 21 nt, Human
ggggccaugagcuccagaccc

SEQ ID NO: 2341570 - RNA, 20 nt, Human
ggggccaugagcuccagacc

SEQ ID NO: 2341571 - RNA, 16 nt, Human
ggggacagggcuggcc

SEQ ID NO: 2341572 - RNA, 19 nt, Human
ggggacagggcuggcccag

SEQ ID NO: 2341573 - RNA, 22 nt, Human
ggggacagggcuggcccagccc

SEQ ID NO: 2341574 - RNA, 24 nt, Human
ggggacagggcuggcccagcccug

SEQ ID NO: 2341575 - RNA, 14 nt, Human
ggggccaugaggcc

SEQ ID NO: 2341576 - RNA, 22 nt, Human
ggggccaugagcuccagacccc

SEQ ID NO: 2341577 - RNA, 14 nt, Human
ggggaccagagcug

SEQ ID NO: 2341578 - RNA, 12 nt, Human
aaaaugucugua

SEQ ID NO: 2341579 - RNA, 22 nt, Human
aaaaugucaaagagaaaacuua

SEQ ID NO: 2341580 - RNA, 12 nt, Human
ggggaccagagc

SEQ ID NO: 2341581 - RNA, 13 nt, Human
ggggaccagagcu

SEQ ID NO: 2341582 - RNA, 19 nt, Human
aaaauguaaaggagucaaa

SEQ ID NO: 2341583 - RNA, 11 nt, Human
aaaauguaaau

SEQ ID NO: 2341584 - RNA, 20 nt, Human
aaaauguaaauauucuauau

SEQ ID NO: 2341585 - RNA, 18 nt, Human
aaaauguauguguaagua

SEQ ID NO: 2341586 - RNA, 17 nt, Human
gggguccagggagcagg

SEQ ID NO: 2341587 - RNA, 21 nt, Human
ggggucaugcccuccucuccc

SEQ ID NO: 2341588 - RNA, 18 nt, Human
gggguccacccagcaaag

SEQ ID NO: 2341589 - RNA, 19 nt, Human
ggggucaugcccuccucuc

SEQ ID NO: 2341590 - RNA, 18 nt, Human
ggggucaugcccuccucu

SEQ ID NO: 2341591 - RNA, 22 nt, Human
ggggucacucaauucugcagua

SEQ ID NO: 2341592 - RNA, 18 nt, Human
gggguauuuuaggcaggg

SEQ ID NO: 2341593 - RNA, 22 nt, Human
ggggucagggaccaaggacccc

SEQ ID NO: 2341594 - RNA, 15 nt, Human
ggggucaggcuccau

SEQ ID NO: 2341595 - RNA, 19 nt, Human
gggguagcuagaggaacca

SEQ ID NO: 2341596 - RNA, 18 nt, Human
gggguagcuagaggaacc

SEQ ID NO: 2341597 - RNA, 24 nt, Human
ggggguuuuuacuccaguggugaa

SEQ ID NO: 2341598 - RNA, 15 nt, Human
gggguagcagcugga

SEQ ID NO: 2341599 - RNA, 17 nt, Human
gggguaggcagagccuu

SEQ ID NO: 2341600 - RNA, 22 nt, Human
gggguauuuaccacagcagcug

SEQ ID NO: 2341601 - RNA, 21 nt, Human
ggggucacucuggcagcucag

SEQ ID NO: 2341602 - RNA, 13 nt, Human
gggggcuggugcc

SEQ ID NO: 2341603 - RNA, 14 nt, Human
gggggcuggugcca

SEQ ID NO: 2341604 - RNA, 19 nt, Human
gggggcuggugccagccuu

SEQ ID NO: 2341605 - RNA, 21 nt, Human
gggggcuggugccagccuucc

SEQ ID NO: 2341606 - RNA, 22 nt, Human
gggggcuucauacacaugagau

SEQ ID NO: 2341607 - RNA, 23 nt, Human
ggggguggccgcugaguggcagg

SEQ ID NO: 2341608 - RNA, 15 nt, Human
gggggcugggcagag

SEQ ID NO: 2341609 - RNA, 22 nt, Human
gggguaaaauuccuuagcuuag

SEQ ID NO: 2341610 - RNA, 18 nt, Human
ggggguugcggggggagg

SEQ ID NO: 2341611 - RNA, 18 nt, Human
ggggguuuuuacuccagu

SEQ ID NO: 2341612 - RNA, 13 nt, Human
ggggguggccucc

SEQ ID NO: 2341613 - RNA, 17 nt, Human
gggggccaccuccccag

SEQ ID NO: 2341614 - RNA, 15 nt, Human
gggggccaacaccag

SEQ ID NO: 2341615 - RNA, 14 nt, Human
gggggcagggcaug

SEQ ID NO: 2341616 - RNA, 20 nt, Human
gggggcugccuggcccccag

SEQ ID NO: 2341617 - RNA, 12 nt, Human
gggggcuggccu

SEQ ID NO: 2341618 - RNA, 13 nt, Human
gggggcuggccua

SEQ ID NO: 2341619 - RNA, 11 nt, Human
gggggcuggga

SEQ ID NO: 2341620 - RNA, 13 nt, Human
gggggcagagggc

SEQ ID NO: 2341621 - RNA, 12 nt, Human
gggggcagaggg

SEQ ID NO: 2341622 - RNA, 11 nt, Human
gggggcagagg

SEQ ID NO: 2341623 - RNA, 23 nt, Human
gggggcaagaagaucacgcuccc

SEQ ID NO: 2341624 - RNA, 23 nt, Human
gggggcacaugcugagucuccca

SEQ ID NO: 2341625 - RNA, 15 nt, Human
ggggcccugccuccu

SEQ ID NO: 2341626 - RNA, 21 nt, Human
ggggcccguugucucccuggc

SEQ ID NO: 2341627 - RNA, 22 nt, Human
ggggcccguugucucccuggcc

SEQ ID NO: 2341628 - RNA, 23 nt, Human
ggggcccguugucucccuggccc

SEQ ID NO: 2341629 - RNA, 17 nt, Human
gggggaucacagccucu

SEQ ID NO: 2341630 - RNA, 15 nt, Human
ggggcccggccagcc

SEQ ID NO: 2341631 - RNA, 23 nt, Human
ggggcccgcuugccucggcuccu

SEQ ID NO: 2341632 - RNA, 19 nt, Human
ggggcccguugucucccug

SEQ ID NO: 2341633 - RNA, 20 nt, Human
ggggcccguugucucccugg

SEQ ID NO: 2341634 - RNA, 13 nt, Human
ggggcccggccag

SEQ ID NO: 2341635 - RNA, 20 nt, Human
ggggcccgcuugccucggcu

SEQ ID NO: 2341636 - RNA, 21 nt, Human
ggggcccgcuugccucggcuc

SEQ ID NO: 2341637 - RNA, 21 nt, Human
aaacgauuuaauucucuugaa

SEQ ID NO: 2341638 - RNA, 22 nt, Human
aaacgcuaaagagcccuugccu

SEQ ID NO: 2341639 - RNA, 20 nt, Human
aaacgcauggaguguguauu

SEQ ID NO: 2341640 - RNA, 21 nt, Human
aaacguggcugcuucaaggau

SEQ ID NO: 2341641 - RNA, 21 nt, Human
aaacguuuuauuguguuuuua

SEQ ID NO: 2341642 - RNA, 17 nt, Human
aaacguguugccuugaa

SEQ ID NO: 2341643 - RNA, 16 nt, Human
aaacguuuuauugugu

SEQ ID NO: 2341644 - RNA, 20 nt, Human
aaacguggcuuuuagacaga

SEQ ID NO: 2341645 - RNA, 21 nt, Human
aaacuguucccaccugcugga

SEQ ID NO: 2341646 - RNA, 16 nt, Human
aaacuguugccagaga

SEQ ID NO: 2341647 - RNA, 17 nt, Human
aaacuuaacauauuuac

SEQ ID NO: 2341648 - RNA, 22 nt, Human
aaacuguugccagagauggagg

SEQ ID NO: 2341649 - RNA, 20 nt, Human
aaacuguucccaccugcugg

SEQ ID NO: 2341650 - RNA, 19 nt, Human
aaacuguuaauaguucagg

SEQ ID NO: 2341651 - RNA, 16 nt, Human
aaacuaaauagcaugu

SEQ ID NO: 2341652 - RNA, 17 nt, Human
aaacuaaauagcaugua

SEQ ID NO: 2341653 - RNA, 23 nt, Human
aaacuaaauagcauguauugugu

SEQ ID NO: 2341654 - RNA, 13 nt, Human
aaacuaaaucucu

SEQ ID NO: 2341655 - RNA, 17 nt, Human
aaacuaaaucucuaaua

SEQ ID NO: 2341656 - RNA, 18 nt, Human
aaacuaaaucucuaauau

SEQ ID NO: 2341657 - RNA, 23 nt, Human
aaacuuauuuuuuucugauugua

SEQ ID NO: 2341658 - RNA, 11 nt, Human
ggguggccucg

SEQ ID NO: 2341659 - RNA, 18 nt, Human
ggguggcuagucagagag

SEQ ID NO: 2341660 - RNA, 16 nt, Human
ggguggcuagucagag

SEQ ID NO: 2341661 - RNA, 15 nt, Human
gggugggacacccug

SEQ ID NO: 2341662 - RNA, 18 nt, Human
gggugggacacccuguga

SEQ ID NO: 2341663 - RNA, 21 nt, Human
aaacuuagugcggacaaguuu

SEQ ID NO: 2341664 - RNA, 10 nt, Human
aaacuuauuu

SEQ ID NO: 2341665 - RNA, 12 nt, Human
aaacuuauuuga

SEQ ID NO: 2341666 - RNA, 14 nt, Human
aaacuuauuugagu

SEQ ID NO: 2341667 - RNA, 13 nt, Human
aaacuuauuuuuu

SEQ ID NO: 2341668 - RNA, 19 nt, Human
aaacuuauuuuuuucugau

SEQ ID NO: 2341669 - RNA, 20 nt, Human
aaacuuauuuuuuucugauu

SEQ ID NO: 2341670 - RNA, 22 nt, Human
aaacuuauuuuuuucugauugu

SEQ ID NO: 2341671 - RNA, 14 nt, Human
aaacuuacacacaa

SEQ ID NO: 2341672 - RNA, 22 nt, Human
aaacuuagaauaaaauuguaaa

SEQ ID NO: 2341673 - RNA, 17 nt, Human
aaacuuagaauaaaauu

SEQ ID NO: 2341674 - RNA, 18 nt, Human
aaacuuagaauaaaauug

SEQ ID NO: 2341675 - RNA, 19 nt, Human
aaacuuaaucuaaauggaa

SEQ ID NO: 2341676 - RNA, 23 nt, Human
ggguguauuuauuuuccucccca

SEQ ID NO: 2341677 - RNA, 19 nt, Human
ggguguaacaggucuccuc

SEQ ID NO: 2341678 - RNA, 18 nt, Human
ggguguaacaggucuccu

SEQ ID NO: 2341679 - RNA, 19 nt, Human
gggugguggggaggggcgc

SEQ ID NO: 2341680 - RNA, 15 nt, Human
gggugguggugauag

SEQ ID NO: 2341681 - RNA, 12 nt, Human
ggguggugggga

SEQ ID NO: 2341682 - RNA, 18 nt, Human
ggguggugcugggacuga

SEQ ID NO: 2341683 - RNA, 13 nt, Human
gggugguggggag

SEQ ID NO: 2341684 - RNA, 12 nt, Human
ggguggugcugg

SEQ ID NO: 2341685 - RNA, 14 nt, Human
ggguggugcuggga

SEQ ID NO: 2341686 - RNA, 23 nt, Human
ggguuuugccauguuggccaggc

SEQ ID NO: 2341687 - RNA, 12 nt, Human
ggguuuucuuaa

SEQ ID NO: 2341688 - RNA, 18 nt, Human
ggguuuuguauucucuga

SEQ ID NO: 2341689 - RNA, 17 nt, Human
ggguuuuccacccugga

SEQ ID NO: 2341690 - RNA, 16 nt, Human
ggguuuuccacccugg

SEQ ID NO: 2341691 - RNA, 20 nt, Human
ggguuuugccauguuggcca

SEQ ID NO: 2341692 - RNA, 18 nt, Human
gguaaauuuccccaacag

SEQ ID NO: 2341693 - RNA, 20 nt, Human
gguaaauaccaaguauuuau

SEQ ID NO: 2341694 - RNA, 15 nt, Human
gguaaauuaagacau

SEQ ID NO: 2341695 - RNA, 13 nt, Human
gguaaaugaugug

SEQ ID NO: 2341696 - RNA, 22 nt, Human
gguaaaucagacuaugaaguuu

SEQ ID NO: 2341697 - RNA, 13 nt, Human
gguaaauuucugu

SEQ ID NO: 2341698 - RNA, 20 nt, Human
gguaaauuuccccaacagug

SEQ ID NO: 2341699 - RNA, 22 nt, Human
gguaaauuuccccaacagugug

SEQ ID NO: 2341700 - RNA, 14 nt, Human
gguaacagaacagc

SEQ ID NO: 2341701 - RNA, 15 nt, Human
gguaacagaacagcu

SEQ ID NO: 2341702 - RNA, 16 nt, Human
gguaacagaacagcuu

SEQ ID NO: 2341703 - RNA, 18 nt, Human
gguaacagaacagcuuca

SEQ ID NO: 2341704 - RNA, 23 nt, Human
gguaaaagugugagcagugaguu

SEQ ID NO: 2341705 - RNA, 13 nt, Human
gguaaaauacuuc

SEQ ID NO: 2341706 - RNA, 16 nt, Human
gguaaacacgccugca

SEQ ID NO: 2341707 - RNA, 15 nt, Human
gguaaagacuggcuu

SEQ ID NO: 2341708 - RNA, 16 nt, Human
gguaaagacuggcuuu

SEQ ID NO: 2341709 - RNA, 17 nt, Human
gguccagcccuggcuga

SEQ ID NO: 2341710 - RNA, 19 nt, Human
gguccagcccuggcugaag

SEQ ID NO: 2341711 - RNA, 22 nt, Human
ggucauacuaucuacucuccuc

SEQ ID NO: 2341712 - RNA, 23 nt, Human
ggucauagcccagaucagcuccu

SEQ ID NO: 2341713 - RNA, 16 nt, Human
ggucauagcagugcuu

SEQ ID NO: 2341714 - RNA, 21 nt, Human
ggucauacuaucuacucuccu

SEQ ID NO: 2341715 - RNA, 24 nt, Human
ggucaguguccaaagcagggucug

SEQ ID NO: 2341716 - RNA, 19 nt, Human
ggucagugaggcccaggga

SEQ ID NO: 2341717 - RNA, 16 nt, Human
ggucagucugguggga

SEQ ID NO: 2341718 - RNA, 14 nt, Human
ggucagugcaaaua

SEQ ID NO: 2341719 - RNA, 16 nt, Human
gguaucuguucuuuaa

SEQ ID NO: 2341720 - RNA, 16 nt, Human
gguaucuccaggauug

SEQ ID NO: 2341721 - RNA, 23 nt, Human
gguaucuccaggauugaagagca

SEQ ID NO: 2341722 - RNA, 12 nt, Human
gguaucuccagg

SEQ ID NO: 2341723 - RNA, 13 nt, Human
gguaucuccagga

SEQ ID NO: 2341724 - RNA, 14 nt, Human
gguaucuccaggau

SEQ ID NO: 2341725 - RNA, 19 nt, Human
gguaucaggugcugccauc

SEQ ID NO: 2341726 - RNA, 18 nt, Human
gguauccccccaucuugc

SEQ ID NO: 2341727 - RNA, 19 nt, Human
gguaucauuuucugcauuu

SEQ ID NO: 2341728 - RNA, 11 nt, Human
gguccaggaga

SEQ ID NO: 2341729 - RNA, 23 nt, Human
aaacuuccagugcaacacugaag

SEQ ID NO: 2341730 - RNA, 18 nt, Human
gguccagcuugcucuuca

SEQ ID NO: 2341731 - RNA, 17 nt, Human
gguccagcuugcucuuc

SEQ ID NO: 2341732 - RNA, 22 nt, Human
gguccagcucuggaggggaggg

SEQ ID NO: 2341733 - RNA, 11 nt, Human
gguccagcucu

SEQ ID NO: 2341734 - RNA, 12 nt, Human
gguccagcucug

SEQ ID NO: 2341735 - RNA, 20 nt, Human
gguccagcccuggcugaagg

SEQ ID NO: 2341736 - RNA, 21 nt, Human
gguccagcccuggcugaagga

SEQ ID NO: 2341737 - RNA, 22 nt, Human
gguccagcccuggcugaaggac

SEQ ID NO: 2341738 - RNA, 23 nt, Human
gguccagcccuggcugaaggacu

SEQ ID NO: 2341739 - RNA, 13 nt, Human
gguccagcucugg

SEQ ID NO: 2341740 - RNA, 14 nt, Human
gguccagcucugga

SEQ ID NO: 2341741 - RNA, 15 nt, Human
gguccagcucuggag

SEQ ID NO: 2341742 - RNA, 16 nt, Human
gguccagcucuggagg

SEQ ID NO: 2341743 - RNA, 18 nt, Human
aaacuucucugaagggag

SEQ ID NO: 2341744 - RNA, 19 nt, Human
aaacuucucugaagggagg

SEQ ID NO: 2341745 - RNA, 23 nt, Human
aaacuuccaugaggccaaacguu

SEQ ID NO: 2341746 - RNA, 23 nt, Human
aaacuucccgucccauauccugc

SEQ ID NO: 2341747 - RNA, 17 nt, Human
aaacuuccccaucuucu

SEQ ID NO: 2341748 - RNA, 21 nt, Human
aaacuucccuuucugcuugug

SEQ ID NO: 2341749 - RNA, 21 nt, Human
aaacuuuagaguagcaugaga

SEQ ID NO: 2341750 - RNA, 22 nt, Human
aaacuugauguguuaucucuua

SEQ ID NO: 2341751 - RNA, 13 nt, Human
gguauagaaaugc

SEQ ID NO: 2341752 - RNA, 15 nt, Human
gguagguucagccaa

SEQ ID NO: 2341753 - RNA, 13 nt, Human
gguagguggcaca

SEQ ID NO: 2341754 - RNA, 19 nt, Human
gguagguggcacacugggu

SEQ ID NO: 2341755 - RNA, 16 nt, Human
gguagguucagccaag

SEQ ID NO: 2341756 - RNA, 17 nt, Human
gguagguucagccaagg

SEQ ID NO: 2341757 - RNA, 23 nt, Human
gguagggugggccuucagggagu

SEQ ID NO: 2341758 - RNA, 11 nt, Human
gguaggguggg

SEQ ID NO: 2341759 - RNA, 20 nt, Human
gguaggguaagugagagagg

SEQ ID NO: 2341760 - RNA, 15 nt, Human
gguaucaagaaaguc

SEQ ID NO: 2341761 - RNA, 13 nt, Human
gguauauucauuu

SEQ ID NO: 2341762 - RNA, 14 nt, Human
gguaucaggugcug

SEQ ID NO: 2341763 - RNA, 22 nt, Human
gguauaucauuauaacugaagg

SEQ ID NO: 2341764 - RNA, 16 nt, Human
gguauauccaaaagcu

SEQ ID NO: 2341765 - RNA, 20 nt, Human
gguauaaugguugacugggu

SEQ ID NO: 2341766 - RNA, 18 nt, Human
gguagguucagccaaggu

SEQ ID NO: 2341767 - RNA, 19 nt, Human
gguagguucagccaagguu

SEQ ID NO: 2341768 - RNA, 19 nt, Human
gguaaguuguuaagagugg

SEQ ID NO: 2341769 - RNA, 15 nt, Human
gguaggaggaugggc

SEQ ID NO: 2341770 - RNA, 18 nt, Human
gguaggaacugcugggcu

SEQ ID NO: 2341771 - RNA, 19 nt, Human
gguaggagguuuggauggg

SEQ ID NO: 2341772 - RNA, 14 nt, Human
gguaggcagagccu

SEQ ID NO: 2341773 - RNA, 13 nt, Human
gguaaggugccuu

SEQ ID NO: 2341774 - RNA, 20 nt, Human
gguaagcacuuaaugaauga

SEQ ID NO: 2341775 - RNA, 16 nt, Human
gguaggaacugcuggg

SEQ ID NO: 2341776 - RNA, 20 nt, Human
gguaaggaauaccugucccc

SEQ ID NO: 2341777 - RNA, 23 nt, Human
gguaagaagccgggaacagacaa

SEQ ID NO: 2341778 - RNA, 16 nt, Human
gguaacuugcaccucu

SEQ ID NO: 2341779 - RNA, 21 nt, Human
gguaacagaacagcuucaggu

SEQ ID NO: 2341780 - RNA, 21 nt, Human
gggccggccaggugggcgggc

SEQ ID NO: 2341781 - RNA, 14 nt, Human
gggccggccaggug

SEQ ID NO: 2341782 - RNA, 15 nt, Human
gggccggccaggugg

SEQ ID NO: 2341783 - RNA, 15 nt, Human
gggccguaccccacc

SEQ ID NO: 2341784 - RNA, 16 nt, Human
gggccguaccccaccc

SEQ ID NO: 2341785 - RNA, 18 nt, Human
gggccguaccccacccuc

SEQ ID NO: 2341786 - RNA, 17 nt, Human
gggccgccgccucuuuc

SEQ ID NO: 2341787 - RNA, 19 nt, Human
gggccgccgguuugaguga

SEQ ID NO: 2341788 - RNA, 21 nt, Human
gggccgcugccacccaccucc

SEQ ID NO: 2341789 - RNA, 15 nt, Human
gggccgcugccaccc

SEQ ID NO: 2341790 - RNA, 14 nt, Human
gggccgcugccacc

SEQ ID NO: 2341791 - RNA, 13 nt, Human
gggccgcugccac

SEQ ID NO: 2341792 - RNA, 12 nt, Human
gggccgcugcca

SEQ ID NO: 2341793 - RNA, 13 nt, Human
gggcccaaaggcc

SEQ ID NO: 2341794 - RNA, 14 nt, Human
gggcccaacccugu

SEQ ID NO: 2341795 - RNA, 16 nt, Human
gggcccaacccugucu

SEQ ID NO: 2341796 - RNA, 18 nt, Human
gggcccaagacagaugcc

SEQ ID NO: 2341797 - RNA, 18 nt, Human
gggccauucuccacagca

SEQ ID NO: 2341798 - RNA, 16 nt, Human
gggccauucuccacag

SEQ ID NO: 2341799 - RNA, 23 nt, Human
gggccaugcugaggccugggccg

SEQ ID NO: 2341800 - RNA, 21 nt, Human
gggccaugcugaggccugggc

SEQ ID NO: 2341801 - RNA, 23 nt, Human
gggccagaggaacuguccagaga

SEQ ID NO: 2341802 - RNA, 12 nt, Human
gggccagaggcu

SEQ ID NO: 2341803 - RNA, 15 nt, Human
gggccagagccaggg

SEQ ID NO: 2341804 - RNA, 22 nt, Human
gggccagaggaacuguccagag

SEQ ID NO: 2341805 - RNA, 14 nt, Human
gggccagagccagg

SEQ ID NO: 2341806 - RNA, 13 nt, Human
gggccagagccag

SEQ ID NO: 2341807 - RNA, 12 nt, Human
gggccagagcca

SEQ ID NO: 2341808 - RNA, 11 nt, Human
gggccagagcc

SEQ ID NO: 2341809 - RNA, 12 nt, Human
gggccaggagcc

SEQ ID NO: 2341810 - RNA, 17 nt, Human
gggccagauccagccug

SEQ ID NO: 2341811 - RNA, 16 nt, Human
gggccagauccagccu

SEQ ID NO: 2341812 - RNA, 14 nt, Human
gggccagauccagc

SEQ ID NO: 2341813 - RNA, 13 nt, Human
gggccagauccag

SEQ ID NO: 2341814 - RNA, 13 nt, Human
gggccaggagccu

SEQ ID NO: 2341815 - RNA, 14 nt, Human
gggccaggagccuc

SEQ ID NO: 2341816 - RNA, 18 nt, Human
gggccagauccagccugg

SEQ ID NO: 2341817 - RNA, 20 nt, Human
gggccagaguauuggucucc

SEQ ID NO: 2341818 - RNA, 11 nt, Human
gggccaggcag

SEQ ID NO: 2341819 - RNA, 12 nt, Human
gggccaggcagg

SEQ ID NO: 2341820 - RNA, 13 nt, Human
gggccaggcaggu

SEQ ID NO: 2341821 - RNA, 20 nt, Human
gggccaggcaggugccugga

SEQ ID NO: 2341822 - RNA, 23 nt, Human
gggccaggcaggugccuggacau

SEQ ID NO: 2341823 - RNA, 19 nt, Human
gggccaugcugaggccugg

SEQ ID NO: 2341824 - RNA, 20 nt, Human
gggccaugcugaggccuggg

SEQ ID NO: 2341825 - RNA, 13 nt, Human
gggccugcuccag

SEQ ID NO: 2341826 - RNA, 18 nt, Human
gggccugcuccagaccug

SEQ ID NO: 2341827 - RNA, 17 nt, Human
gggccugcuccagaccu

SEQ ID NO: 2341828 - RNA, 15 nt, Human
gggccugcuccagac

SEQ ID NO: 2341829 - RNA, 14 nt, Human
gggccugcuccaga

SEQ ID NO: 2341830 - RNA, 21 nt, Human
gggcggugagaggggaacaga

SEQ ID NO: 2341831 - RNA, 19 nt, Human
gggcgugagaccugccccu

SEQ ID NO: 2341832 - RNA, 18 nt, Human
gggcgugagaccugcccc

SEQ ID NO: 2341833 - RNA, 16 nt, Human
gggcgugacucaccca

SEQ ID NO: 2341834 - RNA, 17 nt, Human
gggcgucuguucccccu

SEQ ID NO: 2341835 - RNA, 13 nt, Human
gggcguggagggc

SEQ ID NO: 2341836 - RNA, 19 nt, Human
gggcguggucacugcuguc

SEQ ID NO: 2341837 - RNA, 21 nt, Human
gggcuacccugagcugaggca

SEQ ID NO: 2341838 - RNA, 20 nt, Human
gggcuacugcagcuuuacau

SEQ ID NO: 2341839 - RNA, 22 nt, Human
gggcuacccugagcugaggcag

SEQ ID NO: 2341840 - RNA, 15 nt, Human
gggccucggagccuc

SEQ ID NO: 2341841 - RNA, 16 nt, Human
gggccucaaggacuug

SEQ ID NO: 2341842 - RNA, 20 nt, Human
gggccucaccgagugggggc

SEQ ID NO: 2341843 - RNA, 20 nt, Human
gggccguaccccacccucag

SEQ ID NO: 2341844 - RNA, 20 nt, Human
gggccucaaaggcccgcucu

SEQ ID NO: 2341845 - RNA, 15 nt, Human
gggccucagugccac

SEQ ID NO: 2341846 - RNA, 13 nt, Human
gggccucagugcc

SEQ ID NO: 2341847 - RNA, 14 nt, Human
gggccucagugcca

SEQ ID NO: 2341848 - RNA, 17 nt, Human
gggccucggagccucau

SEQ ID NO: 2341849 - RNA, 14 nt, Human
gggccucgggaccu

SEQ ID NO: 2341850 - RNA, 16 nt, Human
gggccucgggaccuca

SEQ ID NO: 2341851 - RNA, 23 nt, Human
gggccucugguuuggggcgaggc

SEQ ID NO: 2341852 - RNA, 22 nt, Human
gggccucgguguggagaagcgg

SEQ ID NO: 2341853 - RNA, 18 nt, Human
gggccucuuaugggcugg

SEQ ID NO: 2341854 - RNA, 21 nt, Human
gggccugcaggaccugccugu

SEQ ID NO: 2341855 - RNA, 24 nt, Human
gggccugcaggaccugccuguagc

SEQ ID NO: 2341856 - RNA, 15 nt, Human
aaaaugggacuucuu

SEQ ID NO: 2341857 - RNA, 19 nt, Human
aaaaugggacuucuuuuca

SEQ ID NO: 2341858 - RNA, 21 nt, Human
aaaaugggacuucuuuucaca

SEQ ID NO: 2341859 - RNA, 22 nt, Human
aaaaugggacuucuuuucacau

SEQ ID NO: 2341860 - RNA, 14 nt, Human
aaaauggugccuga

SEQ ID NO: 2341861 - RNA, 18 nt, Human
aaaaugguuuaaaugguc

SEQ ID NO: 2341862 - RNA, 16 nt, Human
aaaaugguuuaaaugg

SEQ ID NO: 2341863 - RNA, 13 nt, Human
gggcugggcagcu

SEQ ID NO: 2341864 - RNA, 14 nt, Human
gggcugggcagcug

SEQ ID NO: 2341865 - RNA, 14 nt, Human
gggcugggcagcua

SEQ ID NO: 2341866 - RNA, 17 nt, Human
gggcuggguucuaccca

SEQ ID NO: 2341867 - RNA, 23 nt, Human
aaaauggccauuugcuuuuucac

SEQ ID NO: 2341868 - RNA, 22 nt, Human
gggcugggugcgaccccaucug

SEQ ID NO: 2341869 - RNA, 19 nt, Human
aaaauggccauuugcuuuu

SEQ ID NO: 2341870 - RNA, 14 nt, Human
gggcugcuccucau

SEQ ID NO: 2341871 - RNA, 11 nt, Human
gggcugcuccu

SEQ ID NO: 2341872 - RNA, 19 nt, Human
gggcugcuccuccagggcc

SEQ ID NO: 2341873 - RNA, 18 nt, Human
gggcugcuccuccagggc

SEQ ID NO: 2341874 - RNA, 16 nt, Human
gggcugcuccuccagg

SEQ ID NO: 2341875 - RNA, 15 nt, Human
gggcugcuccuccag

SEQ ID NO: 2341876 - RNA, 17 nt, Human
gggcugcugaccuccac

SEQ ID NO: 2341877 - RNA, 12 nt, Human
gggcugcuguga

SEQ ID NO: 2341878 - RNA, 12 nt, Human
gggcugggcaga

SEQ ID NO: 2341879 - RNA, 12 nt, Human
gggcugcuuccu

SEQ ID NO: 2341880 - RNA, 17 nt, Human
gggcugcuuccuccugg

SEQ ID NO: 2341881 - RNA, 15 nt, Human
gggcugggcagagga

SEQ ID NO: 2341882 - RNA, 21 nt, Human
gggcugcccuggugcugccac

SEQ ID NO: 2341883 - RNA, 12 nt, Human
gggcucccugac

SEQ ID NO: 2341884 - RNA, 12 nt, Human
gggcugccuggg

SEQ ID NO: 2341885 - RNA, 13 nt, Human
gggcugccugggc

SEQ ID NO: 2341886 - RNA, 14 nt, Human
gggcugccugggcu

SEQ ID NO: 2341887 - RNA, 15 nt, Human
gggcugccugggcug

SEQ ID NO: 2341888 - RNA, 19 nt, Human
gggcugccugggcuguugg

SEQ ID NO: 2341889 - RNA, 21 nt, Human
gggcugccugggcuguuggca

SEQ ID NO: 2341890 - RNA, 20 nt, Human
gggcugcaccggcuggccug

SEQ ID NO: 2341891 - RNA, 21 nt, Human
gggcugcaccggcuggccugg

SEQ ID NO: 2341892 - RNA, 13 nt, Human
gggcucccgcccg

SEQ ID NO: 2341893 - RNA, 20 nt, Human
gggcucagggaccacagcaa

SEQ ID NO: 2341894 - RNA, 17 nt, Human
gggcugcaccggcuggc

SEQ ID NO: 2341895 - RNA, 19 nt, Human
gggcugcaccggcuggccu

SEQ ID NO: 2341896 - RNA, 21 nt, Human
gggcucagcggggacagcucc

SEQ ID NO: 2341897 - RNA, 20 nt, Human
gggcucagccuggugggccu

SEQ ID NO: 2341898 - RNA, 16 nt, Human
gggcucagccuggugg

SEQ ID NO: 2341899 - RNA, 13 nt, Human
gggcucaggaaaa

SEQ ID NO: 2341900 - RNA, 17 nt, Human
gggcucagggaccacag

SEQ ID NO: 2341901 - RNA, 10 nt, Human
gggcuccaga

SEQ ID NO: 2341902 - RNA, 13 nt, Human
gggcuccagacac

SEQ ID NO: 2341903 - RNA, 15 nt, Human
gggcuaguugggcuu

SEQ ID NO: 2341904 - RNA, 20 nt, Human
gggcuaggaaauccagggug

SEQ ID NO: 2341905 - RNA, 14 nt, Human
gggcuagaaccugg

SEQ ID NO: 2341906 - RNA, 15 nt, Human
gggcuagaaccugga

SEQ ID NO: 2341907 - RNA, 17 nt, Human
gggcuagaaccuggaga

SEQ ID NO: 2341908 - RNA, 17 nt, Human
gggcuagaaccuggagg

SEQ ID NO: 2341909 - RNA, 22 nt, Human
gggcucagcaaaagaugcuucu

SEQ ID NO: 2341910 - RNA, 18 nt, Human
gggcuaguugggcuuccu

SEQ ID NO: 2341911 - RNA, 17 nt, Human
gggcucagcggggacag

SEQ ID NO: 2341912 - RNA, 19 nt, Human
gggcucagcggggacagcu

SEQ ID NO: 2341913 - RNA, 13 nt, Human
gggcucagccugg

SEQ ID NO: 2341914 - RNA, 12 nt, Human
gggcucagccug

SEQ ID NO: 2341915 - RNA, 11 nt, Human
gggcucagccu

SEQ ID NO: 2341916 - RNA, 16 nt, Human
gggcuagaaccuggca

SEQ ID NO: 2341917 - RNA, 12 nt, Human
gggcuagaaucu

SEQ ID NO: 2341918 - RNA, 13 nt, Human
aaaauggaaagaa

SEQ ID NO: 2341919 - RNA, 14 nt, Human
aaaauggaaagaau

SEQ ID NO: 2341920 - RNA, 22 nt, Human
aaaaugcuuuuuauuucugcau

SEQ ID NO: 2341921 - RNA, 12 nt, Human
aaaauggaaaga

SEQ ID NO: 2341922 - RNA, 20 nt, Human
aaaauggaagacagcucuua

SEQ ID NO: 2341923 - RNA, 16 nt, Human
gggccagacaugccac

SEQ ID NO: 2341924 - RNA, 22 nt, Human
gggccacuucuggguggggcag

SEQ ID NO: 2341925 - RNA, 17 nt, Human
aaaaugcccuuaaauca

SEQ ID NO: 2341926 - RNA, 17 nt, Human
aaaaugccaagacauga

SEQ ID NO: 2341927 - RNA, 13 nt, Human
aaaaugcuuuuua

SEQ ID NO: 2341928 - RNA, 19 nt, Human
aaaaugcuuuuuauuucug

SEQ ID NO: 2341929 - RNA, 18 nt, Human
aaaaugcuuuuuauuucu

SEQ ID NO: 2341930 - RNA, 23 nt, Human
aaaaugcuguauuagucacagag

SEQ ID NO: 2341931 - RNA, 21 nt, Human
aaaaugcuguauuagucacag

SEQ ID NO: 2341932 - RNA, 18 nt, Human
aaaaugcaacaacaugua

SEQ ID NO: 2341933 - RNA, 14 nt, Human
aaaaugcacauagc

SEQ ID NO: 2341934 - RNA, 14 nt, Human
aaaaugcacguagc

SEQ ID NO: 2341935 - RNA, 22 nt, Human
aaaaugcaaauccuaugugauu

SEQ ID NO: 2341936 - RNA, 20 nt, Human
aaaaugcaaauccuauguga

SEQ ID NO: 2341937 - RNA, 14 nt, Human
aaaaugcauuguau

SEQ ID NO: 2341938 - RNA, 18 nt, Human
aaaaugcagcagggaugc

SEQ ID NO: 2341939 - RNA, 22 nt, Human
aaaaugagacuaugcguuuuua

SEQ ID NO: 2341940 - RNA, 20 nt, Human
aaaaugaccaguaauuguga

SEQ ID NO: 2341941 - RNA, 23 nt, Human
aaaaugagagggcaguguuuccu

SEQ ID NO: 2341942 - RNA, 23 nt, Human
aaaaugauguguacccaaacgug

SEQ ID NO: 2341943 - RNA, 16 nt, Human
aaaaugauguucauuu

SEQ ID NO: 2341944 - RNA, 16 nt, Human
aaaaugauuguaaaau

SEQ ID NO: 2341945 - RNA, 19 nt, Human
aaaaugauuguaaaauagc

SEQ ID NO: 2341946 - RNA, 14 nt, Human
aaaaugauuuuauc

SEQ ID NO: 2341947 - RNA, 20 nt, Human
aaaaugauuguaaaauagcu

SEQ ID NO: 2341948 - RNA, 18 nt, Human
aaaaugcaaauccuaugu

SEQ ID NO: 2341949 - RNA, 14 nt, Human
aaaaugcaaauccu

SEQ ID NO: 2341950 - RNA, 13 nt, Human
aaaauauuuugaa

SEQ ID NO: 2341951 - RNA, 13 nt, Human
aaaaucugaaaau

SEQ ID NO: 2341952 - RNA, 15 nt, Human
aaaaucugcuaggga

SEQ ID NO: 2341953 - RNA, 20 nt, Human
aaaaucugucacguagaacu

SEQ ID NO: 2341954 - RNA, 19 nt, Human
aaaaucugcagaaggaaaa

SEQ ID NO: 2341955 - RNA, 23 nt, Human
aaaaucugaaaaugugaauaaaa

SEQ ID NO: 2341956 - RNA, 21 nt, Human
aaaaugacuaaaaauauuaua

SEQ ID NO: 2341957 - RNA, 18 nt, Human
aaaaugacagauguugaa

SEQ ID NO: 2341958 - RNA, 19 nt, Human
aaaaugaccaguaauugug

SEQ ID NO: 2341959 - RNA, 14 nt, Human
aaaaugacauccca

SEQ ID NO: 2341960 - RNA, 17 nt, Human
aaaaugacagauguuga

SEQ ID NO: 2341961 - RNA, 15 nt, Human
aaaaugacagauguu

SEQ ID NO: 2341962 - RNA, 13 nt, Human
aaaaugacagaug

SEQ ID NO: 2341963 - RNA, 12 nt, Human
aaaaucugucca

SEQ ID NO: 2341964 - RNA, 11 nt, Human
aaaaugagaaa

SEQ ID NO: 2341965 - RNA, 12 nt, Human
aaaaugagaaau

SEQ ID NO: 2341966 - RNA, 11 nt, Human
aaaauaugcau

SEQ ID NO: 2341967 - RNA, 16 nt, Human
aaaauauggaacuucu

SEQ ID NO: 2341968 - RNA, 14 nt, Human
aaaauauuuaaagg

SEQ ID NO: 2341969 - RNA, 15 nt, Human
aaaauauuuguacau

SEQ ID NO: 2341970 - RNA, 20 nt, Human
aaaauauggaacuucuaaua

SEQ ID NO: 2341971 - RNA, 13 nt, Human
aaaauauuuauaa

SEQ ID NO: 2341972 - RNA, 11 nt, Human
aaaauauuuau

SEQ ID NO: 2341973 - RNA, 21 nt, Human
aaaauauuuauaaaacuucuc

SEQ ID NO: 2341974 - RNA, 18 nt, Human
aaaauauuuuauaauuuu

SEQ ID NO: 2341975 - RNA, 12 nt, Human
aaaauauuuuca

SEQ ID NO: 2341976 - RNA, 17 nt, Human
aaaauauuuuauaauuu

SEQ ID NO: 2341977 - RNA, 13 nt, Human
aaaauauuuuaua

SEQ ID NO: 2341978 - RNA, 16 nt, Human
aaaauauuuuccugcc

SEQ ID NO: 2341979 - RNA, 17 nt, Human
aaaaucucaauauuuca

SEQ ID NO: 2341980 - RNA, 12 nt, Human
aaaauauuuuga

SEQ ID NO: 2341981 - RNA, 13 nt, Human
aaaauauuuucau

SEQ ID NO: 2341982 - RNA, 20 nt, Human
aaaauauuuucauacagcau

SEQ ID NO: 2341983 - RNA, 14 nt, Human
aaaauagaagaaua

SEQ ID NO: 2341984 - RNA, 15 nt, Human
aaaauagaagcugua

SEQ ID NO: 2341985 - RNA, 13 nt, Human
aaaauagacacuc

SEQ ID NO: 2341986 - RNA, 15 nt, Human
aaaauauauuuaaug

SEQ ID NO: 2341987 - RNA, 21 nt, Human
aaaauacuugucaauauuuaa

SEQ ID NO: 2341988 - RNA, 9 nt, Human
aaaauacuu

SEQ ID NO: 2341989 - RNA, 18 nt, Human
aaaauaucugaaauguga

SEQ ID NO: 2341990 - RNA, 16 nt, Human
aaaauauauuuaauga

SEQ ID NO: 2341991 - RNA, 13 nt, Human
aaaauaugauauu

SEQ ID NO: 2341992 - RNA, 17 nt, Human
aaaauaucuuuugaccu

SEQ ID NO: 2341993 - RNA, 14 nt, Human
aaaauaucuuuuga

SEQ ID NO: 2341994 - RNA, 22 nt, Human
aaaauaugaccacacuccagcu

SEQ ID NO: 2341995 - RNA, 15 nt, Human
aaaauauuccugcau

SEQ ID NO: 2341996 - RNA, 22 nt, Human
aaaaggagccaauuuaaagaaa

SEQ ID NO: 2341997 - RNA, 13 nt, Human
aaaaggaugcaca

SEQ ID NO: 2341998 - RNA, 16 nt, Human
aaaaggacaccuuuua

SEQ ID NO: 2341999 - RNA, 16 nt, Human
aaaaggacaauuucaa

SEQ ID NO: 2342000 - RNA, 13 nt, Human
ggcugguccaggg

SEQ ID NO: 2342001 - RNA, 23 nt, Human
ggcugguccagggcuagugacuu

SEQ ID NO: 2342002 - RNA, 22 nt, Human
aaaaggaugcacagaguuguua

SEQ ID NO: 2342003 - RNA, 19 nt, Human
aaaaggaugcacagaguug

SEQ ID NO: 2342004 - RNA, 15 nt, Human
aaaaggaugcacaga

SEQ ID NO: 2342005 - RNA, 14 nt, Human
aaaaggaugcacag

SEQ ID NO: 2342006 - RNA, 16 nt, Human
aaaagguuaauaaagu

SEQ ID NO: 2342007 - RNA, 20 nt, Human
aaaaggugccugugaggcag

SEQ ID NO: 2342008 - RNA, 15 nt, Human
aaaagguauuaaauu

SEQ ID NO: 2342009 - RNA, 20 nt, Human
aaaauaacccuuugguuuuu

SEQ ID NO: 2342010 - RNA, 22 nt, Human
aaaaggugccugugaggcaggg

SEQ ID NO: 2342011 - RNA, 19 nt, Human
aaaagguucacuaaagcag

SEQ ID NO: 2342012 - RNA, 17 nt, Human
aaaagguuaauaaagua

SEQ ID NO: 2342013 - RNA, 23 nt, Human
aaaaggaucuuuguggccaagga

SEQ ID NO: 2342014 - RNA, 18 nt, Human
aaaaggauuuuuaucuuu

SEQ ID NO: 2342015 - RNA, 20 nt, Human
aaaaggaucuuuguggccaa

SEQ ID NO: 2342016 - RNA, 19 nt, Human
aaaaggaucuuuguggcca

SEQ ID NO: 2342017 - RNA, 11 nt, Human
aaaaggcagga

SEQ ID NO: 2342018 - RNA, 23 nt, Human
aaaaggccaaaccucuguucagu

SEQ ID NO: 2342019 - RNA, 22 nt, Human
aaaaggccaaaccucuguucag

SEQ ID NO: 2342020 - RNA, 19 nt, Human
aaaaggccaaaccucuguu

SEQ ID NO: 2342021 - RNA, 15 nt, Human
aaaaggccaaaccuc

SEQ ID NO: 2342022 - RNA, 14 nt, Human
aaaaggccaaaccu

SEQ ID NO: 2342023 - RNA, 14 nt, Human
aaaaggcauuguuu

SEQ ID NO: 2342024 - RNA, 16 nt, Human
aaaaggcaaaugugua

SEQ ID NO: 2342025 - RNA, 17 nt, Human
aaaaggcauuguuugag

SEQ ID NO: 2342026 - RNA, 13 nt, Human
aaaauaauucuaa

SEQ ID NO: 2342027 - RNA, 14 nt, Human
aaaauaauucuaaa

SEQ ID NO: 2342028 - RNA, 21 nt, Human
aaaauaaucuauuucuaugag

SEQ ID NO: 2342029 - RNA, 23 nt, Human
aaaauaaucuauuucuaugagaa

SEQ ID NO: 2342030 - RNA, 16 nt, Human
aaaauaauugauuuca

SEQ ID NO: 2342031 - RNA, 22 nt, Human
aaaauaauugauuucaagaccu

SEQ ID NO: 2342032 - RNA, 20 nt, Human
aaaauaauuuuaaacaaagg

SEQ ID NO: 2342033 - RNA, 19 nt, Human
aaaauaauuuuaaacaaag

SEQ ID NO: 2342034 - RNA, 11 nt, Human
aaaauaauuuu

SEQ ID NO: 2342035 - RNA, 13 nt, Human
aaaauaauaauaa

SEQ ID NO: 2342036 - RNA, 22 nt, Human
aaaauaagaaaagauguagauu

SEQ ID NO: 2342037 - RNA, 16 nt, Human
aaaauaagaauagaaa

SEQ ID NO: 2342038 - RNA, 16 nt, Human
aaaauaacuucaagca

SEQ ID NO: 2342039 - RNA, 12 nt, Human
aaaauaagaaaa

SEQ ID NO: 2342040 - RNA, 15 nt, Human
aaaauaagaaaagau

SEQ ID NO: 2342041 - RNA, 14 nt, Human
aaaauaagaaaaga

SEQ ID NO: 2342042 - RNA, 15 nt, Human
aaaauaacuuauauc

SEQ ID NO: 2342043 - RNA, 19 nt, Human
aaaauaaccggauauauac

SEQ ID NO: 2342044 - RNA, 14 nt, Human
aaaauacauuuuau

SEQ ID NO: 2342045 - RNA, 14 nt, Human
aaaauacugccaga

SEQ ID NO: 2342046 - RNA, 15 nt, Human
aaaauacugccagau

SEQ ID NO: 2342047 - RNA, 18 nt, Human
aaaauacugccagaugcu

SEQ ID NO: 2342048 - RNA, 19 nt, Human
aaaauacugccagaugcug

SEQ ID NO: 2342049 - RNA, 20 nt, Human
aaaauacugccagaugcuga

SEQ ID NO: 2342050 - RNA, 13 nt, Human
aaaauaccaagga

SEQ ID NO: 2342051 - RNA, 21 nt, Human
aaaauacaguuugucacauga

SEQ ID NO: 2342052 - RNA, 13 nt, Human
aaaauacauuuua

SEQ ID NO: 2342053 - RNA, 12 nt, Human
aaaauacauuuu

SEQ ID NO: 2342054 - RNA, 17 nt, Human
aaaauacauaagaccau

SEQ ID NO: 2342055 - RNA, 20 nt, Human
aaaauaauuuuuauauuuga

SEQ ID NO: 2342056 - RNA, 14 nt, Human
aaaauacacacuca

SEQ ID NO: 2342057 - RNA, 16 nt, Human
aaaauaauuuuuauau

SEQ ID NO: 2342058 - RNA, 17 nt, Human
aaaauaauuuuuauauu

SEQ ID NO: 2342059 - RNA, 19 nt, Human
cugaagccuuucuuuugga

SEQ ID NO: 2342060 - RNA, 15 nt, Human
cugaagccugcagga

SEQ ID NO: 2342061 - RNA, 13 nt, Human
cugaagccugcag

SEQ ID NO: 2342062 - RNA, 19 nt, Human
cugaaagaacauggacuug

SEQ ID NO: 2342063 - RNA, 13 nt, Human
cugaagccucugg

SEQ ID NO: 2342064 - RNA, 14 nt, Human
cugaagccucuggg

SEQ ID NO: 2342065 - RNA, 15 nt, Human
cugaagccucuggga

SEQ ID NO: 2342066 - RNA, 12 nt, Human
cugaagccucug

SEQ ID NO: 2342067 - RNA, 15 nt, Human
cugaaagacaauaua

SEQ ID NO: 2342068 - RNA, 21 nt, Human
cugaagcuaucguaaaauuaa

SEQ ID NO: 2342069 - RNA, 22 nt, Human
cugaagcuaucguaaaauuaag

SEQ ID NO: 2342070 - RNA, 12 nt, Human
cugaaggagaag

SEQ ID NO: 2342071 - RNA, 23 nt, Human
cugaaggacugugacaggcagca

SEQ ID NO: 2342072 - RNA, 21 nt, Human
cugaaggacugugacaggcag

SEQ ID NO: 2342073 - RNA, 22 nt, Human
cugaaggacugugacaggcagc

SEQ ID NO: 2342074 - RNA, 12 nt, Human
cugaaggacugu

SEQ ID NO: 2342075 - RNA, 13 nt, Human
cugaaggacugug

SEQ ID NO: 2342076 - RNA, 14 nt, Human
cugaaggacuguga

SEQ ID NO: 2342077 - RNA, 15 nt, Human
cugaaggacugugac

SEQ ID NO: 2342078 - RNA, 13 nt, Human
cugaaggagcccc

SEQ ID NO: 2342079 - RNA, 12 nt, Human
cugaaggagccc

SEQ ID NO: 2342080 - RNA, 12 nt, Human
cugaaggagauu

SEQ ID NO: 2342081 - RNA, 16 nt, Human
cugaaggagauuuucc

SEQ ID NO: 2342082 - RNA, 18 nt, Human
cugaaggagauuuuccuu

SEQ ID NO: 2342083 - RNA, 20 nt, Human
cugaaggagauuuuccuucc

SEQ ID NO: 2342084 - RNA, 23 nt, Human
cugaaggacauugcggacagcca

SEQ ID NO: 2342085 - RNA, 23 nt, Human
cugaagccuuugcauuuuggaga

SEQ ID NO: 2342086 - RNA, 20 nt, Human
cugaagcugacgaacuucca

SEQ ID NO: 2342087 - RNA, 12 nt, Human
cugaagcugagg

SEQ ID NO: 2342088 - RNA, 18 nt, Human
cugacaaaaaguuuccau

SEQ ID NO: 2342089 - RNA, 21 nt, Human
cugaaggccuggcccacagca

SEQ ID NO: 2342090 - RNA, 22 nt, Human
cugacaacacucauugaccuga

SEQ ID NO: 2342091 - RNA, 23 nt, Human
cugacaacacucauugaccugag

SEQ ID NO: 2342092 - RNA, 18 nt, Human
cugaaggccccgcccagg

SEQ ID NO: 2342093 - RNA, 21 nt, Human
cugaaggagauuuuccuuccu

SEQ ID NO: 2342094 - RNA, 21 nt, Human
cugaaggagccccauuccugg

SEQ ID NO: 2342095 - RNA, 19 nt, Human
cugaaggccccgcccaggc

SEQ ID NO: 2342096 - RNA, 17 nt, Human
cugaaggcuggguucug

SEQ ID NO: 2342097 - RNA, 13 nt, Human
cugaaggccuggc

SEQ ID NO: 2342098 - RNA, 21 nt, Human
cugaaggccccgcccaggcuu

SEQ ID NO: 2342099 - RNA, 14 nt, Human
cucuuuucucugug

SEQ ID NO: 2342100 - RNA, 21 nt, Human
cucuugauuauccauauugag

SEQ ID NO: 2342101 - RNA, 23 nt, Human
cucuugauaccccccucugucuu

SEQ ID NO: 2342102 - RNA, 16 nt, Human
cucuuuuuggaggugc

SEQ ID NO: 2342103 - RNA, 20 nt, Human
cucuuuuuagggccaggcag

SEQ ID NO: 2342104 - RNA, 22 nt, Human
cucuuuuuagggccaggcaggu

SEQ ID NO: 2342105 - RNA, 11 nt, Human
cucuuuuuaag

SEQ ID NO: 2342106 - RNA, 18 nt, Human
cucuuuucuuuagagcau

SEQ ID NO: 2342107 - RNA, 18 nt, Human
cucuuuuuagggccaggc

SEQ ID NO: 2342108 - RNA, 20 nt, Human
cucuuuugaauccaugcuug

SEQ ID NO: 2342109 - RNA, 13 nt, Human
cucuuuucucuuu

SEQ ID NO: 2342110 - RNA, 21 nt, Human
cucuuuugcuuuauuccagaa

SEQ ID NO: 2342111 - RNA, 13 nt, Human
cucuugaugccug

SEQ ID NO: 2342112 - RNA, 15 nt, Human
cucuugaugccuggc

SEQ ID NO: 2342113 - RNA, 16 nt, Human
cucuugaugccuggcg

SEQ ID NO: 2342114 - RNA, 21 nt, Human
cucuugaugccuggcggggug

SEQ ID NO: 2342115 - RNA, 21 nt, Human
cugaaagaaacaguuaacuuu

SEQ ID NO: 2342116 - RNA, 20 nt, Human
cugaaagaaacaguuaacuu

SEQ ID NO: 2342117 - RNA, 19 nt, Human
cugaaagaaacaguuaacu

SEQ ID NO: 2342118 - RNA, 16 nt, Human
cugaaagaaacaguua

SEQ ID NO: 2342119 - RNA, 15 nt, Human
cugaaagaaacaguu

SEQ ID NO: 2342120 - RNA, 14 nt, Human
cugaaagaaacagu

SEQ ID NO: 2342121 - RNA, 23 nt, Human
cugaaacuuauuuuuuucugauu

SEQ ID NO: 2342122 - RNA, 17 nt, Human
cugaaacuuacacacaa

SEQ ID NO: 2342123 - RNA, 22 nt, Human
cugaaacuuauuuuuuucugau

SEQ ID NO: 2342124 - RNA, 13 nt, Human
cugaaacuucccu

SEQ ID NO: 2342125 - RNA, 14 nt, Human
cugaaacaggagag

SEQ ID NO: 2342126 - RNA, 14 nt, Human
cugaaaccaguguu

SEQ ID NO: 2342127 - RNA, 20 nt, Human
cugaaacaacuuggaaagau

SEQ ID NO: 2342128 - RNA, 16 nt, Human
cugaaacccuggacca

SEQ ID NO: 2342129 - RNA, 13 nt, Human
cugaaacaggaga

SEQ ID NO: 2342130 - RNA, 16 nt, Human
cugaaacaacuuggaa

SEQ ID NO: 2342131 - RNA, 15 nt, Human
cugaaacaacuugga

SEQ ID NO: 2342132 - RNA, 22 nt, Human
cugaaaauugaugggauuuggu

SEQ ID NO: 2342133 - RNA, 17 nt, Human
cucuuuuugggcuccuu

SEQ ID NO: 2342134 - RNA, 21 nt, Human
cucuuuuugggcuccuuuuuc

SEQ ID NO: 2342135 - RNA, 19 nt, Human
cucuuuuuguaccugguga

SEQ ID NO: 2342136 - RNA, 15 nt, Human
cugaaacaacaaaua

SEQ ID NO: 2342137 - RNA, 17 nt, Human
cucuugagccuugaacu

SEQ ID NO: 2342138 - RNA, 16 nt, Human
cucuugagccuugaac

SEQ ID NO: 2342139 - RNA, 18 nt, Human
cucuugagccuugaacuu

SEQ ID NO: 2342140 - RNA, 23 nt, Human
cucuugagccuugaacuuugacc

SEQ ID NO: 2342141 - RNA, 18 nt, Human
cucuccccugcccugcug

SEQ ID NO: 2342142 - RNA, 17 nt, Human
cucuccccugcccugcu

SEQ ID NO: 2342143 - RNA, 16 nt, Human
cucuccccugcccugc

SEQ ID NO: 2342144 - RNA, 15 nt, Human
cucuccccugcccug

SEQ ID NO: 2342145 - RNA, 21 nt, Human
cucuccccuggaacugucucu

SEQ ID NO: 2342146 - RNA, 23 nt, Human
cucuaaagcaauaauggucccau

SEQ ID NO: 2342147 - RNA, 20 nt, Human
cucucaggcaugccugugug

SEQ ID NO: 2342148 - RNA, 19 nt, Human
cucucaggcaugccugugu

SEQ ID NO: 2342149 - RNA, 18 nt, Human
cucucaggcaugccugug

SEQ ID NO: 2342150 - RNA, 21 nt, Human
cucucaggcaugccuguguga

SEQ ID NO: 2342151 - RNA, 21 nt, Human
cucuccccucagagugcaagc

SEQ ID NO: 2342152 - RNA, 17 nt, Human
cucuccccugaccugug

SEQ ID NO: 2342153 - RNA, 15 nt, Human
cucuccccugaccug

SEQ ID NO: 2342154 - RNA, 13 nt, Human
cucugcagcaaua

SEQ ID NO: 2342155 - RNA, 13 nt, Human
cucugcagguccc

SEQ ID NO: 2342156 - RNA, 21 nt, Human
cucugcacuccccugcugggu

SEQ ID NO: 2342157 - RNA, 18 nt, Human
cucugcacuccccugcug

SEQ ID NO: 2342158 - RNA, 23 nt, Human
cucucccggagguugggugggcc

SEQ ID NO: 2342159 - RNA, 17 nt, Human
cucucccgguucuucca

SEQ ID NO: 2342160 - RNA, 20 nt, Human
cucugcacuccccugcuggg

SEQ ID NO: 2342161 - RNA, 13 nt, Human
cucugcuccucuc

SEQ ID NO: 2342162 - RNA, 18 nt, Human
cucugcuccucuccccag

SEQ ID NO: 2342163 - RNA, 20 nt, Human
cucugcuccucuccccagca

SEQ ID NO: 2342164 - RNA, 14 nt, Human
cucugcaggucccu

SEQ ID NO: 2342165 - RNA, 15 nt, Human
cucugcaggucccua

SEQ ID NO: 2342166 - RNA, 16 nt, Human
cucugcaggucccuaa

SEQ ID NO: 2342167 - RNA, 17 nt, Human
cucugcaggucccuaau

SEQ ID NO: 2342168 - RNA, 17 nt, Human
cucugguaauauugacu

SEQ ID NO: 2342169 - RNA, 14 nt, Human
cucugguccauaga

SEQ ID NO: 2342170 - RNA, 14 nt, Human
cucugcugaagguu

SEQ ID NO: 2342171 - RNA, 20 nt, Human
cucuggggucccccaucccc

SEQ ID NO: 2342172 - RNA, 17 nt, Human
cucugggucaguggucc

SEQ ID NO: 2342173 - RNA, 20 nt, Human
cucugggucagugguccaca

SEQ ID NO: 2342174 - RNA, 13 nt, Human
cucugcugacaga

SEQ ID NO: 2342175 - RNA, 13 nt, Human
cucugcucugcgu

SEQ ID NO: 2342176 - RNA, 13 nt, Human
cucugcuccccag

SEQ ID NO: 2342177 - RNA, 14 nt, Human
cucugcugacagac

SEQ ID NO: 2342178 - RNA, 16 nt, Human
cucugcugacagacac

SEQ ID NO: 2342179 - RNA, 23 nt, Human
cucugucagaugggaagacauga

SEQ ID NO: 2342180 - RNA, 18 nt, Human
cucugucacugcaggcac

SEQ ID NO: 2342181 - RNA, 19 nt, Human
cucugucagucacagccac

SEQ ID NO: 2342182 - RNA, 17 nt, Human
cucugucagucacagcc

SEQ ID NO: 2342183 - RNA, 16 nt, Human
cucugucagucacagc

SEQ ID NO: 2342184 - RNA, 14 nt, Human
cucugucagucaca

SEQ ID NO: 2342185 - RNA, 20 nt, Human
cucuguccagggcccugagc

SEQ ID NO: 2342186 - RNA, 14 nt, Human
cucuguccagggcc

SEQ ID NO: 2342187 - RNA, 19 nt, Human
cucuguccaggcacugaga

SEQ ID NO: 2342188 - RNA, 14 nt, Human
cucuguccaggcac

SEQ ID NO: 2342189 - RNA, 13 nt, Human
cucugucagaugg

SEQ ID NO: 2342190 - RNA, 20 nt, Human
cucugucagucacagccacc

SEQ ID NO: 2342191 - RNA, 12 nt, Human
cucuguccaggc

SEQ ID NO: 2342192 - RNA, 22 nt, Human
cucuggucugggugccccgucc

SEQ ID NO: 2342193 - RNA, 20 nt, Human
cucuggucgcuccugcccac

SEQ ID NO: 2342194 - RNA, 17 nt, Human
cucuggucgcuccugcc

SEQ ID NO: 2342195 - RNA, 18 nt, Human
cucuggucgcuccugccc

SEQ ID NO: 2342196 - RNA, 16 nt, Human
cucuggucgcuccugc

SEQ ID NO: 2342197 - RNA, 19 nt, Human
cucuggugacaccagccuu

SEQ ID NO: 2342198 - RNA, 18 nt, Human
cucuggugacaccagccu

SEQ ID NO: 2342199 - RNA, 16 nt, Human
cucuggugacaccagc

SEQ ID NO: 2342200 - RNA, 20 nt, Human
cucuggucuucuuuggguaa

SEQ ID NO: 2342201 - RNA, 20 nt, Human
cucuggugacaccagccuuu

SEQ ID NO: 2342202 - RNA, 21 nt, Human
cucuggugagucuuggcggca

SEQ ID NO: 2342203 - RNA, 22 nt, Human
cucuggugagucuuggcggcag

SEQ ID NO: 2342204 - RNA, 23 nt, Human
cucuggugagucuuggcggcagc

SEQ ID NO: 2342205 - RNA, 14 nt, Human
cucuuauugcccac

SEQ ID NO: 2342206 - RNA, 15 nt, Human
cucuuauugcccacg

SEQ ID NO: 2342207 - RNA, 19 nt, Human
cucuuauugcccacgcugg

SEQ ID NO: 2342208 - RNA, 20 nt, Human
cucuuauugcccacgcugga

SEQ ID NO: 2342209 - RNA, 22 nt, Human
cucuguccagggcccugagcuc

SEQ ID NO: 2342210 - RNA, 21 nt, Human
cucuguccagggcccugagcu

SEQ ID NO: 2342211 - RNA, 14 nt, Human
cucuuagauggauu

SEQ ID NO: 2342212 - RNA, 22 nt, Human
cucuuagaugcaguucugaaga

SEQ ID NO: 2342213 - RNA, 13 nt, Human
cucuuauugccca

SEQ ID NO: 2342214 - RNA, 21 nt, Human
cucuuagcauuuuaauuagau

SEQ ID NO: 2342215 - RNA, 19 nt, Human
cucuuagcagcuuccagau

SEQ ID NO: 2342216 - RNA, 17 nt, Human
cucuuagcagcuuccag

SEQ ID NO: 2342217 - RNA, 18 nt, Human
cucuuagcagcuuccaga

SEQ ID NO: 2342218 - RNA, 11 nt, Human
cucuucagaaa

SEQ ID NO: 2342219 - RNA, 16 nt, Human
cucuucaccccccacu

SEQ ID NO: 2342220 - RNA, 17 nt, Human
cucuucaccccccacuc

SEQ ID NO: 2342221 - RNA, 18 nt, Human
cucuucaccccccacuca

SEQ ID NO: 2342222 - RNA, 14 nt, Human
cucuucaaucucuu

SEQ ID NO: 2342223 - RNA, 19 nt, Human
cucuucagaucucuaacuu

SEQ ID NO: 2342224 - RNA, 18 nt, Human
cucuucagaucucuaacu

SEQ ID NO: 2342225 - RNA, 15 nt, Human
cucuuauuuuacaau

SEQ ID NO: 2342226 - RNA, 12 nt, Human
cucuuauuugcu

SEQ ID NO: 2342227 - RNA, 19 nt, Human
cucuuagcuccccuccaac

SEQ ID NO: 2342228 - RNA, 18 nt, Human
cucuuagcuccccuccaa

SEQ ID NO: 2342229 - RNA, 15 nt, Human
cucuuagcuccccuc

SEQ ID NO: 2342230 - RNA, 17 nt, Human
cucuuagcuccccucca

SEQ ID NO: 2342231 - RNA, 20 nt, Human
cucuucaacugaccagccuc

SEQ ID NO: 2342232 - RNA, 18 nt, Human
cucuucaaggacuuucug

SEQ ID NO: 2342233 - RNA, 17 nt, Human
cucuucaaauuagaaga

SEQ ID NO: 2342234 - RNA, 16 nt, Human
cucuucaacugaccag

SEQ ID NO: 2342235 - RNA, 17 nt, Human
cucuucaacugaccagc

SEQ ID NO: 2342236 - RNA, 16 nt, Human
cucuucaggccucccu

SEQ ID NO: 2342237 - RNA, 15 nt, Human
cucuucaggccuccc

SEQ ID NO: 2342238 - RNA, 14 nt, Human
cucuucaggccucc

SEQ ID NO: 2342239 - RNA, 13 nt, Human
cucuucaggccuc

SEQ ID NO: 2342240 - RNA, 17 nt, Human
cucuucagaggcccucg

SEQ ID NO: 2342241 - RNA, 21 nt, Human
cucuucagaaagugugcuuua

SEQ ID NO: 2342242 - RNA, 13 nt, Human
cucuucagaggcc

SEQ ID NO: 2342243 - RNA, 17 nt, Human
cucuucaggccucccuc

SEQ ID NO: 2342244 - RNA, 23 nt, Human
cucuucaggaagaaaggagucug

SEQ ID NO: 2342245 - RNA, 15 nt, Human
cugaccugucaugcc

SEQ ID NO: 2342246 - RNA, 17 nt, Human
cugaccugucaugcccc

SEQ ID NO: 2342247 - RNA, 18 nt, Human
cugaccugucaugccccc

SEQ ID NO: 2342248 - RNA, 19 nt, Human
cugaccugucaugcccccc

SEQ ID NO: 2342249 - RNA, 20 nt, Human
cugaccugucaugccccccu

SEQ ID NO: 2342250 - RNA, 22 nt, Human
cugaccugucaugccccccuca

SEQ ID NO: 2342251 - RNA, 23 nt, Human
cugagacagcccgggcucugccu

SEQ ID NO: 2342252 - RNA, 21 nt, Human
cugagacucgcgacaaugcaa

SEQ ID NO: 2342253 - RNA, 20 nt, Human
cugagaccugacaagcacug

SEQ ID NO: 2342254 - RNA, 20 nt, Human
cugagaccccuggccuccgg

SEQ ID NO: 2342255 - RNA, 21 nt, Human
cugagaccccuggccuccggc

SEQ ID NO: 2342256 - RNA, 19 nt, Human
cugagaccaguugggagca

SEQ ID NO: 2342257 - RNA, 22 nt, Human
cugagaccaguugggagcacug

SEQ ID NO: 2342258 - RNA, 13 nt, Human
cugagaccccugg

SEQ ID NO: 2342259 - RNA, 15 nt, Human
cugagaccccuggcc

SEQ ID NO: 2342260 - RNA, 16 nt, Human
cugagaccccuggccu

SEQ ID NO: 2342261 - RNA, 17 nt, Human
cugagaccccuggccuc

SEQ ID NO: 2342262 - RNA, 19 nt, Human
cugagaccccuggccuccg

SEQ ID NO: 2342263 - RNA, 14 nt, Human
cugagaccaguugg

SEQ ID NO: 2342264 - RNA, 13 nt, Human
cugagacaggaga

SEQ ID NO: 2342265 - RNA, 15 nt, Human
cugagacaggagaau

SEQ ID NO: 2342266 - RNA, 23 nt, Human
cugagaccaguugggagcacugg

SEQ ID NO: 2342267 - RNA, 13 nt, Human
cugaccugcaggc

SEQ ID NO: 2342268 - RNA, 12 nt, Human
cugaccugcagg

SEQ ID NO: 2342269 - RNA, 14 nt, Human
cugaccugcacugg

SEQ ID NO: 2342270 - RNA, 20 nt, Human
cugaccccaaagagccugga

SEQ ID NO: 2342271 - RNA, 23 nt, Human
cugaccccaaagagccuggagaa

SEQ ID NO: 2342272 - RNA, 21 nt, Human
cugaccccagugguauccugu

SEQ ID NO: 2342273 - RNA, 13 nt, Human
cugaccugaggcu

SEQ ID NO: 2342274 - RNA, 21 nt, Human
cugaccugaggcuccugugcu

SEQ ID NO: 2342275 - RNA, 20 nt, Human
cugaccccaaacaccuucca

SEQ ID NO: 2342276 - RNA, 21 nt, Human
cugaccccaaacaccuuccag

SEQ ID NO: 2342277 - RNA, 22 nt, Human
cugaccccaaacaccuuccagc

SEQ ID NO: 2342278 - RNA, 21 nt, Human
cugacccaugcugcccuguga

SEQ ID NO: 2342279 - RNA, 22 nt, Human
cugacccaugcugcccugugag

SEQ ID NO: 2342280 - RNA, 20 nt, Human
cugagagacccaaggaggaa

SEQ ID NO: 2342281 - RNA, 13 nt, Human
cugagagacuuuu

SEQ ID NO: 2342282 - RNA, 16 nt, Human
cugagagacuuuuaau

SEQ ID NO: 2342283 - RNA, 18 nt, Human
cugagagacuuuuaauca

SEQ ID NO: 2342284 - RNA, 19 nt, Human
cugagagacccaaggagga

SEQ ID NO: 2342285 - RNA, 17 nt, Human
cugagagacccaaggag

SEQ ID NO: 2342286 - RNA, 15 nt, Human
cugagagacccaagg

SEQ ID NO: 2342287 - RNA, 12 nt, Human
cugagagaaaua

SEQ ID NO: 2342288 - RNA, 14 nt, Human
cugagagaaaauaa

SEQ ID NO: 2342289 - RNA, 14 nt, Human
cugagacugcggga

SEQ ID NO: 2342290 - RNA, 21 nt, Human
cugagacuuucagugcacugu

SEQ ID NO: 2342291 - RNA, 17 nt, Human
cugagacucucuuagga

SEQ ID NO: 2342292 - RNA, 21 nt, Human
cugagacucucuuaggagcag

SEQ ID NO: 2342293 - RNA, 22 nt, Human
cugagacucgcgacaaugcaaa

SEQ ID NO: 2342294 - RNA, 24 nt, Human
cugagagaguggcauuggcagcag

SEQ ID NO: 2342295 - RNA, 14 nt, Human
cugagagaguggca

SEQ ID NO: 2342296 - RNA, 13 nt, Human
cugagagccccag

SEQ ID NO: 2342297 - RNA, 14 nt, Human
cugagagccccagc

SEQ ID NO: 2342298 - RNA, 17 nt, Human
cugagagccccagcuga

SEQ ID NO: 2342299 - RNA, 15 nt, Human
cugagagccccagcu

SEQ ID NO: 2342300 - RNA, 16 nt, Human
cugagagccccagcug

SEQ ID NO: 2342301 - RNA, 20 nt, Human
cugagaguauuuaggcagau

SEQ ID NO: 2342302 - RNA, 19 nt, Human
cugagaguauuuaggcaga

SEQ ID NO: 2342303 - RNA, 17 nt, Human
cugagaguagagucacu

SEQ ID NO: 2342304 - RNA, 18 nt, Human
cugagauaccagcgagga

SEQ ID NO: 2342305 - RNA, 12 nt, Human
cugagauaugaa

SEQ ID NO: 2342306 - RNA, 16 nt, Human
cugagauaugaacaua

SEQ ID NO: 2342307 - RNA, 15 nt, Human
cugagauaugaacau

SEQ ID NO: 2342308 - RNA, 14 nt, Human
cugagaguuuaguu

SEQ ID NO: 2342309 - RNA, 15 nt, Human
cugagaguuuaguug

SEQ ID NO: 2342310 - RNA, 13 nt, Human
cugagagucugca

SEQ ID NO: 2342311 - RNA, 21 nt, Human
cugagaggacuuuucuuugug

SEQ ID NO: 2342312 - RNA, 22 nt, Human
cugagaggacuuuucuuugugg

SEQ ID NO: 2342313 - RNA, 17 nt, Human
cugagaggcaggcauag

SEQ ID NO: 2342314 - RNA, 14 nt, Human
cugagaggcaggca

SEQ ID NO: 2342315 - RNA, 15 nt, Human
cugagaggcaggcau

SEQ ID NO: 2342316 - RNA, 12 nt, Human
cugagaggccac

SEQ ID NO: 2342317 - RNA, 12 nt, Human
cugagaggcagg

SEQ ID NO: 2342318 - RNA, 13 nt, Human
cugagaggcaggc

SEQ ID NO: 2342319 - RNA, 20 nt, Human
cugacaaccaccgcucccca

SEQ ID NO: 2342320 - RNA, 21 nt, Human
cugacaaccaccgcuccccag

SEQ ID NO: 2342321 - RNA, 19 nt, Human
cugacaacagacuucugaa

SEQ ID NO: 2342322 - RNA, 18 nt, Human
cugacaacagacuucuga

SEQ ID NO: 2342323 - RNA, 15 nt, Human
cugacaacagacuuc

SEQ ID NO: 2342324 - RNA, 13 nt, Human
cugacaacuugaa

SEQ ID NO: 2342325 - RNA, 18 nt, Human
cugacaaccacuggucug

SEQ ID NO: 2342326 - RNA, 20 nt, Human
cugacaaccacuggucugua

SEQ ID NO: 2342327 - RNA, 22 nt, Human
cugacaaccaccgcuccccagc

SEQ ID NO: 2342328 - RNA, 19 nt, Human
cugaguagcuggauuacag

SEQ ID NO: 2342329 - RNA, 20 nt, Human
cugaguagaaaggccuuuaa

SEQ ID NO: 2342330 - RNA, 12 nt, Human
cugaguagaaag

SEQ ID NO: 2342331 - RNA, 14 nt, Human
cugaguagaaaggc

SEQ ID NO: 2342332 - RNA, 19 nt, Human
cugaguagaaaggccuuua

SEQ ID NO: 2342333 - RNA, 12 nt, Human
cugaggugggag

SEQ ID NO: 2342334 - RNA, 21 nt, Human
cugaguacguugugcauuugg

SEQ ID NO: 2342335 - RNA, 20 nt, Human
cugaguacguugugcauuug

SEQ ID NO: 2342336 - RNA, 19 nt, Human
cugaguacguugugcauuu

SEQ ID NO: 2342337 - RNA, 17 nt, Human
cugaguacguugugcau

SEQ ID NO: 2342338 - RNA, 18 nt, Human
cugaguacguugugcauu

SEQ ID NO: 2342339 - RNA, 22 nt, Human
cugaggacuuaaaauauuccug

SEQ ID NO: 2342340 - RNA, 17 nt, Human
cugaggacagcuguccu

SEQ ID NO: 2342341 - RNA, 17 nt, Human
cugaggacauuccaaga

SEQ ID NO: 2342342 - RNA, 14 nt, Human
cugaggaccagcca

SEQ ID NO: 2342343 - RNA, 14 nt, Human
cugaggacagcugu

SEQ ID NO: 2342344 - RNA, 15 nt, Human
cugaggacagcuguc

SEQ ID NO: 2342345 - RNA, 16 nt, Human
cugaggacagcugucc

SEQ ID NO: 2342346 - RNA, 13 nt, Human
cugaggaggccuc

SEQ ID NO: 2342347 - RNA, 11 nt, Human
cugaggagaaa

SEQ ID NO: 2342348 - RNA, 14 nt, Human
cugaggaggccucc

SEQ ID NO: 2342349 - RNA, 15 nt, Human
cugaggaggccucca

SEQ ID NO: 2342350 - RNA, 16 nt, Human
cugaggaggccuccau

SEQ ID NO: 2342351 - RNA, 19 nt, Human
cugaggaggccuccaucuc

SEQ ID NO: 2342352 - RNA, 21 nt, Human
cugaggucucuugagggagcu

SEQ ID NO: 2342353 - RNA, 19 nt, Human
cugaggucucuugagggag

SEQ ID NO: 2342354 - RNA, 16 nt, Human
cugaggucucuugagg

SEQ ID NO: 2342355 - RNA, 19 nt, Human
cugaggucucgcugaugcu

SEQ ID NO: 2342356 - RNA, 17 nt, Human
cugaggucuagaaauag

SEQ ID NO: 2342357 - RNA, 17 nt, Human
cugaggugaaagggagc

SEQ ID NO: 2342358 - RNA, 13 nt, Human
cugaggucuggcu

SEQ ID NO: 2342359 - RNA, 14 nt, Human
cugaggucuggcug

SEQ ID NO: 2342360 - RNA, 19 nt, Human
cugaggugaaagggagcua

SEQ ID NO: 2342361 - RNA, 16 nt, Human
cugaggucuggcugcu

SEQ ID NO: 2342362 - RNA, 17 nt, Human
cugaggugccuguccca

SEQ ID NO: 2342363 - RNA, 19 nt, Human
cugaggugccugucccacc

SEQ ID NO: 2342364 - RNA, 22 nt, Human
cugaggugccugucccaccccc

SEQ ID NO: 2342365 - RNA, 15 nt, Human
cugaggaaaggccag

SEQ ID NO: 2342366 - RNA, 15 nt, Human
cugagcuuucugcua

SEQ ID NO: 2342367 - RNA, 14 nt, Human
cugagcuuucugcu

SEQ ID NO: 2342368 - RNA, 23 nt, Human
cugagauggaacccuuuuggccc

SEQ ID NO: 2342369 - RNA, 14 nt, Human
cugagaucgugccg

SEQ ID NO: 2342370 - RNA, 16 nt, Human
cugagaucucugcagg

SEQ ID NO: 2342371 - RNA, 18 nt, Human
cugagaucucugcaggaa

SEQ ID NO: 2342372 - RNA, 17 nt, Human
cugagaucucugcagga

SEQ ID NO: 2342373 - RNA, 21 nt, Human
cugagaucaaaacgguuuuac

SEQ ID NO: 2342374 - RNA, 23 nt, Human
cugagauaugaacauauuguuga

SEQ ID NO: 2342375 - RNA, 21 nt, Human
cugagauaugaacauauuguu

SEQ ID NO: 2342376 - RNA, 23 nt, Human
cugaggacacuaaccacgcugga

SEQ ID NO: 2342377 - RNA, 16 nt, Human
cugaggaauuuucuuu

SEQ ID NO: 2342378 - RNA, 13 nt, Human
cugaggacagcug

SEQ ID NO: 2342379 - RNA, 21 nt, Human
cugaggaauccagacccggcu

SEQ ID NO: 2342380 - RNA, 20 nt, Human
cugaggacacuaaccacgcu

SEQ ID NO: 2342381 - RNA, 17 nt, Human
cugaggaauccagaccc

SEQ ID NO: 2342382 - RNA, 20 nt, Human
cugaggaauccagacccggc

SEQ ID NO: 2342383 - RNA, 22 nt, Human
cugaggaaaggccagcuggcag

SEQ ID NO: 2342384 - RNA, 20 nt, Human
cugaggaaaggccagcuggc

SEQ ID NO: 2342385 - RNA, 19 nt, Human
cugaggaaaggccagcugg

SEQ ID NO: 2342386 - RNA, 18 nt, Human
cugaggaaaggccagcug

SEQ ID NO: 2342387 - RNA, 17 nt, Human
cugaggaaaggccagcu

SEQ ID NO: 2342388 - RNA, 16 nt, Human
cugaggaaaggccagc

SEQ ID NO: 2342389 - RNA, 12 nt, Human
cugagcuuugca

SEQ ID NO: 2342390 - RNA, 15 nt, Human
cugagcuuugcaugu

SEQ ID NO: 2342391 - RNA, 14 nt, Human
cugaggaauccaga

SEQ ID NO: 2342392 - RNA, 20 nt, Human
cugaguagcuggauuacagg

SEQ ID NO: 2342393 - RNA, 14 nt, Human
cugaguagcuggga

SEQ ID NO: 2342394 - RNA, 20 nt, Human
cugaguagcugggauuacag

SEQ ID NO: 2342395 - RNA, 15 nt, Human
cugaguagcugggau

SEQ ID NO: 2342396 - RNA, 15 nt, Human
cugagucaccaggaa

SEQ ID NO: 2342397 - RNA, 14 nt, Human
cugagucaccagga

SEQ ID NO: 2342398 - RNA, 20 nt, Human
cugaguauguuaagcucuuu

SEQ ID NO: 2342399 - RNA, 22 nt, Human
cugaguaucuccucgcaagcug

SEQ ID NO: 2342400 - RNA, 21 nt, Human
cugaguaucuccucgcaagcu

SEQ ID NO: 2342401 - RNA, 20 nt, Human
cugagucacccaugaagaca

SEQ ID NO: 2342402 - RNA, 17 nt, Human
cugagucaccaggaaug

SEQ ID NO: 2342403 - RNA, 15 nt, Human
cucauguucugcuuu

SEQ ID NO: 2342404 - RNA, 9 nt, Human
cucaugugu

SEQ ID NO: 2342405 - RNA, 16 nt, Human
cucaugugugcaacag

SEQ ID NO: 2342406 - RNA, 16 nt, Human
cucauguucugcuuuc

SEQ ID NO: 2342407 - RNA, 12 nt, Human
cucauguguaug

SEQ ID NO: 2342408 - RNA, 18 nt, Human
cucaugugugcucuucuu

SEQ ID NO: 2342409 - RNA, 21 nt, Human
cuccaaccugcaaagaucugu

SEQ ID NO: 2342410 - RNA, 14 nt, Human
cuccaaccuggaca

SEQ ID NO: 2342411 - RNA, 19 nt, Human
cucaugugugcucuucuuc

SEQ ID NO: 2342412 - RNA, 18 nt, Human
cuccaaccuggggggcag

SEQ ID NO: 2342413 - RNA, 18 nt, Human
cuccaacuggauuauaaa

SEQ ID NO: 2342414 - RNA, 14 nt, Human
cuccaagaaugcug

SEQ ID NO: 2342415 - RNA, 15 nt, Human
cuccaagaaugcuga

SEQ ID NO: 2342416 - RNA, 16 nt, Human
cuccaagaaugcugaa

SEQ ID NO: 2342417 - RNA, 16 nt, Human
cucaugccucagccuc

SEQ ID NO: 2342418 - RNA, 12 nt, Human
cucaugccucag

SEQ ID NO: 2342419 - RNA, 17 nt, Human
cucaugccccuggcugg

SEQ ID NO: 2342420 - RNA, 16 nt, Human
cucaugccccuggcug

SEQ ID NO: 2342421 - RNA, 23 nt, Human
cucaugcccccuuucagaugucu

SEQ ID NO: 2342422 - RNA, 12 nt, Human
cucaugugaucc

SEQ ID NO: 2342423 - RNA, 14 nt, Human
cucaugugauccuu

SEQ ID NO: 2342424 - RNA, 16 nt, Human
cucaugugauccuuuu

SEQ ID NO: 2342425 - RNA, 12 nt, Human
cucauguggcug

SEQ ID NO: 2342426 - RNA, 13 nt, Human
cucauguggcugg

SEQ ID NO: 2342427 - RNA, 14 nt, Human
cucauguggcugga

SEQ ID NO: 2342428 - RNA, 15 nt, Human
cucauguggcuggaa

SEQ ID NO: 2342429 - RNA, 21 nt, Human
cuccaagaccuucuccuucac

SEQ ID NO: 2342430 - RNA, 15 nt, Human
cuccaagaccuucuc

SEQ ID NO: 2342431 - RNA, 17 nt, Human
cuccaagaaugcugaaa

SEQ ID NO: 2342432 - RNA, 20 nt, Human
cuccaagaaugcugaaacca

SEQ ID NO: 2342433 - RNA, 21 nt, Human
cuccaagaccuguugguucca

SEQ ID NO: 2342434 - RNA, 22 nt, Human
cuccaagaccuucuccuucacc

SEQ ID NO: 2342435 - RNA, 13 nt, Human
cuccaagcaggac

SEQ ID NO: 2342436 - RNA, 14 nt, Human
cuccaagcaggaca

SEQ ID NO: 2342437 - RNA, 22 nt, Human
cuccaagcaggacauggacaag

SEQ ID NO: 2342438 - RNA, 24 nt, Human
cuccaagcaggacauggacaagga

SEQ ID NO: 2342439 - RNA, 13 nt, Human
cuccaagccagcg

SEQ ID NO: 2342440 - RNA, 15 nt, Human
cuccaagccccaucu

SEQ ID NO: 2342441 - RNA, 23 nt, Human
cuccaagcccaguucagcuuggg

SEQ ID NO: 2342442 - RNA, 18 nt, Human
cuccaagcuccaucucca

SEQ ID NO: 2342443 - RNA, 19 nt, Human
cuccaagcuccaucuccac

SEQ ID NO: 2342444 - RNA, 14 nt, Human
cuccaagcuccauc

SEQ ID NO: 2342445 - RNA, 17 nt, Human
cuccaagccccaucuuc

SEQ ID NO: 2342446 - RNA, 18 nt, Human
cuccaagccccaucuucu

SEQ ID NO: 2342447 - RNA, 13 nt, Human
cuccaagcuccca

SEQ ID NO: 2342448 - RNA, 14 nt, Human
cuccaagcucccag

SEQ ID NO: 2342449 - RNA, 15 nt, Human
cuccaagcucccagg

SEQ ID NO: 2342450 - RNA, 16 nt, Human
cuccaagcucccaggc

SEQ ID NO: 2342451 - RNA, 16 nt, Human
cuccacuggauggagg

SEQ ID NO: 2342452 - RNA, 23 nt, Human
cuccacuggccggagucagugcc

SEQ ID NO: 2342453 - RNA, 9 nt, Human
cuccacugu

SEQ ID NO: 2342454 - RNA, 11 nt, Human
cuccacuguca

SEQ ID NO: 2342455 - RNA, 12 nt, Human
cuccacugucac

SEQ ID NO: 2342456 - RNA, 13 nt, Human
cuccacugucaca

SEQ ID NO: 2342457 - RNA, 16 nt, Human
cuccacugucacauug

SEQ ID NO: 2342458 - RNA, 15 nt, Human
cuccacuuggucugu

SEQ ID NO: 2342459 - RNA, 13 nt, Human
cuccacuuggucu

SEQ ID NO: 2342460 - RNA, 22 nt, Human
cuccacuuggucugugagaugc

SEQ ID NO: 2342461 - RNA, 21 nt, Human
cuccacuuggucugugagaug

SEQ ID NO: 2342462 - RNA, 17 nt, Human
cuccacuuggucuguga

SEQ ID NO: 2342463 - RNA, 16 nt, Human
cuccacuuggucugug

SEQ ID NO: 2342464 - RNA, 14 nt, Human
cucaguaaaaugaa

SEQ ID NO: 2342465 - RNA, 20 nt, Human
cucagguuugccugagggcg

SEQ ID NO: 2342466 - RNA, 16 nt, Human
cucaguaaagcacuug

SEQ ID NO: 2342467 - RNA, 19 nt, Human
cucaguaagacgacaagga

SEQ ID NO: 2342468 - RNA, 13 nt, Human
cucagucucagga

SEQ ID NO: 2342469 - RNA, 22 nt, Human
cucaguccuccccucacagccu

SEQ ID NO: 2342470 - RNA, 23 nt, Human
cucaguccuccccucacagccuc

SEQ ID NO: 2342471 - RNA, 23 nt, Human
cucaguacuuuggaggccccuau

SEQ ID NO: 2342472 - RNA, 15 nt, Human
cucagucucaggagc

SEQ ID NO: 2342473 - RNA, 14 nt, Human
cucagucucaggag

SEQ ID NO: 2342474 - RNA, 13 nt, Human
cucagucucccuc

SEQ ID NO: 2342475 - RNA, 21 nt, Human
cucaguacuuuggaggccccu

SEQ ID NO: 2342476 - RNA, 20 nt, Human
cucaguacuuuggaggcccc

SEQ ID NO: 2342477 - RNA, 19 nt, Human
cucaguacuuuggaggccc

SEQ ID NO: 2342478 - RNA, 18 nt, Human
cucaguacuuuggaggcc

SEQ ID NO: 2342479 - RNA, 17 nt, Human
cucaguacuuuggaggc

SEQ ID NO: 2342480 - RNA, 12 nt, Human
cucaguacuuug

SEQ ID NO: 2342481 - RNA, 21 nt, Human
cucaguaaguaucuggaggaa

SEQ ID NO: 2342482 - RNA, 21 nt, Human
cucaguaagacgacaaggaaa

SEQ ID NO: 2342483 - RNA, 20 nt, Human
cucaguaaguaucuggagga

SEQ ID NO: 2342484 - RNA, 12 nt, Human
cucaucugugau

SEQ ID NO: 2342485 - RNA, 19 nt, Human
cucaucugggggaguggaa

SEQ ID NO: 2342486 - RNA, 13 nt, Human
cucaucuuacugu

SEQ ID NO: 2342487 - RNA, 18 nt, Human
cucaucugucccuccggg

SEQ ID NO: 2342488 - RNA, 17 nt, Human
cucaucugucccuccgg

SEQ ID NO: 2342489 - RNA, 15 nt, Human
cucaucugucccucc

SEQ ID NO: 2342490 - RNA, 13 nt, Human
cucaucugucccu

SEQ ID NO: 2342491 - RNA, 14 nt, Human
cucaucugucacca

SEQ ID NO: 2342492 - RNA, 12 nt, Human
cucaucugucac

SEQ ID NO: 2342493 - RNA, 18 nt, Human
cucaucuuagugccugag

SEQ ID NO: 2342494 - RNA, 22 nt, Human
cucaugcaucuccaccugcucc

SEQ ID NO: 2342495 - RNA, 13 nt, Human
cucaugcccaccc

SEQ ID NO: 2342496 - RNA, 16 nt, Human
cucaugcccacccccu

SEQ ID NO: 2342497 - RNA, 17 nt, Human
cucaugcccacccccug

SEQ ID NO: 2342498 - RNA, 19 nt, Human
cucaugcccacccccugcc

SEQ ID NO: 2342499 - RNA, 14 nt, Human
cucaugccccuggc

SEQ ID NO: 2342500 - RNA, 17 nt, Human
cucaugcccccuuucag

SEQ ID NO: 2342501 - RNA, 22 nt, Human
cucaugcccccuuucagauguc

SEQ ID NO: 2342502 - RNA, 20 nt, Human
cucaugcccacccccugccc

SEQ ID NO: 2342503 - RNA, 21 nt, Human
cucaugcccacccccugcccu

SEQ ID NO: 2342504 - RNA, 22 nt, Human
cucaugcccacccccugcccug

SEQ ID NO: 2342505 - RNA, 23 nt, Human
cucaugcccacccccugcccugc

SEQ ID NO: 2342506 - RNA, 16 nt, Human
cucagucucaggagca

SEQ ID NO: 2342507 - RNA, 13 nt, Human
cucagucucccuu

SEQ ID NO: 2342508 - RNA, 17 nt, Human
cucagucucccucccuu

SEQ ID NO: 2342509 - RNA, 16 nt, Human
cucagucucccucccu

SEQ ID NO: 2342510 - RNA, 15 nt, Human
cucagucucccuccc

SEQ ID NO: 2342511 - RNA, 14 nt, Human
cucagucucccuuu

SEQ ID NO: 2342512 - RNA, 18 nt, Human
cucaucugggggagugga

SEQ ID NO: 2342513 - RNA, 14 nt, Human
cucaucugcugguc

SEQ ID NO: 2342514 - RNA, 15 nt, Human
cucaucugcuggucc

SEQ ID NO: 2342515 - RNA, 16 nt, Human
cucaucugcugguccg

SEQ ID NO: 2342516 - RNA, 20 nt, Human
cucaucugcugguccguggg

SEQ ID NO: 2342517 - RNA, 22 nt, Human
cucccacccccuucucugcucc

SEQ ID NO: 2342518 - RNA, 18 nt, Human
cucccacccccuucucug

SEQ ID NO: 2342519 - RNA, 22 nt, Human
cucccacccccaucucucccuc

SEQ ID NO: 2342520 - RNA, 20 nt, Human
cucccacccccaucucuccc

SEQ ID NO: 2342521 - RNA, 19 nt, Human
cucccacccccaucucucc

SEQ ID NO: 2342522 - RNA, 15 nt, Human
cucccacccccaucu

SEQ ID NO: 2342523 - RNA, 23 nt, Human
cucccaccccacccccuucagug

SEQ ID NO: 2342524 - RNA, 22 nt, Human
cucccaccccacccccuucagu

SEQ ID NO: 2342525 - RNA, 19 nt, Human
cucccaccccacccccuuc

SEQ ID NO: 2342526 - RNA, 13 nt, Human
cucccaccccacc

SEQ ID NO: 2342527 - RNA, 12 nt, Human
cucccaccccac

SEQ ID NO: 2342528 - RNA, 13 nt, Human
cucccacccaccg

SEQ ID NO: 2342529 - RNA, 14 nt, Human
cucccacccaccgc

SEQ ID NO: 2342530 - RNA, 17 nt, Human
cucccacccaccgccac

SEQ ID NO: 2342531 - RNA, 19 nt, Human
cucccaccacagcaggugu

SEQ ID NO: 2342532 - RNA, 14 nt, Human
cucccaccaggcua

SEQ ID NO: 2342533 - RNA, 14 nt, Human
cucccaccacagca

SEQ ID NO: 2342534 - RNA, 13 nt, Human
cucccaccacagc

SEQ ID NO: 2342535 - RNA, 21 nt, Human
cuccaggggcugcuuccuccu

SEQ ID NO: 2342536 - RNA, 23 nt, Human
cuccagggccacgugccaggccc

SEQ ID NO: 2342537 - RNA, 19 nt, Human
cuccagggccacgugccag

SEQ ID NO: 2342538 - RNA, 18 nt, Human
cuccagggccacgugcca

SEQ ID NO: 2342539 - RNA, 12 nt, Human
cuccagggcugg

SEQ ID NO: 2342540 - RNA, 13 nt, Human
cuccagggcugga

SEQ ID NO: 2342541 - RNA, 14 nt, Human
cuccagggcuggac

SEQ ID NO: 2342542 - RNA, 15 nt, Human
cuccagggcuggacu

SEQ ID NO: 2342543 - RNA, 16 nt, Human
cuccagggcuggacug

SEQ ID NO: 2342544 - RNA, 21 nt, Human
cuccagggcuggacugaggcc

SEQ ID NO: 2342545 - RNA, 14 nt, Human
cuccaggggcugcu

SEQ ID NO: 2342546 - RNA, 15 nt, Human
cuccaggggcugcuu

SEQ ID NO: 2342547 - RNA, 18 nt, Human
cuccaggggcugcuuccu

SEQ ID NO: 2342548 - RNA, 17 nt, Human
cuccagggcuggacuga

SEQ ID NO: 2342549 - RNA, 18 nt, Human
cuccagggcuggacugag

SEQ ID NO: 2342550 - RNA, 19 nt, Human
cuccagggcuggacugagg

SEQ ID NO: 2342551 - RNA, 20 nt, Human
cuccagggcuggacugaggc

SEQ ID NO: 2342552 - RNA, 21 nt, Human
cuccccauuagagucagccuu

SEQ ID NO: 2342553 - RNA, 21 nt, Human
cuccccauguguccugguucc

SEQ ID NO: 2342554 - RNA, 18 nt, Human
cuccccauguguccuggu

SEQ ID NO: 2342555 - RNA, 20 nt, Human
cuccccauguguccugguuc

SEQ ID NO: 2342556 - RNA, 16 nt, Human
cuccccauuagcuuuc

SEQ ID NO: 2342557 - RNA, 17 nt, Human
cuccccauuucccaucu

SEQ ID NO: 2342558 - RNA, 18 nt, Human
cuccccauuucccaucug

SEQ ID NO: 2342559 - RNA, 19 nt, Human
cuccccauuucccaucugc

SEQ ID NO: 2342560 - RNA, 22 nt, Human
cuccccauuucccaucugcacc

SEQ ID NO: 2342561 - RNA, 20 nt, Human
cuccccauuucccaucugca

SEQ ID NO: 2342562 - RNA, 21 nt, Human
cuccccauuucccaucugcac

SEQ ID NO: 2342563 - RNA, 14 nt, Human
cuccccaugugucc

SEQ ID NO: 2342564 - RNA, 17 nt, Human
cuccccauggagccagc

SEQ ID NO: 2342565 - RNA, 12 nt, Human
cuccccauggag

SEQ ID NO: 2342566 - RNA, 19 nt, Human
cuccccaugauguuuagaa

SEQ ID NO: 2342567 - RNA, 14 nt, Human
cucccacgugggag

SEQ ID NO: 2342568 - RNA, 15 nt, Human
cucccacgugggaga

SEQ ID NO: 2342569 - RNA, 23 nt, Human
cucccacccccuucucugcucca

SEQ ID NO: 2342570 - RNA, 23 nt, Human
cucccaccucccccucccccuuc

SEQ ID NO: 2342571 - RNA, 12 nt, Human
cucccaccucug

SEQ ID NO: 2342572 - RNA, 13 nt, Human
cucccaccucugu

SEQ ID NO: 2342573 - RNA, 14 nt, Human
cucccaccucugug

SEQ ID NO: 2342574 - RNA, 15 nt, Human
cucccaccucuguga

SEQ ID NO: 2342575 - RNA, 17 nt, Human
cucccaccucugugacc

SEQ ID NO: 2342576 - RNA, 18 nt, Human
cucccaccucugugaccu

SEQ ID NO: 2342577 - RNA, 19 nt, Human
cucccaccucugugaccuc

SEQ ID NO: 2342578 - RNA, 20 nt, Human
cucccaccucugugaccuca

SEQ ID NO: 2342579 - RNA, 21 nt, Human
cucccaccucugugaccucag

SEQ ID NO: 2342580 - RNA, 16 nt, Human
cuccagggccacgugc

SEQ ID NO: 2342581 - RNA, 21 nt, Human
cuccacuucuuguuccccacu

SEQ ID NO: 2342582 - RNA, 13 nt, Human
cuccacugucacc

SEQ ID NO: 2342583 - RNA, 18 nt, Human
cuccacugucacccucca

SEQ ID NO: 2342584 - RNA, 23 nt, Human
cuccacuuggucugugagaugcu

SEQ ID NO: 2342585 - RNA, 16 nt, Human
cuccacuuucuagcca

SEQ ID NO: 2342586 - RNA, 19 nt, Human
cuccacuuucuagccagag

SEQ ID NO: 2342587 - RNA, 20 nt, Human
cuccacuuucuagccagagg

SEQ ID NO: 2342588 - RNA, 20 nt, Human
cucguugacuggcugugugu

SEQ ID NO: 2342589 - RNA, 14 nt, Human
cucguuaauuugua

SEQ ID NO: 2342590 - RNA, 21 nt, Human
cucgugguaggacuguagaaa

SEQ ID NO: 2342591 - RNA, 16 nt, Human
cucgugguccccaaca

SEQ ID NO: 2342592 - RNA, 14 nt, Human
cucguguauccugg

SEQ ID NO: 2342593 - RNA, 15 nt, Human
cucguguauccuggg

SEQ ID NO: 2342594 - RNA, 16 nt, Human
cucguguauccugggg

SEQ ID NO: 2342595 - RNA, 17 nt, Human
cucguguauccuggggc

SEQ ID NO: 2342596 - RNA, 18 nt, Human
cucguguauccuggggcu

SEQ ID NO: 2342597 - RNA, 19 nt, Human
cucguguauccuggggcuc

SEQ ID NO: 2342598 - RNA, 20 nt, Human
cucguguauccuggggcucc

SEQ ID NO: 2342599 - RNA, 17 nt, Human
cucgugguaggacugua

SEQ ID NO: 2342600 - RNA, 21 nt, Human
cucuaaagaguuuauuuuaag

SEQ ID NO: 2342601 - RNA, 18 nt, Human
cucuaaagcaauaauggu

SEQ ID NO: 2342602 - RNA, 23 nt, Human
cucguugacuggcuguguguugg

SEQ ID NO: 2342603 - RNA, 21 nt, Human
cucguuuuucuucuuaagacu

SEQ ID NO: 2342604 - RNA, 19 nt, Human
cucguuucaaaaacacagu

SEQ ID NO: 2342605 - RNA, 17 nt, Human
cucuaaaauagccacuu

SEQ ID NO: 2342606 - RNA, 18 nt, Human
cucuaaaagguucaggga

SEQ ID NO: 2342607 - RNA, 16 nt, Human
cucuaaaagguucagg

SEQ ID NO: 2342608 - RNA, 17 nt, Human
cucuaaaagguucaggg

SEQ ID NO: 2342609 - RNA, 13 nt, Human
cucuaaaagaucc

SEQ ID NO: 2342610 - RNA, 20 nt, Human
cucuaaaagauccuuuuuaa

SEQ ID NO: 2342611 - RNA, 22 nt, Human
cucuauauuuagauuguuaaaa

SEQ ID NO: 2342612 - RNA, 11 nt, Human
cucuauauuua

SEQ ID NO: 2342613 - RNA, 15 nt, Human
cucuauagcaccagg

SEQ ID NO: 2342614 - RNA, 15 nt, Human
cucuaucaccaagga

SEQ ID NO: 2342615 - RNA, 13 nt, Human
cucuaucauuaaa

SEQ ID NO: 2342616 - RNA, 15 nt, Human
cucuaucauuaaagu

SEQ ID NO: 2342617 - RNA, 16 nt, Human
cucuaucauuaaaguu

SEQ ID NO: 2342618 - RNA, 18 nt, Human
cucuaucauuaaaguucu

SEQ ID NO: 2342619 - RNA, 14 nt, Human
cucuaucauuuaau

SEQ ID NO: 2342620 - RNA, 15 nt, Human
cucuaucauuuaaua

SEQ ID NO: 2342621 - RNA, 21 nt, Human
cucuaucauuuaauaauauac

SEQ ID NO: 2342622 - RNA, 23 nt, Human
cucuaucauuuaauaauauacuu

SEQ ID NO: 2342623 - RNA, 22 nt, Human
cucucacauguuuagaguugca

SEQ ID NO: 2342624 - RNA, 13 nt, Human
cucucacauuacu

SEQ ID NO: 2342625 - RNA, 14 nt, Human
cucucacauuacug

SEQ ID NO: 2342626 - RNA, 12 nt, Human
cucucaccuccu

SEQ ID NO: 2342627 - RNA, 16 nt, Human
cucucaccuguacucu

SEQ ID NO: 2342628 - RNA, 22 nt, Human
cucucaauuuuugguugaauaa

SEQ ID NO: 2342629 - RNA, 19 nt, Human
cucucaauuuuugguugaa

SEQ ID NO: 2342630 - RNA, 14 nt, Human
cucucaauuuuugg

SEQ ID NO: 2342631 - RNA, 13 nt, Human
cucucaauuuuug

SEQ ID NO: 2342632 - RNA, 14 nt, Human
cucucaggaucaag

SEQ ID NO: 2342633 - RNA, 20 nt, Human
cucucaggagcacaggcagc

SEQ ID NO: 2342634 - RNA, 21 nt, Human
cucucaggagcacaggcagcu

SEQ ID NO: 2342635 - RNA, 16 nt, Human
cucucaggcaugccug

SEQ ID NO: 2342636 - RNA, 17 nt, Human
cucucaggaccaaagcu

SEQ ID NO: 2342637 - RNA, 13 nt, Human
cucucaggagcac

SEQ ID NO: 2342638 - RNA, 15 nt, Human
cucucaggagcacag

SEQ ID NO: 2342639 - RNA, 16 nt, Human
cucucaggagcacagg

SEQ ID NO: 2342640 - RNA, 17 nt, Human
cucucaggagcacaggc

SEQ ID NO: 2342641 - RNA, 18 nt, Human
cucucaggagcacaggca

SEQ ID NO: 2342642 - RNA, 19 nt, Human
cucucaggagcacaggcag

SEQ ID NO: 2342643 - RNA, 17 nt, Human
cucucagcucagcgcca

SEQ ID NO: 2342644 - RNA, 13 nt, Human
cucucagcuccag

SEQ ID NO: 2342645 - RNA, 15 nt, Human
cucucagcuccaggu

SEQ ID NO: 2342646 - RNA, 15 nt, Human
cucucacuaaacuuu

SEQ ID NO: 2342647 - RNA, 12 nt, Human
cucucagcucca

SEQ ID NO: 2342648 - RNA, 21 nt, Human
cucucacuaaacuuuacccaa

SEQ ID NO: 2342649 - RNA, 16 nt, Human
cucucagcucagcgcc

SEQ ID NO: 2342650 - RNA, 15 nt, Human
cucgaacuggcugca

SEQ ID NO: 2342651 - RNA, 13 nt, Human
cucgaacuggcug

SEQ ID NO: 2342652 - RNA, 14 nt, Human
cucgaacuggcugc

SEQ ID NO: 2342653 - RNA, 15 nt, Human
cuccuggguugagcu

SEQ ID NO: 2342654 - RNA, 16 nt, Human
cuccuggguugagcug

SEQ ID NO: 2342655 - RNA, 22 nt, Human
cuccuggguugagcuguugccu

SEQ ID NO: 2342656 - RNA, 21 nt, Human
cuccuggguuuuguauucucu

SEQ ID NO: 2342657 - RNA, 23 nt, Human
cuccuggggguucuuucuuccuc

SEQ ID NO: 2342658 - RNA, 14 nt, Human
cuccuggggguucu

SEQ ID NO: 2342659 - RNA, 18 nt, Human
cuccuggggguucuuucu

SEQ ID NO: 2342660 - RNA, 14 nt, Human
cuccugggcccucu

SEQ ID NO: 2342661 - RNA, 12 nt, Human
cuccugggcccu

SEQ ID NO: 2342662 - RNA, 20 nt, Human
cuccuggggguucuuucuuc

SEQ ID NO: 2342663 - RNA, 22 nt, Human
cuccuggggguucuuucuuccu

SEQ ID NO: 2342664 - RNA, 17 nt, Human
cuccuaaaguagacuuc

SEQ ID NO: 2342665 - RNA, 22 nt, Human
cuccguuagcuccuguggcccc

SEQ ID NO: 2342666 - RNA, 12 nt, Human
cuccguuggcca

SEQ ID NO: 2342667 - RNA, 20 nt, Human
cuccguuggccacuccgaga

SEQ ID NO: 2342668 - RNA, 17 nt, Human
cuccguuagcuccugug

SEQ ID NO: 2342669 - RNA, 18 nt, Human
cuccguuagcuccugugg

SEQ ID NO: 2342670 - RNA, 21 nt, Human
cuccguuagcuccuguggccc

SEQ ID NO: 2342671 - RNA, 19 nt, Human
cuccucucugcccuaaugc

SEQ ID NO: 2342672 - RNA, 16 nt, Human
cuccucugcugcuggc

SEQ ID NO: 2342673 - RNA, 18 nt, Human
cuccucugcugcuggcug

SEQ ID NO: 2342674 - RNA, 15 nt, Human
cuccucucugcccua

SEQ ID NO: 2342675 - RNA, 14 nt, Human
cuccucucugcccu

SEQ ID NO: 2342676 - RNA, 13 nt, Human
cuccucucugccc

SEQ ID NO: 2342677 - RNA, 13 nt, Human
cuccucuccugga

SEQ ID NO: 2342678 - RNA, 14 nt, Human
cuccucuccuggag

SEQ ID NO: 2342679 - RNA, 15 nt, Human
cuccucuccuggagg

SEQ ID NO: 2342680 - RNA, 16 nt, Human
cuccucuccuggagga

SEQ ID NO: 2342681 - RNA, 12 nt, Human
cuccuaagagag

SEQ ID NO: 2342682 - RNA, 20 nt, Human
cuccuacccaccgcccuugc

SEQ ID NO: 2342683 - RNA, 16 nt, Human
cuccuacaccuaacuc

SEQ ID NO: 2342684 - RNA, 12 nt, Human
cuccuacagccc

SEQ ID NO: 2342685 - RNA, 22 nt, Human
cuccugggccccucaucugcuc

SEQ ID NO: 2342686 - RNA, 17 nt, Human
cuccugggaucugcucg

SEQ ID NO: 2342687 - RNA, 15 nt, Human
cuccugggaucugcu

SEQ ID NO: 2342688 - RNA, 16 nt, Human
cuccugggaucugcuc

SEQ ID NO: 2342689 - RNA, 19 nt, Human
cuccuggagccuuugaaua

SEQ ID NO: 2342690 - RNA, 18 nt, Human
cuccuggcccacugcauc

SEQ ID NO: 2342691 - RNA, 16 nt, Human
cuccuggcccacugca

SEQ ID NO: 2342692 - RNA, 12 nt, Human
cuccucucugcc

SEQ ID NO: 2342693 - RNA, 20 nt, Human
cuccucuccuggaggauugc

SEQ ID NO: 2342694 - RNA, 16 nt, Human
cuccucugucugcccu

SEQ ID NO: 2342695 - RNA, 18 nt, Human
cuccucugugaagcauuc

SEQ ID NO: 2342696 - RNA, 12 nt, Human
cuccucugugaa

SEQ ID NO: 2342697 - RNA, 13 nt, Human
cuccucugugacc

SEQ ID NO: 2342698 - RNA, 23 nt, Human
cuccucuuaaaaaauaaaaacug

SEQ ID NO: 2342699 - RNA, 21 nt, Human
cuccucuuaaaaaauaaaaac

SEQ ID NO: 2342700 - RNA, 15 nt, Human
cuccuggacuccugc

SEQ ID NO: 2342701 - RNA, 14 nt, Human
cuccuggacugccu

SEQ ID NO: 2342702 - RNA, 22 nt, Human
cuccuggacugccuugaauauc

SEQ ID NO: 2342703 - RNA, 12 nt, Human
cuccuggagccu

SEQ ID NO: 2342704 - RNA, 10 nt, Human
cuccuggagg

SEQ ID NO: 2342705 - RNA, 20 nt, Human
cuccucuuaaaaaauaaaaa

SEQ ID NO: 2342706 - RNA, 19 nt, Human
cuccucuuaaaaaauaaaa

SEQ ID NO: 2342707 - RNA, 22 nt, Human
cuccucugugaccaaugucuug

SEQ ID NO: 2342708 - RNA, 23 nt, Human
cuccucugugaccaaugucuuga

SEQ ID NO: 2342709 - RNA, 18 nt, Human
cuccucuucaacugacca

SEQ ID NO: 2342710 - RNA, 23 nt, Human
cuccucuucaacugaccagccuc

SEQ ID NO: 2342711 - RNA, 19 nt, Human
cucccccacccccucccca

SEQ ID NO: 2342712 - RNA, 14 nt, Human
cucccccacccccu

SEQ ID NO: 2342713 - RNA, 23 nt, Human
cucccccaacccccaccccacac

SEQ ID NO: 2342714 - RNA, 21 nt, Human
cucccccaacccccaccccac

SEQ ID NO: 2342715 - RNA, 15 nt, Human
cucccccagccccau

SEQ ID NO: 2342716 - RNA, 20 nt, Human
cucccccagccccauccucu

SEQ ID NO: 2342717 - RNA, 11 nt, Human
cucccccaucc

SEQ ID NO: 2342718 - RNA, 12 nt, Human
cucccccauccu

SEQ ID NO: 2342719 - RNA, 15 nt, Human
cucccccauccuccc

SEQ ID NO: 2342720 - RNA, 22 nt, Human
cucccccagccccauccucugu

SEQ ID NO: 2342721 - RNA, 16 nt, Human
cuccccccacugcagg

SEQ ID NO: 2342722 - RNA, 15 nt, Human
cuccccccacugcag

SEQ ID NO: 2342723 - RNA, 13 nt, Human
cucccccccaugc

SEQ ID NO: 2342724 - RNA, 15 nt, Human
cucccccccaugcac

SEQ ID NO: 2342725 - RNA, 14 nt, Human
cuccccccacugca

SEQ ID NO: 2342726 - RNA, 13 nt, Human
cuccccccacugc

SEQ ID NO: 2342727 - RNA, 17 nt, Human
cucccccauccuccccu

SEQ ID NO: 2342728 - RNA, 13 nt, Human
cucccccaucucu

SEQ ID NO: 2342729 - RNA, 11 nt, Human
cucaauauuuu

SEQ ID NO: 2342730 - RNA, 18 nt, Human
cucaauauuccugaauga

SEQ ID NO: 2342731 - RNA, 15 nt, Human
cucaauaugcuuaca

SEQ ID NO: 2342732 - RNA, 16 nt, Human
cucaauauuccugaau

SEQ ID NO: 2342733 - RNA, 15 nt, Human
cucaauaagccuugu

SEQ ID NO: 2342734 - RNA, 14 nt, Human
cucaauaaaguaca

SEQ ID NO: 2342735 - RNA, 16 nt, Human
cucaauaaaugauucu

SEQ ID NO: 2342736 - RNA, 14 nt, Human
cucaauaagccuug

SEQ ID NO: 2342737 - RNA, 14 nt, Human
cucaaacuccugac

SEQ ID NO: 2342738 - RNA, 13 nt, Human
cucaaacuccuga

SEQ ID NO: 2342739 - RNA, 20 nt, Human
cucaaacucuugaccucagg

SEQ ID NO: 2342740 - RNA, 13 nt, Human
cucaaaccuccuc

SEQ ID NO: 2342741 - RNA, 18 nt, Human
cucaaacacugcaggcau

SEQ ID NO: 2342742 - RNA, 14 nt, Human
cucaaaccuccucu

SEQ ID NO: 2342743 - RNA, 15 nt, Human
cucaaaccuccucuu

SEQ ID NO: 2342744 - RNA, 15 nt, Human
cucaaaccuguuuaa

SEQ ID NO: 2342745 - RNA, 15 nt, Human
cucaaacguggcuuu

SEQ ID NO: 2342746 - RNA, 18 nt, Human
cucaaaccuguuuaaaua

SEQ ID NO: 2342747 - RNA, 21 nt, Human
cucaaaccuguuuaaauauuu

SEQ ID NO: 2342748 - RNA, 13 nt, Human
cucaaacguggcu

SEQ ID NO: 2342749 - RNA, 16 nt, Human
cucaaugagcucuucc

SEQ ID NO: 2342750 - RNA, 12 nt, Human
cucaaugagcuc

SEQ ID NO: 2342751 - RNA, 12 nt, Human
cucaaugcucau

SEQ ID NO: 2342752 - RNA, 13 nt, Human
cucaaugcucaua

SEQ ID NO: 2342753 - RNA, 16 nt, Human
cucaaugcagccagac

SEQ ID NO: 2342754 - RNA, 15 nt, Human
cucaaugcucauaac

SEQ ID NO: 2342755 - RNA, 13 nt, Human
cucaauggacugg

SEQ ID NO: 2342756 - RNA, 13 nt, Human
cucaaugcacuga

SEQ ID NO: 2342757 - RNA, 15 nt, Human
cucaaugcacugaca

SEQ ID NO: 2342758 - RNA, 13 nt, Human
cucaauuucuccc

SEQ ID NO: 2342759 - RNA, 15 nt, Human
cucaauuucucccca

SEQ ID NO: 2342760 - RNA, 16 nt, Human
cucaauuucuccccag

SEQ ID NO: 2342761 - RNA, 19 nt, Human
cucaauucuucccuaucuu

SEQ ID NO: 2342762 - RNA, 14 nt, Human
cucaauucuucccu

SEQ ID NO: 2342763 - RNA, 21 nt, Human
cucaauuuuugguugaauaaa

SEQ ID NO: 2342764 - RNA, 12 nt, Human
cucaauuuuugg

SEQ ID NO: 2342765 - RNA, 23 nt, Human
cucaauuuuaucccucaccugua

SEQ ID NO: 2342766 - RNA, 11 nt, Human
cucacaaaaga

SEQ ID NO: 2342767 - RNA, 22 nt, Human
cucacaaaccaugcaaaugcua

SEQ ID NO: 2342768 - RNA, 20 nt, Human
cucaaaagcacccuugacgu

SEQ ID NO: 2342769 - RNA, 13 nt, Human
cucaaaauauuug

SEQ ID NO: 2342770 - RNA, 20 nt, Human
cuauuuuuuauuuuacuuuu

SEQ ID NO: 2342771 - RNA, 16 nt, Human
cucaaaacuuaacaua

SEQ ID NO: 2342772 - RNA, 20 nt, Human
cucaaaacuuaacauauuua

SEQ ID NO: 2342773 - RNA, 16 nt, Human
cucaaaaugacagcca

SEQ ID NO: 2342774 - RNA, 18 nt, Human
cucaaaauauuuguacau

SEQ ID NO: 2342775 - RNA, 17 nt, Human
cucaaacaacacuggug

SEQ ID NO: 2342776 - RNA, 16 nt, Human
cucaaacaacacuggu

SEQ ID NO: 2342777 - RNA, 15 nt, Human
cucaaacacaguuac

SEQ ID NO: 2342778 - RNA, 21 nt, Human
cucaaacacaguuacacuugu

SEQ ID NO: 2342779 - RNA, 12 nt, Human
cucaaacacugc

SEQ ID NO: 2342780 - RNA, 13 nt, Human
cucaaacacugca

SEQ ID NO: 2342781 - RNA, 22 nt, Human
cucaaaccaaaucacugaacuu

SEQ ID NO: 2342782 - RNA, 19 nt, Human
cucaaaccaaaucacugaa

SEQ ID NO: 2342783 - RNA, 18 nt, Human
cucaaaccaaaucacuga

SEQ ID NO: 2342784 - RNA, 14 nt, Human
cucaaacacugcag

SEQ ID NO: 2342785 - RNA, 16 nt, Human
cucaaacacugcaggc

SEQ ID NO: 2342786 - RNA, 20 nt, Human
cuauuuuuuuucuguuauau

SEQ ID NO: 2342787 - RNA, 21 nt, Human
cuauuuuuuuucuguuauaua

SEQ ID NO: 2342788 - RNA, 21 nt, Human
cucaaaaaaaaaaaaaugcac

SEQ ID NO: 2342789 - RNA, 17 nt, Human
cucaaaaaaagaaaaag

SEQ ID NO: 2342790 - RNA, 18 nt, Human
cucaaaagcugggcaggu

SEQ ID NO: 2342791 - RNA, 23 nt, Human
cucaaaauaccaugccauuuaaa

SEQ ID NO: 2342792 - RNA, 15 nt, Human
cuauuuuuguagaag

SEQ ID NO: 2342793 - RNA, 18 nt, Human
cuauuuuuuauuuuacuu

SEQ ID NO: 2342794 - RNA, 22 nt, Human
cuauuuuugucuuauauauauu

SEQ ID NO: 2342795 - RNA, 14 nt, Human
cuauuuuuguagaa

SEQ ID NO: 2342796 - RNA, 13 nt, Human
cuauuuuuguaga

SEQ ID NO: 2342797 - RNA, 12 nt, Human
cuauuuuuguag

SEQ ID NO: 2342798 - RNA, 16 nt, Human
cuauuaagauuuccaa

SEQ ID NO: 2342799 - RNA, 17 nt, Human
cuauuaagauuuccaag

SEQ ID NO: 2342800 - RNA, 23 nt, Human
cuauuaagaggcagaaaauugca

SEQ ID NO: 2342801 - RNA, 21 nt, Human
cuauuaaggugauauauuuaa

SEQ ID NO: 2342802 - RNA, 23 nt, Human
cuauuaaggugauauauuuaaaa

SEQ ID NO: 2342803 - RNA, 19 nt, Human
cuauuaaggugauauauuu

SEQ ID NO: 2342804 - RNA, 23 nt, Human
cuauuaagauuuccaagugccaa

SEQ ID NO: 2342805 - RNA, 18 nt, Human
cuaucucccccagcccca

SEQ ID NO: 2342806 - RNA, 15 nt, Human
cuauuaaaggaauaa

SEQ ID NO: 2342807 - RNA, 16 nt, Human
cuaucucccccagccc

SEQ ID NO: 2342808 - RNA, 17 nt, Human
cuaucucccccagcccc

SEQ ID NO: 2342809 - RNA, 16 nt, Human
cuagcaucucaugagu

SEQ ID NO: 2342810 - RNA, 19 nt, Human
cuagccaccgccuccuaca

SEQ ID NO: 2342811 - RNA, 12 nt, Human
cuagccagagga

SEQ ID NO: 2342812 - RNA, 13 nt, Human
cuagccagaggag

SEQ ID NO: 2342813 - RNA, 15 nt, Human
cuagccagaggagag

SEQ ID NO: 2342814 - RNA, 15 nt, Human
cuagccagacacucu

SEQ ID NO: 2342815 - RNA, 19 nt, Human
cuagccagacacucugcuc

SEQ ID NO: 2342816 - RNA, 22 nt, Human
cuagccagacacucugcucugc

SEQ ID NO: 2342817 - RNA, 23 nt, Human
cuagccagacacucugcucugcc

SEQ ID NO: 2342818 - RNA, 13 nt, Human
cuaguuugauuaa

SEQ ID NO: 2342819 - RNA, 22 nt, Human
cuaguuguuugauucagacagc

SEQ ID NO: 2342820 - RNA, 23 nt, Human
cuaguuguuugauucagacagcu

SEQ ID NO: 2342821 - RNA, 21 nt, Human
cuaguuugauuaaauucuugc

SEQ ID NO: 2342822 - RNA, 13 nt, Human
cuaguuugcauuc

SEQ ID NO: 2342823 - RNA, 22 nt, Human
cuaguuugauuaaauucuugca

SEQ ID NO: 2342824 - RNA, 17 nt, Human
cuaguuuucuccuccca

SEQ ID NO: 2342825 - RNA, 16 nt, Human
cuaguuuucuccuccc

SEQ ID NO: 2342826 - RNA, 23 nt, Human
cuaguuuuaaaaaaauaaaacau

SEQ ID NO: 2342827 - RNA, 19 nt, Human
cuaguuuucaguuuguaua

SEQ ID NO: 2342828 - RNA, 20 nt, Human
cuaguuuucaguuuguauau

SEQ ID NO: 2342829 - RNA, 19 nt, Human
cuaguuuucuccucccagg

SEQ ID NO: 2342830 - RNA, 18 nt, Human
cuaguuuucuccucccag

SEQ ID NO: 2342831 - RNA, 22 nt, Human
cuaguuuucaguuuguauauac

SEQ ID NO: 2342832 - RNA, 17 nt, Human
cuaucuacucuccucau

SEQ ID NO: 2342833 - RNA, 16 nt, Human
cuaucuacucuccuca

SEQ ID NO: 2342834 - RNA, 15 nt, Human
cuaucuacucuccuc

SEQ ID NO: 2342835 - RNA, 16 nt, Human
cuaucuaacccuccca

SEQ ID NO: 2342836 - RNA, 15 nt, Human
cuaucucccccagcc

SEQ ID NO: 2342837 - RNA, 14 nt, Human
cuaucuaaauguug

SEQ ID NO: 2342838 - RNA, 17 nt, Human
cuaucguaaaauuaaga

SEQ ID NO: 2342839 - RNA, 17 nt, Human
cuaucuaacccucccau

SEQ ID NO: 2342840 - RNA, 18 nt, Human
cuaucguaaaauuaagaa

SEQ ID NO: 2342841 - RNA, 22 nt, Human
cuaucauuuuuguacaguuugc

SEQ ID NO: 2342842 - RNA, 13 nt, Human
cuauccacagaga

SEQ ID NO: 2342843 - RNA, 15 nt, Human
cuauccacagagagu

SEQ ID NO: 2342844 - RNA, 17 nt, Human
cuauccacagagagucc

SEQ ID NO: 2342845 - RNA, 19 nt, Human
cuauccacagagaguccca

SEQ ID NO: 2342846 - RNA, 23 nt, Human
cuauccacagagagucccacugc

SEQ ID NO: 2342847 - RNA, 13 nt, Human
cuaucauuuaaua

SEQ ID NO: 2342848 - RNA, 15 nt, Human
cuaucauuuaauaau

SEQ ID NO: 2342849 - RNA, 17 nt, Human
cuaucauuuaauaauau

SEQ ID NO: 2342850 - RNA, 21 nt, Human
cuaucauuuaauaauauacuu

SEQ ID NO: 2342851 - RNA, 15 nt, Human
cuaucauuuuuguac

SEQ ID NO: 2342852 - RNA, 16 nt, Human
cuaucauuuuuguaca

SEQ ID NO: 2342853 - RNA, 17 nt, Human
cuaucauuuuuguacag

SEQ ID NO: 2342854 - RNA, 18 nt, Human
cuaucauuuuuguacagu

SEQ ID NO: 2342855 - RNA, 23 nt, Human
cuaucauuuuuguacaguuugcu

SEQ ID NO: 2342856 - RNA, 18 nt, Human
cuaucaugucaaacguga

SEQ ID NO: 2342857 - RNA, 17 nt, Human
cuaucauuaaaguucua

SEQ ID NO: 2342858 - RNA, 15 nt, Human
cuaucauuaaaguuc

SEQ ID NO: 2342859 - RNA, 16 nt, Human
cuaucauuaaaguucu

SEQ ID NO: 2342860 - RNA, 13 nt, Human
cuaucauuaaagu

SEQ ID NO: 2342861 - RNA, 14 nt, Human
cuaucauuaaaguu

SEQ ID NO: 2342862 - RNA, 16 nt, Human
cuacucauuccccggg

SEQ ID NO: 2342863 - RNA, 23 nt, Human
cuacucaggaggcugaggcagaa

SEQ ID NO: 2342864 - RNA, 16 nt, Human
cuacucaggaggcuga

SEQ ID NO: 2342865 - RNA, 15 nt, Human
cuacucaggaggcug

SEQ ID NO: 2342866 - RNA, 13 nt, Human
cuacucaggaggc

SEQ ID NO: 2342867 - RNA, 22 nt, Human
cuacucagcagcccuccucacc

SEQ ID NO: 2342868 - RNA, 21 nt, Human
cuacucagcagcccuccucac

SEQ ID NO: 2342869 - RNA, 20 nt, Human
cuacucagcagcccuccuca

SEQ ID NO: 2342870 - RNA, 19 nt, Human
cuacucagcagcccuccuc

SEQ ID NO: 2342871 - RNA, 18 nt, Human
cuacucagcagcccuccu

SEQ ID NO: 2342872 - RNA, 17 nt, Human
cuacucagcagcccucc

SEQ ID NO: 2342873 - RNA, 16 nt, Human
cuacucagcagcccuc

SEQ ID NO: 2342874 - RNA, 15 nt, Human
cuacucagcagcccu

SEQ ID NO: 2342875 - RNA, 18 nt, Human
cuagaacaucccugccag

SEQ ID NO: 2342876 - RNA, 17 nt, Human
cuagaaccuagaagggc

SEQ ID NO: 2342877 - RNA, 13 nt, Human
cuagaacucccuu

SEQ ID NO: 2342878 - RNA, 12 nt, Human
cuagaacucccu

SEQ ID NO: 2342879 - RNA, 22 nt, Human
cuagaagauuuugaaauuuuua

SEQ ID NO: 2342880 - RNA, 18 nt, Human
cuagaaccuagaagggcu

SEQ ID NO: 2342881 - RNA, 18 nt, Human
cuagaaccuggaagggcu

SEQ ID NO: 2342882 - RNA, 14 nt, Human
cuagaaccuggaga

SEQ ID NO: 2342883 - RNA, 15 nt, Human
cuagaaccuggagag

SEQ ID NO: 2342884 - RNA, 14 nt, Human
cuagaaccuggagg

SEQ ID NO: 2342885 - RNA, 16 nt, Human
cuagaaccuggagggc

SEQ ID NO: 2342886 - RNA, 18 nt, Human
cuagaaccuggagggcug

SEQ ID NO: 2342887 - RNA, 21 nt, Human
cuagaagaugaauacaaacaa

SEQ ID NO: 2342888 - RNA, 23 nt, Human
cuagaagggccaguccugccugg

SEQ ID NO: 2342889 - RNA, 20 nt, Human
cuagaagggccaguccugcc

SEQ ID NO: 2342890 - RNA, 17 nt, Human
cuagaagugggccagga

SEQ ID NO: 2342891 - RNA, 21 nt, Human
cuagaagggcuagaaccugga

SEQ ID NO: 2342892 - RNA, 22 nt, Human
cuagaagggcuagaaccuggag

SEQ ID NO: 2342893 - RNA, 12 nt, Human
cuagaagccaag

SEQ ID NO: 2342894 - RNA, 13 nt, Human
cuagaagccaagg

SEQ ID NO: 2342895 - RNA, 16 nt, Human
cuagaagccaagggaa

SEQ ID NO: 2342896 - RNA, 20 nt, Human
cuagaagccaagggaaaggg

SEQ ID NO: 2342897 - RNA, 21 nt, Human
cuagaagccaagggaaagggg

SEQ ID NO: 2342898 - RNA, 13 nt, Human
cuagaaggccaca

SEQ ID NO: 2342899 - RNA, 14 nt, Human
cuagaaggccacau

SEQ ID NO: 2342900 - RNA, 19 nt, Human
cuagaaggccacaugucac

SEQ ID NO: 2342901 - RNA, 21 nt, Human
cuagaagugggccaggacagg

SEQ ID NO: 2342902 - RNA, 15 nt, Human
cuagaaguuacugaa

SEQ ID NO: 2342903 - RNA, 20 nt, Human
cuagaagugggccaggacag

SEQ ID NO: 2342904 - RNA, 19 nt, Human
cuagaagugggccaggaca

SEQ ID NO: 2342905 - RNA, 22 nt, Human
cuagaauuuauucaauuccucu

SEQ ID NO: 2342906 - RNA, 23 nt, Human
cuagaauuuauucaauuccucug

SEQ ID NO: 2342907 - RNA, 15 nt, Human
cuagaauuuauucaa

SEQ ID NO: 2342908 - RNA, 14 nt, Human
cuagaauuucuuua

SEQ ID NO: 2342909 - RNA, 16 nt, Human
cuagacaacccugcaa

SEQ ID NO: 2342910 - RNA, 15 nt, Human
cuagacaacccugca

SEQ ID NO: 2342911 - RNA, 13 nt, Human
cuagacaacccug

SEQ ID NO: 2342912 - RNA, 19 nt, Human
cuagaauuuuaagugcuuu

SEQ ID NO: 2342913 - RNA, 21 nt, Human
cuagaauuugauuauuaacau

SEQ ID NO: 2342914 - RNA, 14 nt, Human
cuagcauaucugcc

SEQ ID NO: 2342915 - RNA, 15 nt, Human
cuagcauaucugccu

SEQ ID NO: 2342916 - RNA, 17 nt, Human
cuagcauaucugccuuu

SEQ ID NO: 2342917 - RNA, 18 nt, Human
cuagcauaucugccuuua

SEQ ID NO: 2342918 - RNA, 21 nt, Human
cuagcauaugaguuucauagc

SEQ ID NO: 2342919 - RNA, 13 nt, Human
cuagcaucccuga

SEQ ID NO: 2342920 - RNA, 23 nt, Human
cuagcauacguacacauuuuauu

SEQ ID NO: 2342921 - RNA, 21 nt, Human
cuagcauacguacacauuuua

SEQ ID NO: 2342922 - RNA, 22 nt, Human
cuaauucuuugaccuguuggga

SEQ ID NO: 2342923 - RNA, 21 nt, Human
cuaauucuuugaccuguuggg

SEQ ID NO: 2342924 - RNA, 23 nt, Human
cuaaguuuuuauggcuuuugugc

SEQ ID NO: 2342925 - RNA, 20 nt, Human
cuaaguuauaguauaucugg

SEQ ID NO: 2342926 - RNA, 16 nt, Human
cuaaguuauaguauau

SEQ ID NO: 2342927 - RNA, 21 nt, Human
cuaagugguacuaacuuuccu

SEQ ID NO: 2342928 - RNA, 14 nt, Human
cuaagugugaacug

SEQ ID NO: 2342929 - RNA, 20 nt, Human
cuaaguuuuuauggcuuuug

SEQ ID NO: 2342930 - RNA, 23 nt, Human
cuaagugauccucccaccucagc

SEQ ID NO: 2342931 - RNA, 23 nt, Human
cuaaguaaaaccacagcaguuga

SEQ ID NO: 2342932 - RNA, 22 nt, Human
cuaaguaaaaccacagcaguug

SEQ ID NO: 2342933 - RNA, 22 nt, Human
cgugugugcaagugucugugug

SEQ ID NO: 2342934 - RNA, 21 nt, Human
cguguguggguggauauaaau

SEQ ID NO: 2342935 - RNA, 17 nt, Human
cguguguccaugugugu

SEQ ID NO: 2342936 - RNA, 18 nt, Human
cguguguagaguuaagaa

SEQ ID NO: 2342937 - RNA, 20 nt, Human
cguguggcucacguguguga

SEQ ID NO: 2342938 - RNA, 22 nt, Human
cguguggcaauagugggcccuc

SEQ ID NO: 2342939 - RNA, 19 nt, Human
cguguguacacgggacuga

SEQ ID NO: 2342940 - RNA, 12 nt, Human
cguguguagagu

SEQ ID NO: 2342941 - RNA, 15 nt, Human
cguguguagaguuaa

SEQ ID NO: 2342942 - RNA, 22 nt, Human
cguguguagaguuaagaagcug

SEQ ID NO: 2342943 - RNA, 12 nt, Human
cgugugugugcg

SEQ ID NO: 2342944 - RNA, 22 nt, Human
cguguguggguggauauaaaua

SEQ ID NO: 2342945 - RNA, 23 nt, Human
cguguguggguggauauaaauau

SEQ ID NO: 2342946 - RNA, 11 nt, Human
cgugugugugu

SEQ ID NO: 2342947 - RNA, 20 nt, Human
cuaaguaaaaccacagcagu

SEQ ID NO: 2342948 - RNA, 21 nt, Human
cuaauuuauccugaaauuuca

SEQ ID NO: 2342949 - RNA, 21 nt, Human
cuaauuuaucuugucucuggg

SEQ ID NO: 2342950 - RNA, 23 nt, Human
cuaauuuauccugaaauuucaga

SEQ ID NO: 2342951 - RNA, 17 nt, Human
cuaauuucaaaaugcuu

SEQ ID NO: 2342952 - RNA, 19 nt, Human
cuaauuucaaaaauauaac

SEQ ID NO: 2342953 - RNA, 21 nt, Human
cuaauuucaaaaauauaacuu

SEQ ID NO: 2342954 - RNA, 14 nt, Human
cuaauuuauuuugu

SEQ ID NO: 2342955 - RNA, 22 nt, Human
cuaauuucaaaaugcuuuuuau

SEQ ID NO: 2342956 - RNA, 19 nt, Human
cuaauuucaaaaugcuuuu

SEQ ID NO: 2342957 - RNA, 18 nt, Human
cuaauuucaaaaugcuuu

SEQ ID NO: 2342958 - RNA, 15 nt, Human
cuacaaaaacacagc

SEQ ID NO: 2342959 - RNA, 19 nt, Human
cuacaguccucccaucuca

SEQ ID NO: 2342960 - RNA, 18 nt, Human
cuacaaaaacacagcaag

SEQ ID NO: 2342961 - RNA, 17 nt, Human
cuacaaaaacacagcaa

SEQ ID NO: 2342962 - RNA, 16 nt, Human
cuacaaaaacacagca

SEQ ID NO: 2342963 - RNA, 13 nt, Human
cuacaguguacag

SEQ ID NO: 2342964 - RNA, 21 nt, Human
cuacagugguuuuauacugaa

SEQ ID NO: 2342965 - RNA, 20 nt, Human
cuacaguuggaaauccaucc

SEQ ID NO: 2342966 - RNA, 22 nt, Human
cuacaguugaaaaacagcugag

SEQ ID NO: 2342967 - RNA, 22 nt, Human
cuacaguuguuuuuugaaaaca

SEQ ID NO: 2342968 - RNA, 20 nt, Human
cuacaguuguuuuuugaaaa

SEQ ID NO: 2342969 - RNA, 21 nt, Human
cuacaguuggaaauccaucca

SEQ ID NO: 2342970 - RNA, 22 nt, Human
cuacaguuggaaauccauccag

SEQ ID NO: 2342971 - RNA, 18 nt, Human
cuacauacuauggaauuu

SEQ ID NO: 2342972 - RNA, 21 nt, Human
cuacaguugaaaaacagcuga

SEQ ID NO: 2342973 - RNA, 19 nt, Human
cuacaguugaaaaacagcu

SEQ ID NO: 2342974 - RNA, 20 nt, Human
cuacaguccucccaucucac

SEQ ID NO: 2342975 - RNA, 14 nt, Human
cuaauuucuccucc

SEQ ID NO: 2342976 - RNA, 15 nt, Human
cuaauuucuccuccc

SEQ ID NO: 2342977 - RNA, 14 nt, Human
cuacagugguuuua

SEQ ID NO: 2342978 - RNA, 16 nt, Human
cuacagugguuuuaua

SEQ ID NO: 2342979 - RNA, 23 nt, Human
cuacaugcagcccaugcccaccu

SEQ ID NO: 2342980 - RNA, 21 nt, Human
cuacaugcagcccaugcccac

SEQ ID NO: 2342981 - RNA, 17 nt, Human
cuacaugcagcccaugc

SEQ ID NO: 2342982 - RNA, 15 nt, Human
cuacaugcagcccau

SEQ ID NO: 2342983 - RNA, 14 nt, Human
cuacaugcagccca

SEQ ID NO: 2342984 - RNA, 18 nt, Human
cuacaucuuuuuucacaa

SEQ ID NO: 2342985 - RNA, 22 nt, Human
cuacaugaucuagagccaguua

SEQ ID NO: 2342986 - RNA, 13 nt, Human
cuacaugaaacag

SEQ ID NO: 2342987 - RNA, 16 nt, Human
cuaccuggucucuccu

SEQ ID NO: 2342988 - RNA, 19 nt, Human
cuaccugcucuccaagucu

SEQ ID NO: 2342989 - RNA, 12 nt, Human
cuaccugcucuc

SEQ ID NO: 2342990 - RNA, 19 nt, Human
cuaccugccacucacacag

SEQ ID NO: 2342991 - RNA, 22 nt, Human
cuaccugccacucacacagcca

SEQ ID NO: 2342992 - RNA, 14 nt, Human
cuaccugccacuca

SEQ ID NO: 2342993 - RNA, 15 nt, Human
cuaccugccacucac

SEQ ID NO: 2342994 - RNA, 16 nt, Human
cuaccugccacucaca

SEQ ID NO: 2342995 - RNA, 17 nt, Human
cuacaucgcccuccaca

SEQ ID NO: 2342996 - RNA, 15 nt, Human
cuacaucgcccucca

SEQ ID NO: 2342997 - RNA, 23 nt, Human
cuacauacuuucauccugacucu

SEQ ID NO: 2342998 - RNA, 10 nt, Human
cuacaugaaa

SEQ ID NO: 2342999 - RNA, 16 nt, Human
cuacaucuucugccuu

SEQ ID NO: 2343000 - RNA, 14 nt, Human
cuacaucuucugcc

SEQ ID NO: 2343001 - RNA, 15 nt, Human
cuacaucuucugccu

SEQ ID NO: 2343002 - RNA, 18 nt, Human
cuacaugagguacugaga

SEQ ID NO: 2343003 - RNA, 20 nt, Human
cuacaugagguacugagagu

SEQ ID NO: 2343004 - RNA, 12 nt, Human
cuaccugugccu

SEQ ID NO: 2343005 - RNA, 13 nt, Human
cuaccugugccug

SEQ ID NO: 2343006 - RNA, 15 nt, Human
cuaccugcucuccaa

SEQ ID NO: 2343007 - RNA, 19 nt, Human
cuaccuuaaaauguaaaac

SEQ ID NO: 2343008 - RNA, 21 nt, Human
cuaccuguucagugucccggg

SEQ ID NO: 2343009 - RNA, 22 nt, Human
cuaccuguucagugucccgggc

SEQ ID NO: 2343010 - RNA, 16 nt, Human
cuaccuguucaguguc

SEQ ID NO: 2343011 - RNA, 20 nt, Human
cuaccuguucagugucccgg

SEQ ID NO: 2343012 - RNA, 14 nt, Human
cuacgcucuccuuu

SEQ ID NO: 2343013 - RNA, 14 nt, Human
cuacgccugcaugu

SEQ ID NO: 2343014 - RNA, 15 nt, Human
cuacgccaaucaagg

SEQ ID NO: 2343015 - RNA, 17 nt, Human
cuaccuuuguauucucu

SEQ ID NO: 2343016 - RNA, 21 nt, Human
cuacgcucuccuuucuuucua

SEQ ID NO: 2343017 - RNA, 13 nt, Human
cuacgccugccuc

SEQ ID NO: 2343018 - RNA, 22 nt, Human
cuacgcugaagauggcauccug

SEQ ID NO: 2343019 - RNA, 13 nt, Human
cuacgugugauuu

SEQ ID NO: 2343020 - RNA, 17 nt, Human
cuacguacaugugaggc

SEQ ID NO: 2343021 - RNA, 17 nt, Human
cuacguuaccaggcagg

SEQ ID NO: 2343022 - RNA, 14 nt, Human
cuacgugugauuuu

SEQ ID NO: 2343023 - RNA, 18 nt, Human
cuacgugugauuuuucug

SEQ ID NO: 2343024 - RNA, 16 nt, Human
cuacguuaagggaagg

SEQ ID NO: 2343025 - RNA, 19 nt, Human
cuacguuccuauugucauu

SEQ ID NO: 2343026 - RNA, 21 nt, Human
cuacucagaagccugaggcug

SEQ ID NO: 2343027 - RNA, 19 nt, Human
cuacucagaagccugaggc

SEQ ID NO: 2343028 - RNA, 17 nt, Human
cuacucagaagccugag

SEQ ID NO: 2343029 - RNA, 16 nt, Human
cuacucagaagccuga

SEQ ID NO: 2343030 - RNA, 13 nt, Human
cuacucagaagcc

SEQ ID NO: 2343031 - RNA, 15 nt, Human
cgcaggaagcugcuc

SEQ ID NO: 2343032 - RNA, 13 nt, Human
cgcaggaagcugc

SEQ ID NO: 2343033 - RNA, 24 nt, Human
cgaucacaacgugcauugugcuuc

SEQ ID NO: 2343034 - RNA, 15 nt, Human
cgauccaccugucuc

SEQ ID NO: 2343035 - RNA, 22 nt, Human
cgaucacaacgugcauugugcu

SEQ ID NO: 2343036 - RNA, 23 nt, Human
cgaucacaacgugcauugugcuu

SEQ ID NO: 2343037 - RNA, 22 nt, Human
cgcaggauucuuccucccuccc

SEQ ID NO: 2343038 - RNA, 18 nt, Human
cgcaggcccccaggugcc

SEQ ID NO: 2343039 - RNA, 13 nt, Human
cgcauucccugag

SEQ ID NO: 2343040 - RNA, 23 nt, Human
cgcauggaguguguauuguuccc

SEQ ID NO: 2343041 - RNA, 13 nt, Human
cgcauucucaugg

SEQ ID NO: 2343042 - RNA, 12 nt, Human
cgcauucccuga

SEQ ID NO: 2343043 - RNA, 19 nt, Human
cgcauggucacacacugau

SEQ ID NO: 2343044 - RNA, 14 nt, Human
cgcaugcggcccag

SEQ ID NO: 2343045 - RNA, 16 nt, Human
cgcaugcggcccagga

SEQ ID NO: 2343046 - RNA, 22 nt, Human
cgcauggaguguguauuguucc

SEQ ID NO: 2343047 - RNA, 18 nt, Human
cgcauggaguguguauug

SEQ ID NO: 2343048 - RNA, 16 nt, Human
cgcauggucacacacu

SEQ ID NO: 2343049 - RNA, 15 nt, Human
cgcaugcccucaauc

SEQ ID NO: 2343050 - RNA, 22 nt, Human
cgcaugcccccucgugccaguc

SEQ ID NO: 2343051 - RNA, 20 nt, Human
cgcaugcccccucgugccag

SEQ ID NO: 2343052 - RNA, 21 nt, Human
cgcaugcccccucgugccagu

SEQ ID NO: 2343053 - RNA, 13 nt, Human
cgcaugcccccuc

SEQ ID NO: 2343054 - RNA, 14 nt, Human
cgcaugcccccucg

SEQ ID NO: 2343055 - RNA, 16 nt, Human
cgcaugcccccucgug

SEQ ID NO: 2343056 - RNA, 18 nt, Human
cgcaugcccccucgugcc

SEQ ID NO: 2343057 - RNA, 18 nt, Human
cgcaggcgggaaaagcag

SEQ ID NO: 2343058 - RNA, 13 nt, Human
cgcaggcuggccc

SEQ ID NO: 2343059 - RNA, 14 nt, Human
cgagucacugccuc

SEQ ID NO: 2343060 - RNA, 12 nt, Human
cgagucacugcc

SEQ ID NO: 2343061 - RNA, 20 nt, Human
cgagucaauccccucauuca

SEQ ID NO: 2343062 - RNA, 16 nt, Human
cgagucaauccccuca

SEQ ID NO: 2343063 - RNA, 20 nt, Human
cgagucaaaacucaaaugcu

SEQ ID NO: 2343064 - RNA, 13 nt, Human
cgaguauguguuu

SEQ ID NO: 2343065 - RNA, 21 nt, Human
cgaguauguguuugugugugu

SEQ ID NO: 2343066 - RNA, 18 nt, Human
cgagucacugccucuccc

SEQ ID NO: 2343067 - RNA, 15 nt, Human
cgagucacugccucu

SEQ ID NO: 2343068 - RNA, 22 nt, Human
cgagucacugccucucccuggc

SEQ ID NO: 2343069 - RNA, 19 nt, Human
cgagucauucguucugugg

SEQ ID NO: 2343070 - RNA, 18 nt, Human
cgagucauucguucugug

SEQ ID NO: 2343071 - RNA, 14 nt, Human
cgauagugguggug

SEQ ID NO: 2343072 - RNA, 15 nt, Human
cgaguccaagcuggg

SEQ ID NO: 2343073 - RNA, 14 nt, Human
cgaguccaagcugg

SEQ ID NO: 2343074 - RNA, 13 nt, Human
cgaguccaagcug

SEQ ID NO: 2343075 - RNA, 20 nt, Human
cgagucauucguucugugga

SEQ ID NO: 2343076 - RNA, 18 nt, Human
cgaucacaacgugcauug

SEQ ID NO: 2343077 - RNA, 15 nt, Human
cgauauacucuagau

SEQ ID NO: 2343078 - RNA, 13 nt, Human
cgccucccacugg

SEQ ID NO: 2343079 - RNA, 21 nt, Human
cgccuccauuuuuguuguuau

SEQ ID NO: 2343080 - RNA, 16 nt, Human
cgccuccauccaaggc

SEQ ID NO: 2343081 - RNA, 18 nt, Human
cgccuccauccaaggcca

SEQ ID NO: 2343082 - RNA, 14 nt, Human
cgccucccacuggg

SEQ ID NO: 2343083 - RNA, 19 nt, Human
cgccucuucuucuucagaa

SEQ ID NO: 2343084 - RNA, 13 nt, Human
cgccucugcuggc

SEQ ID NO: 2343085 - RNA, 13 nt, Human
cgccucugcauuc

SEQ ID NO: 2343086 - RNA, 15 nt, Human
cgccucuuucaagca

SEQ ID NO: 2343087 - RNA, 20 nt, Human
cgccugacaaccacuggucu

SEQ ID NO: 2343088 - RNA, 21 nt, Human
cgccugacaaccacuggucug

SEQ ID NO: 2343089 - RNA, 23 nt, Human
cgccugacaaccacuggucugua

SEQ ID NO: 2343090 - RNA, 18 nt, Human
cgccugcaaacgcugccu

SEQ ID NO: 2343091 - RNA, 19 nt, Human
cgccugcaaacgcugccug

SEQ ID NO: 2343092 - RNA, 20 nt, Human
cgccugaggaacccuuacag

SEQ ID NO: 2343093 - RNA, 16 nt, Human
cgccugagcucacucg

SEQ ID NO: 2343094 - RNA, 20 nt, Human
cgccuggcagaacugagcuc

SEQ ID NO: 2343095 - RNA, 12 nt, Human
cgccuggccuga

SEQ ID NO: 2343096 - RNA, 11 nt, Human
cgccuggcaga

SEQ ID NO: 2343097 - RNA, 19 nt, Human
cgccuggcugcagccugcg

SEQ ID NO: 2343098 - RNA, 23 nt, Human
cgccacugcacuccagccugggc

SEQ ID NO: 2343099 - RNA, 22 nt, Human
cgccacugcacuccagccuggg

SEQ ID NO: 2343100 - RNA, 21 nt, Human
cgccacugcacuccagccugg

SEQ ID NO: 2343101 - RNA, 23 nt, Human
cgccacucgcuucccccauagcc

SEQ ID NO: 2343102 - RNA, 20 nt, Human
cgccacugcacuccggccug

SEQ ID NO: 2343103 - RNA, 15 nt, Human
cgccacucgcuuccc

SEQ ID NO: 2343104 - RNA, 21 nt, Human
cgccaacaacuucuccauccu

SEQ ID NO: 2343105 - RNA, 15 nt, Human
cgccacuccugaacc

SEQ ID NO: 2343106 - RNA, 22 nt, Human
cgccacuacacuccagccugag

SEQ ID NO: 2343107 - RNA, 17 nt, Human
cgccaaauaaugucucu

SEQ ID NO: 2343108 - RNA, 14 nt, Human
cgcauucucaugga

SEQ ID NO: 2343109 - RNA, 20 nt, Human
cgcauucucauggagaaguu

SEQ ID NO: 2343110 - RNA, 19 nt, Human
cgccaaauaaugucucugu

SEQ ID NO: 2343111 - RNA, 19 nt, Human
cgccaagcaaccugggucc

SEQ ID NO: 2343112 - RNA, 21 nt, Human
cgccacuacacuccagccuga

SEQ ID NO: 2343113 - RNA, 21 nt, Human
cgccuaguggggucucccucu

SEQ ID NO: 2343114 - RNA, 20 nt, Human
cgccuaguggggucucccuc

SEQ ID NO: 2343115 - RNA, 18 nt, Human
cgccagauggggccucug

SEQ ID NO: 2343116 - RNA, 15 nt, Human
cgccagauggggccu

SEQ ID NO: 2343117 - RNA, 22 nt, Human
cgccucaaugugguugcaaggc

SEQ ID NO: 2343118 - RNA, 17 nt, Human
cgccucaaugugguugc

SEQ ID NO: 2343119 - RNA, 16 nt, Human
cgccuaugaucccagc

SEQ ID NO: 2343120 - RNA, 17 nt, Human
cgccucaggaaugggcu

SEQ ID NO: 2343121 - RNA, 19 nt, Human
cgccucaggaaugggcugu

SEQ ID NO: 2343122 - RNA, 15 nt, Human
cgccucaguaagacg

SEQ ID NO: 2343123 - RNA, 13 nt, Human
cgccuccaggcca

SEQ ID NO: 2343124 - RNA, 14 nt, Human
ccuuuacggacacc

SEQ ID NO: 2343125 - RNA, 19 nt, Human
ccuuuacggacacccccuc

SEQ ID NO: 2343126 - RNA, 13 nt, Human
ccuuuaaugcauc

SEQ ID NO: 2343127 - RNA, 19 nt, Human
ccuuuacacucaggcuuuc

SEQ ID NO: 2343128 - RNA, 21 nt, Human
ccuuuacacauucggcucccu

SEQ ID NO: 2343129 - RNA, 23 nt, Human
ccuuuacacauucggcucccugg

SEQ ID NO: 2343130 - RNA, 15 nt, Human
ccuuuacuugaccuc

SEQ ID NO: 2343131 - RNA, 18 nt, Human
ccuuuacucauagcacuu

SEQ ID NO: 2343132 - RNA, 21 nt, Human
ccuuucaauaggaaaaacuga

SEQ ID NO: 2343133 - RNA, 22 nt, Human
ccuuucacaaaauuuuauuccu

SEQ ID NO: 2343134 - RNA, 21 nt, Human
ccuuucacaaaauuuuauucc

SEQ ID NO: 2343135 - RNA, 17 nt, Human
ccuuucaccccagggcc

SEQ ID NO: 2343136 - RNA, 15 nt, Human
ccuuucacaaccuuc

SEQ ID NO: 2343137 - RNA, 22 nt, Human
ccuuucagaugucuucugccug

SEQ ID NO: 2343138 - RNA, 20 nt, Human
ccuuucagaugucuucugcc

SEQ ID NO: 2343139 - RNA, 21 nt, Human
ccuuucagaugucuucugccu

SEQ ID NO: 2343140 - RNA, 13 nt, Human
ccuuucagauguc

SEQ ID NO: 2343141 - RNA, 14 nt, Human
ccuuucagaugucu

SEQ ID NO: 2343142 - RNA, 17 nt, Human
ccuuucagaugucuucu

SEQ ID NO: 2343143 - RNA, 19 nt, Human
ccuuucagaugucuucugc

SEQ ID NO: 2343144 - RNA, 21 nt, Human
ccuuucaccccagggccugag

SEQ ID NO: 2343145 - RNA, 19 nt, Human
ccuuucaccccagggccug

SEQ ID NO: 2343146 - RNA, 16 nt, Human
ccuuuugcaccccucc

SEQ ID NO: 2343147 - RNA, 14 nt, Human
ccuuuuuacucccc

SEQ ID NO: 2343148 - RNA, 12 nt, Human
ccuuuugcaccc

SEQ ID NO: 2343149 - RNA, 14 nt, Human
ccuuuugcaccccu

SEQ ID NO: 2343150 - RNA, 15 nt, Human
ccuuuugcaccccuc

SEQ ID NO: 2343151 - RNA, 17 nt, Human
ccuuuugagugccuuac

SEQ ID NO: 2343152 - RNA, 15 nt, Human
ccuuuugagugccuu

SEQ ID NO: 2343153 - RNA, 16 nt, Human
ccuuuugaggagcccc

SEQ ID NO: 2343154 - RNA, 21 nt, Human
ccuuuugaggagccccagcua

SEQ ID NO: 2343155 - RNA, 23 nt, Human
ccuuuugaggagccccagcuacc

SEQ ID NO: 2343156 - RNA, 20 nt, Human
ccuuucagggaauuucagga

SEQ ID NO: 2343157 - RNA, 12 nt, Human
ccuuucauauuu

SEQ ID NO: 2343158 - RNA, 14 nt, Human
ccuuucauuuacug

SEQ ID NO: 2343159 - RNA, 16 nt, Human
ccuuucauuuacugug

SEQ ID NO: 2343160 - RNA, 12 nt, Human
ccuuucagggaa

SEQ ID NO: 2343161 - RNA, 15 nt, Human
ccuuucagcugugaa

SEQ ID NO: 2343162 - RNA, 12 nt, Human
ccuuucagcugu

SEQ ID NO: 2343163 - RNA, 16 nt, Human
ccuuuccaaggcuucu

SEQ ID NO: 2343164 - RNA, 22 nt, Human
ccuuucauuuacuguggcuucu

SEQ ID NO: 2343165 - RNA, 18 nt, Human
ccuuucauuuacuguggc

SEQ ID NO: 2343166 - RNA, 19 nt, Human
ccuuucauuuacuguggcu

SEQ ID NO: 2343167 - RNA, 21 nt, Human
ccuugcccagggcucagccug

SEQ ID NO: 2343168 - RNA, 19 nt, Human
ccuugcccggauucuggga

SEQ ID NO: 2343169 - RNA, 18 nt, Human
ccuugcccggauucuggg

SEQ ID NO: 2343170 - RNA, 22 nt, Human
ccuugcccagggcucagccugg

SEQ ID NO: 2343171 - RNA, 22 nt, Human
ccuugcucuccccugcccugcu

SEQ ID NO: 2343172 - RNA, 18 nt, Human
ccuugcccuugcccugac

SEQ ID NO: 2343173 - RNA, 13 nt, Human
ccuugcucucccu

SEQ ID NO: 2343174 - RNA, 14 nt, Human
ccuugcucucccuc

SEQ ID NO: 2343175 - RNA, 15 nt, Human
ccuugcucucccucu

SEQ ID NO: 2343176 - RNA, 17 nt, Human
ccuugcucucccucuuc

SEQ ID NO: 2343177 - RNA, 18 nt, Human
ccuugcucucccucuucu

SEQ ID NO: 2343178 - RNA, 20 nt, Human
ccuugcucuccccugcccug

SEQ ID NO: 2343179 - RNA, 23 nt, Human
ccuugcccugaccucccagcccu

SEQ ID NO: 2343180 - RNA, 15 nt, Human
ccuugcccuugcccu

SEQ ID NO: 2343181 - RNA, 16 nt, Human
ccuugcccuugcccug

SEQ ID NO: 2343182 - RNA, 17 nt, Human
ccuugcccuugcccuga

SEQ ID NO: 2343183 - RNA, 16 nt, Human
ccuugccgucuaccug

SEQ ID NO: 2343184 - RNA, 12 nt, Human
ccuugcccugac

SEQ ID NO: 2343185 - RNA, 13 nt, Human
ccuugcccugacc

SEQ ID NO: 2343186 - RNA, 14 nt, Human
ccuugcccugaccu

SEQ ID NO: 2343187 - RNA, 15 nt, Human
ccuugcccugaccuc

SEQ ID NO: 2343188 - RNA, 16 nt, Human
ccuugcccugaccucc

SEQ ID NO: 2343189 - RNA, 19 nt, Human
ccuugcccugaccucccag

SEQ ID NO: 2343190 - RNA, 22 nt, Human
ccuugcccugaccucccagccc

SEQ ID NO: 2343191 - RNA, 16 nt, Human
ccuugcuguccuaggc

SEQ ID NO: 2343192 - RNA, 17 nt, Human
ccuugcucugcaggcac

SEQ ID NO: 2343193 - RNA, 17 nt, Human
ccuugcuggaaaaccca

SEQ ID NO: 2343194 - RNA, 21 nt, Human
ccuugcugguuuucuggaugg

SEQ ID NO: 2343195 - RNA, 19 nt, Human
ccuugcucucccucuucuc

SEQ ID NO: 2343196 - RNA, 13 nt, Human
ccuugcucugcac

SEQ ID NO: 2343197 - RNA, 22 nt, Human
ccuugcuugcugccuucuggau

SEQ ID NO: 2343198 - RNA, 14 nt, Human
ccuuuaagagaaau

SEQ ID NO: 2343199 - RNA, 18 nt, Human
ccuugcuuaugacaucac

SEQ ID NO: 2343200 - RNA, 22 nt, Human
ccuugcuggacggggacugggg

SEQ ID NO: 2343201 - RNA, 15 nt, Human
cgacagcccccucug

SEQ ID NO: 2343202 - RNA, 16 nt, Human
cgacagagcgagacuu

SEQ ID NO: 2343203 - RNA, 12 nt, Human
cgacagccuggc

SEQ ID NO: 2343204 - RNA, 13 nt, Human
cgacagccuggca

SEQ ID NO: 2343205 - RNA, 22 nt, Human
cgacagagggaagaaaagagcu

SEQ ID NO: 2343206 - RNA, 14 nt, Human
cgacagccuggcac

SEQ ID NO: 2343207 - RNA, 19 nt, Human
cgaccccgucacagccuca

SEQ ID NO: 2343208 - RNA, 19 nt, Human
cgaccccaucugcccagga

SEQ ID NO: 2343209 - RNA, 18 nt, Human
cgaccccaucugcccagg

SEQ ID NO: 2343210 - RNA, 17 nt, Human
cgaauuuuucagaugau

SEQ ID NO: 2343211 - RNA, 15 nt, Human
cgacaaccgaugcuc

SEQ ID NO: 2343212 - RNA, 12 nt, Human
cgacaaugcaaa

SEQ ID NO: 2343213 - RNA, 21 nt, Human
cgacaaccgaugcuccagcca

SEQ ID NO: 2343214 - RNA, 18 nt, Human
cgacaaccgaugcuccag

SEQ ID NO: 2343215 - RNA, 12 nt, Human
cgacaagugcug

SEQ ID NO: 2343216 - RNA, 13 nt, Human
cgacaaugcaaac

SEQ ID NO: 2343217 - RNA, 17 nt, Human
ccuuuuuuaaaaaugca

SEQ ID NO: 2343218 - RNA, 13 nt, Human
ccuuuuuuaagau

SEQ ID NO: 2343219 - RNA, 14 nt, Human
ccuuuuuuaagauu

SEQ ID NO: 2343220 - RNA, 18 nt, Human
ccuuuuuuaagauuuuuc

SEQ ID NO: 2343221 - RNA, 19 nt, Human
ccuuuuuuaagauuuuucu

SEQ ID NO: 2343222 - RNA, 20 nt, Human
ccuuuuuuaagauuuuucuc

SEQ ID NO: 2343223 - RNA, 16 nt, Human
ccuuuuuuaaaaaugc

SEQ ID NO: 2343224 - RNA, 13 nt, Human
ccuuuuuuaaaaa

SEQ ID NO: 2343225 - RNA, 21 nt, Human
ccuuuuuuagaguugauacua

SEQ ID NO: 2343226 - RNA, 16 nt, Human
cgaauuuuaaaagaug

SEQ ID NO: 2343227 - RNA, 21 nt, Human
ccuuuuuuaagauuuuucuca

SEQ ID NO: 2343228 - RNA, 23 nt, Human
ccuuuuuacuccccuugagcuga

SEQ ID NO: 2343229 - RNA, 15 nt, Human
ccuuuuuacuccccu

SEQ ID NO: 2343230 - RNA, 22 nt, Human
ccuuuuucauauguugcucagu

SEQ ID NO: 2343231 - RNA, 21 nt, Human
ccuuuuugguacuuauuacug

SEQ ID NO: 2343232 - RNA, 23 nt, Human
ccuuuuugguacuuauuacugcu

SEQ ID NO: 2343233 - RNA, 13 nt, Human
ccuuuuugaagug

SEQ ID NO: 2343234 - RNA, 22 nt, Human
ccuuuuugaaguguaggcagac

SEQ ID NO: 2343235 - RNA, 17 nt, Human
ccuuuuuauuugcaugu

SEQ ID NO: 2343236 - RNA, 18 nt, Human
ccuuuuuauuugcaugug

SEQ ID NO: 2343237 - RNA, 17 nt, Human
cgacugccaucuuggac

SEQ ID NO: 2343238 - RNA, 16 nt, Human
cgacugcacagcggcc

SEQ ID NO: 2343239 - RNA, 17 nt, Human
cgacugcccggcagggu

SEQ ID NO: 2343240 - RNA, 15 nt, Human
cgacuggguuuaugu

SEQ ID NO: 2343241 - RNA, 20 nt, Human
cgacugcacagcggccccug

SEQ ID NO: 2343242 - RNA, 18 nt, Human
cgacucuauagacucuag

SEQ ID NO: 2343243 - RNA, 20 nt, Human
cgacucuauagacucuagga

SEQ ID NO: 2343244 - RNA, 16 nt, Human
cgacuccguuggccac

SEQ ID NO: 2343245 - RNA, 19 nt, Human
cgacuccguuggccacucc

SEQ ID NO: 2343246 - RNA, 13 nt, Human
cgacucugaccuc

SEQ ID NO: 2343247 - RNA, 13 nt, Human
cgacucagccuca

SEQ ID NO: 2343248 - RNA, 11 nt, Human
cgacucaggau

SEQ ID NO: 2343249 - RNA, 14 nt, Human
cgacuaauuucaaa

SEQ ID NO: 2343250 - RNA, 15 nt, Human
cgaccgaggcuggag

SEQ ID NO: 2343251 - RNA, 19 nt, Human
cgaccgaggcuggagcugg

SEQ ID NO: 2343252 - RNA, 12 nt, Human
cgaccuuuaccu

SEQ ID NO: 2343253 - RNA, 22 nt, Human
cgacggugggcauuugugaggc

SEQ ID NO: 2343254 - RNA, 15 nt, Human
cgacgcgucuccugu

SEQ ID NO: 2343255 - RNA, 19 nt, Human
cgacccuugccgucuaccu

SEQ ID NO: 2343256 - RNA, 20 nt, Human
cgacccuugccgucuaccug

SEQ ID NO: 2343257 - RNA, 23 nt, Human
cgggcgccuguagucccagccac

SEQ ID NO: 2343258 - RNA, 19 nt, Human
cgggcgagucacugccucu

SEQ ID NO: 2343259 - RNA, 17 nt, Human
cgggcgagucacugccu

SEQ ID NO: 2343260 - RNA, 11 nt, Human
cgggcucagca

SEQ ID NO: 2343261 - RNA, 20 nt, Human
cgggccaaggacugccgacc

SEQ ID NO: 2343262 - RNA, 14 nt, Human
cgggccaaggacug

SEQ ID NO: 2343263 - RNA, 12 nt, Human
cgggccaaggac

SEQ ID NO: 2343264 - RNA, 21 nt, Human
cgggcaugguggcgcaagccu

SEQ ID NO: 2343265 - RNA, 17 nt, Human
cgggccacagagaaagu

SEQ ID NO: 2343266 - RNA, 16 nt, Human
cgggcgcggccagccc

SEQ ID NO: 2343267 - RNA, 21 nt, Human
cgggcggucagggguucgaga

SEQ ID NO: 2343268 - RNA, 15 nt, Human
cgggcucagcaaaag

SEQ ID NO: 2343269 - RNA, 14 nt, Human
cgggcucugccucc

SEQ ID NO: 2343270 - RNA, 16 nt, Human
cgggcucugccuccca

SEQ ID NO: 2343271 - RNA, 14 nt, Human
cggggacagcuccu

SEQ ID NO: 2343272 - RNA, 14 nt, Human
cggggacagaggcc

SEQ ID NO: 2343273 - RNA, 16 nt, Human
cggggacagaggccug

SEQ ID NO: 2343274 - RNA, 17 nt, Human
cggggacagaggccugc

SEQ ID NO: 2343275 - RNA, 18 nt, Human
cggggacagaggccugcc

SEQ ID NO: 2343276 - RNA, 14 nt, Human
cgggcugcccugcc

SEQ ID NO: 2343277 - RNA, 17 nt, Human
cgggcgugguggcgggc

SEQ ID NO: 2343278 - RNA, 13 nt, Human
cgggcugccuggg

SEQ ID NO: 2343279 - RNA, 17 nt, Human
cgggcucugccucccau

SEQ ID NO: 2343280 - RNA, 16 nt, Human
cggugugggcuguguc

SEQ ID NO: 2343281 - RNA, 21 nt, Human
cggggacagaggccugcccgg

SEQ ID NO: 2343282 - RNA, 20 nt, Human
cgguguggugcagugugaaa

SEQ ID NO: 2343283 - RNA, 18 nt, Human
cgguguggagaagcggcu

SEQ ID NO: 2343284 - RNA, 15 nt, Human
cggggacagcuccuu

SEQ ID NO: 2343285 - RNA, 13 nt, Human
cgguguggagaag

SEQ ID NO: 2343286 - RNA, 15 nt, Human
cggaggccccaaagg

SEQ ID NO: 2343287 - RNA, 16 nt, Human
cggaggccacaugagu

SEQ ID NO: 2343288 - RNA, 19 nt, Human
cggaggccacaugaguccc

SEQ ID NO: 2343289 - RNA, 21 nt, Human
cggaggccacaugagucccag

SEQ ID NO: 2343290 - RNA, 14 nt, Human
cggaggccccaaag

SEQ ID NO: 2343291 - RNA, 12 nt, Human
cggcuccaggcu

SEQ ID NO: 2343292 - RNA, 16 nt, Human
cggcucacugcagccu

SEQ ID NO: 2343293 - RNA, 17 nt, Human
cggcucacugcagccuc

SEQ ID NO: 2343294 - RNA, 18 nt, Human
cggagucccaccuuggcu

SEQ ID NO: 2343295 - RNA, 20 nt, Human
cggagucccaccuuggcugc

SEQ ID NO: 2343296 - RNA, 15 nt, Human
cggcucacugcagcc

SEQ ID NO: 2343297 - RNA, 14 nt, Human
cggcucacugcagc

SEQ ID NO: 2343298 - RNA, 13 nt, Human
cggcuccaggcuc

SEQ ID NO: 2343299 - RNA, 14 nt, Human
cggcuccaggcucc

SEQ ID NO: 2343300 - RNA, 15 nt, Human
cggcuccaggcuccu

SEQ ID NO: 2343301 - RNA, 16 nt, Human
cggcuccaggcuccuu

SEQ ID NO: 2343302 - RNA, 12 nt, Human
cgggccacagag

SEQ ID NO: 2343303 - RNA, 14 nt, Human
cgggccacagagaa

SEQ ID NO: 2343304 - RNA, 14 nt, Human
cggcucccuggagc

SEQ ID NO: 2343305 - RNA, 20 nt, Human
cggcuccccauguguccugg

SEQ ID NO: 2343306 - RNA, 15 nt, Human
cggcuccccaugugu

SEQ ID NO: 2343307 - RNA, 17 nt, Human
cggcuccccaugugucc

SEQ ID NO: 2343308 - RNA, 13 nt, Human
cggagcuggcccc

SEQ ID NO: 2343309 - RNA, 16 nt, Human
cggagcuggccccgcc

SEQ ID NO: 2343310 - RNA, 21 nt, Human
cggagcuggccccgccgccug

SEQ ID NO: 2343311 - RNA, 16 nt, Human
cggagucccaccuugg

SEQ ID NO: 2343312 - RNA, 20 nt, Human
cggagcuaacacuggccccu

SEQ ID NO: 2343313 - RNA, 21 nt, Human
cggagcuaacacuggccccua

SEQ ID NO: 2343314 - RNA, 19 nt, Human
cggagcuaacacuggcccc

SEQ ID NO: 2343315 - RNA, 20 nt, Human
cgccuguaaucccagcacuu

SEQ ID NO: 2343316 - RNA, 17 nt, Human
cgccuguaaucccagca

SEQ ID NO: 2343317 - RNA, 16 nt, Human
cgccuguaaucccagc

SEQ ID NO: 2343318 - RNA, 20 nt, Human
cgccuguaaucccagcuacu

SEQ ID NO: 2343319 - RNA, 18 nt, Human
cgccuguaaucccagcag

SEQ ID NO: 2343320 - RNA, 18 nt, Human
cgccuguaaucccagcac

SEQ ID NO: 2343321 - RNA, 17 nt, Human
cgccuguaaucccagcu

SEQ ID NO: 2343322 - RNA, 15 nt, Human
cgccuguagucccag

SEQ ID NO: 2343323 - RNA, 18 nt, Human
cgccuguagucccagcca

SEQ ID NO: 2343324 - RNA, 13 nt, Human
cgcugauauaugu

SEQ ID NO: 2343325 - RNA, 12 nt, Human
cgcugaugcugg

SEQ ID NO: 2343326 - RNA, 13 nt, Human
cgcugaugcuggg

SEQ ID NO: 2343327 - RNA, 14 nt, Human
cgcugaugcugggc

SEQ ID NO: 2343328 - RNA, 16 nt, Human
cgcugaugcugggcug

SEQ ID NO: 2343329 - RNA, 17 nt, Human
cgcugaugcugggcugg

SEQ ID NO: 2343330 - RNA, 19 nt, Human
cgcugcaaccuguugauag

SEQ ID NO: 2343331 - RNA, 16 nt, Human
cgcugauucucagggu

SEQ ID NO: 2343332 - RNA, 23 nt, Human
cgcugauucucagggucucugcu

SEQ ID NO: 2343333 - RNA, 14 nt, Human
cgcugauucucagg

SEQ ID NO: 2343334 - RNA, 19 nt, Human
cgcugaugcugggcugggu

SEQ ID NO: 2343335 - RNA, 21 nt, Human
cgcugaugcugggcugggugc

SEQ ID NO: 2343336 - RNA, 18 nt, Human
cgcugcccaggggagccc

SEQ ID NO: 2343337 - RNA, 20 nt, Human
cgcugccacccaccucccug

SEQ ID NO: 2343338 - RNA, 17 nt, Human
cgcugccacccaccucc

SEQ ID NO: 2343339 - RNA, 16 nt, Human
cgcugccacccaccuc

SEQ ID NO: 2343340 - RNA, 19 nt, Human
cgcugccagcucuguauca

SEQ ID NO: 2343341 - RNA, 15 nt, Human
cgcugccagcucugu

SEQ ID NO: 2343342 - RNA, 22 nt, Human
cgugaucaaagccacacucugg

SEQ ID NO: 2343343 - RNA, 18 nt, Human
cgugauccacccaccucg

SEQ ID NO: 2343344 - RNA, 13 nt, Human
cgugaucuuggcu

SEQ ID NO: 2343345 - RNA, 22 nt, Human
cgugaucucggcucacugcaac

SEQ ID NO: 2343346 - RNA, 18 nt, Human
cgugauuuugcuguagaa

SEQ ID NO: 2343347 - RNA, 20 nt, Human
cgugcaauuuguuugugcuu

SEQ ID NO: 2343348 - RNA, 23 nt, Human
cgugauguaggguaaggugccuu

SEQ ID NO: 2343349 - RNA, 17 nt, Human
cgugaugccucccuguu

SEQ ID NO: 2343350 - RNA, 14 nt, Human
cgugcacacaccag

SEQ ID NO: 2343351 - RNA, 20 nt, Human
cguguaaccauggacccaau

SEQ ID NO: 2343352 - RNA, 21 nt, Human
cguguggcaauagugggcccu

SEQ ID NO: 2343353 - RNA, 16 nt, Human
cgugugcgugcaugug

SEQ ID NO: 2343354 - RNA, 12 nt, Human
cguguaaaccaa

SEQ ID NO: 2343355 - RNA, 15 nt, Human
cguguaaaccaaagc

SEQ ID NO: 2343356 - RNA, 19 nt, Human
cgugguguuauuuaaagaa

SEQ ID NO: 2343357 - RNA, 18 nt, Human
cgugguguuauuuaaaga

SEQ ID NO: 2343358 - RNA, 21 nt, Human
cgugguggaagaggggacagg

SEQ ID NO: 2343359 - RNA, 17 nt, Human
cgugaguccuggcaugg

SEQ ID NO: 2343360 - RNA, 17 nt, Human
cgugaggccagagacac

SEQ ID NO: 2343361 - RNA, 16 nt, Human
cgugaguccuggcaug

SEQ ID NO: 2343362 - RNA, 16 nt, Human
cgguuuuacugcagcu

SEQ ID NO: 2343363 - RNA, 21 nt, Human
cgguuuggggagcagagacac

SEQ ID NO: 2343364 - RNA, 15 nt, Human
cgguuugaagccugg

SEQ ID NO: 2343365 - RNA, 11 nt, Human
cgguuucucca

SEQ ID NO: 2343366 - RNA, 23 nt, Human
cgguguuuaagacauuuuuggaa

SEQ ID NO: 2343367 - RNA, 18 nt, Human
cgguguggugcaguguga

SEQ ID NO: 2343368 - RNA, 14 nt, Human
cguaaaauuaagaa

SEQ ID NO: 2343369 - RNA, 17 nt, Human
ccagcuacaccuuucuc

SEQ ID NO: 2343370 - RNA, 12 nt, Human
ccagcucacccc

SEQ ID NO: 2343371 - RNA, 13 nt, Human
ccagcucaccccc

SEQ ID NO: 2343372 - RNA, 17 nt, Human
ccagcucaccccccaca

SEQ ID NO: 2343373 - RNA, 19 nt, Human
ccagcucaccccccacacu

SEQ ID NO: 2343374 - RNA, 23 nt, Human
ccagcucaccccccacacucacu

SEQ ID NO: 2343375 - RNA, 13 nt, Human
ccagcucagaggg

SEQ ID NO: 2343376 - RNA, 14 nt, Human
ccagcucacgucac

SEQ ID NO: 2343377 - RNA, 14 nt, Human
ccagcucaccccug

SEQ ID NO: 2343378 - RNA, 19 nt, Human
ccagcucaccccuggagga

SEQ ID NO: 2343379 - RNA, 15 nt, Human
ccagcucacgucaca

SEQ ID NO: 2343380 - RNA, 19 nt, Human
ccagcucaggacagaugcc

SEQ ID NO: 2343381 - RNA, 13 nt, Human
ccagcucaggaca

SEQ ID NO: 2343382 - RNA, 15 nt, Human
ccagcucagucccau

SEQ ID NO: 2343383 - RNA, 20 nt, Human
ccagcucaggacagaugcca

SEQ ID NO: 2343384 - RNA, 23 nt, Human
ccagcucaggacagaugccacac

SEQ ID NO: 2343385 - RNA, 23 nt, Human
ccagcuaaggacauuucccaggg

SEQ ID NO: 2343386 - RNA, 21 nt, Human
ccagcuaaggacauuucccag

SEQ ID NO: 2343387 - RNA, 19 nt, Human
ccagcuaagaaccuggaac

SEQ ID NO: 2343388 - RNA, 18 nt, Human
ccagcuaagaaccuggaa

SEQ ID NO: 2343389 - RNA, 17 nt, Human
ccagcuaagaaccugga

SEQ ID NO: 2343390 - RNA, 17 nt, Human
ccagcuaaucuguaggg

SEQ ID NO: 2343391 - RNA, 20 nt, Human
ccagcuaaucuguagggcug

SEQ ID NO: 2343392 - RNA, 21 nt, Human
ccagcuaaucuguagggcugg

SEQ ID NO: 2343393 - RNA, 22 nt, Human
ccagcuaaucuguagggcugga

SEQ ID NO: 2343394 - RNA, 23 nt, Human
ccagcuaaucuguagggcuggac

SEQ ID NO: 2343395 - RNA, 15 nt, Human
ccagcuaagaaccug

SEQ ID NO: 2343396 - RNA, 14 nt, Human
ccagcuaagaaccu

SEQ ID NO: 2343397 - RNA, 13 nt, Human
ccagcuaagaacc

SEQ ID NO: 2343398 - RNA, 22 nt, Human
ccagcguuugaggggcuggccu

SEQ ID NO: 2343399 - RNA, 17 nt, Human
ccagcguuugaggggcu

SEQ ID NO: 2343400 - RNA, 16 nt, Human
ccagccccuucucaga

SEQ ID NO: 2343401 - RNA, 21 nt, Human
ccagccccuucucagaaucua

SEQ ID NO: 2343402 - RNA, 19 nt, Human
ccagcguccuccucuguga

SEQ ID NO: 2343403 - RNA, 21 nt, Human
ccagcagaucccagcucacgu

SEQ ID NO: 2343404 - RNA, 19 nt, Human
ccagcagaucccagcucac

SEQ ID NO: 2343405 - RNA, 13 nt, Human
ccagccccuggcc

SEQ ID NO: 2343406 - RNA, 21 nt, Human
ccagccccuggaugcagccuc

SEQ ID NO: 2343407 - RNA, 10 nt, Human
ccagccccuu

SEQ ID NO: 2343408 - RNA, 23 nt, Human
ccagccccuggccccaggaccug

SEQ ID NO: 2343409 - RNA, 21 nt, Human
ccagccccuggccccaggacc

SEQ ID NO: 2343410 - RNA, 19 nt, Human
ccagccccuguauggcacu

SEQ ID NO: 2343411 - RNA, 12 nt, Human
ccagccccugua

SEQ ID NO: 2343412 - RNA, 14 nt, Human
ccagcagccuggac

SEQ ID NO: 2343413 - RNA, 15 nt, Human
ccagcagccuggacc

SEQ ID NO: 2343414 - RNA, 20 nt, Human
ccagcagccuggacccugug

SEQ ID NO: 2343415 - RNA, 19 nt, Human
ccagcagccuggacccugu

SEQ ID NO: 2343416 - RNA, 22 nt, Human
ccaggaacacccgacuccucaa

SEQ ID NO: 2343417 - RNA, 16 nt, Human
ccaggaaaugugcaca

SEQ ID NO: 2343418 - RNA, 21 nt, Human
ccaggaacaaucgauggccuu

SEQ ID NO: 2343419 - RNA, 22 nt, Human
ccagcucagucccaucagagag

SEQ ID NO: 2343420 - RNA, 16 nt, Human
ccagcuuaucucaggg

SEQ ID NO: 2343421 - RNA, 14 nt, Human
ccagcuucuccagg

SEQ ID NO: 2343422 - RNA, 15 nt, Human
ccagcuucuccaggc

SEQ ID NO: 2343423 - RNA, 16 nt, Human
ccagcuucuccaggcu

SEQ ID NO: 2343424 - RNA, 17 nt, Human
ccagcuucuccaggcuc

SEQ ID NO: 2343425 - RNA, 18 nt, Human
ccagcuucuccaggcucu

SEQ ID NO: 2343426 - RNA, 21 nt, Human
ccagcuucugguacucuccua

SEQ ID NO: 2343427 - RNA, 22 nt, Human
ccagcuucugguacucuccuag

SEQ ID NO: 2343428 - RNA, 23 nt, Human
ccagcuucugguacucuccuaga

SEQ ID NO: 2343429 - RNA, 18 nt, Human
ccagcuugaaaccuucac

SEQ ID NO: 2343430 - RNA, 21 nt, Human
ccaggaaaggcuccaggagca

SEQ ID NO: 2343431 - RNA, 22 nt, Human
ccaggaaaggcuccaggagcag

SEQ ID NO: 2343432 - RNA, 23 nt, Human
ccaggaaaggcuccaggagcagc

SEQ ID NO: 2343433 - RNA, 17 nt, Human
ccacucuccccacacua

SEQ ID NO: 2343434 - RNA, 20 nt, Human
ccacucucccccacccccuc

SEQ ID NO: 2343435 - RNA, 12 nt, Human
ccacucuccuug

SEQ ID NO: 2343436 - RNA, 21 nt, Human
ccacucuccuugcuacccaga

SEQ ID NO: 2343437 - RNA, 16 nt, Human
ccacucugccucugcc

SEQ ID NO: 2343438 - RNA, 14 nt, Human
ccacucugccucug

SEQ ID NO: 2343439 - RNA, 23 nt, Human
ccacucuccuugcuacccagaaa

SEQ ID NO: 2343440 - RNA, 21 nt, Human
ccacucugcucgccuuagcac

SEQ ID NO: 2343441 - RNA, 13 nt, Human
ccacucugcuucu

SEQ ID NO: 2343442 - RNA, 14 nt, Human
ccacucugcuucuc

SEQ ID NO: 2343443 - RNA, 17 nt, Human
ccacucugcuucucuga

SEQ ID NO: 2343444 - RNA, 19 nt, Human
ccacucugcuucucugacu

SEQ ID NO: 2343445 - RNA, 20 nt, Human
ccacucugcuucucugacuu

SEQ ID NO: 2343446 - RNA, 21 nt, Human
ccacucugcuuugacugagca

SEQ ID NO: 2343447 - RNA, 18 nt, Human
ccagcagaucccagcuca

SEQ ID NO: 2343448 - RNA, 17 nt, Human
ccagcagaucccagcuc

SEQ ID NO: 2343449 - RNA, 16 nt, Human
ccagcagaucccagcu

SEQ ID NO: 2343450 - RNA, 15 nt, Human
ccagcagaucccagc

SEQ ID NO: 2343451 - RNA, 23 nt, Human
ccagcagagcaccuuagacaguc

SEQ ID NO: 2343452 - RNA, 19 nt, Human
ccagcagagcaccuuagac

SEQ ID NO: 2343453 - RNA, 16 nt, Human
ccaggauugaagagca

SEQ ID NO: 2343454 - RNA, 17 nt, Human
ccaggauugaagagcau

SEQ ID NO: 2343455 - RNA, 18 nt, Human
ccaggauugaagagcauu

SEQ ID NO: 2343456 - RNA, 23 nt, Human
ccaggauuuuaacaaaagcaaga

SEQ ID NO: 2343457 - RNA, 17 nt, Human
ccaggcaacuugggaac

SEQ ID NO: 2343458 - RNA, 19 nt, Human
ccaggcaaaucaguuacua

SEQ ID NO: 2343459 - RNA, 20 nt, Human
ccaggauuuuaacaaaagca

SEQ ID NO: 2343460 - RNA, 12 nt, Human
ccaggcaaauca

SEQ ID NO: 2343461 - RNA, 13 nt, Human
ccaggcugggaga

SEQ ID NO: 2343462 - RNA, 14 nt, Human
ccaggcugggagag

SEQ ID NO: 2343463 - RNA, 21 nt, Human
ccaggaguguggccacguggg

SEQ ID NO: 2343464 - RNA, 20 nt, Human
ccaggaguucgaggcugcag

SEQ ID NO: 2343465 - RNA, 23 nt, Human
ccaggauggcccuucccacugga

SEQ ID NO: 2343466 - RNA, 22 nt, Human
ccaggauguacaaggacagccc

SEQ ID NO: 2343467 - RNA, 18 nt, Human
ccaggaggucgaccccaa

SEQ ID NO: 2343468 - RNA, 19 nt, Human
ccaggagggcacuggagcu

SEQ ID NO: 2343469 - RNA, 22 nt, Human
ccaggagguggcuauggccacc

SEQ ID NO: 2343470 - RNA, 16 nt, Human
ccaggagggcacugga

SEQ ID NO: 2343471 - RNA, 17 nt, Human
ccaggagggcacuggag

SEQ ID NO: 2343472 - RNA, 20 nt, Human
ccaggagggcacuggagcug

SEQ ID NO: 2343473 - RNA, 15 nt, Human
ccaggcacacacugu

SEQ ID NO: 2343474 - RNA, 16 nt, Human
ccaggcacacacugug

SEQ ID NO: 2343475 - RNA, 22 nt, Human
ccaggcugggagagccuuccag

SEQ ID NO: 2343476 - RNA, 20 nt, Human
ccaggggcugcuuccuccug

SEQ ID NO: 2343477 - RNA, 21 nt, Human
ccaggggcugcuuccuccugg

SEQ ID NO: 2343478 - RNA, 22 nt, Human
ccaggggcugcuuccuccugga

SEQ ID NO: 2343479 - RNA, 23 nt, Human
ccaggggcugcuuccuccuggaa

SEQ ID NO: 2343480 - RNA, 15 nt, Human
ccaggcugggagagc

SEQ ID NO: 2343481 - RNA, 17 nt, Human
ccaggcugggagagccu

SEQ ID NO: 2343482 - RNA, 18 nt, Human
ccaggcugggagagccuu

SEQ ID NO: 2343483 - RNA, 21 nt, Human
ccaggcugggagagccuucca

SEQ ID NO: 2343484 - RNA, 12 nt, Human
ccagucagccuc

SEQ ID NO: 2343485 - RNA, 13 nt, Human
ccagucagccucu

SEQ ID NO: 2343486 - RNA, 14 nt, Human
ccagucagccucuc

SEQ ID NO: 2343487 - RNA, 15 nt, Human
ccagucagccucucu

SEQ ID NO: 2343488 - RNA, 17 nt, Human
ccagucagccucucucc

SEQ ID NO: 2343489 - RNA, 18 nt, Human
ccagucagccucucuccc

SEQ ID NO: 2343490 - RNA, 19 nt, Human
ccagucagccucucuccca

SEQ ID NO: 2343491 - RNA, 20 nt, Human
ccagucagccucucucccag

SEQ ID NO: 2343492 - RNA, 22 nt, Human
ccagucagccucucucccaguc

SEQ ID NO: 2343493 - RNA, 23 nt, Human
ccagucagccucucucccagucu

SEQ ID NO: 2343494 - RNA, 14 nt, Human
ccagucccaggggc

SEQ ID NO: 2343495 - RNA, 15 nt, Human
ccaguccccaccccu

SEQ ID NO: 2343496 - RNA, 16 nt, Human
ccaguccccaccccug

SEQ ID NO: 2343497 - RNA, 17 nt, Human
ccaguccccaccccugc

SEQ ID NO: 2343498 - RNA, 18 nt, Human
ccaguccccaccccugcc

SEQ ID NO: 2343499 - RNA, 19 nt, Human
ccaguccccaccccugccc

SEQ ID NO: 2343500 - RNA, 21 nt, Human
ccaguccccaccccugccccc

SEQ ID NO: 2343501 - RNA, 22 nt, Human
ccaguccccaccccugccccca

SEQ ID NO: 2343502 - RNA, 14 nt, Human
ccagucccccugcc

SEQ ID NO: 2343503 - RNA, 17 nt, Human
ccaguccccccacccuc

SEQ ID NO: 2343504 - RNA, 15 nt, Human
ccagucccccaaccc

SEQ ID NO: 2343505 - RNA, 16 nt, Human
ccagucccccaacccc

SEQ ID NO: 2343506 - RNA, 20 nt, Human
ccagucccccaaccccagcc

SEQ ID NO: 2343507 - RNA, 21 nt, Human
ccagucccccaaccccagccg

SEQ ID NO: 2343508 - RNA, 23 nt, Human
ccagucccccaaccccagccgcu

SEQ ID NO: 2343509 - RNA, 15 nt, Human
ccaguccccccaccc

SEQ ID NO: 2343510 - RNA, 12 nt, Human
ccagucaccccg

SEQ ID NO: 2343511 - RNA, 13 nt, Human
ccagucaccccgg

SEQ ID NO: 2343512 - RNA, 20 nt, Human
ccagucaccccggccaccug

SEQ ID NO: 2343513 - RNA, 21 nt, Human
ccagucaccccggccaccugc

SEQ ID NO: 2343514 - RNA, 22 nt, Human
ccagggggccagucccugaggc

SEQ ID NO: 2343515 - RNA, 20 nt, Human
ccagggggacuagccccugu

SEQ ID NO: 2343516 - RNA, 23 nt, Human
ccagggggacuagccccugugga

SEQ ID NO: 2343517 - RNA, 14 nt, Human
ccaggggcuggcuu

SEQ ID NO: 2343518 - RNA, 21 nt, Human
ccaggggcuggcuucaggagg

SEQ ID NO: 2343519 - RNA, 19 nt, Human
ccaggggcuggcuucagga

SEQ ID NO: 2343520 - RNA, 17 nt, Human
ccagggggacuagcccc

SEQ ID NO: 2343521 - RNA, 18 nt, Human
ccagggggacuagccccu

SEQ ID NO: 2343522 - RNA, 19 nt, Human
ccagggggacuagccccug

SEQ ID NO: 2343523 - RNA, 14 nt, Human
ccagucaaccuggg

SEQ ID NO: 2343524 - RNA, 15 nt, Human
ccaggagggcacugg

SEQ ID NO: 2343525 - RNA, 22 nt, Human
ccauugaauucuugguugagga

SEQ ID NO: 2343526 - RNA, 13 nt, Human
ccauugaauucuu

SEQ ID NO: 2343527 - RNA, 22 nt, Human
ccauuuaaagcuuauuaaaacu

SEQ ID NO: 2343528 - RNA, 17 nt, Human
ccauugacauguacaga

SEQ ID NO: 2343529 - RNA, 15 nt, Human
ccauugacauguaca

SEQ ID NO: 2343530 - RNA, 16 nt, Human
ccauugacauguacag

SEQ ID NO: 2343531 - RNA, 19 nt, Human
ccauuuaaauuuuuuuccu

SEQ ID NO: 2343532 - RNA, 19 nt, Human
ccauuuaguucuuuguuau

SEQ ID NO: 2343533 - RNA, 14 nt, Human
ccauuuagccacca

SEQ ID NO: 2343534 - RNA, 18 nt, Human
ccauuuauacaaauuaga

SEQ ID NO: 2343535 - RNA, 14 nt, Human
ccauuuauccaccu

SEQ ID NO: 2343536 - RNA, 16 nt, Human
ccauuuauccaccucc

SEQ ID NO: 2343537 - RNA, 21 nt, Human
ccauuuagguuucugaguucc

SEQ ID NO: 2343538 - RNA, 16 nt, Human
ccauuuagguuucuga

SEQ ID NO: 2343539 - RNA, 21 nt, Human
ccauuucuaaaggccucuucc

SEQ ID NO: 2343540 - RNA, 19 nt, Human
ccauuucuaaaggccucuu

SEQ ID NO: 2343541 - RNA, 13 nt, Human
ccauuuccugaga

SEQ ID NO: 2343542 - RNA, 13 nt, Human
ccauuucuacucu

SEQ ID NO: 2343543 - RNA, 18 nt, Human
ccauuucuacucucccau

SEQ ID NO: 2343544 - RNA, 15 nt, Human
ccauucuuuuguaau

SEQ ID NO: 2343545 - RNA, 16 nt, Human
ccauucuuuuguaauu

SEQ ID NO: 2343546 - RNA, 18 nt, Human
ccauucuuuuguaauuua

SEQ ID NO: 2343547 - RNA, 22 nt, Human
ccauucuuuuguaauuuaaaug

SEQ ID NO: 2343548 - RNA, 17 nt, Human
ccauucuuucugauaac

SEQ ID NO: 2343549 - RNA, 13 nt, Human
ccauucuuucuga

SEQ ID NO: 2343550 - RNA, 12 nt, Human
ccauucuuucug

SEQ ID NO: 2343551 - RNA, 14 nt, Human
ccaugggccuccug

SEQ ID NO: 2343552 - RNA, 15 nt, Human
ccaugggccuccugu

SEQ ID NO: 2343553 - RNA, 19 nt, Human
ccauccuaccaaugcaugc

SEQ ID NO: 2343554 - RNA, 20 nt, Human
ccauccuaccaaugcaugca

SEQ ID NO: 2343555 - RNA, 23 nt, Human
ccauccuaaucauccaaugcuca

SEQ ID NO: 2343556 - RNA, 15 nt, Human
ccauccuaccaaugc

SEQ ID NO: 2343557 - RNA, 22 nt, Human
ccauccuaaucauccaaugcuc

SEQ ID NO: 2343558 - RNA, 21 nt, Human
ccauccuaaucauccaaugcu

SEQ ID NO: 2343559 - RNA, 15 nt, Human
ccauccgccagggcc

SEQ ID NO: 2343560 - RNA, 16 nt, Human
ccauccgccagggccc

SEQ ID NO: 2343561 - RNA, 19 nt, Human
ccauccggcccccagagcg

SEQ ID NO: 2343562 - RNA, 15 nt, Human
ccaucccugccuggu

SEQ ID NO: 2343563 - RNA, 16 nt, Human
ccaucccugccugguc

SEQ ID NO: 2343564 - RNA, 15 nt, Human
ccauccccuggacug

SEQ ID NO: 2343565 - RNA, 12 nt, Human
ccaucccugccu

SEQ ID NO: 2343566 - RNA, 13 nt, Human
ccaucccugccug

SEQ ID NO: 2343567 - RNA, 14 nt, Human
ccaucccugccugg

SEQ ID NO: 2343568 - RNA, 19 nt, Human
ccaucccuuuuugaagugu

SEQ ID NO: 2343569 - RNA, 17 nt, Human
ccaucccugccugguca

SEQ ID NO: 2343570 - RNA, 17 nt, Human
ccauccccgcagugugc

SEQ ID NO: 2343571 - RNA, 13 nt, Human
ccauccccuggac

SEQ ID NO: 2343572 - RNA, 14 nt, Human
ccauccccgcagug

SEQ ID NO: 2343573 - RNA, 19 nt, Human
ccaucccccugcccucgug

SEQ ID NO: 2343574 - RNA, 14 nt, Human
ccaucccccugccc

SEQ ID NO: 2343575 - RNA, 15 nt, Human
ccaucccccugcccu

SEQ ID NO: 2343576 - RNA, 22 nt, Human
ccauccccauccuccagcuucu

SEQ ID NO: 2343577 - RNA, 14 nt, Human
ccauccccccucac

SEQ ID NO: 2343578 - RNA, 19 nt, Human
ccauccccccucaccaggg

SEQ ID NO: 2343579 - RNA, 20 nt, Human
ccauccccccucaccagggg

SEQ ID NO: 2343580 - RNA, 21 nt, Human
ccauccccccucaccaggggc

SEQ ID NO: 2343581 - RNA, 22 nt, Human
ccauccccccucaccaggggca

SEQ ID NO: 2343582 - RNA, 12 nt, Human
ccaucccccugc

SEQ ID NO: 2343583 - RNA, 13 nt, Human
ccaucccccugcc

SEQ ID NO: 2343584 - RNA, 22 nt, Human
ccauccccuguagagugggagc

SEQ ID NO: 2343585 - RNA, 16 nt, Human
ccauccccuguagagu

SEQ ID NO: 2343586 - RNA, 14 nt, Human
ccaugagccucagc

SEQ ID NO: 2343587 - RNA, 18 nt, Human
ccaugagccucagcaucc

SEQ ID NO: 2343588 - RNA, 19 nt, Human
ccaugagccucagcauccu

SEQ ID NO: 2343589 - RNA, 13 nt, Human
ccaugaguccccu

SEQ ID NO: 2343590 - RNA, 13 nt, Human
ccaugggccuccu

SEQ ID NO: 2343591 - RNA, 16 nt, Human
ccaugaguccccuguu

SEQ ID NO: 2343592 - RNA, 14 nt, Human
ccaugaguccccug

SEQ ID NO: 2343593 - RNA, 15 nt, Human
ccaugaguccccugu

SEQ ID NO: 2343594 - RNA, 14 nt, Human
ccaguuugcagaaa

SEQ ID NO: 2343595 - RNA, 23 nt, Human
ccaguuugcagaaaagcaccugc

SEQ ID NO: 2343596 - RNA, 13 nt, Human
ccauaaaaagcug

SEQ ID NO: 2343597 - RNA, 14 nt, Human
ccauaaaaagcuga

SEQ ID NO: 2343598 - RNA, 12 nt, Human
ccauaaaacauu

SEQ ID NO: 2343599 - RNA, 19 nt, Human
ccauaaaacauuaagaaaa

SEQ ID NO: 2343600 - RNA, 20 nt, Human
ccauaaaacauuaagaaaau

SEQ ID NO: 2343601 - RNA, 22 nt, Human
ccauaaacacccaugaaucaaa

SEQ ID NO: 2343602 - RNA, 14 nt, Human
ccauaaacuucaug

SEQ ID NO: 2343603 - RNA, 16 nt, Human
ccauaaacuucauggu

SEQ ID NO: 2343604 - RNA, 19 nt, Human
ccauaaagaagauguuuaa

SEQ ID NO: 2343605 - RNA, 20 nt, Human
ccauaaagaagauguuuaac

SEQ ID NO: 2343606 - RNA, 13 nt, Human
ccauaaagaagca

SEQ ID NO: 2343607 - RNA, 13 nt, Human
ccauaacagccaa

SEQ ID NO: 2343608 - RNA, 15 nt, Human
ccauaacagccaaca

SEQ ID NO: 2343609 - RNA, 17 nt, Human
ccaucccacugcucccc

SEQ ID NO: 2343610 - RNA, 20 nt, Human
ccaucccacugcucccccaa

SEQ ID NO: 2343611 - RNA, 16 nt, Human
ccaucccacacccugg

SEQ ID NO: 2343612 - RNA, 21 nt, Human
ccaucccagagggugggcuuc

SEQ ID NO: 2343613 - RNA, 18 nt, Human
ccauccccauccuccagc

SEQ ID NO: 2343614 - RNA, 12 nt, Human
ccaucccagccc

SEQ ID NO: 2343615 - RNA, 14 nt, Human
ccaucccacacccu

SEQ ID NO: 2343616 - RNA, 12 nt, Human
ccaucccacacc

SEQ ID NO: 2343617 - RNA, 13 nt, Human
ccauacagcucua

SEQ ID NO: 2343618 - RNA, 23 nt, Human
ccaucccaaacccuucagugcca

SEQ ID NO: 2343619 - RNA, 20 nt, Human
ccauaauuuuuuuuuuccuu

SEQ ID NO: 2343620 - RNA, 16 nt, Human
ccauaaccgcugauuc

SEQ ID NO: 2343621 - RNA, 17 nt, Human
ccauaaccgcugauucu

SEQ ID NO: 2343622 - RNA, 22 nt, Human
ccauaaccgcugauucucaggg

SEQ ID NO: 2343623 - RNA, 13 nt, Human
ccauacauuugug

SEQ ID NO: 2343624 - RNA, 14 nt, Human
ccauacauuugugu

SEQ ID NO: 2343625 - RNA, 17 nt, Human
cccucaagaggaaguga

SEQ ID NO: 2343626 - RNA, 20 nt, Human
cccucaagccaauccccucc

SEQ ID NO: 2343627 - RNA, 16 nt, Human
cccucaaggccuccca

SEQ ID NO: 2343628 - RNA, 21 nt, Human
cccucaagccaauccccuccu

SEQ ID NO: 2343629 - RNA, 17 nt, Human
cccucaaggccucccac

SEQ ID NO: 2343630 - RNA, 19 nt, Human
cccucaauucccccuggcc

SEQ ID NO: 2343631 - RNA, 22 nt, Human
cccucaaggccucccacaguga

SEQ ID NO: 2343632 - RNA, 18 nt, Human
cccucaaggccucccaca

SEQ ID NO: 2343633 - RNA, 19 nt, Human
cccucaaggccucccacag

SEQ ID NO: 2343634 - RNA, 20 nt, Human
cccucaaggccucccacagu

SEQ ID NO: 2343635 - RNA, 21 nt, Human
cccucaaggccucccacagug

SEQ ID NO: 2343636 - RNA, 14 nt, Human
cccucacacuggga

SEQ ID NO: 2343637 - RNA, 13 nt, Human
cccucacacuggg

SEQ ID NO: 2343638 - RNA, 12 nt, Human
cccucacacugg

SEQ ID NO: 2343639 - RNA, 10 nt, Human
cccucacacu

SEQ ID NO: 2343640 - RNA, 12 nt, Human
cccucacagccu

SEQ ID NO: 2343641 - RNA, 13 nt, Human
cccucacagccuc

SEQ ID NO: 2343642 - RNA, 14 nt, Human
cccucacucuggcc

SEQ ID NO: 2343643 - RNA, 16 nt, Human
cccucacucuggccuc

SEQ ID NO: 2343644 - RNA, 18 nt, Human
cccucacugaaugccuca

SEQ ID NO: 2343645 - RNA, 14 nt, Human
cccucacuggauga

SEQ ID NO: 2343646 - RNA, 17 nt, Human
cccuauggaagcauauu

SEQ ID NO: 2343647 - RNA, 16 nt, Human
cccuauggaugugggg

SEQ ID NO: 2343648 - RNA, 13 nt, Human
cccuaugcugccu

SEQ ID NO: 2343649 - RNA, 21 nt, Human
cccuaucuuugccacccucau

SEQ ID NO: 2343650 - RNA, 18 nt, Human
cccuauggggauggucca

SEQ ID NO: 2343651 - RNA, 16 nt, Human
cccuauggggaugguc

SEQ ID NO: 2343652 - RNA, 20 nt, Human
cccucaacucuccuccagag

SEQ ID NO: 2343653 - RNA, 19 nt, Human
cccuaucuuugccacccuc

SEQ ID NO: 2343654 - RNA, 16 nt, Human
cccuaucuuugccacc

SEQ ID NO: 2343655 - RNA, 14 nt, Human
cccuaucuuugcca

SEQ ID NO: 2343656 - RNA, 17 nt, Human
cccuaucuaacccuccc

SEQ ID NO: 2343657 - RNA, 23 nt, Human
cccuaucuaacccucccauggca

SEQ ID NO: 2343658 - RNA, 12 nt, Human
cccggcugcgga

SEQ ID NO: 2343659 - RNA, 13 nt, Human
cccggcugcccuu

SEQ ID NO: 2343660 - RNA, 12 nt, Human
cccggcugcccu

SEQ ID NO: 2343661 - RNA, 23 nt, Human
cccggcugguuuuguaagaugcu

SEQ ID NO: 2343662 - RNA, 17 nt, Human
cccggcugguuuuguaa

SEQ ID NO: 2343663 - RNA, 22 nt, Human
cccuauccuacuuccccuuccu

SEQ ID NO: 2343664 - RNA, 12 nt, Human
cccgggaagggg

SEQ ID NO: 2343665 - RNA, 17 nt, Human
ccccuucugacccaugc

SEQ ID NO: 2343666 - RNA, 14 nt, Human
ccccuucugcucag

SEQ ID NO: 2343667 - RNA, 14 nt, Human
ccccuucucuccuc

SEQ ID NO: 2343668 - RNA, 15 nt, Human
ccccuucucuccucc

SEQ ID NO: 2343669 - RNA, 20 nt, Human
ccccuugccaccccacccuc

SEQ ID NO: 2343670 - RNA, 14 nt, Human
ccccuugccacccc

SEQ ID NO: 2343671 - RNA, 23 nt, Human
ccccuucugggcaucuguucugg

SEQ ID NO: 2343672 - RNA, 21 nt, Human
ccccuucugcucagcucuggg

SEQ ID NO: 2343673 - RNA, 14 nt, Human
ccccuucugggcau

SEQ ID NO: 2343674 - RNA, 22 nt, Human
ccccuucugggcaucuguucug

SEQ ID NO: 2343675 - RNA, 20 nt, Human
ccccuucugcucagcucugg

SEQ ID NO: 2343676 - RNA, 19 nt, Human
ccccuucugcucagcucug

SEQ ID NO: 2343677 - RNA, 15 nt, Human
cccucagagugcaag

SEQ ID NO: 2343678 - RNA, 13 nt, Human
cccucagagccac

SEQ ID NO: 2343679 - RNA, 14 nt, Human
cccucagcaccccu

SEQ ID NO: 2343680 - RNA, 15 nt, Human
cccucagcaccccuu

SEQ ID NO: 2343681 - RNA, 16 nt, Human
cccucagcaccccuuc

SEQ ID NO: 2343682 - RNA, 17 nt, Human
cccucagaaacacuggg

SEQ ID NO: 2343683 - RNA, 18 nt, Human
cccucagaacccuuggcu

SEQ ID NO: 2343684 - RNA, 17 nt, Human
cccucagaacccuuggc

SEQ ID NO: 2343685 - RNA, 20 nt, Human
cccucagaaacacuggggcu

SEQ ID NO: 2343686 - RNA, 23 nt, Human
cccucagaacccuuggcuugccc

SEQ ID NO: 2343687 - RNA, 22 nt, Human
cccucagaacccuuggcuugcc

SEQ ID NO: 2343688 - RNA, 21 nt, Human
cccucagaacccuuggcuugc

SEQ ID NO: 2343689 - RNA, 22 nt, Human
ccccaugccaaagcuagggugg

SEQ ID NO: 2343690 - RNA, 13 nt, Human
ccccaugccaaag

SEQ ID NO: 2343691 - RNA, 23 nt, Human
ccccauuccugggaaauauuccc

SEQ ID NO: 2343692 - RNA, 13 nt, Human
ccccaugcacugu

SEQ ID NO: 2343693 - RNA, 23 nt, Human
ccccaugcacugugaaggacccu

SEQ ID NO: 2343694 - RNA, 19 nt, Human
ccccaugcacugugaagga

SEQ ID NO: 2343695 - RNA, 12 nt, Human
ccccaucuugcu

SEQ ID NO: 2343696 - RNA, 14 nt, Human
ccccaucuugcuuc

SEQ ID NO: 2343697 - RNA, 14 nt, Human
ccccaucugugaau

SEQ ID NO: 2343698 - RNA, 13 nt, Human
ccccaucugugaa

SEQ ID NO: 2343699 - RNA, 15 nt, Human
ccccaugauguaagu

SEQ ID NO: 2343700 - RNA, 15 nt, Human
ccccauucugccugc

SEQ ID NO: 2343701 - RNA, 13 nt, Human
ccccauucugccu

SEQ ID NO: 2343702 - RNA, 14 nt, Human
ccccauucugccug

SEQ ID NO: 2343703 - RNA, 22 nt, Human
ccccugcacuggaguccagucu

SEQ ID NO: 2343704 - RNA, 12 nt, Human
ccccugauuaca

SEQ ID NO: 2343705 - RNA, 17 nt, Human
ccccugcaaagcccagc

SEQ ID NO: 2343706 - RNA, 16 nt, Human
ccccugcaaagcccag

SEQ ID NO: 2343707 - RNA, 18 nt, Human
ccccugcacuccagccug

SEQ ID NO: 2343708 - RNA, 15 nt, Human
ccccugaccugugag

SEQ ID NO: 2343709 - RNA, 21 nt, Human
ccccugagacaaauggaggcc

SEQ ID NO: 2343710 - RNA, 20 nt, Human
ccccugaccugugagcccag

SEQ ID NO: 2343711 - RNA, 18 nt, Human
ccccugagcaaugucugu

SEQ ID NO: 2343712 - RNA, 19 nt, Human
ccccugagcaaugucugug

SEQ ID NO: 2343713 - RNA, 21 nt, Human
ccccugagcaaugucugugcu

SEQ ID NO: 2343714 - RNA, 15 nt, Human
ccccugcaaagccca

SEQ ID NO: 2343715 - RNA, 13 nt, Human
ccccuucucccac

SEQ ID NO: 2343716 - RNA, 12 nt, Human
ccccuucuccca

SEQ ID NO: 2343717 - RNA, 16 nt, Human
ccccuucucccacacu

SEQ ID NO: 2343718 - RNA, 13 nt, Human
ccccuucucucau

SEQ ID NO: 2343719 - RNA, 16 nt, Human
ccccuucucucaucuc

SEQ ID NO: 2343720 - RNA, 19 nt, Human
ccccuuccuugcucugcac

SEQ ID NO: 2343721 - RNA, 20 nt, Human
ccccuuccuugcucugcacc

SEQ ID NO: 2343722 - RNA, 22 nt, Human
ccccuucuagguggcaaggcug

SEQ ID NO: 2343723 - RNA, 14 nt, Human
ccccuucucagaau

SEQ ID NO: 2343724 - RNA, 16 nt, Human
ccccuucucagaaucu

SEQ ID NO: 2343725 - RNA, 15 nt, Human
ccccuucucaucacu

SEQ ID NO: 2343726 - RNA, 19 nt, Human
ccccuucgcuccugugucu

SEQ ID NO: 2343727 - RNA, 21 nt, Human
ccccuucuacauuucuuagac

SEQ ID NO: 2343728 - RNA, 12 nt, Human
ccccuuccuguc

SEQ ID NO: 2343729 - RNA, 22 nt, Human
ccccuuccugucccaccucuuc

SEQ ID NO: 2343730 - RNA, 14 nt, Human
ccccuucgcuccug

SEQ ID NO: 2343731 - RNA, 15 nt, Human
ccccuucgcuccugu

SEQ ID NO: 2343732 - RNA, 17 nt, Human
ccccuucgcuccugugu

SEQ ID NO: 2343733 - RNA, 17 nt, Human
cccaggggaaaaugaag

SEQ ID NO: 2343734 - RNA, 13 nt, Human
cccaguuguauuu

SEQ ID NO: 2343735 - RNA, 18 nt, Human
cccagggcucagccuggu

SEQ ID NO: 2343736 - RNA, 17 nt, Human
cccagggcucagccugg

SEQ ID NO: 2343737 - RNA, 20 nt, Human
cccagggcucagccuggugg

SEQ ID NO: 2343738 - RNA, 14 nt, Human
cccagggcuccugc

SEQ ID NO: 2343739 - RNA, 15 nt, Human
cccagggcuccugca

SEQ ID NO: 2343740 - RNA, 22 nt, Human
cccaguuugcagaaaagcaccu

SEQ ID NO: 2343741 - RNA, 16 nt, Human
cccaguuugcagaaaa

SEQ ID NO: 2343742 - RNA, 15 nt, Human
cccaguuugcagaaa

SEQ ID NO: 2343743 - RNA, 20 nt, Human
cccaguuucugccucugagg

SEQ ID NO: 2343744 - RNA, 14 nt, Human
cccaguuucugccu

SEQ ID NO: 2343745 - RNA, 16 nt, Human
cccaguuucugccucu

SEQ ID NO: 2343746 - RNA, 17 nt, Human
cccaguuucugccucug

SEQ ID NO: 2343747 - RNA, 19 nt, Human
cccauaauuuucuucaugc

SEQ ID NO: 2343748 - RNA, 22 nt, Human
cccauaauuuuuuuuuuccuuu

SEQ ID NO: 2343749 - RNA, 23 nt, Human
cccauaauuuuuuuuuuccuuuu

SEQ ID NO: 2343750 - RNA, 23 nt, Human
cccaguuugcagaaaagcaccug

SEQ ID NO: 2343751 - RNA, 21 nt, Human
cccauuucuaaaggccucuuc

SEQ ID NO: 2343752 - RNA, 18 nt, Human
cccauuucuaaaggccuc

SEQ ID NO: 2343753 - RNA, 19 nt, Human
cccauuucccaucugcacc

SEQ ID NO: 2343754 - RNA, 14 nt, Human
cccauuucccaucu

SEQ ID NO: 2343755 - RNA, 15 nt, Human
cccauuucccaucug

SEQ ID NO: 2343756 - RNA, 16 nt, Human
cccauuucccaucugc

SEQ ID NO: 2343757 - RNA, 17 nt, Human
cccauuucccaucugca

SEQ ID NO: 2343758 - RNA, 15 nt, Human
cccauuucuauuuau

SEQ ID NO: 2343759 - RNA, 12 nt, Human
cccauuucuacu

SEQ ID NO: 2343760 - RNA, 22 nt, Human
cccauuucuacucuuaaguuuc

SEQ ID NO: 2343761 - RNA, 16 nt, Human
cccauuucuauuuauu

SEQ ID NO: 2343762 - RNA, 17 nt, Human
cccauuucuauuuauuu

SEQ ID NO: 2343763 - RNA, 19 nt, Human
cccauuuauccaccuccau

SEQ ID NO: 2343764 - RNA, 18 nt, Human
cccauuuauccaccucca

SEQ ID NO: 2343765 - RNA, 13 nt, Human
cccauuucagcug

SEQ ID NO: 2343766 - RNA, 12 nt, Human
cccauuucagcu

SEQ ID NO: 2343767 - RNA, 15 nt, Human
cccauuuauccaccu

SEQ ID NO: 2343768 - RNA, 20 nt, Human
cccauuuaaauuuuuuuccu

SEQ ID NO: 2343769 - RNA, 21 nt, Human
ccccagauugcaacaggcugg

SEQ ID NO: 2343770 - RNA, 22 nt, Human
ccccagauugcaacaggcuggg

SEQ ID NO: 2343771 - RNA, 23 nt, Human
ccccagauugcaacaggcugggc

SEQ ID NO: 2343772 - RNA, 17 nt, Human
ccccagcaagugagagc

SEQ ID NO: 2343773 - RNA, 19 nt, Human
ccccagcaagugagagcug

SEQ ID NO: 2343774 - RNA, 20 nt, Human
ccccagcaagugagagcugg

SEQ ID NO: 2343775 - RNA, 19 nt, Human
cccauuucuauuuauuuac

SEQ ID NO: 2343776 - RNA, 20 nt, Human
cccauuucuagaacaucccu

SEQ ID NO: 2343777 - RNA, 17 nt, Human
ccccauccucuguacag

SEQ ID NO: 2343778 - RNA, 12 nt, Human
ccccaucuguga

SEQ ID NO: 2343779 - RNA, 14 nt, Human
ccccaucugggucc

SEQ ID NO: 2343780 - RNA, 19 nt, Human
ccccaucuggguccuugca

SEQ ID NO: 2343781 - RNA, 22 nt, Human
ccccauccucuguacagagccc

SEQ ID NO: 2343782 - RNA, 19 nt, Human
ccccauccucuguacagag

SEQ ID NO: 2343783 - RNA, 21 nt, Human
ccccauccucuguacagagcc

SEQ ID NO: 2343784 - RNA, 20 nt, Human
cccauucugccugcccaggc

SEQ ID NO: 2343785 - RNA, 21 nt, Human
cccauucugccugcccaggcc

SEQ ID NO: 2343786 - RNA, 22 nt, Human
cccauucugccugcccaggccc

SEQ ID NO: 2343787 - RNA, 16 nt, Human
ccauuucucacugaga

SEQ ID NO: 2343788 - RNA, 12 nt, Human
ccauuucucaug

SEQ ID NO: 2343789 - RNA, 17 nt, Human
ccauuucuauuuauuua

SEQ ID NO: 2343790 - RNA, 13 nt, Human
ccauuucucacug

SEQ ID NO: 2343791 - RNA, 14 nt, Human
ccauuucucacuga

SEQ ID NO: 2343792 - RNA, 23 nt, Human
ccauuucuagaacaucccugcca

SEQ ID NO: 2343793 - RNA, 22 nt, Human
ccauuucuacucuuaaguuucu

SEQ ID NO: 2343794 - RNA, 12 nt, Human
ccauuucuauuu

SEQ ID NO: 2343795 - RNA, 13 nt, Human
ccauuucuauuua

SEQ ID NO: 2343796 - RNA, 14 nt, Human
ccauuucuauuuau

SEQ ID NO: 2343797 - RNA, 11 nt, Human
cccagcuguuu

SEQ ID NO: 2343798 - RNA, 19 nt, Human
cccaggaaaggcuccagga

SEQ ID NO: 2343799 - RNA, 21 nt, Human
cccagcugugcucuggacagg

SEQ ID NO: 2343800 - RNA, 23 nt, Human
cccagcugugcucuggacaggca

SEQ ID NO: 2343801 - RNA, 12 nt, Human
cccaggaagccg

SEQ ID NO: 2343802 - RNA, 15 nt, Human
cccaggaacugggcc

SEQ ID NO: 2343803 - RNA, 16 nt, Human
cccagcccacccuccu

SEQ ID NO: 2343804 - RNA, 18 nt, Human
cccagcccacccuccugu

SEQ ID NO: 2343805 - RNA, 19 nt, Human
cccagcugugagccuuggc

SEQ ID NO: 2343806 - RNA, 11 nt, Human
cccaggaacaa

SEQ ID NO: 2343807 - RNA, 23 nt, Human
cccaggaaaggcuccaggagcag

SEQ ID NO: 2343808 - RNA, 21 nt, Human
cccaggaaaggcuccaggagc

SEQ ID NO: 2343809 - RNA, 22 nt, Human
cccaggaaaggcuccaggagca

SEQ ID NO: 2343810 - RNA, 22 nt, Human
cccaggaaugccaaggagacau

SEQ ID NO: 2343811 - RNA, 19 nt, Human
cccaggacaccacacccag

SEQ ID NO: 2343812 - RNA, 20 nt, Human
cccaggacaccacacccagc

SEQ ID NO: 2343813 - RNA, 21 nt, Human
cccaggcuggcgugcaguggu

SEQ ID NO: 2343814 - RNA, 16 nt, Human
cccagggcucagccug

SEQ ID NO: 2343815 - RNA, 15 nt, Human
cccagggcucagccu

SEQ ID NO: 2343816 - RNA, 14 nt, Human
cccagggcucagcc

SEQ ID NO: 2343817 - RNA, 21 nt, Human
cccagggcuacccucccccag

SEQ ID NO: 2343818 - RNA, 20 nt, Human
cccaggcuuagucacugaga

SEQ ID NO: 2343819 - RNA, 13 nt, Human
cccaggcugggca

SEQ ID NO: 2343820 - RNA, 19 nt, Human
cccaggcugggcaaggagg

SEQ ID NO: 2343821 - RNA, 15 nt, Human
cccagggcuacccuc

SEQ ID NO: 2343822 - RNA, 16 nt, Human
cccaggcuggucucaa

SEQ ID NO: 2343823 - RNA, 12 nt, Human
cccaggcugggc

SEQ ID NO: 2343824 - RNA, 15 nt, Human
cccaggcuuagucac

SEQ ID NO: 2343825 - RNA, 15 nt, Human
cccagcacuuuggga

SEQ ID NO: 2343826 - RNA, 17 nt, Human
cccagcacuuugggagg

SEQ ID NO: 2343827 - RNA, 12 nt, Human
cccagcacuuug

SEQ ID NO: 2343828 - RNA, 20 nt, Human
cccagcacuuugggaggcca

SEQ ID NO: 2343829 - RNA, 22 nt, Human
cccagcacuuugggaggccaag

SEQ ID NO: 2343830 - RNA, 20 nt, Human
cccagcacuuugggaggccu

SEQ ID NO: 2343831 - RNA, 24 nt, Human
cccagcacugaggaagaacggggc

SEQ ID NO: 2343832 - RNA, 21 nt, Human
cccagcacugcuugaggaaaa

SEQ ID NO: 2343833 - RNA, 18 nt, Human
cccagcacuuguguuguc

SEQ ID NO: 2343834 - RNA, 16 nt, Human
cccagcacuuggagag

SEQ ID NO: 2343835 - RNA, 16 nt, Human
cccagcagguggggag

SEQ ID NO: 2343836 - RNA, 19 nt, Human
cccagcagggccucaaagu

SEQ ID NO: 2343837 - RNA, 22 nt, Human
cccagcagggucuuuucaucug

SEQ ID NO: 2343838 - RNA, 13 nt, Human
cccagcagggccu

SEQ ID NO: 2343839 - RNA, 18 nt, Human
cccagcagggccacuccc

SEQ ID NO: 2343840 - RNA, 21 nt, Human
cccagcacuuugggaggccua

SEQ ID NO: 2343841 - RNA, 17 nt, Human
cccagcagcccuaagga

SEQ ID NO: 2343842 - RNA, 22 nt, Human
cccagcagcccuaaggaucucu

SEQ ID NO: 2343843 - RNA, 14 nt, Human
cccagcccacuucu

SEQ ID NO: 2343844 - RNA, 18 nt, Human
cccagcugugagccuugg

SEQ ID NO: 2343845 - RNA, 13 nt, Human
cccagcccacccu

SEQ ID NO: 2343846 - RNA, 14 nt, Human
cccagcccacccuc

SEQ ID NO: 2343847 - RNA, 15 nt, Human
cccagcccacccucc

SEQ ID NO: 2343848 - RNA, 16 nt, Human
cccagcccaaagcugu

SEQ ID NO: 2343849 - RNA, 22 nt, Human
cccagccauuaccauggagaca

SEQ ID NO: 2343850 - RNA, 20 nt, Human
cccagccauuaccauggaga

SEQ ID NO: 2343851 - RNA, 19 nt, Human
cccagccauuaccauggag

SEQ ID NO: 2343852 - RNA, 15 nt, Human
cccagcaggugggga

SEQ ID NO: 2343853 - RNA, 12 nt, Human
cccagcccaagu

SEQ ID NO: 2343854 - RNA, 14 nt, Human
cccagcccaagucc

SEQ ID NO: 2343855 - RNA, 13 nt, Human
cccagcccaaguc

SEQ ID NO: 2343856 - RNA, 12 nt, Human
cccagcccaccc

SEQ ID NO: 2343857 - RNA, 15 nt, Human
cccagcacugaggaa

SEQ ID NO: 2343858 - RNA, 23 nt, Human
ccugccuccagggcuggacugag

SEQ ID NO: 2343859 - RNA, 20 nt, Human
ccugccuccagggcuggacu

SEQ ID NO: 2343860 - RNA, 21 nt, Human
ccugccuccagggcuggacug

SEQ ID NO: 2343861 - RNA, 20 nt, Human
ccugccuccaggaaccacac

SEQ ID NO: 2343862 - RNA, 15 nt, Human
ccugccuccaggaac

SEQ ID NO: 2343863 - RNA, 15 nt, Human
ccugccuccagggcu

SEQ ID NO: 2343864 - RNA, 16 nt, Human
ccugccuccagggcug

SEQ ID NO: 2343865 - RNA, 17 nt, Human
ccugccuccagggcugg

SEQ ID NO: 2343866 - RNA, 19 nt, Human
ccugccucgaacuggcugc

SEQ ID NO: 2343867 - RNA, 17 nt, Human
ccugccuccccugugca

SEQ ID NO: 2343868 - RNA, 15 nt, Human
ccugccuccccugug

SEQ ID NO: 2343869 - RNA, 16 nt, Human
ccugccucccuucaug

SEQ ID NO: 2343870 - RNA, 12 nt, Human
ccugccuccugc

SEQ ID NO: 2343871 - RNA, 21 nt, Human
ccugccucgaacuggcugcaa

SEQ ID NO: 2343872 - RNA, 23 nt, Human
ccugccucgaacuggcugcaaag

SEQ ID NO: 2343873 - RNA, 17 nt, Human
ccugcugcaguugccag

SEQ ID NO: 2343874 - RNA, 19 nt, Human
ccugcugcaguugccaguc

SEQ ID NO: 2343875 - RNA, 23 nt, Human
ccugcugccuccccaacccugcc

SEQ ID NO: 2343876 - RNA, 20 nt, Human
ccugcugccuccccaacccu

SEQ ID NO: 2343877 - RNA, 19 nt, Human
ccugcugccuccccaaccc

SEQ ID NO: 2343878 - RNA, 21 nt, Human
ccugcugccuccccaacccug

SEQ ID NO: 2343879 - RNA, 17 nt, Human
ccugcugccuccccaac

SEQ ID NO: 2343880 - RNA, 16 nt, Human
ccugcugccuccccaa

SEQ ID NO: 2343881 - RNA, 15 nt, Human
ccugcugccucccca

SEQ ID NO: 2343882 - RNA, 13 nt, Human
ccugcugccuccc

SEQ ID NO: 2343883 - RNA, 23 nt, Human
ccugcugccgccucccagccugg

SEQ ID NO: 2343884 - RNA, 21 nt, Human
ccugcugcaguugccagucac

SEQ ID NO: 2343885 - RNA, 13 nt, Human
ccugccuccugcc

SEQ ID NO: 2343886 - RNA, 20 nt, Human
ccugcugcaguugccaguca

SEQ ID NO: 2343887 - RNA, 18 nt, Human
ccugcugcugacccagcc

SEQ ID NO: 2343888 - RNA, 20 nt, Human
ccugcugcugacccagccug

SEQ ID NO: 2343889 - RNA, 13 nt, Human
ccugcccacccgu

SEQ ID NO: 2343890 - RNA, 12 nt, Human
ccugcccacccg

SEQ ID NO: 2343891 - RNA, 13 nt, Human
ccugcccaccugg

SEQ ID NO: 2343892 - RNA, 14 nt, Human
ccugcccaccuggc

SEQ ID NO: 2343893 - RNA, 20 nt, Human
ccugcccaccuggccucugc

SEQ ID NO: 2343894 - RNA, 12 nt, Human
ccugcccaccug

SEQ ID NO: 2343895 - RNA, 13 nt, Human
ccugcccaggccc

SEQ ID NO: 2343896 - RNA, 20 nt, Human
ccugccccaaucccuuuauu

SEQ ID NO: 2343897 - RNA, 24 nt, Human
ccugccccaacucuccccugaccu

SEQ ID NO: 2343898 - RNA, 12 nt, Human
ccugccccagcc

SEQ ID NO: 2343899 - RNA, 13 nt, Human
ccugccccagccc

SEQ ID NO: 2343900 - RNA, 14 nt, Human
ccugccccagccca

SEQ ID NO: 2343901 - RNA, 13 nt, Human
ccugcccaccugu

SEQ ID NO: 2343902 - RNA, 22 nt, Human
ccugcccacccguggagauggg

SEQ ID NO: 2343903 - RNA, 14 nt, Human
ccugcccaccuguc

SEQ ID NO: 2343904 - RNA, 23 nt, Human
ccugcccaggagagccagcccuc

SEQ ID NO: 2343905 - RNA, 22 nt, Human
ccugcccaggagagccagcccu

SEQ ID NO: 2343906 - RNA, 20 nt, Human
ccugcccaggagagccagcc

SEQ ID NO: 2343907 - RNA, 12 nt, Human
ccugcccaggag

SEQ ID NO: 2343908 - RNA, 18 nt, Human
ccugcccagaucccagaa

SEQ ID NO: 2343909 - RNA, 15 nt, Human
ccugcccccaaauaa

SEQ ID NO: 2343910 - RNA, 15 nt, Human
ccugcccccaaucca

SEQ ID NO: 2343911 - RNA, 14 nt, Human
ccugccuccaggaa

SEQ ID NO: 2343912 - RNA, 20 nt, Human
ccugccuccacccucugagc

SEQ ID NO: 2343913 - RNA, 12 nt, Human
ccugccuccagg

SEQ ID NO: 2343914 - RNA, 16 nt, Human
ccugcccccaauccau

SEQ ID NO: 2343915 - RNA, 18 nt, Human
ccugccuccacccucuga

SEQ ID NO: 2343916 - RNA, 19 nt, Human
ccugccuccacccucugag

SEQ ID NO: 2343917 - RNA, 17 nt, Human
ccugccccagggcuccc

SEQ ID NO: 2343918 - RNA, 16 nt, Human
ccugccccaggccuga

SEQ ID NO: 2343919 - RNA, 18 nt, Human
ccugccccaggccugaaa

SEQ ID NO: 2343920 - RNA, 14 nt, Human
ccugccccaggccu

SEQ ID NO: 2343921 - RNA, 15 nt, Human
ccugccccagcccaa

SEQ ID NO: 2343922 - RNA, 17 nt, Human
ccugccccagcccaagu

SEQ ID NO: 2343923 - RNA, 18 nt, Human
ccugccccagcccaaguc

SEQ ID NO: 2343924 - RNA, 19 nt, Human
ccugccccagcccaagucc

SEQ ID NO: 2343925 - RNA, 15 nt, Human
ccugcagccuccucc

SEQ ID NO: 2343926 - RNA, 18 nt, Human
ccugcagccuccuccuga

SEQ ID NO: 2343927 - RNA, 22 nt, Human
ccugcagccccgcgccuccuuc

SEQ ID NO: 2343928 - RNA, 19 nt, Human
ccugcagccuccuccugac

SEQ ID NO: 2343929 - RNA, 19 nt, Human
ccugaccaacauggagaaa

SEQ ID NO: 2343930 - RNA, 15 nt, Human
ccucuuucauccacu

SEQ ID NO: 2343931 - RNA, 13 nt, Human
ccucuuucaucca

SEQ ID NO: 2343932 - RNA, 12 nt, Human
ccugaccacccu

SEQ ID NO: 2343933 - RNA, 13 nt, Human
ccugaccacccuc

SEQ ID NO: 2343934 - RNA, 14 nt, Human
ccugaccacccucc

SEQ ID NO: 2343935 - RNA, 15 nt, Human
ccugaccacccuccc

SEQ ID NO: 2343936 - RNA, 20 nt, Human
ccugaccacgcuuucuagcu

SEQ ID NO: 2343937 - RNA, 23 nt, Human
ccugaccacccuccccucucuug

SEQ ID NO: 2343938 - RNA, 17 nt, Human
ccugaccacccuccccu

SEQ ID NO: 2343939 - RNA, 18 nt, Human
ccugaccacccuccccuc

SEQ ID NO: 2343940 - RNA, 20 nt, Human
ccugaccacccuccccucuc

SEQ ID NO: 2343941 - RNA, 21 nt, Human
ccugaccacccuccccucucu

SEQ ID NO: 2343942 - RNA, 13 nt, Human
ccucuuucccucc

SEQ ID NO: 2343943 - RNA, 20 nt, Human
ccugaccaacaguuccuuca

SEQ ID NO: 2343944 - RNA, 18 nt, Human
ccugagucacccaugaag

SEQ ID NO: 2343945 - RNA, 15 nt, Human
ccugagucacccaug

SEQ ID NO: 2343946 - RNA, 14 nt, Human
ccugagucaccagg

SEQ ID NO: 2343947 - RNA, 13 nt, Human
ccugagucaccag

SEQ ID NO: 2343948 - RNA, 18 nt, Human
ccugacccaggccgcagc

SEQ ID NO: 2343949 - RNA, 19 nt, Human
ccugacccaggccgcagcu

SEQ ID NO: 2343950 - RNA, 21 nt, Human
ccugaguagcugggauuacag

SEQ ID NO: 2343951 - RNA, 14 nt, Human
ccugacccaggccg

SEQ ID NO: 2343952 - RNA, 15 nt, Human
ccugacccaggccgc

SEQ ID NO: 2343953 - RNA, 16 nt, Human
ccugacccaggccgca

SEQ ID NO: 2343954 - RNA, 13 nt, Human
ccugacccaggcc

SEQ ID NO: 2343955 - RNA, 15 nt, Human
ccugagucaccagga

SEQ ID NO: 2343956 - RNA, 23 nt, Human
ccugaguccaagaggguccuuua

SEQ ID NO: 2343957 - RNA, 23 nt, Human
ccugagucacccuaccugugccu

SEQ ID NO: 2343958 - RNA, 19 nt, Human
ccugagucguacagaaagc

SEQ ID NO: 2343959 - RNA, 22 nt, Human
ccugagucguacagaaagcugc

SEQ ID NO: 2343960 - RNA, 21 nt, Human
ccugagucguacagaaagcug

SEQ ID NO: 2343961 - RNA, 16 nt, Human
ccugcacuugcagacu

SEQ ID NO: 2343962 - RNA, 17 nt, Human
ccugcacuugcagacuc

SEQ ID NO: 2343963 - RNA, 19 nt, Human
ccugcagaggggaaaccag

SEQ ID NO: 2343964 - RNA, 15 nt, Human
ccugagucuccugug

SEQ ID NO: 2343965 - RNA, 18 nt, Human
ccugcagaggucugugcu

SEQ ID NO: 2343966 - RNA, 14 nt, Human
ccugagucuccugu

SEQ ID NO: 2343967 - RNA, 19 nt, Human
ccugcagaggucugugcug

SEQ ID NO: 2343968 - RNA, 20 nt, Human
ccugcagaggucugugcuga

SEQ ID NO: 2343969 - RNA, 21 nt, Human
ccugcagaggucugugcugag

SEQ ID NO: 2343970 - RNA, 22 nt, Human
ccugcagaggucugugcugagg

SEQ ID NO: 2343971 - RNA, 18 nt, Human
ccugcacuugcagacucu

SEQ ID NO: 2343972 - RNA, 23 nt, Human
ccucuuucaagcagucgugccug

SEQ ID NO: 2343973 - RNA, 11 nt, Human
ccucuuucccu

SEQ ID NO: 2343974 - RNA, 15 nt, Human
ccugucugccagggc

SEQ ID NO: 2343975 - RNA, 23 nt, Human
ccugucugccagccagcagccag

SEQ ID NO: 2343976 - RNA, 21 nt, Human
ccugucugccagccagcagcc

SEQ ID NO: 2343977 - RNA, 20 nt, Human
ccugucuguagagggcccug

SEQ ID NO: 2343978 - RNA, 21 nt, Human
ccugucuguagagggcccugg

SEQ ID NO: 2343979 - RNA, 22 nt, Human
ccugucuguagagggcccuggu

SEQ ID NO: 2343980 - RNA, 23 nt, Human
ccugucuguagagggcccuggug

SEQ ID NO: 2343981 - RNA, 17 nt, Human
ccugucuguuacacugg

SEQ ID NO: 2343982 - RNA, 14 nt, Human
ccugucuucccagg

SEQ ID NO: 2343983 - RNA, 17 nt, Human
ccugucugucucuccau

SEQ ID NO: 2343984 - RNA, 18 nt, Human
ccugucugucucuccauc

SEQ ID NO: 2343985 - RNA, 19 nt, Human
ccugucugucucuccaucu

SEQ ID NO: 2343986 - RNA, 21 nt, Human
ccugucugucucuccaucugu

SEQ ID NO: 2343987 - RNA, 19 nt, Human
ccugucuuccugcauucac

SEQ ID NO: 2343988 - RNA, 15 nt, Human
ccugucuuccugcau

SEQ ID NO: 2343989 - RNA, 22 nt, Human
ccugucuuccugcauucaccca

SEQ ID NO: 2343990 - RNA, 15 nt, Human
ccugucuucccaggg

SEQ ID NO: 2343991 - RNA, 16 nt, Human
ccugucuucccagggu

SEQ ID NO: 2343992 - RNA, 18 nt, Human
ccugucuucccaggguag

SEQ ID NO: 2343993 - RNA, 17 nt, Human
ccugucuuuaaggaaaa

SEQ ID NO: 2343994 - RNA, 14 nt, Human
ccugucuuuaagga

SEQ ID NO: 2343995 - RNA, 22 nt, Human
ccugucuuugggagaaaacguc

SEQ ID NO: 2343996 - RNA, 16 nt, Human
ccugucucagccuccc

SEQ ID NO: 2343997 - RNA, 15 nt, Human
ccugucucagccucc

SEQ ID NO: 2343998 - RNA, 14 nt, Human
ccugucucagccuc

SEQ ID NO: 2343999 - RNA, 13 nt, Human
ccugucucagccu

SEQ ID NO: 2344000 - RNA, 17 nt, Human
ccugucucauccccagg

SEQ ID NO: 2344001 - RNA, 17 nt, Human
ccugucuagagagggag

SEQ ID NO: 2344002 - RNA, 13 nt, Human
ccugucucugccc

SEQ ID NO: 2344003 - RNA, 13 nt, Human
ccugucucuucca

SEQ ID NO: 2344004 - RNA, 14 nt, Human
ccugucucuuccau

SEQ ID NO: 2344005 - RNA, 20 nt, Human
ccugucugccagccagcagc

SEQ ID NO: 2344006 - RNA, 19 nt, Human
ccugucugccagccagcag

SEQ ID NO: 2344007 - RNA, 17 nt, Human
ccugucugccagccagc

SEQ ID NO: 2344008 - RNA, 16 nt, Human
ccugucugccagccag

SEQ ID NO: 2344009 - RNA, 15 nt, Human
ccugucugccagcca

SEQ ID NO: 2344010 - RNA, 14 nt, Human
ccugucugccagcc

SEQ ID NO: 2344011 - RNA, 21 nt, Human
ccugucugaaggacacuuccu

SEQ ID NO: 2344012 - RNA, 22 nt, Human
ccugucucuuccauaugaccuc

SEQ ID NO: 2344013 - RNA, 20 nt, Human
ccugucugaaggacacuucc

SEQ ID NO: 2344014 - RNA, 16 nt, Human
ccugucuagagaggga

SEQ ID NO: 2344015 - RNA, 14 nt, Human
ccugucuagagagg

SEQ ID NO: 2344016 - RNA, 22 nt, Human
ccugucuaaugaaaccuguguc

SEQ ID NO: 2344017 - RNA, 13 nt, Human
ccugucggccugg

SEQ ID NO: 2344018 - RNA, 17 nt, Human
ccugucggccugguguu

SEQ ID NO: 2344019 - RNA, 15 nt, Human
ccugucuaaugaaac

SEQ ID NO: 2344020 - RNA, 16 nt, Human
ccugugaccagcacug

SEQ ID NO: 2344021 - RNA, 19 nt, Human
ccugugaccagucugaccc

SEQ ID NO: 2344022 - RNA, 22 nt, Human
ccugugacauggugccugagag

SEQ ID NO: 2344023 - RNA, 23 nt, Human
ccugugacauggugccugagagg

SEQ ID NO: 2344024 - RNA, 17 nt, Human
ccugugaccagcacugu

SEQ ID NO: 2344025 - RNA, 19 nt, Human
ccugugaaauaguucaaag

SEQ ID NO: 2344026 - RNA, 22 nt, Human
ccugugaaagacucaaugagcu

SEQ ID NO: 2344027 - RNA, 17 nt, Human
ccugugaacugaacucu

SEQ ID NO: 2344028 - RNA, 16 nt, Human
ccugugaacugaacuc

SEQ ID NO: 2344029 - RNA, 18 nt, Human
ccugugaaguaaggaugu

SEQ ID NO: 2344030 - RNA, 16 nt, Human
ccugugaaugccacug

SEQ ID NO: 2344031 - RNA, 17 nt, Human
ccugugaaugccacugc

SEQ ID NO: 2344032 - RNA, 19 nt, Human
ccugugaaugccacugccu

SEQ ID NO: 2344033 - RNA, 21 nt, Human
ccugugaaugccacugccuuc

SEQ ID NO: 2344034 - RNA, 22 nt, Human
ccugugaaugccacugccuucg

SEQ ID NO: 2344035 - RNA, 17 nt, Human
ccugugacauggugccu

SEQ ID NO: 2344036 - RNA, 18 nt, Human
ccugugacauggugccug

SEQ ID NO: 2344037 - RNA, 19 nt, Human
ccugugacauggugccuga

SEQ ID NO: 2344038 - RNA, 21 nt, Human
ccugugacauggugccugaga

SEQ ID NO: 2344039 - RNA, 12 nt, Human
ccuguaauaaau

SEQ ID NO: 2344040 - RNA, 13 nt, Human
ccuguaauaaaua

SEQ ID NO: 2344041 - RNA, 14 nt, Human
ccuguaauaaauau

SEQ ID NO: 2344042 - RNA, 15 nt, Human
ccugguuuccugccc

SEQ ID NO: 2344043 - RNA, 18 nt, Human
ccugguuucacuggccca

SEQ ID NO: 2344044 - RNA, 17 nt, Human
ccugguuucacuggccc

SEQ ID NO: 2344045 - RNA, 15 nt, Human
ccugguucugaugau

SEQ ID NO: 2344046 - RNA, 21 nt, Human
ccugguucugaugaugugccu

SEQ ID NO: 2344047 - RNA, 14 nt, Human
ccugguuuccugcc

SEQ ID NO: 2344048 - RNA, 13 nt, Human
ccugguuuccugc

SEQ ID NO: 2344049 - RNA, 20 nt, Human
ccuggugggccuccucuguc

SEQ ID NO: 2344050 - RNA, 18 nt, Human
ccuggugggccuccucug

SEQ ID NO: 2344051 - RNA, 14 nt, Human
ccuggugggccucc

SEQ ID NO: 2344052 - RNA, 23 nt, Human
ccuggugggccaacaaagaacac

SEQ ID NO: 2344053 - RNA, 14 nt, Human
ccugguucucaucu

SEQ ID NO: 2344054 - RNA, 13 nt, Human
ccugguucucauc

SEQ ID NO: 2344055 - RNA, 15 nt, Human
ccugguucucaucuu

SEQ ID NO: 2344056 - RNA, 16 nt, Human
ccugguucucaucuuu

SEQ ID NO: 2344057 - RNA, 17 nt, Human
ccugguggccucugccc

SEQ ID NO: 2344058 - RNA, 14 nt, Human
ccuggugggccaac

SEQ ID NO: 2344059 - RNA, 16 nt, Human
ccugggggcucucaug

SEQ ID NO: 2344060 - RNA, 19 nt, Human
ccuguccugaccugucuca

SEQ ID NO: 2344061 - RNA, 14 nt, Human
ccuguaaucccagc

SEQ ID NO: 2344062 - RNA, 17 nt, Human
ccuguaaucccagcacu

SEQ ID NO: 2344063 - RNA, 16 nt, Human
ccuguaaucccagcac

SEQ ID NO: 2344064 - RNA, 17 nt, Human
ccuguccugccuaaggc

SEQ ID NO: 2344065 - RNA, 23 nt, Human
ccuguccugauggucagcucccu

SEQ ID NO: 2344066 - RNA, 13 nt, Human
ccuguccugaugg

SEQ ID NO: 2344067 - RNA, 22 nt, Human
ccuguccugauggucagcuccc

SEQ ID NO: 2344068 - RNA, 15 nt, Human
ccuguaaucccagca

SEQ ID NO: 2344069 - RNA, 13 nt, Human
ccuguaaucccag

SEQ ID NO: 2344070 - RNA, 22 nt, Human
ccuguaauaaauaugagugcca

SEQ ID NO: 2344071 - RNA, 20 nt, Human
ccuguaaucauauaauaaau

SEQ ID NO: 2344072 - RNA, 15 nt, Human
ccuguaauaaauaug

SEQ ID NO: 2344073 - RNA, 16 nt, Human
ccuguaauaaauauga

SEQ ID NO: 2344074 - RNA, 15 nt, Human
ccuguaaucacagcu

SEQ ID NO: 2344075 - RNA, 21 nt, Human
ccuguccuucucucaccuccu

SEQ ID NO: 2344076 - RNA, 12 nt, Human
ccuguccuugca

SEQ ID NO: 2344077 - RNA, 14 nt, Human
ccugucgagacacu

SEQ ID NO: 2344078 - RNA, 15 nt, Human
ccugucgagacacuu

SEQ ID NO: 2344079 - RNA, 17 nt, Human
ccugucgagacacuugc

SEQ ID NO: 2344080 - RNA, 19 nt, Human
ccuguccugccuaaggcug

SEQ ID NO: 2344081 - RNA, 15 nt, Human
ccuguccugggcugg

SEQ ID NO: 2344082 - RNA, 16 nt, Human
ccuguccugggcuggu

SEQ ID NO: 2344083 - RNA, 18 nt, Human
ccuguccugggcuggugg

SEQ ID NO: 2344084 - RNA, 18 nt, Human
ccugucgagacacuugcc

SEQ ID NO: 2344085 - RNA, 20 nt, Human
ccugucgagacacuugccuu

SEQ ID NO: 2344086 - RNA, 23 nt, Human
ccuggggcagucaccugcccaga

SEQ ID NO: 2344087 - RNA, 12 nt, Human
ccugggccugca

SEQ ID NO: 2344088 - RNA, 16 nt, Human
ccugggccgcugccac

SEQ ID NO: 2344089 - RNA, 17 nt, Human
ccugggccgcugccacg

SEQ ID NO: 2344090 - RNA, 13 nt, Human
ccugggccgcugc

SEQ ID NO: 2344091 - RNA, 18 nt, Human
ccugggcccucucugcuc

SEQ ID NO: 2344092 - RNA, 15 nt, Human
ccugggcccucucug

SEQ ID NO: 2344093 - RNA, 14 nt, Human
ccugggcccugggc

SEQ ID NO: 2344094 - RNA, 15 nt, Human
ccugggcccugggcu

SEQ ID NO: 2344095 - RNA, 16 nt, Human
ccugggcccugggcug

SEQ ID NO: 2344096 - RNA, 18 nt, Human
ccugggcccugggcugga

SEQ ID NO: 2344097 - RNA, 19 nt, Human
ccugggcccugggcuggaa

SEQ ID NO: 2344098 - RNA, 13 nt, Human
ccuggggccucuu

SEQ ID NO: 2344099 - RNA, 16 nt, Human
ccuggggccuggaccu

SEQ ID NO: 2344100 - RNA, 17 nt, Human
ccuggggccuggaccug

SEQ ID NO: 2344101 - RNA, 18 nt, Human
ccuggggccuggaccugc

SEQ ID NO: 2344102 - RNA, 19 nt, Human
ccuggggccuggaccugcc

SEQ ID NO: 2344103 - RNA, 21 nt, Human
ccuggggccuggaccugccuc

SEQ ID NO: 2344104 - RNA, 22 nt, Human
ccuggggccucggagccucauc

SEQ ID NO: 2344105 - RNA, 12 nt, Human
ccuggggccucg

SEQ ID NO: 2344106 - RNA, 17 nt, Human
ccuggggcuucuccuga

SEQ ID NO: 2344107 - RNA, 18 nt, Human
ccuggggcuucuccugac

SEQ ID NO: 2344108 - RNA, 21 nt, Human
ccuggggcuucuccugaccca

SEQ ID NO: 2344109 - RNA, 18 nt, Human
ccugggggaagcccugga

SEQ ID NO: 2344110 - RNA, 19 nt, Human
ccugggggcagggagagga

SEQ ID NO: 2344111 - RNA, 19 nt, Human
ccugggggaagcccuggau

SEQ ID NO: 2344112 - RNA, 17 nt, Human
ccugggggaagcccugg

SEQ ID NO: 2344113 - RNA, 16 nt, Human
ccugggggaagcccug

SEQ ID NO: 2344114 - RNA, 21 nt, Human
ccugguggcagugggagcugc

SEQ ID NO: 2344115 - RNA, 14 nt, Human
ccugggggcucuca

SEQ ID NO: 2344116 - RNA, 13 nt, Human
ccugggggcucuc

SEQ ID NO: 2344117 - RNA, 12 nt, Human
ccugggggcucu

SEQ ID NO: 2344118 - RNA, 21 nt, Human
ccugggccccaccaccuaggc

SEQ ID NO: 2344119 - RNA, 22 nt, Human
ccugggccccucaucugcucag

SEQ ID NO: 2344120 - RNA, 14 nt, Human
ccugggcccucucu

SEQ ID NO: 2344121 - RNA, 11 nt, Human
ccugggcccuc

SEQ ID NO: 2344122 - RNA, 23 nt, Human
ccugggccccaccaccuaggcca

SEQ ID NO: 2344123 - RNA, 14 nt, Human
ccuggccucugugc

SEQ ID NO: 2344124 - RNA, 20 nt, Human
ccugggccccaguuguauuu

SEQ ID NO: 2344125 - RNA, 22 nt, Human
ccuggccucugcacuccccugc

SEQ ID NO: 2344126 - RNA, 13 nt, Human
ccuggccucugug

SEQ ID NO: 2344127 - RNA, 22 nt, Human
ccuggccuagcauacguacaca

SEQ ID NO: 2344128 - RNA, 20 nt, Human
ccuggccucugcacuccccu

SEQ ID NO: 2344129 - RNA, 21 nt, Human
ccuggccucugcacuccccug

SEQ ID NO: 2344130 - RNA, 22 nt, Human
ccuggccggcaaccccaguucu

SEQ ID NO: 2344131 - RNA, 19 nt, Human
ccuggccggcaaccccagu

SEQ ID NO: 2344132 - RNA, 21 nt, Human
ccuggccggcaaccccaguuc

SEQ ID NO: 2344133 - RNA, 23 nt, Human
ccuggccggcaaccccaguucug

SEQ ID NO: 2344134 - RNA, 21 nt, Human
ccuggccgcccccugcccccc

SEQ ID NO: 2344135 - RNA, 22 nt, Human
ccuggccgcccccugcccccca

SEQ ID NO: 2344136 - RNA, 16 nt, Human
cccugucugccagggc

SEQ ID NO: 2344137 - RNA, 20 nt, Human
cccugucuguagagggcccu

SEQ ID NO: 2344138 - RNA, 21 nt, Human
cccugucuguagagggcccug

SEQ ID NO: 2344139 - RNA, 23 nt, Human
cccugucucuacuaaaaaugcaa

SEQ ID NO: 2344140 - RNA, 23 nt, Human
cccugucugaaggacacuuccug

SEQ ID NO: 2344141 - RNA, 20 nt, Human
cccugucuagagagggaggc

SEQ ID NO: 2344142 - RNA, 14 nt, Human
cccugucucuacua

SEQ ID NO: 2344143 - RNA, 17 nt, Human
cccugucuagagaggga

SEQ ID NO: 2344144 - RNA, 16 nt, Human
cccugucuagagaggg

SEQ ID NO: 2344145 - RNA, 17 nt, Human
cccugugauggggcccu

SEQ ID NO: 2344146 - RNA, 13 nt, Human
cccugucuugucc

SEQ ID NO: 2344147 - RNA, 22 nt, Human
cccugucuguagagggcccugg

SEQ ID NO: 2344148 - RNA, 23 nt, Human
cccugucuguagagggcccuggu

SEQ ID NO: 2344149 - RNA, 17 nt, Human
cccugugacauggugcc

SEQ ID NO: 2344150 - RNA, 18 nt, Human
cccugugacauggugccu

SEQ ID NO: 2344151 - RNA, 13 nt, Human
cccuucgcuccug

SEQ ID NO: 2344152 - RNA, 20 nt, Human
cccugugauggggcccugcc

SEQ ID NO: 2344153 - RNA, 18 nt, Human
cccugugauggggcccug

SEQ ID NO: 2344154 - RNA, 19 nt, Human
cccugugauggggcccugc

SEQ ID NO: 2344155 - RNA, 23 nt, Human
cccugucucaaaaaaagaaaaag

SEQ ID NO: 2344156 - RNA, 20 nt, Human
cccugucucaaaaaaagaaa

SEQ ID NO: 2344157 - RNA, 16 nt, Human
cccugucuaaugaaac

SEQ ID NO: 2344158 - RNA, 13 nt, Human
cccugucuaauga

SEQ ID NO: 2344159 - RNA, 12 nt, Human
cccugucuagag

SEQ ID NO: 2344160 - RNA, 16 nt, Human
ccgcauccuagucucu

SEQ ID NO: 2344161 - RNA, 17 nt, Human
ccgcaguuccugucccu

SEQ ID NO: 2344162 - RNA, 22 nt, Human
ccgcagugugcacuaaggggcc

SEQ ID NO: 2344163 - RNA, 23 nt, Human
ccgcagugugcacuaaggggccc

SEQ ID NO: 2344164 - RNA, 23 nt, Human
ccgcaggauuugggcucuuggaa

SEQ ID NO: 2344165 - RNA, 15 nt, Human
ccgcaggaagcugcu

SEQ ID NO: 2344166 - RNA, 14 nt, Human
ccgcaggaagcugc

SEQ ID NO: 2344167 - RNA, 13 nt, Human
ccgcaggaagcug

SEQ ID NO: 2344168 - RNA, 12 nt, Human
ccgcaggaagcu

SEQ ID NO: 2344169 - RNA, 19 nt, Human
ccgcaggaagcugcuccgu

SEQ ID NO: 2344170 - RNA, 19 nt, Human
ccgcagucgucgcacaguc

SEQ ID NO: 2344171 - RNA, 21 nt, Human
ccgcagucgucgcacagucuc

SEQ ID NO: 2344172 - RNA, 15 nt, Human
ccgcagugugcacua

SEQ ID NO: 2344173 - RNA, 22 nt, Human
ccgcagucgucgcacagucucu

SEQ ID NO: 2344174 - RNA, 13 nt, Human
ccgcauucccuga

SEQ ID NO: 2344175 - RNA, 14 nt, Human
ccgcauucccugag

SEQ ID NO: 2344176 - RNA, 16 nt, Human
ccgcaugcggcccagg

SEQ ID NO: 2344177 - RNA, 17 nt, Human
ccgcaugcggcccagga

SEQ ID NO: 2344178 - RNA, 12 nt, Human
ccgcaugccccc

SEQ ID NO: 2344179 - RNA, 13 nt, Human
ccgcaugcccccu

SEQ ID NO: 2344180 - RNA, 18 nt, Human
ccgcaugcccccucgugc

SEQ ID NO: 2344181 - RNA, 19 nt, Human
ccgcaugcccccucgugcc

SEQ ID NO: 2344182 - RNA, 21 nt, Human
ccgcaugcccccucgugccag

SEQ ID NO: 2344183 - RNA, 22 nt, Human
ccgcaugcccccucgugccagu

SEQ ID NO: 2344184 - RNA, 23 nt, Human
ccgcaugcccccucgugccaguc

SEQ ID NO: 2344185 - RNA, 22 nt, Human
ccgcaucuucuccaucuggcag

SEQ ID NO: 2344186 - RNA, 20 nt, Human
ccgcaucuucuccaucuggc

SEQ ID NO: 2344187 - RNA, 19 nt, Human
ccgcaucuucuccaucugg

SEQ ID NO: 2344188 - RNA, 16 nt, Human
ccgcaucuucuccauc

SEQ ID NO: 2344189 - RNA, 15 nt, Human
ccgcaucuucuccau

SEQ ID NO: 2344190 - RNA, 12 nt, Human
ccgcaucuucuc

SEQ ID NO: 2344191 - RNA, 21 nt, Human
ccgcauccuagucucuaucau

SEQ ID NO: 2344192 - RNA, 14 nt, Human
ccgcagccucccuc

SEQ ID NO: 2344193 - RNA, 14 nt, Human
ccgcagcucuugcc

SEQ ID NO: 2344194 - RNA, 17 nt, Human
ccgcagcucuugcccuu

SEQ ID NO: 2344195 - RNA, 18 nt, Human
ccgcagcucuugcccuuc

SEQ ID NO: 2344196 - RNA, 20 nt, Human
ccgcagcucuugcccuuccc

SEQ ID NO: 2344197 - RNA, 22 nt, Human
ccgcagcucuugcccuucccug

SEQ ID NO: 2344198 - RNA, 23 nt, Human
cccuucucugcuccaccacaucc

SEQ ID NO: 2344199 - RNA, 23 nt, Human
cccuucucuguagggaacucugg

SEQ ID NO: 2344200 - RNA, 20 nt, Human
cccuucucugcuccaccaca

SEQ ID NO: 2344201 - RNA, 17 nt, Human
cccuucucugcuccacc

SEQ ID NO: 2344202 - RNA, 16 nt, Human
cccuucucugcuccac

SEQ ID NO: 2344203 - RNA, 15 nt, Human
cccuucucugcucca

SEQ ID NO: 2344204 - RNA, 14 nt, Human
cccuucucugcucc

SEQ ID NO: 2344205 - RNA, 13 nt, Human
cccuucucugcuc

SEQ ID NO: 2344206 - RNA, 22 nt, Human
cccuucucuccagccccuggau

SEQ ID NO: 2344207 - RNA, 21 nt, Human
cccuuccuuuucccugcuucc

SEQ ID NO: 2344208 - RNA, 22 nt, Human
cccuuccuuuucccugcuucca

SEQ ID NO: 2344209 - RNA, 19 nt, Human
cccugugacauggugccug

SEQ ID NO: 2344210 - RNA, 20 nt, Human
cccugugacauggugccuga

SEQ ID NO: 2344211 - RNA, 21 nt, Human
cccugugacauggugccugag

SEQ ID NO: 2344212 - RNA, 19 nt, Human
cccuuccuuuucccugcuu

SEQ ID NO: 2344213 - RNA, 21 nt, Human
cccuucucuccagccccugga

SEQ ID NO: 2344214 - RNA, 14 nt, Human
cccuucgcuccugu

SEQ ID NO: 2344215 - RNA, 15 nt, Human
cccuucgcuccugug

SEQ ID NO: 2344216 - RNA, 13 nt, Human
ccggccccugcug

SEQ ID NO: 2344217 - RNA, 17 nt, Human
ccggcccccagagcgcc

SEQ ID NO: 2344218 - RNA, 18 nt, Human
ccggccccagccagaguu

SEQ ID NO: 2344219 - RNA, 13 nt, Human
ccggcccccuggu

SEQ ID NO: 2344220 - RNA, 15 nt, Human
ccggcccccuggucu

SEQ ID NO: 2344221 - RNA, 19 nt, Human
ccggcccccuggucucugg

SEQ ID NO: 2344222 - RNA, 20 nt, Human
ccggcccccuggucucuggu

SEQ ID NO: 2344223 - RNA, 16 nt, Human
ccggccccggccccag

SEQ ID NO: 2344224 - RNA, 17 nt, Human
ccggccccagccagagu

SEQ ID NO: 2344225 - RNA, 14 nt, Human
ccggccccugcugg

SEQ ID NO: 2344226 - RNA, 18 nt, Human
ccggccucucuggccucc

SEQ ID NO: 2344227 - RNA, 19 nt, Human
ccggccccggccccagcca

SEQ ID NO: 2344228 - RNA, 20 nt, Human
ccggccucucuggccuccca

SEQ ID NO: 2344229 - RNA, 21 nt, Human
ccggccucucuggccucccac

SEQ ID NO: 2344230 - RNA, 22 nt, Human
ccggccucucuggccucccacc

SEQ ID NO: 2344231 - RNA, 21 nt, Human
ccggccugaugacagagcgag

SEQ ID NO: 2344232 - RNA, 17 nt, Human
ccggcgagcccugugga

SEQ ID NO: 2344233 - RNA, 14 nt, Human
ccggcgcccucugu

SEQ ID NO: 2344234 - RNA, 15 nt, Human
ccggcgcccucuguc

SEQ ID NO: 2344235 - RNA, 17 nt, Human
ccggcgcccucuguccu

SEQ ID NO: 2344236 - RNA, 18 nt, Human
ccggcgcccucuguccug

SEQ ID NO: 2344237 - RNA, 19 nt, Human
ccggcgcccucuguccuga

SEQ ID NO: 2344238 - RNA, 21 nt, Human
ccggcgcccucuguccugacu

SEQ ID NO: 2344239 - RNA, 15 nt, Human
ccggcgagcccugug

SEQ ID NO: 2344240 - RNA, 20 nt, Human
ccggccugcucccagcagcc

SEQ ID NO: 2344241 - RNA, 16 nt, Human
ccggccugcucccagc

SEQ ID NO: 2344242 - RNA, 16 nt, Human
ccggcgugguggaaga

SEQ ID NO: 2344243 - RNA, 23 nt, Human
ccggcgucagccuccagccucug

SEQ ID NO: 2344244 - RNA, 19 nt, Human
ccggcgucagccuccagcc

SEQ ID NO: 2344245 - RNA, 20 nt, Human
ccggcgucagccuccagccu

SEQ ID NO: 2344246 - RNA, 21 nt, Human
ccggcgucagccuccagccuc

SEQ ID NO: 2344247 - RNA, 22 nt, Human
ccggcgucagccuccagccucu

SEQ ID NO: 2344248 - RNA, 21 nt, Human
ccggcgcuugccacuagggcu

SEQ ID NO: 2344249 - RNA, 19 nt, Human
ccggcggcccaagcccgac

SEQ ID NO: 2344250 - RNA, 16 nt, Human
ccggcgggcgggccgg

SEQ ID NO: 2344251 - RNA, 13 nt, Human
ccggcgucagccu

SEQ ID NO: 2344252 - RNA, 14 nt, Human
ccggcgucagccuc

SEQ ID NO: 2344253 - RNA, 15 nt, Human
ccggcgucagccucc

SEQ ID NO: 2344254 - RNA, 16 nt, Human
ccggcgucagccucca

SEQ ID NO: 2344255 - RNA, 17 nt, Human
ccggcgucagccuccag

SEQ ID NO: 2344256 - RNA, 19 nt, Human
ccucagcugccucacuucc

SEQ ID NO: 2344257 - RNA, 21 nt, Human
ccucagccuugccagagaucc

SEQ ID NO: 2344258 - RNA, 20 nt, Human
ccucagcugccucacuuccu

SEQ ID NO: 2344259 - RNA, 14 nt, Human
ccucagcugcuucu

SEQ ID NO: 2344260 - RNA, 20 nt, Human
ccucagccuugccagagauc

SEQ ID NO: 2344261 - RNA, 19 nt, Human
ccucagccuugccagagau

SEQ ID NO: 2344262 - RNA, 18 nt, Human
ccucagccuugccagaga

SEQ ID NO: 2344263 - RNA, 17 nt, Human
ccucagccuugccagag

SEQ ID NO: 2344264 - RNA, 13 nt, Human
ccucaggacugca

SEQ ID NO: 2344265 - RNA, 18 nt, Human
ccucaggacugcaacagg

SEQ ID NO: 2344266 - RNA, 16 nt, Human
ccucaggaaugggcug

SEQ ID NO: 2344267 - RNA, 17 nt, Human
ccucaggaaugggcugu

SEQ ID NO: 2344268 - RNA, 18 nt, Human
ccucaggacaaugucuga

SEQ ID NO: 2344269 - RNA, 23 nt, Human
ccucauggaauuggagcucgugg

SEQ ID NO: 2344270 - RNA, 15 nt, Human
ccucauggccccucu

SEQ ID NO: 2344271 - RNA, 16 nt, Human
ccucauggccccucug

SEQ ID NO: 2344272 - RNA, 16 nt, Human
ccucagccugugcugc

SEQ ID NO: 2344273 - RNA, 22 nt, Human
ccucagccuuccccuugcccag

SEQ ID NO: 2344274 - RNA, 12 nt, Human
ccucagccugug

SEQ ID NO: 2344275 - RNA, 11 nt, Human
ccucagccugu

SEQ ID NO: 2344276 - RNA, 22 nt, Human
ccucagccuggccagacacagg

SEQ ID NO: 2344277 - RNA, 14 nt, Human
ccucaaagucugca

SEQ ID NO: 2344278 - RNA, 19 nt, Human
ccucagccuggccagacac

SEQ ID NO: 2344279 - RNA, 16 nt, Human
ccucaaaggcccgcuc

SEQ ID NO: 2344280 - RNA, 21 nt, Human
ccucagccuggccagacacag

SEQ ID NO: 2344281 - RNA, 20 nt, Human
ccucagccuggccagacaca

SEQ ID NO: 2344282 - RNA, 16 nt, Human
ccucaaaagcacccuu

SEQ ID NO: 2344283 - RNA, 13 nt, Human
ccucaaacacugc

SEQ ID NO: 2344284 - RNA, 15 nt, Human
ccucaaacacugcag

SEQ ID NO: 2344285 - RNA, 17 nt, Human
ccucaaacacugcaggc

SEQ ID NO: 2344286 - RNA, 18 nt, Human
ccucaaacacugcaggca

SEQ ID NO: 2344287 - RNA, 21 nt, Human
ccucaaacacugcaggcauca

SEQ ID NO: 2344288 - RNA, 22 nt, Human
ccucaaacaguagguuggcagu

SEQ ID NO: 2344289 - RNA, 13 nt, Human
ccucaaaccuccu

SEQ ID NO: 2344290 - RNA, 15 nt, Human
ccucaaaccuccucu

SEQ ID NO: 2344291 - RNA, 16 nt, Human
ccucaaaccuccucuu

SEQ ID NO: 2344292 - RNA, 18 nt, Human
ccucaaaccuccucuucu

SEQ ID NO: 2344293 - RNA, 20 nt, Human
ccuauuuuuuuucuguuaua

SEQ ID NO: 2344294 - RNA, 20 nt, Human
ccucaaaaagauuuccccau

SEQ ID NO: 2344295 - RNA, 21 nt, Human
ccucccacccccuucucugcu

SEQ ID NO: 2344296 - RNA, 20 nt, Human
ccucccacccccuucucugc

SEQ ID NO: 2344297 - RNA, 12 nt, Human
ccucccacccga

SEQ ID NO: 2344298 - RNA, 19 nt, Human
ccucccacccgaugcugcu

SEQ ID NO: 2344299 - RNA, 21 nt, Human
ccucccacccgaugcugcuuu

SEQ ID NO: 2344300 - RNA, 14 nt, Human
ccucccauccccug

SEQ ID NO: 2344301 - RNA, 13 nt, Human
ccucccaucucac

SEQ ID NO: 2344302 - RNA, 16 nt, Human
ccucccaucucacaca

SEQ ID NO: 2344303 - RNA, 20 nt, Human
ccuccccaaaucaauacacu

SEQ ID NO: 2344304 - RNA, 17 nt, Human
ccucccauccccuggac

SEQ ID NO: 2344305 - RNA, 13 nt, Human
ccucccaucuggg

SEQ ID NO: 2344306 - RNA, 16 nt, Human
ccucccaucugggagu

SEQ ID NO: 2344307 - RNA, 21 nt, Human
ccucccaucugggaguccccu

SEQ ID NO: 2344308 - RNA, 21 nt, Human
ccuccccaacccugccccugc

SEQ ID NO: 2344309 - RNA, 16 nt, Human
ccuccccaacccugcc

SEQ ID NO: 2344310 - RNA, 15 nt, Human
ccucccauggcaccu

SEQ ID NO: 2344311 - RNA, 19 nt, Human
ccucaugguggguucaggg

SEQ ID NO: 2344312 - RNA, 21 nt, Human
ccucauguacauacccuggcc

SEQ ID NO: 2344313 - RNA, 18 nt, Human
ccucauggccccucugac

SEQ ID NO: 2344314 - RNA, 22 nt, Human
ccucauggccccucugaccugc

SEQ ID NO: 2344315 - RNA, 23 nt, Human
ccucauuuuugaauacaggcaua

SEQ ID NO: 2344316 - RNA, 19 nt, Human
ccuccaacaccaagcacag

SEQ ID NO: 2344317 - RNA, 16 nt, Human
ccuccaaaggcccccu

SEQ ID NO: 2344318 - RNA, 17 nt, Human
ccuccaaaggcccccua

SEQ ID NO: 2344319 - RNA, 19 nt, Human
ccuccaaaacuccugcccc

SEQ ID NO: 2344320 - RNA, 15 nt, Human
ccuccaaaagcacuu

SEQ ID NO: 2344321 - RNA, 13 nt, Human
ccucccacccccu

SEQ ID NO: 2344322 - RNA, 17 nt, Human
ccucccacccccaucuc

SEQ ID NO: 2344323 - RNA, 13 nt, Human
ccucccaccccca

SEQ ID NO: 2344324 - RNA, 16 nt, Human
ccucccacccaccgcc

SEQ ID NO: 2344325 - RNA, 12 nt, Human
ccucccaccccc

SEQ ID NO: 2344326 - RNA, 19 nt, Human
ccuccaaccuggggggcag

SEQ ID NO: 2344327 - RNA, 15 nt, Human
ccucccaccucagcc

SEQ ID NO: 2344328 - RNA, 17 nt, Human
ccucccaccucagccuc

SEQ ID NO: 2344329 - RNA, 22 nt, Human
ccaaucauuuuaauuauuauuc

SEQ ID NO: 2344330 - RNA, 15 nt, Human
ccaaugauggucacc

SEQ ID NO: 2344331 - RNA, 19 nt, Human
ccaaugaggucugaaaugg

SEQ ID NO: 2344332 - RNA, 14 nt, Human
ccaaugcacuuugu

SEQ ID NO: 2344333 - RNA, 18 nt, Human
ccaauauuucucagacau

SEQ ID NO: 2344334 - RNA, 14 nt, Human
ccaauauuuguaga

SEQ ID NO: 2344335 - RNA, 20 nt, Human
ccaauauuuucuuuaaugcu

SEQ ID NO: 2344336 - RNA, 17 nt, Human
ccaauauuuaccagacc

SEQ ID NO: 2344337 - RNA, 22 nt, Human
ccaauauuuucuuuaaugcuuu

SEQ ID NO: 2344338 - RNA, 12 nt, Human
ccaaucauuuua

SEQ ID NO: 2344339 - RNA, 14 nt, Human
ccaaucauuuuaau

SEQ ID NO: 2344340 - RNA, 12 nt, Human
ccaaugaaauga

SEQ ID NO: 2344341 - RNA, 22 nt, Human
ccaagcuccuugggaggcccca

SEQ ID NO: 2344342 - RNA, 18 nt, Human
ccaagcucuagugggaag

SEQ ID NO: 2344343 - RNA, 14 nt, Human
ccaagcucucugca

SEQ ID NO: 2344344 - RNA, 15 nt, Human
ccaagcucucugcau

SEQ ID NO: 2344345 - RNA, 18 nt, Human
ccaagcucugcuccucuc

SEQ ID NO: 2344346 - RNA, 23 nt, Human
ccaagcugccuccccucuccuuc

SEQ ID NO: 2344347 - RNA, 19 nt, Human
ccaagcuccuugggaggcc

SEQ ID NO: 2344348 - RNA, 17 nt, Human
ccaagcuccuugggagg

SEQ ID NO: 2344349 - RNA, 15 nt, Human
ccaagcuccuuggga

SEQ ID NO: 2344350 - RNA, 14 nt, Human
ccaagcuccuuggg

SEQ ID NO: 2344351 - RNA, 12 nt, Human
ccaagcucugcu

SEQ ID NO: 2344352 - RNA, 17 nt, Human
ccaagcucugcuccucu

SEQ ID NO: 2344353 - RNA, 13 nt, Human
ccaagcucugcuc

SEQ ID NO: 2344354 - RNA, 22 nt, Human
ccaaauguaauugaauaaaguu

SEQ ID NO: 2344355 - RNA, 18 nt, Human
ccaaauguaauugaauaa

SEQ ID NO: 2344356 - RNA, 23 nt, Human
ccaaauggaaaugggcagagcag

SEQ ID NO: 2344357 - RNA, 14 nt, Human
ccaacucaccccag

SEQ ID NO: 2344358 - RNA, 17 nt, Human
ccaaauguucaucaaug

SEQ ID NO: 2344359 - RNA, 17 nt, Human
ccaacugggcccaagac

SEQ ID NO: 2344360 - RNA, 18 nt, Human
ccaacuguguucauuaga

SEQ ID NO: 2344361 - RNA, 13 nt, Human
ccaacuguauaua

SEQ ID NO: 2344362 - RNA, 16 nt, Human
ccaacugggcccaaga

SEQ ID NO: 2344363 - RNA, 12 nt, Human
ccaacugcugcu

SEQ ID NO: 2344364 - RNA, 13 nt, Human
ccaacugcugcuu

SEQ ID NO: 2344365 - RNA, 14 nt, Human
ccaacugcugcuuu

SEQ ID NO: 2344366 - RNA, 22 nt, Human
ccaacuccuggaagcugugucc

SEQ ID NO: 2344367 - RNA, 19 nt, Human
ccaacuccuggaagcugug

SEQ ID NO: 2344368 - RNA, 15 nt, Human
ccaacuccuggaagc

SEQ ID NO: 2344369 - RNA, 21 nt, Human
ccaacucuagcuggggguggg

SEQ ID NO: 2344370 - RNA, 14 nt, Human
ccaacucuagcugg

SEQ ID NO: 2344371 - RNA, 12 nt, Human
ccaacucuccug

SEQ ID NO: 2344372 - RNA, 16 nt, Human
ccaacucaccccagcc

SEQ ID NO: 2344373 - RNA, 17 nt, Human
ccaacucaccccagccc

SEQ ID NO: 2344374 - RNA, 18 nt, Human
ccaacucaccccagcccc

SEQ ID NO: 2344375 - RNA, 17 nt, Human
ccaaugggagcucaugg

SEQ ID NO: 2344376 - RNA, 15 nt, Human
ccaauguaggagcug

SEQ ID NO: 2344377 - RNA, 20 nt, Human
ccaauggguuuuucccugua

SEQ ID NO: 2344378 - RNA, 19 nt, Human
ccaaugugaacagcggcug

SEQ ID NO: 2344379 - RNA, 12 nt, Human
ccaaugucuuga

SEQ ID NO: 2344380 - RNA, 20 nt, Human
ccaauguaggagcugccuug

SEQ ID NO: 2344381 - RNA, 17 nt, Human
ccaauguaggagcugcc

SEQ ID NO: 2344382 - RNA, 21 nt, Human
ccaauguauugauaagagggc

SEQ ID NO: 2344383 - RNA, 11 nt, Human
ccaaugucugc

SEQ ID NO: 2344384 - RNA, 18 nt, Human
ccaaugucugccacacaa

SEQ ID NO: 2344385 - RNA, 11 nt, Human
cauuugugagg

SEQ ID NO: 2344386 - RNA, 12 nt, Human
cauuugugaggc

SEQ ID NO: 2344387 - RNA, 15 nt, Human
cauuugugaggccca

SEQ ID NO: 2344388 - RNA, 19 nt, Human
cauuugugugugugcaagu

SEQ ID NO: 2344389 - RNA, 13 nt, Human
cauuugugugugu

SEQ ID NO: 2344390 - RNA, 15 nt, Human
cauuugugucaaugg

SEQ ID NO: 2344391 - RNA, 14 nt, Human
cauuugugucaaug

SEQ ID NO: 2344392 - RNA, 22 nt, Human
cauuugugugugugcaagugug

SEQ ID NO: 2344393 - RNA, 13 nt, Human
cauuuuuucaguc

SEQ ID NO: 2344394 - RNA, 18 nt, Human
cauuuuuuuccaggcugg

SEQ ID NO: 2344395 - RNA, 15 nt, Human
cauuuuuuuccaggc

SEQ ID NO: 2344396 - RNA, 17 nt, Human
cauuuuuuuccaggcug

SEQ ID NO: 2344397 - RNA, 17 nt, Human
cauuuuuuuaauuuauu

SEQ ID NO: 2344398 - RNA, 20 nt, Human
cauuuuuuuaauuuauuauu

SEQ ID NO: 2344399 - RNA, 19 nt, Human
cauuuguauaaaauaauuu

SEQ ID NO: 2344400 - RNA, 20 nt, Human
cauuuguauaaaauaauuuu

SEQ ID NO: 2344401 - RNA, 17 nt, Human
cauuuguauaaaauaau

SEQ ID NO: 2344402 - RNA, 22 nt, Human
cauuuuuuuuaagaaaaaggau

SEQ ID NO: 2344403 - RNA, 20 nt, Human
ccaaaacucuccucugcugc

SEQ ID NO: 2344404 - RNA, 16 nt, Human
ccaaaacugugcagag

SEQ ID NO: 2344405 - RNA, 11 nt, Human
ccaaaacugug

SEQ ID NO: 2344406 - RNA, 21 nt, Human
ccaaaacucuccucugcugcu

SEQ ID NO: 2344407 - RNA, 22 nt, Human
ccaaaagaagcccccagcuaag

SEQ ID NO: 2344408 - RNA, 16 nt, Human
ccaaaagauugcugaa

SEQ ID NO: 2344409 - RNA, 22 nt, Human
ccaaaagauugcugaaauuuua

SEQ ID NO: 2344410 - RNA, 19 nt, Human
ccaaaagauugcugaaauu

SEQ ID NO: 2344411 - RNA, 16 nt, Human
ccacuccuccaaagga

SEQ ID NO: 2344412 - RNA, 12 nt, Human
ccacuccuccaa

SEQ ID NO: 2344413 - RNA, 20 nt, Human
ccacuccgagaggugggcca

SEQ ID NO: 2344414 - RNA, 18 nt, Human
ccacucuacccucccacc

SEQ ID NO: 2344415 - RNA, 12 nt, Human
ccacuccucuga

SEQ ID NO: 2344416 - RNA, 14 nt, Human
ccacuccuccuagc

SEQ ID NO: 2344417 - RNA, 16 nt, Human
ccacuccgagaggugg

SEQ ID NO: 2344418 - RNA, 17 nt, Human
ccacuccgagagguggg

SEQ ID NO: 2344419 - RNA, 19 nt, Human
ccacuccgagaggugggcc

SEQ ID NO: 2344420 - RNA, 23 nt, Human
ccacuccgagaggugggccaguc

SEQ ID NO: 2344421 - RNA, 20 nt, Human
ccacucuacccucccacccc

SEQ ID NO: 2344422 - RNA, 19 nt, Human
ccacucuacccucccaccc

SEQ ID NO: 2344423 - RNA, 21 nt, Human
ccacucuacccucccaccccc

SEQ ID NO: 2344424 - RNA, 19 nt, Human
ccacucuagggcaguggag

SEQ ID NO: 2344425 - RNA, 23 nt, Human
ccacucuaggggucaggcuccau

SEQ ID NO: 2344426 - RNA, 21 nt, Human
ccacucuaggggucaggcucc

SEQ ID NO: 2344427 - RNA, 22 nt, Human
ccacucuaggggucaggcucca

SEQ ID NO: 2344428 - RNA, 16 nt, Human
ccacucuccccacacu

SEQ ID NO: 2344429 - RNA, 15 nt, Human
ccacucuccccacac

SEQ ID NO: 2344430 - RNA, 14 nt, Human
ccacucuccccaca

SEQ ID NO: 2344431 - RNA, 13 nt, Human
ccacucuccccac

SEQ ID NO: 2344432 - RNA, 12 nt, Human
ccacucucccca

SEQ ID NO: 2344433 - RNA, 19 nt, Human
ccacucucauuccccaggu

SEQ ID NO: 2344434 - RNA, 18 nt, Human
ccacucucauuccccagg

SEQ ID NO: 2344435 - RNA, 17 nt, Human
ccacucucauuccccag

SEQ ID NO: 2344436 - RNA, 16 nt, Human
ccacucucauucccca

SEQ ID NO: 2344437 - RNA, 14 nt, Human
ccacucucauuccc

SEQ ID NO: 2344438 - RNA, 17 nt, Human
ccacucccugcaaccug

SEQ ID NO: 2344439 - RNA, 14 nt, Human
ccaccaccccagcu

SEQ ID NO: 2344440 - RNA, 16 nt, Human
ccaccaccacuggcca

SEQ ID NO: 2344441 - RNA, 15 nt, Human
ccaccaccagaaagc

SEQ ID NO: 2344442 - RNA, 11 nt, Human
ccaccacccaa

SEQ ID NO: 2344443 - RNA, 21 nt, Human
ccaccacagccagcaccuggc

SEQ ID NO: 2344444 - RNA, 17 nt, Human
ccaccaccaauugccaa

SEQ ID NO: 2344445 - RNA, 14 nt, Human
ccaccaccacuggc

SEQ ID NO: 2344446 - RNA, 15 nt, Human
ccaccaccacuggcc

SEQ ID NO: 2344447 - RNA, 13 nt, Human
ccaccaucaagcc

SEQ ID NO: 2344448 - RNA, 14 nt, Human
ccaccaucaagcca

SEQ ID NO: 2344449 - RNA, 17 nt, Human
ccaccacaccgcagaag

SEQ ID NO: 2344450 - RNA, 21 nt, Human
ccaccacacugauccagcccu

SEQ ID NO: 2344451 - RNA, 14 nt, Human
ccaccacagccagc

SEQ ID NO: 2344452 - RNA, 15 nt, Human
ccaccacagccagca

SEQ ID NO: 2344453 - RNA, 18 nt, Human
ccaccacagccagcaccu

SEQ ID NO: 2344454 - RNA, 20 nt, Human
ccaccacagccagcaccugg

SEQ ID NO: 2344455 - RNA, 17 nt, Human
ccaccacacccagccca

SEQ ID NO: 2344456 - RNA, 19 nt, Human
ccacagcucccaccccacc

SEQ ID NO: 2344457 - RNA, 23 nt, Human
ccaccauauucagugcuguggcc

SEQ ID NO: 2344458 - RNA, 15 nt, Human
ccacccugggcccug

SEQ ID NO: 2344459 - RNA, 22 nt, Human
ccaccauauucagugcuguggc

SEQ ID NO: 2344460 - RNA, 18 nt, Human
ccaccauauucagugcug

SEQ ID NO: 2344461 - RNA, 15 nt, Human
ccaccaucaagccac

SEQ ID NO: 2344462 - RNA, 16 nt, Human
ccacccugggcccugg

SEQ ID NO: 2344463 - RNA, 17 nt, Human
ccacccugggcccuggg

SEQ ID NO: 2344464 - RNA, 20 nt, Human
ccacccugggcccugggcug

SEQ ID NO: 2344465 - RNA, 22 nt, Human
ccacccugggcccugggcugga

SEQ ID NO: 2344466 - RNA, 12 nt, Human
ccacccugggcu

SEQ ID NO: 2344467 - RNA, 13 nt, Human
ccacccugggcuc

SEQ ID NO: 2344468 - RNA, 15 nt, Human
ccacccugggcucug

SEQ ID NO: 2344469 - RNA, 16 nt, Human
ccacccugggcucugg

SEQ ID NO: 2344470 - RNA, 17 nt, Human
ccacccugggcucugug

SEQ ID NO: 2344471 - RNA, 18 nt, Human
ccacccugggcucugugg

SEQ ID NO: 2344472 - RNA, 20 nt, Human
ccacccugggcucugugggc

SEQ ID NO: 2344473 - RNA, 23 nt, Human
ccacccugggcucugugggcugc

SEQ ID NO: 2344474 - RNA, 14 nt, Human
ccacccuuccccuc

SEQ ID NO: 2344475 - RNA, 12 nt, Human
ccacccuugccc

SEQ ID NO: 2344476 - RNA, 13 nt, Human
ccacccuugccca

SEQ ID NO: 2344477 - RNA, 12 nt, Human
ccacccuguguu

SEQ ID NO: 2344478 - RNA, 21 nt, Human
ccacccugucccccagcucug

SEQ ID NO: 2344479 - RNA, 22 nt, Human
ccacccugucccccagcucugg

SEQ ID NO: 2344480 - RNA, 14 nt, Human
ccacccuguccccc

SEQ ID NO: 2344481 - RNA, 16 nt, Human
ccacccugucccccag

SEQ ID NO: 2344482 - RNA, 18 nt, Human
ccacccugucccccagcu

SEQ ID NO: 2344483 - RNA, 19 nt, Human
ccacccugucccccagcuc

SEQ ID NO: 2344484 - RNA, 15 nt, Human
ccacccuuggccugu

SEQ ID NO: 2344485 - RNA, 14 nt, Human
ccacccuuggccug

SEQ ID NO: 2344486 - RNA, 13 nt, Human
ccacccuuggccu

SEQ ID NO: 2344487 - RNA, 12 nt, Human
ccacccuuggcc

SEQ ID NO: 2344488 - RNA, 17 nt, Human
ccacccuuggccugucu

SEQ ID NO: 2344489 - RNA, 16 nt, Human
ccacccuuggccuguc

SEQ ID NO: 2344490 - RNA, 19 nt, Human
ccacccuuggccugucuca

SEQ ID NO: 2344491 - RNA, 20 nt, Human
ccacccuuggaggcugucuu

SEQ ID NO: 2344492 - RNA, 12 nt, Human
ccacagcaggug

SEQ ID NO: 2344493 - RNA, 20 nt, Human
ccacagcaucauuuugcauu

SEQ ID NO: 2344494 - RNA, 15 nt, Human
ccacagccagcaccu

SEQ ID NO: 2344495 - RNA, 14 nt, Human
ccacagcagcugaa

SEQ ID NO: 2344496 - RNA, 20 nt, Human
ccacagcaaggcaccugcag

SEQ ID NO: 2344497 - RNA, 23 nt, Human
ccacagcaguugaaaagacucca

SEQ ID NO: 2344498 - RNA, 18 nt, Human
ccacagcaguugaaaaga

SEQ ID NO: 2344499 - RNA, 17 nt, Human
ccacagcaguugaaaag

SEQ ID NO: 2344500 - RNA, 20 nt, Human
ccacagccuccccugccagg

SEQ ID NO: 2344501 - RNA, 19 nt, Human
ccacagccuccccugccag

SEQ ID NO: 2344502 - RNA, 16 nt, Human
ccacagccuccccugc

SEQ ID NO: 2344503 - RNA, 17 nt, Human
ccacagccagcaccugg

SEQ ID NO: 2344504 - RNA, 18 nt, Human
ccacagccagcaccuggc

SEQ ID NO: 2344505 - RNA, 19 nt, Human
ccacagccagcaccuggca

SEQ ID NO: 2344506 - RNA, 22 nt, Human
ccacagccagcaccuggcaucg

SEQ ID NO: 2344507 - RNA, 17 nt, Human
ccacagcucccacccca

SEQ ID NO: 2344508 - RNA, 16 nt, Human
ccacagcucccacccc

SEQ ID NO: 2344509 - RNA, 15 nt, Human
ccacagcucccaccc

SEQ ID NO: 2344510 - RNA, 13 nt, Human
ccacagcucccac

SEQ ID NO: 2344511 - RNA, 23 nt, Human
ccacagcgcuggccgggaccccg

SEQ ID NO: 2344512 - RNA, 18 nt, Human
ccacagaugccuccaccc

SEQ ID NO: 2344513 - RNA, 20 nt, Human
ccacagcaaccccaggcuga

SEQ ID NO: 2344514 - RNA, 19 nt, Human
ccacagcaaccccaggcug

SEQ ID NO: 2344515 - RNA, 17 nt, Human
ccacagcaaggcaccug

SEQ ID NO: 2344516 - RNA, 19 nt, Human
ccacagcaaggcaccugca

SEQ ID NO: 2344517 - RNA, 14 nt, Human
ccacagcacagcca

SEQ ID NO: 2344518 - RNA, 12 nt, Human
ccacagcaguug

SEQ ID NO: 2344519 - RNA, 14 nt, Human
ccacgcccuccccu

SEQ ID NO: 2344520 - RNA, 23 nt, Human
ccacgcccguccugccuguggcg

SEQ ID NO: 2344521 - RNA, 15 nt, Human
ccacgcccuccccuc

SEQ ID NO: 2344522 - RNA, 20 nt, Human
ccacgcccuccccuccccug

SEQ ID NO: 2344523 - RNA, 17 nt, Human
ccacgcccuccccuccc

SEQ ID NO: 2344524 - RNA, 19 nt, Human
ccacgcccguccugccugu

SEQ ID NO: 2344525 - RNA, 20 nt, Human
ccacgcccguccugccugug

SEQ ID NO: 2344526 - RNA, 21 nt, Human
ccacgcccguccugccugugg

SEQ ID NO: 2344527 - RNA, 22 nt, Human
ccacgcccguccugccuguggc

SEQ ID NO: 2344528 - RNA, 23 nt, Human
ccacccuuuggggggggcccgcc

SEQ ID NO: 2344529 - RNA, 22 nt, Human
ccaccgaaguggacuggccccu

SEQ ID NO: 2344530 - RNA, 15 nt, Human
ccacccuuugggggg

SEQ ID NO: 2344531 - RNA, 18 nt, Human
ccaccgaagccgccugug

SEQ ID NO: 2344532 - RNA, 13 nt, Human
ccaccgcagacag

SEQ ID NO: 2344533 - RNA, 22 nt, Human
ccaccgcagacaggaccaggga

SEQ ID NO: 2344534 - RNA, 19 nt, Human
ccaccgcagacaggaccag

SEQ ID NO: 2344535 - RNA, 23 nt, Human
ccaccgaaguggacuggccccug

SEQ ID NO: 2344536 - RNA, 13 nt, Human
ccaccgcaugccc

SEQ ID NO: 2344537 - RNA, 16 nt, Human
ccaccgcaugcccccu

SEQ ID NO: 2344538 - RNA, 17 nt, Human
ccaccgcaugcccccuc

SEQ ID NO: 2344539 - RNA, 21 nt, Human
ccaccuuugaagaaguaagga

SEQ ID NO: 2344540 - RNA, 20 nt, Human
ccaccuuuauuaaaaucuua

SEQ ID NO: 2344541 - RNA, 18 nt, Human
ccaccgccauggcuucca

SEQ ID NO: 2344542 - RNA, 23 nt, Human
ccaccuuucagauaacuguuauu

SEQ ID NO: 2344543 - RNA, 13 nt, Human
ccaccgcccagag

SEQ ID NO: 2344544 - RNA, 18 nt, Human
ccaccgcaugcccccucg

SEQ ID NO: 2344545 - RNA, 13 nt, Human
ccaccgccauggc

SEQ ID NO: 2344546 - RNA, 14 nt, Human
ccaccgccauggcu

SEQ ID NO: 2344547 - RNA, 17 nt, Human
ccaccgccauggcuucc

SEQ ID NO: 2344548 - RNA, 17 nt, Human
ccaccgcccagagaccc

SEQ ID NO: 2344549 - RNA, 13 nt, Human
ccaccgccuccua

SEQ ID NO: 2344550 - RNA, 16 nt, Human
ccacgcccccacuggu

SEQ ID NO: 2344551 - RNA, 17 nt, Human
ccacgcccccacuggug

SEQ ID NO: 2344552 - RNA, 14 nt, Human
ccacgacugucucc

SEQ ID NO: 2344553 - RNA, 23 nt, Human
ccacgaauuugcuggggaaucuc

SEQ ID NO: 2344554 - RNA, 15 nt, Human
ccacgaauuugcugg

SEQ ID NO: 2344555 - RNA, 19 nt, Human
ccacgaauuugcuggggaa

SEQ ID NO: 2344556 - RNA, 14 nt, Human
ccaccuuuucagcg

SEQ ID NO: 2344557 - RNA, 13 nt, Human
ccacgcccggcua

SEQ ID NO: 2344558 - RNA, 15 nt, Human
ccacgacugucucca

SEQ ID NO: 2344559 - RNA, 15 nt, Human
ccacgcccguccugc

SEQ ID NO: 2344560 - RNA, 17 nt, Human
ccacgcccguccugccu

SEQ ID NO: 2344561 - RNA, 18 nt, Human
ccacgcccguccugccug

SEQ ID NO: 2344562 - RNA, 18 nt, Human
ccacgcccccacugguga

SEQ ID NO: 2344563 - RNA, 19 nt, Human
ccacgcccccacuggugac

SEQ ID NO: 2344564 - RNA, 22 nt, Human
cauauguuucgcugauauaugu

SEQ ID NO: 2344565 - RNA, 15 nt, Human
cauauguugcucagu

SEQ ID NO: 2344566 - RNA, 16 nt, Human
cauauguugcucaguc

SEQ ID NO: 2344567 - RNA, 15 nt, Human
cauauggcccagugu

SEQ ID NO: 2344568 - RNA, 16 nt, Human
cauauggcccaguguc

SEQ ID NO: 2344569 - RNA, 20 nt, Human
cauauggcccagugucaagu

SEQ ID NO: 2344570 - RNA, 21 nt, Human
cauauuccugcagccuggagg

SEQ ID NO: 2344571 - RNA, 18 nt, Human
cauauuccugcagccugg

SEQ ID NO: 2344572 - RNA, 17 nt, Human
cauauuccugcagccug

SEQ ID NO: 2344573 - RNA, 17 nt, Human
cauauuccauauuuauu

SEQ ID NO: 2344574 - RNA, 23 nt, Human
cauauucauguaaacaaaauuua

SEQ ID NO: 2344575 - RNA, 16 nt, Human
cauauuccauauuuau

SEQ ID NO: 2344576 - RNA, 16 nt, Human
cauauuaccacagaca

SEQ ID NO: 2344577 - RNA, 17 nt, Human
cauauucuguuggccag

SEQ ID NO: 2344578 - RNA, 18 nt, Human
cauauucuguuggccagu

SEQ ID NO: 2344579 - RNA, 19 nt, Human
cagugguggcagggccuag

SEQ ID NO: 2344580 - RNA, 12 nt, Human
cagugguggcag

SEQ ID NO: 2344581 - RNA, 14 nt, Human
cagugguggcaggg

SEQ ID NO: 2344582 - RNA, 16 nt, Human
cagugguggcagggcc

SEQ ID NO: 2344583 - RNA, 23 nt, Human
cauaugcuguauauccuuucuaa

SEQ ID NO: 2344584 - RNA, 18 nt, Human
cauauggacucugcacau

SEQ ID NO: 2344585 - RNA, 18 nt, Human
cauauggauuuucuauug

SEQ ID NO: 2344586 - RNA, 20 nt, Human
cauauggauuuucuauuguu

SEQ ID NO: 2344587 - RNA, 23 nt, Human
cauauggauuuucuauuguuacu

SEQ ID NO: 2344588 - RNA, 15 nt, Human
cauauggacucugca

SEQ ID NO: 2344589 - RNA, 17 nt, Human
cauauggacucugcaca

SEQ ID NO: 2344590 - RNA, 20 nt, Human
cauauggacucugcacauga

SEQ ID NO: 2344591 - RNA, 22 nt, Human
caguggugguuuucuguucuuu

SEQ ID NO: 2344592 - RNA, 21 nt, Human
caguggugguuuucuguucuu

SEQ ID NO: 2344593 - RNA, 20 nt, Human
caguggugguuuucuguucu

SEQ ID NO: 2344594 - RNA, 19 nt, Human
caguggugguuuucuguuc

SEQ ID NO: 2344595 - RNA, 22 nt, Human
cauauuccugcagccuggaggc

SEQ ID NO: 2344596 - RNA, 13 nt, Human
cauauucugucug

SEQ ID NO: 2344597 - RNA, 19 nt, Human
caucacuggagcaccaggc

SEQ ID NO: 2344598 - RNA, 23 nt, Human
caucccgacauggacccggagcu

SEQ ID NO: 2344599 - RNA, 21 nt, Human
cauccccuguagagugggagc

SEQ ID NO: 2344600 - RNA, 20 nt, Human
caucacuugaauccuagggc

SEQ ID NO: 2344601 - RNA, 23 nt, Human
caucacuugaauccuagggccug

SEQ ID NO: 2344602 - RNA, 15 nt, Human
caucacuuguacaaa

SEQ ID NO: 2344603 - RNA, 14 nt, Human
caucacuuguacaa

SEQ ID NO: 2344604 - RNA, 14 nt, Human
caucacuucccuac

SEQ ID NO: 2344605 - RNA, 12 nt, Human
caucacuucccu

SEQ ID NO: 2344606 - RNA, 14 nt, Human
caucccguguucuc

SEQ ID NO: 2344607 - RNA, 16 nt, Human
caucccguguucuccu

SEQ ID NO: 2344608 - RNA, 21 nt, Human
caucccgggacgcagcaggag

SEQ ID NO: 2344609 - RNA, 17 nt, Human
caucccgagcaccucca

SEQ ID NO: 2344610 - RNA, 14 nt, Human
caucccuacccccu

SEQ ID NO: 2344611 - RNA, 18 nt, Human
caucccuaaugcugcaga

SEQ ID NO: 2344612 - RNA, 12 nt, Human
caucccuacccc

SEQ ID NO: 2344613 - RNA, 17 nt, Human
caucccguguucuccuu

SEQ ID NO: 2344614 - RNA, 21 nt, Human
caucccguguucuccuuuucc

SEQ ID NO: 2344615 - RNA, 15 nt, Human
cauccuggcacccgg

SEQ ID NO: 2344616 - RNA, 22 nt, Human
cauccugccuuagagccaggca

SEQ ID NO: 2344617 - RNA, 16 nt, Human
caucgccgggacucca

SEQ ID NO: 2344618 - RNA, 16 nt, Human
caucgcaccauucuga

SEQ ID NO: 2344619 - RNA, 23 nt, Human
cauccugccuuagagccaggcac

SEQ ID NO: 2344620 - RNA, 18 nt, Human
caucgcaccauucugacu

SEQ ID NO: 2344621 - RNA, 19 nt, Human
caucgcaccauucugacuc

SEQ ID NO: 2344622 - RNA, 22 nt, Human
cauccuggcacccggccccugc

SEQ ID NO: 2344623 - RNA, 21 nt, Human
caucguauaacacaauaugaa

SEQ ID NO: 2344624 - RNA, 21 nt, Human
caucggugaaacuaacagaua

SEQ ID NO: 2344625 - RNA, 13 nt, Human
caucgggcugagg

SEQ ID NO: 2344626 - RNA, 22 nt, Human
caucggugaaacuaacagauaa

SEQ ID NO: 2344627 - RNA, 14 nt, Human
caucugcugguccg

SEQ ID NO: 2344628 - RNA, 19 nt, Human
caucugcugguccguggga

SEQ ID NO: 2344629 - RNA, 16 nt, Human
caucugcucuccuucc

SEQ ID NO: 2344630 - RNA, 20 nt, Human
caucgugaaacccugucucu

SEQ ID NO: 2344631 - RNA, 18 nt, Human
caucugcucuccuuccug

SEQ ID NO: 2344632 - RNA, 20 nt, Human
caucugcucuccuuccugga

SEQ ID NO: 2344633 - RNA, 15 nt, Human
caucugugugaaaau

SEQ ID NO: 2344634 - RNA, 14 nt, Human
caucugugucuugu

SEQ ID NO: 2344635 - RNA, 13 nt, Human
caucugugucuug

SEQ ID NO: 2344636 - RNA, 11 nt, Human
caucugugucu

SEQ ID NO: 2344637 - RNA, 12 nt, Human
caucuguucugg

SEQ ID NO: 2344638 - RNA, 17 nt, Human
caucuguguuucaagug

SEQ ID NO: 2344639 - RNA, 12 nt, Human
caucuguuguuu

SEQ ID NO: 2344640 - RNA, 19 nt, Human
caucuguguuucaaguggg

SEQ ID NO: 2344641 - RNA, 20 nt, Human
caucuguuguuuuguuuuaa

SEQ ID NO: 2344642 - RNA, 11 nt, Human
caucuguuuuu

SEQ ID NO: 2344643 - RNA, 17 nt, Human
caucugugggcacgcug

SEQ ID NO: 2344644 - RNA, 15 nt, Human
caucugugcacgcag

SEQ ID NO: 2344645 - RNA, 21 nt, Human
caucugugcacugcccaugga

SEQ ID NO: 2344646 - RNA, 18 nt, Human
caucugugcacugcccau

SEQ ID NO: 2344647 - RNA, 17 nt, Human
caucugugcacugccca

SEQ ID NO: 2344648 - RNA, 15 nt, Human
caucugugauucccu

SEQ ID NO: 2344649 - RNA, 21 nt, Human
caucuggaaggggaucccacc

SEQ ID NO: 2344650 - RNA, 14 nt, Human
caucugugaauaag

SEQ ID NO: 2344651 - RNA, 20 nt, Human
caucugcuuacaauucccug

SEQ ID NO: 2344652 - RNA, 22 nt, Human
caucugcuuacaauucccugcu

SEQ ID NO: 2344653 - RNA, 17 nt, Human
caucuggaaccaucaga

SEQ ID NO: 2344654 - RNA, 12 nt, Human
caucuggaacca

SEQ ID NO: 2344655 - RNA, 19 nt, Human
caucuggaaccaucagaaa

SEQ ID NO: 2344656 - RNA, 21 nt, Human
caucuggaaucuggagaccag

SEQ ID NO: 2344657 - RNA, 16 nt, Human
caucuggaaucuggag

SEQ ID NO: 2344658 - RNA, 13 nt, Human
caugauguuuucc

SEQ ID NO: 2344659 - RNA, 17 nt, Human
caugauuuccuugaaug

SEQ ID NO: 2344660 - RNA, 16 nt, Human
caugauuuccuugaau

SEQ ID NO: 2344661 - RNA, 14 nt, Human
caugauuuccuuga

SEQ ID NO: 2344662 - RNA, 12 nt, Human
caugauuuccuu

SEQ ID NO: 2344663 - RNA, 23 nt, Human
caugcuacacacugcauguuugu

SEQ ID NO: 2344664 - RNA, 20 nt, Human
caugcuacacacugcauguu

SEQ ID NO: 2344665 - RNA, 14 nt, Human
caugcuacacacug

SEQ ID NO: 2344666 - RNA, 18 nt, Human
caugauuuccuugaaugu

SEQ ID NO: 2344667 - RNA, 24 nt, Human
caugauuuugaaaucaugaagaua

SEQ ID NO: 2344668 - RNA, 19 nt, Human
caugauguuaaccagaaua

SEQ ID NO: 2344669 - RNA, 20 nt, Human
caugauguggaguggggcag

SEQ ID NO: 2344670 - RNA, 22 nt, Human
caugauguuaaccagaauaaag

SEQ ID NO: 2344671 - RNA, 22 nt, Human
caugaugguuauuuucuuuucu

SEQ ID NO: 2344672 - RNA, 23 nt, Human
caugaugguuauuuucuuuucuu

SEQ ID NO: 2344673 - RNA, 20 nt, Human
caugauguagugccucuuuc

SEQ ID NO: 2344674 - RNA, 12 nt, Human
caugauguggag

SEQ ID NO: 2344675 - RNA, 14 nt, Human
caugauguuuagaa

SEQ ID NO: 2344676 - RNA, 20 nt, Human
caugauggcaacagaucugg

SEQ ID NO: 2344677 - RNA, 20 nt, Human
caugauggugcugaccucug

SEQ ID NO: 2344678 - RNA, 20 nt, Human
caugcugggaagacgccuga

SEQ ID NO: 2344679 - RNA, 22 nt, Human
caugcuggagccuguguaacag

SEQ ID NO: 2344680 - RNA, 23 nt, Human
caugcugggaagacgccugagcu

SEQ ID NO: 2344681 - RNA, 20 nt, Human
caugcuggggcaagucccug

SEQ ID NO: 2344682 - RNA, 13 nt, Human
caugcuggagccu

SEQ ID NO: 2344683 - RNA, 14 nt, Human
caugcuggagccug

SEQ ID NO: 2344684 - RNA, 15 nt, Human
caugcuggagccugu

SEQ ID NO: 2344685 - RNA, 16 nt, Human
caugcuggagccugug

SEQ ID NO: 2344686 - RNA, 17 nt, Human
caugcuggagccugugu

SEQ ID NO: 2344687 - RNA, 19 nt, Human
caugcuggagccuguguaa

SEQ ID NO: 2344688 - RNA, 22 nt, Human
caugcuggaggugacaucucuu

SEQ ID NO: 2344689 - RNA, 21 nt, Human
caugcugacuuucauuucuug

SEQ ID NO: 2344690 - RNA, 18 nt, Human
caugcugaagggaccuug

SEQ ID NO: 2344691 - RNA, 19 nt, Human
caugcugaagggaccuuga

SEQ ID NO: 2344692 - RNA, 12 nt, Human
caugcuggagcc

SEQ ID NO: 2344693 - RNA, 23 nt, Human
caugcucucugcagccagcccag

SEQ ID NO: 2344694 - RNA, 20 nt, Human
caugcucucugcagccagcc

SEQ ID NO: 2344695 - RNA, 19 nt, Human
caugcucucugcagccagc

SEQ ID NO: 2344696 - RNA, 16 nt, Human
caugcucucugcagcc

SEQ ID NO: 2344697 - RNA, 15 nt, Human
caugcucucugcagc

SEQ ID NO: 2344698 - RNA, 14 nt, Human
caugcucucugcag

SEQ ID NO: 2344699 - RNA, 21 nt, Human
caugcucucugcagccagccc

SEQ ID NO: 2344700 - RNA, 16 nt, Human
caugcucuuagaaaau

SEQ ID NO: 2344701 - RNA, 17 nt, Human
caugcucuuagaaaauu

SEQ ID NO: 2344702 - RNA, 15 nt, Human
caugcugaagccaaa

SEQ ID NO: 2344703 - RNA, 13 nt, Human
caugcugaaggga

SEQ ID NO: 2344704 - RNA, 16 nt, Human
caugcugaagccaaag

SEQ ID NO: 2344705 - RNA, 20 nt, Human
caugcugaagccaaagccaa

SEQ ID NO: 2344706 - RNA, 16 nt, Human
caugcuaucucugugu

SEQ ID NO: 2344707 - RNA, 13 nt, Human
caugcucucugca

SEQ ID NO: 2344708 - RNA, 14 nt, Human
caugcuaauuauau

SEQ ID NO: 2344709 - RNA, 15 nt, Human
cauggcuccagucug

SEQ ID NO: 2344710 - RNA, 14 nt, Human
cauggcuccagucu

SEQ ID NO: 2344711 - RNA, 13 nt, Human
cauggcuccaguc

SEQ ID NO: 2344712 - RNA, 17 nt, Human
cauggcuccagaaaugu

SEQ ID NO: 2344713 - RNA, 17 nt, Human
cauggcucccccuccac

SEQ ID NO: 2344714 - RNA, 22 nt, Human
cauggcuccagucugcugcccu

SEQ ID NO: 2344715 - RNA, 20 nt, Human
cauggcuccagucugcugcc

SEQ ID NO: 2344716 - RNA, 11 nt, Human
cauggcugaac

SEQ ID NO: 2344717 - RNA, 22 nt, Human
cauggcuauaaacaauuacaug

SEQ ID NO: 2344718 - RNA, 12 nt, Human
cauggcuaucug

SEQ ID NO: 2344719 - RNA, 15 nt, Human
cauggcuaagcuuua

SEQ ID NO: 2344720 - RNA, 18 nt, Human
caugcuggguucugcaca

SEQ ID NO: 2344721 - RNA, 16 nt, Human
caugcuggguucugca

SEQ ID NO: 2344722 - RNA, 17 nt, Human
caugcuggguucugcac

SEQ ID NO: 2344723 - RNA, 16 nt, Human
cauggcuaagcuuuau

SEQ ID NO: 2344724 - RNA, 14 nt, Human
caugggaaugaaug

SEQ ID NO: 2344725 - RNA, 15 nt, Human
caugggaaugaaugu

SEQ ID NO: 2344726 - RNA, 16 nt, Human
caugggaaugaauguc

SEQ ID NO: 2344727 - RNA, 17 nt, Human
caugggaaugaauguca

SEQ ID NO: 2344728 - RNA, 23 nt, Human
cauucuagguaggggcccacuuc

SEQ ID NO: 2344729 - RNA, 13 nt, Human
cauucuccaccug

SEQ ID NO: 2344730 - RNA, 14 nt, Human
cauucuccaccugc

SEQ ID NO: 2344731 - RNA, 16 nt, Human
cauucuccaccugcca

SEQ ID NO: 2344732 - RNA, 17 nt, Human
cauucuccacagcaacc

SEQ ID NO: 2344733 - RNA, 15 nt, Human
cauucuccacagcaa

SEQ ID NO: 2344734 - RNA, 18 nt, Human
cauucuccacagcaaccc

SEQ ID NO: 2344735 - RNA, 14 nt, Human
cauucuccacagca

SEQ ID NO: 2344736 - RNA, 15 nt, Human
cauucuacugaaaag

SEQ ID NO: 2344737 - RNA, 17 nt, Human
cauucuacacagagcag

SEQ ID NO: 2344738 - RNA, 19 nt, Human
cauucuacacagagcagga

SEQ ID NO: 2344739 - RNA, 22 nt, Human
cauucuacacagagcaggacug

SEQ ID NO: 2344740 - RNA, 16 nt, Human
cauucuacacagagca

SEQ ID NO: 2344741 - RNA, 14 nt, Human
cauucguucugugg

SEQ ID NO: 2344742 - RNA, 16 nt, Human
cauucgguguggugca

SEQ ID NO: 2344743 - RNA, 21 nt, Human
cauguuuacuuuucagggcau

SEQ ID NO: 2344744 - RNA, 19 nt, Human
cauguuuacuuuucagggc

SEQ ID NO: 2344745 - RNA, 13 nt, Human
cauuauaaacgug

SEQ ID NO: 2344746 - RNA, 18 nt, Human
cauuauaacugaaggaga

SEQ ID NO: 2344747 - RNA, 20 nt, Human
cauuauaacugaaggagaag

SEQ ID NO: 2344748 - RNA, 17 nt, Human
cauuauagaucccccag

SEQ ID NO: 2344749 - RNA, 13 nt, Human
cauguagaagcug

SEQ ID NO: 2344750 - RNA, 19 nt, Human
cauguagaagcugcaucuu

SEQ ID NO: 2344751 - RNA, 20 nt, Human
cauguagaaaauuuguuauu

SEQ ID NO: 2344752 - RNA, 20 nt, Human
cauguagcaggacugaauug

SEQ ID NO: 2344753 - RNA, 14 nt, Human
cauguagcaggacu

SEQ ID NO: 2344754 - RNA, 17 nt, Human
cauguagcccccuggcc

SEQ ID NO: 2344755 - RNA, 13 nt, Human
cauguagcccccu

SEQ ID NO: 2344756 - RNA, 22 nt, Human
cauguagcccccuggccucugu

SEQ ID NO: 2344757 - RNA, 21 nt, Human
cauguagcccccuggccucug

SEQ ID NO: 2344758 - RNA, 20 nt, Human
cauguagcccccuggccucu

SEQ ID NO: 2344759 - RNA, 18 nt, Human
cauguagcccccuggccu

SEQ ID NO: 2344760 - RNA, 18 nt, Human
cauguaggaaguaggaag

SEQ ID NO: 2344761 - RNA, 15 nt, Human
cauguagaagcugca

SEQ ID NO: 2344762 - RNA, 14 nt, Human
cauguagcugaguu

SEQ ID NO: 2344763 - RNA, 15 nt, Human
cauguagcugaguuu

SEQ ID NO: 2344764 - RNA, 14 nt, Human
cauguauugugucu

SEQ ID NO: 2344765 - RNA, 15 nt, Human
cauguauugugucuu

SEQ ID NO: 2344766 - RNA, 20 nt, Human
cauguauugugucuuuugca

SEQ ID NO: 2344767 - RNA, 21 nt, Human
cauguauugugucuuuugcau

SEQ ID NO: 2344768 - RNA, 23 nt, Human
cauguauugugucuuuugcauga

SEQ ID NO: 2344769 - RNA, 15 nt, Human
cauguauuuaucucu

SEQ ID NO: 2344770 - RNA, 23 nt, Human
cauguauuuaucucuauuuaaua

SEQ ID NO: 2344771 - RNA, 20 nt, Human
cauguauuuaucucuauuua

SEQ ID NO: 2344772 - RNA, 16 nt, Human
cauguuggccaggcug

SEQ ID NO: 2344773 - RNA, 20 nt, Human
cauguuauauauuuuuugua

SEQ ID NO: 2344774 - RNA, 22 nt, Human
cauguuggucaaaagcuggauu

SEQ ID NO: 2344775 - RNA, 15 nt, Human
cauguugggaaacuu

SEQ ID NO: 2344776 - RNA, 19 nt, Human
cauguugggaaacuuggcu

SEQ ID NO: 2344777 - RNA, 20 nt, Human
cauguugggaaacuuggcuc

SEQ ID NO: 2344778 - RNA, 21 nt, Human
cauguugggaaacuuggcucg

SEQ ID NO: 2344779 - RNA, 13 nt, Human
cauguuauauauu

SEQ ID NO: 2344780 - RNA, 14 nt, Human
cauguuauauauuu

SEQ ID NO: 2344781 - RNA, 22 nt, Human
cauguuauauauuuuuuguagg

SEQ ID NO: 2344782 - RNA, 14 nt, Human
cauguuggccaggc

SEQ ID NO: 2344783 - RNA, 15 nt, Human
cauguuggccaggcu

SEQ ID NO: 2344784 - RNA, 16 nt, Human
caugucccuaccgagu

SEQ ID NO: 2344785 - RNA, 22 nt, Human
caugucccuaccgagucucuuc

SEQ ID NO: 2344786 - RNA, 21 nt, Human
cauguccccaaaccugcaagg

SEQ ID NO: 2344787 - RNA, 14 nt, Human
caugucaaacguga

SEQ ID NO: 2344788 - RNA, 19 nt, Human
caugucaaacgugaaaaug

SEQ ID NO: 2344789 - RNA, 18 nt, Human
cauguauuuguuugcaua

SEQ ID NO: 2344790 - RNA, 17 nt, Human
caugucccuacaccccu

SEQ ID NO: 2344791 - RNA, 23 nt, Human
caugucccuaccgagucucuucu

SEQ ID NO: 2344792 - RNA, 15 nt, Human
cauguccuguaaagg

SEQ ID NO: 2344793 - RNA, 14 nt, Human
cauguccuguaaag

SEQ ID NO: 2344794 - RNA, 19 nt, Human
cauguuaggaaaauuucac

SEQ ID NO: 2344795 - RNA, 18 nt, Human
cauguuaggaaaauuuca

SEQ ID NO: 2344796 - RNA, 14 nt, Human
cauguuaggaaaau

SEQ ID NO: 2344797 - RNA, 17 nt, Human
cauguuacugaccagca

SEQ ID NO: 2344798 - RNA, 15 nt, Human
caggugcacaagcuc

SEQ ID NO: 2344799 - RNA, 22 nt, Human
caggugauccacccaccucagc

SEQ ID NO: 2344800 - RNA, 23 nt, Human
caggugauccacccaccucagcc

SEQ ID NO: 2344801 - RNA, 17 nt, Human
caggugcacaagcucca

SEQ ID NO: 2344802 - RNA, 18 nt, Human
caggugcacaagcuccaa

SEQ ID NO: 2344803 - RNA, 19 nt, Human
caggugcacaagcuccaag

SEQ ID NO: 2344804 - RNA, 20 nt, Human
caggugcacaagcuccaagc

SEQ ID NO: 2344805 - RNA, 21 nt, Human
caggugauccacccaccucag

SEQ ID NO: 2344806 - RNA, 19 nt, Human
cagguuguaguaaagaaau

SEQ ID NO: 2344807 - RNA, 13 nt, Human
cagguuuguuaca

SEQ ID NO: 2344808 - RNA, 14 nt, Human
cagguuuguuacau

SEQ ID NO: 2344809 - RNA, 19 nt, Human
cagguuuucugggugucca

SEQ ID NO: 2344810 - RNA, 16 nt, Human
cagguuuuccugaaga

SEQ ID NO: 2344811 - RNA, 14 nt, Human
cagguuuaagcugu

SEQ ID NO: 2344812 - RNA, 12 nt, Human
cagguuuuccug

SEQ ID NO: 2344813 - RNA, 15 nt, Human
cagguuuuguaaaga

SEQ ID NO: 2344814 - RNA, 13 nt, Human
cagguuuuucaau

SEQ ID NO: 2344815 - RNA, 12 nt, Human
cagguuuuucaa

SEQ ID NO: 2344816 - RNA, 20 nt, Human
caguaaaauugccauauugc

SEQ ID NO: 2344817 - RNA, 21 nt, Human
caguaaaauugccauauugca

SEQ ID NO: 2344818 - RNA, 14 nt, Human
cagguuuuucaauu

SEQ ID NO: 2344819 - RNA, 15 nt, Human
cagguuuuucaauua

SEQ ID NO: 2344820 - RNA, 16 nt, Human
cagguuuuucaauuaa

SEQ ID NO: 2344821 - RNA, 17 nt, Human
cagguuuuucaauuaaa

SEQ ID NO: 2344822 - RNA, 16 nt, Human
caguaaacagaggagu

SEQ ID NO: 2344823 - RNA, 10 nt, Human
caguaaacau

SEQ ID NO: 2344824 - RNA, 23 nt, Human
caguaaagaacaucccuccuggg

SEQ ID NO: 2344825 - RNA, 21 nt, Human
cagguuggugggggccucggu

SEQ ID NO: 2344826 - RNA, 12 nt, Human
caggugccucca

SEQ ID NO: 2344827 - RNA, 13 nt, Human
caggugccuccag

SEQ ID NO: 2344828 - RNA, 14 nt, Human
caggugccuccagg

SEQ ID NO: 2344829 - RNA, 15 nt, Human
caggugccuccaggu

SEQ ID NO: 2344830 - RNA, 16 nt, Human
caggugccuccaggug

SEQ ID NO: 2344831 - RNA, 17 nt, Human
caggugccuccaggugu

SEQ ID NO: 2344832 - RNA, 18 nt, Human
caggugccuccaggugug

SEQ ID NO: 2344833 - RNA, 19 nt, Human
caggugccuccaggugugc

SEQ ID NO: 2344834 - RNA, 22 nt, Human
cagguugucugaagucacugca

SEQ ID NO: 2344835 - RNA, 21 nt, Human
caggugccuccaggugugcac

SEQ ID NO: 2344836 - RNA, 12 nt, Human
caggugccugga

SEQ ID NO: 2344837 - RNA, 15 nt, Human
caggugccuggacau

SEQ ID NO: 2344838 - RNA, 13 nt, Human
caggugccuugga

SEQ ID NO: 2344839 - RNA, 18 nt, Human
cagguuguaguaaagaaa

SEQ ID NO: 2344840 - RNA, 14 nt, Human
caggugccuuggag

SEQ ID NO: 2344841 - RNA, 23 nt, Human
cagguugucugaagucacugcac

SEQ ID NO: 2344842 - RNA, 11 nt, Human
caggugccucc

SEQ ID NO: 2344843 - RNA, 23 nt, Human
caggugcccagcuauaccugugc

SEQ ID NO: 2344844 - RNA, 17 nt, Human
caggugcccaucccugg

SEQ ID NO: 2344845 - RNA, 20 nt, Human
caggugcccaucccuggaag

SEQ ID NO: 2344846 - RNA, 22 nt, Human
caggugcacaagcuccaagcuc

SEQ ID NO: 2344847 - RNA, 22 nt, Human
caggugcccagcuauaccugug

SEQ ID NO: 2344848 - RNA, 21 nt, Human
caggugcacaagcuccaagcu

SEQ ID NO: 2344849 - RNA, 19 nt, Human
caggugccaguuauggcua

SEQ ID NO: 2344850 - RNA, 17 nt, Human
caguaaauaaauuguuu

SEQ ID NO: 2344851 - RNA, 17 nt, Human
cagucaaggaguggcuu

SEQ ID NO: 2344852 - RNA, 15 nt, Human
cagucaauauuuuua

SEQ ID NO: 2344853 - RNA, 16 nt, Human
cagucacagccacccc

SEQ ID NO: 2344854 - RNA, 14 nt, Human
cagucacagccacc

SEQ ID NO: 2344855 - RNA, 13 nt, Human
cagucacagccac

SEQ ID NO: 2344856 - RNA, 12 nt, Human
cagucacagcca

SEQ ID NO: 2344857 - RNA, 15 nt, Human
caguaaagcacuugc

SEQ ID NO: 2344858 - RNA, 14 nt, Human
caguaaacuuuuaa

SEQ ID NO: 2344859 - RNA, 14 nt, Human
caguaaauaaauug

SEQ ID NO: 2344860 - RNA, 15 nt, Human
caguaaauaaauugu

SEQ ID NO: 2344861 - RNA, 16 nt, Human
caguaaauaaauuguu

SEQ ID NO: 2344862 - RNA, 17 nt, Human
cagucaccugcccagau

SEQ ID NO: 2344863 - RNA, 17 nt, Human
cagucaccccaggacuc

SEQ ID NO: 2344864 - RNA, 12 nt, Human
cagucaccccag

SEQ ID NO: 2344865 - RNA, 19 nt, Human
cagucaccucauggaauug

SEQ ID NO: 2344866 - RNA, 15 nt, Human
cagucacauuccaag

SEQ ID NO: 2344867 - RNA, 16 nt, Human
cagucaccucauggaa

SEQ ID NO: 2344868 - RNA, 18 nt, Human
cagucacguggaggagca

SEQ ID NO: 2344869 - RNA, 23 nt, Human
cagucacguggaggagcagugca

SEQ ID NO: 2344870 - RNA, 20 nt, Human
caguggugcgaucuggguuc

SEQ ID NO: 2344871 - RNA, 15 nt, Human
caguggggcagucau

SEQ ID NO: 2344872 - RNA, 20 nt, Human
caguggggaggggcuguggg

SEQ ID NO: 2344873 - RNA, 21 nt, Human
caguggugcgaucuggguuca

SEQ ID NO: 2344874 - RNA, 18 nt, Human
caguggugguuuucuguu

SEQ ID NO: 2344875 - RNA, 21 nt, Human
cagugggccuggccagcaggu

SEQ ID NO: 2344876 - RNA, 15 nt, Human
cagugggccuggcca

SEQ ID NO: 2344877 - RNA, 14 nt, Human
cagugggccuggcc

SEQ ID NO: 2344878 - RNA, 21 nt, Human
cagugggaggggcaggcugac

SEQ ID NO: 2344879 - RNA, 19 nt, Human
cagugggaggggcaggcug

SEQ ID NO: 2344880 - RNA, 20 nt, Human
cagugggaggggcaggcuga

SEQ ID NO: 2344881 - RNA, 13 nt, Human
cagugggaggcgc

SEQ ID NO: 2344882 - RNA, 11 nt, Human
cagugggaggg

SEQ ID NO: 2344883 - RNA, 12 nt, Human
cagugggagggg

SEQ ID NO: 2344884 - RNA, 14 nt, Human
cagugggaggggca

SEQ ID NO: 2344885 - RNA, 15 nt, Human
cagugggaggggcag

SEQ ID NO: 2344886 - RNA, 16 nt, Human
cagugggaggggcagg

SEQ ID NO: 2344887 - RNA, 17 nt, Human
cagugggaggggcaggc

SEQ ID NO: 2344888 - RNA, 18 nt, Human
cagugggaggggcaggcu

SEQ ID NO: 2344889 - RNA, 13 nt, Human
cagugcccacagg

SEQ ID NO: 2344890 - RNA, 15 nt, Human
cagugcccacaggau

SEQ ID NO: 2344891 - RNA, 16 nt, Human
cagugcaugcuguccc

SEQ ID NO: 2344892 - RNA, 17 nt, Human
cagugcaugcugucccu

SEQ ID NO: 2344893 - RNA, 17 nt, Human
cagugcccacaggauca

SEQ ID NO: 2344894 - RNA, 20 nt, Human
cagugggagcugccuguuca

SEQ ID NO: 2344895 - RNA, 23 nt, Human
cagugggagcugccuguucagcu

SEQ ID NO: 2344896 - RNA, 12 nt, Human
cagugggaggcg

SEQ ID NO: 2344897 - RNA, 14 nt, Human
cagugcauauuccu

SEQ ID NO: 2344898 - RNA, 18 nt, Human
cagugcauauuccuuucu

SEQ ID NO: 2344899 - RNA, 15 nt, Human
cagucugcugcccuc

SEQ ID NO: 2344900 - RNA, 14 nt, Human
cagucugcugcccu

SEQ ID NO: 2344901 - RNA, 12 nt, Human
cagucugacccu

SEQ ID NO: 2344902 - RNA, 13 nt, Human
cagucugcugccc

SEQ ID NO: 2344903 - RNA, 20 nt, Human
cagucugacuguuuccauca

SEQ ID NO: 2344904 - RNA, 22 nt, Human
cagucucuuuaaucuucaguuu

SEQ ID NO: 2344905 - RNA, 20 nt, Human
cagucucuuuaaucuucagu

SEQ ID NO: 2344906 - RNA, 19 nt, Human
cagucucuuuaaucuucag

SEQ ID NO: 2344907 - RNA, 15 nt, Human
cagucucuuuaaucu

SEQ ID NO: 2344908 - RNA, 15 nt, Human
cagucucugagggcu

SEQ ID NO: 2344909 - RNA, 16 nt, Human
cagucucugagggcuu

SEQ ID NO: 2344910 - RNA, 14 nt, Human
cagucucugagcag

SEQ ID NO: 2344911 - RNA, 12 nt, Human
cagucucugagc

SEQ ID NO: 2344912 - RNA, 20 nt, Human
cagucucugagggcuuccuu

SEQ ID NO: 2344913 - RNA, 15 nt, Human
cagugcaucucagcc

SEQ ID NO: 2344914 - RNA, 16 nt, Human
cagugcaucucagccc

SEQ ID NO: 2344915 - RNA, 17 nt, Human
cagugcaucucagccca

SEQ ID NO: 2344916 - RNA, 18 nt, Human
cagugcaucucagcccac

SEQ ID NO: 2344917 - RNA, 13 nt, Human
cagugcaugcugu

SEQ ID NO: 2344918 - RNA, 14 nt, Human
cagugcaugcuguc

SEQ ID NO: 2344919 - RNA, 22 nt, Human
cagucugcugcccuccaucccg

SEQ ID NO: 2344920 - RNA, 21 nt, Human
cagucugcugcccuccauccc

SEQ ID NO: 2344921 - RNA, 18 nt, Human
cagucugcugcccuccau

SEQ ID NO: 2344922 - RNA, 15 nt, Human
cagucuggaaugcag

SEQ ID NO: 2344923 - RNA, 17 nt, Human
cagucuggaaugcagug

SEQ ID NO: 2344924 - RNA, 12 nt, Human
cagugcaucuca

SEQ ID NO: 2344925 - RNA, 15 nt, Human
cagggagcugggaca

SEQ ID NO: 2344926 - RNA, 17 nt, Human
cagggaucuugcauucc

SEQ ID NO: 2344927 - RNA, 19 nt, Human
cagggaucuugcauuccca

SEQ ID NO: 2344928 - RNA, 12 nt, Human
cagggaugagca

SEQ ID NO: 2344929 - RNA, 23 nt, Human
cagggaugccaucugugggcacg

SEQ ID NO: 2344930 - RNA, 22 nt, Human
cagggaugagcauggagcuggc

SEQ ID NO: 2344931 - RNA, 23 nt, Human
cagggaugagcauggagcuggcc

SEQ ID NO: 2344932 - RNA, 16 nt, Human
cagggaugagcaugga

SEQ ID NO: 2344933 - RNA, 19 nt, Human
cagggaugagcauggagcu

SEQ ID NO: 2344934 - RNA, 20 nt, Human
cagggaugagcauggagcug

SEQ ID NO: 2344935 - RNA, 21 nt, Human
cagggaugagcauggagcugg

SEQ ID NO: 2344936 - RNA, 22 nt, Human
cagggagcggaaagcagcucaa

SEQ ID NO: 2344937 - RNA, 23 nt, Human
cagggagcggccggccagccccu

SEQ ID NO: 2344938 - RNA, 21 nt, Human
cagggagcggccggccagccc

SEQ ID NO: 2344939 - RNA, 19 nt, Human
cagggagcggaaagcagcu

SEQ ID NO: 2344940 - RNA, 18 nt, Human
cagggagcggaaagcagc

SEQ ID NO: 2344941 - RNA, 15 nt, Human
cagggagcggccggc

SEQ ID NO: 2344942 - RNA, 19 nt, Human
cagggagcggccggccagc

SEQ ID NO: 2344943 - RNA, 17 nt, Human
cagggagcggccggcca

SEQ ID NO: 2344944 - RNA, 20 nt, Human
cagggauggccguuggccac

SEQ ID NO: 2344945 - RNA, 16 nt, Human
cagggaugguguucaa

SEQ ID NO: 2344946 - RNA, 23 nt, Human
cagggaugcccuggagguggcug

SEQ ID NO: 2344947 - RNA, 19 nt, Human
cagggauggccguuggcca

SEQ ID NO: 2344948 - RNA, 22 nt, Human
cagggaugcccuggagguggcu

SEQ ID NO: 2344949 - RNA, 21 nt, Human
cagggaugcccuggagguggc

SEQ ID NO: 2344950 - RNA, 20 nt, Human
cagggaugcccuggaggugg

SEQ ID NO: 2344951 - RNA, 16 nt, Human
cagggaugcccuggag

SEQ ID NO: 2344952 - RNA, 14 nt, Human
cagggaugcccugg

SEQ ID NO: 2344953 - RNA, 13 nt, Human
cagggaugcccug

SEQ ID NO: 2344954 - RNA, 21 nt, Human
cagggcucagcggggacagcu

SEQ ID NO: 2344955 - RNA, 23 nt, Human
cagggcucagcggggacagcucc

SEQ ID NO: 2344956 - RNA, 19 nt, Human
caggggaaaaucagccugc

SEQ ID NO: 2344957 - RNA, 16 nt, Human
cagggcuggacugagg

SEQ ID NO: 2344958 - RNA, 17 nt, Human
cagggcuggacugaggc

SEQ ID NO: 2344959 - RNA, 20 nt, Human
caggggaaaaucagccugcu

SEQ ID NO: 2344960 - RNA, 18 nt, Human
cagggcuggacugaggcc

SEQ ID NO: 2344961 - RNA, 14 nt, Human
caggggaaaaugaa

SEQ ID NO: 2344962 - RNA, 23 nt, Human
caggggaaagaugagcuuuucua

SEQ ID NO: 2344963 - RNA, 16 nt, Human
caggggaaaaugaagg

SEQ ID NO: 2344964 - RNA, 18 nt, Human
caggggaaagaugagcuu

SEQ ID NO: 2344965 - RNA, 21 nt, Human
cagggcugacacguccacccc

SEQ ID NO: 2344966 - RNA, 18 nt, Human
cagggcugaggccucuca

SEQ ID NO: 2344967 - RNA, 14 nt, Human
cagggcuggacuga

SEQ ID NO: 2344968 - RNA, 15 nt, Human
cagggcuggacugag

SEQ ID NO: 2344969 - RNA, 14 nt, Human
cagggcugcuagac

SEQ ID NO: 2344970 - RNA, 18 nt, Human
cagggcugcuagacggag

SEQ ID NO: 2344971 - RNA, 16 nt, Human
cagggcugaggccucu

SEQ ID NO: 2344972 - RNA, 21 nt, Human
cagggcucugccccagaggcc

SEQ ID NO: 2344973 - RNA, 12 nt, Human
cagggcucagga

SEQ ID NO: 2344974 - RNA, 13 nt, Human
cagggcucaggau

SEQ ID NO: 2344975 - RNA, 20 nt, Human
cagggagcauuuuccuccau

SEQ ID NO: 2344976 - RNA, 12 nt, Human
cagggagccucc

SEQ ID NO: 2344977 - RNA, 13 nt, Human
cagggagccuccu

SEQ ID NO: 2344978 - RNA, 14 nt, Human
cagggagccuccug

SEQ ID NO: 2344979 - RNA, 17 nt, Human
cagggagcggaaagcag

SEQ ID NO: 2344980 - RNA, 16 nt, Human
cagggagcggaaagca

SEQ ID NO: 2344981 - RNA, 13 nt, Human
cagggagcggaaa

SEQ ID NO: 2344982 - RNA, 18 nt, Human
cagggagccuccugccca

SEQ ID NO: 2344983 - RNA, 22 nt, Human
cagggagccuuugguucuggcc

SEQ ID NO: 2344984 - RNA, 15 nt, Human
cagggagccuccugc

SEQ ID NO: 2344985 - RNA, 16 nt, Human
cagggagccuccugcc

SEQ ID NO: 2344986 - RNA, 21 nt, Human
caggcugggcuucaguggcag

SEQ ID NO: 2344987 - RNA, 22 nt, Human
caggcugggcuucaguggcagc

SEQ ID NO: 2344988 - RNA, 20 nt, Human
caggcugggcuucaguggca

SEQ ID NO: 2344989 - RNA, 15 nt, Human
caggcugggagagcc

SEQ ID NO: 2344990 - RNA, 12 nt, Human
caggcugggaga

SEQ ID NO: 2344991 - RNA, 14 nt, Human
caggcugggagagc

SEQ ID NO: 2344992 - RNA, 18 nt, Human
caggcuggcuccagaugc

SEQ ID NO: 2344993 - RNA, 17 nt, Human
caggcuggcuccagaug

SEQ ID NO: 2344994 - RNA, 20 nt, Human
caggcuggcuccagaugcag

SEQ ID NO: 2344995 - RNA, 16 nt, Human
caggcuggcuccagau

SEQ ID NO: 2344996 - RNA, 17 nt, Human
caggccacggcagccua

SEQ ID NO: 2344997 - RNA, 16 nt, Human
caggccagagggagug

SEQ ID NO: 2344998 - RNA, 20 nt, Human
caggccaggcccucugccca

SEQ ID NO: 2344999 - RNA, 19 nt, Human
caggccaggcccucugccc

SEQ ID NO: 2345000 - RNA, 17 nt, Human
caggccaggcccucugc

SEQ ID NO: 2345001 - RNA, 18 nt, Human
caggccaggcccucugcc

SEQ ID NO: 2345002 - RNA, 17 nt, Human
caggccagcugcuuggg

SEQ ID NO: 2345003 - RNA, 19 nt, Human
caggccagcugcuugggcu

SEQ ID NO: 2345004 - RNA, 21 nt, Human
caggccagcugcuugggcuuc

SEQ ID NO: 2345005 - RNA, 23 nt, Human
caggccagcugcuugggcuucau

SEQ ID NO: 2345006 - RNA, 15 nt, Human
caggccacuugauga

SEQ ID NO: 2345007 - RNA, 13 nt, Human
caggcagauccag

SEQ ID NO: 2345008 - RNA, 18 nt, Human
caggcagauacaggaaaa

SEQ ID NO: 2345009 - RNA, 13 nt, Human
caggccagaggga

SEQ ID NO: 2345010 - RNA, 15 nt, Human
caggccagagggagu

SEQ ID NO: 2345011 - RNA, 23 nt, Human
caggcagagaaucauacuuagca

SEQ ID NO: 2345012 - RNA, 15 nt, Human
caggcagagaaucau

SEQ ID NO: 2345013 - RNA, 14 nt, Human
caggcagagaauca

SEQ ID NO: 2345014 - RNA, 22 nt, Human
caggcagacacggaucugagaa

SEQ ID NO: 2345015 - RNA, 10 nt, Human
caggcagaca

SEQ ID NO: 2345016 - RNA, 11 nt, Human
caggcagacac

SEQ ID NO: 2345017 - RNA, 12 nt, Human
caggcagacacg

SEQ ID NO: 2345018 - RNA, 14 nt, Human
caggcagacacgga

SEQ ID NO: 2345019 - RNA, 16 nt, Human
caggcagacacggauc

SEQ ID NO: 2345020 - RNA, 19 nt, Human
caggcagacacggaucuga

SEQ ID NO: 2345021 - RNA, 14 nt, Human
caggcacaaaauga

SEQ ID NO: 2345022 - RNA, 14 nt, Human
caggcacacacugu

SEQ ID NO: 2345023 - RNA, 15 nt, Human
caggcacacacugug

SEQ ID NO: 2345024 - RNA, 23 nt, Human
caggcacacacugugcuuucuau

SEQ ID NO: 2345025 - RNA, 15 nt, Human
caggcacacuucuuc

SEQ ID NO: 2345026 - RNA, 19 nt, Human
caggcacacgccaccucgc

SEQ ID NO: 2345027 - RNA, 16 nt, Human
caggcacagcacaggg

SEQ ID NO: 2345028 - RNA, 14 nt, Human
caggcacagcacag

SEQ ID NO: 2345029 - RNA, 13 nt, Human
cagccagggcugc

SEQ ID NO: 2345030 - RNA, 12 nt, Human
cagccagggcug

SEQ ID NO: 2345031 - RNA, 23 nt, Human
cagccagggcugcuagacggagg

SEQ ID NO: 2345032 - RNA, 15 nt, Human
cagccagggcugcua

SEQ ID NO: 2345033 - RNA, 16 nt, Human
cagccagggcugcuag

SEQ ID NO: 2345034 - RNA, 13 nt, Human
cagccaggugccu

SEQ ID NO: 2345035 - RNA, 14 nt, Human
cagccaggugccuu

SEQ ID NO: 2345036 - RNA, 15 nt, Human
cagccagggccaggg

SEQ ID NO: 2345037 - RNA, 11 nt, Human
cagccagggcc

SEQ ID NO: 2345038 - RNA, 12 nt, Human
cagccagggcca

SEQ ID NO: 2345039 - RNA, 15 nt, Human
cagccaggugccuug

SEQ ID NO: 2345040 - RNA, 16 nt, Human
cagccaggugccuugg

SEQ ID NO: 2345041 - RNA, 20 nt, Human
cagcaucauggagguuugaa

SEQ ID NO: 2345042 - RNA, 13 nt, Human
cagcaucaggguu

SEQ ID NO: 2345043 - RNA, 23 nt, Human
cagcaucaggguuaagaagacuu

SEQ ID NO: 2345044 - RNA, 19 nt, Human
cagcaucauuuugcauuca

SEQ ID NO: 2345045 - RNA, 20 nt, Human
cagcaucauuuugcauucaa

SEQ ID NO: 2345046 - RNA, 19 nt, Human
cagcaucccuugaccaggc

SEQ ID NO: 2345047 - RNA, 22 nt, Human
cagcaucccuugaccaggccug

SEQ ID NO: 2345048 - RNA, 23 nt, Human
cagcaucccuugaccaggccugg

SEQ ID NO: 2345049 - RNA, 18 nt, Human
cagcaucccuugaccagg

SEQ ID NO: 2345050 - RNA, 22 nt, Human
cagcaucauuuugcauucaaau

SEQ ID NO: 2345051 - RNA, 23 nt, Human
cagcaucauuuugcauucaaauu

SEQ ID NO: 2345052 - RNA, 18 nt, Human
cagccagcucucagccaa

SEQ ID NO: 2345053 - RNA, 17 nt, Human
cagccagcucucagcca

SEQ ID NO: 2345054 - RNA, 21 nt, Human
cagccagcucucagccaacga

SEQ ID NO: 2345055 - RNA, 16 nt, Human
cagccagcucucagcc

SEQ ID NO: 2345056 - RNA, 15 nt, Human
cagccagcucucagc

SEQ ID NO: 2345057 - RNA, 12 nt, Human
cagccagcucuc

SEQ ID NO: 2345058 - RNA, 17 nt, Human
cagauugcaacaggcug

SEQ ID NO: 2345059 - RNA, 14 nt, Human
cagauugaaaagga

SEQ ID NO: 2345060 - RNA, 12 nt, Human
cagauugaaaag

SEQ ID NO: 2345061 - RNA, 22 nt, Human
cagauugaguuuucuucuguga

SEQ ID NO: 2345062 - RNA, 20 nt, Human
cagauucuuuccugaggcug

SEQ ID NO: 2345063 - RNA, 22 nt, Human
cagauucuuuccugaggcuggg

SEQ ID NO: 2345064 - RNA, 20 nt, Human
cagcacgauuucuguuuaga

SEQ ID NO: 2345065 - RNA, 19 nt, Human
cagcacgauuucuguuuag

SEQ ID NO: 2345066 - RNA, 18 nt, Human
cagcacgauuucuguuua

SEQ ID NO: 2345067 - RNA, 16 nt, Human
cagcacgauuucuguu

SEQ ID NO: 2345068 - RNA, 17 nt, Human
cagcauagaaguaacuu

SEQ ID NO: 2345069 - RNA, 22 nt, Human
cagcauaacaagguccaagaua

SEQ ID NO: 2345070 - RNA, 16 nt, Human
cagcauaccugcuggu

SEQ ID NO: 2345071 - RNA, 19 nt, Human
cagcauaccuuuauuguga

SEQ ID NO: 2345072 - RNA, 14 nt, Human
cagcauaaaggccu

SEQ ID NO: 2345073 - RNA, 15 nt, Human
cagcauaaaggccuu

SEQ ID NO: 2345074 - RNA, 18 nt, Human
cagcauaaaggccuuuuu

SEQ ID NO: 2345075 - RNA, 17 nt, Human
cagcaguuugggagguc

SEQ ID NO: 2345076 - RNA, 20 nt, Human
cagcaguuuucaagucaaau

SEQ ID NO: 2345077 - RNA, 13 nt, Human
cagcauaauacuu

SEQ ID NO: 2345078 - RNA, 21 nt, Human
cagcagugagucucuucagaa

SEQ ID NO: 2345079 - RNA, 19 nt, Human
cagcagugagucucuucag

SEQ ID NO: 2345080 - RNA, 17 nt, Human
cagcagugugaggccag

SEQ ID NO: 2345081 - RNA, 16 nt, Human
cagcagugcagccggg

SEQ ID NO: 2345082 - RNA, 16 nt, Human
cagcagugucaucaga

SEQ ID NO: 2345083 - RNA, 22 nt, Human
cagcagugugaggccagggcag

SEQ ID NO: 2345084 - RNA, 12 nt, Human
cagcaguguucc

SEQ ID NO: 2345085 - RNA, 13 nt, Human
cagcaguguuccc

SEQ ID NO: 2345086 - RNA, 20 nt, Human
cagcagugugaggccagggc

SEQ ID NO: 2345087 - RNA, 19 nt, Human
cagcagugugaggccaggg

SEQ ID NO: 2345088 - RNA, 23 nt, Human
cagcaguugaaugacaacagaag

SEQ ID NO: 2345089 - RNA, 22 nt, Human
cagcaguguuccccaucugggu

SEQ ID NO: 2345090 - RNA, 23 nt, Human
cagcaguguuccccaucuggguc

SEQ ID NO: 2345091 - RNA, 14 nt, Human
cagcaguguucccc

SEQ ID NO: 2345092 - RNA, 17 nt, Human
cagcaguguuccccauc

SEQ ID NO: 2345093 - RNA, 19 nt, Human
cagcaguguuccccaucug

SEQ ID NO: 2345094 - RNA, 21 nt, Human
cagcaguguuccccaucuggg

SEQ ID NO: 2345095 - RNA, 18 nt, Human
cagagguagggcugccac

SEQ ID NO: 2345096 - RNA, 20 nt, Human
cagagguaacagaacagcuu

SEQ ID NO: 2345097 - RNA, 22 nt, Human
cagagguaacagaacagcuuca

SEQ ID NO: 2345098 - RNA, 20 nt, Human
cagagguccacaacacacag

SEQ ID NO: 2345099 - RNA, 15 nt, Human
cagagguccacaaca

SEQ ID NO: 2345100 - RNA, 16 nt, Human
cagagguugcagugag

SEQ ID NO: 2345101 - RNA, 17 nt, Human
cagagguugcagugagc

SEQ ID NO: 2345102 - RNA, 17 nt, Human
cagagguugcagugugg

SEQ ID NO: 2345103 - RNA, 23 nt, Human
cagagguaacagaacagcuucag

SEQ ID NO: 2345104 - RNA, 20 nt, Human
cagauauuuuuucagaaaua

SEQ ID NO: 2345105 - RNA, 15 nt, Human
cagaucaagcuguga

SEQ ID NO: 2345106 - RNA, 21 nt, Human
cagaguaauccaagcaaaugu

SEQ ID NO: 2345107 - RNA, 13 nt, Human
cagaucacuacug

SEQ ID NO: 2345108 - RNA, 22 nt, Human
cagaucaccagcccggccugcu

SEQ ID NO: 2345109 - RNA, 23 nt, Human
cagaucaauggcgcagugccucu

SEQ ID NO: 2345110 - RNA, 21 nt, Human
cagaucaccagcccggccugc

SEQ ID NO: 2345111 - RNA, 16 nt, Human
cagaucacuacugcag

SEQ ID NO: 2345112 - RNA, 18 nt, Human
cagaucacagcuucagcc

SEQ ID NO: 2345113 - RNA, 22 nt, Human
cagaucacagcuucagccagga

SEQ ID NO: 2345114 - RNA, 18 nt, Human
cagaucaauggcgcagug

SEQ ID NO: 2345115 - RNA, 17 nt, Human
cagaucaagcugugaga

SEQ ID NO: 2345116 - RNA, 19 nt, Human
cagaucaagcugugagaca

SEQ ID NO: 2345117 - RNA, 23 nt, Human
cagagggguggguuccucuuccc

SEQ ID NO: 2345118 - RNA, 21 nt, Human
cagagggguaggcagagccuu

SEQ ID NO: 2345119 - RNA, 15 nt, Human
cagagggguaggcag

SEQ ID NO: 2345120 - RNA, 20 nt, Human
cagagggguaggcagagccu

SEQ ID NO: 2345121 - RNA, 16 nt, Human
cagaauccuggcccuc

SEQ ID NO: 2345122 - RNA, 21 nt, Human
cagaauccuggcccucugugu

SEQ ID NO: 2345123 - RNA, 21 nt, Human
cagaaucauaugauucugcuu

SEQ ID NO: 2345124 - RNA, 15 nt, Human
cagaauccuggcccu

SEQ ID NO: 2345125 - RNA, 18 nt, Human
cagagguaaaagugugag

SEQ ID NO: 2345126 - RNA, 20 nt, Human
cagagguaaaagugugagca

SEQ ID NO: 2345127 - RNA, 21 nt, Human
cagagguaaaagugugagcag

SEQ ID NO: 2345128 - RNA, 13 nt, Human
cagagguaacaga

SEQ ID NO: 2345129 - RNA, 14 nt, Human
cagagguaacagaa

SEQ ID NO: 2345130 - RNA, 15 nt, Human
cagagguaacagaac

SEQ ID NO: 2345131 - RNA, 16 nt, Human
cagagguaacagaaca

SEQ ID NO: 2345132 - RNA, 17 nt, Human
cagagguaacagaacag

SEQ ID NO: 2345133 - RNA, 18 nt, Human
cagagguaacagaacagc

SEQ ID NO: 2345134 - RNA, 19 nt, Human
cagagguaacagaacagcu

SEQ ID NO: 2345135 - RNA, 19 nt, Human
cagaauccaagugaacacu

SEQ ID NO: 2345136 - RNA, 23 nt, Human
cagaaucaaagcaaugcauuuug

SEQ ID NO: 2345137 - RNA, 16 nt, Human
cagaaucauaugauuc

SEQ ID NO: 2345138 - RNA, 19 nt, Human
cagaaucauaugauucugc

SEQ ID NO: 2345139 - RNA, 15 nt, Human
cagaauaucugggau

SEQ ID NO: 2345140 - RNA, 13 nt, Human
cagaaucaaagca

SEQ ID NO: 2345141 - RNA, 15 nt, Human
cagaaucaaagcaau

SEQ ID NO: 2345142 - RNA, 20 nt, Human
cagaaucaaagcaaugcauu

SEQ ID NO: 2345143 - RNA, 21 nt, Human
cagaaucaaagcaaugcauuu

SEQ ID NO: 2345144 - RNA, 22 nt, Human
cagaggggguggccucccaacu

SEQ ID NO: 2345145 - RNA, 23 nt, Human
cagaggggguggccucccaacuc

SEQ ID NO: 2345146 - RNA, 13 nt, Human
cagauccuggaaa

SEQ ID NO: 2345147 - RNA, 14 nt, Human
cagauccucuuggu

SEQ ID NO: 2345148 - RNA, 12 nt, Human
cagauccuggaa

SEQ ID NO: 2345149 - RNA, 15 nt, Human
cagaucauccagaag

SEQ ID NO: 2345150 - RNA, 16 nt, Human
cagaucaguguaccau

SEQ ID NO: 2345151 - RNA, 20 nt, Human
cagaucagcuccuaacccuu

SEQ ID NO: 2345152 - RNA, 16 nt, Human
cagauccucacaacca

SEQ ID NO: 2345153 - RNA, 13 nt, Human
cagauccucuugg

SEQ ID NO: 2345154 - RNA, 15 nt, Human
cagauccccaagccu

SEQ ID NO: 2345155 - RNA, 19 nt, Human
cagauccccaagccuggca

SEQ ID NO: 2345156 - RNA, 15 nt, Human
cagauucuuuccuga

SEQ ID NO: 2345157 - RNA, 17 nt, Human
cagauucuuuccugagg

SEQ ID NO: 2345158 - RNA, 18 nt, Human
cagauucuuuccugaggc

SEQ ID NO: 2345159 - RNA, 19 nt, Human
cagauucuuuccugaggcu

SEQ ID NO: 2345160 - RNA, 20 nt, Human
cagcugaggucucuugaggg

SEQ ID NO: 2345161 - RNA, 19 nt, Human
cagcugaggucucuugagg

SEQ ID NO: 2345162 - RNA, 22 nt, Human
cagcuccuccgugcuuccucag

SEQ ID NO: 2345163 - RNA, 22 nt, Human
cagcuccucccuuguucucuaa

SEQ ID NO: 2345164 - RNA, 19 nt, Human
cagcuccuccgugcuuccu

SEQ ID NO: 2345165 - RNA, 19 nt, Human
cagcugagggugagugggu

SEQ ID NO: 2345166 - RNA, 15 nt, Human
cagcugauacaaauu

SEQ ID NO: 2345167 - RNA, 23 nt, Human
cagcugauacaaauugcagacug

SEQ ID NO: 2345168 - RNA, 14 nt, Human
cagcugaugaguua

SEQ ID NO: 2345169 - RNA, 12 nt, Human
cagcugauuuua

SEQ ID NO: 2345170 - RNA, 20 nt, Human
cagcugauguuggaagagaa

SEQ ID NO: 2345171 - RNA, 20 nt, Human
cagcugaugaguuacagccu

SEQ ID NO: 2345172 - RNA, 18 nt, Human
cagcugauguuggaagag

SEQ ID NO: 2345173 - RNA, 17 nt, Human
cagcugauuuuaacaau

SEQ ID NO: 2345174 - RNA, 15 nt, Human
cagcugauuuuaaca

SEQ ID NO: 2345175 - RNA, 12 nt, Human
cagcugccugca

SEQ ID NO: 2345176 - RNA, 12 nt, Human
cagcugccuggg

SEQ ID NO: 2345177 - RNA, 13 nt, Human
cagcugccuggga

SEQ ID NO: 2345178 - RNA, 14 nt, Human
cagcugccugggau

SEQ ID NO: 2345179 - RNA, 21 nt, Human
cagcuguuuaugcauagauaa

SEQ ID NO: 2345180 - RNA, 20 nt, Human
cagcuguucugucccuugga

SEQ ID NO: 2345181 - RNA, 15 nt, Human
cagcuguuugucaua

SEQ ID NO: 2345182 - RNA, 20 nt, Human
cagcuguuuuaguuaaauuu

SEQ ID NO: 2345183 - RNA, 14 nt, Human
cagcuguuugucau

SEQ ID NO: 2345184 - RNA, 14 nt, Human
cagcuguuuaagau

SEQ ID NO: 2345185 - RNA, 21 nt, Human
cagcuguuuaaauguuuuucu

SEQ ID NO: 2345186 - RNA, 21 nt, Human
cagcuguuuuaguuaaauuuc

SEQ ID NO: 2345187 - RNA, 15 nt, Human
cagcuuaaaguaacc

SEQ ID NO: 2345188 - RNA, 18 nt, Human
cagcugauuuuaacaaua

SEQ ID NO: 2345189 - RNA, 19 nt, Human
cagcuguucagcugguuga

SEQ ID NO: 2345190 - RNA, 24 nt, Human
cagcugugcucuggacaggcaugu

SEQ ID NO: 2345191 - RNA, 19 nt, Human
cagcugugcucuggacagg

SEQ ID NO: 2345192 - RNA, 20 nt, Human
cagcugugcucuggacaggc

SEQ ID NO: 2345193 - RNA, 16 nt, Human
cagcucccucugccug

SEQ ID NO: 2345194 - RNA, 15 nt, Human
cagcucccucugccu

SEQ ID NO: 2345195 - RNA, 14 nt, Human
cagcucccucugcc

SEQ ID NO: 2345196 - RNA, 14 nt, Human
cagcucccuucucu

SEQ ID NO: 2345197 - RNA, 15 nt, Human
cagcucccuucucug

SEQ ID NO: 2345198 - RNA, 21 nt, Human
cagcuccggccuguccuccaa

SEQ ID NO: 2345199 - RNA, 16 nt, Human
cagcuccggccugucc

SEQ ID NO: 2345200 - RNA, 14 nt, Human
cagcuccucccaca

SEQ ID NO: 2345201 - RNA, 20 nt, Human
cagcuccucauccagggcuc

SEQ ID NO: 2345202 - RNA, 21 nt, Human
cagcuccucccuuguucucua

SEQ ID NO: 2345203 - RNA, 13 nt, Human
cagcuccuaaccc

SEQ ID NO: 2345204 - RNA, 19 nt, Human
cagcuccuaacccuuauca

SEQ ID NO: 2345205 - RNA, 15 nt, Human
cagcuccucauccag

SEQ ID NO: 2345206 - RNA, 19 nt, Human
cagcuccucauccagggcu

SEQ ID NO: 2345207 - RNA, 15 nt, Human
cagcucccuaggaga

SEQ ID NO: 2345208 - RNA, 18 nt, Human
cagcucccccuguccccu

SEQ ID NO: 2345209 - RNA, 19 nt, Human
cagcucccccuguccccuc

SEQ ID NO: 2345210 - RNA, 19 nt, Human
cagcucccuaggagaccaa

SEQ ID NO: 2345211 - RNA, 18 nt, Human
cagcucccuaggagacca

SEQ ID NO: 2345212 - RNA, 20 nt, Human
cagcucccuaggagaccaag

SEQ ID NO: 2345213 - RNA, 22 nt, Human
cagcuccccucggagaagagcu

SEQ ID NO: 2345214 - RNA, 21 nt, Human
cagcuccccucggagaagagc

SEQ ID NO: 2345215 - RNA, 23 nt, Human
cagcucccaccccacccccuuca

SEQ ID NO: 2345216 - RNA, 22 nt, Human
cagcucccaccccacccccuuc

SEQ ID NO: 2345217 - RNA, 23 nt, Human
cagcucccauaaccgcugauucu

SEQ ID NO: 2345218 - RNA, 14 nt, Human
cagcucccauuucu

SEQ ID NO: 2345219 - RNA, 17 nt, Human
cagcucccauuucuacu

SEQ ID NO: 2345220 - RNA, 19 nt, Human
cagcucccauuucuacucu

SEQ ID NO: 2345221 - RNA, 20 nt, Human
cagcucccauuucuacucuu

SEQ ID NO: 2345222 - RNA, 13 nt, Human
cagcuccccaaga

SEQ ID NO: 2345223 - RNA, 13 nt, Human
cagcuccccagag

SEQ ID NO: 2345224 - RNA, 15 nt, Human
cagcuccccagaguc

SEQ ID NO: 2345225 - RNA, 24 nt, Human
cagcuccccagaguccucuaugaa

SEQ ID NO: 2345226 - RNA, 22 nt, Human
cagcucccccgacggugggcau

SEQ ID NO: 2345227 - RNA, 12 nt, Human
cagcucccccgg

SEQ ID NO: 2345228 - RNA, 10 nt, Human
cagcuccccc

SEQ ID NO: 2345229 - RNA, 13 nt, Human
cagcucccccugu

SEQ ID NO: 2345230 - RNA, 14 nt, Human
cagcucccccuguc

SEQ ID NO: 2345231 - RNA, 15 nt, Human
cagcucccccugucc

SEQ ID NO: 2345232 - RNA, 16 nt, Human
cagcucccccuguccc

SEQ ID NO: 2345233 - RNA, 17 nt, Human
cagcucccccugucccc

SEQ ID NO: 2345234 - RNA, 20 nt, Human
cagcucccaccccacccccu

SEQ ID NO: 2345235 - RNA, 23 nt, Human
caggaaaacugacagaggagggc

SEQ ID NO: 2345236 - RNA, 17 nt, Human
caggaaaagccucugug

SEQ ID NO: 2345237 - RNA, 18 nt, Human
caggaaaagccucugugu

SEQ ID NO: 2345238 - RNA, 19 nt, Human
caggaaaagccucuguguc

SEQ ID NO: 2345239 - RNA, 18 nt, Human
caggaaaagcugcugaca

SEQ ID NO: 2345240 - RNA, 15 nt, Human
caggaaaagcugcug

SEQ ID NO: 2345241 - RNA, 16 nt, Human
caggaaaagcugcuga

SEQ ID NO: 2345242 - RNA, 20 nt, Human
cagcccuugagcuccccaaa

SEQ ID NO: 2345243 - RNA, 11 nt, Human
cagcccuugcu

SEQ ID NO: 2345244 - RNA, 12 nt, Human
cagcccuugcuu

SEQ ID NO: 2345245 - RNA, 13 nt, Human
cagcccuugcuug

SEQ ID NO: 2345246 - RNA, 14 nt, Human
cagcccuugcuugu

SEQ ID NO: 2345247 - RNA, 15 nt, Human
cagcccuugcuuguu

SEQ ID NO: 2345248 - RNA, 12 nt, Human
cagcccuuggcc

SEQ ID NO: 2345249 - RNA, 13 nt, Human
cagcccuuggcca

SEQ ID NO: 2345250 - RNA, 19 nt, Human
cagccgcuccugucugcca

SEQ ID NO: 2345251 - RNA, 18 nt, Human
cagccgcuccugucugcc

SEQ ID NO: 2345252 - RNA, 17 nt, Human
cagccgcuccugucugc

SEQ ID NO: 2345253 - RNA, 16 nt, Human
cagccgcuccugucug

SEQ ID NO: 2345254 - RNA, 14 nt, Human
cagccgcuccuguc

SEQ ID NO: 2345255 - RNA, 20 nt, Human
cagccgagauagccaaggcc

SEQ ID NO: 2345256 - RNA, 19 nt, Human
cagcccuuugggaggcuga

SEQ ID NO: 2345257 - RNA, 14 nt, Human
cagcccuuggccag

SEQ ID NO: 2345258 - RNA, 23 nt, Human
cagcccuuugggaggcugaggcg

SEQ ID NO: 2345259 - RNA, 20 nt, Human
cagcccuuugggaggcugag

SEQ ID NO: 2345260 - RNA, 19 nt, Human
cagccgagauagccaaggc

SEQ ID NO: 2345261 - RNA, 23 nt, Human
cagccgcuccugucugccagcca

SEQ ID NO: 2345262 - RNA, 22 nt, Human
cagccgcuccugucugccagcc

SEQ ID NO: 2345263 - RNA, 21 nt, Human
cagccgcuccugucugccagc

SEQ ID NO: 2345264 - RNA, 20 nt, Human
cagccgcuccugucugccag

SEQ ID NO: 2345265 - RNA, 19 nt, Human
cagccgcugagcgaggaga

SEQ ID NO: 2345266 - RNA, 23 nt, Human
cagccgcucggaggccccaaagg

SEQ ID NO: 2345267 - RNA, 19 nt, Human
cagccgcucggaggcccca

SEQ ID NO: 2345268 - RNA, 20 nt, Human
cagccgcucggaggccccaa

SEQ ID NO: 2345269 - RNA, 21 nt, Human
cagccgcucggaggccccaaa

SEQ ID NO: 2345270 - RNA, 13 nt, Human
cagccucugaccc

SEQ ID NO: 2345271 - RNA, 16 nt, Human
cagccgcugcccggcg

SEQ ID NO: 2345272 - RNA, 15 nt, Human
cagccgcugcccggc

SEQ ID NO: 2345273 - RNA, 20 nt, Human
cagccgcugagcgaggagau

SEQ ID NO: 2345274 - RNA, 12 nt, Human
cagccgcugccc

SEQ ID NO: 2345275 - RNA, 13 nt, Human
cagccgcugcccg

SEQ ID NO: 2345276 - RNA, 17 nt, Human
cagccucugaaaaccaa

SEQ ID NO: 2345277 - RNA, 18 nt, Human
cagccucugagccccugg

SEQ ID NO: 2345278 - RNA, 23 nt, Human
cagccucugacuuaagcugccuc

SEQ ID NO: 2345279 - RNA, 22 nt, Human
cagccucugaccccuccucacu

SEQ ID NO: 2345280 - RNA, 23 nt, Human
cagccucugaccccuccucacug

SEQ ID NO: 2345281 - RNA, 21 nt, Human
cagccucugagccccugggac

SEQ ID NO: 2345282 - RNA, 19 nt, Human
cagccucugagccccuggg

SEQ ID NO: 2345283 - RNA, 13 nt, Human
cagccucuggcau

SEQ ID NO: 2345284 - RNA, 14 nt, Human
cagccucugacccc

SEQ ID NO: 2345285 - RNA, 15 nt, Human
cagccucugaccccu

SEQ ID NO: 2345286 - RNA, 16 nt, Human
cagccucugaccccuc

SEQ ID NO: 2345287 - RNA, 17 nt, Human
cagccucugaccccucc

SEQ ID NO: 2345288 - RNA, 18 nt, Human
cagccucugaccccuccu

SEQ ID NO: 2345289 - RNA, 19 nt, Human
cagccucugaccccuccuc

SEQ ID NO: 2345290 - RNA, 20 nt, Human
cagccucugaccccuccuca

SEQ ID NO: 2345291 - RNA, 21 nt, Human
cagccucugaccccuccucac

SEQ ID NO: 2345292 - RNA, 19 nt, Human
cagccugcuaauuccccag

SEQ ID NO: 2345293 - RNA, 12 nt, Human
cagccugcucca

SEQ ID NO: 2345294 - RNA, 12 nt, Human
cagcgccaggcu

SEQ ID NO: 2345295 - RNA, 19 nt, Human
cagcgccaggcugaccaca

SEQ ID NO: 2345296 - RNA, 18 nt, Human
cagcgccaggcugaccac

SEQ ID NO: 2345297 - RNA, 22 nt, Human
cagcgccaggcugaccacagca

SEQ ID NO: 2345298 - RNA, 14 nt, Human
cagcgcccgcuggg

SEQ ID NO: 2345299 - RNA, 21 nt, Human
cagcgccaggcugaccacagc

SEQ ID NO: 2345300 - RNA, 20 nt, Human
cagcgccaggcugaccacag

SEQ ID NO: 2345301 - RNA, 23 nt, Human
cagcgccuaguggggucucccuc

SEQ ID NO: 2345302 - RNA, 22 nt, Human
cagcgccuaguggggucucccu

SEQ ID NO: 2345303 - RNA, 20 nt, Human
cagcgcccuuccucuccacc

SEQ ID NO: 2345304 - RNA, 16 nt, Human
cagcgcccuuccucuc

SEQ ID NO: 2345305 - RNA, 18 nt, Human
cagcgcccuuccucucca

SEQ ID NO: 2345306 - RNA, 16 nt, Human
cagcgcccgcugggcu

SEQ ID NO: 2345307 - RNA, 17 nt, Human
cagcgcccgcugggcug

SEQ ID NO: 2345308 - RNA, 19 nt, Human
cagcgcccgcugggcugag

SEQ ID NO: 2345309 - RNA, 12 nt, Human
cagcgcccuucc

SEQ ID NO: 2345310 - RNA, 13 nt, Human
cagcgcccuuccu

SEQ ID NO: 2345311 - RNA, 14 nt, Human
cagcgcccuuccuc

SEQ ID NO: 2345312 - RNA, 15 nt, Human
cagcgcccuuccucu

SEQ ID NO: 2345313 - RNA, 18 nt, Human
cagcggggacagcuccuu

SEQ ID NO: 2345314 - RNA, 19 nt, Human
cagcggggacagcuccuuc

SEQ ID NO: 2345315 - RNA, 18 nt, Human
cagcggggccccagggcu

SEQ ID NO: 2345316 - RNA, 13 nt, Human
cagcgccuuuccc

SEQ ID NO: 2345317 - RNA, 12 nt, Human
cagcgccuuucc

SEQ ID NO: 2345318 - RNA, 20 nt, Human
cagcggggccuggcgggaug

SEQ ID NO: 2345319 - RNA, 21 nt, Human
cagcggggacagcuccuucug

SEQ ID NO: 2345320 - RNA, 17 nt, Human
cacuuucagugaaagca

SEQ ID NO: 2345321 - RNA, 18 nt, Human
cacuuucagugaaagcau

SEQ ID NO: 2345322 - RNA, 19 nt, Human
cacuuucagugaaagcauc

SEQ ID NO: 2345323 - RNA, 15 nt, Human
cacuuuccuccuggc

SEQ ID NO: 2345324 - RNA, 17 nt, Human
cacuuucacauagaugu

SEQ ID NO: 2345325 - RNA, 22 nt, Human
cacuuuaugccggaugugcuuu

SEQ ID NO: 2345326 - RNA, 22 nt, Human
cacuugugccaacacucaagaa

SEQ ID NO: 2345327 - RNA, 21 nt, Human
cacuuuaugccggaugugcuu

SEQ ID NO: 2345328 - RNA, 21 nt, Human
cacuggggaaauaacagcugu

SEQ ID NO: 2345329 - RNA, 21 nt, Human
cacuggggagcccgucucagu

SEQ ID NO: 2345330 - RNA, 23 nt, Human
cacugggcuuggggaccagagcu

SEQ ID NO: 2345331 - RNA, 18 nt, Human
cacuggggauugggcccc

SEQ ID NO: 2345332 - RNA, 17 nt, Human
cacuggggauugggccc

SEQ ID NO: 2345333 - RNA, 16 nt, Human
cacuggggauugggcc

SEQ ID NO: 2345334 - RNA, 15 nt, Human
cacuggggauugggc

SEQ ID NO: 2345335 - RNA, 22 nt, Human
cacugggcuuggggaccagagc

SEQ ID NO: 2345336 - RNA, 20 nt, Human
cacugggcuuggggaccaga

SEQ ID NO: 2345337 - RNA, 14 nt, Human
cacuguugcccagg

SEQ ID NO: 2345338 - RNA, 22 nt, Human
cacugguggcccgacagccugg

SEQ ID NO: 2345339 - RNA, 13 nt, Human
cacugguggcccg

SEQ ID NO: 2345340 - RNA, 21 nt, Human
cacugguggcccgacagccug

SEQ ID NO: 2345341 - RNA, 15 nt, Human
cacuguugcccaggc

SEQ ID NO: 2345342 - RNA, 16 nt, Human
cacuguugcccaggcu

SEQ ID NO: 2345343 - RNA, 17 nt, Human
cacuggugacaugucuu

SEQ ID NO: 2345344 - RNA, 22 nt, Human
cacuggggagcccgucucagug

SEQ ID NO: 2345345 - RNA, 14 nt, Human
cacuggggcacuug

SEQ ID NO: 2345346 - RNA, 23 nt, Human
cacuggggauugggccccugcca

SEQ ID NO: 2345347 - RNA, 21 nt, Human
cacuugguuggguccucacau

SEQ ID NO: 2345348 - RNA, 20 nt, Human
cacuugguuggguccucaca

SEQ ID NO: 2345349 - RNA, 12 nt, Human
cacuuguacaaa

SEQ ID NO: 2345350 - RNA, 23 nt, Human
cacuuguccagcugagcgccagg

SEQ ID NO: 2345351 - RNA, 17 nt, Human
cacuuguacaaaauaaa

SEQ ID NO: 2345352 - RNA, 19 nt, Human
cacuugguuggguccucac

SEQ ID NO: 2345353 - RNA, 16 nt, Human
cacuugguuggguccu

SEQ ID NO: 2345354 - RNA, 20 nt, Human
cacuuggugauauguccuau

SEQ ID NO: 2345355 - RNA, 20 nt, Human
cacuuagaaauugcauuucc

SEQ ID NO: 2345356 - RNA, 20 nt, Human
cacuuggucugugagaugcu

SEQ ID NO: 2345357 - RNA, 17 nt, Human
cacuuggucugugagau

SEQ ID NO: 2345358 - RNA, 19 nt, Human
cacuugucccacuaucugg

SEQ ID NO: 2345359 - RNA, 20 nt, Human
cacuugucccacuaucuggg

SEQ ID NO: 2345360 - RNA, 22 nt, Human
cacuugucccacuaucugggug

SEQ ID NO: 2345361 - RNA, 20 nt, Human
cacuuguccccaaauccgaa

SEQ ID NO: 2345362 - RNA, 12 nt, Human
cacuugucccca

SEQ ID NO: 2345363 - RNA, 23 nt, Human
cacuuguccccaaauccgaaccu

SEQ ID NO: 2345364 - RNA, 17 nt, Human
cacuugugauuauuuau

SEQ ID NO: 2345365 - RNA, 22 nt, Human
cacuugugcacccucuauccca

SEQ ID NO: 2345366 - RNA, 18 nt, Human
cacuugugccaacacuca

SEQ ID NO: 2345367 - RNA, 24 nt, Human
cacuugugccaacacucaagaagc

SEQ ID NO: 2345368 - RNA, 17 nt, Human
cacuguugcccaggcug

SEQ ID NO: 2345369 - RNA, 18 nt, Human
cacuguuuacaagaaaaa

SEQ ID NO: 2345370 - RNA, 17 nt, Human
cacuguuuacaagaaaa

SEQ ID NO: 2345371 - RNA, 22 nt, Human
cacuggugacugcgaucuucag

SEQ ID NO: 2345372 - RNA, 11 nt, Human
cacuguuuaag

SEQ ID NO: 2345373 - RNA, 19 nt, Human
cacuguuucaaacuuuacu

SEQ ID NO: 2345374 - RNA, 18 nt, Human
cacuguuucucugcuguu

SEQ ID NO: 2345375 - RNA, 14 nt, Human
cacuguuucucugc

SEQ ID NO: 2345376 - RNA, 12 nt, Human
cacuguuucucu

SEQ ID NO: 2345377 - RNA, 22 nt, Human
cacuuaccuucaauaaaguauc

SEQ ID NO: 2345378 - RNA, 18 nt, Human
cacuuacuguuguccuau

SEQ ID NO: 2345379 - RNA, 21 nt, Human
cacuuacugguaggaccaagc

SEQ ID NO: 2345380 - RNA, 15 nt, Human
cacuuacugguagga

SEQ ID NO: 2345381 - RNA, 17 nt, Human
cacuuagaaauugcauu

SEQ ID NO: 2345382 - RNA, 19 nt, Human
cacuuagaaauugcauuuc

SEQ ID NO: 2345383 - RNA, 17 nt, Human
cacuuacuuacccucac

SEQ ID NO: 2345384 - RNA, 16 nt, Human
cacuuacuugcuuauu

SEQ ID NO: 2345385 - RNA, 15 nt, Human
cacuuacuguuucug

SEQ ID NO: 2345386 - RNA, 16 nt, Human
cacuuacuguuucugu

SEQ ID NO: 2345387 - RNA, 18 nt, Human
cacuuacuguuucuguca

SEQ ID NO: 2345388 - RNA, 20 nt, Human
cacuuacuguuucugucagg

SEQ ID NO: 2345389 - RNA, 23 nt, Human
cagaauacaguaagcugcucuau

SEQ ID NO: 2345390 - RNA, 23 nt, Human
cagaauaaugaauggacucaaac

SEQ ID NO: 2345391 - RNA, 14 nt, Human
cagaauaaugaaug

SEQ ID NO: 2345392 - RNA, 22 nt, Human
cagaauacuguuaaaggaaaaa

SEQ ID NO: 2345393 - RNA, 17 nt, Human
cagaauaaucuuugggu

SEQ ID NO: 2345394 - RNA, 21 nt, Human
cagaauaaguuauugcaguuu

SEQ ID NO: 2345395 - RNA, 23 nt, Human
cagaauaaguuauugcaguuuau

SEQ ID NO: 2345396 - RNA, 21 nt, Human
cagaauagcaaggugcucaca

SEQ ID NO: 2345397 - RNA, 15 nt, Human
cagaauagccacauu

SEQ ID NO: 2345398 - RNA, 22 nt, Human
cagaauagccacauuuggaaua

SEQ ID NO: 2345399 - RNA, 21 nt, Human
cagaauagccacauuuggaau

SEQ ID NO: 2345400 - RNA, 16 nt, Human
cagaauacuuuucucu

SEQ ID NO: 2345401 - RNA, 12 nt, Human
cagaauaucugg

SEQ ID NO: 2345402 - RNA, 22 nt, Human
cagaauauuagugaccucagcu

SEQ ID NO: 2345403 - RNA, 13 nt, Human
cagaauauugcuu

SEQ ID NO: 2345404 - RNA, 22 nt, Human
cagaauaaaguucugaguguuu

SEQ ID NO: 2345405 - RNA, 15 nt, Human
cagaauaaguuauug

SEQ ID NO: 2345406 - RNA, 20 nt, Human
cagaauaaagcaauuuuccu

SEQ ID NO: 2345407 - RNA, 21 nt, Human
cagaauaaagcaauuuuccuu

SEQ ID NO: 2345408 - RNA, 22 nt, Human
cagaauaaagcaauuuuccuug

SEQ ID NO: 2345409 - RNA, 23 nt, Human
cagaauaaagcaauuuuccuuga

SEQ ID NO: 2345410 - RNA, 17 nt, Human
cagaauaaguuauugca

SEQ ID NO: 2345411 - RNA, 18 nt, Human
cagaauaaguuauugcag

SEQ ID NO: 2345412 - RNA, 19 nt, Human
cagaauaaguuauugcagu

SEQ ID NO: 2345413 - RNA, 20 nt, Human
cagaauaaguuauugcaguu

SEQ ID NO: 2345414 - RNA, 19 nt, Human
cagaaguuugucaagucaa

SEQ ID NO: 2345415 - RNA, 11 nt, Human
cagaauaaagc

SEQ ID NO: 2345416 - RNA, 16 nt, Human
cagaaguuuggcaaua

SEQ ID NO: 2345417 - RNA, 21 nt, Human
cagaauaaacuggcagcucag

SEQ ID NO: 2345418 - RNA, 12 nt, Human
cagaauaaagca

SEQ ID NO: 2345419 - RNA, 13 nt, Human
cagaauaaagcaa

SEQ ID NO: 2345420 - RNA, 14 nt, Human
cagaauaaagcaau

SEQ ID NO: 2345421 - RNA, 15 nt, Human
cagaauaaagcaauu

SEQ ID NO: 2345422 - RNA, 16 nt, Human
cagaauaaagcaauuu

SEQ ID NO: 2345423 - RNA, 17 nt, Human
cagaauaaagcaauuuu

SEQ ID NO: 2345424 - RNA, 18 nt, Human
cagaauaaagcaauuuuc

SEQ ID NO: 2345425 - RNA, 19 nt, Human
cagaauaaagcaauuuucc

SEQ ID NO: 2345426 - RNA, 22 nt, Human
cagaaguuucugccgcagcccu

SEQ ID NO: 2345427 - RNA, 20 nt, Human
cagaaguuucugccgcagcc

SEQ ID NO: 2345428 - RNA, 21 nt, Human
cagaaguuucugccgcagccc

SEQ ID NO: 2345429 - RNA, 11 nt, Human
cagaacacugu

SEQ ID NO: 2345430 - RNA, 12 nt, Human
cagaacagcaga

SEQ ID NO: 2345431 - RNA, 21 nt, Human
cagaacacuaaccugaccgug

SEQ ID NO: 2345432 - RNA, 19 nt, Human
cagaagucaugaagcccaa

SEQ ID NO: 2345433 - RNA, 21 nt, Human
cagaacagcagagguucuuuu

SEQ ID NO: 2345434 - RNA, 13 nt, Human
cagaacacuaacc

SEQ ID NO: 2345435 - RNA, 15 nt, Human
cagaacacuaaccug

SEQ ID NO: 2345436 - RNA, 15 nt, Human
cagaacacauaauuc

SEQ ID NO: 2345437 - RNA, 23 nt, Human
cagaaauuuaauucauguuucuu

SEQ ID NO: 2345438 - RNA, 14 nt, Human
cagaaauuuuuauu

SEQ ID NO: 2345439 - RNA, 15 nt, Human
cagaaauuuuuauuu

SEQ ID NO: 2345440 - RNA, 22 nt, Human
cagaaauuuaauucauguuucu

SEQ ID NO: 2345441 - RNA, 18 nt, Human
cagaacacacuccaucag

SEQ ID NO: 2345442 - RNA, 21 nt, Human
cagaacaagguucccucugag

SEQ ID NO: 2345443 - RNA, 18 nt, Human
cagaaauuuuuauuuuuc

SEQ ID NO: 2345444 - RNA, 19 nt, Human
cagaaauuuuuauuuuucu

SEQ ID NO: 2345445 - RNA, 14 nt, Human
cagaacagcagagg

SEQ ID NO: 2345446 - RNA, 17 nt, Human
cagaagugagcuuugcu

SEQ ID NO: 2345447 - RNA, 18 nt, Human
cagaagugagcuuugcug

SEQ ID NO: 2345448 - RNA, 22 nt, Human
cagaagugagcuuugcugcuac

SEQ ID NO: 2345449 - RNA, 20 nt, Human
cagaagugagcuuugcugcu

SEQ ID NO: 2345450 - RNA, 21 nt, Human
cagaagugagcuuugcugcua

SEQ ID NO: 2345451 - RNA, 13 nt, Human
cagaaguggagcu

SEQ ID NO: 2345452 - RNA, 14 nt, Human
cagaaguggagcug

SEQ ID NO: 2345453 - RNA, 11 nt, Human
cagaaguguga

SEQ ID NO: 2345454 - RNA, 15 nt, Human
cagaaguggagcugg

SEQ ID NO: 2345455 - RNA, 16 nt, Human
cagaaguggagcuggg

SEQ ID NO: 2345456 - RNA, 13 nt, Human
cagaagugugauu

SEQ ID NO: 2345457 - RNA, 22 nt, Human
cagaagugugauugggaauaaa

SEQ ID NO: 2345458 - RNA, 16 nt, Human
cagaaauuagccgggc

SEQ ID NO: 2345459 - RNA, 23 nt, Human
cagaaauuagaaaccuuaauaug

SEQ ID NO: 2345460 - RNA, 11 nt, Human
cagaaauugga

SEQ ID NO: 2345461 - RNA, 20 nt, Human
cagaaauuggaacagaaugu

SEQ ID NO: 2345462 - RNA, 21 nt, Human
cagaaauuggaacagaauguu

SEQ ID NO: 2345463 - RNA, 17 nt, Human
cagaaauguguuaucac

SEQ ID NO: 2345464 - RNA, 15 nt, Human
cacuaauacaccagg

SEQ ID NO: 2345465 - RNA, 20 nt, Human
cacggcaggacaacgaggaa

SEQ ID NO: 2345466 - RNA, 22 nt, Human
cacuaaguuauaguauaucugg

SEQ ID NO: 2345467 - RNA, 17 nt, Human
cacuaauuugauguuua

SEQ ID NO: 2345468 - RNA, 23 nt, Human
cacuacggaauaguuggcuagga

SEQ ID NO: 2345469 - RNA, 17 nt, Human
cacuacucacagucucu

SEQ ID NO: 2345470 - RNA, 14 nt, Human
cacuacuccucugc

SEQ ID NO: 2345471 - RNA, 15 nt, Human
cacuacuccucugca

SEQ ID NO: 2345472 - RNA, 18 nt, Human
cacuacuccucugcagug

SEQ ID NO: 2345473 - RNA, 19 nt, Human
cacuacuccucugcagugc

SEQ ID NO: 2345474 - RNA, 18 nt, Human
cacuaccuccucagggau

SEQ ID NO: 2345475 - RNA, 20 nt, Human
cacuaccuccucagggaugg

SEQ ID NO: 2345476 - RNA, 16 nt, Human
cacuaccuccucaggg

SEQ ID NO: 2345477 - RNA, 17 nt, Human
cacuaccuccucaggga

SEQ ID NO: 2345478 - RNA, 14 nt, Human
cacggccaggccag

SEQ ID NO: 2345479 - RNA, 18 nt, Human
cacggaucugagaaucuu

SEQ ID NO: 2345480 - RNA, 15 nt, Human
cacggccaggccaga

SEQ ID NO: 2345481 - RNA, 16 nt, Human
cacggccaggccagag

SEQ ID NO: 2345482 - RNA, 23 nt, Human
cacggauccauguagcaggacug

SEQ ID NO: 2345483 - RNA, 20 nt, Human
cacggauccauguagcagga

SEQ ID NO: 2345484 - RNA, 13 nt, Human
cacggaucugaga

SEQ ID NO: 2345485 - RNA, 14 nt, Human
cacggaucugagaa

SEQ ID NO: 2345486 - RNA, 21 nt, Human
cacggaggcaucugcacccuc

SEQ ID NO: 2345487 - RNA, 23 nt, Human
cacggagucguggggugugcugg

SEQ ID NO: 2345488 - RNA, 20 nt, Human
cacggagggugacgggggug

SEQ ID NO: 2345489 - RNA, 19 nt, Human
cacggagcccagcccuccc

SEQ ID NO: 2345490 - RNA, 17 nt, Human
cacucuuccugcaagga

SEQ ID NO: 2345491 - RNA, 21 nt, Human
cacucuuccagaaucccaaga

SEQ ID NO: 2345492 - RNA, 14 nt, Human
cacucuuccugagu

SEQ ID NO: 2345493 - RNA, 14 nt, Human
cacucuuggagccu

SEQ ID NO: 2345494 - RNA, 16 nt, Human
cacucuuggagccugc

SEQ ID NO: 2345495 - RNA, 15 nt, Human
cacucuuggagccug

SEQ ID NO: 2345496 - RNA, 11 nt, Human
cacucuuccaa

SEQ ID NO: 2345497 - RNA, 11 nt, Human
cacucuuccag

SEQ ID NO: 2345498 - RNA, 17 nt, Human
cacucuugaaaaaugca

SEQ ID NO: 2345499 - RNA, 19 nt, Human
cacuccccgaagucuuuug

SEQ ID NO: 2345500 - RNA, 18 nt, Human
cacuccccgaagucuuuu

SEQ ID NO: 2345501 - RNA, 17 nt, Human
cacucuuauugcccacg

SEQ ID NO: 2345502 - RNA, 18 nt, Human
cacucuuauugcccacgc

SEQ ID NO: 2345503 - RNA, 19 nt, Human
cacucuuauugcccacgcu

SEQ ID NO: 2345504 - RNA, 18 nt, Human
cacuaggacucugaggcu

SEQ ID NO: 2345505 - RNA, 17 nt, Human
cacuaggacucugaggc

SEQ ID NO: 2345506 - RNA, 17 nt, Human
cacuaggcccccacuug

SEQ ID NO: 2345507 - RNA, 20 nt, Human
cacuaggcccccacuugccu

SEQ ID NO: 2345508 - RNA, 21 nt, Human
cacuagccucuccaggaaugc

SEQ ID NO: 2345509 - RNA, 17 nt, Human
cacuagccuuuggcucu

SEQ ID NO: 2345510 - RNA, 18 nt, Human
cacuagccuuuggcucug

SEQ ID NO: 2345511 - RNA, 20 nt, Human
cacuagccuuuggcucugga

SEQ ID NO: 2345512 - RNA, 16 nt, Human
cacuaggacucugagg

SEQ ID NO: 2345513 - RNA, 21 nt, Human
cacuagccuuuggcucuggag

SEQ ID NO: 2345514 - RNA, 22 nt, Human
cacuagccuuuggcucuggaga

SEQ ID NO: 2345515 - RNA, 17 nt, Human
cacuagccucuccagga

SEQ ID NO: 2345516 - RNA, 16 nt, Human
cacuagccucuccagg

SEQ ID NO: 2345517 - RNA, 14 nt, Human
cacuagccucucca

SEQ ID NO: 2345518 - RNA, 23 nt, Human
cacuagcccaaugaaaugaauua

SEQ ID NO: 2345519 - RNA, 12 nt, Human
cacuacugcagu

SEQ ID NO: 2345520 - RNA, 14 nt, Human
cacuacucugugcc

SEQ ID NO: 2345521 - RNA, 13 nt, Human
cacuacugacaug

SEQ ID NO: 2345522 - RNA, 20 nt, Human
cacuacuccucugcagugcc

SEQ ID NO: 2345523 - RNA, 13 nt, Human
cacuacucugugc

SEQ ID NO: 2345524 - RNA, 15 nt, Human
cacuacugacaugug

SEQ ID NO: 2345525 - RNA, 14 nt, Human
cacuccccaccuuc

SEQ ID NO: 2345526 - RNA, 13 nt, Human
cacucccaggcag

SEQ ID NO: 2345527 - RNA, 14 nt, Human
cacucccaggcagc

SEQ ID NO: 2345528 - RNA, 15 nt, Human
cacucccaggcagcc

SEQ ID NO: 2345529 - RNA, 13 nt, Human
cacucccagugcu

SEQ ID NO: 2345530 - RNA, 15 nt, Human
cacuccccaccuuca

SEQ ID NO: 2345531 - RNA, 15 nt, Human
cacucccacuucccu

SEQ ID NO: 2345532 - RNA, 14 nt, Human
cacucccacuuccc

SEQ ID NO: 2345533 - RNA, 13 nt, Human
cacucccacuucc

SEQ ID NO: 2345534 - RNA, 21 nt, Human
cacuaggcccccacuugccuc

SEQ ID NO: 2345535 - RNA, 22 nt, Human
cacuaggcccccacuugccucu

SEQ ID NO: 2345536 - RNA, 23 nt, Human
cacuaggcccccacuugccucuu

SEQ ID NO: 2345537 - RNA, 20 nt, Human
cacugaaaaaucuaagugau

SEQ ID NO: 2345538 - RNA, 23 nt, Human
cacugaaaaaucuaagugauaua

SEQ ID NO: 2345539 - RNA, 19 nt, Human
cacucuuggagccugcaga

SEQ ID NO: 2345540 - RNA, 17 nt, Human
cacucuuggagccugca

SEQ ID NO: 2345541 - RNA, 20 nt, Human
cacugaaauauacacacagc

SEQ ID NO: 2345542 - RNA, 16 nt, Human
cacugaaauauacaca

SEQ ID NO: 2345543 - RNA, 16 nt, Human
cacugaaaacaucugg

SEQ ID NO: 2345544 - RNA, 15 nt, Human
cacugaaaacaucug

SEQ ID NO: 2345545 - RNA, 18 nt, Human
cacugaaaacaucuggaa

SEQ ID NO: 2345546 - RNA, 20 nt, Human
cacugaacuuugcugagccu

SEQ ID NO: 2345547 - RNA, 11 nt, Human
cacugaagaag

SEQ ID NO: 2345548 - RNA, 19 nt, Human
cacugaagaaaccuucaga

SEQ ID NO: 2345549 - RNA, 21 nt, Human
caccucacagaaaugagauca

SEQ ID NO: 2345550 - RNA, 13 nt, Human
caccugccaggga

SEQ ID NO: 2345551 - RNA, 23 nt, Human
caccucaaaauaccaugccauuu

SEQ ID NO: 2345552 - RNA, 14 nt, Human
caccugccagggac

SEQ ID NO: 2345553 - RNA, 16 nt, Human
caccugccagggacag

SEQ ID NO: 2345554 - RNA, 13 nt, Human
caccuauuuccau

SEQ ID NO: 2345555 - RNA, 21 nt, Human
caccuaugugccaacuguugu

SEQ ID NO: 2345556 - RNA, 23 nt, Human
caccuaugucauuucauuuccua

SEQ ID NO: 2345557 - RNA, 20 nt, Human
caccuaugucauuucauuuc

SEQ ID NO: 2345558 - RNA, 12 nt, Human
caccuaugugcc

SEQ ID NO: 2345559 - RNA, 14 nt, Human
caccuaugugccaa

SEQ ID NO: 2345560 - RNA, 17 nt, Human
caccuaugugccaacug

SEQ ID NO: 2345561 - RNA, 20 nt, Human
caccuacuacaucgcccucc

SEQ ID NO: 2345562 - RNA, 21 nt, Human
caccuacuacaucgcccucca

SEQ ID NO: 2345563 - RNA, 19 nt, Human
caccuaugucauuucauuu

SEQ ID NO: 2345564 - RNA, 21 nt, Human
caccuaucucgugggagagcc

SEQ ID NO: 2345565 - RNA, 20 nt, Human
caccuaccaccacgcccggc

SEQ ID NO: 2345566 - RNA, 22 nt, Human
caccuaccaucagggacaggau

SEQ ID NO: 2345567 - RNA, 17 nt, Human
caccuaccaucagggac

SEQ ID NO: 2345568 - RNA, 18 nt, Human
caccuaccaucagggaca

SEQ ID NO: 2345569 - RNA, 19 nt, Human
caccuaagggacauguuuu

SEQ ID NO: 2345570 - RNA, 13 nt, Human
caccuaagggaca

SEQ ID NO: 2345571 - RNA, 18 nt, Human
caccuaagggacauguuu

SEQ ID NO: 2345572 - RNA, 23 nt, Human
caccuacaguguacagucuugua

SEQ ID NO: 2345573 - RNA, 19 nt, Human
caccuaaucaggcugaggu

SEQ ID NO: 2345574 - RNA, 21 nt, Human
caccuacaugagguacugaga

SEQ ID NO: 2345575 - RNA, 13 nt, Human
caccguucugugc

SEQ ID NO: 2345576 - RNA, 21 nt, Human
caccguuggggauuggggaag

SEQ ID NO: 2345577 - RNA, 18 nt, Human
caccguguaaaccaaagc

SEQ ID NO: 2345578 - RNA, 15 nt, Human
caccguucugugcac

SEQ ID NO: 2345579 - RNA, 14 nt, Human
caccguucugugca

SEQ ID NO: 2345580 - RNA, 17 nt, Human
caccuugcaacacacag

SEQ ID NO: 2345581 - RNA, 16 nt, Human
caccuugcaacacaca

SEQ ID NO: 2345582 - RNA, 17 nt, Human
caccugccauuugcacc

SEQ ID NO: 2345583 - RNA, 22 nt, Human
caccugccauuugcacccuccg

SEQ ID NO: 2345584 - RNA, 19 nt, Human
caccuugacagggcacacc

SEQ ID NO: 2345585 - RNA, 17 nt, Human
caccugccagggacaga

SEQ ID NO: 2345586 - RNA, 21 nt, Human
caccuugcaacacacagacac

SEQ ID NO: 2345587 - RNA, 18 nt, Human
caccuugcaacacacaga

SEQ ID NO: 2345588 - RNA, 11 nt, Human
caccucacccc

SEQ ID NO: 2345589 - RNA, 14 nt, Human
caccuugcggggau

SEQ ID NO: 2345590 - RNA, 16 nt, Human
caccuuggacauccuc

SEQ ID NO: 2345591 - RNA, 17 nt, Human
caccuuggacauccucc

SEQ ID NO: 2345592 - RNA, 18 nt, Human
caccuuggacauccuccu

SEQ ID NO: 2345593 - RNA, 21 nt, Human
caccuuggacauccuccuccc

SEQ ID NO: 2345594 - RNA, 13 nt, Human
caccuuggcucaa

SEQ ID NO: 2345595 - RNA, 17 nt, Human
caccuuggcaccagaca

SEQ ID NO: 2345596 - RNA, 22 nt, Human
caccuuggacauccuccuccca

SEQ ID NO: 2345597 - RNA, 18 nt, Human
caccuuggggcuugacuu

SEQ ID NO: 2345598 - RNA, 18 nt, Human
caccuuuauuaaaaucuu

SEQ ID NO: 2345599 - RNA, 17 nt, Human
caccuuuauuaaaaucu

SEQ ID NO: 2345600 - RNA, 15 nt, Human
caccuuugcaggcau

SEQ ID NO: 2345601 - RNA, 17 nt, Human
caccuuuguccccaccg

SEQ ID NO: 2345602 - RNA, 14 nt, Human
caccuuugucccca

SEQ ID NO: 2345603 - RNA, 15 nt, Human
caccuuuguccccac

SEQ ID NO: 2345604 - RNA, 15 nt, Human
caccuuuauuaaaau

SEQ ID NO: 2345605 - RNA, 14 nt, Human
caccuuuauuaaaa

SEQ ID NO: 2345606 - RNA, 12 nt, Human
caccuuuauuaa

SEQ ID NO: 2345607 - RNA, 14 nt, Human
caccuuuaaagugu

SEQ ID NO: 2345608 - RNA, 21 nt, Human
caccuuguuggagccugcagg

SEQ ID NO: 2345609 - RNA, 14 nt, Human
caccuuuauucugg

SEQ ID NO: 2345610 - RNA, 14 nt, Human
caccuuugaagaag

SEQ ID NO: 2345611 - RNA, 20 nt, Human
caccuuggggcuugacuuuu

SEQ ID NO: 2345612 - RNA, 14 nt, Human
caccuuguggcaag

SEQ ID NO: 2345613 - RNA, 15 nt, Human
caccuugugucugua

SEQ ID NO: 2345614 - RNA, 17 nt, Human
caccuugugucuguaca

SEQ ID NO: 2345615 - RNA, 21 nt, Human
caccuugugucuguacacgug

SEQ ID NO: 2345616 - RNA, 14 nt, Human
caccuuguuggagc

SEQ ID NO: 2345617 - RNA, 19 nt, Human
caccuuguuggagccugca

SEQ ID NO: 2345618 - RNA, 23 nt, Human
cacagguaugaccuucuaggaag

SEQ ID NO: 2345619 - RNA, 23 nt, Human
cacaggguugggcccagaucugg

SEQ ID NO: 2345620 - RNA, 22 nt, Human
cacaggguugggcccagaucug

SEQ ID NO: 2345621 - RNA, 18 nt, Human
cacaggguugggcccaga

SEQ ID NO: 2345622 - RNA, 16 nt, Human
cacaggguugggccca

SEQ ID NO: 2345623 - RNA, 14 nt, Human
cacaggguugggcc

SEQ ID NO: 2345624 - RNA, 21 nt, Human
cacaggguucaaaaugucugu

SEQ ID NO: 2345625 - RNA, 23 nt, Human
cacagggucugcucuuucucugc

SEQ ID NO: 2345626 - RNA, 13 nt, Human
cacagggcgagac

SEQ ID NO: 2345627 - RNA, 16 nt, Human
cacagggucugcucuu

SEQ ID NO: 2345628 - RNA, 17 nt, Human
cacagggucugcucuuu

SEQ ID NO: 2345629 - RNA, 19 nt, Human
cacagggucugcucuuucu

SEQ ID NO: 2345630 - RNA, 17 nt, Human
cacagggcagagccggg

SEQ ID NO: 2345631 - RNA, 14 nt, Human
cacagggcagagcc

SEQ ID NO: 2345632 - RNA, 13 nt, Human
cacagggcagagc

SEQ ID NO: 2345633 - RNA, 15 nt, Human
cacagggauccgacu

SEQ ID NO: 2345634 - RNA, 21 nt, Human
cacagggcagcugggcccaac

SEQ ID NO: 2345635 - RNA, 22 nt, Human
cacagggcagcugggcccaacc

SEQ ID NO: 2345636 - RNA, 16 nt, Human
cacagggcagcugggc

SEQ ID NO: 2345637 - RNA, 17 nt, Human
cacagggcagcugggcc

SEQ ID NO: 2345638 - RNA, 18 nt, Human
cacagggcagcugggccc

SEQ ID NO: 2345639 - RNA, 19 nt, Human
cacagggcagcugggccca

SEQ ID NO: 2345640 - RNA, 22 nt, Human
cacagggccccagaaggcaggg

SEQ ID NO: 2345641 - RNA, 19 nt, Human
cacagggccccagaaggca

SEQ ID NO: 2345642 - RNA, 14 nt, Human
cacagggccccaga

SEQ ID NO: 2345643 - RNA, 23 nt, Human
cacagggcaugccccggccaccu

SEQ ID NO: 2345644 - RNA, 20 nt, Human
cacagggcaugccccggcca

SEQ ID NO: 2345645 - RNA, 21 nt, Human
cacagggccuuuggcaggugc

SEQ ID NO: 2345646 - RNA, 15 nt, Human
cacagcuaccucuuc

SEQ ID NO: 2345647 - RNA, 20 nt, Human
cacagcuaacacacagcucc

SEQ ID NO: 2345648 - RNA, 21 nt, Human
cacagcuaacacacagcuccc

SEQ ID NO: 2345649 - RNA, 19 nt, Human
cacagcguccuguccacac

SEQ ID NO: 2345650 - RNA, 20 nt, Human
cacagcuaacaauugugaag

SEQ ID NO: 2345651 - RNA, 21 nt, Human
cacagcuaacaauugugaagu

SEQ ID NO: 2345652 - RNA, 22 nt, Human
cacagcuaacauggaaguacua

SEQ ID NO: 2345653 - RNA, 22 nt, Human
cacagcuaugaaggcuguacac

SEQ ID NO: 2345654 - RNA, 12 nt, Human
cacagcuaugaa

SEQ ID NO: 2345655 - RNA, 17 nt, Human
cacagcucccaccccac

SEQ ID NO: 2345656 - RNA, 16 nt, Human
cacagcucccacccca

SEQ ID NO: 2345657 - RNA, 15 nt, Human
cacagcucccacccc

SEQ ID NO: 2345658 - RNA, 14 nt, Human
cacagcucccaccc

SEQ ID NO: 2345659 - RNA, 22 nt, Human
cacagcucccaccccacccccu

SEQ ID NO: 2345660 - RNA, 19 nt, Human
cacagcucccaccccaccc

SEQ ID NO: 2345661 - RNA, 20 nt, Human
cacagcucuguccugggagu

SEQ ID NO: 2345662 - RNA, 23 nt, Human
cacagcucuguccugggagugag

SEQ ID NO: 2345663 - RNA, 10 nt, Human
cacagcucuu

SEQ ID NO: 2345664 - RNA, 14 nt, Human
cacagcucuguguu

SEQ ID NO: 2345665 - RNA, 20 nt, Human
cacagcggggccccagggcu

SEQ ID NO: 2345666 - RNA, 21 nt, Human
cacagcggagguguggagccg

SEQ ID NO: 2345667 - RNA, 14 nt, Human
cacagcggccccug

SEQ ID NO: 2345668 - RNA, 16 nt, Human
cacagcggccccugca

SEQ ID NO: 2345669 - RNA, 15 nt, Human
cacagcuaacaugga

SEQ ID NO: 2345670 - RNA, 16 nt, Human
cacagcuaacauggaa

SEQ ID NO: 2345671 - RNA, 19 nt, Human
cacagacccugcccugugg

SEQ ID NO: 2345672 - RNA, 20 nt, Human
cacagacccugcccuguggg

SEQ ID NO: 2345673 - RNA, 21 nt, Human
cacagacccugcccugugggc

SEQ ID NO: 2345674 - RNA, 19 nt, Human
cacagaaucauaugauucu

SEQ ID NO: 2345675 - RNA, 12 nt, Human
cacagacacaca

SEQ ID NO: 2345676 - RNA, 13 nt, Human
cacagacacacac

SEQ ID NO: 2345677 - RNA, 14 nt, Human
cacagacacacaca

SEQ ID NO: 2345678 - RNA, 17 nt, Human
cacagacacacacacgc

SEQ ID NO: 2345679 - RNA, 18 nt, Human
cacagacacacacacgca

SEQ ID NO: 2345680 - RNA, 20 nt, Human
cacagacacacacacgcacg

SEQ ID NO: 2345681 - RNA, 22 nt, Human
cacagacacacacacgcacgca

SEQ ID NO: 2345682 - RNA, 23 nt, Human
cacagaagccaggagcaaauguu

SEQ ID NO: 2345683 - RNA, 16 nt, Human
cacagaagccaggagc

SEQ ID NO: 2345684 - RNA, 18 nt, Human
cacagaagccaggagcaa

SEQ ID NO: 2345685 - RNA, 14 nt, Human
cacagaagccagga

SEQ ID NO: 2345686 - RNA, 16 nt, Human
cacaguauuacuucug

SEQ ID NO: 2345687 - RNA, 16 nt, Human
cacaguagucuugaug

SEQ ID NO: 2345688 - RNA, 14 nt, Human
cacaggucuuuccu

SEQ ID NO: 2345689 - RNA, 18 nt, Human
cacaguauuacuucugcu

SEQ ID NO: 2345690 - RNA, 19 nt, Human
cacaguauuacuucugcua

SEQ ID NO: 2345691 - RNA, 15 nt, Human
cacaggucuuuccua

SEQ ID NO: 2345692 - RNA, 13 nt, Human
cacaguagucuug

SEQ ID NO: 2345693 - RNA, 24 nt, Human
cacaucagcuccacuuucagugaa

SEQ ID NO: 2345694 - RNA, 12 nt, Human
cacaucccaggc

SEQ ID NO: 2345695 - RNA, 22 nt, Human
cacaucccaggcuucacccuga

SEQ ID NO: 2345696 - RNA, 22 nt, Human
cacaucagcacgauuucuguuu

SEQ ID NO: 2345697 - RNA, 19 nt, Human
cacauccuaugcaauauau

SEQ ID NO: 2345698 - RNA, 17 nt, Human
cacauccuguguuucua

SEQ ID NO: 2345699 - RNA, 18 nt, Human
cacauccuccguccagcc

SEQ ID NO: 2345700 - RNA, 14 nt, Human
cacauccuccgucc

SEQ ID NO: 2345701 - RNA, 22 nt, Human
cacauccuccacguucugcuca

SEQ ID NO: 2345702 - RNA, 15 nt, Human
cacauccuuucuaaa

SEQ ID NO: 2345703 - RNA, 14 nt, Human
cacaucuaagccug

SEQ ID NO: 2345704 - RNA, 13 nt, Human
cacaucuaagccu

SEQ ID NO: 2345705 - RNA, 17 nt, Human
cacaucuaaccucaucu

SEQ ID NO: 2345706 - RNA, 16 nt, Human
cacaucuugcucugcu

SEQ ID NO: 2345707 - RNA, 17 nt, Human
cacaucuugcucugcug

SEQ ID NO: 2345708 - RNA, 21 nt, Human
cacaucagcacgauuucuguu

SEQ ID NO: 2345709 - RNA, 20 nt, Human
cacaucagcacgauuucugu

SEQ ID NO: 2345710 - RNA, 14 nt, Human
cacauuuuucagau

SEQ ID NO: 2345711 - RNA, 22 nt, Human
cacauuuuguauaauuguaucg

SEQ ID NO: 2345712 - RNA, 12 nt, Human
cacauuuuguau

SEQ ID NO: 2345713 - RNA, 13 nt, Human
cacauuuuguaua

SEQ ID NO: 2345714 - RNA, 15 nt, Human
cacauuuuguauaau

SEQ ID NO: 2345715 - RNA, 16 nt, Human
cacauuuuguauaauu

SEQ ID NO: 2345716 - RNA, 21 nt, Human
cacauuuuguauaauuguauc

SEQ ID NO: 2345717 - RNA, 18 nt, Human
cacauuuuccuuuucaaa

SEQ ID NO: 2345718 - RNA, 15 nt, Human
cacauuuuauuuuau

SEQ ID NO: 2345719 - RNA, 17 nt, Human
cacauuugauucugugu

SEQ ID NO: 2345720 - RNA, 16 nt, Human
cacauuuggaauacuu

SEQ ID NO: 2345721 - RNA, 19 nt, Human
cacauuuggaauacuuuuu

SEQ ID NO: 2345722 - RNA, 17 nt, Human
cacauuuggaauacuuu

SEQ ID NO: 2345723 - RNA, 18 nt, Human
cacauuuccccagaccug

SEQ ID NO: 2345724 - RNA, 17 nt, Human
cacaucuaagccugaag

SEQ ID NO: 2345725 - RNA, 19 nt, Human
cacaucuugcucugcugac

SEQ ID NO: 2345726 - RNA, 18 nt, Human
cacaucuugcucugcuga

SEQ ID NO: 2345727 - RNA, 18 nt, Human
cacauuuuucagauauaa

SEQ ID NO: 2345728 - RNA, 17 nt, Human
caccaacauacucccau

SEQ ID NO: 2345729 - RNA, 20 nt, Human
caccaacauacucccaucug

SEQ ID NO: 2345730 - RNA, 21 nt, Human
caccaacauacucccaucugu

SEQ ID NO: 2345731 - RNA, 21 nt, Human
cacauuuuuuaaaugcaccug

SEQ ID NO: 2345732 - RNA, 17 nt, Human
cacauuuuuuaaaugca

SEQ ID NO: 2345733 - RNA, 14 nt, Human
cacauuuuucuuag

SEQ ID NO: 2345734 - RNA, 13 nt, Human
cacauuuuucuua

SEQ ID NO: 2345735 - RNA, 16 nt, Human
cacccagcccacuucu

SEQ ID NO: 2345736 - RNA, 17 nt, Human
cacccagcccacuucug

SEQ ID NO: 2345737 - RNA, 14 nt, Human
caccaggcugcuca

SEQ ID NO: 2345738 - RNA, 21 nt, Human
caccaggcugcucagggcugg

SEQ ID NO: 2345739 - RNA, 13 nt, Human
caccaggcuggcg

SEQ ID NO: 2345740 - RNA, 15 nt, Human
caccaggcuggcgca

SEQ ID NO: 2345741 - RNA, 16 nt, Human
caccaggcuggcgcag

SEQ ID NO: 2345742 - RNA, 17 nt, Human
caccaggcuggcgcagc

SEQ ID NO: 2345743 - RNA, 16 nt, Human
caccaggccguccucc

SEQ ID NO: 2345744 - RNA, 21 nt, Human
caccaggccguccucccgggc

SEQ ID NO: 2345745 - RNA, 13 nt, Human
caccagccaggcu

SEQ ID NO: 2345746 - RNA, 16 nt, Human
caccagcugccucuuc

SEQ ID NO: 2345747 - RNA, 17 nt, Human
caccagcugccucuucu

SEQ ID NO: 2345748 - RNA, 22 nt, Human
caccagcuguucugucccuugg

SEQ ID NO: 2345749 - RNA, 16 nt, Human
caccagcuucuccagg

SEQ ID NO: 2345750 - RNA, 17 nt, Human
caccagcuucuccaggc

SEQ ID NO: 2345751 - RNA, 12 nt, Human
caccagcugccu

SEQ ID NO: 2345752 - RNA, 17 nt, Human
caccagcuccucccuug

SEQ ID NO: 2345753 - RNA, 14 nt, Human
caccagcugccucu

SEQ ID NO: 2345754 - RNA, 15 nt, Human
caccagcugccucuu

SEQ ID NO: 2345755 - RNA, 22 nt, Human
caccaggccaccuccccagcau

SEQ ID NO: 2345756 - RNA, 15 nt, Human
caccaggccaccucc

SEQ ID NO: 2345757 - RNA, 19 nt, Human
caccaggccaccuccccag

SEQ ID NO: 2345758 - RNA, 17 nt, Human
caccaggaaccucuuca

SEQ ID NO: 2345759 - RNA, 19 nt, Human
caccagcuucuccaggcuc

SEQ ID NO: 2345760 - RNA, 13 nt, Human
caccaggccaccu

SEQ ID NO: 2345761 - RNA, 14 nt, Human
caccaggccaccuc

SEQ ID NO: 2345762 - RNA, 12 nt, Human
caccagcagccu

SEQ ID NO: 2345763 - RNA, 14 nt, Human
caccagcagccugg

SEQ ID NO: 2345764 - RNA, 14 nt, Human
caccaacaucccau

SEQ ID NO: 2345765 - RNA, 23 nt, Human
caccaacauacucccaucuguga

SEQ ID NO: 2345766 - RNA, 13 nt, Human
caccagccugcac

SEQ ID NO: 2345767 - RNA, 15 nt, Human
caccagcauuccuuu

SEQ ID NO: 2345768 - RNA, 22 nt, Human
caccagccuuucucccaggcca

SEQ ID NO: 2345769 - RNA, 20 nt, Human
caccagccuuucucccaggc

SEQ ID NO: 2345770 - RNA, 14 nt, Human
caccagccugcacu

SEQ ID NO: 2345771 - RNA, 14 nt, Human
caccagcauuccuu

SEQ ID NO: 2345772 - RNA, 19 nt, Human
caccagcguuugaggggcu

SEQ ID NO: 2345773 - RNA, 21 nt, Human
caccagcguuugaggggcugg

SEQ ID NO: 2345774 - RNA, 12 nt, Human
caccagcuccuc

SEQ ID NO: 2345775 - RNA, 15 nt, Human
caccagcuccucccu

SEQ ID NO: 2345776 - RNA, 15 nt, Human
caccagcagccugga

SEQ ID NO: 2345777 - RNA, 21 nt, Human
caccagcccuuagcagggaaa

SEQ ID NO: 2345778 - RNA, 11 nt, Human
cacccaggagg

SEQ ID NO: 2345779 - RNA, 15 nt, Human
cacccagcccauucu

SEQ ID NO: 2345780 - RNA, 24 nt, Human
cacccaggagccccgaggccuucu

SEQ ID NO: 2345781 - RNA, 13 nt, Human
cacccagcccauu

SEQ ID NO: 2345782 - RNA, 12 nt, Human
cacccagcccau

SEQ ID NO: 2345783 - RNA, 23 nt, Human
caccaggcuggcgcagccaaggc

SEQ ID NO: 2345784 - RNA, 18 nt, Human
caccaggcuggcgcagcc

SEQ ID NO: 2345785 - RNA, 19 nt, Human
caccaggcuggcgcagcca

SEQ ID NO: 2345786 - RNA, 20 nt, Human
caccaggcuggcgcagccaa

SEQ ID NO: 2345787 - RNA, 22 nt, Human
caccaggcuggcgcagccaagg

SEQ ID NO: 2345788 - RNA, 19 nt, Human
cacccagcccacuucugcc

SEQ ID NO: 2345789 - RNA, 20 nt, Human
cacccaggagccccgaggcc

SEQ ID NO: 2345790 - RNA, 23 nt, Human
cacccaggagccccgaggccuuc

SEQ ID NO: 2345791 - RNA, 12 nt, Human
caauuuaaagca

SEQ ID NO: 2345792 - RNA, 20 nt, Human
caauuuaaacccauuuuagu

SEQ ID NO: 2345793 - RNA, 22 nt, Human
caauuuaaacccauuuuaguca

SEQ ID NO: 2345794 - RNA, 16 nt, Human
cacaagacugcacauc

SEQ ID NO: 2345795 - RNA, 22 nt, Human
cacaagauucccagagacagga

SEQ ID NO: 2345796 - RNA, 22 nt, Human
cacaagcaaaaaaaaaaaaaag

SEQ ID NO: 2345797 - RNA, 19 nt, Human
cacaagauucccagagaca

SEQ ID NO: 2345798 - RNA, 18 nt, Human
cacaagauucccagagac

SEQ ID NO: 2345799 - RNA, 17 nt, Human
cacaagauucccagaga

SEQ ID NO: 2345800 - RNA, 16 nt, Human
cacaagauucccagag

SEQ ID NO: 2345801 - RNA, 15 nt, Human
cacaagauucccaga

SEQ ID NO: 2345802 - RNA, 22 nt, Human
caauuguuugggguugaaaauu

SEQ ID NO: 2345803 - RNA, 15 nt, Human
caauuuaaacccauu

SEQ ID NO: 2345804 - RNA, 16 nt, Human
caauuuaaacccauuu

SEQ ID NO: 2345805 - RNA, 18 nt, Human
caauuuaaacccauuuua

SEQ ID NO: 2345806 - RNA, 12 nt, Human
caauuuaaaaaa

SEQ ID NO: 2345807 - RNA, 14 nt, Human
cacaagacccuugu

SEQ ID NO: 2345808 - RNA, 16 nt, Human
cacaagacccuugugg

SEQ ID NO: 2345809 - RNA, 14 nt, Human
cacaagccuucggc

SEQ ID NO: 2345810 - RNA, 17 nt, Human
cacaagccacagaagcc

SEQ ID NO: 2345811 - RNA, 12 nt, Human
cacaagccacag

SEQ ID NO: 2345812 - RNA, 15 nt, Human
cacaagccacagaag

SEQ ID NO: 2345813 - RNA, 17 nt, Human
caauucuuacaaacaug

SEQ ID NO: 2345814 - RNA, 14 nt, Human
caauucuguuuuag

SEQ ID NO: 2345815 - RNA, 22 nt, Human
caauucuguuuuagguuaaaaa

SEQ ID NO: 2345816 - RNA, 18 nt, Human
caauucuuacaaacaugu

SEQ ID NO: 2345817 - RNA, 19 nt, Human
caauucuuacaaacaugug

SEQ ID NO: 2345818 - RNA, 17 nt, Human
caauucucuuuaguucu

SEQ ID NO: 2345819 - RNA, 19 nt, Human
caauucuccugccucagcc

SEQ ID NO: 2345820 - RNA, 14 nt, Human
caauuguugacagu

SEQ ID NO: 2345821 - RNA, 21 nt, Human
caauuguugacaguucugaag

SEQ ID NO: 2345822 - RNA, 23 nt, Human
caauuguugacaguucugaagaa

SEQ ID NO: 2345823 - RNA, 24 nt, Human
caauuguugacaguucugaagaau

SEQ ID NO: 2345824 - RNA, 17 nt, Human
caauucuucccuaucuu

SEQ ID NO: 2345825 - RNA, 21 nt, Human
caaugcuuugccccugagaca

SEQ ID NO: 2345826 - RNA, 22 nt, Human
caaugcugugcccuaaagugua

SEQ ID NO: 2345827 - RNA, 16 nt, Human
caauucuccugccuca

SEQ ID NO: 2345828 - RNA, 17 nt, Human
caauucuccugccucag

SEQ ID NO: 2345829 - RNA, 13 nt, Human
caauggaaacuga

SEQ ID NO: 2345830 - RNA, 15 nt, Human
caauggaaacugaau

SEQ ID NO: 2345831 - RNA, 16 nt, Human
caauggaaacugaaug

SEQ ID NO: 2345832 - RNA, 17 nt, Human
caauggaaacugaaugc

SEQ ID NO: 2345833 - RNA, 14 nt, Human
caauggaaccuccu

SEQ ID NO: 2345834 - RNA, 16 nt, Human
caauggaaccuccuuu

SEQ ID NO: 2345835 - RNA, 17 nt, Human
caauggaaccuccuuuc

SEQ ID NO: 2345836 - RNA, 19 nt, Human
caauauuuauuauuuucac

SEQ ID NO: 2345837 - RNA, 12 nt, Human
caauauuucaga

SEQ ID NO: 2345838 - RNA, 20 nt, Human
caauauuucagauaaucaca

SEQ ID NO: 2345839 - RNA, 21 nt, Human
caauauuucagauaaucacaa

SEQ ID NO: 2345840 - RNA, 22 nt, Human
caaugcuggcuguuggcugggg

SEQ ID NO: 2345841 - RNA, 23 nt, Human
caaugcuggcuguuggcuggggg

SEQ ID NO: 2345842 - RNA, 14 nt, Human
caaugcuguauuuu

SEQ ID NO: 2345843 - RNA, 23 nt, Human
caaugcuguauuuuaaaagaaug

SEQ ID NO: 2345844 - RNA, 16 nt, Human
caauaaaaauggcuca

SEQ ID NO: 2345845 - RNA, 14 nt, Human
caauaaaaaucaua

SEQ ID NO: 2345846 - RNA, 13 nt, Human
caauaaaaauguu

SEQ ID NO: 2345847 - RNA, 17 nt, Human
caauaaaaauggcucag

SEQ ID NO: 2345848 - RNA, 22 nt, Human
caauaaaaauggcucagaugcc

SEQ ID NO: 2345849 - RNA, 22 nt, Human
caauaaaauuuuuuuucauguu

SEQ ID NO: 2345850 - RNA, 19 nt, Human
caauaaacgauuuaauucu

SEQ ID NO: 2345851 - RNA, 21 nt, Human
caauaaacgauuuaauucucu

SEQ ID NO: 2345852 - RNA, 12 nt, Human
caauaaacgauu

SEQ ID NO: 2345853 - RNA, 16 nt, Human
caauaaacgauuuaau

SEQ ID NO: 2345854 - RNA, 17 nt, Human
caauaaacgauuuaauu

SEQ ID NO: 2345855 - RNA, 18 nt, Human
caauaaacgauuuaauuc

SEQ ID NO: 2345856 - RNA, 17 nt, Human
caauaaaccucuuuucu

SEQ ID NO: 2345857 - RNA, 19 nt, Human
caauaaaauuuuuuuucau

SEQ ID NO: 2345858 - RNA, 23 nt, Human
caauaaaccagguuuagacagua

SEQ ID NO: 2345859 - RNA, 18 nt, Human
caauaaaauuuuuuuuca

SEQ ID NO: 2345860 - RNA, 13 nt, Human
caauaaaccaggu

SEQ ID NO: 2345861 - RNA, 22 nt, Human
caauaaagaguuagaaugaaaa

SEQ ID NO: 2345862 - RNA, 13 nt, Human
caauaaagaagag

SEQ ID NO: 2345863 - RNA, 12 nt, Human
caauaaagagau

SEQ ID NO: 2345864 - RNA, 20 nt, Human
caaguuguggugcugacaaa

SEQ ID NO: 2345865 - RNA, 21 nt, Human
caaguuguggugcugacaaag

SEQ ID NO: 2345866 - RNA, 13 nt, Human
caaguuuugugua

SEQ ID NO: 2345867 - RNA, 15 nt, Human
caaguugcuaauaca

SEQ ID NO: 2345868 - RNA, 17 nt, Human
caaguugugcuuguuua

SEQ ID NO: 2345869 - RNA, 17 nt, Human
caaguuguggugcugac

SEQ ID NO: 2345870 - RNA, 13 nt, Human
caaguugugcuug

SEQ ID NO: 2345871 - RNA, 15 nt, Human
caaguugaauugagg

SEQ ID NO: 2345872 - RNA, 21 nt, Human
caaguucuagagaagaggcug

SEQ ID NO: 2345873 - RNA, 23 nt, Human
caaguucuagagaagaggcuggu

SEQ ID NO: 2345874 - RNA, 13 nt, Human
caaguucuagaga

SEQ ID NO: 2345875 - RNA, 16 nt, Human
caaguucuagagaaga

SEQ ID NO: 2345876 - RNA, 18 nt, Human
caaguucuagagaagagg

SEQ ID NO: 2345877 - RNA, 19 nt, Human
caaguucuagagaagaggc

SEQ ID NO: 2345878 - RNA, 17 nt, Human
caaguauguuuuagcau

SEQ ID NO: 2345879 - RNA, 22 nt, Human
caaguaugugggcagauuuuca

SEQ ID NO: 2345880 - RNA, 20 nt, Human
caaguauuagggguaauaua

SEQ ID NO: 2345881 - RNA, 23 nt, Human
caaguauuagggguaauauauug

SEQ ID NO: 2345882 - RNA, 20 nt, Human
caaguauuagaauaccacag

SEQ ID NO: 2345883 - RNA, 14 nt, Human
caaguauuagaaua

SEQ ID NO: 2345884 - RNA, 14 nt, Human
caaguacugcugua

SEQ ID NO: 2345885 - RNA, 13 nt, Human
caaguacugcugu

SEQ ID NO: 2345886 - RNA, 20 nt, Human
caaguacauggcuagcuuuu

SEQ ID NO: 2345887 - RNA, 16 nt, Human
caaguacugcuguaaa

SEQ ID NO: 2345888 - RNA, 23 nt, Human
caaguaauugugaaaaaguuaaa

SEQ ID NO: 2345889 - RNA, 11 nt, Human
caaguaauugu

SEQ ID NO: 2345890 - RNA, 23 nt, Human
caagauucccagagacaggaaaa

SEQ ID NO: 2345891 - RNA, 19 nt, Human
caagauucccagagacagg

SEQ ID NO: 2345892 - RNA, 18 nt, Human
caagauucccagagacag

SEQ ID NO: 2345893 - RNA, 17 nt, Human
caagauucccagagaca

SEQ ID NO: 2345894 - RNA, 16 nt, Human
caagauucccagagac

SEQ ID NO: 2345895 - RNA, 15 nt, Human
caagauucccagaga

SEQ ID NO: 2345896 - RNA, 14 nt, Human
caagauucccagag

SEQ ID NO: 2345897 - RNA, 13 nt, Human
caagauucccaga

SEQ ID NO: 2345898 - RNA, 18 nt, Human
caagauucacaccugacu

SEQ ID NO: 2345899 - RNA, 19 nt, Human
caagauucacaccugacuc

SEQ ID NO: 2345900 - RNA, 12 nt, Human
caagauuagaag

SEQ ID NO: 2345901 - RNA, 17 nt, Human
caagauucacaccugac

SEQ ID NO: 2345902 - RNA, 20 nt, Human
caagauuagaagcugaaaac

SEQ ID NO: 2345903 - RNA, 22 nt, Human
caaguaauccaccugccucggc

SEQ ID NO: 2345904 - RNA, 16 nt, Human
caaguaauucugcugu

SEQ ID NO: 2345905 - RNA, 23 nt, Human
caaguaauucugcugucucagcc

SEQ ID NO: 2345906 - RNA, 20 nt, Human
caacaauuucuacuuugaag

SEQ ID NO: 2345907 - RNA, 19 nt, Human
caacaauuucuacuuugaa

SEQ ID NO: 2345908 - RNA, 18 nt, Human
caacaauuucuacuuuga

SEQ ID NO: 2345909 - RNA, 13 nt, Human
caacaauuucuac

SEQ ID NO: 2345910 - RNA, 18 nt, Human
caacaauuuaugaauuga

SEQ ID NO: 2345911 - RNA, 17 nt, Human
caacaauuuaugaauug

SEQ ID NO: 2345912 - RNA, 16 nt, Human
caacaauuuaugaauu

SEQ ID NO: 2345913 - RNA, 14 nt, Human
caacaauuuaugaa

SEQ ID NO: 2345914 - RNA, 13 nt, Human
caaauuuuggcca

SEQ ID NO: 2345915 - RNA, 15 nt, Human
caaauuuuggccaaa

SEQ ID NO: 2345916 - RNA, 16 nt, Human
caacaaaaagcuuccc

SEQ ID NO: 2345917 - RNA, 17 nt, Human
caacaaaaagcuucccc

SEQ ID NO: 2345918 - RNA, 23 nt, Human
caacaaaccuguuucugcagcca

SEQ ID NO: 2345919 - RNA, 13 nt, Human
caaaucuauucag

SEQ ID NO: 2345920 - RNA, 14 nt, Human
caaaucuauucaga

SEQ ID NO: 2345921 - RNA, 19 nt, Human
caaaucguccagcgaccuu

SEQ ID NO: 2345922 - RNA, 21 nt, Human
caaaucguccagcgaccuucc

SEQ ID NO: 2345923 - RNA, 21 nt, Human
caaaucugcuuuuuaaagaau

SEQ ID NO: 2345924 - RNA, 16 nt, Human
caaaucuauucagaca

SEQ ID NO: 2345925 - RNA, 20 nt, Human
caaaucuauucagacaagca

SEQ ID NO: 2345926 - RNA, 22 nt, Human
caaaucuauucagacaagcaac

SEQ ID NO: 2345927 - RNA, 22 nt, Human
caaaugagggucuugguuccag

SEQ ID NO: 2345928 - RNA, 13 nt, Human
caaaugcagcuuu

SEQ ID NO: 2345929 - RNA, 19 nt, Human
caaaugcagggauugcugc

SEQ ID NO: 2345930 - RNA, 20 nt, Human
caaaugcagggauugcugcc

SEQ ID NO: 2345931 - RNA, 22 nt, Human
caaaugcagggauugcugccac

SEQ ID NO: 2345932 - RNA, 21 nt, Human
caaauuuugaugccaagaaag

SEQ ID NO: 2345933 - RNA, 23 nt, Human
caaaugcagggauugcugccacu

SEQ ID NO: 2345934 - RNA, 21 nt, Human
caaaguaaaacuugcugccug

SEQ ID NO: 2345935 - RNA, 14 nt, Human
caaagaugcagccg

SEQ ID NO: 2345936 - RNA, 13 nt, Human
caaagaugcagcc

SEQ ID NO: 2345937 - RNA, 21 nt, Human
caaagaucuguccucagccuu

SEQ ID NO: 2345938 - RNA, 20 nt, Human
caaagaucuguccucagccu

SEQ ID NO: 2345939 - RNA, 12 nt, Human
caaagaucacuu

SEQ ID NO: 2345940 - RNA, 15 nt, Human
caaagaucacuuguu

SEQ ID NO: 2345941 - RNA, 20 nt, Human
caaaguacacuguuucaaac

SEQ ID NO: 2345942 - RNA, 16 nt, Human
caaaguacacuguuuc

SEQ ID NO: 2345943 - RNA, 21 nt, Human
caaaguacacuguuucaaacu

SEQ ID NO: 2345944 - RNA, 17 nt, Human
caaaucagcugcuacua

SEQ ID NO: 2345945 - RNA, 16 nt, Human
caaagucaagccacau

SEQ ID NO: 2345946 - RNA, 22 nt, Human
caaaguauuuuuuuaucuuggg

SEQ ID NO: 2345947 - RNA, 23 nt, Human
caaaguauuuuuuuaucuuggga

SEQ ID NO: 2345948 - RNA, 22 nt, Human
caaauccagccugcugccugcu

SEQ ID NO: 2345949 - RNA, 13 nt, Human
caaaucagucagu

SEQ ID NO: 2345950 - RNA, 23 nt, Human
caaaucagucagugcaaauguca

SEQ ID NO: 2345951 - RNA, 14 nt, Human
caaaucaguuacua

SEQ ID NO: 2345952 - RNA, 20 nt, Human
caaaucaguuacuaagaaga

SEQ ID NO: 2345953 - RNA, 21 nt, Human
caaaucaguuacuaagaagaa

SEQ ID NO: 2345954 - RNA, 22 nt, Human
caaaucaguuacuaagaagaaa

SEQ ID NO: 2345955 - RNA, 13 nt, Human
caaaucauagcug

SEQ ID NO: 2345956 - RNA, 20 nt, Human
caaauccuugugggaaaaga

SEQ ID NO: 2345957 - RNA, 15 nt, Human
caacacgagcaggcu

SEQ ID NO: 2345958 - RNA, 20 nt, Human
caacaccuuguuucccucuc

SEQ ID NO: 2345959 - RNA, 22 nt, Human
caacaccucugcacaagcugca

SEQ ID NO: 2345960 - RNA, 17 nt, Human
caacacaagcuggaagc

SEQ ID NO: 2345961 - RNA, 17 nt, Human
caaccaccgcuccccag

SEQ ID NO: 2345962 - RNA, 19 nt, Human
caaccaccgcuccccagcc

SEQ ID NO: 2345963 - RNA, 21 nt, Human
caaccaccgcuccccagccca

SEQ ID NO: 2345964 - RNA, 20 nt, Human
caaccaccgcuccccagccc

SEQ ID NO: 2345965 - RNA, 16 nt, Human
caaccaccuuucagau

SEQ ID NO: 2345966 - RNA, 18 nt, Human
caaccacugcgaccacaa

SEQ ID NO: 2345967 - RNA, 23 nt, Human
caagaauuucuugguaagaagcc

SEQ ID NO: 2345968 - RNA, 22 nt, Human
caagaauuucuugguaagaagc

SEQ ID NO: 2345969 - RNA, 22 nt, Human
caagaauuugaucguuccaguu

SEQ ID NO: 2345970 - RNA, 13 nt, Human
caagacacaguga

SEQ ID NO: 2345971 - RNA, 21 nt, Human
caagacagaugccccagagcu

SEQ ID NO: 2345972 - RNA, 16 nt, Human
caagacagaugcccca

SEQ ID NO: 2345973 - RNA, 22 nt, Human
caagacagaugccccagagcug

SEQ ID NO: 2345974 - RNA, 18 nt, Human
caagacagaagcugaagu

SEQ ID NO: 2345975 - RNA, 13 nt, Human
caagacagaugcc

SEQ ID NO: 2345976 - RNA, 13 nt, Human
caagacacugugg

SEQ ID NO: 2345977 - RNA, 17 nt, Human
caagacagaagcugaag

SEQ ID NO: 2345978 - RNA, 15 nt, Human
caagacacaucccua

SEQ ID NO: 2345979 - RNA, 14 nt, Human
caagauuaaaugua

SEQ ID NO: 2345980 - RNA, 22 nt, Human
caagacccuuguggucccaccc

SEQ ID NO: 2345981 - RNA, 18 nt, Human
caagacccuugugguccc

SEQ ID NO: 2345982 - RNA, 19 nt, Human
caagacccuugugguccca

SEQ ID NO: 2345983 - RNA, 16 nt, Human
caacucaccccagccc

SEQ ID NO: 2345984 - RNA, 13 nt, Human
caacucaccccag

SEQ ID NO: 2345985 - RNA, 15 nt, Human
caacucaccccagcc

SEQ ID NO: 2345986 - RNA, 19 nt, Human
caagaagucaaaguaaaac

SEQ ID NO: 2345987 - RNA, 23 nt, Human
caagaaggguuuuccacccugga

SEQ ID NO: 2345988 - RNA, 14 nt, Human
caagaagugauuag

SEQ ID NO: 2345989 - RNA, 22 nt, Human
caacuaugauaugguaaaaguu

SEQ ID NO: 2345990 - RNA, 23 nt, Human
caagaagggcuagaaccuggagg

SEQ ID NO: 2345991 - RNA, 22 nt, Human
caagaaggguuuuccacccugg

SEQ ID NO: 2345992 - RNA, 15 nt, Human
caagaaguuuaagga

SEQ ID NO: 2345993 - RNA, 17 nt, Human
caagaauaaucacgcuu

SEQ ID NO: 2345994 - RNA, 18 nt, Human
caagaauaaucacgcuuu

SEQ ID NO: 2345995 - RNA, 19 nt, Human
caaccacuguaaaaugaaa

SEQ ID NO: 2345996 - RNA, 22 nt, Human
caaccauuccagacugcuucca

SEQ ID NO: 2345997 - RNA, 16 nt, Human
caaccauuccagacug

SEQ ID NO: 2345998 - RNA, 14 nt, Human
caaccauuccagac

SEQ ID NO: 2345999 - RNA, 13 nt, Human
caaccauuccaga

SEQ ID NO: 2346000 - RNA, 21 nt, Human
caaccacuguaaaaugaaauu

SEQ ID NO: 2346001 - RNA, 17 nt, Human
caaccacuguaaaauga

SEQ ID NO: 2346002 - RNA, 14 nt, Human
caaccacuguaaaa

SEQ ID NO: 2346003 - RNA, 23 nt, Human
caaccacuggucuguagggauuu

SEQ ID NO: 2346004 - RNA, 22 nt, Human
caaccaccgcuccccagcccag

SEQ ID NO: 2346005 - RNA, 21 nt, Human
caaccacuaagaauucaaacu

SEQ ID NO: 2346006 - RNA, 14 nt, Human
caaccacuggucug

SEQ ID NO: 2346007 - RNA, 22 nt, Human
caaccacuggucuguagggauu

SEQ ID NO: 2346008 - RNA, 14 nt, Human
caaccauuccccau

SEQ ID NO: 2346009 - RNA, 19 nt, Human
caacccaaauguucaucaa

SEQ ID NO: 2346010 - RNA, 15 nt, Human
caacccaaggacuga

SEQ ID NO: 2346011 - RNA, 11 nt, Human
caacccagccg

SEQ ID NO: 2346012 - RNA, 19 nt, Human
caacccaaggacugaggga

SEQ ID NO: 2346013 - RNA, 22 nt, Human
caacccaaggacugagggacuc

SEQ ID NO: 2346014 - RNA, 14 nt, Human
caacccagccgcug

SEQ ID NO: 2346015 - RNA, 16 nt, Human
caacccagccgcugcc

SEQ ID NO: 2346016 - RNA, 17 nt, Human
caacccagccgcugccc

SEQ ID NO: 2346017 - RNA, 18 nt, Human
caacccagccgcugcccg

SEQ ID NO: 2346018 - RNA, 22 nt, Human
caacccaugaugagcuccucuu

SEQ ID NO: 2346019 - RNA, 22 nt, Human
caacccaggagcauccaccucc

SEQ ID NO: 2346020 - RNA, 15 nt, Human
caacccauuagccau

SEQ ID NO: 2346021 - RNA, 12 nt, Human
caaccccagccg

SEQ ID NO: 2346022 - RNA, 15 nt, Human
caaccccaacuccag

SEQ ID NO: 2346023 - RNA, 15 nt, Human
caacccccagccugc

SEQ ID NO: 2346024 - RNA, 16 nt, Human
caacccccagccugcu

SEQ ID NO: 2346025 - RNA, 17 nt, Human
caacccccagccugcua

SEQ ID NO: 2346026 - RNA, 18 nt, Human
caacuaugauuuggaaaa

SEQ ID NO: 2346027 - RNA, 19 nt, Human
caacuaugauuuggaaaau

SEQ ID NO: 2346028 - RNA, 22 nt, Human
caacuaugauuuggaaaauaaa

SEQ ID NO: 2346029 - RNA, 20 nt, Human
caacuauuuuuccaaaauaa

SEQ ID NO: 2346030 - RNA, 17 nt, Human
caacuaugauuuggaaa

SEQ ID NO: 2346031 - RNA, 23 nt, Human
caaccccacacgcuccucccucu

SEQ ID NO: 2346032 - RNA, 14 nt, Human
caaccccagccgcu

SEQ ID NO: 2346033 - RNA, 21 nt, Human
caacuaucucauuuccaagca

SEQ ID NO: 2346034 - RNA, 21 nt, Human
auuuuuacuagaacacagaaa

SEQ ID NO: 2346035 - RNA, 17 nt, Human
auuuuuuuuuccuagcc

SEQ ID NO: 2346036 - RNA, 19 nt, Human
auuuuuaccguuucuuccc

SEQ ID NO: 2346037 - RNA, 19 nt, Human
caaaaaaaaaaaaaugcac

SEQ ID NO: 2346038 - RNA, 17 nt, Human
auuuuuuuuuccuucag

SEQ ID NO: 2346039 - RNA, 13 nt, Human
caaaaaaacacua

SEQ ID NO: 2346040 - RNA, 16 nt, Human
caaaaaaacacuaguu

SEQ ID NO: 2346041 - RNA, 22 nt, Human
caaaaaaaaaguuuuauuuuuc

SEQ ID NO: 2346042 - RNA, 16 nt, Human
caaaaaaaaaguuuua

SEQ ID NO: 2346043 - RNA, 17 nt, Human
caaaaaaaaaguuuuau

SEQ ID NO: 2346044 - RNA, 19 nt, Human
caaaaaaaaaguuuuauuu

SEQ ID NO: 2346045 - RNA, 20 nt, Human
caaaaaaaaaguuuuauuuu

SEQ ID NO: 2346046 - RNA, 12 nt, Human
caaaagcugcuc

SEQ ID NO: 2346047 - RNA, 22 nt, Human
caaaagcccauucauuccauuc

SEQ ID NO: 2346048 - RNA, 20 nt, Human
caaaagcccauucauuccau

SEQ ID NO: 2346049 - RNA, 13 nt, Human
caaaaaaauacug

SEQ ID NO: 2346050 - RNA, 15 nt, Human
caaaaaaauacugcc

SEQ ID NO: 2346051 - RNA, 23 nt, Human
caaaaaaauacugccagaugcug

SEQ ID NO: 2346052 - RNA, 18 nt, Human
caaaaaaauauauuuaau

SEQ ID NO: 2346053 - RNA, 19 nt, Human
auuuuuacaauaaauaauc

SEQ ID NO: 2346054 - RNA, 13 nt, Human
auuuuuacaauaa

SEQ ID NO: 2346055 - RNA, 14 nt, Human
auuuuuacaauaaa

SEQ ID NO: 2346056 - RNA, 16 nt, Human
auuuuuacauucugaa

SEQ ID NO: 2346057 - RNA, 13 nt, Human
auuuuuaagugcu

SEQ ID NO: 2346058 - RNA, 14 nt, Human
auuuuuaaggacuu

SEQ ID NO: 2346059 - RNA, 16 nt, Human
auuuuuaaucaugaaa

SEQ ID NO: 2346060 - RNA, 17 nt, Human
auuuuuaaucaugaaau

SEQ ID NO: 2346061 - RNA, 11 nt, Human
auuuuuaaugg

SEQ ID NO: 2346062 - RNA, 12 nt, Human
auuuuuaauggg

SEQ ID NO: 2346063 - RNA, 15 nt, Human
auuuuuaaugggggu

SEQ ID NO: 2346064 - RNA, 23 nt, Human
auuuuuaauggggguagcagcug

SEQ ID NO: 2346065 - RNA, 20 nt, Human
auuuuuaccuuuuuccuucc

SEQ ID NO: 2346066 - RNA, 17 nt, Human
auuuuuacauucugaau

SEQ ID NO: 2346067 - RNA, 12 nt, Human
auuuuuuuuucc

SEQ ID NO: 2346068 - RNA, 13 nt, Human
auuuuuuuuuccu

SEQ ID NO: 2346069 - RNA, 16 nt, Human
auuuuuuuuuccuuca

SEQ ID NO: 2346070 - RNA, 15 nt, Human
caaaccacacuggac

SEQ ID NO: 2346071 - RNA, 14 nt, Human
caaaagcugcucag

SEQ ID NO: 2346072 - RNA, 20 nt, Human
caaaagguucacuaaagcag

SEQ ID NO: 2346073 - RNA, 15 nt, Human
caaaagcugggcagg

SEQ ID NO: 2346074 - RNA, 13 nt, Human
caaaaguauuuuc

SEQ ID NO: 2346075 - RNA, 14 nt, Human
caaaaguauuuucc

SEQ ID NO: 2346076 - RNA, 15 nt, Human
caaaaguauuuuccu

SEQ ID NO: 2346077 - RNA, 16 nt, Human
caaaaguauuuuccug

SEQ ID NO: 2346078 - RNA, 17 nt, Human
caaaaguauuuuccugu

SEQ ID NO: 2346079 - RNA, 19 nt, Human
caaaaguauuuuccuguaa

SEQ ID NO: 2346080 - RNA, 14 nt, Human
caaaccacacugga

SEQ ID NO: 2346081 - RNA, 20 nt, Human
caaaaguggccucuuugucu

SEQ ID NO: 2346082 - RNA, 17 nt, Human
caaaccaaaucacugaa

SEQ ID NO: 2346083 - RNA, 20 nt, Human
caaaaguauuuuccuguaaa

SEQ ID NO: 2346084 - RNA, 19 nt, Human
caaaagucaaaaggugccu

SEQ ID NO: 2346085 - RNA, 18 nt, Human
caaaaguggccucuuugu

SEQ ID NO: 2346086 - RNA, 17 nt, Human
caaaaguggccucuuug

SEQ ID NO: 2346087 - RNA, 16 nt, Human
caaaaguggccucuuu

SEQ ID NO: 2346088 - RNA, 14 nt, Human
caaaaguggccucu

SEQ ID NO: 2346089 - RNA, 22 nt, Human
caaaccaccagaagcccagaau

SEQ ID NO: 2346090 - RNA, 20 nt, Human
caaaccaccagaagcccaga

SEQ ID NO: 2346091 - RNA, 16 nt, Human
caaaccaccagaagcc

SEQ ID NO: 2346092 - RNA, 15 nt, Human
caaaccaccagaagc

SEQ ID NO: 2346093 - RNA, 14 nt, Human
caaagaucaaaaua

SEQ ID NO: 2346094 - RNA, 15 nt, Human
caaagaucaaaauaa

SEQ ID NO: 2346095 - RNA, 16 nt, Human
caaagaucaaaauaaa

SEQ ID NO: 2346096 - RNA, 17 nt, Human
caaagaucaaaauaaaa

SEQ ID NO: 2346097 - RNA, 18 nt, Human
caaagaucaaaauaaaaa

SEQ ID NO: 2346098 - RNA, 20 nt, Human
caaagaucaaaauaaaaagu

SEQ ID NO: 2346099 - RNA, 23 nt, Human
auuuuauaaaucgcuuuugauaa

SEQ ID NO: 2346100 - RNA, 21 nt, Human
auuuuauaaaucgcuuuugau

SEQ ID NO: 2346101 - RNA, 20 nt, Human
auuuuauaaaucgcuuuuga

SEQ ID NO: 2346102 - RNA, 15 nt, Human
auuuuauacauuaac

SEQ ID NO: 2346103 - RNA, 23 nt, Human
auuuuauaugcuuacugauauau

SEQ ID NO: 2346104 - RNA, 12 nt, Human
auuuuauaauuu

SEQ ID NO: 2346105 - RNA, 15 nt, Human
auuuuauaugucaaa

SEQ ID NO: 2346106 - RNA, 16 nt, Human
auuuuauaugucaaag

SEQ ID NO: 2346107 - RNA, 18 nt, Human
auuuuauauuaaaauaag

SEQ ID NO: 2346108 - RNA, 20 nt, Human
auuuuauauuagaaguguua

SEQ ID NO: 2346109 - RNA, 19 nt, Human
auuuuauauuagaaguguu

SEQ ID NO: 2346110 - RNA, 16 nt, Human
auuuguuugaacugau

SEQ ID NO: 2346111 - RNA, 14 nt, Human
auuuguuugaacug

SEQ ID NO: 2346112 - RNA, 15 nt, Human
auuuuauaaaucgcu

SEQ ID NO: 2346113 - RNA, 17 nt, Human
auuuuauaaaucgcuuu

SEQ ID NO: 2346114 - RNA, 16 nt, Human
auuuuauaaaucgcuu

SEQ ID NO: 2346115 - RNA, 13 nt, Human
auuuguuugaacu

SEQ ID NO: 2346116 - RNA, 15 nt, Human
auuuuaucucuuauu

SEQ ID NO: 2346117 - RNA, 20 nt, Human
auuuuaucccucaccuguag

SEQ ID NO: 2346118 - RNA, 13 nt, Human
auuuuaucuguga

SEQ ID NO: 2346119 - RNA, 14 nt, Human
auuuuaucugugaa

SEQ ID NO: 2346120 - RNA, 15 nt, Human
auuuuaucugugaau

SEQ ID NO: 2346121 - RNA, 13 nt, Human
auuuuaucuuuga

SEQ ID NO: 2346122 - RNA, 15 nt, Human
auuuuaucuuugauu

SEQ ID NO: 2346123 - RNA, 20 nt, Human
auuuuaucuuugauucuccu

SEQ ID NO: 2346124 - RNA, 21 nt, Human
auuuuaucuuugauucuccuu

SEQ ID NO: 2346125 - RNA, 21 nt, Human
auuuucuuccaagcaaaggug

SEQ ID NO: 2346126 - RNA, 22 nt, Human
auuuuaucuuugauucuccuuc

SEQ ID NO: 2346127 - RNA, 23 nt, Human
auuuuaucuuugauucuccuuca

SEQ ID NO: 2346128 - RNA, 21 nt, Human
auuuucuucaugcaaugacau

SEQ ID NO: 2346129 - RNA, 13 nt, Human
auuuucuuuaaaa

SEQ ID NO: 2346130 - RNA, 19 nt, Human
auuuuaucuuucgcacagc

SEQ ID NO: 2346131 - RNA, 15 nt, Human
auuuucuuuaaugcu

SEQ ID NO: 2346132 - RNA, 12 nt, Human
auuuucuuuaau

SEQ ID NO: 2346133 - RNA, 15 nt, Human
auuuucuuuaaaaga

SEQ ID NO: 2346134 - RNA, 19 nt, Human
auuuucuuuaaaagaaugg

SEQ ID NO: 2346135 - RNA, 18 nt, Human
auuuugacacuauaucug

SEQ ID NO: 2346136 - RNA, 19 nt, Human
auuuugacacuauaucugu

SEQ ID NO: 2346137 - RNA, 13 nt, Human
auuuucuuuucuu

SEQ ID NO: 2346138 - RNA, 19 nt, Human
auuuucuuuuguaaauguu

SEQ ID NO: 2346139 - RNA, 18 nt, Human
auuuugaccuacucucau

SEQ ID NO: 2346140 - RNA, 17 nt, Human
auuuugaccuacucuca

SEQ ID NO: 2346141 - RNA, 22 nt, Human
auuuugagaaagucuuauuuau

SEQ ID NO: 2346142 - RNA, 17 nt, Human
auuuucuuuuguaaaug

SEQ ID NO: 2346143 - RNA, 16 nt, Human
auuuucuuuuguaaau

SEQ ID NO: 2346144 - RNA, 23 nt, Human
auuuucuuuguguagcuuugcuc

SEQ ID NO: 2346145 - RNA, 20 nt, Human
auuuucuuuucuuucaacuu

SEQ ID NO: 2346146 - RNA, 15 nt, Human
auuuucuuugaaauu

SEQ ID NO: 2346147 - RNA, 21 nt, Human
auuuucuuucucuacuuugag

SEQ ID NO: 2346148 - RNA, 16 nt, Human
auuuucuuucuguaac

SEQ ID NO: 2346149 - RNA, 19 nt, Human
auuuucuuuaaugcuuuua

SEQ ID NO: 2346150 - RNA, 18 nt, Human
auuuucuuuaaugcuuuu

SEQ ID NO: 2346151 - RNA, 14 nt, Human
auuuucuuucaaaa

SEQ ID NO: 2346152 - RNA, 18 nt, Human
auuuugauccaagcuggu

SEQ ID NO: 2346153 - RNA, 14 nt, Human
auuuugaggcuuuc

SEQ ID NO: 2346154 - RNA, 21 nt, Human
auuuugagcugaaaugcugca

SEQ ID NO: 2346155 - RNA, 21 nt, Human
auuuugaguaucucggaccuu

SEQ ID NO: 2346156 - RNA, 13 nt, Human
auuuugagugacu

SEQ ID NO: 2346157 - RNA, 14 nt, Human
auuuugagugacuc

SEQ ID NO: 2346158 - RNA, 23 nt, Human
auuuugagugacucgaggguugg

SEQ ID NO: 2346159 - RNA, 21 nt, Human
auuuuuaagcaaaauauuauu

SEQ ID NO: 2346160 - RNA, 20 nt, Human
auuuuuaagauaauaauaua

SEQ ID NO: 2346161 - RNA, 22 nt, Human
auuuuuaagauaauaauauaug

SEQ ID NO: 2346162 - RNA, 18 nt, Human
auuuuuaagauaauaaua

SEQ ID NO: 2346163 - RNA, 19 nt, Human
auuuuuaagauaauaauau

SEQ ID NO: 2346164 - RNA, 19 nt, Human
auuuuuaaauguaaaacau

SEQ ID NO: 2346165 - RNA, 17 nt, Human
auuuuuaaaguauauau

SEQ ID NO: 2346166 - RNA, 18 nt, Human
auuccucuuugcuuugcu

SEQ ID NO: 2346167 - RNA, 17 nt, Human
auuccucuuugcuuugc

SEQ ID NO: 2346168 - RNA, 16 nt, Human
auuccucuuugcuuug

SEQ ID NO: 2346169 - RNA, 15 nt, Human
auuccucuuugcuuu

SEQ ID NO: 2346170 - RNA, 14 nt, Human
auuccucuuugcuu

SEQ ID NO: 2346171 - RNA, 13 nt, Human
auuccucuuugcu

SEQ ID NO: 2346172 - RNA, 13 nt, Human
auuccugaaagaa

SEQ ID NO: 2346173 - RNA, 15 nt, Human
auuccugaagaacca

SEQ ID NO: 2346174 - RNA, 19 nt, Human
auuccugaaugaaauauca

SEQ ID NO: 2346175 - RNA, 17 nt, Human
auuccugaaugaaauau

SEQ ID NO: 2346176 - RNA, 11 nt, Human
auuccugaccc

SEQ ID NO: 2346177 - RNA, 12 nt, Human
auuccugaccca

SEQ ID NO: 2346178 - RNA, 19 nt, Human
auuccugaagaaccagucc

SEQ ID NO: 2346179 - RNA, 16 nt, Human
auuccugaagaaccag

SEQ ID NO: 2346180 - RNA, 21 nt, Human
auuccugacccaggccgcagc

SEQ ID NO: 2346181 - RNA, 22 nt, Human
auuccugacccaggccgcagcu

SEQ ID NO: 2346182 - RNA, 14 nt, Human
auuccugacccagg

SEQ ID NO: 2346183 - RNA, 15 nt, Human
auuccugacccaggc

SEQ ID NO: 2346184 - RNA, 16 nt, Human
auuccugacccaggcc

SEQ ID NO: 2346185 - RNA, 17 nt, Human
auuccugacccaggccg

SEQ ID NO: 2346186 - RNA, 13 nt, Human
auuccugcagccu

SEQ ID NO: 2346187 - RNA, 23 nt, Human
auuccugauaugauuuaaaacau

SEQ ID NO: 2346188 - RNA, 20 nt, Human
auuccugauaugauuuaaaa

SEQ ID NO: 2346189 - RNA, 22 nt, Human
auuccugauaugauuuaaaaca

SEQ ID NO: 2346190 - RNA, 16 nt, Human
auuccugauaugauuu

SEQ ID NO: 2346191 - RNA, 19 nt, Human
auuccugauaugauuuaaa

SEQ ID NO: 2346192 - RNA, 21 nt, Human
auuccugaugcuucuucagag

SEQ ID NO: 2346193 - RNA, 21 nt, Human
auucucuccuguaccucuuga

SEQ ID NO: 2346194 - RNA, 19 nt, Human
auucucuccuguaccucuu

SEQ ID NO: 2346195 - RNA, 15 nt, Human
auucucucuccuguc

SEQ ID NO: 2346196 - RNA, 12 nt, Human
auucucucuccu

SEQ ID NO: 2346197 - RNA, 15 nt, Human
auucucucuccugua

SEQ ID NO: 2346198 - RNA, 17 nt, Human
auucucucuccugucca

SEQ ID NO: 2346199 - RNA, 16 nt, Human
auucucucuccugucc

SEQ ID NO: 2346200 - RNA, 11 nt, Human
auucucugagc

SEQ ID NO: 2346201 - RNA, 10 nt, Human
auucucucuc

SEQ ID NO: 2346202 - RNA, 15 nt, Human
auuccugcagccugg

SEQ ID NO: 2346203 - RNA, 14 nt, Human
auuccugcagccug

SEQ ID NO: 2346204 - RNA, 16 nt, Human
auucucuccuguaccu

SEQ ID NO: 2346205 - RNA, 18 nt, Human
auucugacucgguuucuc

SEQ ID NO: 2346206 - RNA, 20 nt, Human
auucugacucgguuucucca

SEQ ID NO: 2346207 - RNA, 14 nt, Human
auucugagagcugu

SEQ ID NO: 2346208 - RNA, 13 nt, Human
auucugagagcug

SEQ ID NO: 2346209 - RNA, 15 nt, Human
auucugauuacacaa

SEQ ID NO: 2346210 - RNA, 13 nt, Human
auucugauuccac

SEQ ID NO: 2346211 - RNA, 14 nt, Human
auucugauuacaca

SEQ ID NO: 2346212 - RNA, 17 nt, Human
auucuugccaaauauaa

SEQ ID NO: 2346213 - RNA, 12 nt, Human
auucuuguauau

SEQ ID NO: 2346214 - RNA, 14 nt, Human
auucuugucaaaaa

SEQ ID NO: 2346215 - RNA, 19 nt, Human
auucuuugaccuguuggga

SEQ ID NO: 2346216 - RNA, 15 nt, Human
auucuuucugauaac

SEQ ID NO: 2346217 - RNA, 15 nt, Human
auucuuucuguauug

SEQ ID NO: 2346218 - RNA, 13 nt, Human
auucuuugauguu

SEQ ID NO: 2346219 - RNA, 14 nt, Human
auucuuugauguua

SEQ ID NO: 2346220 - RNA, 15 nt, Human
auucuuugauguuaa

SEQ ID NO: 2346221 - RNA, 21 nt, Human
auucuuggcccgcacagagcu

SEQ ID NO: 2346222 - RNA, 17 nt, Human
auucuugguuggcuggc

SEQ ID NO: 2346223 - RNA, 20 nt, Human
auucuugguuggcuggccuu

SEQ ID NO: 2346224 - RNA, 18 nt, Human
auucuugguugaggaaac

SEQ ID NO: 2346225 - RNA, 17 nt, Human
auucuugguugaggaaa

SEQ ID NO: 2346226 - RNA, 22 nt, Human
auucuuggcccgcacagagcug

SEQ ID NO: 2346227 - RNA, 17 nt, Human
auucuuuccugaggcug

SEQ ID NO: 2346228 - RNA, 22 nt, Human
auucuuuccugaggcugggcuc

SEQ ID NO: 2346229 - RNA, 15 nt, Human
auugaucaaauucau

SEQ ID NO: 2346230 - RNA, 17 nt, Human
auugaucaaauucauuu

SEQ ID NO: 2346231 - RNA, 18 nt, Human
auugaucauuuucccccc

SEQ ID NO: 2346232 - RNA, 16 nt, Human
auugauccagaaagaa

SEQ ID NO: 2346233 - RNA, 17 nt, Human
auugauccagaaagaaa

SEQ ID NO: 2346234 - RNA, 22 nt, Human
auugagagaauggaaaacagac

SEQ ID NO: 2346235 - RNA, 21 nt, Human
auugagaauuuuaaauuauaa

SEQ ID NO: 2346236 - RNA, 17 nt, Human
auugagaauuuuaaauu

SEQ ID NO: 2346237 - RNA, 20 nt, Human
auugagaguaacuuaaguua

SEQ ID NO: 2346238 - RNA, 14 nt, Human
auugagaguuuugu

SEQ ID NO: 2346239 - RNA, 19 nt, Human
auugagauuagagggaggu

SEQ ID NO: 2346240 - RNA, 16 nt, Human
auugagaguuuugucu

SEQ ID NO: 2346241 - RNA, 20 nt, Human
auugagaguuuugucuugaa

SEQ ID NO: 2346242 - RNA, 15 nt, Human
auugagcucucucau

SEQ ID NO: 2346243 - RNA, 13 nt, Human
auugagaauuuua

SEQ ID NO: 2346244 - RNA, 20 nt, Human
auugagaaguuuuguacaga

SEQ ID NO: 2346245 - RNA, 17 nt, Human
auugagaaggagagaaa

SEQ ID NO: 2346246 - RNA, 22 nt, Human
auugagaaagagcacuuaagag

SEQ ID NO: 2346247 - RNA, 14 nt, Human
auugagaaggagag

SEQ ID NO: 2346248 - RNA, 15 nt, Human
auugagaaggagaga

SEQ ID NO: 2346249 - RNA, 16 nt, Human
auugagaaggagagaa

SEQ ID NO: 2346250 - RNA, 18 nt, Human
auugagaacugcauaugu

SEQ ID NO: 2346251 - RNA, 14 nt, Human
auugagaacugcau

SEQ ID NO: 2346252 - RNA, 22 nt, Human
auugagaacugcauauguuucg

SEQ ID NO: 2346253 - RNA, 13 nt, Human
auugagaaggaga

SEQ ID NO: 2346254 - RNA, 16 nt, Human
auugagaaagaaacua

SEQ ID NO: 2346255 - RNA, 12 nt, Human
auugagaaagag

SEQ ID NO: 2346256 - RNA, 17 nt, Human
auugagaaagagcacuu

SEQ ID NO: 2346257 - RNA, 18 nt, Human
auugagaaagagcacuua

SEQ ID NO: 2346258 - RNA, 21 nt, Human
auugagaaagagcacuuaaga

SEQ ID NO: 2346259 - RNA, 17 nt, Human
auucaucucucuuuaau

SEQ ID NO: 2346260 - RNA, 17 nt, Human
auucaucccaacugucu

SEQ ID NO: 2346261 - RNA, 22 nt, Human
auucaucucucuuuaauauaaa

SEQ ID NO: 2346262 - RNA, 13 nt, Human
auucaugaacuuc

SEQ ID NO: 2346263 - RNA, 17 nt, Human
auucaugaacuucgcau

SEQ ID NO: 2346264 - RNA, 20 nt, Human
auucaucuguuuuucuuuuu

SEQ ID NO: 2346265 - RNA, 17 nt, Human
auucaucuuguguuuua

SEQ ID NO: 2346266 - RNA, 15 nt, Human
auucaucuuuuguau

SEQ ID NO: 2346267 - RNA, 18 nt, Human
auucauuuuaacaucuga

SEQ ID NO: 2346268 - RNA, 15 nt, Human
auucauuuccugccc

SEQ ID NO: 2346269 - RNA, 12 nt, Human
auucauuuccug

SEQ ID NO: 2346270 - RNA, 13 nt, Human
auucauuuccugc

SEQ ID NO: 2346271 - RNA, 14 nt, Human
auucauuuccugcc

SEQ ID NO: 2346272 - RNA, 22 nt, Human
auucauuucaaagggagagaga

SEQ ID NO: 2346273 - RNA, 21 nt, Human
auucaugcuacugccaaccug

SEQ ID NO: 2346274 - RNA, 14 nt, Human
auucaugccuggcu

SEQ ID NO: 2346275 - RNA, 13 nt, Human
auucaugccuggc

SEQ ID NO: 2346276 - RNA, 16 nt, Human
auucaugcuacugcca

SEQ ID NO: 2346277 - RNA, 12 nt, Human
auuccucuggga

SEQ ID NO: 2346278 - RNA, 20 nt, Human
auuccucuacuaacaaucag

SEQ ID NO: 2346279 - RNA, 13 nt, Human
auuccucugggaa

SEQ ID NO: 2346280 - RNA, 22 nt, Human
auuccucugggaauguuacauu

SEQ ID NO: 2346281 - RNA, 20 nt, Human
auuccaaagaguagaauugc

SEQ ID NO: 2346282 - RNA, 13 nt, Human
auucauuuuuaau

SEQ ID NO: 2346283 - RNA, 19 nt, Human
auucauuugaguuauuuua

SEQ ID NO: 2346284 - RNA, 21 nt, Human
auucauuuuaacaucugagaa

SEQ ID NO: 2346285 - RNA, 19 nt, Human
auucauauuuacuucuuau

SEQ ID NO: 2346286 - RNA, 18 nt, Human
auucauauuuacuucuua

SEQ ID NO: 2346287 - RNA, 20 nt, Human
auucauauuuacuucuuaua

SEQ ID NO: 2346288 - RNA, 16 nt, Human
auucauauuuucuuuc

SEQ ID NO: 2346289 - RNA, 16 nt, Human
auucaucccaacuguc

SEQ ID NO: 2346290 - RNA, 20 nt, Human
auucauauuuucuuucaaaa

SEQ ID NO: 2346291 - RNA, 19 nt, Human
auucaucaaauggaagaca

SEQ ID NO: 2346292 - RNA, 15 nt, Human
auuaaauuuaauuag

SEQ ID NO: 2346293 - RNA, 20 nt, Human
auuaaauuuugaguucuaca

SEQ ID NO: 2346294 - RNA, 15 nt, Human
auuauguguguuuua

SEQ ID NO: 2346295 - RNA, 20 nt, Human
auuauguguguuuuaaaaug

SEQ ID NO: 2346296 - RNA, 21 nt, Human
auuauguguguuuuaaaauga

SEQ ID NO: 2346297 - RNA, 18 nt, Human
auuaaauucuugcaaagu

SEQ ID NO: 2346298 - RNA, 14 nt, Human
auuaaauucuugca

SEQ ID NO: 2346299 - RNA, 20 nt, Human
auuaaauucuugcaaaguau

SEQ ID NO: 2346300 - RNA, 18 nt, Human
auuaaauuuugaguucua

SEQ ID NO: 2346301 - RNA, 19 nt, Human
auucaauuuauucaagaaa

SEQ ID NO: 2346302 - RNA, 22 nt, Human
auucaauuguaaauugaaucag

SEQ ID NO: 2346303 - RNA, 21 nt, Human
auucaauuguaaauugaauca

SEQ ID NO: 2346304 - RNA, 13 nt, Human
auucacaaacuuu

SEQ ID NO: 2346305 - RNA, 14 nt, Human
auucacaaacuuuu

SEQ ID NO: 2346306 - RNA, 22 nt, Human
auucacaaacuuuuauacucuu

SEQ ID NO: 2346307 - RNA, 18 nt, Human
auucacaagacccaaaag

SEQ ID NO: 2346308 - RNA, 11 nt, Human
auuauguuaaa

SEQ ID NO: 2346309 - RNA, 23 nt, Human
auucaacuaaaaaaaaaaaagua

SEQ ID NO: 2346310 - RNA, 14 nt, Human
auucaacucagacu

SEQ ID NO: 2346311 - RNA, 14 nt, Human
auucaacuaaaaaa

SEQ ID NO: 2346312 - RNA, 13 nt, Human
auucaacuaaaaa

SEQ ID NO: 2346313 - RNA, 15 nt, Human
auucaacccuggaga

SEQ ID NO: 2346314 - RNA, 16 nt, Human
auucaacccuggagag

SEQ ID NO: 2346315 - RNA, 19 nt, Human
auucaagaaaaguaagccc

SEQ ID NO: 2346316 - RNA, 22 nt, Human
auucaagaaaacaacuucaaua

SEQ ID NO: 2346317 - RNA, 17 nt, Human
auucacaaacuuuuaua

SEQ ID NO: 2346318 - RNA, 20 nt, Human
auuguaaaaccugucaauga

SEQ ID NO: 2346319 - RNA, 17 nt, Human
auuguaaaacugaggca

SEQ ID NO: 2346320 - RNA, 21 nt, Human
auuguaaaaccugucaaugau

SEQ ID NO: 2346321 - RNA, 18 nt, Human
auugaugggauuugguca

SEQ ID NO: 2346322 - RNA, 19 nt, Human
auugaucggagccuccucu

SEQ ID NO: 2346323 - RNA, 13 nt, Human
auuguaaaauggu

SEQ ID NO: 2346324 - RNA, 20 nt, Human
auugaucauuuuccccccac

SEQ ID NO: 2346325 - RNA, 19 nt, Human
auugaucauuuucccccca

SEQ ID NO: 2346326 - RNA, 21 nt, Human
auugaucauuuuccccccacu

SEQ ID NO: 2346327 - RNA, 23 nt, Human
auugaucggagccuccucucuca

SEQ ID NO: 2346328 - RNA, 22 nt, Human
auugauccagaaagaaaacuug

SEQ ID NO: 2346329 - RNA, 18 nt, Human
auugauccagaaagaaaa

SEQ ID NO: 2346330 - RNA, 19 nt, Human
auugauccagaaagaaaac

SEQ ID NO: 2346331 - RNA, 16 nt, Human
auuguaaggaaugauu

SEQ ID NO: 2346332 - RNA, 18 nt, Human
auuguaagcaugcacaaa

SEQ ID NO: 2346333 - RNA, 23 nt, Human
auuguaaauugaaucaguauaaa

SEQ ID NO: 2346334 - RNA, 17 nt, Human
auuguaaauugaaucag

SEQ ID NO: 2346335 - RNA, 16 nt, Human
auuguaaauugaauca

SEQ ID NO: 2346336 - RNA, 15 nt, Human
auuguaaggaaugau

SEQ ID NO: 2346337 - RNA, 17 nt, Human
auuguaaaugugcuuuu

SEQ ID NO: 2346338 - RNA, 15 nt, Human
auuguaaaauagcuu

SEQ ID NO: 2346339 - RNA, 19 nt, Human
auuguaaaauagcuuguau

SEQ ID NO: 2346340 - RNA, 21 nt, Human
auuguaaaauagcuuguauag

SEQ ID NO: 2346341 - RNA, 22 nt, Human
auuguaaaauagcuuguauagu

SEQ ID NO: 2346342 - RNA, 16 nt, Human
auuguaaauauguuuu

SEQ ID NO: 2346343 - RNA, 15 nt, Human
auuguaaaugugcuu

SEQ ID NO: 2346344 - RNA, 14 nt, Human
auuguaaaugugcu

SEQ ID NO: 2346345 - RNA, 19 nt, Human
auuguacacaccuuauauu

SEQ ID NO: 2346346 - RNA, 12 nt, Human
auuguacacuuu

SEQ ID NO: 2346347 - RNA, 14 nt, Human
auuguacacuuuuu

SEQ ID NO: 2346348 - RNA, 14 nt, Human
auuguacagcuguu

SEQ ID NO: 2346349 - RNA, 16 nt, Human
auuguacagcuguuua

SEQ ID NO: 2346350 - RNA, 17 nt, Human
auuguacagcuguuuaa

SEQ ID NO: 2346351 - RNA, 13 nt, Human
auuguacaguuuu

SEQ ID NO: 2346352 - RNA, 20 nt, Human
auuguacagcuguuuaagau

SEQ ID NO: 2346353 - RNA, 14 nt, Human
auuguacaguuugu

SEQ ID NO: 2346354 - RNA, 16 nt, Human
auuguacaguuuguuu

SEQ ID NO: 2346355 - RNA, 17 nt, Human
auuguacaguuuguuua

SEQ ID NO: 2346356 - RNA, 21 nt, Human
auuguaauaaugcuaaagaaa

SEQ ID NO: 2346357 - RNA, 22 nt, Human
auuguuccaagacauugucaau

SEQ ID NO: 2346358 - RNA, 21 nt, Human
auuguacaguuuguuuacaca

SEQ ID NO: 2346359 - RNA, 18 nt, Human
auuguacaguuuguuuac

SEQ ID NO: 2346360 - RNA, 19 nt, Human
auuguacaguuuguuuaca

SEQ ID NO: 2346361 - RNA, 19 nt, Human
auuguucccagugacacuu

SEQ ID NO: 2346362 - RNA, 16 nt, Human
auuguucccagugaca

SEQ ID NO: 2346363 - RNA, 24 nt, Human
auuguuccagcaguuuucaaguca

SEQ ID NO: 2346364 - RNA, 19 nt, Human
auuguucuuaguuugcagu

SEQ ID NO: 2346365 - RNA, 13 nt, Human
auuguuccuguca

SEQ ID NO: 2346366 - RNA, 21 nt, Human
auuguucccagugacacuuca

SEQ ID NO: 2346367 - RNA, 21 nt, Human
auuguuuaaguguuguaaaua

SEQ ID NO: 2346368 - RNA, 20 nt, Human
auuguuuaaagcaacugucu

SEQ ID NO: 2346369 - RNA, 22 nt, Human
auuguuuaaagcaacugucuau

SEQ ID NO: 2346370 - RNA, 16 nt, Human
auuguuuaaagcaacu

SEQ ID NO: 2346371 - RNA, 19 nt, Human
auuguuuaaaaucauuucu

SEQ ID NO: 2346372 - RNA, 18 nt, Human
auuguuuauuuaucagug

SEQ ID NO: 2346373 - RNA, 17 nt, Human
auuguuuauuuaucagu

SEQ ID NO: 2346374 - RNA, 15 nt, Human
auuguuuauuuauca

SEQ ID NO: 2346375 - RNA, 14 nt, Human
auuguuuauucuuu

SEQ ID NO: 2346376 - RNA, 21 nt, Human
auuguuuauuuaucagugaca

SEQ ID NO: 2346377 - RNA, 19 nt, Human
auuguuuauuuaucaguga

SEQ ID NO: 2346378 - RNA, 19 nt, Human
auuguuucaaaauaaaaac

SEQ ID NO: 2346379 - RNA, 17 nt, Human
auuuauacuguauauau

SEQ ID NO: 2346380 - RNA, 14 nt, Human
auuuauacaaauua

SEQ ID NO: 2346381 - RNA, 20 nt, Human
auuuauacucuuuuuucaug

SEQ ID NO: 2346382 - RNA, 14 nt, Human
auuuauacuauuua

SEQ ID NO: 2346383 - RNA, 12 nt, Human
auuuauaguuug

SEQ ID NO: 2346384 - RNA, 14 nt, Human
auuuauaguuugua

SEQ ID NO: 2346385 - RNA, 13 nt, Human
auuuauauuuuug

SEQ ID NO: 2346386 - RNA, 18 nt, Human
auuuauauuuuuauuuua

SEQ ID NO: 2346387 - RNA, 13 nt, Human
auuuauauuucac

SEQ ID NO: 2346388 - RNA, 19 nt, Human
auuuauauuuuuaaaauau

SEQ ID NO: 2346389 - RNA, 15 nt, Human
auuuaucagugacag

SEQ ID NO: 2346390 - RNA, 14 nt, Human
auuuaucagugaca

SEQ ID NO: 2346391 - RNA, 16 nt, Human
auuuaucacacuucug

SEQ ID NO: 2346392 - RNA, 12 nt, Human
auuuaucaaauc

SEQ ID NO: 2346393 - RNA, 13 nt, Human
auuuaucaaauca

SEQ ID NO: 2346394 - RNA, 14 nt, Human
auuuaucaaaucag

SEQ ID NO: 2346395 - RNA, 17 nt, Human
auuuaucaaaucaguca

SEQ ID NO: 2346396 - RNA, 17 nt, Human
auuuaucaaucaguaua

SEQ ID NO: 2346397 - RNA, 18 nt, Human
auuuaucaaucaguauaa

SEQ ID NO: 2346398 - RNA, 15 nt, Human
auuucaagaccuucu

SEQ ID NO: 2346399 - RNA, 15 nt, Human
auuucaagagauuua

SEQ ID NO: 2346400 - RNA, 17 nt, Human
auuuaucagugacagag

SEQ ID NO: 2346401 - RNA, 21 nt, Human
auuucaagacauuaaaucuau

SEQ ID NO: 2346402 - RNA, 18 nt, Human
auuuaucagugacagagu

SEQ ID NO: 2346403 - RNA, 19 nt, Human
auuucaagagauuuaauua

SEQ ID NO: 2346404 - RNA, 20 nt, Human
auuucaagagauuuaauuaa

SEQ ID NO: 2346405 - RNA, 15 nt, Human
auuucagauuuguga

SEQ ID NO: 2346406 - RNA, 18 nt, Human
auuucagauucccagagc

SEQ ID NO: 2346407 - RNA, 16 nt, Human
auuucaucuauuucug

SEQ ID NO: 2346408 - RNA, 15 nt, Human
auuucaucuauuucu

SEQ ID NO: 2346409 - RNA, 14 nt, Human
auuucaucuauuuc

SEQ ID NO: 2346410 - RNA, 13 nt, Human
auuucaucuauuu

SEQ ID NO: 2346411 - RNA, 20 nt, Human
auuucaucauauuauacaga

SEQ ID NO: 2346412 - RNA, 18 nt, Human
auuucaucauauuauaca

SEQ ID NO: 2346413 - RNA, 22 nt, Human
auuucagagaggccuuuuggaa

SEQ ID NO: 2346414 - RNA, 18 nt, Human
auuucagacucccauucc

SEQ ID NO: 2346415 - RNA, 14 nt, Human
auuucaauucucaa

SEQ ID NO: 2346416 - RNA, 15 nt, Human
auuucaauucucaaa

SEQ ID NO: 2346417 - RNA, 23 nt, Human
auuucagacucccauuccugaag

SEQ ID NO: 2346418 - RNA, 16 nt, Human
auuucagagaggccuu

SEQ ID NO: 2346419 - RNA, 16 nt, Human
auuucaaguuccaagu

SEQ ID NO: 2346420 - RNA, 11 nt, Human
auuucaaguuc

SEQ ID NO: 2346421 - RNA, 23 nt, Human
auuucaaguuccaaguugcuaau

SEQ ID NO: 2346422 - RNA, 22 nt, Human
auuucaaguuccaaguugcuaa

SEQ ID NO: 2346423 - RNA, 17 nt, Human
auuuaauauagcuauuu

SEQ ID NO: 2346424 - RNA, 16 nt, Human
auuuaauauagcuauu

SEQ ID NO: 2346425 - RNA, 14 nt, Human
auuuaauauagcua

SEQ ID NO: 2346426 - RNA, 19 nt, Human
auuuaauauagcuauuuuu

SEQ ID NO: 2346427 - RNA, 13 nt, Human
auuuaauauuuau

SEQ ID NO: 2346428 - RNA, 14 nt, Human
auuuauaauguuug

SEQ ID NO: 2346429 - RNA, 15 nt, Human
auuuaauuagugcua

SEQ ID NO: 2346430 - RNA, 16 nt, Human
auuuaauuagugcuaa

SEQ ID NO: 2346431 - RNA, 18 nt, Human
auuuaauuagugcuaagu

SEQ ID NO: 2346432 - RNA, 18 nt, Human
auuuauacaaauuagaaa

SEQ ID NO: 2346433 - RNA, 23 nt, Human
auuuauaaucacuuuuuuccaca

SEQ ID NO: 2346434 - RNA, 13 nt, Human
auuuaauuaaaaa

SEQ ID NO: 2346435 - RNA, 19 nt, Human
auuuaauuaaucaugaaug

SEQ ID NO: 2346436 - RNA, 14 nt, Human
auuuaauguuuuca

SEQ ID NO: 2346437 - RNA, 16 nt, Human
auuuaauguagccaug

SEQ ID NO: 2346438 - RNA, 21 nt, Human
auuuaauggccggcuggaaau

SEQ ID NO: 2346439 - RNA, 14 nt, Human
auuuaauguagcca

SEQ ID NO: 2346440 - RNA, 18 nt, Human
auuuaaucuuuuuuaugu

SEQ ID NO: 2346441 - RNA, 22 nt, Human
auuuaaugauaaguaaaugcua

SEQ ID NO: 2346442 - RNA, 14 nt, Human
auuuaaugaaagac

SEQ ID NO: 2346443 - RNA, 15 nt, Human
auuuaauauuuugca

SEQ ID NO: 2346444 - RNA, 19 nt, Human
auuucaucuauuucugaga

SEQ ID NO: 2346445 - RNA, 18 nt, Human
auuucaucuauuucugag

SEQ ID NO: 2346446 - RNA, 11 nt, Human
auuucaucugc

SEQ ID NO: 2346447 - RNA, 14 nt, Human
auuucaucuauuuu

SEQ ID NO: 2346448 - RNA, 14 nt, Human
auuucaucugcucu

SEQ ID NO: 2346449 - RNA, 15 nt, Human
auuucaucugcucuc

SEQ ID NO: 2346450 - RNA, 16 nt, Human
auuucaucugcucucc

SEQ ID NO: 2346451 - RNA, 17 nt, Human
auuucaucugcucuccu

SEQ ID NO: 2346452 - RNA, 15 nt, Human
auuucuaugaaauau

SEQ ID NO: 2346453 - RNA, 18 nt, Human
auuucuaugaaauauuau

SEQ ID NO: 2346454 - RNA, 18 nt, Human
auuucuauuuuuguagaa

SEQ ID NO: 2346455 - RNA, 19 nt, Human
auuucucaacaaagcacag

SEQ ID NO: 2346456 - RNA, 20 nt, Human
auuucaucuauuucugagaa

SEQ ID NO: 2346457 - RNA, 12 nt, Human
auuucuauuuuu

SEQ ID NO: 2346458 - RNA, 22 nt, Human
auuucucaacaaagcacagugu

SEQ ID NO: 2346459 - RNA, 20 nt, Human
auuucucaacaaagcacagu

SEQ ID NO: 2346460 - RNA, 14 nt, Human
auuucucacugaga

SEQ ID NO: 2346461 - RNA, 20 nt, Human
auuucuaugaaauauuaugu

SEQ ID NO: 2346462 - RNA, 11 nt, Human
auuucucccag

SEQ ID NO: 2346463 - RNA, 18 nt, Human
auuucucagacuuuggaa

SEQ ID NO: 2346464 - RNA, 20 nt, Human
auuucuccuccaugggagaa

SEQ ID NO: 2346465 - RNA, 15 nt, Human
auuucuccauacgca

SEQ ID NO: 2346466 - RNA, 21 nt, Human
auuucucagacuuuggaaaau

SEQ ID NO: 2346467 - RNA, 16 nt, Human
auuucucagacuuugg

SEQ ID NO: 2346468 - RNA, 14 nt, Human
auuucucauguuuu

SEQ ID NO: 2346469 - RNA, 16 nt, Human
auuuauaguuuguaca

SEQ ID NO: 2346470 - RNA, 23 nt, Human
auuucuguguugccaagcuccaa

SEQ ID NO: 2346471 - RNA, 15 nt, Human
auuucuguguugcca

SEQ ID NO: 2346472 - RNA, 15 nt, Human
auuucuccuuugaua

SEQ ID NO: 2346473 - RNA, 11 nt, Human
auuucuguguu

SEQ ID NO: 2346474 - RNA, 16 nt, Human
auuucuguuuagauaa

SEQ ID NO: 2346475 - RNA, 14 nt, Human
auuucuguuuagau

SEQ ID NO: 2346476 - RNA, 19 nt, Human
auuucuccucccuuccuuu

SEQ ID NO: 2346477 - RNA, 12 nt, Human
auuucuccccag

SEQ ID NO: 2346478 - RNA, 12 nt, Human
auuucuccuccc

SEQ ID NO: 2346479 - RNA, 14 nt, Human
auuucuccucccuu

SEQ ID NO: 2346480 - RNA, 17 nt, Human
auuucuccucccuuccu

SEQ ID NO: 2346481 - RNA, 12 nt, Human
auuucuguuuag

SEQ ID NO: 2346482 - RNA, 12 nt, Human
uuuugcaugaaa

SEQ ID NO: 2346483 - RNA, 16 nt, Human
uuuugcauggcacuug

SEQ ID NO: 2346484 - RNA, 19 nt, Human
uuuugcauggcacuugcau

SEQ ID NO: 2346485 - RNA, 18 nt, Human
uuuugcauuuaaaacaga

SEQ ID NO: 2346486 - RNA, 22 nt, Human
uuuugcauggcacuugcaucug

SEQ ID NO: 2346487 - RNA, 13 nt, Human
uuuugcauucaaa

SEQ ID NO: 2346488 - RNA, 18 nt, Human
uuuugcaucauuguuuua

SEQ ID NO: 2346489 - RNA, 22 nt, Human
uuuugcaguagagucaucucca

SEQ ID NO: 2346490 - RNA, 14 nt, Human
uuuugcagcaguga

SEQ ID NO: 2346491 - RNA, 21 nt, Human
uuuugcagcccagacaaaugu

SEQ ID NO: 2346492 - RNA, 13 nt, Human
uuuugcaggagca

SEQ ID NO: 2346493 - RNA, 16 nt, Human
uuuugcaccccuccca

SEQ ID NO: 2346494 - RNA, 17 nt, Human
uuuugcaccccucccau

SEQ ID NO: 2346495 - RNA, 12 nt, Human
uuuugcacuuuu

SEQ ID NO: 2346496 - RNA, 15 nt, Human
uuuugccucuuuucu

SEQ ID NO: 2346497 - RNA, 13 nt, Human
uuuugcccuuuga

SEQ ID NO: 2346498 - RNA, 18 nt, Human
uuuugcccuucacagugu

SEQ ID NO: 2346499 - RNA, 15 nt, Human
uuuugccauuaaacu

SEQ ID NO: 2346500 - RNA, 23 nt, Human
uuuugccauguuggccaggcugg

SEQ ID NO: 2346501 - RNA, 19 nt, Human
uuuugcauuugaauaaagc

SEQ ID NO: 2346502 - RNA, 13 nt, Human
uuuugcauuuaug

SEQ ID NO: 2346503 - RNA, 15 nt, Human
uuuugcauucaaauu

SEQ ID NO: 2346504 - RNA, 15 nt, Human
uuuugccaacauugc

SEQ ID NO: 2346505 - RNA, 16 nt, Human
uuuugaugaguuguga

SEQ ID NO: 2346506 - RNA, 15 nt, Human
uuuugauguuugugg

SEQ ID NO: 2346507 - RNA, 23 nt, Human
uuuugaugaacaaaauuuccuaa

SEQ ID NO: 2346508 - RNA, 15 nt, Human
uuuugauuauuguau

SEQ ID NO: 2346509 - RNA, 12 nt, Human
uuuugauuaugu

SEQ ID NO: 2346510 - RNA, 22 nt, Human
uuuugauguuuguggccucaga

SEQ ID NO: 2346511 - RNA, 20 nt, Human
uuuugauguuuguggccuca

SEQ ID NO: 2346512 - RNA, 15 nt, Human
uuuugauuuaugcau

SEQ ID NO: 2346513 - RNA, 20 nt, Human
uuuugauuuguacugaaaaa

SEQ ID NO: 2346514 - RNA, 20 nt, Human
uuuugauuuaauguuuucag

SEQ ID NO: 2346515 - RNA, 18 nt, Human
uuuugauuauuguauuua

SEQ ID NO: 2346516 - RNA, 12 nt, Human
uuuugauugaag

SEQ ID NO: 2346517 - RNA, 13 nt, Human
uuuugcaaaauuu

SEQ ID NO: 2346518 - RNA, 21 nt, Human
uuuugauuuguacugaaaaau

SEQ ID NO: 2346519 - RNA, 21 nt, Human
uuuugcaaccucgcuggacuc

SEQ ID NO: 2346520 - RNA, 17 nt, Human
uuuugcaaccucgcugg

SEQ ID NO: 2346521 - RNA, 22 nt, Human
uuuugcaagugaagguuuacaa

SEQ ID NO: 2346522 - RNA, 23 nt, Human
uuuugcaagugaagguuuacaau

SEQ ID NO: 2346523 - RNA, 10 nt, Human
uuuugcacag

SEQ ID NO: 2346524 - RNA, 17 nt, Human
uuuugcaauggcuauau

SEQ ID NO: 2346525 - RNA, 20 nt, Human
uuuugcacauguuuccucua

SEQ ID NO: 2346526 - RNA, 17 nt, Human
uuuugcaccccaugcug

SEQ ID NO: 2346527 - RNA, 18 nt, Human
uuuugcaccccaugcugu

SEQ ID NO: 2346528 - RNA, 19 nt, Human
uuuugcaccccaugcuguu

SEQ ID NO: 2346529 - RNA, 21 nt, Human
uuuugcaccccaugcuguuga

SEQ ID NO: 2346530 - RNA, 13 nt, Human
uuuugcaccccuc

SEQ ID NO: 2346531 - RNA, 17 nt, Human
uuuugagcaacuuucuu

SEQ ID NO: 2346532 - RNA, 15 nt, Human
uuuugaggagcccca

SEQ ID NO: 2346533 - RNA, 21 nt, Human
uuuugagcugaaaugcugcau

SEQ ID NO: 2346534 - RNA, 22 nt, Human
uuuugagcugaaaugcugcauu

SEQ ID NO: 2346535 - RNA, 17 nt, Human
uuuugagacagaaucuc

SEQ ID NO: 2346536 - RNA, 11 nt, Human
uuuugagaaag

SEQ ID NO: 2346537 - RNA, 16 nt, Human
uuuugagcaacuuucu

SEQ ID NO: 2346538 - RNA, 18 nt, Human
uuuugaguggaugauguu

SEQ ID NO: 2346539 - RNA, 14 nt, Human
uuuugaggcuuuca

SEQ ID NO: 2346540 - RNA, 17 nt, Human
uuuugagugccuuacac

SEQ ID NO: 2346541 - RNA, 17 nt, Human
uuuugauccaagcuggu

SEQ ID NO: 2346542 - RNA, 15 nt, Human
uuuugauagcuuuau

SEQ ID NO: 2346543 - RNA, 15 nt, Human
uuuugauagcaaagc

SEQ ID NO: 2346544 - RNA, 18 nt, Human
uuuugauaaaguaguaaa

SEQ ID NO: 2346545 - RNA, 22 nt, Human
uuuugauaaaguaguaaaaauu

SEQ ID NO: 2346546 - RNA, 14 nt, Human
uuuugaguucuaca

SEQ ID NO: 2346547 - RNA, 20 nt, Human
uuuugauaaaguuucucaga

SEQ ID NO: 2346548 - RNA, 23 nt, Human
uuuugauaaaguaguaaaaauua

SEQ ID NO: 2346549 - RNA, 19 nt, Human
uuuugauaaaguuucucag

SEQ ID NO: 2346550 - RNA, 21 nt, Human
uuuugauaaaguuucucagau

SEQ ID NO: 2346551 - RNA, 15 nt, Human
auuaaagcauuuacu

SEQ ID NO: 2346552 - RNA, 15 nt, Human
auuaaagacuccagu

SEQ ID NO: 2346553 - RNA, 13 nt, Human
auuaaagacagag

SEQ ID NO: 2346554 - RNA, 20 nt, Human
auuaaagcauuuacuuugaa

SEQ ID NO: 2346555 - RNA, 24 nt, Human
auuaagauggauucucagauauuu

SEQ ID NO: 2346556 - RNA, 20 nt, Human
auuaagccacuuaaaauguu

SEQ ID NO: 2346557 - RNA, 17 nt, Human
auuaagccacuuaaaau

SEQ ID NO: 2346558 - RNA, 16 nt, Human
auuaagauuuccaagu

SEQ ID NO: 2346559 - RNA, 17 nt, Human
auuaagauugaggccug

SEQ ID NO: 2346560 - RNA, 20 nt, Human
auuaagauugaggccugccc

SEQ ID NO: 2346561 - RNA, 13 nt, Human
auuaagauuucca

SEQ ID NO: 2346562 - RNA, 22 nt, Human
uuuuuacccauauccccucucc

SEQ ID NO: 2346563 - RNA, 16 nt, Human
uuuuuacuacaguugu

SEQ ID NO: 2346564 - RNA, 22 nt, Human
uuuuuaccuaccacagugucug

SEQ ID NO: 2346565 - RNA, 19 nt, Human
uuuuuaccguuucuucccu

SEQ ID NO: 2346566 - RNA, 20 nt, Human
uuuuuagaaagcauuugaau

SEQ ID NO: 2346567 - RNA, 13 nt, Human
uuuuuacugccac

SEQ ID NO: 2346568 - RNA, 14 nt, Human
uuuuuacugaacaa

SEQ ID NO: 2346569 - RNA, 12 nt, Human
uuuuuacugcca

SEQ ID NO: 2346570 - RNA, 22 nt, Human
uuuuuagacagagucucacugu

SEQ ID NO: 2346571 - RNA, 21 nt, Human
uuuuuagaucaaauacuuuaa

SEQ ID NO: 2346572 - RNA, 14 nt, Human
uuuuuagaucaaau

SEQ ID NO: 2346573 - RNA, 15 nt, Human
uuuuuagaucaaaua

SEQ ID NO: 2346574 - RNA, 11 nt, Human
uuuuuacuaau

SEQ ID NO: 2346575 - RNA, 18 nt, Human
uuuuuacccauauccccu

SEQ ID NO: 2346576 - RNA, 19 nt, Human
uuuuguuugguauuguauu

SEQ ID NO: 2346577 - RNA, 22 nt, Human
uuuuguuugguauuguauuuau

SEQ ID NO: 2346578 - RNA, 14 nt, Human
uuuuguuugguauu

SEQ ID NO: 2346579 - RNA, 23 nt, Human
uuuuuaucuccccuucacaugca

SEQ ID NO: 2346580 - RNA, 17 nt, Human
uuuuuaucuugggacug

SEQ ID NO: 2346581 - RNA, 17 nt, Human
uuuuuaucaugcauguc

SEQ ID NO: 2346582 - RNA, 13 nt, Human
uuuuuauacacau

SEQ ID NO: 2346583 - RNA, 12 nt, Human
uuuuuauggcuu

SEQ ID NO: 2346584 - RNA, 12 nt, Human
uuuuuaucaugu

SEQ ID NO: 2346585 - RNA, 20 nt, Human
uuuuuaucgucacugcuuaa

SEQ ID NO: 2346586 - RNA, 23 nt, Human
uuuuuauacauaaacaagaccac

SEQ ID NO: 2346587 - RNA, 19 nt, Human
uuuuuauauuugaaauauu

SEQ ID NO: 2346588 - RNA, 12 nt, Human
uuuuguuucaua

SEQ ID NO: 2346589 - RNA, 19 nt, Human
uuuuguuucauauugaugu

SEQ ID NO: 2346590 - RNA, 15 nt, Human
uuuuguuucuuccaa

SEQ ID NO: 2346591 - RNA, 13 nt, Human
uuuuguuugcuau

SEQ ID NO: 2346592 - RNA, 22 nt, Human
uuuuguuugcuaucuuaauuuu

SEQ ID NO: 2346593 - RNA, 21 nt, Human
uuuuguuccacaaguuaaaua

SEQ ID NO: 2346594 - RNA, 15 nt, Human
uuuuguuccacaagu

SEQ ID NO: 2346595 - RNA, 16 nt, Human
uuuugugauuuagaac

SEQ ID NO: 2346596 - RNA, 16 nt, Human
uuuuguucaaagccag

SEQ ID NO: 2346597 - RNA, 13 nt, Human
uuuugcuguagaa

SEQ ID NO: 2346598 - RNA, 14 nt, Human
uuuugcuguagaag

SEQ ID NO: 2346599 - RNA, 21 nt, Human
uuuugugaugucccaacuugu

SEQ ID NO: 2346600 - RNA, 13 nt, Human
uuuugcuguauau

SEQ ID NO: 2346601 - RNA, 10 nt, Human
uuuugcuguu

SEQ ID NO: 2346602 - RNA, 12 nt, Human
uuuugcuguaua

SEQ ID NO: 2346603 - RNA, 21 nt, Human
uuuugcuauuagacuguagga

SEQ ID NO: 2346604 - RNA, 17 nt, Human
uuuugcuauuguaaaua

SEQ ID NO: 2346605 - RNA, 13 nt, Human
uuuugccuucauu

SEQ ID NO: 2346606 - RNA, 17 nt, Human
uuuugccuucauuaccu

SEQ ID NO: 2346607 - RNA, 13 nt, Human
uuuugcuggaaua

SEQ ID NO: 2346608 - RNA, 20 nt, Human
uuuugugcauuaucuagaua

SEQ ID NO: 2346609 - RNA, 17 nt, Human
uuuugugcauuaucuag

SEQ ID NO: 2346610 - RNA, 18 nt, Human
uuuuguuaucagucaaua

SEQ ID NO: 2346611 - RNA, 19 nt, Human
uuuugugauuuagaacugu

SEQ ID NO: 2346612 - RNA, 15 nt, Human
uuuuuguguauuugu

SEQ ID NO: 2346613 - RNA, 14 nt, Human
uuuuuguacuguaa

SEQ ID NO: 2346614 - RNA, 22 nt, Human
uuuuuguguuuuguucuuuaaa

SEQ ID NO: 2346615 - RNA, 13 nt, Human
uuuuugucuuuuc

SEQ ID NO: 2346616 - RNA, 20 nt, Human
uuuuugugaaaaugucaaag

SEQ ID NO: 2346617 - RNA, 12 nt, Human
uuuuugucauca

SEQ ID NO: 2346618 - RNA, 21 nt, Human
auuaaguaaugauaacuggaa

SEQ ID NO: 2346619 - RNA, 23 nt, Human
auuaaguaaugauaacuggaaac

SEQ ID NO: 2346620 - RNA, 19 nt, Human
uuuuuguagagccaggguc

SEQ ID NO: 2346621 - RNA, 20 nt, Human
uuuuuguagagccagggucu

SEQ ID NO: 2346622 - RNA, 19 nt, Human
uuuuugugaaaagcuccau

SEQ ID NO: 2346623 - RNA, 23 nt, Human
uuuuuauugaaucuauuuaagua

SEQ ID NO: 2346624 - RNA, 13 nt, Human
uuuuuauucauaa

SEQ ID NO: 2346625 - RNA, 14 nt, Human
uuuuuauuauuugu

SEQ ID NO: 2346626 - RNA, 13 nt, Human
uuuuuauuauuug

SEQ ID NO: 2346627 - RNA, 13 nt, Human
uuuuuguaauuua

SEQ ID NO: 2346628 - RNA, 18 nt, Human
uuuuuguacaguuugcug

SEQ ID NO: 2346629 - RNA, 16 nt, Human
uuuuuguaccugguga

SEQ ID NO: 2346630 - RNA, 12 nt, Human
uuuuuguacugu

SEQ ID NO: 2346631 - RNA, 14 nt, Human
uuuuuaucuuuaua

SEQ ID NO: 2346632 - RNA, 22 nt, Human
uuuuuauggcuuuugugcauua

SEQ ID NO: 2346633 - RNA, 21 nt, Human
uuuuuauggcuuuugugcauu

SEQ ID NO: 2346634 - RNA, 20 nt, Human
uuuuuauggcuuuugugcau

SEQ ID NO: 2346635 - RNA, 16 nt, Human
auuaauaaucuuauua

SEQ ID NO: 2346636 - RNA, 13 nt, Human
auuaauaaucuua

SEQ ID NO: 2346637 - RNA, 12 nt, Human
auuaauaaucuu

SEQ ID NO: 2346638 - RNA, 15 nt, Human
auuaauaauaaauuc

SEQ ID NO: 2346639 - RNA, 15 nt, Human
auuacagugggugcc

SEQ ID NO: 2346640 - RNA, 13 nt, Human
auuaauagcuuuu

SEQ ID NO: 2346641 - RNA, 22 nt, Human
auuacaucuuucacauuggcua

SEQ ID NO: 2346642 - RNA, 18 nt, Human
auuacaucuuucacauug

SEQ ID NO: 2346643 - RNA, 16 nt, Human
auuacaucuuucacau

SEQ ID NO: 2346644 - RNA, 21 nt, Human
auuacauauuugcauauguau

SEQ ID NO: 2346645 - RNA, 15 nt, Human
auuacaucuuucaca

SEQ ID NO: 2346646 - RNA, 18 nt, Human
auuacauaaucuguacaa

SEQ ID NO: 2346647 - RNA, 21 nt, Human
auuacauaaucuguacaauga

SEQ ID NO: 2346648 - RNA, 14 nt, Human
auuaaguuguuaau

SEQ ID NO: 2346649 - RNA, 16 nt, Human
auuaaguacuauguau

SEQ ID NO: 2346650 - RNA, 14 nt, Human
auuaaguacuaugu

SEQ ID NO: 2346651 - RNA, 19 nt, Human
auuaaguuguuaauaaaag

SEQ ID NO: 2346652 - RNA, 20 nt, Human
auuaaguuguuaauaaaagu

SEQ ID NO: 2346653 - RNA, 13 nt, Human
auuaaguuguuaa

SEQ ID NO: 2346654 - RNA, 16 nt, Human
auuaauaaaaaaugga

SEQ ID NO: 2346655 - RNA, 22 nt, Human
auuaauaaaaaauggaaagaau

SEQ ID NO: 2346656 - RNA, 19 nt, Human
auuaauaaaaaauggaaag

SEQ ID NO: 2346657 - RNA, 15 nt, Human
auuacauuuccaaau

SEQ ID NO: 2346658 - RNA, 16 nt, Human
auuacauguaaaacau

SEQ ID NO: 2346659 - RNA, 19 nt, Human
auuacauguaaaacauuau

SEQ ID NO: 2346660 - RNA, 17 nt, Human
auuacauuuguauaaaa

SEQ ID NO: 2346661 - RNA, 18 nt, Human
auuacauuuguauaaaau

SEQ ID NO: 2346662 - RNA, 20 nt, Human
auuacauuuguauaaaauaa

SEQ ID NO: 2346663 - RNA, 17 nt, Human
auuacauuuccaaauga

SEQ ID NO: 2346664 - RNA, 20 nt, Human
auuaccaugagaagagggcc

SEQ ID NO: 2346665 - RNA, 18 nt, Human
auuacauuuccaaaugaa

SEQ ID NO: 2346666 - RNA, 12 nt, Human
auuaccagggac

SEQ ID NO: 2346667 - RNA, 15 nt, Human
auuaccauggagaca

SEQ ID NO: 2346668 - RNA, 13 nt, Human
auuaccauggaga

SEQ ID NO: 2346669 - RNA, 13 nt, Human
auuacccaagcaa

SEQ ID NO: 2346670 - RNA, 22 nt, Human
auuacccccucauuguuuauua

SEQ ID NO: 2346671 - RNA, 15 nt, Human
auuacccaagcaaaa

SEQ ID NO: 2346672 - RNA, 13 nt, Human
auuacccccuccu

SEQ ID NO: 2346673 - RNA, 19 nt, Human
auuacccccuccuucagac

SEQ ID NO: 2346674 - RNA, 18 nt, Human
auuacccccuccuucaga

SEQ ID NO: 2346675 - RNA, 16 nt, Human
auuaccgcguuguaaa

SEQ ID NO: 2346676 - RNA, 17 nt, Human
auuaccgcguuguaaaa

SEQ ID NO: 2346677 - RNA, 18 nt, Human
auuaccgcguuguaaaau

SEQ ID NO: 2346678 - RNA, 21 nt, Human
auuacccccuccuucagacac

SEQ ID NO: 2346679 - RNA, 20 nt, Human
auuacccccuccuucagaca

SEQ ID NO: 2346680 - RNA, 20 nt, Human
auuaccuuuuuugauaaagu

SEQ ID NO: 2346681 - RNA, 15 nt, Human
auuacuacaaaauuu

SEQ ID NO: 2346682 - RNA, 20 nt, Human
auuacuaaggaguaaucugu

SEQ ID NO: 2346683 - RNA, 20 nt, Human
auuacgugagccagguaaug

SEQ ID NO: 2346684 - RNA, 13 nt, Human
auuacgugagcca

SEQ ID NO: 2346685 - RNA, 14 nt, Human
auuacgugagccag

SEQ ID NO: 2346686 - RNA, 16 nt, Human
auuacgugagccaggu

SEQ ID NO: 2346687 - RNA, 21 nt, Human
auuacuacaaaauuugaaauu

SEQ ID NO: 2346688 - RNA, 20 nt, Human
auuacuacaaaauuugaaau

SEQ ID NO: 2346689 - RNA, 13 nt, Human
auuacuuagagga

SEQ ID NO: 2346690 - RNA, 18 nt, Human
auuacuaugacugcuccc

SEQ ID NO: 2346691 - RNA, 22 nt, Human
auuacuguuugucuucucccca

SEQ ID NO: 2346692 - RNA, 23 nt, Human
auuacuguuugucuucuccccag

SEQ ID NO: 2346693 - RNA, 15 nt, Human
auuacuuaucaucca

SEQ ID NO: 2346694 - RNA, 15 nt, Human
auuacuuauuuuuga

SEQ ID NO: 2346695 - RNA, 23 nt, Human
auuacuuaucauccacauuguuu

SEQ ID NO: 2346696 - RNA, 19 nt, Human
auuacuuauuuuugacagu

SEQ ID NO: 2346697 - RNA, 18 nt, Human
auuacuuauuuuugacag

SEQ ID NO: 2346698 - RNA, 17 nt, Human
auuacuuauuuuugaca

SEQ ID NO: 2346699 - RNA, 16 nt, Human
auuacuuauuuuugac

SEQ ID NO: 2346700 - RNA, 23 nt, Human
auuagucauucaauaaauuguaa

SEQ ID NO: 2346701 - RNA, 13 nt, Human
auuaguccuugcu

SEQ ID NO: 2346702 - RNA, 14 nt, Human
auuaguccuugcuu

SEQ ID NO: 2346703 - RNA, 23 nt, Human
auuaguauuuauuuaauguuaug

SEQ ID NO: 2346704 - RNA, 18 nt, Human
auuaguauuuauuuaaug

SEQ ID NO: 2346705 - RNA, 19 nt, Human
auuacuuaucauccacauu

SEQ ID NO: 2346706 - RNA, 15 nt, Human
auuagugcuaagugu

SEQ ID NO: 2346707 - RNA, 23 nt, Human
auuauagugauguaaucuugaau

SEQ ID NO: 2346708 - RNA, 13 nt, Human
auuagugcuaagu

SEQ ID NO: 2346709 - RNA, 13 nt, Human
auuauauauauau

SEQ ID NO: 2346710 - RNA, 20 nt, Human
auguucagauugcuuugauu

SEQ ID NO: 2346711 - RNA, 22 nt, Human
auguuagagguuuuaaagugau

SEQ ID NO: 2346712 - RNA, 23 nt, Human
auguucagaagguugcucuagau

SEQ ID NO: 2346713 - RNA, 16 nt, Human
auguuagggugcucug

SEQ ID NO: 2346714 - RNA, 19 nt, Human
auguuaggaaaauuucaca

SEQ ID NO: 2346715 - RNA, 22 nt, Human
auguucacuuuugacaaaggca

SEQ ID NO: 2346716 - RNA, 20 nt, Human
auguucacuuuugacaaagg

SEQ ID NO: 2346717 - RNA, 15 nt, Human
auguuagcaaagagu

SEQ ID NO: 2346718 - RNA, 16 nt, Human
auguuagagguuuuaa

SEQ ID NO: 2346719 - RNA, 21 nt, Human
auguuagagguuuuaaaguga

SEQ ID NO: 2346720 - RNA, 18 nt, Human
auguuaggaaaauuucac

SEQ ID NO: 2346721 - RNA, 21 nt, Human
auguuacugaucaugcauugu

SEQ ID NO: 2346722 - RNA, 20 nt, Human
auguuacugaucaugcauug

SEQ ID NO: 2346723 - RNA, 19 nt, Human
auguuacugaucaugcauu

SEQ ID NO: 2346724 - RNA, 18 nt, Human
auguuacugaucaugcau

SEQ ID NO: 2346725 - RNA, 22 nt, Human
auguuacugaucaugcauuguu

SEQ ID NO: 2346726 - RNA, 23 nt, Human
auguuagaggaucccucucugga

SEQ ID NO: 2346727 - RNA, 22 nt, Human
auguuaauucagcacugauuuc

SEQ ID NO: 2346728 - RNA, 23 nt, Human
auguuaauucagcacugauuuca

SEQ ID NO: 2346729 - RNA, 17 nt, Human
auguuacuacaugcacu

SEQ ID NO: 2346730 - RNA, 16 nt, Human
auguuacugaucaugc

SEQ ID NO: 2346731 - RNA, 13 nt, Human
auguuacugauca

SEQ ID NO: 2346732 - RNA, 14 nt, Human
auguuacugaccag

SEQ ID NO: 2346733 - RNA, 13 nt, Human
auguuacugacca

SEQ ID NO: 2346734 - RNA, 13 nt, Human
auguuaauuucau

SEQ ID NO: 2346735 - RNA, 15 nt, Human
auguuaaguuacuuc

SEQ ID NO: 2346736 - RNA, 23 nt, Human
auguuaaggaaacucuuaucuca

SEQ ID NO: 2346737 - RNA, 17 nt, Human
auguuaaguuacuucac

SEQ ID NO: 2346738 - RNA, 23 nt, Human
auguuaaguuacuucacuuuaau

SEQ ID NO: 2346739 - RNA, 20 nt, Human
auguuaagggaagaauucca

SEQ ID NO: 2346740 - RNA, 18 nt, Human
auguuaaggaaacucuua

SEQ ID NO: 2346741 - RNA, 19 nt, Human
auguuaaggaaacucuuau

SEQ ID NO: 2346742 - RNA, 14 nt, Human
auguguugaaaaaa

SEQ ID NO: 2346743 - RNA, 13 nt, Human
auguguugugaua

SEQ ID NO: 2346744 - RNA, 17 nt, Human
auguguuuacuuuaugu

SEQ ID NO: 2346745 - RNA, 14 nt, Human
auguguugugauag

SEQ ID NO: 2346746 - RNA, 15 nt, Human
auguuaaaauguauu

SEQ ID NO: 2346747 - RNA, 14 nt, Human
auguuaaaauguau

SEQ ID NO: 2346748 - RNA, 21 nt, Human
auguuaaacuagcauaucugc

SEQ ID NO: 2346749 - RNA, 23 nt, Human
auguuaaacuagcauaucugccu

SEQ ID NO: 2346750 - RNA, 13 nt, Human
auguuaagcucuu

SEQ ID NO: 2346751 - RNA, 15 nt, Human
auguuaagcucuuua

SEQ ID NO: 2346752 - RNA, 13 nt, Human
auguuaaggaaac

SEQ ID NO: 2346753 - RNA, 17 nt, Human
auguuaaggaaacucuu

SEQ ID NO: 2346754 - RNA, 24 nt, Human
auguuaaacuagcauaucugccuu

SEQ ID NO: 2346755 - RNA, 15 nt, Human
auguuaaacuagcau

SEQ ID NO: 2346756 - RNA, 19 nt, Human
auguuaaacuagcauaucu

SEQ ID NO: 2346757 - RNA, 20 nt, Human
auguugcccaggcaggucuu

SEQ ID NO: 2346758 - RNA, 20 nt, Human
auguugcccuguugcugccu

SEQ ID NO: 2346759 - RNA, 14 nt, Human
uuuuagaaaacagc

SEQ ID NO: 2346760 - RNA, 19 nt, Human
uuuuacuuuuauaauaaaa

SEQ ID NO: 2346761 - RNA, 15 nt, Human
uuuuacuuuuaaaug

SEQ ID NO: 2346762 - RNA, 12 nt, Human
uuuuacuuuuau

SEQ ID NO: 2346763 - RNA, 20 nt, Human
uuuuacuuuuaaacugugua

SEQ ID NO: 2346764 - RNA, 18 nt, Human
uuuuacuuuuaaacugug

SEQ ID NO: 2346765 - RNA, 17 nt, Human
uuuuacuuuuaaacugu

SEQ ID NO: 2346766 - RNA, 21 nt, Human
uuuuagcugaugaacuuauuc

SEQ ID NO: 2346767 - RNA, 22 nt, Human
uuuuagcugguggcaauaaaua

SEQ ID NO: 2346768 - RNA, 15 nt, Human
uuuuaggaaaugaau

SEQ ID NO: 2346769 - RNA, 14 nt, Human
uuuuagaaagcauu

SEQ ID NO: 2346770 - RNA, 16 nt, Human
uuuuagaaagcauuug

SEQ ID NO: 2346771 - RNA, 18 nt, Human
uuuuagaaagcauuugaa

SEQ ID NO: 2346772 - RNA, 19 nt, Human
uuuuagaaagcauuugaau

SEQ ID NO: 2346773 - RNA, 20 nt, Human
uuuuagaaagcauuugaaug

SEQ ID NO: 2346774 - RNA, 21 nt, Human
uuuuagaaagcauuugaaugc

SEQ ID NO: 2346775 - RNA, 22 nt, Human
uuuuagaaagcauuugaaugca

SEQ ID NO: 2346776 - RNA, 23 nt, Human
uuuuagaaagcauuugaaugcau

SEQ ID NO: 2346777 - RNA, 17 nt, Human
auguugcccaggcaggu

SEQ ID NO: 2346778 - RNA, 16 nt, Human
auguugcccaggcagg

SEQ ID NO: 2346779 - RNA, 22 nt, Human
auguugccaguuuaaucauugc

SEQ ID NO: 2346780 - RNA, 12 nt, Human
auguugcccagg

SEQ ID NO: 2346781 - RNA, 22 nt, Human
auguucaguguaauuucuuugc

SEQ ID NO: 2346782 - RNA, 18 nt, Human
auguucaguguaauuucu

SEQ ID NO: 2346783 - RNA, 21 nt, Human
auguucaguguaauuucuuug

SEQ ID NO: 2346784 - RNA, 15 nt, Human
auguugcauagaaua

SEQ ID NO: 2346785 - RNA, 17 nt, Human
auguugcauagaauaaa

SEQ ID NO: 2346786 - RNA, 18 nt, Human
auguugcauagaauaaaa

SEQ ID NO: 2346787 - RNA, 18 nt, Human
auguucaucaaugaauga

SEQ ID NO: 2346788 - RNA, 16 nt, Human
auguucagcacugucc

SEQ ID NO: 2346789 - RNA, 19 nt, Human
auguucagcacugucccuu

SEQ ID NO: 2346790 - RNA, 22 nt, Human
auguucagcacugucccuugcc

SEQ ID NO: 2346791 - RNA, 14 nt, Human
auguucaguguaau

SEQ ID NO: 2346792 - RNA, 16 nt, Human
auguucaguguaauuu

SEQ ID NO: 2346793 - RNA, 23 nt, Human
auguggcaauaaauuuuuuuuaa

SEQ ID NO: 2346794 - RNA, 18 nt, Human
auguggcaaggaaaaaca

SEQ ID NO: 2346795 - RNA, 18 nt, Human
auguggccccugaacaag

SEQ ID NO: 2346796 - RNA, 24 nt, Human
auguggaguucaucuugaauugua

SEQ ID NO: 2346797 - RNA, 20 nt, Human
augugcuacugauuguuuca

SEQ ID NO: 2346798 - RNA, 19 nt, Human
auguggagaaacuguaguc

SEQ ID NO: 2346799 - RNA, 16 nt, Human
auguggaguggggcag

SEQ ID NO: 2346800 - RNA, 20 nt, Human
auguggaguucaucuugaau

SEQ ID NO: 2346801 - RNA, 14 nt, Human
augugcuacugauu

SEQ ID NO: 2346802 - RNA, 15 nt, Human
auguggaauauaaag

SEQ ID NO: 2346803 - RNA, 17 nt, Human
auguggaauauaaagau

SEQ ID NO: 2346804 - RNA, 23 nt, Human
auguggaagugugggucugugug

SEQ ID NO: 2346805 - RNA, 22 nt, Human
auguggaagugugggucugugu

SEQ ID NO: 2346806 - RNA, 13 nt, Human
auguggaagugug

SEQ ID NO: 2346807 - RNA, 16 nt, Human
auguggaagugugggu

SEQ ID NO: 2346808 - RNA, 15 nt, Human
auguggaaguguggg

SEQ ID NO: 2346809 - RNA, 21 nt, Human
auguguguguauguuugcaca

SEQ ID NO: 2346810 - RNA, 15 nt, Human
auguguguguauguu

SEQ ID NO: 2346811 - RNA, 18 nt, Human
auguguguguguugugug

SEQ ID NO: 2346812 - RNA, 23 nt, Human
auguguguuuuaaaaugagaaau

SEQ ID NO: 2346813 - RNA, 13 nt, Human
auguguguguaug

SEQ ID NO: 2346814 - RNA, 12 nt, Human
auguguguguau

SEQ ID NO: 2346815 - RNA, 15 nt, Human
augugugugcucagg

SEQ ID NO: 2346816 - RNA, 22 nt, Human
augugugugguuuuuuuucuaa

SEQ ID NO: 2346817 - RNA, 10 nt, Human
augugugugu

SEQ ID NO: 2346818 - RNA, 21 nt, Human
auguguguguaugcuacuaca

SEQ ID NO: 2346819 - RNA, 19 nt, Human
auguguguguaugcuacua

SEQ ID NO: 2346820 - RNA, 16 nt, Human
auguguguguaugcua

SEQ ID NO: 2346821 - RNA, 15 nt, Human
auguguguguaugcu

SEQ ID NO: 2346822 - RNA, 12 nt, Human
augugugugugc

SEQ ID NO: 2346823 - RNA, 19 nt, Human
auguggccuaaaaaugcaa

SEQ ID NO: 2346824 - RNA, 19 nt, Human
auguggccuguggccugug

SEQ ID NO: 2346825 - RNA, 20 nt, Human
auguggcccuggccugcugg

SEQ ID NO: 2346826 - RNA, 19 nt, Human
auguggcccuggccugcug

SEQ ID NO: 2346827 - RNA, 16 nt, Human
auguggcccuggccug

SEQ ID NO: 2346828 - RNA, 15 nt, Human
auguggcccuggccu

SEQ ID NO: 2346829 - RNA, 14 nt, Human
auguggcccuggcc

SEQ ID NO: 2346830 - RNA, 13 nt, Human
auguggcccuggc

SEQ ID NO: 2346831 - RNA, 22 nt, Human
auguggccccugaacaagaauu

SEQ ID NO: 2346832 - RNA, 20 nt, Human
auguggccccugaacaagaa

SEQ ID NO: 2346833 - RNA, 22 nt, Human
auguggcuguaucuuguuuuuc

SEQ ID NO: 2346834 - RNA, 13 nt, Human
auguggcugcccc

SEQ ID NO: 2346835 - RNA, 19 nt, Human
augugugugcaagugugug

SEQ ID NO: 2346836 - RNA, 16 nt, Human
augugugugcaagugu

SEQ ID NO: 2346837 - RNA, 11 nt, Human
augugugugca

SEQ ID NO: 2346838 - RNA, 15 nt, Human
auguggcugcagcag

SEQ ID NO: 2346839 - RNA, 17 nt, Human
auguggcugcagcagcg

SEQ ID NO: 2346840 - RNA, 13 nt, Human
auguggcuggaag

SEQ ID NO: 2346841 - RNA, 14 nt, Human
auguggcuggaaga

SEQ ID NO: 2346842 - RNA, 20 nt, Human
auguggcuggaagauccugc

SEQ ID NO: 2346843 - RNA, 20 nt, Human
augugcgugugugcaagugu

SEQ ID NO: 2346844 - RNA, 18 nt, Human
augugcgugugugcaagu

SEQ ID NO: 2346845 - RNA, 15 nt, Human
augugcgugugugca

SEQ ID NO: 2346846 - RNA, 14 nt, Human
augugcgugugugc

SEQ ID NO: 2346847 - RNA, 19 nt, Human
augugcuaguaauuggaaa

SEQ ID NO: 2346848 - RNA, 21 nt, Human
augugccguguuauuguauua

SEQ ID NO: 2346849 - RNA, 15 nt, Human
augugccugauccag

SEQ ID NO: 2346850 - RNA, 20 nt, Human
augugccugauccagccucu

SEQ ID NO: 2346851 - RNA, 14 nt, Human
augugccugggugg

SEQ ID NO: 2346852 - RNA, 12 nt, Human
augugcccccag

SEQ ID NO: 2346853 - RNA, 14 nt, Human
augugcccccagac

SEQ ID NO: 2346854 - RNA, 18 nt, Human
augugccauuuuaaaaaa

SEQ ID NO: 2346855 - RNA, 22 nt, Human
augugccauuuuaaaaaaaaag

SEQ ID NO: 2346856 - RNA, 17 nt, Human
augugccgaaugugcag

SEQ ID NO: 2346857 - RNA, 18 nt, Human
augugccgaaugugcagg

SEQ ID NO: 2346858 - RNA, 22 nt, Human
augugccagguuuuuggucuga

SEQ ID NO: 2346859 - RNA, 16 nt, Human
uuuuaauaauguuuca

SEQ ID NO: 2346860 - RNA, 22 nt, Human
auggggcugaacggggagaaaa

SEQ ID NO: 2346861 - RNA, 12 nt, Human
auggggccucug

SEQ ID NO: 2346862 - RNA, 14 nt, Human
auggggccucuguu

SEQ ID NO: 2346863 - RNA, 17 nt, Human
auggggcucccgcccgu

SEQ ID NO: 2346864 - RNA, 20 nt, Human
auggggcccugccuccuuug

SEQ ID NO: 2346865 - RNA, 19 nt, Human
auggggcugaacggggaga

SEQ ID NO: 2346866 - RNA, 16 nt, Human
uuuuaaguuguuugca

SEQ ID NO: 2346867 - RNA, 18 nt, Human
uuuuaaguuguuugcaug

SEQ ID NO: 2346868 - RNA, 14 nt, Human
uuuuaauaaacacu

SEQ ID NO: 2346869 - RNA, 12 nt, Human
uuuuaauaaugu

SEQ ID NO: 2346870 - RNA, 14 nt, Human
uuuuaauaaacuuu

SEQ ID NO: 2346871 - RNA, 15 nt, Human
uuuuaauaaacuuuu

SEQ ID NO: 2346872 - RNA, 13 nt, Human
uuuuaauaauguu

SEQ ID NO: 2346873 - RNA, 14 nt, Human
uuuuaauaauguuu

SEQ ID NO: 2346874 - RNA, 18 nt, Human
auuaaaacugaagucuga

SEQ ID NO: 2346875 - RNA, 19 nt, Human
auuaaaacugaagucugaa

SEQ ID NO: 2346876 - RNA, 20 nt, Human
auuaaaacugaagucugaaa

SEQ ID NO: 2346877 - RNA, 23 nt, Human
auuaaaagaaaauaaaaaaaaga

SEQ ID NO: 2346878 - RNA, 21 nt, Human
auuaaaacugaagucugaaau

SEQ ID NO: 2346879 - RNA, 22 nt, Human
auuaaaacugaagucugaaauu

SEQ ID NO: 2346880 - RNA, 15 nt, Human
auuaaaacugaauug

SEQ ID NO: 2346881 - RNA, 14 nt, Human
auuaaacccuggau

SEQ ID NO: 2346882 - RNA, 14 nt, Human
auuaaaacugaauu

SEQ ID NO: 2346883 - RNA, 15 nt, Human
auuaaaagaauauuu

SEQ ID NO: 2346884 - RNA, 23 nt, Human
auuaaacucuucacaaaaucugu

SEQ ID NO: 2346885 - RNA, 20 nt, Human
auuaaacguaugcaugugaa

SEQ ID NO: 2346886 - RNA, 21 nt, Human
auuaaacguaugcaugugaag

SEQ ID NO: 2346887 - RNA, 22 nt, Human
auuaaacggauuauuuuuucag

SEQ ID NO: 2346888 - RNA, 23 nt, Human
auuaaacggauuauuuuuucaga

SEQ ID NO: 2346889 - RNA, 18 nt, Human
auuaaacguaugcaugug

SEQ ID NO: 2346890 - RNA, 19 nt, Human
auuaaacguaugcauguga

SEQ ID NO: 2346891 - RNA, 13 nt, Human
auuaaacggauua

SEQ ID NO: 2346892 - RNA, 14 nt, Human
auuaaacggauuau

SEQ ID NO: 2346893 - RNA, 15 nt, Human
auuaaacggauuauu

SEQ ID NO: 2346894 - RNA, 16 nt, Human
auuaaacggauuauuu

SEQ ID NO: 2346895 - RNA, 17 nt, Human
auuaaacggauuauuuu

SEQ ID NO: 2346896 - RNA, 19 nt, Human
auuaaacggauuauuuuuu

SEQ ID NO: 2346897 - RNA, 20 nt, Human
auuaaacggauuauuuuuuc

SEQ ID NO: 2346898 - RNA, 21 nt, Human
auuaaacggauuauuuuuuca

SEQ ID NO: 2346899 - RNA, 14 nt, Human
auguuuugugacua

SEQ ID NO: 2346900 - RNA, 17 nt, Human
auguuuugugacuauau

SEQ ID NO: 2346901 - RNA, 21 nt, Human
auguuuugugacuauauagag

SEQ ID NO: 2346902 - RNA, 19 nt, Human
auguuuugugacuauauag

SEQ ID NO: 2346903 - RNA, 18 nt, Human
auguuuugugggaacaga

SEQ ID NO: 2346904 - RNA, 19 nt, Human
auuaaaaaucucaaauuuc

SEQ ID NO: 2346905 - RNA, 15 nt, Human
auuaaaaaucucaaa

SEQ ID NO: 2346906 - RNA, 16 nt, Human
auguuuuuaaaaguuu

SEQ ID NO: 2346907 - RNA, 18 nt, Human
auguuuuuaaaaguuuca

SEQ ID NO: 2346908 - RNA, 20 nt, Human
auguuuuuaaaaguuucaau

SEQ ID NO: 2346909 - RNA, 23 nt, Human
auuaaaacacaacaucuuuuucu

SEQ ID NO: 2346910 - RNA, 22 nt, Human
auuaaaaaucucaaauuucuaa

SEQ ID NO: 2346911 - RNA, 20 nt, Human
auuaaaaaucucaaauuucu

SEQ ID NO: 2346912 - RNA, 20 nt, Human
uuuucugguagauagaaaua

SEQ ID NO: 2346913 - RNA, 19 nt, Human
uuuucugguagauagaaau

SEQ ID NO: 2346914 - RNA, 16 nt, Human
uuuucugguagauaga

SEQ ID NO: 2346915 - RNA, 22 nt, Human
uuuucuggguguccaaaggaag

SEQ ID NO: 2346916 - RNA, 12 nt, Human
uuuucuguauuu

SEQ ID NO: 2346917 - RNA, 12 nt, Human
auguuguuauuu

SEQ ID NO: 2346918 - RNA, 22 nt, Human
auguuguguuucuguucaccuu

SEQ ID NO: 2346919 - RNA, 18 nt, Human
uuuucugugccugaauau

SEQ ID NO: 2346920 - RNA, 17 nt, Human
uuuucugugccugaaua

SEQ ID NO: 2346921 - RNA, 15 nt, Human
uuuucugucucugcc

SEQ ID NO: 2346922 - RNA, 17 nt, Human
uuuucugucucugccuc

SEQ ID NO: 2346923 - RNA, 17 nt, Human
auguuuaguaaucauau

SEQ ID NO: 2346924 - RNA, 20 nt, Human
auguuguucauuauuggagg

SEQ ID NO: 2346925 - RNA, 13 nt, Human
auguuguuauuua

SEQ ID NO: 2346926 - RNA, 14 nt, Human
auguuguuauuuaa

SEQ ID NO: 2346927 - RNA, 15 nt, Human
auguuguuauuuaaa

SEQ ID NO: 2346928 - RNA, 17 nt, Human
auguuguuauuuaaaga

SEQ ID NO: 2346929 - RNA, 20 nt, Human
auguuuaugcaaggaaggaa

SEQ ID NO: 2346930 - RNA, 18 nt, Human
auguuuaugcaaggaagg

SEQ ID NO: 2346931 - RNA, 22 nt, Human
auguuuaugcaaggaaggaaag

SEQ ID NO: 2346932 - RNA, 15 nt, Human
auguuuucaggcuag

SEQ ID NO: 2346933 - RNA, 21 nt, Human
auguuuaugagccagacaaau

SEQ ID NO: 2346934 - RNA, 20 nt, Human
auguuuaugagccagacaaa

SEQ ID NO: 2346935 - RNA, 16 nt, Human
auguuuaugagccaga

SEQ ID NO: 2346936 - RNA, 15 nt, Human
auguuuaugagccag

SEQ ID NO: 2346937 - RNA, 14 nt, Human
auguuuaugagcca

SEQ ID NO: 2346938 - RNA, 19 nt, Human
auguuuauauaaaugcuuu

SEQ ID NO: 2346939 - RNA, 13 nt, Human
auguuuauauaaa

SEQ ID NO: 2346940 - RNA, 14 nt, Human
auguuuauauaaau

SEQ ID NO: 2346941 - RNA, 16 nt, Human
auguuuauauaaaugc

SEQ ID NO: 2346942 - RNA, 17 nt, Human
auguuuauauaaaugcu

SEQ ID NO: 2346943 - RNA, 21 nt, Human
auguuuauauaaaugcuuuua

SEQ ID NO: 2346944 - RNA, 23 nt, Human
auguuuugguaucuguucuuuaa

SEQ ID NO: 2346945 - RNA, 15 nt, Human
auguuuugguaucug

SEQ ID NO: 2346946 - RNA, 17 nt, Human
auguuuugguaucuguu

SEQ ID NO: 2346947 - RNA, 20 nt, Human
auguuuugguaucuguucuu

SEQ ID NO: 2346948 - RNA, 16 nt, Human
auguuuuccagcuccu

SEQ ID NO: 2346949 - RNA, 18 nt, Human
auguuuuccagcuccuca

SEQ ID NO: 2346950 - RNA, 22 nt, Human
auguuuugauaaaguaguaaaa

SEQ ID NO: 2346951 - RNA, 17 nt, Human
auguuuucaggcuagau

SEQ ID NO: 2346952 - RNA, 21 nt, Human
auguuuucaggcuagauguau

SEQ ID NO: 2346953 - RNA, 19 nt, Human
uuuucauauugugccaaua

SEQ ID NO: 2346954 - RNA, 21 nt, Human
uuuucaucuucucuggcgaca

SEQ ID NO: 2346955 - RNA, 14 nt, Human
uuuucaucugggaa

SEQ ID NO: 2346956 - RNA, 15 nt, Human
uuuucaucugggaaa

SEQ ID NO: 2346957 - RNA, 16 nt, Human
uuuucaucugggaaag

SEQ ID NO: 2346958 - RNA, 15 nt, Human
uuuucaucuguuguu

SEQ ID NO: 2346959 - RNA, 21 nt, Human
uuuucaugauuuugaaaucau

SEQ ID NO: 2346960 - RNA, 21 nt, Human
uuuucaugauuuugaaaccau

SEQ ID NO: 2346961 - RNA, 20 nt, Human
uuuucauuuaggugaggaag

SEQ ID NO: 2346962 - RNA, 17 nt, Human
uuuucuccacuuuguug

SEQ ID NO: 2346963 - RNA, 20 nt, Human
uuuuccaaaaguggccucuu

SEQ ID NO: 2346964 - RNA, 15 nt, Human
uuuuccaaaaaaaua

SEQ ID NO: 2346965 - RNA, 23 nt, Human
uuuuccaaaaguggccucuuugu

SEQ ID NO: 2346966 - RNA, 15 nt, Human
uuuuccaaaauaauu

SEQ ID NO: 2346967 - RNA, 18 nt, Human
uuuucauuuucugcaagc

SEQ ID NO: 2346968 - RNA, 22 nt, Human
uuuucauuuucugcaagccugc

SEQ ID NO: 2346969 - RNA, 21 nt, Human
uuuuccaaaaaaauacugcca

SEQ ID NO: 2346970 - RNA, 22 nt, Human
uuuucauggacacuuugaaaug

SEQ ID NO: 2346971 - RNA, 17 nt, Human
uuuucauugauaugaaa

SEQ ID NO: 2346972 - RNA, 16 nt, Human
uuuucauuuucugcaa

SEQ ID NO: 2346973 - RNA, 13 nt, Human
uuuucauuguaaa

SEQ ID NO: 2346974 - RNA, 13 nt, Human
uuuucauuugccu

SEQ ID NO: 2346975 - RNA, 15 nt, Human
uuuucauuugccuau

SEQ ID NO: 2346976 - RNA, 16 nt, Human
uuuucauuugccuauu

SEQ ID NO: 2346977 - RNA, 17 nt, Human
uuuucucuaacucagaa

SEQ ID NO: 2346978 - RNA, 19 nt, Human
uuuucuccucccaggaacu

SEQ ID NO: 2346979 - RNA, 14 nt, Human
uuuucuccucccag

SEQ ID NO: 2346980 - RNA, 13 nt, Human
uuuucuccuccca

SEQ ID NO: 2346981 - RNA, 14 nt, Human
uuuucucuaggaaa

SEQ ID NO: 2346982 - RNA, 17 nt, Human
uuuucugaauaacauuu

SEQ ID NO: 2346983 - RNA, 16 nt, Human
uuuucucuaggaaaua

SEQ ID NO: 2346984 - RNA, 21 nt, Human
uuuucuggagguugauaacuu

SEQ ID NO: 2346985 - RNA, 15 nt, Human
uuuucugagcgauua

SEQ ID NO: 2346986 - RNA, 18 nt, Human
uuuucuggaauguaauca

SEQ ID NO: 2346987 - RNA, 23 nt, Human
uuuucuggagguugauaacuuug

SEQ ID NO: 2346988 - RNA, 10 nt, Human
uuuucugagc

SEQ ID NO: 2346989 - RNA, 12 nt, Human
uuuucugagccc

SEQ ID NO: 2346990 - RNA, 16 nt, Human
uuuucugagcccgggc

SEQ ID NO: 2346991 - RNA, 22 nt, Human
uuuucugagcccgggcugccug

SEQ ID NO: 2346992 - RNA, 18 nt, Human
uuuucugagaaagacuau

SEQ ID NO: 2346993 - RNA, 15 nt, Human
uuuucugagaaagac

SEQ ID NO: 2346994 - RNA, 18 nt, Human
uuuuaggucucuuccccu

SEQ ID NO: 2346995 - RNA, 16 nt, Human
uuuuagguguugauuu

SEQ ID NO: 2346996 - RNA, 19 nt, Human
uuuuagguguugauuuucu

SEQ ID NO: 2346997 - RNA, 22 nt, Human
uuuuagguguugauuuucuguu

SEQ ID NO: 2346998 - RNA, 20 nt, Human
uuuuaggccaaaaaaaugua

SEQ ID NO: 2346999 - RNA, 18 nt, Human
uuuuaggcagggauuuga

SEQ ID NO: 2347000 - RNA, 19 nt, Human
uuuuaggcagggauuugag

SEQ ID NO: 2347001 - RNA, 14 nt, Human
uuuuauuaaugcac

SEQ ID NO: 2347002 - RNA, 19 nt, Human
uuuuauuaaugcacuuucu

SEQ ID NO: 2347003 - RNA, 13 nt, Human
uuuuauuaugcau

SEQ ID NO: 2347004 - RNA, 20 nt, Human
uuuuauuguuuaaagcaacu

SEQ ID NO: 2347005 - RNA, 12 nt, Human
uuuuauuguuuu

SEQ ID NO: 2347006 - RNA, 14 nt, Human
uuuuauuguuuuca

SEQ ID NO: 2347007 - RNA, 14 nt, Human
uuuucaguuuucag

SEQ ID NO: 2347008 - RNA, 12 nt, Human
uuuucaguuuuc

SEQ ID NO: 2347009 - RNA, 20 nt, Human
uuuucaguuucaauucagug

SEQ ID NO: 2347010 - RNA, 12 nt, Human
uuuucauaauaa

SEQ ID NO: 2347011 - RNA, 18 nt, Human
uuuucauacuuuuaccuu

SEQ ID NO: 2347012 - RNA, 21 nt, Human
uuuucauagauugagaaguuu

SEQ ID NO: 2347013 - RNA, 13 nt, Human
uuuucauauugug

SEQ ID NO: 2347014 - RNA, 14 nt, Human
uuuucauauugugc

SEQ ID NO: 2347015 - RNA, 16 nt, Human
uuuucauauugugcca

SEQ ID NO: 2347016 - RNA, 11 nt, Human
uuuuauuuuau

SEQ ID NO: 2347017 - RNA, 15 nt, Human
uuuuauuuauuuuau

SEQ ID NO: 2347018 - RNA, 15 nt, Human
uuuuauuugcaugug

SEQ ID NO: 2347019 - RNA, 15 nt, Human
uuuuauuugacaaaa

SEQ ID NO: 2347020 - RNA, 16 nt, Human
uuuuauuuuacuuuua

SEQ ID NO: 2347021 - RNA, 23 nt, Human
auuccaacaaaggguuuuaaugu

SEQ ID NO: 2347022 - RNA, 18 nt, Human
auuccaacaaaggguuuu

SEQ ID NO: 2347023 - RNA, 19 nt, Human
auuccaacaaaggguuuua

SEQ ID NO: 2347024 - RNA, 15 nt, Human
auuccaacaaagggu

SEQ ID NO: 2347025 - RNA, 20 nt, Human
auuccaacagcucaagucuu

SEQ ID NO: 2347026 - RNA, 14 nt, Human
auuccaacagcuca

SEQ ID NO: 2347027 - RNA, 14 nt, Human
auuccaacagugag

SEQ ID NO: 2347028 - RNA, 15 nt, Human
auuccaacagugagu

SEQ ID NO: 2347029 - RNA, 22 nt, Human
auuccaagacaugucuguucua

SEQ ID NO: 2347030 - RNA, 13 nt, Human
auuccaagacagu

SEQ ID NO: 2347031 - RNA, 17 nt, Human
auuccagccccucuggu

SEQ ID NO: 2347032 - RNA, 17 nt, Human
auuccaaccccaacucc

SEQ ID NO: 2347033 - RNA, 11 nt, Human
auuccaaccuu

SEQ ID NO: 2347034 - RNA, 15 nt, Human
auuccaaccccaacu

SEQ ID NO: 2347035 - RNA, 16 nt, Human
auuccaaccccaacuc

SEQ ID NO: 2347036 - RNA, 18 nt, Human
auuccaugaaucgcuucu

SEQ ID NO: 2347037 - RNA, 19 nt, Human
auuccaugaaucgcuucuc

SEQ ID NO: 2347038 - RNA, 12 nt, Human
auuccaugaauc

SEQ ID NO: 2347039 - RNA, 18 nt, Human
auuccauccauauacuuu

SEQ ID NO: 2347040 - RNA, 15 nt, Human
auuccaugaaucgcu

SEQ ID NO: 2347041 - RNA, 11 nt, Human
auuccauccuu

SEQ ID NO: 2347042 - RNA, 13 nt, Human
auuccauauuuau

SEQ ID NO: 2347043 - RNA, 14 nt, Human
auuccauccauaua

SEQ ID NO: 2347044 - RNA, 17 nt, Human
auuccauauucauguaa

SEQ ID NO: 2347045 - RNA, 18 nt, Human
auuccauauucauguaaa

SEQ ID NO: 2347046 - RNA, 17 nt, Human
auuccauauuuauucaa

SEQ ID NO: 2347047 - RNA, 14 nt, Human
auuccaagacagua

SEQ ID NO: 2347048 - RNA, 15 nt, Human
auuccagcuccuccg

SEQ ID NO: 2347049 - RNA, 16 nt, Human
auuccauauucaugua

SEQ ID NO: 2347050 - RNA, 22 nt, Human
auucccuaucuuuuaguuuuag

SEQ ID NO: 2347051 - RNA, 21 nt, Human
auucccuaucuuuuaguuuua

SEQ ID NO: 2347052 - RNA, 21 nt, Human
auuccaugaaucgcuucucuu

SEQ ID NO: 2347053 - RNA, 22 nt, Human
auucccaagcucuagugggaag

SEQ ID NO: 2347054 - RNA, 16 nt, Human
auucccaagcucugcu

SEQ ID NO: 2347055 - RNA, 14 nt, Human
auucccaagcucug

SEQ ID NO: 2347056 - RNA, 15 nt, Human
auucccaagcucugc

SEQ ID NO: 2347057 - RNA, 13 nt, Human
auucccugccugg

SEQ ID NO: 2347058 - RNA, 20 nt, Human
auucccugagucaccaggaa

SEQ ID NO: 2347059 - RNA, 19 nt, Human
auucccugagucaccagga

SEQ ID NO: 2347060 - RNA, 22 nt, Human
auucccucucucugacucucaa

SEQ ID NO: 2347061 - RNA, 19 nt, Human
auucccucucucugacucu

SEQ ID NO: 2347062 - RNA, 20 nt, Human
auucccucucucugacucuc

SEQ ID NO: 2347063 - RNA, 19 nt, Human
auucccuggccuuucauau

SEQ ID NO: 2347064 - RNA, 13 nt, Human
auucccuggccuu

SEQ ID NO: 2347065 - RNA, 14 nt, Human
auucccuccugcua

SEQ ID NO: 2347066 - RNA, 21 nt, Human
auucccuccugcuacucuguu

SEQ ID NO: 2347067 - RNA, 13 nt, Human
auucccucucucu

SEQ ID NO: 2347068 - RNA, 14 nt, Human
auucccucucucug

SEQ ID NO: 2347069 - RNA, 15 nt, Human
auucccucucucuga

SEQ ID NO: 2347070 - RNA, 16 nt, Human
auucccucucucugac

SEQ ID NO: 2347071 - RNA, 21 nt, Human
auucagauauauuuuucacag

SEQ ID NO: 2347072 - RNA, 18 nt, Human
auucagauauauuuuuca

SEQ ID NO: 2347073 - RNA, 20 nt, Human
auucagguauguugccuuua

SEQ ID NO: 2347074 - RNA, 20 nt, Human
auucaggaagcucagggccu

SEQ ID NO: 2347075 - RNA, 17 nt, Human
auucaggaagcucaggg

SEQ ID NO: 2347076 - RNA, 19 nt, Human
auucaggaagcucagggcc

SEQ ID NO: 2347077 - RNA, 18 nt, Human
auucaguccuaagaaaga

SEQ ID NO: 2347078 - RNA, 15 nt, Human
auucagugagggucu

SEQ ID NO: 2347079 - RNA, 23 nt, Human
auucagguauguugccuuuaugg

SEQ ID NO: 2347080 - RNA, 19 nt, Human
auucaguaauaacucuacc

SEQ ID NO: 2347081 - RNA, 15 nt, Human
auucaguaauaacuc

SEQ ID NO: 2347082 - RNA, 17 nt, Human
auucagaguugaugguu

SEQ ID NO: 2347083 - RNA, 14 nt, Human
auucaggaagcuca

SEQ ID NO: 2347084 - RNA, 13 nt, Human
auuauauagguug

SEQ ID NO: 2347085 - RNA, 20 nt, Human
auuauauagguugugcaaau

SEQ ID NO: 2347086 - RNA, 23 nt, Human
auuauauagguugugcaaauuaa

SEQ ID NO: 2347087 - RNA, 14 nt, Human
auucagacaggcaa

SEQ ID NO: 2347088 - RNA, 13 nt, Human
auucagacaggca

SEQ ID NO: 2347089 - RNA, 14 nt, Human
auucagagagcagc

SEQ ID NO: 2347090 - RNA, 20 nt, Human
auucucccagguaccagcug

SEQ ID NO: 2347091 - RNA, 21 nt, Human
auucucccagguaccagcugc

SEQ ID NO: 2347092 - RNA, 22 nt, Human
auucucccagguaccagcugcg

SEQ ID NO: 2347093 - RNA, 24 nt, Human
auucucccagguaccagcugcgcu

SEQ ID NO: 2347094 - RNA, 21 nt, Human
auucuccaccugccagggaca

SEQ ID NO: 2347095 - RNA, 11 nt, Human
auucuccugcc

SEQ ID NO: 2347096 - RNA, 12 nt, Human
auucuccugccu

SEQ ID NO: 2347097 - RNA, 14 nt, Human
auucuccugccuca

SEQ ID NO: 2347098 - RNA, 13 nt, Human
auucuccugccuc

SEQ ID NO: 2347099 - RNA, 18 nt, Human
auucuccugccucagccu

SEQ ID NO: 2347100 - RNA, 11 nt, Human
auucuccugga

SEQ ID NO: 2347101 - RNA, 22 nt, Human
auucuccugccuguagcaguga

SEQ ID NO: 2347102 - RNA, 13 nt, Human
auucuccuucagc

SEQ ID NO: 2347103 - RNA, 13 nt, Human
auucuccugugcu

SEQ ID NO: 2347104 - RNA, 14 nt, Human
auucuccugugcua

SEQ ID NO: 2347105 - RNA, 14 nt, Human
auucuccuucagcc

SEQ ID NO: 2347106 - RNA, 15 nt, Human
auucuccuucagccc

SEQ ID NO: 2347107 - RNA, 16 nt, Human
auucuccuuguguuac

SEQ ID NO: 2347108 - RNA, 16 nt, Human
auucuccuucagcccu

SEQ ID NO: 2347109 - RNA, 17 nt, Human
auucuccuucagcccuc

SEQ ID NO: 2347110 - RNA, 18 nt, Human
auucuccuucagcccuca

SEQ ID NO: 2347111 - RNA, 22 nt, Human
auucuccuucagcccucacccc

SEQ ID NO: 2347112 - RNA, 20 nt, Human
auucuccugccucagccucc

SEQ ID NO: 2347113 - RNA, 19 nt, Human
auucuccugccucagccuc

SEQ ID NO: 2347114 - RNA, 15 nt, Human
auucuccugccucag

SEQ ID NO: 2347115 - RNA, 17 nt, Human
auucuccugccucagcc

SEQ ID NO: 2347116 - RNA, 15 nt, Human
auucucaaacacagu

SEQ ID NO: 2347117 - RNA, 18 nt, Human
auucuauuuucauuuucu

SEQ ID NO: 2347118 - RNA, 21 nt, Human
auucuauuuucauuuucugca

SEQ ID NO: 2347119 - RNA, 15 nt, Human
auucucaagcccugc

SEQ ID NO: 2347120 - RNA, 15 nt, Human
auucuauuugcuggg

SEQ ID NO: 2347121 - RNA, 18 nt, Human
auucuauuugcugggcuu

SEQ ID NO: 2347122 - RNA, 22 nt, Human
auucuauuuauauguacaugag

SEQ ID NO: 2347123 - RNA, 16 nt, Human
auucucaagcccugca

SEQ ID NO: 2347124 - RNA, 21 nt, Human
auucucaaccuaccaccccuu

SEQ ID NO: 2347125 - RNA, 16 nt, Human
auucucagggucucug

SEQ ID NO: 2347126 - RNA, 17 nt, Human
auucucagggucucugc

SEQ ID NO: 2347127 - RNA, 18 nt, Human
auucucagggucucugcu

SEQ ID NO: 2347128 - RNA, 22 nt, Human
auucucagggucucugcugccg

SEQ ID NO: 2347129 - RNA, 21 nt, Human
auucucagggucucugcugcc

SEQ ID NO: 2347130 - RNA, 19 nt, Human
auucucagggucucugcug

SEQ ID NO: 2347131 - RNA, 20 nt, Human
auucucagggucucugcugc

SEQ ID NO: 2347132 - RNA, 15 nt, Human
auucucaugccucag

SEQ ID NO: 2347133 - RNA, 14 nt, Human
auucucaugccuca

SEQ ID NO: 2347134 - RNA, 19 nt, Human
auucuccaccugccaggga

SEQ ID NO: 2347135 - RNA, 20 nt, Human
auucuccaccugccagggac

SEQ ID NO: 2347136 - RNA, 15 nt, Human
auucuaaaugaaugu

SEQ ID NO: 2347137 - RNA, 17 nt, Human
auucuaaaugaauguuu

SEQ ID NO: 2347138 - RNA, 18 nt, Human
auucuaaaugaauguuua

SEQ ID NO: 2347139 - RNA, 17 nt, Human
auucuaguuuugucaaa

SEQ ID NO: 2347140 - RNA, 15 nt, Human
auucuauaaggccau

SEQ ID NO: 2347141 - RNA, 18 nt, Human
auucuauaaguuuuaugu

SEQ ID NO: 2347142 - RNA, 20 nt, Human
auucuauuuauauguacaug

SEQ ID NO: 2347143 - RNA, 14 nt, Human
auucuauuaacuuu

SEQ ID NO: 2347144 - RNA, 22 nt, Human
auucuauugcaguuauagaaaa

SEQ ID NO: 2347145 - RNA, 13 nt, Human
auucuauaugaau

SEQ ID NO: 2347146 - RNA, 14 nt, Human
auucuauaugaauu

SEQ ID NO: 2347147 - RNA, 15 nt, Human
auucuaucuauuccu

SEQ ID NO: 2347148 - RNA, 23 nt, Human
auucuauaugaauuuaaauauaa

SEQ ID NO: 2347149 - RNA, 15 nt, Human
auucuauaugaauuu

SEQ ID NO: 2347150 - RNA, 16 nt, Human
auucuauaugaauuua

SEQ ID NO: 2347151 - RNA, 17 nt, Human
auucuauaugaauuuaa

SEQ ID NO: 2347152 - RNA, 19 nt, Human
auucuauaugaauuuaaau

SEQ ID NO: 2347153 - RNA, 12 nt, Human
auugaaaucuuu

SEQ ID NO: 2347154 - RNA, 18 nt, Human
auuguauuuauuccauau

SEQ ID NO: 2347155 - RNA, 23 nt, Human
auugucauuccuguauucacccg

SEQ ID NO: 2347156 - RNA, 23 nt, Human
auuguauuuauucaauaaaguau

SEQ ID NO: 2347157 - RNA, 14 nt, Human
auuguauuuauucc

SEQ ID NO: 2347158 - RNA, 16 nt, Human
auuguauuuauucaau

SEQ ID NO: 2347159 - RNA, 18 nt, Human
auuguauuuauucaauaa

SEQ ID NO: 2347160 - RNA, 19 nt, Human
auuguauuuauucaauaaa

SEQ ID NO: 2347161 - RNA, 20 nt, Human
auuguauuuauucaauaaag

SEQ ID NO: 2347162 - RNA, 23 nt, Human
auuguauuaggugucauuuccau

SEQ ID NO: 2347163 - RNA, 11 nt, Human
auuguauuuau

SEQ ID NO: 2347164 - RNA, 14 nt, Human
auuguauuuauuca

SEQ ID NO: 2347165 - RNA, 13 nt, Human
auuguauucagag

SEQ ID NO: 2347166 - RNA, 17 nt, Human
auuggucuccucucagc

SEQ ID NO: 2347167 - RNA, 14 nt, Human
auuggucuccucuc

SEQ ID NO: 2347168 - RNA, 12 nt, Human
auugguguugac

SEQ ID NO: 2347169 - RNA, 13 nt, Human
auugucauuuaua

SEQ ID NO: 2347170 - RNA, 18 nt, Human
auuguccaauccuauguu

SEQ ID NO: 2347171 - RNA, 17 nt, Human
auuguccccgacccuug

SEQ ID NO: 2347172 - RNA, 19 nt, Human
auuguccccgacccuugcc

SEQ ID NO: 2347173 - RNA, 20 nt, Human
auuguccccgacccuugccg

SEQ ID NO: 2347174 - RNA, 17 nt, Human
auugugaccaaguuaua

SEQ ID NO: 2347175 - RNA, 21 nt, Human
auugugaucuaucaauaguca

SEQ ID NO: 2347176 - RNA, 21 nt, Human
auugugaugguucguucuguu

SEQ ID NO: 2347177 - RNA, 16 nt, Human
auugugagccaccacg

SEQ ID NO: 2347178 - RNA, 23 nt, Human
auugugaucagaccauaauguua

SEQ ID NO: 2347179 - RNA, 15 nt, Human
auugugaaguacaua

SEQ ID NO: 2347180 - RNA, 14 nt, Human
auugugaaguacau

SEQ ID NO: 2347181 - RNA, 16 nt, Human
auugugaacugacagg

SEQ ID NO: 2347182 - RNA, 15 nt, Human
auugugaccaaguua

SEQ ID NO: 2347183 - RNA, 16 nt, Human
auugugaccaaguuau

SEQ ID NO: 2347184 - RNA, 15 nt, Human
auugugauguguccu

SEQ ID NO: 2347185 - RNA, 18 nt, Human
auugugauucugccuuug

SEQ ID NO: 2347186 - RNA, 14 nt, Human
auugugaugugucc

SEQ ID NO: 2347187 - RNA, 13 nt, Human
auugugauguguc

SEQ ID NO: 2347188 - RNA, 19 nt, Human
auugugcacauacuugaga

SEQ ID NO: 2347189 - RNA, 16 nt, Human
auugugccaauaugua

SEQ ID NO: 2347190 - RNA, 17 nt, Human
auugugccaauauguau

SEQ ID NO: 2347191 - RNA, 19 nt, Human
auugugccaauauguauug

SEQ ID NO: 2347192 - RNA, 12 nt, Human
auuguggugcca

SEQ ID NO: 2347193 - RNA, 23 nt, Human
auugugauuugacuguuuuuacc

SEQ ID NO: 2347194 - RNA, 16 nt, Human
auugugauuugacugu

SEQ ID NO: 2347195 - RNA, 17 nt, Human
auugugauuugacuguu

SEQ ID NO: 2347196 - RNA, 18 nt, Human
auugugauuugacuguuu

SEQ ID NO: 2347197 - RNA, 19 nt, Human
auugugauuugacuguuuu

SEQ ID NO: 2347198 - RNA, 14 nt, Human
auugugauuucccg

SEQ ID NO: 2347199 - RNA, 16 nt, Human
auugugauuucccgug

SEQ ID NO: 2347200 - RNA, 23 nt, Human
auugugauuucccguggccccag

SEQ ID NO: 2347201 - RNA, 12 nt, Human
auugugauuuga

SEQ ID NO: 2347202 - RNA, 14 nt, Human
auugugauuugacu

SEQ ID NO: 2347203 - RNA, 14 nt, Human
auuguggugccaca

SEQ ID NO: 2347204 - RNA, 23 nt, Human
auuguguaacaauuuuaaugcua

SEQ ID NO: 2347205 - RNA, 14 nt, Human
auugugucucuugg

SEQ ID NO: 2347206 - RNA, 15 nt, Human
auuguguauauucau

SEQ ID NO: 2347207 - RNA, 18 nt, Human
auugugucucuugguccu

SEQ ID NO: 2347208 - RNA, 14 nt, Human
auuuaaaacagaca

SEQ ID NO: 2347209 - RNA, 17 nt, Human
auucuggauaaagccac

SEQ ID NO: 2347210 - RNA, 21 nt, Human
auucuggauaaagccacugaa

SEQ ID NO: 2347211 - RNA, 18 nt, Human
auucugcccaaaaauaug

SEQ ID NO: 2347212 - RNA, 19 nt, Human
auucugcccaaaaauaugg

SEQ ID NO: 2347213 - RNA, 14 nt, Human
auucugcugucuca

SEQ ID NO: 2347214 - RNA, 23 nt, Human
auucuggccuagucccuuccaca

SEQ ID NO: 2347215 - RNA, 21 nt, Human
auucuggauuuugucaagcag

SEQ ID NO: 2347216 - RNA, 22 nt, Human
auucuggauggauuugaagcaa

SEQ ID NO: 2347217 - RNA, 17 nt, Human
auucuggccuagucccu

SEQ ID NO: 2347218 - RNA, 16 nt, Human
auucugguuccagggu

SEQ ID NO: 2347219 - RNA, 23 nt, Human
auucugccaggcccccaagccug

SEQ ID NO: 2347220 - RNA, 16 nt, Human
auucugcccaaaaaua

SEQ ID NO: 2347221 - RNA, 14 nt, Human
auucugccaggccc

SEQ ID NO: 2347222 - RNA, 22 nt, Human
auucugcagcaugaccugugac

SEQ ID NO: 2347223 - RNA, 23 nt, Human
auucugcaguaaaucuuuuacaa

SEQ ID NO: 2347224 - RNA, 21 nt, Human
auucugcaguaaaucuuuuac

SEQ ID NO: 2347225 - RNA, 20 nt, Human
auucugcaguaaaucuuuua

SEQ ID NO: 2347226 - RNA, 18 nt, Human
auucugcaguaaaucuuu

SEQ ID NO: 2347227 - RNA, 17 nt, Human
auucugcaguaaaucuu

SEQ ID NO: 2347228 - RNA, 22 nt, Human
auucugcaagcacaucugcauu

SEQ ID NO: 2347229 - RNA, 19 nt, Human
auucugcaagcacaucugc

SEQ ID NO: 2347230 - RNA, 15 nt, Human
auucugcagcaugac

SEQ ID NO: 2347231 - RNA, 19 nt, Human
auucugauuuggaaaaaga

SEQ ID NO: 2347232 - RNA, 13 nt, Human
auucugcagcaug

SEQ ID NO: 2347233 - RNA, 23 nt, Human
auucuccuucagcccucaccccu

SEQ ID NO: 2347234 - RNA, 19 nt, Human
auucugucgccuuagcaug

SEQ ID NO: 2347235 - RNA, 20 nt, Human
auucugucgccuuagcaugu

SEQ ID NO: 2347236 - RNA, 21 nt, Human
auucugucgccuuagcauguu

SEQ ID NO: 2347237 - RNA, 18 nt, Human
auucugucgccuuagcau

SEQ ID NO: 2347238 - RNA, 19 nt, Human
auucugguuccaggguccc

SEQ ID NO: 2347239 - RNA, 21 nt, Human
auucuguguguuuucauaaua

SEQ ID NO: 2347240 - RNA, 17 nt, Human
auucuguguguuuucau

SEQ ID NO: 2347241 - RNA, 14 nt, Human
auucugucuugaag

SEQ ID NO: 2347242 - RNA, 17 nt, Human
auucuguggaacaagcc

SEQ ID NO: 2347243 - RNA, 24 nt, Human
auucugucucuggauuauauuaug

SEQ ID NO: 2347244 - RNA, 20 nt, Human
auucuuaaaauauauuucag

SEQ ID NO: 2347245 - RNA, 23 nt, Human
auucuuaaaauauauuucagaua

SEQ ID NO: 2347246 - RNA, 23 nt, Human
auucuguguguuuucauaauaaa

SEQ ID NO: 2347247 - RNA, 22 nt, Human
auucuguguguuuucauaauaa

SEQ ID NO: 2347248 - RNA, 12 nt, Human
auucuguuucuu

SEQ ID NO: 2347249 - RNA, 18 nt, Human
auucuguuuuagguuaaa

SEQ ID NO: 2347250 - RNA, 13 nt, Human
auucuuuuguaau

SEQ ID NO: 2347251 - RNA, 16 nt, Human
auucuuuuguaauuua

SEQ ID NO: 2347252 - RNA, 17 nt, Human
auucuuuuguaauuuaa

SEQ ID NO: 2347253 - RNA, 14 nt, Human
auucuuuuuaaagu

SEQ ID NO: 2347254 - RNA, 22 nt, Human
auucuuuuaaaagacaagacuu

SEQ ID NO: 2347255 - RNA, 18 nt, Human
auucuuuuaaaagacaag

SEQ ID NO: 2347256 - RNA, 22 nt, Human
auucuuugauguuaacacauuu

SEQ ID NO: 2347257 - RNA, 13 nt, Human
auucuuuuaaaag

SEQ ID NO: 2347258 - RNA, 21 nt, Human
auucuucucuuccuuuuauca

SEQ ID NO: 2347259 - RNA, 16 nt, Human
auucuuugauguuaac

SEQ ID NO: 2347260 - RNA, 17 nt, Human
auucuuugauguuaaca

SEQ ID NO: 2347261 - RNA, 18 nt, Human
auucuuugauguuaacac

SEQ ID NO: 2347262 - RNA, 19 nt, Human
auucuuugauguuaacaca

SEQ ID NO: 2347263 - RNA, 20 nt, Human
auucuuugauguuaacacau

SEQ ID NO: 2347264 - RNA, 21 nt, Human
auucuuugauguuaacacauu

SEQ ID NO: 2347265 - RNA, 13 nt, Human
auucuuccucccu

SEQ ID NO: 2347266 - RNA, 22 nt, Human
auucuuccucccucccucuuuc

SEQ ID NO: 2347267 - RNA, 13 nt, Human
auucuucuccacu

SEQ ID NO: 2347268 - RNA, 15 nt, Human
auucuucucuagcug

SEQ ID NO: 2347269 - RNA, 15 nt, Human
auucuucucuuccuu

SEQ ID NO: 2347270 - RNA, 22 nt, Human
auucuuauguagcaggaaauaa

SEQ ID NO: 2347271 - RNA, 20 nt, Human
auucuuauaaauaugaagcu

SEQ ID NO: 2347272 - RNA, 14 nt, Human
auucuuaugcuuau

SEQ ID NO: 2347273 - RNA, 13 nt, Human
auucuuauuuaau

SEQ ID NO: 2347274 - RNA, 12 nt, Human
auucuuauaaau

SEQ ID NO: 2347275 - RNA, 19 nt, Human
auucuuaaaguacuuguua

SEQ ID NO: 2347276 - RNA, 14 nt, Human
auucuuauaaauau

SEQ ID NO: 2347277 - RNA, 15 nt, Human
auucuuauaaauaug

SEQ ID NO: 2347278 - RNA, 16 nt, Human
auucuuauaaauauga

SEQ ID NO: 2347279 - RNA, 18 nt, Human
auucuuauaaauaugaag

SEQ ID NO: 2347280 - RNA, 17 nt, Human
auucuuacauguuuucu

SEQ ID NO: 2347281 - RNA, 15 nt, Human
auucuuacauguuuu

SEQ ID NO: 2347282 - RNA, 17 nt, Human
auucuuauuucaugaaa

SEQ ID NO: 2347283 - RNA, 18 nt, Human
auucuuauuuaaugaaag

SEQ ID NO: 2347284 - RNA, 14 nt, Human
auucuuauuuaaug

SEQ ID NO: 2347285 - RNA, 17 nt, Human
auugggcaagugauuga

SEQ ID NO: 2347286 - RNA, 21 nt, Human
auugggagcuugggaauggau

SEQ ID NO: 2347287 - RNA, 18 nt, Human
auugggcaagugauugaa

SEQ ID NO: 2347288 - RNA, 19 nt, Human
auuggggaagacuguggcu

SEQ ID NO: 2347289 - RNA, 22 nt, Human
auugggcagcgcccuuccucuc

SEQ ID NO: 2347290 - RNA, 16 nt, Human
auugggccccugccag

SEQ ID NO: 2347291 - RNA, 15 nt, Human
auugggccccugcca

SEQ ID NO: 2347292 - RNA, 14 nt, Human
auugggcagcgccc

SEQ ID NO: 2347293 - RNA, 19 nt, Human
auugggcagcgcccuuccu

SEQ ID NO: 2347294 - RNA, 20 nt, Human
auugggcagcgcccuuccuc

SEQ ID NO: 2347295 - RNA, 19 nt, Human
auugggggcuggugccagc

SEQ ID NO: 2347296 - RNA, 22 nt, Human
auugggggcuggugccagccuu

SEQ ID NO: 2347297 - RNA, 15 nt, Human
auuggggucccucua

SEQ ID NO: 2347298 - RNA, 20 nt, Human
auuggguggggggcuucaua

SEQ ID NO: 2347299 - RNA, 19 nt, Human
auuggguccugggucuuuc

SEQ ID NO: 2347300 - RNA, 22 nt, Human
auuggguggggggcuucauaca

SEQ ID NO: 2347301 - RNA, 18 nt, Human
auugggugggcaggaaaa

SEQ ID NO: 2347302 - RNA, 21 nt, Human
auuggguggggggcuucauac

SEQ ID NO: 2347303 - RNA, 21 nt, Human
auugacauugcuuuacuguca

SEQ ID NO: 2347304 - RNA, 18 nt, Human
auugacccacaagaaaug

SEQ ID NO: 2347305 - RNA, 14 nt, Human
auugacauguacag

SEQ ID NO: 2347306 - RNA, 18 nt, Human
auugaaaggcauucucug

SEQ ID NO: 2347307 - RNA, 18 nt, Human
auugaaagagaaccaguu

SEQ ID NO: 2347308 - RNA, 15 nt, Human
auugacauguacaga

SEQ ID NO: 2347309 - RNA, 23 nt, Human
auugacauguacagagaacuaac

SEQ ID NO: 2347310 - RNA, 17 nt, Human
auugacauguacagaga

SEQ ID NO: 2347311 - RNA, 15 nt, Human
auugaaagagaacca

SEQ ID NO: 2347312 - RNA, 21 nt, Human
auugaaaauaguaaaugcuuu

SEQ ID NO: 2347313 - RNA, 13 nt, Human
auugaaaaggaca

SEQ ID NO: 2347314 - RNA, 15 nt, Human
auugaaaaaucacca

SEQ ID NO: 2347315 - RNA, 18 nt, Human
auugaaaacuuuucucag

SEQ ID NO: 2347316 - RNA, 16 nt, Human
auucuuuuuaaaguau

SEQ ID NO: 2347317 - RNA, 16 nt, Human
auuuaguuuuuguucu

SEQ ID NO: 2347318 - RNA, 20 nt, Human
auuuaguuuuuguaauuuau

SEQ ID NO: 2347319 - RNA, 19 nt, Human
auuuaguuuuuguaauuua

SEQ ID NO: 2347320 - RNA, 22 nt, Human
auuuaguuugauuauucagugu

SEQ ID NO: 2347321 - RNA, 15 nt, Human
auuuaguuugauuau

SEQ ID NO: 2347322 - RNA, 17 nt, Human
auuuauaaaaauaaaaa

SEQ ID NO: 2347323 - RNA, 22 nt, Human
auuuauaaaaauaaaaaacacu

SEQ ID NO: 2347324 - RNA, 23 nt, Human
auuuauuaagauggauucucaga

SEQ ID NO: 2347325 - RNA, 22 nt, Human
auuuauuaagauggauucucag

SEQ ID NO: 2347326 - RNA, 21 nt, Human
auuuauuaagauggauucuca

SEQ ID NO: 2347327 - RNA, 16 nt, Human
auuuauuaagauggau

SEQ ID NO: 2347328 - RNA, 15 nt, Human
auuuauuaagaugga

SEQ ID NO: 2347329 - RNA, 19 nt, Human
auuuaguuuuuguucuuaa

SEQ ID NO: 2347330 - RNA, 18 nt, Human
auuuagcaaauaauuucc

SEQ ID NO: 2347331 - RNA, 13 nt, Human
auuuagcaaauaa

SEQ ID NO: 2347332 - RNA, 22 nt, Human
auuuagcaugacaagccccagg

SEQ ID NO: 2347333 - RNA, 23 nt, Human
auuuagcacauacuacacauuca

SEQ ID NO: 2347334 - RNA, 18 nt, Human
auuuagauuguuaaaaua

SEQ ID NO: 2347335 - RNA, 17 nt, Human
auuuagauugaaaacuu

SEQ ID NO: 2347336 - RNA, 22 nt, Human
auuuagagaugaauuaaauuua

SEQ ID NO: 2347337 - RNA, 23 nt, Human
auuuagagaugaauuaaauuuaa

SEQ ID NO: 2347338 - RNA, 17 nt, Human
auuuagagaugaauuaa

SEQ ID NO: 2347339 - RNA, 16 nt, Human
auuuagagaggaaaag

SEQ ID NO: 2347340 - RNA, 16 nt, Human
auuuagacaagagaug

SEQ ID NO: 2347341 - RNA, 20 nt, Human
auuuagagaacuguggccgu

SEQ ID NO: 2347342 - RNA, 13 nt, Human
auuuagauguaua

SEQ ID NO: 2347343 - RNA, 20 nt, Human
auuuagugaaagcuagagau

SEQ ID NO: 2347344 - RNA, 14 nt, Human
auuuagucauguga

SEQ ID NO: 2347345 - RNA, 15 nt, Human
auuuagugaacuacg

SEQ ID NO: 2347346 - RNA, 13 nt, Human
auuuaguguucau

SEQ ID NO: 2347347 - RNA, 20 nt, Human
auuuaguaucuuuuuauuca

SEQ ID NO: 2347348 - RNA, 16 nt, Human
auuuagucaugugacc

SEQ ID NO: 2347349 - RNA, 13 nt, Human
auuuaaaaaauaa

SEQ ID NO: 2347350 - RNA, 15 nt, Human
auuuaaaaaauaacu

SEQ ID NO: 2347351 - RNA, 16 nt, Human
auuuaaaaauaagaaa

SEQ ID NO: 2347352 - RNA, 14 nt, Human
auuuaaaaauauuu

SEQ ID NO: 2347353 - RNA, 18 nt, Human
auuuaaaaauauuuuugg

SEQ ID NO: 2347354 - RNA, 21 nt, Human
auuuacugagcuucucuguga

SEQ ID NO: 2347355 - RNA, 14 nt, Human
auuuaacagaaaug

SEQ ID NO: 2347356 - RNA, 12 nt, Human
auuuaacagaaa

SEQ ID NO: 2347357 - RNA, 19 nt, Human
auuuaaauuuuacccuuua

SEQ ID NO: 2347358 - RNA, 13 nt, Human
auuuaacaagauc

SEQ ID NO: 2347359 - RNA, 17 nt, Human
auuuaaauuuuuuuccu

SEQ ID NO: 2347360 - RNA, 21 nt, Human
auuuacugcuagucuuaagaa

SEQ ID NO: 2347361 - RNA, 17 nt, Human
auuuacuucuuauacau

SEQ ID NO: 2347362 - RNA, 16 nt, Human
auuuacuucuuauaca

SEQ ID NO: 2347363 - RNA, 14 nt, Human
auuuacuucuuaua

SEQ ID NO: 2347364 - RNA, 22 nt, Human
auuuagaaagaagcccaauauu

SEQ ID NO: 2347365 - RNA, 14 nt, Human
auuuagaacuguau

SEQ ID NO: 2347366 - RNA, 15 nt, Human
auuuagaaauauaau

SEQ ID NO: 2347367 - RNA, 14 nt, Human
auuuagacaagaga

SEQ ID NO: 2347368 - RNA, 20 nt, Human
auuuagacaagagaugggaa

SEQ ID NO: 2347369 - RNA, 14 nt, Human
auuuauucugcuca

SEQ ID NO: 2347370 - RNA, 23 nt, Human
auuucccuugaaauuuuaaacua

SEQ ID NO: 2347371 - RNA, 16 nt, Human
auuuccguuaaaauac

SEQ ID NO: 2347372 - RNA, 15 nt, Human
auuuccguuaaaaua

SEQ ID NO: 2347373 - RNA, 23 nt, Human
auuucuagaacaucccugccagc

SEQ ID NO: 2347374 - RNA, 21 nt, Human
auuucuagaacaucccugcca

SEQ ID NO: 2347375 - RNA, 18 nt, Human
auuucuacugugacugau

SEQ ID NO: 2347376 - RNA, 18 nt, Human
auuucuacuuugaaguca

SEQ ID NO: 2347377 - RNA, 16 nt, Human
auuucuacugugacug

SEQ ID NO: 2347378 - RNA, 17 nt, Human
auuucuacugugacuga

SEQ ID NO: 2347379 - RNA, 21 nt, Human
auuucuacucuuaaguuucuc

SEQ ID NO: 2347380 - RNA, 20 nt, Human
auuucuacucuuaaguuucu

SEQ ID NO: 2347381 - RNA, 15 nt, Human
auuucuacugugacu

SEQ ID NO: 2347382 - RNA, 18 nt, Human
auuucuaccauuucagag

SEQ ID NO: 2347383 - RNA, 15 nt, Human
auuucuacucuccca

SEQ ID NO: 2347384 - RNA, 21 nt, Human
auuucuacucucccauggcuu

SEQ ID NO: 2347385 - RNA, 17 nt, Human
auuucuaccauuucaga

SEQ ID NO: 2347386 - RNA, 11 nt, Human
auuugaaauuu

SEQ ID NO: 2347387 - RNA, 16 nt, Human
auuugaagaacaugug

SEQ ID NO: 2347388 - RNA, 15 nt, Human
auuugaaauuuagcu

SEQ ID NO: 2347389 - RNA, 17 nt, Human
auuugaaaauaauuguu

SEQ ID NO: 2347390 - RNA, 18 nt, Human
auuugaaaauaauuguuc

SEQ ID NO: 2347391 - RNA, 14 nt, Human
auuugaaauauuga

SEQ ID NO: 2347392 - RNA, 22 nt, Human
auuugaaaacauaaucugcaaa

SEQ ID NO: 2347393 - RNA, 21 nt, Human
auuucuuuuuuaaaugaagaa

SEQ ID NO: 2347394 - RNA, 14 nt, Human
auuugaaaauuuug

SEQ ID NO: 2347395 - RNA, 20 nt, Human
auuucuaggaagaauuuuaa

SEQ ID NO: 2347396 - RNA, 22 nt, Human
auuucuaggaagaauuuuaaaa

SEQ ID NO: 2347397 - RNA, 15 nt, Human
auuucuaggaagaau

SEQ ID NO: 2347398 - RNA, 16 nt, Human
auuucuaggaagaauu

SEQ ID NO: 2347399 - RNA, 17 nt, Human
auuucuaggaagaauuu

SEQ ID NO: 2347400 - RNA, 19 nt, Human
auuucuaggaagaauuuua

SEQ ID NO: 2347401 - RNA, 22 nt, Human
auuucuuuuuuaaaugaagaaa

SEQ ID NO: 2347402 - RNA, 18 nt, Human
auuucuuuuuuaaaugaa

SEQ ID NO: 2347403 - RNA, 13 nt, Human
auuucccaucugc

SEQ ID NO: 2347404 - RNA, 14 nt, Human
auuucccaucugca

SEQ ID NO: 2347405 - RNA, 15 nt, Human
auuucccaucugcac

SEQ ID NO: 2347406 - RNA, 17 nt, Human
auuuccagucuccacca

SEQ ID NO: 2347407 - RNA, 13 nt, Human
auuuccagucucc

SEQ ID NO: 2347408 - RNA, 22 nt, Human
auuuccauauaaauauuagaaa

SEQ ID NO: 2347409 - RNA, 15 nt, Human
auuuccccaacagug

SEQ ID NO: 2347410 - RNA, 16 nt, Human
auuuccccaacagugu

SEQ ID NO: 2347411 - RNA, 17 nt, Human
auuuccccaacagugug

SEQ ID NO: 2347412 - RNA, 18 nt, Human
auuuccccaacaguguga

SEQ ID NO: 2347413 - RNA, 19 nt, Human
auuuccccaacagugugaa

SEQ ID NO: 2347414 - RNA, 21 nt, Human
auuuccccaggggaaaaugaa

SEQ ID NO: 2347415 - RNA, 20 nt, Human
auuuccccaggggaaaauga

SEQ ID NO: 2347416 - RNA, 15 nt, Human
auuuccccagaccug

SEQ ID NO: 2347417 - RNA, 17 nt, Human
auuuccccaccccagcu

SEQ ID NO: 2347418 - RNA, 23 nt, Human
auuuccccagaccugagcucccc

SEQ ID NO: 2347419 - RNA, 21 nt, Human
auuucauuguaugauguguug

SEQ ID NO: 2347420 - RNA, 19 nt, Human
auuucauuuuuacccuuac

SEQ ID NO: 2347421 - RNA, 22 nt, Human
auuucauuugugccagaaugcu

SEQ ID NO: 2347422 - RNA, 17 nt, Human
auuuccagccaaagccu

SEQ ID NO: 2347423 - RNA, 10 nt, Human
auuuccagag

SEQ ID NO: 2347424 - RNA, 14 nt, Human
auuuccagccaggg

SEQ ID NO: 2347425 - RNA, 18 nt, Human
auuuccagccagggcugc

SEQ ID NO: 2347426 - RNA, 20 nt, Human
auuuccaguaccuuugucac

SEQ ID NO: 2347427 - RNA, 17 nt, Human
auuuccaguaccuuugu

SEQ ID NO: 2347428 - RNA, 13 nt, Human
auuuccaguaccu

SEQ ID NO: 2347429 - RNA, 17 nt, Human
auuuccagccagggcug

SEQ ID NO: 2347430 - RNA, 20 nt, Human
auuuccagugaaaucaguua

SEQ ID NO: 2347431 - RNA, 13 nt, Human
auuucaaaauaua

SEQ ID NO: 2347432 - RNA, 13 nt, Human
auuucaaaaugcu

SEQ ID NO: 2347433 - RNA, 21 nt, Human
auuucaaaaugcuuuuuauua

SEQ ID NO: 2347434 - RNA, 15 nt, Human
auuucaaaaugcuuu

SEQ ID NO: 2347435 - RNA, 14 nt, Human
auuucaaaaugcuu

SEQ ID NO: 2347436 - RNA, 19 nt, Human
auuuauuuuaauaauguuu

SEQ ID NO: 2347437 - RNA, 20 nt, Human
auuuauuuuaauaauguuuc

SEQ ID NO: 2347438 - RNA, 14 nt, Human
auuucauucuucuc

SEQ ID NO: 2347439 - RNA, 23 nt, Human
auuucaacaaguagcuaaagucu

SEQ ID NO: 2347440 - RNA, 16 nt, Human
auuucaaacggccuca

SEQ ID NO: 2347441 - RNA, 16 nt, Human
auuucaaaaugcuuuu

SEQ ID NO: 2347442 - RNA, 17 nt, Human
auuucaaauuggagcuu

SEQ ID NO: 2347443 - RNA, 18 nt, Human
auuucauuucaacuguuu

SEQ ID NO: 2347444 - RNA, 19 nt, Human
auuucauuguaugaugugu

SEQ ID NO: 2347445 - RNA, 20 nt, Human
auuucauuguaugauguguu

SEQ ID NO: 2347446 - RNA, 12 nt, Human
auuucauuguau

SEQ ID NO: 2347447 - RNA, 14 nt, Human
auuucauuguauga

SEQ ID NO: 2347448 - RNA, 15 nt, Human
auuucauuguaugau

SEQ ID NO: 2347449 - RNA, 17 nt, Human
auuucauuguaugaugu

SEQ ID NO: 2347450 - RNA, 12 nt, Human
auuucauuucuu

SEQ ID NO: 2347451 - RNA, 14 nt, Human
auuuauuauuuuca

SEQ ID NO: 2347452 - RNA, 19 nt, Human
auuuauuauuuauuuauua

SEQ ID NO: 2347453 - RNA, 14 nt, Human
auuuauucaagaaa

SEQ ID NO: 2347454 - RNA, 12 nt, Human
auuuauucaaga

SEQ ID NO: 2347455 - RNA, 21 nt, Human
auuuauuauuuucaccuguuu

SEQ ID NO: 2347456 - RNA, 13 nt, Human
auuuauuauuuau

SEQ ID NO: 2347457 - RNA, 11 nt, Human
auuuauuauuu

SEQ ID NO: 2347458 - RNA, 15 nt, Human
auuuauuaauugcuu

SEQ ID NO: 2347459 - RNA, 16 nt, Human
auuuauuauugaaauu

SEQ ID NO: 2347460 - RNA, 17 nt, Human
auuuauuauugaaauug

SEQ ID NO: 2347461 - RNA, 11 nt, Human
auuuauucaau

SEQ ID NO: 2347462 - RNA, 13 nt, Human
auuuauucaauaa

SEQ ID NO: 2347463 - RNA, 14 nt, Human
auuuauucaauaaa

SEQ ID NO: 2347464 - RNA, 15 nt, Human
auuuauucaauaaag

SEQ ID NO: 2347465 - RNA, 16 nt, Human
auuuauucaauaaagu

SEQ ID NO: 2347466 - RNA, 17 nt, Human
auuuauucaauaaagua

SEQ ID NO: 2347467 - RNA, 18 nt, Human
auuuauucaauaaaguau

SEQ ID NO: 2347468 - RNA, 21 nt, Human
auuuauucaauaaaguauuua

SEQ ID NO: 2347469 - RNA, 16 nt, Human
auuuauuuauuaagau

SEQ ID NO: 2347470 - RNA, 14 nt, Human
auuuauuuauuaag

SEQ ID NO: 2347471 - RNA, 13 nt, Human
auuuauuuauuau

SEQ ID NO: 2347472 - RNA, 24 nt, Human
auuuauuuacugagcuucucugug

SEQ ID NO: 2347473 - RNA, 17 nt, Human
auuuauuuacugcuagu

SEQ ID NO: 2347474 - RNA, 23 nt, Human
auuuauuuacagaugaauguauu

SEQ ID NO: 2347475 - RNA, 13 nt, Human
auuuauuuacaga

SEQ ID NO: 2347476 - RNA, 17 nt, Human
auuuauuuauuaagaug

SEQ ID NO: 2347477 - RNA, 14 nt, Human
auuuauuuauuuau

SEQ ID NO: 2347478 - RNA, 14 nt, Human
auuuauuuauuuaa

SEQ ID NO: 2347479 - RNA, 14 nt, Human
auuuauuuauuauu

SEQ ID NO: 2347480 - RNA, 17 nt, Human
auuuauuuuaauaaugu

SEQ ID NO: 2347481 - RNA, 18 nt, Human
auuuauucaauuccucug

SEQ ID NO: 2347482 - RNA, 22 nt, Human
auuuauucaauaaaguauuuaa

SEQ ID NO: 2347483 - RNA, 19 nt, Human
auuuauucaauuccucugg

SEQ ID NO: 2347484 - RNA, 18 nt, Human
auuuauucagcuucauuu

SEQ ID NO: 2347485 - RNA, 20 nt, Human
auuuauucagcuucauuugu

SEQ ID NO: 2347486 - RNA, 17 nt, Human
auuuauucauauuuucu

SEQ ID NO: 2347487 - RNA, 19 nt, Human
auuuauuccauauucaugu

SEQ ID NO: 2347488 - RNA, 20 nt, Human
auuuauuccauauucaugua

SEQ ID NO: 2347489 - RNA, 23 nt, Human
auuuauuccauauucauguaaac

SEQ ID NO: 2347490 - RNA, 13 nt, Human
auuuauucugcuc

SEQ ID NO: 2347491 - RNA, 17 nt, Human
auuuauuuaauguuaug

SEQ ID NO: 2347492 - RNA, 15 nt, Human
auuuauuuaauguua

SEQ ID NO: 2347493 - RNA, 14 nt, Human
auuuucauuguaaa

SEQ ID NO: 2347494 - RNA, 15 nt, Human
auuuucauuauuccu

SEQ ID NO: 2347495 - RNA, 22 nt, Human
auuuuccaaaaguggccucuuu

SEQ ID NO: 2347496 - RNA, 23 nt, Human
auuuucauuuucugcaagccugc

SEQ ID NO: 2347497 - RNA, 15 nt, Human
auuuucauuuucugc

SEQ ID NO: 2347498 - RNA, 17 nt, Human
auuuucauuuucugcaa

SEQ ID NO: 2347499 - RNA, 14 nt, Human
auuuuccaaagagu

SEQ ID NO: 2347500 - RNA, 14 nt, Human
auuuuccaaaugua

SEQ ID NO: 2347501 - RNA, 18 nt, Human
auuuucauguauaugugu

SEQ ID NO: 2347502 - RNA, 17 nt, Human
auuuucauguauaugug

SEQ ID NO: 2347503 - RNA, 19 nt, Human
auuuucaugacuuuuccau

SEQ ID NO: 2347504 - RNA, 20 nt, Human
auuuucaugacuuuuccaug

SEQ ID NO: 2347505 - RNA, 22 nt, Human
auuuucauacagcauuacaaau

SEQ ID NO: 2347506 - RNA, 13 nt, Human
auuuucaugacuu

SEQ ID NO: 2347507 - RNA, 16 nt, Human
auuuuccuccccagca

SEQ ID NO: 2347508 - RNA, 15 nt, Human
auuuuccuccccagc

SEQ ID NO: 2347509 - RNA, 14 nt, Human
auuuuccuccccag

SEQ ID NO: 2347510 - RNA, 13 nt, Human
auuuuccucccca

SEQ ID NO: 2347511 - RNA, 21 nt, Human
auuuuccacaagauucccaga

SEQ ID NO: 2347512 - RNA, 20 nt, Human
auuuuccacaagauucccag

SEQ ID NO: 2347513 - RNA, 23 nt, Human
auuuuccacaagauucccagaga

SEQ ID NO: 2347514 - RNA, 17 nt, Human
auuuuccaaauguaaua

SEQ ID NO: 2347515 - RNA, 15 nt, Human
auuuuccaagugugc

SEQ ID NO: 2347516 - RNA, 17 nt, Human
auuuuccaagugugcau

SEQ ID NO: 2347517 - RNA, 12 nt, Human
auuuuccucccc

SEQ ID NO: 2347518 - RNA, 21 nt, Human
auuuuccuaauaaaguucugu

SEQ ID NO: 2347519 - RNA, 19 nt, Human
auuuucaguauaauuuaac

SEQ ID NO: 2347520 - RNA, 11 nt, Human
auuuucaguau

SEQ ID NO: 2347521 - RNA, 22 nt, Human
auuuucaguagggcuacaaaac

SEQ ID NO: 2347522 - RNA, 21 nt, Human
auuuucaguagggcuacaaaa

SEQ ID NO: 2347523 - RNA, 14 nt, Human
auuuucaguauuuu

SEQ ID NO: 2347524 - RNA, 12 nt, Human
auuuucaguauu

SEQ ID NO: 2347525 - RNA, 22 nt, Human
auuuucauaaguauuucaaauu

SEQ ID NO: 2347526 - RNA, 21 nt, Human
auuuucauaaguauuucaaau

SEQ ID NO: 2347527 - RNA, 20 nt, Human
auuuucauaaguauuucaaa

SEQ ID NO: 2347528 - RNA, 22 nt, Human
auuuucaguuauuauauuuaca

SEQ ID NO: 2347529 - RNA, 12 nt, Human
auuuucagaccc

SEQ ID NO: 2347530 - RNA, 14 nt, Human
auuuucagaaaaua

SEQ ID NO: 2347531 - RNA, 17 nt, Human
auuuucagaaaauauua

SEQ ID NO: 2347532 - RNA, 17 nt, Human
auuuucagcaaacucuu

SEQ ID NO: 2347533 - RNA, 23 nt, Human
auuuucagcccauauuucaucgu

SEQ ID NO: 2347534 - RNA, 19 nt, Human
auuuucagcaaacucuuuu

SEQ ID NO: 2347535 - RNA, 18 nt, Human
auuuucagcaaacucuuu

SEQ ID NO: 2347536 - RNA, 20 nt, Human
auuuucacacaauacaauaa

SEQ ID NO: 2347537 - RNA, 15 nt, Human
auuuucacauaaaau

SEQ ID NO: 2347538 - RNA, 16 nt, Human
auuuucaaguaauugu

SEQ ID NO: 2347539 - RNA, 12 nt, Human
auuuucaaguaa

SEQ ID NO: 2347540 - RNA, 19 nt, Human
auuuucaaguaauugugaa

SEQ ID NO: 2347541 - RNA, 20 nt, Human
auuuucaaggcccucagcau

SEQ ID NO: 2347542 - RNA, 16 nt, Human
auuuucaccccacccu

SEQ ID NO: 2347543 - RNA, 15 nt, Human
auuuucaccccaccc

SEQ ID NO: 2347544 - RNA, 16 nt, Human
auuuucacaugaacau

SEQ ID NO: 2347545 - RNA, 17 nt, Human
auuuucacaugaacaua

SEQ ID NO: 2347546 - RNA, 22 nt, Human
auuuucacauucccaucuguca

SEQ ID NO: 2347547 - RNA, 22 nt, Human
auuuucaccccacccuuccccu

SEQ ID NO: 2347548 - RNA, 21 nt, Human
auuuucaccuguuuuuaagcu

SEQ ID NO: 2347549 - RNA, 14 nt, Human
auuuucacuuugug

SEQ ID NO: 2347550 - RNA, 13 nt, Human
auuuucacuguag

SEQ ID NO: 2347551 - RNA, 18 nt, Human
auuuucaacgcagcccug

SEQ ID NO: 2347552 - RNA, 22 nt, Human
auuuucaaagcuuuuuccagag

SEQ ID NO: 2347553 - RNA, 18 nt, Human
auuuucaaauuguaucua

SEQ ID NO: 2347554 - RNA, 13 nt, Human
auuuucaagaaac

SEQ ID NO: 2347555 - RNA, 20 nt, Human
auuuucaacgcagcccugcu

SEQ ID NO: 2347556 - RNA, 17 nt, Human
auuuucaaggcccucag

SEQ ID NO: 2347557 - RNA, 24 nt, Human
auuuucaagaauaaucacgcuuuc

SEQ ID NO: 2347558 - RNA, 23 nt, Human
auuuucaagaaacugaggaauuu

SEQ ID NO: 2347559 - RNA, 22 nt, Human
auuuucaagaaacugaggaauu

SEQ ID NO: 2347560 - RNA, 17 nt, Human
auuuucaagaaacugag

SEQ ID NO: 2347561 - RNA, 16 nt, Human
auuuucaagaaacuga

SEQ ID NO: 2347562 - RNA, 14 nt, Human
auuuucaagaaacu

SEQ ID NO: 2347563 - RNA, 16 nt, Human
auuuuacuuuuauaau

SEQ ID NO: 2347564 - RNA, 19 nt, Human
auuuuagaagacucuacca

SEQ ID NO: 2347565 - RNA, 21 nt, Human
auuuuagccuucucuguucau

SEQ ID NO: 2347566 - RNA, 18 nt, Human
auuuuagccuucucuguu

SEQ ID NO: 2347567 - RNA, 17 nt, Human
auuuuagccuucucugu

SEQ ID NO: 2347568 - RNA, 17 nt, Human
auuuuauuuuuuucuac

SEQ ID NO: 2347569 - RNA, 21 nt, Human
auuuuauuuuuuucugaauua

SEQ ID NO: 2347570 - RNA, 17 nt, Human
auuuuacuuuuuccugg

SEQ ID NO: 2347571 - RNA, 16 nt, Human
auuuuacuuuuuccug

SEQ ID NO: 2347572 - RNA, 14 nt, Human
auuuuaaaaagucu

SEQ ID NO: 2347573 - RNA, 18 nt, Human
auuuuaccucuuauugca

SEQ ID NO: 2347574 - RNA, 15 nt, Human
auuuuaccucuuauu

SEQ ID NO: 2347575 - RNA, 12 nt, Human
auuuuaauuuau

SEQ ID NO: 2347576 - RNA, 12 nt, Human
auuuuaauucau

SEQ ID NO: 2347577 - RNA, 23 nt, Human
auuuuaauuauuauucuucauaa

SEQ ID NO: 2347578 - RNA, 24 nt, Human
auuuuaauucaucccaacugucuu

SEQ ID NO: 2347579 - RNA, 15 nt, Human
auuuuaauucaguug

SEQ ID NO: 2347580 - RNA, 18 nt, Human
auuuuaaaauuuuaucuc

SEQ ID NO: 2347581 - RNA, 17 nt, Human
auuuuaaacaaaauaga

SEQ ID NO: 2347582 - RNA, 17 nt, Human
auuuuaaaauuuuaucu

SEQ ID NO: 2347583 - RNA, 19 nt, Human
auuuuaaaaagauuuguuu

SEQ ID NO: 2347584 - RNA, 18 nt, Human
auuuuaaaagaaugauua

SEQ ID NO: 2347585 - RNA, 22 nt, Human
auuuuaaaagaaugauuaugaa

SEQ ID NO: 2347586 - RNA, 18 nt, Human
auuuuaauuaucuuuucu

SEQ ID NO: 2347587 - RNA, 13 nt, Human
auuuuaauuauua

SEQ ID NO: 2347588 - RNA, 19 nt, Human
auuuuaauuauuauucuuc

SEQ ID NO: 2347589 - RNA, 21 nt, Human
auuuuaaaccauaaaaagcug

SEQ ID NO: 2347590 - RNA, 14 nt, Human
auuuuaaagacaug

SEQ ID NO: 2347591 - RNA, 21 nt, Human
auuuuaaugcaccugaauguu

SEQ ID NO: 2347592 - RNA, 20 nt, Human
auuuuaaaccauaaaaagcu

SEQ ID NO: 2347593 - RNA, 22 nt, Human
auuuuaaaccauaaaaagcuga

SEQ ID NO: 2347594 - RNA, 22 nt, Human
auuuuaaacaaagguugagaug

SEQ ID NO: 2347595 - RNA, 13 nt, Human
auuuuaaacaaag

SEQ ID NO: 2347596 - RNA, 21 nt, Human
auuuguuuugacggaugauug

SEQ ID NO: 2347597 - RNA, 19 nt, Human
auuuguuuucccgccaagc

SEQ ID NO: 2347598 - RNA, 18 nt, Human
auuuguuuugacggauga

SEQ ID NO: 2347599 - RNA, 17 nt, Human
auuuuaaaagaaugauu

SEQ ID NO: 2347600 - RNA, 22 nt, Human
auuuguuuuuguauuuuuaaug

SEQ ID NO: 2347601 - RNA, 16 nt, Human
auuugaaugaaaaauu

SEQ ID NO: 2347602 - RNA, 15 nt, Human
auuugaaugaaaaau

SEQ ID NO: 2347603 - RNA, 14 nt, Human
auuugaaugaaaaa

SEQ ID NO: 2347604 - RNA, 13 nt, Human
auuugaaugaaaa

SEQ ID NO: 2347605 - RNA, 11 nt, Human
auuugugacua

SEQ ID NO: 2347606 - RNA, 16 nt, Human
auuugugacuaauugu

SEQ ID NO: 2347607 - RNA, 18 nt, Human
auuugugacuaauuguau

SEQ ID NO: 2347608 - RNA, 19 nt, Human
auuugugacuaauuguaua

SEQ ID NO: 2347609 - RNA, 20 nt, Human
auuugugacuaauuguauaa

SEQ ID NO: 2347610 - RNA, 22 nt, Human
auuugugacuaauuguauaaca

SEQ ID NO: 2347611 - RNA, 14 nt, Human
auuugugauacaau

SEQ ID NO: 2347612 - RNA, 15 nt, Human
auuuguuuucauggu

SEQ ID NO: 2347613 - RNA, 13 nt, Human
auuuguuuucccg

SEQ ID NO: 2347614 - RNA, 14 nt, Human
auuugaaucuuguc

SEQ ID NO: 2347615 - RNA, 15 nt, Human
auuugaaucuugucu

SEQ ID NO: 2347616 - RNA, 16 nt, Human
auuugaaucuugucuc

SEQ ID NO: 2347617 - RNA, 11 nt, Human
auuugaaugaa

SEQ ID NO: 2347618 - RNA, 22 nt, Human
auuugaaucuugucucaaugcu

SEQ ID NO: 2347619 - RNA, 18 nt, Human
auuugaaucuugucucaa

SEQ ID NO: 2347620 - RNA, 20 nt, Human
auuugaaucuugucucaaug

SEQ ID NO: 2347621 - RNA, 14 nt, Human
auuugaaggucugc

SEQ ID NO: 2347622 - RNA, 23 nt, Human
auuugaaggucugcaagaaccug

SEQ ID NO: 2347623 - RNA, 19 nt, Human
auuugaagaaugaacaaau

SEQ ID NO: 2347624 - RNA, 16 nt, Human
auuugaagcaaagcac

SEQ ID NO: 2347625 - RNA, 13 nt, Human
auuugaaggccag

SEQ ID NO: 2347626 - RNA, 23 nt, Human
auuugugaagguggaaauaaacu

SEQ ID NO: 2347627 - RNA, 19 nt, Human
auuuguauaaaauaauuuu

SEQ ID NO: 2347628 - RNA, 15 nt, Human
auuuguauaaaauaa

SEQ ID NO: 2347629 - RNA, 18 nt, Human
auuuguauaaaauaauuu

SEQ ID NO: 2347630 - RNA, 13 nt, Human
aucuuuguggcca

SEQ ID NO: 2347631 - RNA, 15 nt, Human
aucuuuguggccaag

SEQ ID NO: 2347632 - RNA, 14 nt, Human
aucuuuguggccaa

SEQ ID NO: 2347633 - RNA, 16 nt, Human
aucuuucgcacagcag

SEQ ID NO: 2347634 - RNA, 17 nt, Human
aucuuucgcacagcagu

SEQ ID NO: 2347635 - RNA, 18 nt, Human
aucuuucgcacagcaguu

SEQ ID NO: 2347636 - RNA, 23 nt, Human
aucuuucgcacagcaguuccgga

SEQ ID NO: 2347637 - RNA, 16 nt, Human
aucuuucuauuccaaa

SEQ ID NO: 2347638 - RNA, 11 nt, Human
aucuuuuacau

SEQ ID NO: 2347639 - RNA, 23 nt, Human
aucuuuguggccaaggagcugcu

SEQ ID NO: 2347640 - RNA, 19 nt, Human
aucuuuguggccaaggagc

SEQ ID NO: 2347641 - RNA, 16 nt, Human
aucuuuguggccaagg

SEQ ID NO: 2347642 - RNA, 22 nt, Human
aucuuuuacaacugccucgaaa

SEQ ID NO: 2347643 - RNA, 17 nt, Human
uuggcgcacccuccccu

SEQ ID NO: 2347644 - RNA, 16 nt, Human
aucuuuauugagaaag

SEQ ID NO: 2347645 - RNA, 17 nt, Human
aucuuuauugagaaaga

SEQ ID NO: 2347646 - RNA, 18 nt, Human
aucuuuauugagaaagag

SEQ ID NO: 2347647 - RNA, 22 nt, Human
uuggcgcugccccuggcagccc

SEQ ID NO: 2347648 - RNA, 12 nt, Human
aucuuucaggaa

SEQ ID NO: 2347649 - RNA, 22 nt, Human
aucuuucacacuuccaccagcc

SEQ ID NO: 2347650 - RNA, 17 nt, Human
aucuuucacacuuccac

SEQ ID NO: 2347651 - RNA, 20 nt, Human
aucuuucauuaaaggcuucu

SEQ ID NO: 2347652 - RNA, 20 nt, Human
aucuuucaucaaucauugua

SEQ ID NO: 2347653 - RNA, 19 nt, Human
aucuuucauuaaaggcuuc

SEQ ID NO: 2347654 - RNA, 11 nt, Human
aucuuuccugu

SEQ ID NO: 2347655 - RNA, 12 nt, Human
aucuuuccuguc

SEQ ID NO: 2347656 - RNA, 14 nt, Human
augaaaugagguca

SEQ ID NO: 2347657 - RNA, 18 nt, Human
augaaaucuuacagcugg

SEQ ID NO: 2347658 - RNA, 13 nt, Human
augaaagaggagg

SEQ ID NO: 2347659 - RNA, 18 nt, Human
augaaagaguaaaggaaa

SEQ ID NO: 2347660 - RNA, 21 nt, Human
augaaauauuauguuaaaacu

SEQ ID NO: 2347661 - RNA, 20 nt, Human
augaaauauuauguuaaaac

SEQ ID NO: 2347662 - RNA, 19 nt, Human
augaaagauggcugugccu

SEQ ID NO: 2347663 - RNA, 20 nt, Human
augaaagauggcugugccuc

SEQ ID NO: 2347664 - RNA, 23 nt, Human
augaaagauggcugugccucugc

SEQ ID NO: 2347665 - RNA, 20 nt, Human
augaaagacuguacaaagua

SEQ ID NO: 2347666 - RNA, 13 nt, Human
aucuuuucacaaa

SEQ ID NO: 2347667 - RNA, 14 nt, Human
aucuuuucacaaau

SEQ ID NO: 2347668 - RNA, 15 nt, Human
aucuuuucacaaaua

SEQ ID NO: 2347669 - RNA, 16 nt, Human
aucuuuucacaaauaa

SEQ ID NO: 2347670 - RNA, 17 nt, Human
uuggacggcugggcaca

SEQ ID NO: 2347671 - RNA, 21 nt, Human
uuggacggccugaugcucccu

SEQ ID NO: 2347672 - RNA, 13 nt, Human
uuggacuauuaua

SEQ ID NO: 2347673 - RNA, 19 nt, Human
uuggccugaucagaccacg

SEQ ID NO: 2347674 - RNA, 13 nt, Human
uuggacggccuga

SEQ ID NO: 2347675 - RNA, 17 nt, Human
uuggaccucugcucuga

SEQ ID NO: 2347676 - RNA, 18 nt, Human
uuggaccucugcucugag

SEQ ID NO: 2347677 - RNA, 20 nt, Human
uuggaaaccugcccugccug

SEQ ID NO: 2347678 - RNA, 14 nt, Human
uuggaccucugcuc

SEQ ID NO: 2347679 - RNA, 15 nt, Human
uuggaccucugcucu

SEQ ID NO: 2347680 - RNA, 16 nt, Human
uuggaccucugcucug

SEQ ID NO: 2347681 - RNA, 23 nt, Human
uuggccugucucauccccagggg

SEQ ID NO: 2347682 - RNA, 16 nt, Human
uuggccugucucaucc

SEQ ID NO: 2347683 - RNA, 16 nt, Human
uuggccuggagguggg

SEQ ID NO: 2347684 - RNA, 12 nt, Human
uuggccugcugu

SEQ ID NO: 2347685 - RNA, 21 nt, Human
uuggaccucugcucugaggcu

SEQ ID NO: 2347686 - RNA, 13 nt, Human
uuggccugcugug

SEQ ID NO: 2347687 - RNA, 14 nt, Human
uuggccugcuguga

SEQ ID NO: 2347688 - RNA, 12 nt, Human
uuggccuggagg

SEQ ID NO: 2347689 - RNA, 13 nt, Human
uuggaccucugcu

SEQ ID NO: 2347690 - RNA, 17 nt, Human
uuggaccuaauccaagc

SEQ ID NO: 2347691 - RNA, 21 nt, Human
uuggaccuaaauggccucaug

SEQ ID NO: 2347692 - RNA, 23 nt, Human
uuggaccuaaauggccucaugug

SEQ ID NO: 2347693 - RNA, 16 nt, Human
uuggacccuuccaugg

SEQ ID NO: 2347694 - RNA, 19 nt, Human
uuggaccuaaauggccuca

SEQ ID NO: 2347695 - RNA, 14 nt, Human
uuggacccuuccau

SEQ ID NO: 2347696 - RNA, 13 nt, Human
uuggacccuucca

SEQ ID NO: 2347697 - RNA, 18 nt, Human
uuggaaagaguaggaaga

SEQ ID NO: 2347698 - RNA, 21 nt, Human
uuggaaaccugcccugccuga

SEQ ID NO: 2347699 - RNA, 22 nt, Human
uuggccugucucauccccaggg

SEQ ID NO: 2347700 - RNA, 22 nt, Human
uuggccuucagaaccauccaua

SEQ ID NO: 2347701 - RNA, 15 nt, Human
uuggcgcacccuccc

SEQ ID NO: 2347702 - RNA, 19 nt, Human
uuggcgcacccuccccucc

SEQ ID NO: 2347703 - RNA, 21 nt, Human
uuggcuagagguucaaagaua

SEQ ID NO: 2347704 - RNA, 22 nt, Human
uuggcuaggaccccuccaugug

SEQ ID NO: 2347705 - RNA, 22 nt, Human
uuggcuagagguucaaagauau

SEQ ID NO: 2347706 - RNA, 14 nt, Human
uuggcugcagggag

SEQ ID NO: 2347707 - RNA, 11 nt, Human
uuggcugcuga

SEQ ID NO: 2347708 - RNA, 15 nt, Human
uuggcugcugaaggc

SEQ ID NO: 2347709 - RNA, 11 nt, Human
uugcugaauag

SEQ ID NO: 2347710 - RNA, 19 nt, Human
uugcugaaauuuuauaugc

SEQ ID NO: 2347711 - RNA, 19 nt, Human
uugcugaauacagaggcaa

SEQ ID NO: 2347712 - RNA, 13 nt, Human
uugcuccgccucu

SEQ ID NO: 2347713 - RNA, 16 nt, Human
uugcugaaauuuuaua

SEQ ID NO: 2347714 - RNA, 11 nt, Human
uugcugaaauu

SEQ ID NO: 2347715 - RNA, 17 nt, Human
uugcuccuaauguugaa

SEQ ID NO: 2347716 - RNA, 16 nt, Human
uugcuaucuuaauuuu

SEQ ID NO: 2347717 - RNA, 18 nt, Human
uugcuaucuuaauuuugg

SEQ ID NO: 2347718 - RNA, 20 nt, Human
uugcuaugagcuggggaugu

SEQ ID NO: 2347719 - RNA, 12 nt, Human
uugcucauggaa

SEQ ID NO: 2347720 - RNA, 13 nt, Human
uugcuaucuuaau

SEQ ID NO: 2347721 - RNA, 14 nt, Human
uugcuaucuuaauu

SEQ ID NO: 2347722 - RNA, 15 nt, Human
uugcuaucuuaauuu

SEQ ID NO: 2347723 - RNA, 11 nt, Human
uugcucaugga

SEQ ID NO: 2347724 - RNA, 15 nt, Human
uugcuaaucaguguc

SEQ ID NO: 2347725 - RNA, 16 nt, Human
uugcuaaucagugucu

SEQ ID NO: 2347726 - RNA, 18 nt, Human
uugcuaaucagugucuca

SEQ ID NO: 2347727 - RNA, 21 nt, Human
uugcuaaucagugucucacac

SEQ ID NO: 2347728 - RNA, 14 nt, Human
uugcuaaucagugu

SEQ ID NO: 2347729 - RNA, 20 nt, Human
uugcuaagugaggaugaaaa

SEQ ID NO: 2347730 - RNA, 15 nt, Human
aucuaauaccucugu

SEQ ID NO: 2347731 - RNA, 17 nt, Human
aucuaauaccucugugu

SEQ ID NO: 2347732 - RNA, 19 nt, Human
aucuaauaccucugugugc

SEQ ID NO: 2347733 - RNA, 13 nt, Human
uugcuaccucagu

SEQ ID NO: 2347734 - RNA, 17 nt, Human
uugcuaccucagucagu

SEQ ID NO: 2347735 - RNA, 20 nt, Human
uugcuacuacuuaccuacca

SEQ ID NO: 2347736 - RNA, 23 nt, Human
uugcuuguugggauuccugaccc

SEQ ID NO: 2347737 - RNA, 24 nt, Human
uugcuuguugggauuccugaccca

SEQ ID NO: 2347738 - RNA, 16 nt, Human
uugcuuggacuauuau

SEQ ID NO: 2347739 - RNA, 14 nt, Human
uugcuuggcugcuu

SEQ ID NO: 2347740 - RNA, 15 nt, Human
uugcuuggcugcuug

SEQ ID NO: 2347741 - RNA, 19 nt, Human
uugcuuggcugcuuggccu

SEQ ID NO: 2347742 - RNA, 14 nt, Human
uugcuugggaaggg

SEQ ID NO: 2347743 - RNA, 15 nt, Human
uugcuugggaagggg

SEQ ID NO: 2347744 - RNA, 19 nt, Human
uugcugauggugcaaugac

SEQ ID NO: 2347745 - RNA, 20 nt, Human
uugcuugcaguagauuuucu

SEQ ID NO: 2347746 - RNA, 15 nt, Human
uugcugagccucugc

SEQ ID NO: 2347747 - RNA, 14 nt, Human
uugcugagccucug

SEQ ID NO: 2347748 - RNA, 22 nt, Human
uugcugagccucugcuccccag

SEQ ID NO: 2347749 - RNA, 11 nt, Human
uugcuugccuc

SEQ ID NO: 2347750 - RNA, 15 nt, Human
uugcuugccucucug

SEQ ID NO: 2347751 - RNA, 16 nt, Human
uugcuugccucucugu

SEQ ID NO: 2347752 - RNA, 16 nt, Human
uugcuugccugauaua

SEQ ID NO: 2347753 - RNA, 18 nt, Human
uugcuugccugauauaaa

SEQ ID NO: 2347754 - RNA, 18 nt, Human
uugcugaauaggcgauca

SEQ ID NO: 2347755 - RNA, 11 nt, Human
uugcugagccu

SEQ ID NO: 2347756 - RNA, 17 nt, Human
uugcugauggugcaaug

SEQ ID NO: 2347757 - RNA, 18 nt, Human
uugcugauggugcaauga

SEQ ID NO: 2347758 - RNA, 15 nt, Human
uugcuuuacugucaa

SEQ ID NO: 2347759 - RNA, 16 nt, Human
uugcuuuacugucaaa

SEQ ID NO: 2347760 - RNA, 19 nt, Human
uugcuuuacugucaaaaua

SEQ ID NO: 2347761 - RNA, 16 nt, Human
uugcuuuuaaaaucca

SEQ ID NO: 2347762 - RNA, 18 nt, Human
uugcuuuaauuguuaaga

SEQ ID NO: 2347763 - RNA, 16 nt, Human
uugcuuuaauuguuaa

SEQ ID NO: 2347764 - RNA, 22 nt, Human
uugcuuuacugucaaaauaauu

SEQ ID NO: 2347765 - RNA, 19 nt, Human
uugcuuuuccacugccugg

SEQ ID NO: 2347766 - RNA, 15 nt, Human
uugcuuuuucuaaug

SEQ ID NO: 2347767 - RNA, 22 nt, Human
uugcuuuuucuaaugugguuau

SEQ ID NO: 2347768 - RNA, 13 nt, Human
uugcuuuuucuga

SEQ ID NO: 2347769 - RNA, 15 nt, Human
uugcuuuuucugacu

SEQ ID NO: 2347770 - RNA, 20 nt, Human
uugcuuuuggcaaaacucua

SEQ ID NO: 2347771 - RNA, 13 nt, Human
uugcuuuugugaa

SEQ ID NO: 2347772 - RNA, 15 nt, Human
uugcuuuuucaccag

SEQ ID NO: 2347773 - RNA, 15 nt, Human
uuggaaaccugcccu

SEQ ID NO: 2347774 - RNA, 17 nt, Human
uuggaaaccugcccugc

SEQ ID NO: 2347775 - RNA, 18 nt, Human
uuggaaaccugcccugcc

SEQ ID NO: 2347776 - RNA, 17 nt, Human
uuggaaagaguaggaag

SEQ ID NO: 2347777 - RNA, 23 nt, Human
augacaaaaauucaacucagacu

SEQ ID NO: 2347778 - RNA, 15 nt, Human
augacaaaaauucaa

SEQ ID NO: 2347779 - RNA, 19 nt, Human
augacaaaaauucaacuca

SEQ ID NO: 2347780 - RNA, 18 nt, Human
augacaacuggaauaguu

SEQ ID NO: 2347781 - RNA, 14 nt, Human
augacaacagaagc

SEQ ID NO: 2347782 - RNA, 19 nt, Human
augacaacagaagcuucag

SEQ ID NO: 2347783 - RNA, 19 nt, Human
augacaacuggaauaguuu

SEQ ID NO: 2347784 - RNA, 23 nt, Human
augaauuuuuuucaucuucucug

SEQ ID NO: 2347785 - RNA, 17 nt, Human
augaauucuuaugcuua

SEQ ID NO: 2347786 - RNA, 23 nt, Human
augaauuaguuuuauaugcuucu

SEQ ID NO: 2347787 - RNA, 20 nt, Human
uuguauauuauggaagauuu

SEQ ID NO: 2347788 - RNA, 18 nt, Human
uuguauauuauggaagau

SEQ ID NO: 2347789 - RNA, 21 nt, Human
uuguauauuauggaagauuuu

SEQ ID NO: 2347790 - RNA, 16 nt, Human
uuguauauuauuucua

SEQ ID NO: 2347791 - RNA, 13 nt, Human
uuguauauucacu

SEQ ID NO: 2347792 - RNA, 14 nt, Human
uuguauauucacuu

SEQ ID NO: 2347793 - RNA, 21 nt, Human
augaauuaguuuuauaugcuu

SEQ ID NO: 2347794 - RNA, 15 nt, Human
augacaacuuugcca

SEQ ID NO: 2347795 - RNA, 16 nt, Human
augacaagccccaggc

SEQ ID NO: 2347796 - RNA, 15 nt, Human
augacaagccccagg

SEQ ID NO: 2347797 - RNA, 19 nt, Human
augacacgaauauugcuga

SEQ ID NO: 2347798 - RNA, 20 nt, Human
augacaagccccaggcaggc

SEQ ID NO: 2347799 - RNA, 18 nt, Human
augacaagccccaggcag

SEQ ID NO: 2347800 - RNA, 20 nt, Human
augacacgaauauugcugau

SEQ ID NO: 2347801 - RNA, 21 nt, Human
augacagcugucccugucacc

SEQ ID NO: 2347802 - RNA, 16 nt, Human
augacagguaaauuaa

SEQ ID NO: 2347803 - RNA, 23 nt, Human
augacaguaguaccaaaugcuuu

SEQ ID NO: 2347804 - RNA, 19 nt, Human
augacagcugucccuguca

SEQ ID NO: 2347805 - RNA, 17 nt, Human
augacagcugucccugu

SEQ ID NO: 2347806 - RNA, 16 nt, Human
augacagcugucccug

SEQ ID NO: 2347807 - RNA, 12 nt, Human
augacagagcga

SEQ ID NO: 2347808 - RNA, 15 nt, Human
augacagcugucccu

SEQ ID NO: 2347809 - RNA, 16 nt, Human
augacagauguugaau

SEQ ID NO: 2347810 - RNA, 13 nt, Human
augacagagccag

SEQ ID NO: 2347811 - RNA, 22 nt, Human
augacacuuguccccaaauccg

SEQ ID NO: 2347812 - RNA, 20 nt, Human
uuguaaggaaugauuaauua

SEQ ID NO: 2347813 - RNA, 12 nt, Human
uuguaaguuuau

SEQ ID NO: 2347814 - RNA, 14 nt, Human
uuguaaguuuaugu

SEQ ID NO: 2347815 - RNA, 13 nt, Human
uuguaaugaaaac

SEQ ID NO: 2347816 - RNA, 15 nt, Human
uuguaauguuacuga

SEQ ID NO: 2347817 - RNA, 14 nt, Human
uuguaaugucacca

SEQ ID NO: 2347818 - RNA, 23 nt, Human
uuguaguguuggagaagaacuga

SEQ ID NO: 2347819 - RNA, 20 nt, Human
uuguauaaaaauagaagaau

SEQ ID NO: 2347820 - RNA, 19 nt, Human
uuguauaaauuuauuuacu

SEQ ID NO: 2347821 - RNA, 12 nt, Human
uuguauaaauuu

SEQ ID NO: 2347822 - RNA, 19 nt, Human
uuguauaaaauaauuuuua

SEQ ID NO: 2347823 - RNA, 12 nt, Human
uuguauaaaaau

SEQ ID NO: 2347824 - RNA, 16 nt, Human
uuguauaaaaaaaaua

SEQ ID NO: 2347825 - RNA, 13 nt, Human
uuguaguuuaccu

SEQ ID NO: 2347826 - RNA, 17 nt, Human
uuguaguuuaccucuuu

SEQ ID NO: 2347827 - RNA, 13 nt, Human
uuguauaaaauaa

SEQ ID NO: 2347828 - RNA, 14 nt, Human
uuguauaguugcuu

SEQ ID NO: 2347829 - RNA, 15 nt, Human
uuguauaguugcuug

SEQ ID NO: 2347830 - RNA, 19 nt, Human
uuguauaguugcuugccug

SEQ ID NO: 2347831 - RNA, 12 nt, Human
uuguauaauugu

SEQ ID NO: 2347832 - RNA, 13 nt, Human
uuguauaauugua

SEQ ID NO: 2347833 - RNA, 20 nt, Human
uuguauaguugcuugccuga

SEQ ID NO: 2347834 - RNA, 11 nt, Human
uuguauauauc

SEQ ID NO: 2347835 - RNA, 13 nt, Human
uuguauauaucug

SEQ ID NO: 2347836 - RNA, 19 nt, Human
uuguauauaucugcuucag

SEQ ID NO: 2347837 - RNA, 14 nt, Human
uuguauauaugugu

SEQ ID NO: 2347838 - RNA, 15 nt, Human
uuguauauaugugug

SEQ ID NO: 2347839 - RNA, 16 nt, Human
uuguauauaugugugu

SEQ ID NO: 2347840 - RNA, 21 nt, Human
uuguauauauguguguuuaaa

SEQ ID NO: 2347841 - RNA, 23 nt, Human
uuguauaaauuuauuuacugcua

SEQ ID NO: 2347842 - RNA, 13 nt, Human
uuguauaacaggu

SEQ ID NO: 2347843 - RNA, 14 nt, Human
uuguauaacagguu

SEQ ID NO: 2347844 - RNA, 15 nt, Human
uuguauaacagguua

SEQ ID NO: 2347845 - RNA, 16 nt, Human
uuguauaacagguuau

SEQ ID NO: 2347846 - RNA, 17 nt, Human
uuguauaacagguuauu

SEQ ID NO: 2347847 - RNA, 14 nt, Human
uuguauaacuucuu

SEQ ID NO: 2347848 - RNA, 21 nt, Human
uuguauaagauuagaaugaaa

SEQ ID NO: 2347849 - RNA, 15 nt, Human
uuguaaaaaaaaaug

SEQ ID NO: 2347850 - RNA, 18 nt, Human
uugguuuuguuccccucc

SEQ ID NO: 2347851 - RNA, 18 nt, Human
uugguuuuuaaaacccag

SEQ ID NO: 2347852 - RNA, 16 nt, Human
uuguaaaaaaaaaugc

SEQ ID NO: 2347853 - RNA, 17 nt, Human
uuguaaaaaaaaaugcc

SEQ ID NO: 2347854 - RNA, 19 nt, Human
uuguaaaaaaaaaugccuu

SEQ ID NO: 2347855 - RNA, 20 nt, Human
uuguaaaaaaaaaugccuuu

SEQ ID NO: 2347856 - RNA, 21 nt, Human
uuguaaaaaaaaaugccuuug

SEQ ID NO: 2347857 - RNA, 22 nt, Human
uuguaaaaaaaaaugccuuuga

SEQ ID NO: 2347858 - RNA, 23 nt, Human
uuguaaaaaaaaaugccuuugag

SEQ ID NO: 2347859 - RNA, 23 nt, Human
uuguaaaaacagcauugcuuucu

SEQ ID NO: 2347860 - RNA, 20 nt, Human
uuguaaaaacagcauugcuu

SEQ ID NO: 2347861 - RNA, 19 nt, Human
uuguaaaaacagcauugcu

SEQ ID NO: 2347862 - RNA, 21 nt, Human
uuguaaaaacagcauugcuuu

SEQ ID NO: 2347863 - RNA, 20 nt, Human
uuguaacguugcugugggaa

SEQ ID NO: 2347864 - RNA, 21 nt, Human
uuguaacguugcugugggaac

SEQ ID NO: 2347865 - RNA, 14 nt, Human
uuguaagaaauacu

SEQ ID NO: 2347866 - RNA, 13 nt, Human
uuguaagaaauac

SEQ ID NO: 2347867 - RNA, 22 nt, Human
uuguaagcaugcacaaauucug

SEQ ID NO: 2347868 - RNA, 14 nt, Human
uuguaaggaaugau

SEQ ID NO: 2347869 - RNA, 14 nt, Human
uuguaacuccacca

SEQ ID NO: 2347870 - RNA, 17 nt, Human
uuguaacuuggauguag

SEQ ID NO: 2347871 - RNA, 11 nt, Human
uuguaagaaau

SEQ ID NO: 2347872 - RNA, 20 nt, Human
uuguaacuaggcucagagau

SEQ ID NO: 2347873 - RNA, 20 nt, Human
uugguucauuaauucuauaa

SEQ ID NO: 2347874 - RNA, 14 nt, Human
uugguucauuaauu

SEQ ID NO: 2347875 - RNA, 14 nt, Human
uugguucauaaaug

SEQ ID NO: 2347876 - RNA, 15 nt, Human
uugguucauaaauga

SEQ ID NO: 2347877 - RNA, 18 nt, Human
uugguucccccacugauc

SEQ ID NO: 2347878 - RNA, 14 nt, Human
uugguuuuguuccc

SEQ ID NO: 2347879 - RNA, 17 nt, Human
uugguuuuguuccccuc

SEQ ID NO: 2347880 - RNA, 16 nt, Human
uugguuaagucuguuu

SEQ ID NO: 2347881 - RNA, 19 nt, Human
uugguuaggcauuguggga

SEQ ID NO: 2347882 - RNA, 21 nt, Human
uugggguagcuagaggaacca

SEQ ID NO: 2347883 - RNA, 22 nt, Human
uugggguacccacugcucuggu

SEQ ID NO: 2347884 - RNA, 17 nt, Human
uuggggucuggcagccu

SEQ ID NO: 2347885 - RNA, 15 nt, Human
uuggggucagccagg

SEQ ID NO: 2347886 - RNA, 16 nt, Human
uuggggucugccacca

SEQ ID NO: 2347887 - RNA, 18 nt, Human
uugguuaagucuguuuua

SEQ ID NO: 2347888 - RNA, 13 nt, Human
uuggggucagcca

SEQ ID NO: 2347889 - RNA, 16 nt, Human
uuggggucagccaggg

SEQ ID NO: 2347890 - RNA, 14 nt, Human
uuggggucugaccc

SEQ ID NO: 2347891 - RNA, 15 nt, Human
uuggggucugacccc

SEQ ID NO: 2347892 - RNA, 17 nt, Human
uugggguacccacugcu

SEQ ID NO: 2347893 - RNA, 19 nt, Human
uuggggaagaacgaagcca

SEQ ID NO: 2347894 - RNA, 15 nt, Human
uugggcugagacugg

SEQ ID NO: 2347895 - RNA, 19 nt, Human
uugggcuggaacagauuca

SEQ ID NO: 2347896 - RNA, 22 nt, Human
uugggcugugcggaucucugga

SEQ ID NO: 2347897 - RNA, 13 nt, Human
uugggcugagacu

SEQ ID NO: 2347898 - RNA, 15 nt, Human
uugggcuccuuuuuc

SEQ ID NO: 2347899 - RNA, 16 nt, Human
uugggcuccuuuuucu

SEQ ID NO: 2347900 - RNA, 16 nt, Human
uugggcggcugagagc

SEQ ID NO: 2347901 - RNA, 18 nt, Human
uugggcggcugagagccc

SEQ ID NO: 2347902 - RNA, 21 nt, Human
uugggcggcugagagccccag

SEQ ID NO: 2347903 - RNA, 20 nt, Human
uugggcagaagggagaagga

SEQ ID NO: 2347904 - RNA, 12 nt, Human
uugggcagagcu

SEQ ID NO: 2347905 - RNA, 19 nt, Human
uugggcagaagggagaagg

SEQ ID NO: 2347906 - RNA, 22 nt, Human
uugggcagagcuggcucugagc

SEQ ID NO: 2347907 - RNA, 17 nt, Human
uugggcagagcuggcuc

SEQ ID NO: 2347908 - RNA, 21 nt, Human
uugggcagagcuggcucugag

SEQ ID NO: 2347909 - RNA, 20 nt, Human
uugggccugcuccagaccug

SEQ ID NO: 2347910 - RNA, 13 nt, Human
uugggccagacau

SEQ ID NO: 2347911 - RNA, 22 nt, Human
uugggcagcgcccuuccucucc

SEQ ID NO: 2347912 - RNA, 18 nt, Human
uugggcagcgcccuuccu

SEQ ID NO: 2347913 - RNA, 19 nt, Human
uugggcagcgcccuuccuc

SEQ ID NO: 2347914 - RNA, 21 nt, Human
uugggcagcgcccuuccucuc

SEQ ID NO: 2347915 - RNA, 23 nt, Human
uugggcagcgcccuuccucucca

SEQ ID NO: 2347916 - RNA, 20 nt, Human
augaaccacaucuugcucug

SEQ ID NO: 2347917 - RNA, 13 nt, Human
augaaccacaucu

SEQ ID NO: 2347918 - RNA, 21 nt, Human
augaacauauuguugaaaggu

SEQ ID NO: 2347919 - RNA, 15 nt, Human
augaacauguuccug

SEQ ID NO: 2347920 - RNA, 18 nt, Human
augaacauguacuguucu

SEQ ID NO: 2347921 - RNA, 22 nt, Human
augaauuacauuuguauaaaau

SEQ ID NO: 2347922 - RNA, 18 nt, Human
augaauuacauuuguaua

SEQ ID NO: 2347923 - RNA, 19 nt, Human
augaauuacauuuguauaa

SEQ ID NO: 2347924 - RNA, 21 nt, Human
augaucugagucccaggagcu

SEQ ID NO: 2347925 - RNA, 22 nt, Human
augaucucuucuuuuggcuucc

SEQ ID NO: 2347926 - RNA, 16 nt, Human
augaucuacucagaaa

SEQ ID NO: 2347927 - RNA, 18 nt, Human
augaucuacucagaaauu

SEQ ID NO: 2347928 - RNA, 14 nt, Human
augaucuucuuuau

SEQ ID NO: 2347929 - RNA, 15 nt, Human
augauccuaaugaau

SEQ ID NO: 2347930 - RNA, 23 nt, Human
augaucuaccagccucccuauuu

SEQ ID NO: 2347931 - RNA, 14 nt, Human
augaucuacucaga

SEQ ID NO: 2347932 - RNA, 15 nt, Human
augaucuacucagaa

SEQ ID NO: 2347933 - RNA, 20 nt, Human
augaucagcuguuugucaua

SEQ ID NO: 2347934 - RNA, 18 nt, Human
augaucccuguguugucu

SEQ ID NO: 2347935 - RNA, 20 nt, Human
augaucccuguguugucucu

SEQ ID NO: 2347936 - RNA, 21 nt, Human
augauccggauuuaauuugau

SEQ ID NO: 2347937 - RNA, 22 nt, Human
augauccggauuuaauuugaua

SEQ ID NO: 2347938 - RNA, 16 nt, Human
augauccuaggcauuu

SEQ ID NO: 2347939 - RNA, 19 nt, Human
augaucagcuguuugucau

SEQ ID NO: 2347940 - RNA, 18 nt, Human
augaucagcuguuuguca

SEQ ID NO: 2347941 - RNA, 20 nt, Human
uuguuggcagcauaaaggcc

SEQ ID NO: 2347942 - RNA, 22 nt, Human
augaucacuaauacuaauucau

SEQ ID NO: 2347943 - RNA, 23 nt, Human
augaucacggcucacugcagccu

SEQ ID NO: 2347944 - RNA, 18 nt, Human
augaucacggcucacugc

SEQ ID NO: 2347945 - RNA, 19 nt, Human
augaucacggcucacugca

SEQ ID NO: 2347946 - RNA, 15 nt, Human
augaucacggcucac

SEQ ID NO: 2347947 - RNA, 18 nt, Human
augauauugcauaugcau

SEQ ID NO: 2347948 - RNA, 13 nt, Human
augauauugcaua

SEQ ID NO: 2347949 - RNA, 20 nt, Human
uuguuggaucuucaauggcu

SEQ ID NO: 2347950 - RNA, 21 nt, Human
uuguuggaaaagaauacagaa

SEQ ID NO: 2347951 - RNA, 15 nt, Human
uuguuggagccugca

SEQ ID NO: 2347952 - RNA, 15 nt, Human
uuguuggaucuucaa

SEQ ID NO: 2347953 - RNA, 13 nt, Human
uuguuggaaugaa

SEQ ID NO: 2347954 - RNA, 18 nt, Human
uuguugcuguugauguuu

SEQ ID NO: 2347955 - RNA, 21 nt, Human
uuguugauaaauuccacugga

SEQ ID NO: 2347956 - RNA, 22 nt, Human
uuguugagguggucugaauguu

SEQ ID NO: 2347957 - RNA, 19 nt, Human
uuguugcaaguacugcugu

SEQ ID NO: 2347958 - RNA, 14 nt, Human
uugugaaguacaua

SEQ ID NO: 2347959 - RNA, 22 nt, Human
uugugaaguacccguucacauu

SEQ ID NO: 2347960 - RNA, 18 nt, Human
uugugaagacugggaagu

SEQ ID NO: 2347961 - RNA, 18 nt, Human
uugugugguuuggcccuu

SEQ ID NO: 2347962 - RNA, 17 nt, Human
uugugaagguggaaaua

SEQ ID NO: 2347963 - RNA, 18 nt, Human
uugugaagguggaaauaa

SEQ ID NO: 2347964 - RNA, 19 nt, Human
uugugaagaaaaauaaagu

SEQ ID NO: 2347965 - RNA, 11 nt, Human
uugugaagagg

SEQ ID NO: 2347966 - RNA, 13 nt, Human
uugugaaggcagg

SEQ ID NO: 2347967 - RNA, 18 nt, Human
uugugaagcaaaauuuuu

SEQ ID NO: 2347968 - RNA, 19 nt, Human
uugugaacaagucccugua

SEQ ID NO: 2347969 - RNA, 19 nt, Human
uugugaacucagccaagca

SEQ ID NO: 2347970 - RNA, 22 nt, Human
uugugaacucagccaagcacag

SEQ ID NO: 2347971 - RNA, 23 nt, Human
uugugaacucagccaagcacagu

SEQ ID NO: 2347972 - RNA, 17 nt, Human
uugugaacuuuuuguag

SEQ ID NO: 2347973 - RNA, 19 nt, Human
uugugugugggcugugagu

SEQ ID NO: 2347974 - RNA, 19 nt, Human
uugugugucuuaauuauua

SEQ ID NO: 2347975 - RNA, 16 nt, Human
uugugugugggagugu

SEQ ID NO: 2347976 - RNA, 13 nt, Human
uuguuccccuccu

SEQ ID NO: 2347977 - RNA, 19 nt, Human
uuguuccccaucaucugug

SEQ ID NO: 2347978 - RNA, 14 nt, Human
uuguuccccuccuc

SEQ ID NO: 2347979 - RNA, 15 nt, Human
uuguuccccuccucc

SEQ ID NO: 2347980 - RNA, 13 nt, Human
uugugugucuuaa

SEQ ID NO: 2347981 - RNA, 15 nt, Human
uuguguguaugugua

SEQ ID NO: 2347982 - RNA, 13 nt, Human
uugugugugggag

SEQ ID NO: 2347983 - RNA, 10 nt, Human
uugugugugg

SEQ ID NO: 2347984 - RNA, 20 nt, Human
uuguugauaaauuccacugg

SEQ ID NO: 2347985 - RNA, 21 nt, Human
uuguugagguggucugaaugu

SEQ ID NO: 2347986 - RNA, 14 nt, Human
uuguugaggugguc

SEQ ID NO: 2347987 - RNA, 13 nt, Human
uuguucucagcuc

SEQ ID NO: 2347988 - RNA, 17 nt, Human
uuguucgggugugcaau

SEQ ID NO: 2347989 - RNA, 16 nt, Human
uuguucgggugugcaa

SEQ ID NO: 2347990 - RNA, 15 nt, Human
uuguucuaguuuuca

SEQ ID NO: 2347991 - RNA, 16 nt, Human
uuguucuaguuuucag

SEQ ID NO: 2347992 - RNA, 14 nt, Human
uuguucccucuccc

SEQ ID NO: 2347993 - RNA, 10 nt, Human
uugugugugu

SEQ ID NO: 2347994 - RNA, 23 nt, Human
uuguuccccuccuccacucuccc

SEQ ID NO: 2347995 - RNA, 16 nt, Human
uuguuccccuccucca

SEQ ID NO: 2347996 - RNA, 18 nt, Human
uuguuccccuccuccacu

SEQ ID NO: 2347997 - RNA, 19 nt, Human
uuguuccccuccuccacuc

SEQ ID NO: 2347998 - RNA, 20 nt, Human
uuguuccccuccuccacucu

SEQ ID NO: 2347999 - RNA, 18 nt, Human
augaucuucuuuauaauu

SEQ ID NO: 2348000 - RNA, 15 nt, Human
augaucuucuuuaua

SEQ ID NO: 2348001 - RNA, 16 nt, Human
augcaaaccaucauug

SEQ ID NO: 2348002 - RNA, 18 nt, Human
augcaaaccaucauugaa

SEQ ID NO: 2348003 - RNA, 19 nt, Human
augcaaaccaucauugaaa

SEQ ID NO: 2348004 - RNA, 20 nt, Human
augcaaaccaucauugaaau

SEQ ID NO: 2348005 - RNA, 21 nt, Human
augcaaaccaucauugaaauc

SEQ ID NO: 2348006 - RNA, 22 nt, Human
augcaaaccaucauugaaaucu

SEQ ID NO: 2348007 - RNA, 15 nt, Human
augcaaagaaaauca

SEQ ID NO: 2348008 - RNA, 22 nt, Human
augcaaggaccaggacucccuc

SEQ ID NO: 2348009 - RNA, 13 nt, Human
augcaagggacug

SEQ ID NO: 2348010 - RNA, 18 nt, Human
augcaagggacugugugu

SEQ ID NO: 2348011 - RNA, 22 nt, Human
augcaaggucauuuuuuuuaag

SEQ ID NO: 2348012 - RNA, 14 nt, Human
augcaccuggaaua

SEQ ID NO: 2348013 - RNA, 16 nt, Human
augcaccuggaauaua

SEQ ID NO: 2348014 - RNA, 22 nt, Human
augcaaacuuuauuuuguguuu

SEQ ID NO: 2348015 - RNA, 16 nt, Human
augcaaggucauuuuu

SEQ ID NO: 2348016 - RNA, 14 nt, Human
augcaaggucauuu

SEQ ID NO: 2348017 - RNA, 14 nt, Human
uuguuuuguuuuaa

SEQ ID NO: 2348018 - RNA, 13 nt, Human
uuguuuuguuuua

SEQ ID NO: 2348019 - RNA, 16 nt, Human
uuguuuuguuuuuugg

SEQ ID NO: 2348020 - RNA, 19 nt, Human
augcaccuugugucuguac

SEQ ID NO: 2348021 - RNA, 15 nt, Human
augcaccuugugucu

SEQ ID NO: 2348022 - RNA, 16 nt, Human
augcaccuugugucug

SEQ ID NO: 2348023 - RNA, 18 nt, Human
augcaccuugugucugua

SEQ ID NO: 2348024 - RNA, 19 nt, Human
augcaccuggaauauauaa

SEQ ID NO: 2348025 - RNA, 18 nt, Human
uuguuuuuuuuuuccacu

SEQ ID NO: 2348026 - RNA, 22 nt, Human
uuguuuuuccuuguauuuaaau

SEQ ID NO: 2348027 - RNA, 21 nt, Human
uuguuuuuccuuguauuuaaa

SEQ ID NO: 2348028 - RNA, 13 nt, Human
uuguuuuuccuug

SEQ ID NO: 2348029 - RNA, 12 nt, Human
uuguuuuuauga

SEQ ID NO: 2348030 - RNA, 19 nt, Human
uuguuuuucauucagucuu

SEQ ID NO: 2348031 - RNA, 17 nt, Human
uuuaaaaaauuaaucug

SEQ ID NO: 2348032 - RNA, 20 nt, Human
uuuaaaaaauaacuaccaag

SEQ ID NO: 2348033 - RNA, 22 nt, Human
uuuaaacuguguacauaacuga

SEQ ID NO: 2348034 - RNA, 21 nt, Human
uuuaaacuguguacauaacug

SEQ ID NO: 2348035 - RNA, 19 nt, Human
uuuaaacuguguacauaac

SEQ ID NO: 2348036 - RNA, 15 nt, Human
uuuaaacuguguaca

SEQ ID NO: 2348037 - RNA, 15 nt, Human
uuuaaaaaaauaaaa

SEQ ID NO: 2348038 - RNA, 19 nt, Human
uuguuuuuuuuuuccacuu

SEQ ID NO: 2348039 - RNA, 20 nt, Human
uuuaaaaaagaaacauuugg

SEQ ID NO: 2348040 - RNA, 17 nt, Human
uuuaaaaaaauaaaaca

SEQ ID NO: 2348041 - RNA, 18 nt, Human
uuuaaaaaaauaaaacau

SEQ ID NO: 2348042 - RNA, 19 nt, Human
uuuaaaaaaauaaaacauu

SEQ ID NO: 2348043 - RNA, 20 nt, Human
uuuaaaaaaauaaaacauuu

SEQ ID NO: 2348044 - RNA, 16 nt, Human
uugucccucugcccca

SEQ ID NO: 2348045 - RNA, 15 nt, Human
uugucccucugcccc

SEQ ID NO: 2348046 - RNA, 21 nt, Human
uuguccccuaagaguguuuaa

SEQ ID NO: 2348047 - RNA, 14 nt, Human
uuguccccucuuga

SEQ ID NO: 2348048 - RNA, 21 nt, Human
uuguccccugccugugccugc

SEQ ID NO: 2348049 - RNA, 18 nt, Human
uugucccugaagagaagg

SEQ ID NO: 2348050 - RNA, 17 nt, Human
uugucccucugccccau

SEQ ID NO: 2348051 - RNA, 16 nt, Human
uugucccucugcuacg

SEQ ID NO: 2348052 - RNA, 15 nt, Human
uugucccugugccua

SEQ ID NO: 2348053 - RNA, 16 nt, Human
uuguccgcuggguggu

SEQ ID NO: 2348054 - RNA, 18 nt, Human
uuguccguguucauacau

SEQ ID NO: 2348055 - RNA, 16 nt, Human
uuguccuaugggaguc

SEQ ID NO: 2348056 - RNA, 13 nt, Human
uuguccuccccuu

SEQ ID NO: 2348057 - RNA, 15 nt, Human
uuguccuccccuugg

SEQ ID NO: 2348058 - RNA, 14 nt, Human
uuguccuugcuggu

SEQ ID NO: 2348059 - RNA, 15 nt, Human
uuguccuuucccuuc

SEQ ID NO: 2348060 - RNA, 17 nt, Human
uuguccuuucccuucag

SEQ ID NO: 2348061 - RNA, 13 nt, Human
uugugaaauuauu

SEQ ID NO: 2348062 - RNA, 14 nt, Human
uugucgcucaugug

SEQ ID NO: 2348063 - RNA, 22 nt, Human
uugucacaugaaacauuugcaa

SEQ ID NO: 2348064 - RNA, 19 nt, Human
uugucaucuuucuucuauu

SEQ ID NO: 2348065 - RNA, 21 nt, Human
uugucaucauuguauauaugu

SEQ ID NO: 2348066 - RNA, 21 nt, Human
uugucaucuuucuucuauuuu

SEQ ID NO: 2348067 - RNA, 23 nt, Human
uugucaucauuguauauaugugu

SEQ ID NO: 2348068 - RNA, 18 nt, Human
uugucacgcuucuucuuu

SEQ ID NO: 2348069 - RNA, 19 nt, Human
uugucacgcuucuucuuuu

SEQ ID NO: 2348070 - RNA, 14 nt, Human
uugucauugcuguu

SEQ ID NO: 2348071 - RNA, 15 nt, Human
uugucauugcuguug

SEQ ID NO: 2348072 - RNA, 13 nt, Human
uugucauuuauaa

SEQ ID NO: 2348073 - RNA, 12 nt, Human
uugucauuuucu

SEQ ID NO: 2348074 - RNA, 15 nt, Human
uugucauuuucucca

SEQ ID NO: 2348075 - RNA, 15 nt, Human
uuguccccguggucu

SEQ ID NO: 2348076 - RNA, 17 nt, Human
uugucauuagccugagu

SEQ ID NO: 2348077 - RNA, 18 nt, Human
uugucauuagccugagua

SEQ ID NO: 2348078 - RNA, 19 nt, Human
uugucauuagccugaguag

SEQ ID NO: 2348079 - RNA, 20 nt, Human
uugucauuagccugaguaga

SEQ ID NO: 2348080 - RNA, 14 nt, Human
uugucauuagccug

SEQ ID NO: 2348081 - RNA, 15 nt, Human
uugucauuagccuga

SEQ ID NO: 2348082 - RNA, 14 nt, Human
uugucauuaaaggu

SEQ ID NO: 2348083 - RNA, 12 nt, Human
uugucauuaaag

SEQ ID NO: 2348084 - RNA, 13 nt, Human
augaguuuuuccc

SEQ ID NO: 2348085 - RNA, 13 nt, Human
augaguuuuugau

SEQ ID NO: 2348086 - RNA, 20 nt, Human
augaguuuuugauagcuuua

SEQ ID NO: 2348087 - RNA, 19 nt, Human
augaguuuuugauagcuuu

SEQ ID NO: 2348088 - RNA, 17 nt, Human
augaguggcuuuaauga

SEQ ID NO: 2348089 - RNA, 17 nt, Human
augagugaauaaauguc

SEQ ID NO: 2348090 - RNA, 23 nt, Human
augagugcuucagaaugugauuu

SEQ ID NO: 2348091 - RNA, 16 nt, Human
augagugcgugcucag

SEQ ID NO: 2348092 - RNA, 17 nt, Human
augagugcgugcucagu

SEQ ID NO: 2348093 - RNA, 15 nt, Human
augagugaauaaaug

SEQ ID NO: 2348094 - RNA, 16 nt, Human
augagugaauaaaugu

SEQ ID NO: 2348095 - RNA, 21 nt, Human
augaguuuuugauagcuuuau

SEQ ID NO: 2348096 - RNA, 15 nt, Human
augauaaaacacaaa

SEQ ID NO: 2348097 - RNA, 18 nt, Human
uugucacacacuuuggcu

SEQ ID NO: 2348098 - RNA, 14 nt, Human
augauaacuggaaa

SEQ ID NO: 2348099 - RNA, 19 nt, Human
augaggugcugggagggau

SEQ ID NO: 2348100 - RNA, 13 nt, Human
augaggugggagg

SEQ ID NO: 2348101 - RNA, 14 nt, Human
augaggugggaggu

SEQ ID NO: 2348102 - RNA, 16 nt, Human
augaguccuugaaaau

SEQ ID NO: 2348103 - RNA, 18 nt, Human
augaguccuugaaaauau

SEQ ID NO: 2348104 - RNA, 20 nt, Human
augaguccuugaaaauauuu

SEQ ID NO: 2348105 - RNA, 21 nt, Human
augaguccuugaaaauauuuu

SEQ ID NO: 2348106 - RNA, 18 nt, Human
augaggugcugggaggga

SEQ ID NO: 2348107 - RNA, 17 nt, Human
augaggugcugggaggg

SEQ ID NO: 2348108 - RNA, 16 nt, Human
augaggugcugggagg

SEQ ID NO: 2348109 - RNA, 15 nt, Human
augaggugcugggag

SEQ ID NO: 2348110 - RNA, 22 nt, Human
augaggugggagguggaagaag

SEQ ID NO: 2348111 - RNA, 14 nt, Human
augaggugcuggga

SEQ ID NO: 2348112 - RNA, 15 nt, Human
augaggucugaaaug

SEQ ID NO: 2348113 - RNA, 17 nt, Human
augaggucugaaaugga

SEQ ID NO: 2348114 - RNA, 14 nt, Human
augaggucugaaau

SEQ ID NO: 2348115 - RNA, 23 nt, Human
augagccuacgcugaagauggca

SEQ ID NO: 2348116 - RNA, 20 nt, Human
augaggucccaggcagagaa

SEQ ID NO: 2348117 - RNA, 19 nt, Human
augaggucccaggcagaga

SEQ ID NO: 2348118 - RNA, 18 nt, Human
augaggucccaggcagag

SEQ ID NO: 2348119 - RNA, 17 nt, Human
augaggucccaggcaga

SEQ ID NO: 2348120 - RNA, 16 nt, Human
augaggucccaggcag

SEQ ID NO: 2348121 - RNA, 15 nt, Human
augaggucccaggca

SEQ ID NO: 2348122 - RNA, 14 nt, Human
augaggucccaggc

SEQ ID NO: 2348123 - RNA, 20 nt, Human
augagccgcugugagccccu

SEQ ID NO: 2348124 - RNA, 23 nt, Human
augagccgcugugagccccuggu

SEQ ID NO: 2348125 - RNA, 16 nt, Human
augagccuacgcugaa

SEQ ID NO: 2348126 - RNA, 19 nt, Human
augagccuacgcugaagau

SEQ ID NO: 2348127 - RNA, 17 nt, Human
augagccucagcauccu

SEQ ID NO: 2348128 - RNA, 18 nt, Human
augagccucagcauccug

SEQ ID NO: 2348129 - RNA, 18 nt, Human
augagauuguuuuaucau

SEQ ID NO: 2348130 - RNA, 22 nt, Human
augagauuguuuuaucaugaca

SEQ ID NO: 2348131 - RNA, 15 nt, Human
augagcaucaggcca

SEQ ID NO: 2348132 - RNA, 16 nt, Human
augagcaucaggccag

SEQ ID NO: 2348133 - RNA, 17 nt, Human
augagcaucaggccagg

SEQ ID NO: 2348134 - RNA, 18 nt, Human
augagcaucaggccaggc

SEQ ID NO: 2348135 - RNA, 19 nt, Human
augagcaucaggccaggcc

SEQ ID NO: 2348136 - RNA, 20 nt, Human
augagcaucaggccaggccc

SEQ ID NO: 2348137 - RNA, 21 nt, Human
augagcaucaggccaggcccu

SEQ ID NO: 2348138 - RNA, 18 nt, Human
augagccaccgcgcccag

SEQ ID NO: 2348139 - RNA, 18 nt, Human
augagcauggagcuggcc

SEQ ID NO: 2348140 - RNA, 15 nt, Human
augagcauggagcug

SEQ ID NO: 2348141 - RNA, 17 nt, Human
augagcauggagcuggc

SEQ ID NO: 2348142 - RNA, 21 nt, Human
augagccaccgcgcccagccu

SEQ ID NO: 2348143 - RNA, 14 nt, Human
augagccagacaaa

SEQ ID NO: 2348144 - RNA, 14 nt, Human
augagcaucccagg

SEQ ID NO: 2348145 - RNA, 15 nt, Human
augagcaucccagga

SEQ ID NO: 2348146 - RNA, 22 nt, Human
augagcaucaggccaggcccuc

SEQ ID NO: 2348147 - RNA, 11 nt, Human
augagccagac

SEQ ID NO: 2348148 - RNA, 12 nt, Human
augagccucagc

SEQ ID NO: 2348149 - RNA, 15 nt, Human
augagccucagcauc

SEQ ID NO: 2348150 - RNA, 16 nt, Human
augagccucagcaucc

SEQ ID NO: 2348151 - RNA, 22 nt, Human
augacaguuauacugucgguuu

SEQ ID NO: 2348152 - RNA, 18 nt, Human
augacaucaccacaguuu

SEQ ID NO: 2348153 - RNA, 18 nt, Human
augacaucacuuguacaa

SEQ ID NO: 2348154 - RNA, 14 nt, Human
augacaucacuugu

SEQ ID NO: 2348155 - RNA, 24 nt, Human
augacaucuucaaagcuugaagau

SEQ ID NO: 2348156 - RNA, 20 nt, Human
augacaucacuuguacaaaa

SEQ ID NO: 2348157 - RNA, 19 nt, Human
augacaucacuuguacaaa

SEQ ID NO: 2348158 - RNA, 16 nt, Human
augacaucucaggggc

SEQ ID NO: 2348159 - RNA, 18 nt, Human
augacaucucaggggcca

SEQ ID NO: 2348160 - RNA, 15 nt, Human
augacauguuauaua

SEQ ID NO: 2348161 - RNA, 16 nt, Human
augacauucaugccug

SEQ ID NO: 2348162 - RNA, 17 nt, Human
augacauguuauauauu

SEQ ID NO: 2348163 - RNA, 23 nt, Human
augacauguuauauauuuuuugu

SEQ ID NO: 2348164 - RNA, 17 nt, Human
augacauucaugccugg

SEQ ID NO: 2348165 - RNA, 13 nt, Human
augagagcccaga

SEQ ID NO: 2348166 - RNA, 14 nt, Human
augagagcccagag

SEQ ID NO: 2348167 - RNA, 16 nt, Human
augagagcccagaggu

SEQ ID NO: 2348168 - RNA, 18 nt, Human
augagagcccagagguaa

SEQ ID NO: 2348169 - RNA, 20 nt, Human
augagagcccagagguaaca

SEQ ID NO: 2348170 - RNA, 12 nt, Human
augagaggaaau

SEQ ID NO: 2348171 - RNA, 13 nt, Human
augagaggaaauc

SEQ ID NO: 2348172 - RNA, 19 nt, Human
augagaucccgccucuucu

SEQ ID NO: 2348173 - RNA, 20 nt, Human
augagaucaggcucugccuc

SEQ ID NO: 2348174 - RNA, 17 nt, Human
augagaucaggcucugc

SEQ ID NO: 2348175 - RNA, 18 nt, Human
augagaucaggcucugcc

SEQ ID NO: 2348176 - RNA, 16 nt, Human
augagauauuaaacca

SEQ ID NO: 2348177 - RNA, 15 nt, Human
augagaucaggcucu

SEQ ID NO: 2348178 - RNA, 16 nt, Human
augagaucaggcucug

SEQ ID NO: 2348179 - RNA, 13 nt, Human
augagagucacuu

SEQ ID NO: 2348180 - RNA, 21 nt, Human
augagaguuuuggaugcagug

SEQ ID NO: 2348181 - RNA, 18 nt, Human
augagaguuuuggaugca

SEQ ID NO: 2348182 - RNA, 20 nt, Human
augagaguuuuggaugcagu

SEQ ID NO: 2348183 - RNA, 23 nt, Human
augagaucuaagccuuuccauaa

SEQ ID NO: 2348184 - RNA, 22 nt, Human
augagaucuaagccuuuccaua

SEQ ID NO: 2348185 - RNA, 13 nt, Human
augagauccuuua

SEQ ID NO: 2348186 - RNA, 22 nt, Human
augagaucuaggugaggauuga

SEQ ID NO: 2348187 - RNA, 23 nt, Human
augagaugauacauccaaagcag

SEQ ID NO: 2348188 - RNA, 24 nt, Human
augagaugauacauccaaagcaga

SEQ ID NO: 2348189 - RNA, 18 nt, Human
augagaugccugaagcca

SEQ ID NO: 2348190 - RNA, 19 nt, Human
augagagggcaguguuucc

SEQ ID NO: 2348191 - RNA, 18 nt, Human
augagagggcaguguuuc

SEQ ID NO: 2348192 - RNA, 22 nt, Human
augagagcccagagguaacaga

SEQ ID NO: 2348193 - RNA, 15 nt, Human
augagaguuuuggau

SEQ ID NO: 2348194 - RNA, 17 nt, Human
augagaguuuuggaugc

SEQ ID NO: 2348195 - RNA, 16 nt, Human
augagaggaaaucacc

SEQ ID NO: 2348196 - RNA, 14 nt, Human
augagaggaaauca

SEQ ID NO: 2348197 - RNA, 15 nt, Human
augagaggaaaucac

SEQ ID NO: 2348198 - RNA, 18 nt, Human
uuucuaaagccuuaaguc

SEQ ID NO: 2348199 - RNA, 18 nt, Human
uuucuagggaaaugaaag

SEQ ID NO: 2348200 - RNA, 15 nt, Human
uuucuagggaaauga

SEQ ID NO: 2348201 - RNA, 14 nt, Human
uuucuagggaaaug

SEQ ID NO: 2348202 - RNA, 20 nt, Human
uuucuaggccuacaugcuuu

SEQ ID NO: 2348203 - RNA, 23 nt, Human
uuucuaguggucuuuguaagagu

SEQ ID NO: 2348204 - RNA, 20 nt, Human
uuucuaguggucuuuguaag

SEQ ID NO: 2348205 - RNA, 21 nt, Human
uuucuaguggucuuuguaaga

SEQ ID NO: 2348206 - RNA, 14 nt, Human
uuucuaguggucuu

SEQ ID NO: 2348207 - RNA, 17 nt, Human
uuucuaguggucuuugu

SEQ ID NO: 2348208 - RNA, 18 nt, Human
uuucuaguggucuuugua

SEQ ID NO: 2348209 - RNA, 19 nt, Human
uuucuaguggucuuuguaa

SEQ ID NO: 2348210 - RNA, 21 nt, Human
uuucuaugacacaugcaaggu

SEQ ID NO: 2348211 - RNA, 15 nt, Human
uuucuaugacacaug

SEQ ID NO: 2348212 - RNA, 22 nt, Human
uuucuauuaaauuaaauuuugu

SEQ ID NO: 2348213 - RNA, 13 nt, Human
uuucuaugaaaua

SEQ ID NO: 2348214 - RNA, 14 nt, Human
uuucuaucacauau

SEQ ID NO: 2348215 - RNA, 15 nt, Human
uuucuauccucugua

SEQ ID NO: 2348216 - RNA, 20 nt, Human
uuucuaucauuuuuguacag

SEQ ID NO: 2348217 - RNA, 14 nt, Human
uuucuaugaaauau

SEQ ID NO: 2348218 - RNA, 20 nt, Human
uuucuaugaaauauuauguu

SEQ ID NO: 2348219 - RNA, 12 nt, Human
uuucuccagcug

SEQ ID NO: 2348220 - RNA, 18 nt, Human
uuucuccagccagcaaug

SEQ ID NO: 2348221 - RNA, 20 nt, Human
uuucucccaggccaggcucc

SEQ ID NO: 2348222 - RNA, 12 nt, Human
uuucucccagcu

SEQ ID NO: 2348223 - RNA, 14 nt, Human
uuucugcaucagcu

SEQ ID NO: 2348224 - RNA, 22 nt, Human
uuucucauuugccaauaauaau

SEQ ID NO: 2348225 - RNA, 20 nt, Human
uuucuccaauaucagugcuc

SEQ ID NO: 2348226 - RNA, 11 nt, Human
uuucuccagcu

SEQ ID NO: 2348227 - RNA, 17 nt, Human
uuucuccaauaucagug

SEQ ID NO: 2348228 - RNA, 16 nt, Human
uuucugccagggagcu

SEQ ID NO: 2348229 - RNA, 18 nt, Human
uuucugcauuuugcuauu

SEQ ID NO: 2348230 - RNA, 13 nt, Human
uuucugcauuuug

SEQ ID NO: 2348231 - RNA, 13 nt, Human
uuucugcauaugu

SEQ ID NO: 2348232 - RNA, 17 nt, Human
uuucugcauauguugaa

SEQ ID NO: 2348233 - RNA, 19 nt, Human
uuucugcaguagucucugu

SEQ ID NO: 2348234 - RNA, 14 nt, Human
uuucugccgcagcc

SEQ ID NO: 2348235 - RNA, 16 nt, Human
uuucugccgcagcccu

SEQ ID NO: 2348236 - RNA, 21 nt, Human
uuucuauuuucccucgcuggg

SEQ ID NO: 2348237 - RNA, 17 nt, Human
uuucuauuucuccucca

SEQ ID NO: 2348238 - RNA, 14 nt, Human
uuucuauuccaaag

SEQ ID NO: 2348239 - RNA, 13 nt, Human
uuucuauuccaaa

SEQ ID NO: 2348240 - RNA, 17 nt, Human
uuucuauugaaaaauca

SEQ ID NO: 2348241 - RNA, 13 nt, Human
uuucuauuguaca

SEQ ID NO: 2348242 - RNA, 16 nt, Human
uuucuauuguacagaa

SEQ ID NO: 2348243 - RNA, 13 nt, Human
uuucuauuguuac

SEQ ID NO: 2348244 - RNA, 14 nt, Human
uuucuauuguuacu

SEQ ID NO: 2348245 - RNA, 23 nt, Human
uuucucagccgcuucugacugcu

SEQ ID NO: 2348246 - RNA, 20 nt, Human
uuucucagauccuuguuuca

SEQ ID NO: 2348247 - RNA, 23 nt, Human
uuucucagauccuuguuucaaac

SEQ ID NO: 2348248 - RNA, 19 nt, Human
uuucucagacuuuggaaaa

SEQ ID NO: 2348249 - RNA, 23 nt, Human
uuucucaccgcagucgucgcaca

SEQ ID NO: 2348250 - RNA, 17 nt, Human
uuucucagauccuuguu

SEQ ID NO: 2348251 - RNA, 16 nt, Human
uuucucaguuuucaua

SEQ ID NO: 2348252 - RNA, 18 nt, Human
uuucucaugaaucugcaa

SEQ ID NO: 2348253 - RNA, 14 nt, Human
uuucucagcuccca

SEQ ID NO: 2348254 - RNA, 15 nt, Human
uuucucagcucccau

SEQ ID NO: 2348255 - RNA, 20 nt, Human
uuucucagcucccauuucua

SEQ ID NO: 2348256 - RNA, 13 nt, Human
uuucucaaaguuu

SEQ ID NO: 2348257 - RNA, 14 nt, Human
uuucucaaaguuuu

SEQ ID NO: 2348258 - RNA, 15 nt, Human
uuucucaaaguuuug

SEQ ID NO: 2348259 - RNA, 16 nt, Human
uuucucaaaguuuuga

SEQ ID NO: 2348260 - RNA, 18 nt, Human
uuucucaaaguuuugaaa

SEQ ID NO: 2348261 - RNA, 22 nt, Human
uuucucaaaguuuugaaaagcu

SEQ ID NO: 2348262 - RNA, 22 nt, Human
uuucucaacaaagcacaguguu

SEQ ID NO: 2348263 - RNA, 15 nt, Human
uuugaaacaaagaag

SEQ ID NO: 2348264 - RNA, 20 nt, Human
uuugaaauagucugugugaa

SEQ ID NO: 2348265 - RNA, 19 nt, Human
uuugaaauagucuguguga

SEQ ID NO: 2348266 - RNA, 14 nt, Human
uuugaaauaauaaa

SEQ ID NO: 2348267 - RNA, 16 nt, Human
uuugaaacaauacuca

SEQ ID NO: 2348268 - RNA, 17 nt, Human
uuugaaacacuuugcau

SEQ ID NO: 2348269 - RNA, 19 nt, Human
uuugaaacacuuugcauaa

SEQ ID NO: 2348270 - RNA, 23 nt, Human
augggcuuguuuucuugccaaug

SEQ ID NO: 2348271 - RNA, 19 nt, Human
augggcuucacuguauaaa

SEQ ID NO: 2348272 - RNA, 20 nt, Human
augggcuucacuguauaaau

SEQ ID NO: 2348273 - RNA, 16 nt, Human
augggcuuagagcagu

SEQ ID NO: 2348274 - RNA, 15 nt, Human
augggcuucacugua

SEQ ID NO: 2348275 - RNA, 23 nt, Human
augggcuggguucuacccaggug

SEQ ID NO: 2348276 - RNA, 14 nt, Human
uuugaaauauugac

SEQ ID NO: 2348277 - RNA, 16 nt, Human
auggggaaggaggcug

SEQ ID NO: 2348278 - RNA, 18 nt, Human
augggcuuguuuucuugc

SEQ ID NO: 2348279 - RNA, 15 nt, Human
auggggagaaaagac

SEQ ID NO: 2348280 - RNA, 11 nt, Human
auggggaggga

SEQ ID NO: 2348281 - RNA, 14 nt, Human
auggggcccugccu

SEQ ID NO: 2348282 - RNA, 13 nt, Human
auggggcccugcc

SEQ ID NO: 2348283 - RNA, 19 nt, Human
uuucugcuggaaacagacu

SEQ ID NO: 2348284 - RNA, 21 nt, Human
uuucugcugaauuuucacaug

SEQ ID NO: 2348285 - RNA, 23 nt, Human
uuucugcugaauuuucacaugaa

SEQ ID NO: 2348286 - RNA, 19 nt, Human
uuucugcucagcuucuccu

SEQ ID NO: 2348287 - RNA, 20 nt, Human
uuucugcugaauuuucacau

SEQ ID NO: 2348288 - RNA, 18 nt, Human
uuucugcucagcuucucc

SEQ ID NO: 2348289 - RNA, 15 nt, Human
uuucugcucagcuuc

SEQ ID NO: 2348290 - RNA, 20 nt, Human
uuucuggaauacaugaaaua

SEQ ID NO: 2348291 - RNA, 18 nt, Human
uuucuggaauacaugaaa

SEQ ID NO: 2348292 - RNA, 12 nt, Human
uuucugcccugg

SEQ ID NO: 2348293 - RNA, 13 nt, Human
uuucugcccuggc

SEQ ID NO: 2348294 - RNA, 14 nt, Human
uuucugcccuggcu

SEQ ID NO: 2348295 - RNA, 13 nt, Human
uuucugccucuca

SEQ ID NO: 2348296 - RNA, 14 nt, Human
uuucugccucucaa

SEQ ID NO: 2348297 - RNA, 15 nt, Human
uuucugcccuggcug

SEQ ID NO: 2348298 - RNA, 20 nt, Human
uuucugcccuggcugcugcc

SEQ ID NO: 2348299 - RNA, 20 nt, Human
uuucugccuuccuugcuaau

SEQ ID NO: 2348300 - RNA, 13 nt, Human
uuucugccuuccu

SEQ ID NO: 2348301 - RNA, 15 nt, Human
uuucugccuuccuug

SEQ ID NO: 2348302 - RNA, 14 nt, Human
uuucugccuggagu

SEQ ID NO: 2348303 - RNA, 22 nt, Human
uuucugccuggaguguaugacu

SEQ ID NO: 2348304 - RNA, 15 nt, Human
uuucuuuaaaaaaca

SEQ ID NO: 2348305 - RNA, 13 nt, Human
uuucuuuaaaaga

SEQ ID NO: 2348306 - RNA, 14 nt, Human
uuucuuuaaaagaa

SEQ ID NO: 2348307 - RNA, 15 nt, Human
uuucuuuaagaaagu

SEQ ID NO: 2348308 - RNA, 16 nt, Human
uuucuuuaagaaagua

SEQ ID NO: 2348309 - RNA, 20 nt, Human
uuucuuuaaaagaaugggca

SEQ ID NO: 2348310 - RNA, 15 nt, Human
uuucuuuaaaagaau

SEQ ID NO: 2348311 - RNA, 23 nt, Human
uuucuggacugaagccugcagga

SEQ ID NO: 2348312 - RNA, 16 nt, Human
uuucuggagguugaua

SEQ ID NO: 2348313 - RNA, 21 nt, Human
uuucuggacugaagccugcag

SEQ ID NO: 2348314 - RNA, 18 nt, Human
uuucuggaauguaaucaa

SEQ ID NO: 2348315 - RNA, 21 nt, Human
uuucuggaauacaugaaauau

SEQ ID NO: 2348316 - RNA, 17 nt, Human
uuucuggagguugauaa

SEQ ID NO: 2348317 - RNA, 21 nt, Human
uuucuggagguugauaacuuu

SEQ ID NO: 2348318 - RNA, 22 nt, Human
uuucuggagguugauaacuuug

SEQ ID NO: 2348319 - RNA, 11 nt, Human
uuucuggaguc

SEQ ID NO: 2348320 - RNA, 19 nt, Human
uuucuuucaacuugcaucc

SEQ ID NO: 2348321 - RNA, 21 nt, Human
uuucuuuagagcauugccauu

SEQ ID NO: 2348322 - RNA, 13 nt, Human
uuucuuucaacuu

SEQ ID NO: 2348323 - RNA, 18 nt, Human
uuucuuuaaugcuuuuau

SEQ ID NO: 2348324 - RNA, 20 nt, Human
uuucuuuagagcauugccau

SEQ ID NO: 2348325 - RNA, 14 nt, Human
uuucuuucaaaauu

SEQ ID NO: 2348326 - RNA, 21 nt, Human
uuucuuuaguuuuugugaagu

SEQ ID NO: 2348327 - RNA, 13 nt, Human
uuucuuuaaugcu

SEQ ID NO: 2348328 - RNA, 20 nt, Human
uuucuuuaagauaauaguuu

SEQ ID NO: 2348329 - RNA, 13 nt, Human
uuucuuuguggcu

SEQ ID NO: 2348330 - RNA, 21 nt, Human
uuucuuuucuacccuagccau

SEQ ID NO: 2348331 - RNA, 16 nt, Human
uuucuuuguuaucaaa

SEQ ID NO: 2348332 - RNA, 15 nt, Human
uuucuuuguguagcu

SEQ ID NO: 2348333 - RNA, 16 nt, Human
uuucuuuuguaaaugu

SEQ ID NO: 2348334 - RNA, 23 nt, Human
uuucuuuugguaaagacuggcuu

SEQ ID NO: 2348335 - RNA, 22 nt, Human
uuucuuuugcccuucacagugu

SEQ ID NO: 2348336 - RNA, 14 nt, Human
uuucuuuucacaua

SEQ ID NO: 2348337 - RNA, 22 nt, Human
uuucuuuucuggaauguaauca

SEQ ID NO: 2348338 - RNA, 16 nt, Human
uuucuuuucucuggua

SEQ ID NO: 2348339 - RNA, 13 nt, Human
uuugaaaagcuau

SEQ ID NO: 2348340 - RNA, 14 nt, Human
uuugaaaagcuauu

SEQ ID NO: 2348341 - RNA, 15 nt, Human
uuugaaaagcuauua

SEQ ID NO: 2348342 - RNA, 18 nt, Human
uuugaaaagcuauuagcc

SEQ ID NO: 2348343 - RNA, 19 nt, Human
uuugaaaagcuauuagcca

SEQ ID NO: 2348344 - RNA, 24 nt, Human
augggagcuccucuccuggaggau

SEQ ID NO: 2348345 - RNA, 14 nt, Human
augggcacugcugg

SEQ ID NO: 2348346 - RNA, 14 nt, Human
augggcagagccca

SEQ ID NO: 2348347 - RNA, 18 nt, Human
augggcacugcugggugg

SEQ ID NO: 2348348 - RNA, 22 nt, Human
augggcacugcuggguggccca

SEQ ID NO: 2348349 - RNA, 15 nt, Human
augggcagagcagag

SEQ ID NO: 2348350 - RNA, 13 nt, Human
augggcagagcag

SEQ ID NO: 2348351 - RNA, 14 nt, Human
augggcagagcaga

SEQ ID NO: 2348352 - RNA, 15 nt, Human
augggccuccugugu

SEQ ID NO: 2348353 - RNA, 13 nt, Human
augggccaccgcc

SEQ ID NO: 2348354 - RNA, 12 nt, Human
augggccaccgc

SEQ ID NO: 2348355 - RNA, 14 nt, Human
augggcaguuacau

SEQ ID NO: 2348356 - RNA, 19 nt, Human
augggcaguuacaugcaua

SEQ ID NO: 2348357 - RNA, 23 nt, Human
augggcacugcuggguggcccau

SEQ ID NO: 2348358 - RNA, 22 nt, Human
augggcauggggugggccucug

SEQ ID NO: 2348359 - RNA, 23 nt, Human
augggcauggggugggccucugg

SEQ ID NO: 2348360 - RNA, 22 nt, Human
augggagccccagggucuuccc

SEQ ID NO: 2348361 - RNA, 20 nt, Human
augggagccgggucugccuc

SEQ ID NO: 2348362 - RNA, 17 nt, Human
augggagccgggucugc

SEQ ID NO: 2348363 - RNA, 13 nt, Human
augggagcucaug

SEQ ID NO: 2348364 - RNA, 13 nt, Human
augggagccccag

SEQ ID NO: 2348365 - RNA, 13 nt, Human
augggacugggag

SEQ ID NO: 2348366 - RNA, 23 nt, Human
augggagaguagauggugaaauu

SEQ ID NO: 2348367 - RNA, 15 nt, Human
augggacuggccucu

SEQ ID NO: 2348368 - RNA, 13 nt, Human
augggacauuuuu

SEQ ID NO: 2348369 - RNA, 18 nt, Human
augggcaacccccagccu

SEQ ID NO: 2348370 - RNA, 14 nt, Human
augggagcuccucu

SEQ ID NO: 2348371 - RNA, 15 nt, Human
augggagcuccucuc

SEQ ID NO: 2348372 - RNA, 19 nt, Human
augggagcuccucuccugg

SEQ ID NO: 2348373 - RNA, 20 nt, Human
augggagcuccucuccugga

SEQ ID NO: 2348374 - RNA, 21 nt, Human
augggagcuccucuccuggag

SEQ ID NO: 2348375 - RNA, 22 nt, Human
augggagcuccucuccuggagg

SEQ ID NO: 2348376 - RNA, 23 nt, Human
augggagcuccucuccuggagga

SEQ ID NO: 2348377 - RNA, 19 nt, Human
augggcaacccccagccug

SEQ ID NO: 2348378 - RNA, 21 nt, Human
augggcaacccccagccugcu

SEQ ID NO: 2348379 - RNA, 22 nt, Human
uuucccaucugcaccccuucuc

SEQ ID NO: 2348380 - RNA, 12 nt, Human
auggaauuugua

SEQ ID NO: 2348381 - RNA, 19 nt, Human
auggaauugauuugcauug

SEQ ID NO: 2348382 - RNA, 18 nt, Human
auggaauugauuugcauu

SEQ ID NO: 2348383 - RNA, 17 nt, Human
auggaauuucucccagu

SEQ ID NO: 2348384 - RNA, 19 nt, Human
auggacaugaucuucuuua

SEQ ID NO: 2348385 - RNA, 21 nt, Human
auggaauuuguaaguuuaugu

SEQ ID NO: 2348386 - RNA, 15 nt, Human
auggaauuuguaagu

SEQ ID NO: 2348387 - RNA, 17 nt, Human
auggaauuuguaaguuu

SEQ ID NO: 2348388 - RNA, 17 nt, Human
auggccucagcugccuc

SEQ ID NO: 2348389 - RNA, 16 nt, Human
auggccucagcugccu

SEQ ID NO: 2348390 - RNA, 13 nt, Human
auggacggugcuc

SEQ ID NO: 2348391 - RNA, 15 nt, Human
auggacggugcucca

SEQ ID NO: 2348392 - RNA, 20 nt, Human
auggacggugcuccaggcag

SEQ ID NO: 2348393 - RNA, 15 nt, Human
auggccucagcugcc

SEQ ID NO: 2348394 - RNA, 19 nt, Human
auggccucagcugccucac

SEQ ID NO: 2348395 - RNA, 18 nt, Human
auggccucagcugccuca

SEQ ID NO: 2348396 - RNA, 21 nt, Human
auggccucagcugccucacuu

SEQ ID NO: 2348397 - RNA, 13 nt, Human
auggccucaugug

SEQ ID NO: 2348398 - RNA, 14 nt, Human
auggaccugucacg

SEQ ID NO: 2348399 - RNA, 13 nt, Human
auggacccaaugc

SEQ ID NO: 2348400 - RNA, 18 nt, Human
auggacccaaugcacaca

SEQ ID NO: 2348401 - RNA, 21 nt, Human
auggacccaauauuuaccaga

SEQ ID NO: 2348402 - RNA, 18 nt, Human
auggccucuucagaucuc

SEQ ID NO: 2348403 - RNA, 17 nt, Human
auggccucauguggcug

SEQ ID NO: 2348404 - RNA, 18 nt, Human
auggccucauguggcugg

SEQ ID NO: 2348405 - RNA, 19 nt, Human
auggccucauguggcugga

SEQ ID NO: 2348406 - RNA, 20 nt, Human
auggccucauguggcuggaa

SEQ ID NO: 2348407 - RNA, 19 nt, Human
auggcuauaggugcuacaa

SEQ ID NO: 2348408 - RNA, 16 nt, Human
auggcuauaggugcua

SEQ ID NO: 2348409 - RNA, 22 nt, Human
augggacauuugcucauggaau

SEQ ID NO: 2348410 - RNA, 21 nt, Human
augggacauuugcucauggaa

SEQ ID NO: 2348411 - RNA, 23 nt, Human
auggcuauaggugcuacaaaaac

SEQ ID NO: 2348412 - RNA, 13 nt, Human
auggccuccuccc

SEQ ID NO: 2348413 - RNA, 17 nt, Human
auggacggugcuccagg

SEQ ID NO: 2348414 - RNA, 17 nt, Human
auggccugagaagagag

SEQ ID NO: 2348415 - RNA, 21 nt, Human
auggcuauaggugcuacaaaa

SEQ ID NO: 2348416 - RNA, 22 nt, Human
uuucgauucguuaagagagcaa

SEQ ID NO: 2348417 - RNA, 19 nt, Human
uuucgccguugaagaggaa

SEQ ID NO: 2348418 - RNA, 22 nt, Human
uuucgcaggauucuuccucccu

SEQ ID NO: 2348419 - RNA, 18 nt, Human
uuucgcaggauucuuccu

SEQ ID NO: 2348420 - RNA, 19 nt, Human
uuucgacuugcauuuuugc

SEQ ID NO: 2348421 - RNA, 15 nt, Human
uuucgacuugcauuu

SEQ ID NO: 2348422 - RNA, 15 nt, Human
uuucgagaagcugcu

SEQ ID NO: 2348423 - RNA, 19 nt, Human
uuucgagaagcugcucugg

SEQ ID NO: 2348424 - RNA, 14 nt, Human
uuucguuucuguau

SEQ ID NO: 2348425 - RNA, 14 nt, Human
uuucguuuguuugu

SEQ ID NO: 2348426 - RNA, 21 nt, Human
uuucgugggucuguuuuccuu

SEQ ID NO: 2348427 - RNA, 21 nt, Human
uuucgucuguuuauaaacauu

SEQ ID NO: 2348428 - RNA, 13 nt, Human
uuucguggggagg

SEQ ID NO: 2348429 - RNA, 17 nt, Human
uuucuaaacaagauuuu

SEQ ID NO: 2348430 - RNA, 13 nt, Human
uuucuaaacaaga

SEQ ID NO: 2348431 - RNA, 12 nt, Human
uuucuaaaacua

SEQ ID NO: 2348432 - RNA, 15 nt, Human
uuucuaaaacuaaau

SEQ ID NO: 2348433 - RNA, 14 nt, Human
uuucuaaaaaacag

SEQ ID NO: 2348434 - RNA, 19 nt, Human
uuucuaaaacuaaauagca

SEQ ID NO: 2348435 - RNA, 18 nt, Human
uuuccuuccuucccuggc

SEQ ID NO: 2348436 - RNA, 14 nt, Human
uuuccuucugaagu

SEQ ID NO: 2348437 - RNA, 18 nt, Human
uuuccuucucaucuguga

SEQ ID NO: 2348438 - RNA, 14 nt, Human
uuuccuugaagccg

SEQ ID NO: 2348439 - RNA, 13 nt, Human
uuuccuugaagcc

SEQ ID NO: 2348440 - RNA, 16 nt, Human
uuuccuucuugccuuc

SEQ ID NO: 2348441 - RNA, 19 nt, Human
uuuccuuggggcaggcagu

SEQ ID NO: 2348442 - RNA, 19 nt, Human
uuuccuuguccccacacuc

SEQ ID NO: 2348443 - RNA, 18 nt, Human
uuuccuuggggcaggcag

SEQ ID NO: 2348444 - RNA, 16 nt, Human
uuuccuuggcuggugc

SEQ ID NO: 2348445 - RNA, 12 nt, Human
uuuccuugcuca

SEQ ID NO: 2348446 - RNA, 23 nt, Human
uuuccuuggcucccauucacucu

SEQ ID NO: 2348447 - RNA, 21 nt, Human
uuuccuuuaaaaaaauuuaag

SEQ ID NO: 2348448 - RNA, 22 nt, Human
uuuccuuuaaaaaaauuuaagu

SEQ ID NO: 2348449 - RNA, 21 nt, Human
uuuccuuguccccacacuccu

SEQ ID NO: 2348450 - RNA, 19 nt, Human
uuuccuuucauuuacugug

SEQ ID NO: 2348451 - RNA, 16 nt, Human
uuuccuuuccccagcc

SEQ ID NO: 2348452 - RNA, 17 nt, Human
uuuccuuuccccagccc

SEQ ID NO: 2348453 - RNA, 23 nt, Human
uuuccuuuaaaaaaauuuaagug

SEQ ID NO: 2348454 - RNA, 19 nt, Human
uuuccuuuauauuuaguga

SEQ ID NO: 2348455 - RNA, 21 nt, Human
uuuccuuuuaaaacacuucca

SEQ ID NO: 2348456 - RNA, 14 nt, Human
uuuccuuucucacc

SEQ ID NO: 2348457 - RNA, 20 nt, Human
uuuccuuuccccagcccagg

SEQ ID NO: 2348458 - RNA, 12 nt, Human
uuuccuuuggag

SEQ ID NO: 2348459 - RNA, 23 nt, Human
uuuccuuugucaucauuguauau

SEQ ID NO: 2348460 - RNA, 16 nt, Human
uuuccuuugucaucau

SEQ ID NO: 2348461 - RNA, 21 nt, Human
uuuccuuuuuuaaaaaugcaa

SEQ ID NO: 2348462 - RNA, 13 nt, Human
uuuccuuuuuuau

SEQ ID NO: 2348463 - RNA, 18 nt, Human
uuuccuuuuuuauacaca

SEQ ID NO: 2348464 - RNA, 22 nt, Human
uuuccuuuuuuauacacauaau

SEQ ID NO: 2348465 - RNA, 16 nt, Human
uuuccuuuuuuaaaaa

SEQ ID NO: 2348466 - RNA, 15 nt, Human
uuuccuuuuuuaaaa

SEQ ID NO: 2348467 - RNA, 17 nt, Human
uuuccuuuuuuguuauu

SEQ ID NO: 2348468 - RNA, 16 nt, Human
uuuccuuuuuuguuau

SEQ ID NO: 2348469 - RNA, 13 nt, Human
uuuccuucagugc

SEQ ID NO: 2348470 - RNA, 23 nt, Human
uuuccuucauucaacccaccugc

SEQ ID NO: 2348471 - RNA, 15 nt, Human
uuuccuucucaucug

SEQ ID NO: 2348472 - RNA, 16 nt, Human
uuuccuuccuucccug

SEQ ID NO: 2348473 - RNA, 15 nt, Human
uuuccuuccaucccu

SEQ ID NO: 2348474 - RNA, 14 nt, Human
uuuccuuccauccc

SEQ ID NO: 2348475 - RNA, 19 nt, Human
uuuccuuccaucccuaccc

SEQ ID NO: 2348476 - RNA, 21 nt, Human
uuuccuucauucaacccaccu

SEQ ID NO: 2348477 - RNA, 22 nt, Human
uuuccuucagugccuuauggaa

SEQ ID NO: 2348478 - RNA, 18 nt, Human
uuuccuucagugccuuau

SEQ ID NO: 2348479 - RNA, 21 nt, Human
uuuccuucagugccuuaugga

SEQ ID NO: 2348480 - RNA, 19 nt, Human
uuuccuuaaauuaucuaaa

SEQ ID NO: 2348481 - RNA, 16 nt, Human
uuuccuuaaacugugu

SEQ ID NO: 2348482 - RNA, 23 nt, Human
uuuccuuaaacuguguggacugu

SEQ ID NO: 2348483 - RNA, 17 nt, Human
augggccuccugugugu

SEQ ID NO: 2348484 - RNA, 12 nt, Human
uuuccugugucu

SEQ ID NO: 2348485 - RNA, 11 nt, Human
uuuccuucagu

SEQ ID NO: 2348486 - RNA, 16 nt, Human
uuuccuuaauccagcu

SEQ ID NO: 2348487 - RNA, 13 nt, Human
uuuccuuaaucca

SEQ ID NO: 2348488 - RNA, 12 nt, Human
uuuccuucagug

SEQ ID NO: 2348489 - RNA, 15 nt, Human
uuuccuucagugccu

SEQ ID NO: 2348490 - RNA, 13 nt, Human
uuuacggacaccc

SEQ ID NO: 2348491 - RNA, 18 nt, Human
uuuacgcuuugauucaua

SEQ ID NO: 2348492 - RNA, 13 nt, Human
uuuacgcuuugau

SEQ ID NO: 2348493 - RNA, 21 nt, Human
uuuaccuuuuuuauacauaaa

SEQ ID NO: 2348494 - RNA, 17 nt, Human
uuuacggacacccccuc

SEQ ID NO: 2348495 - RNA, 18 nt, Human
uuuacgucugggagaaau

SEQ ID NO: 2348496 - RNA, 16 nt, Human
uuuaccuuuuaauuaa

SEQ ID NO: 2348497 - RNA, 15 nt, Human
uuuacuaaagaaaga

SEQ ID NO: 2348498 - RNA, 17 nt, Human
uuuacuaaagaaagauu

SEQ ID NO: 2348499 - RNA, 22 nt, Human
uuuacuaaagaaagauuacuua

SEQ ID NO: 2348500 - RNA, 18 nt, Human
uuuacuaauagacaauuu

SEQ ID NO: 2348501 - RNA, 15 nt, Human
uuuacuaagaugaca

SEQ ID NO: 2348502 - RNA, 16 nt, Human
uuuacuaagaugacau

SEQ ID NO: 2348503 - RNA, 21 nt, Human
uuuacuaagaugacauugcua

SEQ ID NO: 2348504 - RNA, 23 nt, Human
uuuacuaagaugacauugcuaag

SEQ ID NO: 2348505 - RNA, 20 nt, Human
uuuacuaagccacaagaaau

SEQ ID NO: 2348506 - RNA, 21 nt, Human
uuuacuaagccacaagaaauu

SEQ ID NO: 2348507 - RNA, 22 nt, Human
uuuacuaagccacaagaaauuu

SEQ ID NO: 2348508 - RNA, 19 nt, Human
uuuacuaauuuucuagauu

SEQ ID NO: 2348509 - RNA, 17 nt, Human
uuuacuaauagacaauu

SEQ ID NO: 2348510 - RNA, 14 nt, Human
uuuacuaauagaca

SEQ ID NO: 2348511 - RNA, 16 nt, Human
uuuaccugugaaauag

SEQ ID NO: 2348512 - RNA, 15 nt, Human
uuuaccugugaaaua

SEQ ID NO: 2348513 - RNA, 21 nt, Human
uuuaccugugcguuacuaauu

SEQ ID NO: 2348514 - RNA, 13 nt, Human
uuuaccuuguaua

SEQ ID NO: 2348515 - RNA, 14 nt, Human
uuuaccuuuuuuau

SEQ ID NO: 2348516 - RNA, 20 nt, Human
uuuaccuuuuuuauacauaa

SEQ ID NO: 2348517 - RNA, 19 nt, Human
uuuaccuuuuuuauacaua

SEQ ID NO: 2348518 - RNA, 19 nt, Human
augcggccgcauucccuga

SEQ ID NO: 2348519 - RNA, 21 nt, Human
augcggcccagcccggcuccc

SEQ ID NO: 2348520 - RNA, 21 nt, Human
augcuaauauaaguuucuuug

SEQ ID NO: 2348521 - RNA, 17 nt, Human
augcuacacacugcaug

SEQ ID NO: 2348522 - RNA, 18 nt, Human
augcuacacacugcaugu

SEQ ID NO: 2348523 - RNA, 16 nt, Human
uuuaccugcaaaaaau

SEQ ID NO: 2348524 - RNA, 13 nt, Human
uuuaccugagacc

SEQ ID NO: 2348525 - RNA, 16 nt, Human
uuuaccugagaccagu

SEQ ID NO: 2348526 - RNA, 13 nt, Human
augccucagcccu

SEQ ID NO: 2348527 - RNA, 23 nt, Human
augcgcaggcuggcccugcccug

SEQ ID NO: 2348528 - RNA, 15 nt, Human
augccucaaugugac

SEQ ID NO: 2348529 - RNA, 22 nt, Human
augccguggauugcacguggcc

SEQ ID NO: 2348530 - RNA, 17 nt, Human
augccggaugugcuuuu

SEQ ID NO: 2348531 - RNA, 20 nt, Human
augccggugagaauaagaga

SEQ ID NO: 2348532 - RNA, 18 nt, Human
augcggcaagaaggaauu

SEQ ID NO: 2348533 - RNA, 12 nt, Human
augcggcccagc

SEQ ID NO: 2348534 - RNA, 15 nt, Human
augcgcucagggcca

SEQ ID NO: 2348535 - RNA, 23 nt, Human
augcgcucagggccaugcugagg

SEQ ID NO: 2348536 - RNA, 13 nt, Human
augcgcccccucc

SEQ ID NO: 2348537 - RNA, 18 nt, Human
augcgcccccuccgcccu

SEQ ID NO: 2348538 - RNA, 22 nt, Human
augcgcccccuccgcccugcca

SEQ ID NO: 2348539 - RNA, 16 nt, Human
augcggcccaggaugg

SEQ ID NO: 2348540 - RNA, 20 nt, Human
augcggcccaggauggcuuu

SEQ ID NO: 2348541 - RNA, 13 nt, Human
augcggcccagcc

SEQ ID NO: 2348542 - RNA, 14 nt, Human
augcggcccagccc

SEQ ID NO: 2348543 - RNA, 15 nt, Human
augcggcccagcccg

SEQ ID NO: 2348544 - RNA, 18 nt, Human
augcggcccagcccggcu

SEQ ID NO: 2348545 - RNA, 13 nt, Human
augcuaagugaaa

SEQ ID NO: 2348546 - RNA, 23 nt, Human
uuuaaagcaacugucuauuucug

SEQ ID NO: 2348547 - RNA, 17 nt, Human
uuuaaagcaacugucua

SEQ ID NO: 2348548 - RNA, 20 nt, Human
uuuaaagcaacugucuauuu

SEQ ID NO: 2348549 - RNA, 14 nt, Human
augccggaugugcu

SEQ ID NO: 2348550 - RNA, 21 nt, Human
uuuaaaggaaaaaauguugga

SEQ ID NO: 2348551 - RNA, 15 nt, Human
augccggaugugcuu

SEQ ID NO: 2348552 - RNA, 16 nt, Human
augccggaugugcuuu

SEQ ID NO: 2348553 - RNA, 17 nt, Human
uuuaaaggcccuaucug

SEQ ID NO: 2348554 - RNA, 12 nt, Human
uuuaaaggaaaa

SEQ ID NO: 2348555 - RNA, 15 nt, Human
uuuaaaggaaaaaau

SEQ ID NO: 2348556 - RNA, 17 nt, Human
uuuaaaggaaaaaaugu

SEQ ID NO: 2348557 - RNA, 24 nt, Human
uuuaaagcuuauuaaaacucauuu

SEQ ID NO: 2348558 - RNA, 19 nt, Human
uuuauguaguaauugacau

SEQ ID NO: 2348559 - RNA, 22 nt, Human
uuuauguaaacugcauuagaaa

SEQ ID NO: 2348560 - RNA, 19 nt, Human
uuuauaugaagauaagugu

SEQ ID NO: 2348561 - RNA, 17 nt, Human
uuuauaugaagauaagu

SEQ ID NO: 2348562 - RNA, 20 nt, Human
uuuauaugcuuacugauaua

SEQ ID NO: 2348563 - RNA, 19 nt, Human
uuuauaugcuucuguuuua

SEQ ID NO: 2348564 - RNA, 21 nt, Human
uuuauaugaagaaaaucacuu

SEQ ID NO: 2348565 - RNA, 14 nt, Human
uuuauaugaagaaa

SEQ ID NO: 2348566 - RNA, 17 nt, Human
uuuauaugcuucuguuu

SEQ ID NO: 2348567 - RNA, 12 nt, Human
uuuauauauuua

SEQ ID NO: 2348568 - RNA, 23 nt, Human
uuuauauauugguaacauccuuu

SEQ ID NO: 2348569 - RNA, 13 nt, Human
uuuauauauguau

SEQ ID NO: 2348570 - RNA, 21 nt, Human
uuuauauauacaguaacuuua

SEQ ID NO: 2348571 - RNA, 16 nt, Human
uuuauauauuuauaac

SEQ ID NO: 2348572 - RNA, 15 nt, Human
uuuauaucacauguu

SEQ ID NO: 2348573 - RNA, 15 nt, Human
uuuauauauuuauaa

SEQ ID NO: 2348574 - RNA, 13 nt, Human
uuuauauauuuau

SEQ ID NO: 2348575 - RNA, 17 nt, Human
uuuauaucccauuuuua

SEQ ID NO: 2348576 - RNA, 17 nt, Human
uuuauaucagccugagu

SEQ ID NO: 2348577 - RNA, 21 nt, Human
uuuauuaaauacaaaacuucc

SEQ ID NO: 2348578 - RNA, 15 nt, Human
uuuauuaaauacaaa

SEQ ID NO: 2348579 - RNA, 19 nt, Human
uuuauuaaaugcccagccc

SEQ ID NO: 2348580 - RNA, 16 nt, Human
uuuauuacuguaagaa

SEQ ID NO: 2348581 - RNA, 12 nt, Human
uuuauuaacaaa

SEQ ID NO: 2348582 - RNA, 18 nt, Human
uuuauuaacaaauuaugu

SEQ ID NO: 2348583 - RNA, 16 nt, Human
uuuaugguuucuccag

SEQ ID NO: 2348584 - RNA, 22 nt, Human
uuuaugucccuucacauaguuu

SEQ ID NO: 2348585 - RNA, 14 nt, Human
uuuaugucuaaaga

SEQ ID NO: 2348586 - RNA, 19 nt, Human
uuuaugucuaaagagcuuu

SEQ ID NO: 2348587 - RNA, 14 nt, Human
uuuaugugaaacau

SEQ ID NO: 2348588 - RNA, 15 nt, Human
uuuaugugaaacaug

SEQ ID NO: 2348589 - RNA, 23 nt, Human
uuuauuaaacagauuuuuacaaa

SEQ ID NO: 2348590 - RNA, 18 nt, Human
uuuaugucuauuuaagcc

SEQ ID NO: 2348591 - RNA, 13 nt, Human
uuuacuauuuuac

SEQ ID NO: 2348592 - RNA, 17 nt, Human
uuuacucaacccucuca

SEQ ID NO: 2348593 - RNA, 21 nt, Human
uuuacucaacccucucaggug

SEQ ID NO: 2348594 - RNA, 15 nt, Human
uuuagauaauacacc

SEQ ID NO: 2348595 - RNA, 23 nt, Human
uuuagcaugacaagccccaggca

SEQ ID NO: 2348596 - RNA, 20 nt, Human
uuuagcaugacaagccccag

SEQ ID NO: 2348597 - RNA, 16 nt, Human
uuuagcauaaaauuuu

SEQ ID NO: 2348598 - RNA, 12 nt, Human
uuuagcaugugu

SEQ ID NO: 2348599 - RNA, 15 nt, Human
uuuagccaaacccuu

SEQ ID NO: 2348600 - RNA, 17 nt, Human
uuuagaucaaauacuuu

SEQ ID NO: 2348601 - RNA, 16 nt, Human
uuuagaucaaauacuu

SEQ ID NO: 2348602 - RNA, 21 nt, Human
uuuacuacuguggaaaaauau

SEQ ID NO: 2348603 - RNA, 20 nt, Human
uuuacuagaacacagaaagc

SEQ ID NO: 2348604 - RNA, 23 nt, Human
uuuacuacuguggaaaaauauuu

SEQ ID NO: 2348605 - RNA, 15 nt, Human
uuuacuaugccugug

SEQ ID NO: 2348606 - RNA, 18 nt, Human
uuuacuagggaucccuca

SEQ ID NO: 2348607 - RNA, 23 nt, Human
uuuacuagggaucccucaucugu

SEQ ID NO: 2348608 - RNA, 13 nt, Human
uuuagauaauaca

SEQ ID NO: 2348609 - RNA, 18 nt, Human
uuuagaguugauacuaca

SEQ ID NO: 2348610 - RNA, 15 nt, Human
uuuagccuaguucau

SEQ ID NO: 2348611 - RNA, 18 nt, Human
uuuagccaaacccuuguc

SEQ ID NO: 2348612 - RNA, 15 nt, Human
uuuagccaccaucuu

SEQ ID NO: 2348613 - RNA, 23 nt, Human
uuuagcuacuauauaugugauga

SEQ ID NO: 2348614 - RNA, 16 nt, Human
uuuagccuucucuguu

SEQ ID NO: 2348615 - RNA, 20 nt, Human
uuuagcucaaacguggcuuu

SEQ ID NO: 2348616 - RNA, 19 nt, Human
uuuaggucucuuccccucu

SEQ ID NO: 2348617 - RNA, 23 nt, Human
uuuagcugaugaacuuauucugu

SEQ ID NO: 2348618 - RNA, 21 nt, Human
uuuagcugaugaacuuauucu

SEQ ID NO: 2348619 - RNA, 13 nt, Human
uuuauauauacag

SEQ ID NO: 2348620 - RNA, 15 nt, Human
uuuauauauacagua

SEQ ID NO: 2348621 - RNA, 21 nt, Human
uuuaguaccugaaaaguaacu

SEQ ID NO: 2348622 - RNA, 16 nt, Human
uuuaguaaggcugugu

SEQ ID NO: 2348623 - RNA, 22 nt, Human
uuuaggucaagaagaagaugga

SEQ ID NO: 2348624 - RNA, 22 nt, Human
uuuagguguugauuuucuguug

SEQ ID NO: 2348625 - RNA, 22 nt, Human
uuuagguuuuuguuuguuuccu

SEQ ID NO: 2348626 - RNA, 16 nt, Human
auggaaggguuugugg

SEQ ID NO: 2348627 - RNA, 23 nt, Human
auggaacccuuuuggcccccgag

SEQ ID NO: 2348628 - RNA, 21 nt, Human
auggaaguacuauaauuuacc

SEQ ID NO: 2348629 - RNA, 16 nt, Human
augcuuauuuuaaaau

SEQ ID NO: 2348630 - RNA, 15 nt, Human
auggaacaggcucag

SEQ ID NO: 2348631 - RNA, 14 nt, Human
augcuuauuuuaaa

SEQ ID NO: 2348632 - RNA, 16 nt, Human
auggaacauaaaauac

SEQ ID NO: 2348633 - RNA, 19 nt, Human
augcuuaucaucuaaagau

SEQ ID NO: 2348634 - RNA, 23 nt, Human
augcuuagucccucaugcaaauc

SEQ ID NO: 2348635 - RNA, 23 nt, Human
augcuuagucacugccugcagag

SEQ ID NO: 2348636 - RNA, 21 nt, Human
augcuuagucccucaugcaaa

SEQ ID NO: 2348637 - RNA, 15 nt, Human
augcuuagucccuca

SEQ ID NO: 2348638 - RNA, 15 nt, Human
augcuuacaaaaaag

SEQ ID NO: 2348639 - RNA, 14 nt, Human
augcuuaguaaugc

SEQ ID NO: 2348640 - RNA, 15 nt, Human
augcuuaguaaugcu

SEQ ID NO: 2348641 - RNA, 15 nt, Human
augcuuagucacugc

SEQ ID NO: 2348642 - RNA, 18 nt, Human
auggaacacucugagacu

SEQ ID NO: 2348643 - RNA, 17 nt, Human
auggaacacucugagac

SEQ ID NO: 2348644 - RNA, 22 nt, Human
auggaagguuuguauauuguca

SEQ ID NO: 2348645 - RNA, 17 nt, Human
auggaagguuuguauau

SEQ ID NO: 2348646 - RNA, 16 nt, Human
auggaaccgcaggaag

SEQ ID NO: 2348647 - RNA, 16 nt, Human
uuuauuuuaauaaugu

SEQ ID NO: 2348648 - RNA, 15 nt, Human
auggaauaacaugua

SEQ ID NO: 2348649 - RNA, 14 nt, Human
auggaauaacaugu

SEQ ID NO: 2348650 - RNA, 22 nt, Human
uuuauuuucugguagauagaaa

SEQ ID NO: 2348651 - RNA, 16 nt, Human
uuuauuuuccucccca

SEQ ID NO: 2348652 - RNA, 21 nt, Human
uuuauuuucuuuuguaaaugu

SEQ ID NO: 2348653 - RNA, 17 nt, Human
uuuauuuuuuaaguauu

SEQ ID NO: 2348654 - RNA, 15 nt, Human
uuuauuuuuuacauu

SEQ ID NO: 2348655 - RNA, 13 nt, Human
uuuauuuuuuggg

SEQ ID NO: 2348656 - RNA, 14 nt, Human
uuuauuuuuuaagu

SEQ ID NO: 2348657 - RNA, 18 nt, Human
uuuauuuuguaauuauug

SEQ ID NO: 2348658 - RNA, 23 nt, Human
augcugugacacauggccccucc

SEQ ID NO: 2348659 - RNA, 19 nt, Human
augcugugcccuaaagugu

SEQ ID NO: 2348660 - RNA, 17 nt, Human
augcuuagauguuccag

SEQ ID NO: 2348661 - RNA, 23 nt, Human
augcuuacugauauauuuuacaa

SEQ ID NO: 2348662 - RNA, 22 nt, Human
augcuuacugauauauuuuaca

SEQ ID NO: 2348663 - RNA, 13 nt, Human
augcuuacugaua

SEQ ID NO: 2348664 - RNA, 14 nt, Human
augcuguauauguu

SEQ ID NO: 2348665 - RNA, 14 nt, Human
augcuguauuuuaa

SEQ ID NO: 2348666 - RNA, 19 nt, Human
augcuguauucuucuuugg

SEQ ID NO: 2348667 - RNA, 23 nt, Human
augcugucuacacuaagagagaa

SEQ ID NO: 2348668 - RNA, 22 nt, Human
augcuggggcaagucccugacu

SEQ ID NO: 2348669 - RNA, 15 nt, Human
augcugggcugggug

SEQ ID NO: 2348670 - RNA, 16 nt, Human
augcugggcugggugc

SEQ ID NO: 2348671 - RNA, 11 nt, Human
augcuggguug

SEQ ID NO: 2348672 - RNA, 19 nt, Human
augcuggguuggugcacag

SEQ ID NO: 2348673 - RNA, 23 nt, Human
augcuggguuggugcacagugau

SEQ ID NO: 2348674 - RNA, 23 nt, Human
augcuguacaucuauuuuggauu

SEQ ID NO: 2348675 - RNA, 19 nt, Human
augcuguauauccuuucua

SEQ ID NO: 2348676 - RNA, 16 nt, Human
augcugggcugacggu

SEQ ID NO: 2348677 - RNA, 16 nt, Human
augcugggacucagcc

SEQ ID NO: 2348678 - RNA, 12 nt, Human
augcugggcugg

SEQ ID NO: 2348679 - RNA, 14 nt, Human
augcugggcuggcu

SEQ ID NO: 2348680 - RNA, 21 nt, Human
augcugggcuggcucccucuu

SEQ ID NO: 2348681 - RNA, 14 nt, Human
augcugggcugggu

SEQ ID NO: 2348682 - RNA, 9 nt, Human
augcuggga

SEQ ID NO: 2348683 - RNA, 23 nt, Human
augcugggaagacgccugagcuc

SEQ ID NO: 2348684 - RNA, 10 nt, Human
augcugggac

SEQ ID NO: 2348685 - RNA, 15 nt, Human
augcugggacucagc

SEQ ID NO: 2348686 - RNA, 22 nt, Human
augcuggcuguuggcugggggc

SEQ ID NO: 2348687 - RNA, 12 nt, Human
uuuauuaagaug

SEQ ID NO: 2348688 - RNA, 19 nt, Human
uuuauuacuguaagaaaau

SEQ ID NO: 2348689 - RNA, 20 nt, Human
uuucauagauugagaaguuu

SEQ ID NO: 2348690 - RNA, 20 nt, Human
uuucauagcuaagaaauaaa

SEQ ID NO: 2348691 - RNA, 19 nt, Human
uuucauacucuagauuuug

SEQ ID NO: 2348692 - RNA, 22 nt, Human
uuucauacucuagauuuuguuu

SEQ ID NO: 2348693 - RNA, 19 nt, Human
uuuccagguuuaagcuguu

SEQ ID NO: 2348694 - RNA, 15 nt, Human
uuucauaugcuguau

SEQ ID NO: 2348695 - RNA, 12 nt, Human
uuucauaaucuu

SEQ ID NO: 2348696 - RNA, 14 nt, Human
uuucauaaucuuug

SEQ ID NO: 2348697 - RNA, 19 nt, Human
uuucauaaguauuucaaau

SEQ ID NO: 2348698 - RNA, 18 nt, Human
uuucauaaguauuucaaa

SEQ ID NO: 2348699 - RNA, 16 nt, Human
uuucauacucuagauu

SEQ ID NO: 2348700 - RNA, 17 nt, Human
uuucauacucuagauuu

SEQ ID NO: 2348701 - RNA, 18 nt, Human
uuucauacucuagauuuu

SEQ ID NO: 2348702 - RNA, 21 nt, Human
uuucauacagcauuacaaauu

SEQ ID NO: 2348703 - RNA, 14 nt, Human
uuucauacacuuau

SEQ ID NO: 2348704 - RNA, 17 nt, Human
uuucauaaguauuucaa

SEQ ID NO: 2348705 - RNA, 14 nt, Human
uuucauaaguauuu

SEQ ID NO: 2348706 - RNA, 20 nt, Human
uuucccagcuacaccuuucu

SEQ ID NO: 2348707 - RNA, 21 nt, Human
uuucccacuguuuaaggaguu

SEQ ID NO: 2348708 - RNA, 12 nt, Human
uuucccacugca

SEQ ID NO: 2348709 - RNA, 15 nt, Human
uuucccacugcaccc

SEQ ID NO: 2348710 - RNA, 18 nt, Human
uuucccacugcacccccu

SEQ ID NO: 2348711 - RNA, 18 nt, Human
uuucccaggacccugaag

SEQ ID NO: 2348712 - RNA, 16 nt, Human
uuucccaggacccuga

SEQ ID NO: 2348713 - RNA, 14 nt, Human
uuucccaggacccu

SEQ ID NO: 2348714 - RNA, 11 nt, Human
uuucccaggac

SEQ ID NO: 2348715 - RNA, 14 nt, Human
uuucccauaauuuu

SEQ ID NO: 2348716 - RNA, 12 nt, Human
uuucccauaauu

SEQ ID NO: 2348717 - RNA, 22 nt, Human
uuucccacugcacccccuccug

SEQ ID NO: 2348718 - RNA, 17 nt, Human
auggaauugauuugcau

SEQ ID NO: 2348719 - RNA, 12 nt, Human
uuucccaucugc

SEQ ID NO: 2348720 - RNA, 13 nt, Human
uuucccaucugca

SEQ ID NO: 2348721 - RNA, 23 nt, Human
auggaauuggagcucgugggaca

SEQ ID NO: 2348722 - RNA, 19 nt, Human
uuuccauaaagaagauguu

SEQ ID NO: 2348723 - RNA, 12 nt, Human
uuuccagugcaa

SEQ ID NO: 2348724 - RNA, 19 nt, Human
uuuccagugagcuuaucau

SEQ ID NO: 2348725 - RNA, 21 nt, Human
uuuccagucuccaccaggaac

SEQ ID NO: 2348726 - RNA, 20 nt, Human
uuuccagucuccaccaggaa

SEQ ID NO: 2348727 - RNA, 15 nt, Human
uuuccagucuccacc

SEQ ID NO: 2348728 - RNA, 15 nt, Human
uuuccaguaccuuug

SEQ ID NO: 2348729 - RNA, 15 nt, Human
uuuccauaaggaaug

SEQ ID NO: 2348730 - RNA, 18 nt, Human
uuuccauauggauuuucu

SEQ ID NO: 2348731 - RNA, 22 nt, Human
uuuccauauggauuuucuauug

SEQ ID NO: 2348732 - RNA, 12 nt, Human
uuuccauauguu

SEQ ID NO: 2348733 - RNA, 20 nt, Human
uuucccacaccguguaaacc

SEQ ID NO: 2348734 - RNA, 23 nt, Human
uuucccacaccguguaaaccaaa

SEQ ID NO: 2348735 - RNA, 15 nt, Human
uuucaguuuucagga

SEQ ID NO: 2348736 - RNA, 21 nt, Human
uuucaguugaucacuggcaau

SEQ ID NO: 2348737 - RNA, 12 nt, Human
uuucauaaagca

SEQ ID NO: 2348738 - RNA, 21 nt, Human
uuucacuuucacauagauguc

SEQ ID NO: 2348739 - RNA, 17 nt, Human
uuucacuuugugauuau

SEQ ID NO: 2348740 - RNA, 12 nt, Human
uuucacuuuaga

SEQ ID NO: 2348741 - RNA, 17 nt, Human
uuucacuuuagaugcug

SEQ ID NO: 2348742 - RNA, 22 nt, Human
uuucagaaaauauuauguguuu

SEQ ID NO: 2348743 - RNA, 24 nt, Human
uuucacucuuauugcccacgcugg

SEQ ID NO: 2348744 - RNA, 15 nt, Human
uuucacucuccuugg

SEQ ID NO: 2348745 - RNA, 24 nt, Human
uuucacugcuggcugccuuagaac

SEQ ID NO: 2348746 - RNA, 17 nt, Human
uuucacucccuccauca

SEQ ID NO: 2348747 - RNA, 23 nt, Human
uuucacuggccacaguuguuuga

SEQ ID NO: 2348748 - RNA, 24 nt, Human
uuucacuguagaaugauuucaugc

SEQ ID NO: 2348749 - RNA, 17 nt, Human
uuucacuggaguuacau

SEQ ID NO: 2348750 - RNA, 18 nt, Human
uuucacuggaguuacauu

SEQ ID NO: 2348751 - RNA, 19 nt, Human
uuucacuggaguuacauua

SEQ ID NO: 2348752 - RNA, 22 nt, Human
uuucaccccacccuuccccucc

SEQ ID NO: 2348753 - RNA, 13 nt, Human
uuucaccccuccc

SEQ ID NO: 2348754 - RNA, 14 nt, Human
uuucaccccucccu

SEQ ID NO: 2348755 - RNA, 15 nt, Human
uuucaccccucccuu

SEQ ID NO: 2348756 - RNA, 17 nt, Human
uuucaccccucccuuuc

SEQ ID NO: 2348757 - RNA, 18 nt, Human
uuucaccccucccuuucu

SEQ ID NO: 2348758 - RNA, 20 nt, Human
uuucaccccucccuuucucc

SEQ ID NO: 2348759 - RNA, 22 nt, Human
uuucaccccucccuuucucccc

SEQ ID NO: 2348760 - RNA, 23 nt, Human
uuucacuccggagugagaagcuu

SEQ ID NO: 2348761 - RNA, 14 nt, Human
uuucacucuccuug

SEQ ID NO: 2348762 - RNA, 14 nt, Human
uuuauuuuuuucua

SEQ ID NO: 2348763 - RNA, 16 nt, Human
uuuauuuuuugggaaa

SEQ ID NO: 2348764 - RNA, 17 nt, Human
uuuauuuuuuucugaau

SEQ ID NO: 2348765 - RNA, 15 nt, Human
uuucaaaaaaauaaa

SEQ ID NO: 2348766 - RNA, 15 nt, Human
uuucaaaaacacagu

SEQ ID NO: 2348767 - RNA, 13 nt, Human
uuucacauuuucc

SEQ ID NO: 2348768 - RNA, 13 nt, Human
uuucaaaaacauu

SEQ ID NO: 2348769 - RNA, 15 nt, Human
uuucaccacauucgu

SEQ ID NO: 2348770 - RNA, 14 nt, Human
uuucacauuuuccu

SEQ ID NO: 2348771 - RNA, 22 nt, Human
uuucaccauuugauuauguagc

SEQ ID NO: 2348772 - RNA, 17 nt, Human
uuucaccagauuugcua

SEQ ID NO: 2348773 - RNA, 19 nt, Human
auauguaguauaaagaaaa

SEQ ID NO: 2348774 - RNA, 18 nt, Human
auauguaguauaaagaaa

SEQ ID NO: 2348775 - RNA, 19 nt, Human
auauguacuugucaaagaa

SEQ ID NO: 2348776 - RNA, 20 nt, Human
auauguacuugucaaagaag

SEQ ID NO: 2348777 - RNA, 21 nt, Human
auauguacuugucaaagaagg

SEQ ID NO: 2348778 - RNA, 20 nt, Human
auauguggaguucaucuuga

SEQ ID NO: 2348779 - RNA, 21 nt, Human
auauguggaguucaucuugaa

SEQ ID NO: 2348780 - RNA, 16 nt, Human
auauggggaugcagca

SEQ ID NO: 2348781 - RNA, 20 nt, Human
auauggggaugcagcauuau

SEQ ID NO: 2348782 - RNA, 17 nt, Human
auauggggggccaacac

SEQ ID NO: 2348783 - RNA, 20 nt, Human
auaugggggccuggauucau

SEQ ID NO: 2348784 - RNA, 15 nt, Human
auaugggagaaauag

SEQ ID NO: 2348785 - RNA, 17 nt, Human
auaugggcauuguaguu

SEQ ID NO: 2348786 - RNA, 14 nt, Human
auaugggagaaaua

SEQ ID NO: 2348787 - RNA, 17 nt, Human
auaugggacauuuuuga

SEQ ID NO: 2348788 - RNA, 18 nt, Human
auauggggggccaacacc

SEQ ID NO: 2348789 - RNA, 23 nt, Human
auauggggggccaacaccaggga

SEQ ID NO: 2348790 - RNA, 17 nt, Human
auauggguucuuuuuug

SEQ ID NO: 2348791 - RNA, 17 nt, Human
auauguacuugucaaag

SEQ ID NO: 2348792 - RNA, 23 nt, Human
auauguaccuaacgaaguauccu

SEQ ID NO: 2348793 - RNA, 15 nt, Human
uucauuaaagcauuu

SEQ ID NO: 2348794 - RNA, 23 nt, Human
uucauuaaaggcuucucucucac

SEQ ID NO: 2348795 - RNA, 19 nt, Human
uucauuaagcccucuucca

SEQ ID NO: 2348796 - RNA, 21 nt, Human
uucauuaauaauaaauucccu

SEQ ID NO: 2348797 - RNA, 18 nt, Human
uucauuaauaauaaauuc

SEQ ID NO: 2348798 - RNA, 15 nt, Human
uucauuaauaauaaa

SEQ ID NO: 2348799 - RNA, 13 nt, Human
uucauuaaagcau

SEQ ID NO: 2348800 - RNA, 16 nt, Human
uucauggacacuuuga

SEQ ID NO: 2348801 - RNA, 20 nt, Human
uucauggacacuuugaaaug

SEQ ID NO: 2348802 - RNA, 14 nt, Human
uucauggacacuuu

SEQ ID NO: 2348803 - RNA, 15 nt, Human
uucauggacacuuug

SEQ ID NO: 2348804 - RNA, 20 nt, Human
auauguguguguauguuugc

SEQ ID NO: 2348805 - RNA, 22 nt, Human
auauguguauguacguuuguau

SEQ ID NO: 2348806 - RNA, 16 nt, Human
auauguguguguaugu

SEQ ID NO: 2348807 - RNA, 12 nt, Human
auauguguaugu

SEQ ID NO: 2348808 - RNA, 14 nt, Human
auauguguauguac

SEQ ID NO: 2348809 - RNA, 16 nt, Human
auauguguauguacgu

SEQ ID NO: 2348810 - RNA, 17 nt, Human
auauguaggugucugca

SEQ ID NO: 2348811 - RNA, 23 nt, Human
auauggccacaguagucuugaug

SEQ ID NO: 2348812 - RNA, 15 nt, Human
auaugcaaagcacug

SEQ ID NO: 2348813 - RNA, 15 nt, Human
auauggccucaagau

SEQ ID NO: 2348814 - RNA, 16 nt, Human
auauggccucaagauc

SEQ ID NO: 2348815 - RNA, 15 nt, Human
auaugggacauuuuu

SEQ ID NO: 2348816 - RNA, 15 nt, Human
auauggcuauaaaua

SEQ ID NO: 2348817 - RNA, 22 nt, Human
auauggcucuucauaauucuaa

SEQ ID NO: 2348818 - RNA, 14 nt, Human
auaugcaaagcacu

SEQ ID NO: 2348819 - RNA, 13 nt, Human
auaugcaaagcac

SEQ ID NO: 2348820 - RNA, 23 nt, Human
auaugagaaggugccucaagaau

SEQ ID NO: 2348821 - RNA, 22 nt, Human
auaugagcuuccuucugugaaa

SEQ ID NO: 2348822 - RNA, 12 nt, Human
auaugauuuaua

SEQ ID NO: 2348823 - RNA, 13 nt, Human
auaugauuuauag

SEQ ID NO: 2348824 - RNA, 14 nt, Human
auaugauuuauagu

SEQ ID NO: 2348825 - RNA, 16 nt, Human
auaugauuuuauuuga

SEQ ID NO: 2348826 - RNA, 19 nt, Human
auaugauuuuauuugacaa

SEQ ID NO: 2348827 - RNA, 22 nt, Human
auaugauuuuauuugacaaaau

SEQ ID NO: 2348828 - RNA, 23 nt, Human
auaugacggaagaacauagaacu

SEQ ID NO: 2348829 - RNA, 20 nt, Human
auaugacucacaugaugcau

SEQ ID NO: 2348830 - RNA, 21 nt, Human
auaugagcuuccuucugugaa

SEQ ID NO: 2348831 - RNA, 20 nt, Human
auaugacggaagaacauaga

SEQ ID NO: 2348832 - RNA, 18 nt, Human
auaugacggaagaacaua

SEQ ID NO: 2348833 - RNA, 13 nt, Human
auaugacucacau

SEQ ID NO: 2348834 - RNA, 16 nt, Human
auaugacggaagaaca

SEQ ID NO: 2348835 - RNA, 13 nt, Human
auaugaccucaug

SEQ ID NO: 2348836 - RNA, 19 nt, Human
auaugacauucaugccugg

SEQ ID NO: 2348837 - RNA, 22 nt, Human
auaugaauacagggcaugcauu

SEQ ID NO: 2348838 - RNA, 17 nt, Human
auaugaauuuaaauaua

SEQ ID NO: 2348839 - RNA, 17 nt, Human
auaugaagcucaccugu

SEQ ID NO: 2348840 - RNA, 21 nt, Human
auaugaagcucaccuguugcu

SEQ ID NO: 2348841 - RNA, 21 nt, Human
auaugacagcugucccuguca

SEQ ID NO: 2348842 - RNA, 15 nt, Human
auaugacagcugucc

SEQ ID NO: 2348843 - RNA, 14 nt, Human
auaugacagcuguc

SEQ ID NO: 2348844 - RNA, 21 nt, Human
auaugaauuuaaauauaauuc

SEQ ID NO: 2348845 - RNA, 15 nt, Human
auaugaacauauugu

SEQ ID NO: 2348846 - RNA, 20 nt, Human
auaugaacauauuguugaaa

SEQ ID NO: 2348847 - RNA, 19 nt, Human
auaugaacauauuguugaa

SEQ ID NO: 2348848 - RNA, 14 nt, Human
auaugaagacauaa

SEQ ID NO: 2348849 - RNA, 15 nt, Human
auaugaagacauaaa

SEQ ID NO: 2348850 - RNA, 16 nt, Human
auaugaagacauaaac

SEQ ID NO: 2348851 - RNA, 14 nt, Human
auaugaaauuuaau

SEQ ID NO: 2348852 - RNA, 14 nt, Human
auauauuuuuaaga

SEQ ID NO: 2348853 - RNA, 16 nt, Human
auauauuuuuaagaua

SEQ ID NO: 2348854 - RNA, 23 nt, Human
auauauuuuuaagauaauaauau

SEQ ID NO: 2348855 - RNA, 14 nt, Human
auauauuuuuauau

SEQ ID NO: 2348856 - RNA, 14 nt, Human
auauauuucuuugu

SEQ ID NO: 2348857 - RNA, 18 nt, Human
auauauuuuacaauuuuu

SEQ ID NO: 2348858 - RNA, 15 nt, Human
auauauuuucuguuu

SEQ ID NO: 2348859 - RNA, 18 nt, Human
uuccaguaccuuugucac

SEQ ID NO: 2348860 - RNA, 17 nt, Human
uuccaguaccuuuguca

SEQ ID NO: 2348861 - RNA, 19 nt, Human
uuccaguaccuuugucaca

SEQ ID NO: 2348862 - RNA, 17 nt, Human
uuccagguuuaagcugu

SEQ ID NO: 2348863 - RNA, 18 nt, Human
uuccagguuuaagcuguu

SEQ ID NO: 2348864 - RNA, 19 nt, Human
uuccacgucccccuggggc

SEQ ID NO: 2348865 - RNA, 24 nt, Human
uuccacggagccacuccucugacu

SEQ ID NO: 2348866 - RNA, 13 nt, Human
uuccaggcuggga

SEQ ID NO: 2348867 - RNA, 15 nt, Human
uuccaggcugggaga

SEQ ID NO: 2348868 - RNA, 17 nt, Human
uuccaggcugggagagc

SEQ ID NO: 2348869 - RNA, 19 nt, Human
uuccacguguuuuauuccu

SEQ ID NO: 2348870 - RNA, 11 nt, Human
uuccaccagcc

SEQ ID NO: 2348871 - RNA, 22 nt, Human
uuccaccacagccagcaccugg

SEQ ID NO: 2348872 - RNA, 18 nt, Human
uuccaccaucaagccacc

SEQ ID NO: 2348873 - RNA, 12 nt, Human
uuccaccagccu

SEQ ID NO: 2348874 - RNA, 14 nt, Human
uuccaccucccucc

SEQ ID NO: 2348875 - RNA, 15 nt, Human
uuccaccucccuccc

SEQ ID NO: 2348876 - RNA, 19 nt, Human
uuccacgcugucuccagac

SEQ ID NO: 2348877 - RNA, 18 nt, Human
uuccacgcugucuccaga

SEQ ID NO: 2348878 - RNA, 15 nt, Human
uuccacggagccacu

SEQ ID NO: 2348879 - RNA, 22 nt, Human
uuccacggagccacuccucuga

SEQ ID NO: 2348880 - RNA, 21 nt, Human
uuccacggagccacuccucug

SEQ ID NO: 2348881 - RNA, 15 nt, Human
uuccaccuucccaug

SEQ ID NO: 2348882 - RNA, 15 nt, Human
uuccacgcugucucc

SEQ ID NO: 2348883 - RNA, 19 nt, Human
uuccacgaugaaaaacuuc

SEQ ID NO: 2348884 - RNA, 14 nt, Human
uuccacgaugaaaa

SEQ ID NO: 2348885 - RNA, 22 nt, Human
uuccacaucuacguuuuuggug

SEQ ID NO: 2348886 - RNA, 15 nt, Human
uuccaccacagccag

SEQ ID NO: 2348887 - RNA, 16 nt, Human
uuccaccacagccagc

SEQ ID NO: 2348888 - RNA, 21 nt, Human
uuccaccacagccagcaccug

SEQ ID NO: 2348889 - RNA, 16 nt, Human
uuccacauauaaagcu

SEQ ID NO: 2348890 - RNA, 21 nt, Human
uuccacagccugcaagucagu

SEQ ID NO: 2348891 - RNA, 21 nt, Human
uuccacaagagcccaggccuc

SEQ ID NO: 2348892 - RNA, 18 nt, Human
uucauuauuggaauuaac

SEQ ID NO: 2348893 - RNA, 17 nt, Human
uucauuauuggaauuaa

SEQ ID NO: 2348894 - RNA, 13 nt, Human
uucauuauuggaa

SEQ ID NO: 2348895 - RNA, 20 nt, Human
uucauuauuggaauuaaccu

SEQ ID NO: 2348896 - RNA, 13 nt, Human
uucauucuuagcu

SEQ ID NO: 2348897 - RNA, 16 nt, Human
uucauucuucucuagc

SEQ ID NO: 2348898 - RNA, 18 nt, Human
uucauugauaugaaaaau

SEQ ID NO: 2348899 - RNA, 18 nt, Human
uucauucuucucuagcug

SEQ ID NO: 2348900 - RNA, 17 nt, Human
uucauugagaguuuugu

SEQ ID NO: 2348901 - RNA, 19 nt, Human
uucauugagaguuuugucu

SEQ ID NO: 2348902 - RNA, 22 nt, Human
uucauugagaguuuugucuuga

SEQ ID NO: 2348903 - RNA, 13 nt, Human
uucauucuugaaa

SEQ ID NO: 2348904 - RNA, 19 nt, Human
uucauucuugaaagcugug

SEQ ID NO: 2348905 - RNA, 16 nt, Human
uucauugacuaucaaa

SEQ ID NO: 2348906 - RNA, 21 nt, Human
uucauggacacuuugaaaugu

SEQ ID NO: 2348907 - RNA, 14 nt, Human
uucauuauguaaaa

SEQ ID NO: 2348908 - RNA, 17 nt, Human
uucauuauguaaaaugu

SEQ ID NO: 2348909 - RNA, 22 nt, Human
uucauuauuaguacugcucuug

SEQ ID NO: 2348910 - RNA, 14 nt, Human
uucauuaucucaaa

SEQ ID NO: 2348911 - RNA, 13 nt, Human
uucauuagagcag

SEQ ID NO: 2348912 - RNA, 16 nt, Human
uucauuaauucuauaa

SEQ ID NO: 2348913 - RNA, 13 nt, Human
uucauuacagcuu

SEQ ID NO: 2348914 - RNA, 18 nt, Human
uucauuacagcuuaauca

SEQ ID NO: 2348915 - RNA, 13 nt, Human
uucauuaccuuuu

SEQ ID NO: 2348916 - RNA, 21 nt, Human
uucauuaccuuuuuugauaaa

SEQ ID NO: 2348917 - RNA, 20 nt, Human
uuccaagacauugucaauaa

SEQ ID NO: 2348918 - RNA, 19 nt, Human
uuccaagacauugucaaua

SEQ ID NO: 2348919 - RNA, 17 nt, Human
uuccaagacauugucaa

SEQ ID NO: 2348920 - RNA, 16 nt, Human
uuccaagacauuguca

SEQ ID NO: 2348921 - RNA, 22 nt, Human
uuccaauuuacauacucugcuu

SEQ ID NO: 2348922 - RNA, 18 nt, Human
uuccacaaaaucugucca

SEQ ID NO: 2348923 - RNA, 11 nt, Human
uuccacaaaau

SEQ ID NO: 2348924 - RNA, 21 nt, Human
uuccaauuuucuggaauacau

SEQ ID NO: 2348925 - RNA, 12 nt, Human
uuccaagacagu

SEQ ID NO: 2348926 - RNA, 14 nt, Human
uuccaagacaguau

SEQ ID NO: 2348927 - RNA, 14 nt, Human
uuccaagacauugu

SEQ ID NO: 2348928 - RNA, 13 nt, Human
uuccaagacauug

SEQ ID NO: 2348929 - RNA, 12 nt, Human
uuccaagacauu

SEQ ID NO: 2348930 - RNA, 22 nt, Human
uuccaagacaguauacaguccu

SEQ ID NO: 2348931 - RNA, 21 nt, Human
uuccaagacaugucuguucua

SEQ ID NO: 2348932 - RNA, 16 nt, Human
uuccaagacaugucug

SEQ ID NO: 2348933 - RNA, 22 nt, Human
uuccaacuguauauauucccaa

SEQ ID NO: 2348934 - RNA, 12 nt, Human
uucauuguaaaa

SEQ ID NO: 2348935 - RNA, 20 nt, Human
uucauugcccccagggcacu

SEQ ID NO: 2348936 - RNA, 19 nt, Human
uucauugcacuuugauuag

SEQ ID NO: 2348937 - RNA, 21 nt, Human
uucauugccuuaacuggagcc

SEQ ID NO: 2348938 - RNA, 22 nt, Human
uucagauauaaaagacugacca

SEQ ID NO: 2348939 - RNA, 19 nt, Human
uucagaaccucuuccccag

SEQ ID NO: 2348940 - RNA, 18 nt, Human
uucagaaccucuucccca

SEQ ID NO: 2348941 - RNA, 17 nt, Human
uucagaaccucuucccc

SEQ ID NO: 2348942 - RNA, 16 nt, Human
uucagaaccucuuccc

SEQ ID NO: 2348943 - RNA, 16 nt, Human
uucagaagacacugca

SEQ ID NO: 2348944 - RNA, 19 nt, Human
uucagauauaaaagacuga

SEQ ID NO: 2348945 - RNA, 15 nt, Human
uucagauauauauca

SEQ ID NO: 2348946 - RNA, 16 nt, Human
uucagauauauuuuuc

SEQ ID NO: 2348947 - RNA, 14 nt, Human
uucagauucccaga

SEQ ID NO: 2348948 - RNA, 14 nt, Human
uucagauugcuuug

SEQ ID NO: 2348949 - RNA, 22 nt, Human
uucagauucccagagcaaaaua

SEQ ID NO: 2348950 - RNA, 21 nt, Human
uucagauucccagagcaaaau

SEQ ID NO: 2348951 - RNA, 16 nt, Human
uucagauuugccuuau

SEQ ID NO: 2348952 - RNA, 23 nt, Human
uucagaaaacccuuuucuacagu

SEQ ID NO: 2348953 - RNA, 20 nt, Human
uucacuuuugacaaaggcaa

SEQ ID NO: 2348954 - RNA, 17 nt, Human
uucacuuuugacaaagg

SEQ ID NO: 2348955 - RNA, 16 nt, Human
uucagaaauguguuau

SEQ ID NO: 2348956 - RNA, 15 nt, Human
uucagaaccucuucc

SEQ ID NO: 2348957 - RNA, 12 nt, Human
uucagaaccucu

SEQ ID NO: 2348958 - RNA, 16 nt, Human
uucagaaccauccaua

SEQ ID NO: 2348959 - RNA, 20 nt, Human
uucagaaauuggaacagaau

SEQ ID NO: 2348960 - RNA, 20 nt, Human
uucacuuuuagggagaguca

SEQ ID NO: 2348961 - RNA, 13 nt, Human
uucagaaauugga

SEQ ID NO: 2348962 - RNA, 21 nt, Human
uucagaaauuggaacagaaug

SEQ ID NO: 2348963 - RNA, 19 nt, Human
uucacuuucacauagaugu

SEQ ID NO: 2348964 - RNA, 17 nt, Human
uucacuuuagaugcuga

SEQ ID NO: 2348965 - RNA, 17 nt, Human
uucacuuucaaaaacau

SEQ ID NO: 2348966 - RNA, 13 nt, Human
uucacuuuaauuc

SEQ ID NO: 2348967 - RNA, 16 nt, Human
uucacuuuagaugcug

SEQ ID NO: 2348968 - RNA, 18 nt, Human
uucacuucucccaagacu

SEQ ID NO: 2348969 - RNA, 18 nt, Human
uucacuucaucuucucag

SEQ ID NO: 2348970 - RNA, 14 nt, Human
uucacuucucccaa

SEQ ID NO: 2348971 - RNA, 21 nt, Human
uuaucauguguaaucaauaaa

SEQ ID NO: 2348972 - RNA, 15 nt, Human
uuaucauguguaauc

SEQ ID NO: 2348973 - RNA, 18 nt, Human
uuaucauguguaaucaau

SEQ ID NO: 2348974 - RNA, 19 nt, Human
uuaucauucauucuuagcu

SEQ ID NO: 2348975 - RNA, 18 nt, Human
uuaucauucaaguguaaa

SEQ ID NO: 2348976 - RNA, 19 nt, Human
uucacuucauaauccagua

SEQ ID NO: 2348977 - RNA, 15 nt, Human
uucacuucaucuucu

SEQ ID NO: 2348978 - RNA, 16 nt, Human
uucacuucaucuucuc

SEQ ID NO: 2348979 - RNA, 14 nt, Human
uucaggguuggccc

SEQ ID NO: 2348980 - RNA, 18 nt, Human
uucagcucacacaugaga

SEQ ID NO: 2348981 - RNA, 16 nt, Human
uucagggugaugccag

SEQ ID NO: 2348982 - RNA, 16 nt, Human
uucaggguuggccccu

SEQ ID NO: 2348983 - RNA, 17 nt, Human
uucaggguuggccccug

SEQ ID NO: 2348984 - RNA, 19 nt, Human
uucaggguuggccccugcc

SEQ ID NO: 2348985 - RNA, 22 nt, Human
uucaggguuggccccugcccgg

SEQ ID NO: 2348986 - RNA, 15 nt, Human
uucagguaacaggca

SEQ ID NO: 2348987 - RNA, 16 nt, Human
uucagguaacaggcag

SEQ ID NO: 2348988 - RNA, 16 nt, Human
uucagcgauguaugca

SEQ ID NO: 2348989 - RNA, 10 nt, Human
uucagccaag

SEQ ID NO: 2348990 - RNA, 24 nt, Human
uucagcgauguaugcagcuaucug

SEQ ID NO: 2348991 - RNA, 14 nt, Human
uucagcuaagcuag

SEQ ID NO: 2348992 - RNA, 20 nt, Human
uucagcuaagcuaggaauga

SEQ ID NO: 2348993 - RNA, 17 nt, Human
uucagcgguuuauauaa

SEQ ID NO: 2348994 - RNA, 16 nt, Human
uucagcauauuuauag

SEQ ID NO: 2348995 - RNA, 20 nt, Human
uucagcacugucccuugccu

SEQ ID NO: 2348996 - RNA, 20 nt, Human
uucagauuuuaaaaagucuu

SEQ ID NO: 2348997 - RNA, 14 nt, Human
uucagcacuguccc

SEQ ID NO: 2348998 - RNA, 15 nt, Human
uucagcacugucccu

SEQ ID NO: 2348999 - RNA, 16 nt, Human
uucagcacugucccuu

SEQ ID NO: 2349000 - RNA, 21 nt, Human
uucagcacugucccuugccuc

SEQ ID NO: 2349001 - RNA, 13 nt, Human
auauauuuuaauu

SEQ ID NO: 2349002 - RNA, 16 nt, Human
auauauuuuacaauuu

SEQ ID NO: 2349003 - RNA, 15 nt, Human
auauauuuuaagacg

SEQ ID NO: 2349004 - RNA, 14 nt, Human
auauauuucagaua

SEQ ID NO: 2349005 - RNA, 23 nt, Human
auauauuuauaacucaucauaaa

SEQ ID NO: 2349006 - RNA, 20 nt, Human
auauauguuuaccuuuuaau

SEQ ID NO: 2349007 - RNA, 22 nt, Human
auauauuucacguguucccucu

SEQ ID NO: 2349008 - RNA, 21 nt, Human
auauauuuauaacucaucaua

SEQ ID NO: 2349009 - RNA, 16 nt, Human
auauauuuauaacuca

SEQ ID NO: 2349010 - RNA, 15 nt, Human
auauauuuauaacuc

SEQ ID NO: 2349011 - RNA, 14 nt, Human
auauauuuauaacu

SEQ ID NO: 2349012 - RNA, 9 nt, Human
auauauuuc

SEQ ID NO: 2349013 - RNA, 21 nt, Human
auauauguuuuaagaggcagg

SEQ ID NO: 2349014 - RNA, 22 nt, Human
auauauguuuuaagaggcaggg

SEQ ID NO: 2349015 - RNA, 14 nt, Human
auauauguuuaccu

SEQ ID NO: 2349016 - RNA, 17 nt, Human
auauauguuuaccuuuu

SEQ ID NO: 2349017 - RNA, 16 nt, Human
auauauuuaaugauaa

SEQ ID NO: 2349018 - RNA, 13 nt, Human
auauauuuauaac

SEQ ID NO: 2349019 - RNA, 12 nt, Human
auauauuuauaa

SEQ ID NO: 2349020 - RNA, 10 nt, Human
auauauuuau

SEQ ID NO: 2349021 - RNA, 17 nt, Human
auauauguuuuugaagg

SEQ ID NO: 2349022 - RNA, 14 nt, Human
uucaucaagacugg

SEQ ID NO: 2349023 - RNA, 13 nt, Human
uucaucaaucauu

SEQ ID NO: 2349024 - RNA, 16 nt, Human
uucaucaaucauugua

SEQ ID NO: 2349025 - RNA, 22 nt, Human
uucaucaaucauuguacaguuu

SEQ ID NO: 2349026 - RNA, 15 nt, Human
uucaucaaugaauga

SEQ ID NO: 2349027 - RNA, 13 nt, Human
auauaugcuaagu

SEQ ID NO: 2349028 - RNA, 23 nt, Human
auauauguguuuuucacauuugc

SEQ ID NO: 2349029 - RNA, 21 nt, Human
auauauguguuuuucacauuu

SEQ ID NO: 2349030 - RNA, 15 nt, Human
auauauguguuuuuc

SEQ ID NO: 2349031 - RNA, 13 nt, Human
auauauguguuuu

SEQ ID NO: 2349032 - RNA, 21 nt, Human
auauauggcagaguuguaaau

SEQ ID NO: 2349033 - RNA, 22 nt, Human
auauauggcagaguuguaaaua

SEQ ID NO: 2349034 - RNA, 19 nt, Human
uucaucauauuauacagac

SEQ ID NO: 2349035 - RNA, 14 nt, Human
auauauggauaaug

SEQ ID NO: 2349036 - RNA, 13 nt, Human
auauauggcagag

SEQ ID NO: 2349037 - RNA, 14 nt, Human
auauauggcagagu

SEQ ID NO: 2349038 - RNA, 17 nt, Human
auauauggcagaguugu

SEQ ID NO: 2349039 - RNA, 19 nt, Human
auauauggcagaguuguaa

SEQ ID NO: 2349040 - RNA, 20 nt, Human
auauauggcagaguuguaaa

SEQ ID NO: 2349041 - RNA, 15 nt, Human
uucaguaaaaaacaa

SEQ ID NO: 2349042 - RNA, 18 nt, Human
uucaguauuuuggagaaa

SEQ ID NO: 2349043 - RNA, 19 nt, Human
uucaguauuuuggagaaau

SEQ ID NO: 2349044 - RNA, 20 nt, Human
uucaguauuuuggagaaauu

SEQ ID NO: 2349045 - RNA, 21 nt, Human
uucaguauuuuggagaaauua

SEQ ID NO: 2349046 - RNA, 21 nt, Human
uucagucauauaaaagcuaug

SEQ ID NO: 2349047 - RNA, 19 nt, Human
uucagguuuuguaaagaug

SEQ ID NO: 2349048 - RNA, 15 nt, Human
uucagguuuuguaaa

SEQ ID NO: 2349049 - RNA, 24 nt, Human
uucagguuaucgaaauaacaaugu

SEQ ID NO: 2349050 - RNA, 22 nt, Human
uucagguuaucgaaauaacaau

SEQ ID NO: 2349051 - RNA, 16 nt, Human
uucagguuuuaguuuu

SEQ ID NO: 2349052 - RNA, 14 nt, Human
uucaguaagccgug

SEQ ID NO: 2349053 - RNA, 20 nt, Human
uucagguguuuaguugcaga

SEQ ID NO: 2349054 - RNA, 19 nt, Human
uucagguuaucgaaauaac

SEQ ID NO: 2349055 - RNA, 20 nt, Human
uucagguuaucgaaauaaca

SEQ ID NO: 2349056 - RNA, 21 nt, Human
uucagguuaucgaaauaacaa

SEQ ID NO: 2349057 - RNA, 21 nt, Human
uucaggugacaugugaaaccu

SEQ ID NO: 2349058 - RNA, 22 nt, Human
uucaggugacaugugaaaccuu

SEQ ID NO: 2349059 - RNA, 23 nt, Human
uucaggugacaugugaaaccuuu

SEQ ID NO: 2349060 - RNA, 13 nt, Human
uucaggugacaug

SEQ ID NO: 2349061 - RNA, 14 nt, Human
uucaggugacaugu

SEQ ID NO: 2349062 - RNA, 16 nt, Human
uucaggugacauguga

SEQ ID NO: 2349063 - RNA, 17 nt, Human
uucaggugacaugugaa

SEQ ID NO: 2349064 - RNA, 18 nt, Human
uucaggugacaugugaaa

SEQ ID NO: 2349065 - RNA, 19 nt, Human
uucaggugacaugugaaac

SEQ ID NO: 2349066 - RNA, 17 nt, Human
uucagguaacaggcaga

SEQ ID NO: 2349067 - RNA, 14 nt, Human
uucagguacuaaau

SEQ ID NO: 2349068 - RNA, 19 nt, Human
uucagguagcugccccugg

SEQ ID NO: 2349069 - RNA, 16 nt, Human
uucagguauguugccu

SEQ ID NO: 2349070 - RNA, 16 nt, Human
uucagugaaagcauca

SEQ ID NO: 2349071 - RNA, 20 nt, Human
uucagugagggucuucuuac

SEQ ID NO: 2349072 - RNA, 16 nt, Human
uucagugauuacuguc

SEQ ID NO: 2349073 - RNA, 14 nt, Human
uucauaggucacug

SEQ ID NO: 2349074 - RNA, 19 nt, Human
uucauaggucacuggcucu

SEQ ID NO: 2349075 - RNA, 17 nt, Human
uucauaguaacuucuua

SEQ ID NO: 2349076 - RNA, 20 nt, Human
uucauaucuauuuauuaaau

SEQ ID NO: 2349077 - RNA, 20 nt, Human
uucauaugacauucaugccu

SEQ ID NO: 2349078 - RNA, 21 nt, Human
uucauauaugaggacuugugu

SEQ ID NO: 2349079 - RNA, 18 nt, Human
uucauauaugaggacuug

SEQ ID NO: 2349080 - RNA, 19 nt, Human
uucaucaaauggaagacac

SEQ ID NO: 2349081 - RNA, 16 nt, Human
uucaucaaauggaaga

SEQ ID NO: 2349082 - RNA, 23 nt, Human
uucauaugacauucaugccuggc

SEQ ID NO: 2349083 - RNA, 23 nt, Human
uucccgaaccccaaggagggaga

SEQ ID NO: 2349084 - RNA, 21 nt, Human
uucccgagcaaagucuaaagu

SEQ ID NO: 2349085 - RNA, 17 nt, Human
uuccccuuuccccacuc

SEQ ID NO: 2349086 - RNA, 14 nt, Human
uuccccuuucccca

SEQ ID NO: 2349087 - RNA, 22 nt, Human
uuccccuugcccuugcccugac

SEQ ID NO: 2349088 - RNA, 23 nt, Human
uuccccuugcccuugcccugacc

SEQ ID NO: 2349089 - RNA, 13 nt, Human
uuccccuugcccu

SEQ ID NO: 2349090 - RNA, 14 nt, Human
uuccccuugcccuu

SEQ ID NO: 2349091 - RNA, 20 nt, Human
uuccccuugcccuugcccug

SEQ ID NO: 2349092 - RNA, 21 nt, Human
uuccccuugcccuugcccuga

SEQ ID NO: 2349093 - RNA, 14 nt, Human
uucccgcucagccc

SEQ ID NO: 2349094 - RNA, 15 nt, Human
uucccgcucagcccu

SEQ ID NO: 2349095 - RNA, 12 nt, Human
uucccgcucagc

SEQ ID NO: 2349096 - RNA, 22 nt, Human
uucccgagcaaagucuaaaguu

SEQ ID NO: 2349097 - RNA, 23 nt, Human
uucccgagcaaagucuaaaguuu

SEQ ID NO: 2349098 - RNA, 13 nt, Human
auauuugcuuuuu

SEQ ID NO: 2349099 - RNA, 21 nt, Human
auauuugaaucuugucucaau

SEQ ID NO: 2349100 - RNA, 15 nt, Human
auauuuacauaugaa

SEQ ID NO: 2349101 - RNA, 23 nt, Human
auauuuacagugaaaauguaagc

SEQ ID NO: 2349102 - RNA, 17 nt, Human
auauuugaaucuugucu

SEQ ID NO: 2349103 - RNA, 18 nt, Human
auauuugaaucuugucuc

SEQ ID NO: 2349104 - RNA, 19 nt, Human
auauuugaaucuugucuca

SEQ ID NO: 2349105 - RNA, 21 nt, Human
auauuugaauguaugcuucau

SEQ ID NO: 2349106 - RNA, 15 nt, Human
uucccuaagccaagg

SEQ ID NO: 2349107 - RNA, 19 nt, Human
uucccguggccccagccug

SEQ ID NO: 2349108 - RNA, 17 nt, Human
uucccguuucuccaccu

SEQ ID NO: 2349109 - RNA, 14 nt, Human
uucccguuucucca

SEQ ID NO: 2349110 - RNA, 15 nt, Human
uucccguuucuccac

SEQ ID NO: 2349111 - RNA, 13 nt, Human
uucccguggcccc

SEQ ID NO: 2349112 - RNA, 15 nt, Human
uucccguggccccag

SEQ ID NO: 2349113 - RNA, 16 nt, Human
uucccguggccccagc

SEQ ID NO: 2349114 - RNA, 17 nt, Human
uucccguggccccagcc

SEQ ID NO: 2349115 - RNA, 19 nt, Human
uucccuaagccaagggccu

SEQ ID NO: 2349116 - RNA, 16 nt, Human
uucccuaaucuauggu

SEQ ID NO: 2349117 - RNA, 14 nt, Human
uucccuaccucagg

SEQ ID NO: 2349118 - RNA, 13 nt, Human
uucccuaccucag

SEQ ID NO: 2349119 - RNA, 15 nt, Human
uucccuaccucaggc

SEQ ID NO: 2349120 - RNA, 20 nt, Human
uuccgaaaaauccucuuccu

SEQ ID NO: 2349121 - RNA, 20 nt, Human
uuccgaaaccaaagaagaaa

SEQ ID NO: 2349122 - RNA, 21 nt, Human
uuccgaaaaauccucuuccuc

SEQ ID NO: 2349123 - RNA, 23 nt, Human
uuccgaaaaauccucuuccucug

SEQ ID NO: 2349124 - RNA, 15 nt, Human
uucccuuuuuuuaag

SEQ ID NO: 2349125 - RNA, 23 nt, Human
uuccgacaaccgaugcuccagcc

SEQ ID NO: 2349126 - RNA, 22 nt, Human
uuccgacaaccgaugcuccagc

SEQ ID NO: 2349127 - RNA, 20 nt, Human
uuccgacaaccgaugcucca

SEQ ID NO: 2349128 - RNA, 19 nt, Human
uuccgcuuggagcagaggg

SEQ ID NO: 2349129 - RNA, 13 nt, Human
uuccgcuuggagc

SEQ ID NO: 2349130 - RNA, 18 nt, Human
uuccugaaacaacuugga

SEQ ID NO: 2349131 - RNA, 12 nt, Human
uuccugaaagaa

SEQ ID NO: 2349132 - RNA, 22 nt, Human
uuccucuuugcuuugcuuucug

SEQ ID NO: 2349133 - RNA, 22 nt, Human
uuccucuuuuuauuuaguuccu

SEQ ID NO: 2349134 - RNA, 18 nt, Human
uuccugaaagaaacaguu

SEQ ID NO: 2349135 - RNA, 17 nt, Human
uuccugaaagaaacagu

SEQ ID NO: 2349136 - RNA, 15 nt, Human
uuccugaaaugcagu

SEQ ID NO: 2349137 - RNA, 19 nt, Human
uuccuggcacugcuuccag

SEQ ID NO: 2349138 - RNA, 14 nt, Human
uuccuggcuucuua

SEQ ID NO: 2349139 - RNA, 17 nt, Human
uuccugggaaauauucc

SEQ ID NO: 2349140 - RNA, 21 nt, Human
uuccugggaaauauucccuag

SEQ ID NO: 2349141 - RNA, 22 nt, Human
uuccuguuguuauggaaacugu

SEQ ID NO: 2349142 - RNA, 20 nt, Human
uuccuggcacugcuuccagu

SEQ ID NO: 2349143 - RNA, 22 nt, Human
uuccuggcacugcuuccaguga

SEQ ID NO: 2349144 - RNA, 21 nt, Human
uuccggaauccuguccucagc

SEQ ID NO: 2349145 - RNA, 20 nt, Human
uuccuaaauauauuuuaaga

SEQ ID NO: 2349146 - RNA, 13 nt, Human
uuccuaaaugcag

SEQ ID NO: 2349147 - RNA, 14 nt, Human
uuccuaaaugcagu

SEQ ID NO: 2349148 - RNA, 21 nt, Human
uuccuaaauauauuuuaagac

SEQ ID NO: 2349149 - RNA, 19 nt, Human
uuccuaacaggauuagaca

SEQ ID NO: 2349150 - RNA, 14 nt, Human
uuccuaaggcugca

SEQ ID NO: 2349151 - RNA, 19 nt, Human
uuccuaacacagcaugugu

SEQ ID NO: 2349152 - RNA, 18 nt, Human
uuccuaacacagcaugug

SEQ ID NO: 2349153 - RNA, 14 nt, Human
uuccuaacacagca

SEQ ID NO: 2349154 - RNA, 16 nt, Human
uuccuaaaugcaguga

SEQ ID NO: 2349155 - RNA, 19 nt, Human
uuccucuccacugccuucg

SEQ ID NO: 2349156 - RNA, 17 nt, Human
uuccuaaguauaaaugg

SEQ ID NO: 2349157 - RNA, 16 nt, Human
uuccucuccacugccu

SEQ ID NO: 2349158 - RNA, 18 nt, Human
uuccucuccacugccuuc

SEQ ID NO: 2349159 - RNA, 13 nt, Human
uuccucugagccu

SEQ ID NO: 2349160 - RNA, 16 nt, Human
uuccucuuugcuuugc

SEQ ID NO: 2349161 - RNA, 15 nt, Human
uuccucuuugcuuug

SEQ ID NO: 2349162 - RNA, 21 nt, Human
uuccucucuuuguucucagcu

SEQ ID NO: 2349163 - RNA, 22 nt, Human
uuccucucuuuguucucagcuc

SEQ ID NO: 2349164 - RNA, 14 nt, Human
uuccucucuccaga

SEQ ID NO: 2349165 - RNA, 15 nt, Human
uuccucucuccagau

SEQ ID NO: 2349166 - RNA, 18 nt, Human
uuccucucuuuguucuca

SEQ ID NO: 2349167 - RNA, 18 nt, Human
auauuuuugguugucaau

SEQ ID NO: 2349168 - RNA, 21 nt, Human
auauuuuugguugucaauauu

SEQ ID NO: 2349169 - RNA, 15 nt, Human
aucaaauaugcaaag

SEQ ID NO: 2349170 - RNA, 16 nt, Human
uuccuuacugcagaau

SEQ ID NO: 2349171 - RNA, 21 nt, Human
auauuuuucaugauuuugaaa

SEQ ID NO: 2349172 - RNA, 13 nt, Human
uuccuuaccuuuu

SEQ ID NO: 2349173 - RNA, 17 nt, Human
uuccuuaaacugugugg

SEQ ID NO: 2349174 - RNA, 16 nt, Human
uuccuuaaacugugug

SEQ ID NO: 2349175 - RNA, 15 nt, Human
uuccuuaaacugugu

SEQ ID NO: 2349176 - RNA, 13 nt, Human
uuccuuaaacugu

SEQ ID NO: 2349177 - RNA, 23 nt, Human
uuccuguuuuucacauuuuccuu

SEQ ID NO: 2349178 - RNA, 19 nt, Human
uuccuguuuuucacauuuu

SEQ ID NO: 2349179 - RNA, 18 nt, Human
aucaaauaugcaaagcac

SEQ ID NO: 2349180 - RNA, 17 nt, Human
aucaaauaugcaaagca

SEQ ID NO: 2349181 - RNA, 16 nt, Human
aucaaauaugcaaagc

SEQ ID NO: 2349182 - RNA, 11 nt, Human
aucaacugaau

SEQ ID NO: 2349183 - RNA, 14 nt, Human
aucaacugaaugag

SEQ ID NO: 2349184 - RNA, 13 nt, Human
aucaacugaauga

SEQ ID NO: 2349185 - RNA, 21 nt, Human
aucaacugcaucaagauguga

SEQ ID NO: 2349186 - RNA, 19 nt, Human
aucaacugggcugaacacu

SEQ ID NO: 2349187 - RNA, 16 nt, Human
aucaaggguacacugc

SEQ ID NO: 2349188 - RNA, 14 nt, Human
aucacucugcugcu

SEQ ID NO: 2349189 - RNA, 21 nt, Human
aucacucugcugcuuagacau

SEQ ID NO: 2349190 - RNA, 13 nt, Human
aucacucuguccu

SEQ ID NO: 2349191 - RNA, 23 nt, Human
aucacgcuccccgccuguucccc

SEQ ID NO: 2349192 - RNA, 14 nt, Human
aucacuccccucca

SEQ ID NO: 2349193 - RNA, 12 nt, Human
aucacuccccuc

SEQ ID NO: 2349194 - RNA, 13 nt, Human
aucacuccccucc

SEQ ID NO: 2349195 - RNA, 23 nt, Human
aucacgccacugcacuccagccu

SEQ ID NO: 2349196 - RNA, 14 nt, Human
aucacgccacugca

SEQ ID NO: 2349197 - RNA, 13 nt, Human
aucacgcuuuccu

SEQ ID NO: 2349198 - RNA, 20 nt, Human
aucaauuuguaauugcuuac

SEQ ID NO: 2349199 - RNA, 12 nt, Human
aucacgcucccc

SEQ ID NO: 2349200 - RNA, 13 nt, Human
aucacgcuccccg

SEQ ID NO: 2349201 - RNA, 15 nt, Human
aucacgcuccccgcc

SEQ ID NO: 2349202 - RNA, 15 nt, Human
aucacgccacugcac

SEQ ID NO: 2349203 - RNA, 17 nt, Human
aucacgccacugcacua

SEQ ID NO: 2349204 - RNA, 19 nt, Human
aucaauuuuucuuauuuca

SEQ ID NO: 2349205 - RNA, 16 nt, Human
aucaauuuaaacccau

SEQ ID NO: 2349206 - RNA, 17 nt, Human
aucaauuuaaacccauu

SEQ ID NO: 2349207 - RNA, 21 nt, Human
aucaauuuaaacccauuuuag

SEQ ID NO: 2349208 - RNA, 14 nt, Human
aucaauuuuucuua

SEQ ID NO: 2349209 - RNA, 13 nt, Human
aucaauguucauu

SEQ ID NO: 2349210 - RNA, 23 nt, Human
aucaauggcgcagugccucuggu

SEQ ID NO: 2349211 - RNA, 14 nt, Human
aucaaugggaaaua

SEQ ID NO: 2349212 - RNA, 13 nt, Human
aucaacucuaaua

SEQ ID NO: 2349213 - RNA, 21 nt, Human
aucaaggguacacugccuucu

SEQ ID NO: 2349214 - RNA, 16 nt, Human
aucaauucauaucuau

SEQ ID NO: 2349215 - RNA, 15 nt, Human
aucaauuuaaaccca

SEQ ID NO: 2349216 - RNA, 13 nt, Human
aucaauuuaaaaa

SEQ ID NO: 2349217 - RNA, 14 nt, Human
aucaauuaaaugua

SEQ ID NO: 2349218 - RNA, 14 nt, Human
aucaauuaauuuuu

SEQ ID NO: 2349219 - RNA, 15 nt, Human
aucaauuaaauguag

SEQ ID NO: 2349220 - RNA, 15 nt, Human
aucaauuaauuuuuu

SEQ ID NO: 2349221 - RNA, 22 nt, Human
aucaauuaauuuuuuuauuguu

SEQ ID NO: 2349222 - RNA, 17 nt, Human
aucaauguucauuguaa

SEQ ID NO: 2349223 - RNA, 16 nt, Human
aucaauguucauugua

SEQ ID NO: 2349224 - RNA, 15 nt, Human
aucaauguucauugu

SEQ ID NO: 2349225 - RNA, 14 nt, Human
aucaauguucauug

SEQ ID NO: 2349226 - RNA, 13 nt, Human
aucaauuaaaugu

SEQ ID NO: 2349227 - RNA, 18 nt, Human
aucaauguucauuguaau

SEQ ID NO: 2349228 - RNA, 19 nt, Human
aucaauguuucuucuaggu

SEQ ID NO: 2349229 - RNA, 13 nt, Human
uucccagggaagu

SEQ ID NO: 2349230 - RNA, 14 nt, Human
uucccagggaagug

SEQ ID NO: 2349231 - RNA, 22 nt, Human
uucccagggaagugcucugaua

SEQ ID NO: 2349232 - RNA, 10 nt, Human
uucccagggu

SEQ ID NO: 2349233 - RNA, 16 nt, Human
uucccaggugcuacac

SEQ ID NO: 2349234 - RNA, 12 nt, Human
uucccaggugcu

SEQ ID NO: 2349235 - RNA, 23 nt, Human
uucccaggguagcccgccugcca

SEQ ID NO: 2349236 - RNA, 19 nt, Human
uucccaggguagcccgccu

SEQ ID NO: 2349237 - RNA, 20 nt, Human
uucccaggguagcccgccug

SEQ ID NO: 2349238 - RNA, 23 nt, Human
uucccagugacacuucagagagc

SEQ ID NO: 2349239 - RNA, 14 nt, Human
uucccaguggcugc

SEQ ID NO: 2349240 - RNA, 15 nt, Human
uucccaguggcugcu

SEQ ID NO: 2349241 - RNA, 17 nt, Human
uucccagugaauucuug

SEQ ID NO: 2349242 - RNA, 20 nt, Human
uucccaguggcugcugccca

SEQ ID NO: 2349243 - RNA, 21 nt, Human
uucccaguggcugcugcccag

SEQ ID NO: 2349244 - RNA, 16 nt, Human
uucccaguggcugcug

SEQ ID NO: 2349245 - RNA, 17 nt, Human
uucccaguggcugcugc

SEQ ID NO: 2349246 - RNA, 18 nt, Human
uucccaguggcugcugcc

SEQ ID NO: 2349247 - RNA, 19 nt, Human
uucccaguggcugcugccc

SEQ ID NO: 2349248 - RNA, 15 nt, Human
auauguucaacugga

SEQ ID NO: 2349249 - RNA, 12 nt, Human
auauguucaacu

SEQ ID NO: 2349250 - RNA, 20 nt, Human
auauguuaaccucaguguca

SEQ ID NO: 2349251 - RNA, 22 nt, Human
auauguguuuuucacauuugcg

SEQ ID NO: 2349252 - RNA, 19 nt, Human
auauguguuuuucacauuu

SEQ ID NO: 2349253 - RNA, 17 nt, Human
auauguguuuuucacau

SEQ ID NO: 2349254 - RNA, 19 nt, Human
auauguguguuuaaauaaa

SEQ ID NO: 2349255 - RNA, 20 nt, Human
auauguguguuuaaauaaag

SEQ ID NO: 2349256 - RNA, 18 nt, Human
auauguucuuuaaaaaua

SEQ ID NO: 2349257 - RNA, 14 nt, Human
auauguucacuguc

SEQ ID NO: 2349258 - RNA, 14 nt, Human
auauguugaauacu

SEQ ID NO: 2349259 - RNA, 16 nt, Human
auauguucaacuggag

SEQ ID NO: 2349260 - RNA, 21 nt, Human
auauguucacaccuagcguca

SEQ ID NO: 2349261 - RNA, 16 nt, Human
auauguucugacauaa

SEQ ID NO: 2349262 - RNA, 20 nt, Human
uucccaggaugagcauccca

SEQ ID NO: 2349263 - RNA, 20 nt, Human
uucccaggacccugaagggg

SEQ ID NO: 2349264 - RNA, 19 nt, Human
uucccaggacccugaaggg

SEQ ID NO: 2349265 - RNA, 23 nt, Human
uucccagcucucccucuggcccu

SEQ ID NO: 2349266 - RNA, 11 nt, Human
uucccaggacc

SEQ ID NO: 2349267 - RNA, 13 nt, Human
uucccaggacccu

SEQ ID NO: 2349268 - RNA, 12 nt, Human
uucccaggaccc

SEQ ID NO: 2349269 - RNA, 21 nt, Human
uucccagcuacaccuuucucc

SEQ ID NO: 2349270 - RNA, 14 nt, Human
uucccagcucuccc

SEQ ID NO: 2349271 - RNA, 20 nt, Human
uuccagucuuccugacacuu

SEQ ID NO: 2349272 - RNA, 20 nt, Human
uucccagcucucccucuggc

SEQ ID NO: 2349273 - RNA, 19 nt, Human
uucccagcucucccucugg

SEQ ID NO: 2349274 - RNA, 18 nt, Human
uucccagcucucccucug

SEQ ID NO: 2349275 - RNA, 17 nt, Human
uucccagcucucccucu

SEQ ID NO: 2349276 - RNA, 16 nt, Human
uucccagcucucccuc

SEQ ID NO: 2349277 - RNA, 21 nt, Human
uuccagugagcuuaucaugcu

SEQ ID NO: 2349278 - RNA, 22 nt, Human
uuccagugaaaucaguuacucu

SEQ ID NO: 2349279 - RNA, 22 nt, Human
uuccagucuccaccaggaaccu

SEQ ID NO: 2349280 - RNA, 18 nt, Human
uuccagucucugcaugua

SEQ ID NO: 2349281 - RNA, 17 nt, Human
uuccagucuuccugaca

SEQ ID NO: 2349282 - RNA, 15 nt, Human
uuccaguccaaucuc

SEQ ID NO: 2349283 - RNA, 15 nt, Human
uuccagucaggauga

SEQ ID NO: 2349284 - RNA, 20 nt, Human
uuccagucuccaccaggaac

SEQ ID NO: 2349285 - RNA, 11 nt, Human
uuccagucucc

SEQ ID NO: 2349286 - RNA, 15 nt, Human
uuccagugaggcucu

SEQ ID NO: 2349287 - RNA, 16 nt, Human
uuccagugaggcucug

SEQ ID NO: 2349288 - RNA, 23 nt, Human
auauuaaugccuuuaaaguauga

SEQ ID NO: 2349289 - RNA, 17 nt, Human
auauuaaugccuuuaaa

SEQ ID NO: 2349290 - RNA, 17 nt, Human
auauuaccacagacaua

SEQ ID NO: 2349291 - RNA, 22 nt, Human
auauuaagaaagacuaucuaaa

SEQ ID NO: 2349292 - RNA, 17 nt, Human
auauuaagaaagacuau

SEQ ID NO: 2349293 - RNA, 15 nt, Human
auauuaagaaagacu

SEQ ID NO: 2349294 - RNA, 16 nt, Human
auauuaagaaagacua

SEQ ID NO: 2349295 - RNA, 22 nt, Human
auauguugaugaaaaauagcaa

SEQ ID NO: 2349296 - RNA, 14 nt, Human
auauguugaugaaa

SEQ ID NO: 2349297 - RNA, 13 nt, Human
auauguugcucag

SEQ ID NO: 2349298 - RNA, 18 nt, Human
auauguugaauacuuuuu

SEQ ID NO: 2349299 - RNA, 17 nt, Human
auauguugaauacuuuu

SEQ ID NO: 2349300 - RNA, 16 nt, Human
auauguugaauacuuu

SEQ ID NO: 2349301 - RNA, 15 nt, Human
auauguugaauacuu

SEQ ID NO: 2349302 - RNA, 17 nt, Human
auauguuuaccuuuuaa

SEQ ID NO: 2349303 - RNA, 20 nt, Human
auauguuuaccuuuuaauua

SEQ ID NO: 2349304 - RNA, 22 nt, Human
auauguuuaccuuuuaauuaau

SEQ ID NO: 2349305 - RNA, 17 nt, Human
auauuaaaaauauaaaa

SEQ ID NO: 2349306 - RNA, 18 nt, Human
auauuaaaaauauaaaac

SEQ ID NO: 2349307 - RNA, 21 nt, Human
auauuaaaaauauaaaacugc

SEQ ID NO: 2349308 - RNA, 23 nt, Human
auauuaaaaauauggaacuucua

SEQ ID NO: 2349309 - RNA, 17 nt, Human
auauuaaaauauggcua

SEQ ID NO: 2349310 - RNA, 14 nt, Human
auauuaaaauaagc

SEQ ID NO: 2349311 - RNA, 21 nt, Human
auauuaaaauaagcacugugc

SEQ ID NO: 2349312 - RNA, 13 nt, Human
auauuaaaaauau

SEQ ID NO: 2349313 - RNA, 14 nt, Human
auauuaaaaauaua

SEQ ID NO: 2349314 - RNA, 15 nt, Human
auauuaaaaauauaa

SEQ ID NO: 2349315 - RNA, 16 nt, Human
auauuaaaaauauaaa

SEQ ID NO: 2349316 - RNA, 24 nt, Human
auauguuuaccuuuuaauuaauga

SEQ ID NO: 2349317 - RNA, 21 nt, Human
auauguuuuuuagaucaaaua

SEQ ID NO: 2349318 - RNA, 15 nt, Human
auauugguauucacu

SEQ ID NO: 2349319 - RNA, 22 nt, Human
auauugcuuuuucuaauguggu

SEQ ID NO: 2349320 - RNA, 18 nt, Human
auauugcuuuuucuaaug

SEQ ID NO: 2349321 - RNA, 21 nt, Human
auauugcuuuuucuaaugugg

SEQ ID NO: 2349322 - RNA, 17 nt, Human
auauugcuucuucuccu

SEQ ID NO: 2349323 - RNA, 13 nt, Human
auauugcuuuuuc

SEQ ID NO: 2349324 - RNA, 15 nt, Human
auauugcuuuuucua

SEQ ID NO: 2349325 - RNA, 16 nt, Human
auauugcuuuuucuaa

SEQ ID NO: 2349326 - RNA, 22 nt, Human
auauugcugauggugcaaugac

SEQ ID NO: 2349327 - RNA, 17 nt, Human
auauugagucaaauggu

SEQ ID NO: 2349328 - RNA, 21 nt, Human
auauugcugcugguaauuugu

SEQ ID NO: 2349329 - RNA, 12 nt, Human
auauuguaagaa

SEQ ID NO: 2349330 - RNA, 13 nt, Human
auauugguauuca

SEQ ID NO: 2349331 - RNA, 12 nt, Human
auauuguacagu

SEQ ID NO: 2349332 - RNA, 12 nt, Human
auauuguacacu

SEQ ID NO: 2349333 - RNA, 13 nt, Human
auauuguacacuu

SEQ ID NO: 2349334 - RNA, 14 nt, Human
auauuguacacuuu

SEQ ID NO: 2349335 - RNA, 16 nt, Human
auauuguaagaaauac

SEQ ID NO: 2349336 - RNA, 15 nt, Human
auauuguaagaaaua

SEQ ID NO: 2349337 - RNA, 14 nt, Human
auauuguaagaaau

SEQ ID NO: 2349338 - RNA, 13 nt, Human
auauuguaagaaa

SEQ ID NO: 2349339 - RNA, 21 nt, Human
auauuccugcauuugugaaau

SEQ ID NO: 2349340 - RNA, 16 nt, Human
auauuccuuucuauca

SEQ ID NO: 2349341 - RNA, 19 nt, Human
auauuccuuucuaucauuu

SEQ ID NO: 2349342 - RNA, 20 nt, Human
auauuccuuucuaucauuuu

SEQ ID NO: 2349343 - RNA, 18 nt, Human
auauucuauaugaauuua

SEQ ID NO: 2349344 - RNA, 23 nt, Human
auauucuauuuucauuuucugca

SEQ ID NO: 2349345 - RNA, 20 nt, Human
auauucuauaugaauuuaaa

SEQ ID NO: 2349346 - RNA, 15 nt, Human
auauugauaugcuua

SEQ ID NO: 2349347 - RNA, 18 nt, Human
auauugaauguuuccaac

SEQ ID NO: 2349348 - RNA, 14 nt, Human
auauugacuuguau

SEQ ID NO: 2349349 - RNA, 15 nt, Human
auauugacuuguaua

SEQ ID NO: 2349350 - RNA, 16 nt, Human
auauugacuuguauau

SEQ ID NO: 2349351 - RNA, 14 nt, Human
auauugugauucug

SEQ ID NO: 2349352 - RNA, 16 nt, Human
auauugucagauauuu

SEQ ID NO: 2349353 - RNA, 15 nt, Human
auauugucauuccug

SEQ ID NO: 2349354 - RNA, 18 nt, Human
auauugucauuccuguau

SEQ ID NO: 2349355 - RNA, 13 nt, Human
auauugugaagua

SEQ ID NO: 2349356 - RNA, 12 nt, Human
auauugugccaa

SEQ ID NO: 2349357 - RNA, 18 nt, Human
auauugugccaauaugua

SEQ ID NO: 2349358 - RNA, 19 nt, Human
auauugugccaauauguau

SEQ ID NO: 2349359 - RNA, 19 nt, Human
auauugugauucugccuuu

SEQ ID NO: 2349360 - RNA, 17 nt, Human
auauugugauucugccu

SEQ ID NO: 2349361 - RNA, 13 nt, Human
auauuguacaguu

SEQ ID NO: 2349362 - RNA, 14 nt, Human
auauuguacaguuu

SEQ ID NO: 2349363 - RNA, 17 nt, Human
auauugucagauauuuu

SEQ ID NO: 2349364 - RNA, 15 nt, Human
auauugucagauauu

SEQ ID NO: 2349365 - RNA, 12 nt, Human
auauugucagau

SEQ ID NO: 2349366 - RNA, 15 nt, Human
auauuguacacuuuu

SEQ ID NO: 2349367 - RNA, 16 nt, Human
auauuguauuacuaga

SEQ ID NO: 2349368 - RNA, 18 nt, Human
auauuguauuacuagaag

SEQ ID NO: 2349369 - RNA, 22 nt, Human
auauugucagaguucugcucua

SEQ ID NO: 2349370 - RNA, 12 nt, Human
auauuguuucua

SEQ ID NO: 2349371 - RNA, 20 nt, Human
auauugugccaauauguauu

SEQ ID NO: 2349372 - RNA, 21 nt, Human
auauugugccaauauguauug

SEQ ID NO: 2349373 - RNA, 14 nt, Human
auauuguuugcuaa

SEQ ID NO: 2349374 - RNA, 17 nt, Human
auauuguuuucagugua

SEQ ID NO: 2349375 - RNA, 13 nt, Human
auauuguuuucag

SEQ ID NO: 2349376 - RNA, 13 nt, Human
auauuuacaaaug

SEQ ID NO: 2349377 - RNA, 12 nt, Human
auauuuaaugau

SEQ ID NO: 2349378 - RNA, 13 nt, Human
auauuuaaugaua

SEQ ID NO: 2349379 - RNA, 23 nt, Human
auauuuaaugauaaguaaaugcu

SEQ ID NO: 2349380 - RNA, 18 nt, Human
uugagaagaaaacaucua

SEQ ID NO: 2349381 - RNA, 15 nt, Human
uugagaagaaaacau

SEQ ID NO: 2349382 - RNA, 22 nt, Human
uugagaagaccucaccuagaaa

SEQ ID NO: 2349383 - RNA, 21 nt, Human
uugagaacugcauauguuucg

SEQ ID NO: 2349384 - RNA, 19 nt, Human
uugagaacugcauauguuu

SEQ ID NO: 2349385 - RNA, 22 nt, Human
uugagaaaugaauaauuuccca

SEQ ID NO: 2349386 - RNA, 16 nt, Human
uugagaaaugaauaau

SEQ ID NO: 2349387 - RNA, 16 nt, Human
uugagaaaugcauauu

SEQ ID NO: 2349388 - RNA, 19 nt, Human
uugagaaaugcauauugua

SEQ ID NO: 2349389 - RNA, 15 nt, Human
uugagaaaugaauaa

SEQ ID NO: 2349390 - RNA, 21 nt, Human
uugagaaauauggacacuuaa

SEQ ID NO: 2349391 - RNA, 24 nt, Human
uugaccauucuccaccugccaggg

SEQ ID NO: 2349392 - RNA, 14 nt, Human
uugagaaggagaga

SEQ ID NO: 2349393 - RNA, 17 nt, Human
uugagagaccaggcaaa

SEQ ID NO: 2349394 - RNA, 16 nt, Human
uugagagaccaggcaa

SEQ ID NO: 2349395 - RNA, 17 nt, Human
uugagagaagagacaaa

SEQ ID NO: 2349396 - RNA, 16 nt, Human
uugagaaggagagaaa

SEQ ID NO: 2349397 - RNA, 17 nt, Human
uugagaaggagagaaag

SEQ ID NO: 2349398 - RNA, 19 nt, Human
uugagaggcccugggguuc

SEQ ID NO: 2349399 - RNA, 14 nt, Human
uugagaguucuaaa

SEQ ID NO: 2349400 - RNA, 19 nt, Human
uugacaguguugaaaaugu

SEQ ID NO: 2349401 - RNA, 18 nt, Human
uugacaguucugaagaau

SEQ ID NO: 2349402 - RNA, 15 nt, Human
uugacaguucugaag

SEQ ID NO: 2349403 - RNA, 17 nt, Human
uugacaguucugaagaa

SEQ ID NO: 2349404 - RNA, 19 nt, Human
uugacagggcacaccgggc

SEQ ID NO: 2349405 - RNA, 19 nt, Human
uugacacuuaaaaaugguu

SEQ ID NO: 2349406 - RNA, 20 nt, Human
uugacauaacacuauaaagg

SEQ ID NO: 2349407 - RNA, 18 nt, Human
uugaccauucuccaccug

SEQ ID NO: 2349408 - RNA, 19 nt, Human
uugaccauucuccaccugc

SEQ ID NO: 2349409 - RNA, 21 nt, Human
uugagguggucugaauguucu

SEQ ID NO: 2349410 - RNA, 22 nt, Human
uugagguggcacuuuuucauuu

SEQ ID NO: 2349411 - RNA, 12 nt, Human
uugaguuuuguu

SEQ ID NO: 2349412 - RNA, 21 nt, Human
uugaguuuuguuuuaaaauua

SEQ ID NO: 2349413 - RNA, 12 nt, Human
uugauaaaguaa

SEQ ID NO: 2349414 - RNA, 20 nt, Human
uugauaaaguaguaaaaauu

SEQ ID NO: 2349415 - RNA, 12 nt, Human
uugauaaaguuu

SEQ ID NO: 2349416 - RNA, 13 nt, Human
uugauaaaguuuc

SEQ ID NO: 2349417 - RNA, 14 nt, Human
uugauaaaguuucu

SEQ ID NO: 2349418 - RNA, 17 nt, Human
uugauaaaguuucucag

SEQ ID NO: 2349419 - RNA, 22 nt, Human
uugagguggaagcccuccuucc

SEQ ID NO: 2349420 - RNA, 19 nt, Human
uugagguggaagcccuccu

SEQ ID NO: 2349421 - RNA, 23 nt, Human
uugaggucuuuugacauguggaa

SEQ ID NO: 2349422 - RNA, 22 nt, Human
uugaggucuuuugacaugugga

SEQ ID NO: 2349423 - RNA, 19 nt, Human
uugaggucuuuugacaugu

SEQ ID NO: 2349424 - RNA, 18 nt, Human
uugaggucuuuugacaug

SEQ ID NO: 2349425 - RNA, 17 nt, Human
uugaggucuuuugacau

SEQ ID NO: 2349426 - RNA, 16 nt, Human
uugaggucuguucuuu

SEQ ID NO: 2349427 - RNA, 18 nt, Human
uugagauagaagaacugc

SEQ ID NO: 2349428 - RNA, 17 nt, Human
uugagauagaagaacug

SEQ ID NO: 2349429 - RNA, 18 nt, Human
uugagaguuuugucuuga

SEQ ID NO: 2349430 - RNA, 15 nt, Human
uugaggucuguucuu

SEQ ID NO: 2349431 - RNA, 17 nt, Human
aucuaagccuuuccaua

SEQ ID NO: 2349432 - RNA, 18 nt, Human
aucuaaggaugucacagg

SEQ ID NO: 2349433 - RNA, 18 nt, Human
aucuaagccuuuccauaa

SEQ ID NO: 2349434 - RNA, 13 nt, Human
aucuaagugauau

SEQ ID NO: 2349435 - RNA, 20 nt, Human
aucuaaggaugucacagggc

SEQ ID NO: 2349436 - RNA, 17 nt, Human
aucuaagugauauaaau

SEQ ID NO: 2349437 - RNA, 14 nt, Human
aucuaagugauaua

SEQ ID NO: 2349438 - RNA, 15 nt, Human
aucuaagugauauaa

SEQ ID NO: 2349439 - RNA, 16 nt, Human
aucuaagccuuuccau

SEQ ID NO: 2349440 - RNA, 13 nt, Human
aucuaagccugaa

SEQ ID NO: 2349441 - RNA, 18 nt, Human
aucuaagcagcauuucug

SEQ ID NO: 2349442 - RNA, 21 nt, Human
aucuaagcagcauuucugaag

SEQ ID NO: 2349443 - RNA, 19 nt, Human
uugauaaucaacugggcug

SEQ ID NO: 2349444 - RNA, 21 nt, Human
uugauaaauuccacuggacuu

SEQ ID NO: 2349445 - RNA, 19 nt, Human
uugauaaauuccacuggac

SEQ ID NO: 2349446 - RNA, 14 nt, Human
uugauaacagcacu

SEQ ID NO: 2349447 - RNA, 15 nt, Human
uugauaacagcacug

SEQ ID NO: 2349448 - RNA, 18 nt, Human
uugauaaauuccacugga

SEQ ID NO: 2349449 - RNA, 19 nt, Human
uugauaacagcacugacua

SEQ ID NO: 2349450 - RNA, 13 nt, Human
uugauaacuuugc

SEQ ID NO: 2349451 - RNA, 14 nt, Human
uugauaacuuugcu

SEQ ID NO: 2349452 - RNA, 16 nt, Human
uugauaagagggcaca

SEQ ID NO: 2349453 - RNA, 22 nt, Human
uugauaagagggcacacacugu

SEQ ID NO: 2349454 - RNA, 22 nt, Human
uugaauauaauauauuugugua

SEQ ID NO: 2349455 - RNA, 20 nt, Human
uugaauauaauauauuugug

SEQ ID NO: 2349456 - RNA, 21 nt, Human
uugaauauaauauauuugugu

SEQ ID NO: 2349457 - RNA, 19 nt, Human
uugaauauauuauaaucuu

SEQ ID NO: 2349458 - RNA, 13 nt, Human
uugaauauauuau

SEQ ID NO: 2349459 - RNA, 16 nt, Human
uugaauauccccuccc

SEQ ID NO: 2349460 - RNA, 17 nt, Human
uugaauauccccuccca

SEQ ID NO: 2349461 - RNA, 17 nt, Human
uugacacuuaaaaaugg

SEQ ID NO: 2349462 - RNA, 15 nt, Human
uugaauauaaacacu

SEQ ID NO: 2349463 - RNA, 16 nt, Human
uugaauauaaacacua

SEQ ID NO: 2349464 - RNA, 18 nt, Human
uugaauauaaacacuaua

SEQ ID NO: 2349465 - RNA, 19 nt, Human
uugaaguuguuacuaacua

SEQ ID NO: 2349466 - RNA, 13 nt, Human
uugaauacuuuuu

SEQ ID NO: 2349467 - RNA, 12 nt, Human
uugaauacuuuu

SEQ ID NO: 2349468 - RNA, 18 nt, Human
uugaaguggccagaugag

SEQ ID NO: 2349469 - RNA, 17 nt, Human
uugaaguguaggcagac

SEQ ID NO: 2349470 - RNA, 18 nt, Human
uugaaguguaggcagaca

SEQ ID NO: 2349471 - RNA, 19 nt, Human
uugaaguguaggcagacac

SEQ ID NO: 2349472 - RNA, 22 nt, Human
uugaaguguaggcagacacagg

SEQ ID NO: 2349473 - RNA, 20 nt, Human
uugaaguguaggcagacaca

SEQ ID NO: 2349474 - RNA, 21 nt, Human
uugaaguuguuacuaacuaaa

SEQ ID NO: 2349475 - RNA, 15 nt, Human
uugaaggaucuguuu

SEQ ID NO: 2349476 - RNA, 20 nt, Human
uugaagggccagagccaggg

SEQ ID NO: 2349477 - RNA, 19 nt, Human
uugaagggccagagccagg

SEQ ID NO: 2349478 - RNA, 17 nt, Human
uugaagggccagagcca

SEQ ID NO: 2349479 - RNA, 15 nt, Human
uugaagggccagagc

SEQ ID NO: 2349480 - RNA, 18 nt, Human
uugaaggaggugagggau

SEQ ID NO: 2349481 - RNA, 11 nt, Human
uugaaggaaac

SEQ ID NO: 2349482 - RNA, 13 nt, Human
uugaaggaaacag

SEQ ID NO: 2349483 - RNA, 14 nt, Human
uugaaggaaacagu

SEQ ID NO: 2349484 - RNA, 23 nt, Human
uugaaggugcugacggccaggga

SEQ ID NO: 2349485 - RNA, 18 nt, Human
uugaaggguaaagaaguu

SEQ ID NO: 2349486 - RNA, 19 nt, Human
uugaaggguaaagaaguuu

SEQ ID NO: 2349487 - RNA, 17 nt, Human
uugaaguaaugaauuuu

SEQ ID NO: 2349488 - RNA, 16 nt, Human
uugaaguaaugaauuu

SEQ ID NO: 2349489 - RNA, 12 nt, Human
uugaaguaauga

SEQ ID NO: 2349490 - RNA, 18 nt, Human
uugaaguaaucccgccac

SEQ ID NO: 2349491 - RNA, 18 nt, Human
uugaaguauuuugcugga

SEQ ID NO: 2349492 - RNA, 12 nt, Human
aucguccaggga

SEQ ID NO: 2349493 - RNA, 13 nt, Human
aucguccagggag

SEQ ID NO: 2349494 - RNA, 23 nt, Human
aucguauagcuguauugaaucau

SEQ ID NO: 2349495 - RNA, 19 nt, Human
aucguccagcgaccuuccu

SEQ ID NO: 2349496 - RNA, 18 nt, Human
aucgucacugcuuaacuu

SEQ ID NO: 2349497 - RNA, 14 nt, Human
aucgucacugcuua

SEQ ID NO: 2349498 - RNA, 16 nt, Human
aucguaaccagccaga

SEQ ID NO: 2349499 - RNA, 16 nt, Human
aucguaauguacagau

SEQ ID NO: 2349500 - RNA, 18 nt, Human
aucguaauguacagaugg

SEQ ID NO: 2349501 - RNA, 14 nt, Human
aucguauagcugua

SEQ ID NO: 2349502 - RNA, 15 nt, Human
aucguauagcuguau

SEQ ID NO: 2349503 - RNA, 16 nt, Human
aucguauagcuguauu

SEQ ID NO: 2349504 - RNA, 18 nt, Human
aucguauagcuguauuga

SEQ ID NO: 2349505 - RNA, 22 nt, Human
aucguauagcuguauugaauca

SEQ ID NO: 2349506 - RNA, 23 nt, Human
aucguccagggagcauuuuccuc

SEQ ID NO: 2349507 - RNA, 23 nt, Human
aucgucucucccucccuuugaaa

SEQ ID NO: 2349508 - RNA, 20 nt, Human
aucgugaaacccugucucua

SEQ ID NO: 2349509 - RNA, 12 nt, Human
aucgugaaaccc

SEQ ID NO: 2349510 - RNA, 17 nt, Human
aucgugacgcugaauaa

SEQ ID NO: 2349511 - RNA, 18 nt, Human
aucgugccguuacucucc

SEQ ID NO: 2349512 - RNA, 23 nt, Human
aucuaaaaauagacuuaaaucuc

SEQ ID NO: 2349513 - RNA, 18 nt, Human
aucgugacgcugaauaaa

SEQ ID NO: 2349514 - RNA, 20 nt, Human
aucgugacgcugaauaaaug

SEQ ID NO: 2349515 - RNA, 21 nt, Human
aucgugacgcugaauaaaugu

SEQ ID NO: 2349516 - RNA, 22 nt, Human
aucgugacgcugaauaaauguc

SEQ ID NO: 2349517 - RNA, 14 nt, Human
aucgugacaacacu

SEQ ID NO: 2349518 - RNA, 15 nt, Human
aucgugacaacacuu

SEQ ID NO: 2349519 - RNA, 15 nt, Human
aucuaaaguguguug

SEQ ID NO: 2349520 - RNA, 22 nt, Human
aucuaaacuggauucacagcuc

SEQ ID NO: 2349521 - RNA, 15 nt, Human
aucuaaacugccccc

SEQ ID NO: 2349522 - RNA, 19 nt, Human
aucuaaaagaaaugucuau

SEQ ID NO: 2349523 - RNA, 19 nt, Human
aucuaaauggaaccacucu

SEQ ID NO: 2349524 - RNA, 22 nt, Human
aucuaaauauugauuucugccu

SEQ ID NO: 2349525 - RNA, 18 nt, Human
aucuaaauaccugcccug

SEQ ID NO: 2349526 - RNA, 17 nt, Human
aucuaaaguguguuguu

SEQ ID NO: 2349527 - RNA, 20 nt, Human
aucuaaaguguguuguugcu

SEQ ID NO: 2349528 - RNA, 23 nt, Human
aucuaaaguguguuguugcuuua

SEQ ID NO: 2349529 - RNA, 21 nt, Human
aucuaaauugaauaaugguac

SEQ ID NO: 2349530 - RNA, 17 nt, Human
aucuaaauuuagaaauc

SEQ ID NO: 2349531 - RNA, 15 nt, Human
aucuaaauugaauaa

SEQ ID NO: 2349532 - RNA, 16 nt, Human
aucuaaauugaauaau

SEQ ID NO: 2349533 - RNA, 15 nt, Human
aucuaaauguugaaa

SEQ ID NO: 2349534 - RNA, 15 nt, Human
aucuaaccucaucuu

SEQ ID NO: 2349535 - RNA, 14 nt, Human
aucuaaccucaucu

SEQ ID NO: 2349536 - RNA, 13 nt, Human
aucuaaccucauc

SEQ ID NO: 2349537 - RNA, 14 nt, Human
aucuaaccacauca

SEQ ID NO: 2349538 - RNA, 15 nt, Human
aucuaacccucccau

SEQ ID NO: 2349539 - RNA, 18 nt, Human
aucuaaccucaucuucuu

SEQ ID NO: 2349540 - RNA, 22 nt, Human
aucuaacccucccauggcaccu

SEQ ID NO: 2349541 - RNA, 17 nt, Human
uugaaggaaaaugauac

SEQ ID NO: 2349542 - RNA, 19 nt, Human
auccucuuccucugaggcu

SEQ ID NO: 2349543 - RNA, 22 nt, Human
auccucuucugcuuaggagaga

SEQ ID NO: 2349544 - RNA, 13 nt, Human
auccucuuuagag

SEQ ID NO: 2349545 - RNA, 15 nt, Human
auccucuuuagaguu

SEQ ID NO: 2349546 - RNA, 13 nt, Human
auccucuuccucu

SEQ ID NO: 2349547 - RNA, 14 nt, Human
uucuuuuggcuucc

SEQ ID NO: 2349548 - RNA, 14 nt, Human
auccucuuccucug

SEQ ID NO: 2349549 - RNA, 15 nt, Human
auccucuuccucuga

SEQ ID NO: 2349550 - RNA, 16 nt, Human
auccucuuccucugag

SEQ ID NO: 2349551 - RNA, 17 nt, Human
auccucuuccucugagg

SEQ ID NO: 2349552 - RNA, 18 nt, Human
auccucuguacagagccc

SEQ ID NO: 2349553 - RNA, 20 nt, Human
auccucuguacagagcccac

SEQ ID NO: 2349554 - RNA, 12 nt, Human
uucuuuuguaaa

SEQ ID NO: 2349555 - RNA, 23 nt, Human
uucuuuugguaaagacuggcuuu

SEQ ID NO: 2349556 - RNA, 13 nt, Human
uucuuuugguaaa

SEQ ID NO: 2349557 - RNA, 22 nt, Human
uucuuuugguaaagacuggcuu

SEQ ID NO: 2349558 - RNA, 20 nt, Human
uucuuuugccguuauuaaaa

SEQ ID NO: 2349559 - RNA, 23 nt, Human
uucuuuugcccuucacaguguuu

SEQ ID NO: 2349560 - RNA, 22 nt, Human
uucuuuugcccuucacaguguu

SEQ ID NO: 2349561 - RNA, 21 nt, Human
uucuuuugcccuucacagugu

SEQ ID NO: 2349562 - RNA, 23 nt, Human
uucuuuugagcaacuuucuuaca

SEQ ID NO: 2349563 - RNA, 21 nt, Human
uucuuuucuggaauguaauca

SEQ ID NO: 2349564 - RNA, 18 nt, Human
auccugaaauagaggcua

SEQ ID NO: 2349565 - RNA, 22 nt, Human
auccucuuuagaguuagacugu

SEQ ID NO: 2349566 - RNA, 23 nt, Human
auccucuuuagaguuagacuguu

SEQ ID NO: 2349567 - RNA, 17 nt, Human
auccugaaauuucagau

SEQ ID NO: 2349568 - RNA, 16 nt, Human
auccugaaauuucaga

SEQ ID NO: 2349569 - RNA, 14 nt, Human
auccugaaauuuca

SEQ ID NO: 2349570 - RNA, 17 nt, Human
auccucuuugagugaag

SEQ ID NO: 2349571 - RNA, 16 nt, Human
auccucuuuagaguua

SEQ ID NO: 2349572 - RNA, 19 nt, Human
auccucuuuagaguuagac

SEQ ID NO: 2349573 - RNA, 20 nt, Human
auccucuuuagaguuagacu

SEQ ID NO: 2349574 - RNA, 21 nt, Human
auccucuuuagaguuagacug

SEQ ID NO: 2349575 - RNA, 21 nt, Human
auccugaaauagaggcuaaau

SEQ ID NO: 2349576 - RNA, 14 nt, Human
auccugacucugcc

SEQ ID NO: 2349577 - RNA, 15 nt, Human
auccugacucugccc

SEQ ID NO: 2349578 - RNA, 17 nt, Human
auccugacucugccccc

SEQ ID NO: 2349579 - RNA, 18 nt, Human
auccugacucugcccccu

SEQ ID NO: 2349580 - RNA, 11 nt, Human
auccugagcca

SEQ ID NO: 2349581 - RNA, 12 nt, Human
auccugagccag

SEQ ID NO: 2349582 - RNA, 13 nt, Human
auccugagccaga

SEQ ID NO: 2349583 - RNA, 12 nt, Human
auccugagccau

SEQ ID NO: 2349584 - RNA, 19 nt, Human
auccugaugagguuucuac

SEQ ID NO: 2349585 - RNA, 16 nt, Human
auccugcaauuccacu

SEQ ID NO: 2349586 - RNA, 24 nt, Human
auccugagccaucggugaaacuaa

SEQ ID NO: 2349587 - RNA, 19 nt, Human
auccugacucugcccccug

SEQ ID NO: 2349588 - RNA, 13 nt, Human
auccugaggcuga

SEQ ID NO: 2349589 - RNA, 22 nt, Human
auccugaggcuccacuuggucu

SEQ ID NO: 2349590 - RNA, 14 nt, Human
auccugcugcugug

SEQ ID NO: 2349591 - RNA, 16 nt, Human
auccugcggguggggc

SEQ ID NO: 2349592 - RNA, 23 nt, Human
auccugccuuagagccaggcaca

SEQ ID NO: 2349593 - RNA, 20 nt, Human
auccugcccccugaaacuua

SEQ ID NO: 2349594 - RNA, 22 nt, Human
auccugcccccugaaacuuauu

SEQ ID NO: 2349595 - RNA, 23 nt, Human
auccugcccccugaaacuuauuu

SEQ ID NO: 2349596 - RNA, 19 nt, Human
auccugccuuagagccagg

SEQ ID NO: 2349597 - RNA, 21 nt, Human
auccugccuuagagccaggca

SEQ ID NO: 2349598 - RNA, 22 nt, Human
auccugccuuagagccaggcac

SEQ ID NO: 2349599 - RNA, 16 nt, Human
auccugcagccuccuc

SEQ ID NO: 2349600 - RNA, 17 nt, Human
auccugcagccuccucc

SEQ ID NO: 2349601 - RNA, 20 nt, Human
auccugcagccuccuccuga

SEQ ID NO: 2349602 - RNA, 13 nt, Human
auccugccccuga

SEQ ID NO: 2349603 - RNA, 14 nt, Human
auccugagccagau

SEQ ID NO: 2349604 - RNA, 15 nt, Human
auccugagccagauu

SEQ ID NO: 2349605 - RNA, 17 nt, Human
auccugagccagauuuc

SEQ ID NO: 2349606 - RNA, 21 nt, Human
auccugagccagauuucacuc

SEQ ID NO: 2349607 - RNA, 18 nt, Human
auccugaggcuccacuug

SEQ ID NO: 2349608 - RNA, 16 nt, Human
auccugaggcuccacu

SEQ ID NO: 2349609 - RNA, 13 nt, Human
auccugaggcucc

SEQ ID NO: 2349610 - RNA, 11 nt, Human
auccugaggcu

SEQ ID NO: 2349611 - RNA, 19 nt, Human
auccugcuucugauaugca

SEQ ID NO: 2349612 - RNA, 21 nt, Human
auccugcuucugauaugcagu

SEQ ID NO: 2349613 - RNA, 22 nt, Human
auccuggacaugaagauucuuu

SEQ ID NO: 2349614 - RNA, 14 nt, Human
auccugcuucagug

SEQ ID NO: 2349615 - RNA, 15 nt, Human
auccuggaguucugg

SEQ ID NO: 2349616 - RNA, 17 nt, Human
auccuggaggcccaguu

SEQ ID NO: 2349617 - RNA, 16 nt, Human
auccuggaggcccagu

SEQ ID NO: 2349618 - RNA, 15 nt, Human
auccuggaggcccag

SEQ ID NO: 2349619 - RNA, 14 nt, Human
auccuggaggccca

SEQ ID NO: 2349620 - RNA, 17 nt, Human
auccuggcacccggccc

SEQ ID NO: 2349621 - RNA, 19 nt, Human
auccuggcacccggccccu

SEQ ID NO: 2349622 - RNA, 20 nt, Human
auccuggcacccggccccug

SEQ ID NO: 2349623 - RNA, 21 nt, Human
auccuggcacccggccccugc

SEQ ID NO: 2349624 - RNA, 22 nt, Human
auccuggcacccggccccugcu

SEQ ID NO: 2349625 - RNA, 23 nt, Human
auccuggcacccggccccugcug

SEQ ID NO: 2349626 - RNA, 20 nt, Human
auccuggaggcccaguucac

SEQ ID NO: 2349627 - RNA, 19 nt, Human
auccuggaggcccaguuca

SEQ ID NO: 2349628 - RNA, 17 nt, Human
auccuggccaacauggu

SEQ ID NO: 2349629 - RNA, 14 nt, Human
auccuggcccucug

SEQ ID NO: 2349630 - RNA, 14 nt, Human
auccuggcccauca

SEQ ID NO: 2349631 - RNA, 16 nt, Human
auccuggcccaucagu

SEQ ID NO: 2349632 - RNA, 12 nt, Human
auccuggcccau

SEQ ID NO: 2349633 - RNA, 13 nt, Human
auccuggcccauc

SEQ ID NO: 2349634 - RNA, 24 nt, Human
auccuggcucuuuggagaucaagg

SEQ ID NO: 2349635 - RNA, 18 nt, Human
auccugggcauccuucuu

SEQ ID NO: 2349636 - RNA, 22 nt, Human
auccugguugguguugcagaag

SEQ ID NO: 2349637 - RNA, 23 nt, Human
auccuggguggucugcaggcagg

SEQ ID NO: 2349638 - RNA, 22 nt, Human
auccuggguggucugcaggcag

SEQ ID NO: 2349639 - RNA, 20 nt, Human
auccuggggcucccuucauc

SEQ ID NO: 2349640 - RNA, 20 nt, Human
auccuggggcauuaaaaaaa

SEQ ID NO: 2349641 - RNA, 21 nt, Human
auccugggggacccaauguag

SEQ ID NO: 2349642 - RNA, 15 nt, Human
auccuggggcucccu

SEQ ID NO: 2349643 - RNA, 16 nt, Human
auccuggggcucccuu

SEQ ID NO: 2349644 - RNA, 14 nt, Human
auccuguccucagc

SEQ ID NO: 2349645 - RNA, 17 nt, Human
auccuguccucagcuuc

SEQ ID NO: 2349646 - RNA, 18 nt, Human
auccuguccucagcuucu

SEQ ID NO: 2349647 - RNA, 19 nt, Human
auccugucuuuaaggaaaa

SEQ ID NO: 2349648 - RNA, 23 nt, Human
auccugucuuuaaggaaaaaaag

SEQ ID NO: 2349649 - RNA, 21 nt, Human
auccugucuuuaaggaaaaaa

SEQ ID NO: 2349650 - RNA, 15 nt, Human
auccugucuuucuga

SEQ ID NO: 2349651 - RNA, 18 nt, Human
auccugucuuucugagca

SEQ ID NO: 2349652 - RNA, 23 nt, Human
auccugucuuucugagcacacuu

SEQ ID NO: 2349653 - RNA, 13 nt, Human
auccuguggguga

SEQ ID NO: 2349654 - RNA, 12 nt, Human
auccugugaagu

SEQ ID NO: 2349655 - RNA, 16 nt, Human
auccugugaaguaagg

SEQ ID NO: 2349656 - RNA, 15 nt, Human
auccugugacaugua

SEQ ID NO: 2349657 - RNA, 16 nt, Human
auccugugacauguaa

SEQ ID NO: 2349658 - RNA, 18 nt, Human
auccugugacauguaaca

SEQ ID NO: 2349659 - RNA, 18 nt, Human
auccuguguuucuaggga

SEQ ID NO: 2349660 - RNA, 14 nt, Human
auccuguguuucua

SEQ ID NO: 2349661 - RNA, 21 nt, Human
aucggugaaacuaacagauaa

SEQ ID NO: 2349662 - RNA, 19 nt, Human
aucggugaaacuaacagau

SEQ ID NO: 2349663 - RNA, 18 nt, Human
aucggugaaacuaacaga

SEQ ID NO: 2349664 - RNA, 15 nt, Human
aucguaaccagccag

SEQ ID NO: 2349665 - RNA, 17 nt, Human
aucguaaaauuaagaaa

SEQ ID NO: 2349666 - RNA, 13 nt, Human
aucguaaaauuaa

SEQ ID NO: 2349667 - RNA, 14 nt, Human
aucguaaaauuaag

SEQ ID NO: 2349668 - RNA, 19 nt, Human
aucggucuugcccagagga

SEQ ID NO: 2349669 - RNA, 17 nt, Human
aucggggcacugcaggg

SEQ ID NO: 2349670 - RNA, 12 nt, Human
aucguaaaauua

SEQ ID NO: 2349671 - RNA, 21 nt, Human
aucgggagcagugucuuccau

SEQ ID NO: 2349672 - RNA, 18 nt, Human
aucgggagcagugucuuc

SEQ ID NO: 2349673 - RNA, 17 nt, Human
aucgggagcagugucuu

SEQ ID NO: 2349674 - RNA, 16 nt, Human
aucgggagcagugucu

SEQ ID NO: 2349675 - RNA, 21 nt, Human
aucgggaacaguguuucccau

SEQ ID NO: 2349676 - RNA, 17 nt, Human
aucgggaacaguguuuc

SEQ ID NO: 2349677 - RNA, 16 nt, Human
aucgggaacaguguuu

SEQ ID NO: 2349678 - RNA, 15 nt, Human
aucgggaacaguguu

SEQ ID NO: 2349679 - RNA, 23 nt, Human
aucagugugucuaaauuugaaug

SEQ ID NO: 2349680 - RNA, 18 nt, Human
aucaguuacucugaaggg

SEQ ID NO: 2349681 - RNA, 21 nt, Human
aucaguuacucagcccugggc

SEQ ID NO: 2349682 - RNA, 19 nt, Human
aucaguuacucagcccugg

SEQ ID NO: 2349683 - RNA, 15 nt, Human
aucaguuagagcuga

SEQ ID NO: 2349684 - RNA, 18 nt, Human
aucaguuacucagcccug

SEQ ID NO: 2349685 - RNA, 17 nt, Human
aucaguuacucagcccu

SEQ ID NO: 2349686 - RNA, 16 nt, Human
aucaguuacucagccc

SEQ ID NO: 2349687 - RNA, 15 nt, Human
aucaguuacucagcc

SEQ ID NO: 2349688 - RNA, 18 nt, Human
aucaguuacuaagaagaa

SEQ ID NO: 2349689 - RNA, 14 nt, Human
aucaggugcugcca

SEQ ID NO: 2349690 - RNA, 13 nt, Human
aucagucucugag

SEQ ID NO: 2349691 - RNA, 20 nt, Human
aucagucuauccacagagag

SEQ ID NO: 2349692 - RNA, 18 nt, Human
aucagucucugagggcuu

SEQ ID NO: 2349693 - RNA, 19 nt, Human
aucagucugauucccaagc

SEQ ID NO: 2349694 - RNA, 15 nt, Human
aucagugcccuccag

SEQ ID NO: 2349695 - RNA, 13 nt, Human
aucagugcccucc

SEQ ID NO: 2349696 - RNA, 17 nt, Human
aucagugcccuccagga

SEQ ID NO: 2349697 - RNA, 15 nt, Human
aucagugcucccuca

SEQ ID NO: 2349698 - RNA, 20 nt, Human
aucagugcucgagacacagu

SEQ ID NO: 2349699 - RNA, 16 nt, Human
aucacucuuguggaug

SEQ ID NO: 2349700 - RNA, 14 nt, Human
aucacucuugugga

SEQ ID NO: 2349701 - RNA, 17 nt, Human
aucacucuuguggaugu

SEQ ID NO: 2349702 - RNA, 14 nt, Human
aucacugaacuuug

SEQ ID NO: 2349703 - RNA, 20 nt, Human
aucacuuaggaaauggcuuu

SEQ ID NO: 2349704 - RNA, 18 nt, Human
aucacuucugagaacuca

SEQ ID NO: 2349705 - RNA, 17 nt, Human
aucaggugcugccaucc

SEQ ID NO: 2349706 - RNA, 19 nt, Human
aucaggugcugccauccag

SEQ ID NO: 2349707 - RNA, 15 nt, Human
aucaggugcugccau

SEQ ID NO: 2349708 - RNA, 23 nt, Human
aucacuugaacccgggaggcaga

SEQ ID NO: 2349709 - RNA, 22 nt, Human
aucauuauaacugaaggagaag

SEQ ID NO: 2349710 - RNA, 20 nt, Human
aucauuauaacugaaggaga

SEQ ID NO: 2349711 - RNA, 20 nt, Human
aucauuaucagccugugcca

SEQ ID NO: 2349712 - RNA, 21 nt, Human
aucauucucugucucauccau

SEQ ID NO: 2349713 - RNA, 16 nt, Human
aucauucucugucuca

SEQ ID NO: 2349714 - RNA, 14 nt, Human
aucauucucugucu

SEQ ID NO: 2349715 - RNA, 12 nt, Human
aucauucucugu

SEQ ID NO: 2349716 - RNA, 23 nt, Human
aucauuauaaacgugaugaucag

SEQ ID NO: 2349717 - RNA, 16 nt, Human
aucauuauaaacguga

SEQ ID NO: 2349718 - RNA, 19 nt, Human
aucauuagggggaacucua

SEQ ID NO: 2349719 - RNA, 15 nt, Human
aucauuaaaguucua

SEQ ID NO: 2349720 - RNA, 11 nt, Human
aucauuagaac

SEQ ID NO: 2349721 - RNA, 13 nt, Human
aucauuaaaguuc

SEQ ID NO: 2349722 - RNA, 14 nt, Human
aucauuaaaguucu

SEQ ID NO: 2349723 - RNA, 16 nt, Human
aucauuaggugugacu

SEQ ID NO: 2349724 - RNA, 21 nt, Human
aucauccacugugccaugugc

SEQ ID NO: 2349725 - RNA, 18 nt, Human
aucaucauguguguccac

SEQ ID NO: 2349726 - RNA, 11 nt, Human
aucauuaauac

SEQ ID NO: 2349727 - RNA, 16 nt, Human
aucauccacauuguuu

SEQ ID NO: 2349728 - RNA, 11 nt, Human
aucauuaaagu

SEQ ID NO: 2349729 - RNA, 12 nt, Human
aucauuaaaguu

SEQ ID NO: 2349730 - RNA, 23 nt, Human
aucauccacugugccaugugcca

SEQ ID NO: 2349731 - RNA, 12 nt, Human
aucauaaaauaa

SEQ ID NO: 2349732 - RNA, 17 nt, Human
aucaguuuuauccacag

SEQ ID NO: 2349733 - RNA, 22 nt, Human
aucaguuugcuagcagaaaucu

SEQ ID NO: 2349734 - RNA, 13 nt, Human
aucauaaaauaaa

SEQ ID NO: 2349735 - RNA, 14 nt, Human
aucauaaacugugu

SEQ ID NO: 2349736 - RNA, 23 nt, Human
aucauaguggcuuaaaacaacac

SEQ ID NO: 2349737 - RNA, 18 nt, Human
aucaguugcaauaauacu

SEQ ID NO: 2349738 - RNA, 21 nt, Human
aucaguugcaauaauacuucu

SEQ ID NO: 2349739 - RNA, 15 nt, Human
aucauaaaacuugau

SEQ ID NO: 2349740 - RNA, 13 nt, Human
aucauaugauucu

SEQ ID NO: 2349741 - RNA, 20 nt, Human
aucauauaauaaauguacau

SEQ ID NO: 2349742 - RNA, 16 nt, Human
aucauauaauaaaugu

SEQ ID NO: 2349743 - RNA, 18 nt, Human
aucaucaguggagccaug

SEQ ID NO: 2349744 - RNA, 16 nt, Human
aucauaugauucugcu

SEQ ID NO: 2349745 - RNA, 18 nt, Human
aucauaugauucugcuuu

SEQ ID NO: 2349746 - RNA, 19 nt, Human
aucauaugauucugcuuuu

SEQ ID NO: 2349747 - RNA, 21 nt, Human
aucauaugauucugcuuuuac

SEQ ID NO: 2349748 - RNA, 19 nt, Human
aucaucaguauugaagcau

SEQ ID NO: 2349749 - RNA, 16 nt, Human
aucauaaacugugugc

SEQ ID NO: 2349750 - RNA, 17 nt, Human
uucucccucucacuguc

SEQ ID NO: 2349751 - RNA, 13 nt, Human
uucucccucugga

SEQ ID NO: 2349752 - RNA, 21 nt, Human
uucucccguucacguugccua

SEQ ID NO: 2349753 - RNA, 20 nt, Human
uucucccucauuucaggagc

SEQ ID NO: 2349754 - RNA, 15 nt, Human
uucuccccugccccc

SEQ ID NO: 2349755 - RNA, 16 nt, Human
uucuccccugccccca

SEQ ID NO: 2349756 - RNA, 17 nt, Human
uucuccccugcccccag

SEQ ID NO: 2349757 - RNA, 18 nt, Human
uucuccccugcccccagg

SEQ ID NO: 2349758 - RNA, 19 nt, Human
uucuccccugcccccagga

SEQ ID NO: 2349759 - RNA, 21 nt, Human
uucuccccugcccccaggacu

SEQ ID NO: 2349760 - RNA, 22 nt, Human
uucuccccugcccccaggacug

SEQ ID NO: 2349761 - RNA, 23 nt, Human
uucuccccugcccccaggacugg

SEQ ID NO: 2349762 - RNA, 17 nt, Human
uucuccuuucacaaccu

SEQ ID NO: 2349763 - RNA, 15 nt, Human
uucuccuauguguaa

SEQ ID NO: 2349764 - RNA, 18 nt, Human
uucuccguuagcuccugu

SEQ ID NO: 2349765 - RNA, 19 nt, Human
uucuccguuagcuccugug

SEQ ID NO: 2349766 - RNA, 20 nt, Human
uucuccguuagcuccugugg

SEQ ID NO: 2349767 - RNA, 22 nt, Human
uucuccguuagcuccuguggcc

SEQ ID NO: 2349768 - RNA, 23 nt, Human
uucuccgacugcuagggaguggu

SEQ ID NO: 2349769 - RNA, 13 nt, Human
uucuccgccagcc

SEQ ID NO: 2349770 - RNA, 14 nt, Human
uucuccgccagccu

SEQ ID NO: 2349771 - RNA, 15 nt, Human
uucuccgccagccuc

SEQ ID NO: 2349772 - RNA, 16 nt, Human
uucuccgccagccucc

SEQ ID NO: 2349773 - RNA, 17 nt, Human
uucuccgccagccuccu

SEQ ID NO: 2349774 - RNA, 18 nt, Human
uucuccgccagccuccuc

SEQ ID NO: 2349775 - RNA, 16 nt, Human
uucuccguuagcuccu

SEQ ID NO: 2349776 - RNA, 17 nt, Human
uucuccguuagcuccug

SEQ ID NO: 2349777 - RNA, 19 nt, Human
uucuccgccagccuccucu

SEQ ID NO: 2349778 - RNA, 20 nt, Human
uucuccgccagccuccucug

SEQ ID NO: 2349779 - RNA, 21 nt, Human
uucuccgccagccuccucugg

SEQ ID NO: 2349780 - RNA, 19 nt, Human
aucauugugaaauuauuca

SEQ ID NO: 2349781 - RNA, 13 nt, Human
aucauugugaaau

SEQ ID NO: 2349782 - RNA, 15 nt, Human
aucauugugaaauua

SEQ ID NO: 2349783 - RNA, 12 nt, Human
aucauugaaauc

SEQ ID NO: 2349784 - RNA, 24 nt, Human
aucauucucugucucauccaucau

SEQ ID NO: 2349785 - RNA, 19 nt, Human
aucauucuuauuucaugaa

SEQ ID NO: 2349786 - RNA, 20 nt, Human
aucauucuuauuucaugaaa

SEQ ID NO: 2349787 - RNA, 14 nt, Human
aucauuguauggau

SEQ ID NO: 2349788 - RNA, 16 nt, Human
aucauuguacaguuug

SEQ ID NO: 2349789 - RNA, 18 nt, Human
aucauuguacaguuuguu

SEQ ID NO: 2349790 - RNA, 22 nt, Human
aucauuguacaguuuguuuaca

SEQ ID NO: 2349791 - RNA, 18 nt, Human
aucauuguauauaugugu

SEQ ID NO: 2349792 - RNA, 15 nt, Human
aucauuguacaguuu

SEQ ID NO: 2349793 - RNA, 23 nt, Human
aucauucuuauuucaugaaaauu

SEQ ID NO: 2349794 - RNA, 13 nt, Human
aucauugaaaucu

SEQ ID NO: 2349795 - RNA, 12 nt, Human
uucuccuuugua

SEQ ID NO: 2349796 - RNA, 23 nt, Human
uucuccuccaugggagaaaauag

SEQ ID NO: 2349797 - RNA, 14 nt, Human
uucuccuuuguacu

SEQ ID NO: 2349798 - RNA, 17 nt, Human
uucuccuuuguacuuug

SEQ ID NO: 2349799 - RNA, 18 nt, Human
uucuccuuucacaaccuu

SEQ ID NO: 2349800 - RNA, 22 nt, Human
uucuccuuucacaaccuucugu

SEQ ID NO: 2349801 - RNA, 17 nt, Human
uucucgauuuuaucuuu

SEQ ID NO: 2349802 - RNA, 20 nt, Human
uucuccuuugauaaaauaaa

SEQ ID NO: 2349803 - RNA, 16 nt, Human
uucuccuuuugaaaag

SEQ ID NO: 2349804 - RNA, 13 nt, Human
uucuccuuuuccu

SEQ ID NO: 2349805 - RNA, 18 nt, Human
uucuccuuuuccucucuc

SEQ ID NO: 2349806 - RNA, 23 nt, Human
uucucuaaaugaggggccucagg

SEQ ID NO: 2349807 - RNA, 12 nt, Human
uucucgggcuga

SEQ ID NO: 2349808 - RNA, 20 nt, Human
uucucucaucucuuagcucc

SEQ ID NO: 2349809 - RNA, 23 nt, Human
uucucucaucucuuagcuccccu

SEQ ID NO: 2349810 - RNA, 13 nt, Human
uucucucaucucu

SEQ ID NO: 2349811 - RNA, 17 nt, Human
uucucucaucucuuagc

SEQ ID NO: 2349812 - RNA, 12 nt, Human
uucucucaucuc

SEQ ID NO: 2349813 - RNA, 16 nt, Human
uucucuaucauuuaau

SEQ ID NO: 2349814 - RNA, 13 nt, Human
uucucucaccucc

SEQ ID NO: 2349815 - RNA, 20 nt, Human
uucucuaaaauagccacuua

SEQ ID NO: 2349816 - RNA, 13 nt, Human
uucucuaucauuu

SEQ ID NO: 2349817 - RNA, 21 nt, Human
uucucuaguuugauuaaauuc

SEQ ID NO: 2349818 - RNA, 18 nt, Human
uucugaagucuacuuugu

SEQ ID NO: 2349819 - RNA, 17 nt, Human
uucugaauaacauuugu

SEQ ID NO: 2349820 - RNA, 15 nt, Human
uucugaauaugcugc

SEQ ID NO: 2349821 - RNA, 14 nt, Human
uucugaaugcugcu

SEQ ID NO: 2349822 - RNA, 16 nt, Human
uucugaaugcugcuac

SEQ ID NO: 2349823 - RNA, 16 nt, Human
uucugaauaauuucuu

SEQ ID NO: 2349824 - RNA, 17 nt, Human
uucugaauaauuucuua

SEQ ID NO: 2349825 - RNA, 19 nt, Human
uucugaauacaaagugaug

SEQ ID NO: 2349826 - RNA, 11 nt, Human
uucugaauaug

SEQ ID NO: 2349827 - RNA, 19 nt, Human
uucugcagccacuauuguu

SEQ ID NO: 2349828 - RNA, 22 nt, Human
uucugcaguaaaucuuuuacaa

SEQ ID NO: 2349829 - RNA, 19 nt, Human
uucugcaguagucucugug

SEQ ID NO: 2349830 - RNA, 20 nt, Human
uucugcaguagucucugugc

SEQ ID NO: 2349831 - RNA, 18 nt, Human
uucugcaguaaaucuuuu

SEQ ID NO: 2349832 - RNA, 15 nt, Human
uucugcaguaaaucu

SEQ ID NO: 2349833 - RNA, 18 nt, Human
uucugaaugcugcuacuu

SEQ ID NO: 2349834 - RNA, 11 nt, Human
uucugaaugua

SEQ ID NO: 2349835 - RNA, 12 nt, Human
uucugcagcugu

SEQ ID NO: 2349836 - RNA, 15 nt, Human
uucugcagcuguuuu

SEQ ID NO: 2349837 - RNA, 16 nt, Human
uucugcagcuguuuua

SEQ ID NO: 2349838 - RNA, 23 nt, Human
uucugcauauguugaauacuuuu

SEQ ID NO: 2349839 - RNA, 22 nt, Human
uucugcauauguugaauacuuu

SEQ ID NO: 2349840 - RNA, 21 nt, Human
uucugcauauguugaauacuu

SEQ ID NO: 2349841 - RNA, 17 nt, Human
uucugcauauguugaau

SEQ ID NO: 2349842 - RNA, 17 nt, Human
uucugccugccagcugc

SEQ ID NO: 2349843 - RNA, 16 nt, Human
uucugccugccagcug

SEQ ID NO: 2349844 - RNA, 12 nt, Human
uucugccugcca

SEQ ID NO: 2349845 - RNA, 21 nt, Human
uucugcaguagucucugugcu

SEQ ID NO: 2349846 - RNA, 16 nt, Human
uucugcaucagcugcu

SEQ ID NO: 2349847 - RNA, 23 nt, Human
uucuucucaggcaugaacaugua

SEQ ID NO: 2349848 - RNA, 16 nt, Human
uucuugccaaugaggu

SEQ ID NO: 2349849 - RNA, 18 nt, Human
uucuugccucuguccccu

SEQ ID NO: 2349850 - RNA, 20 nt, Human
uucuugccucuguccccuuc

SEQ ID NO: 2349851 - RNA, 15 nt, Human
uucuugccucugugc

SEQ ID NO: 2349852 - RNA, 16 nt, Human
uucuugccucugugcu

SEQ ID NO: 2349853 - RNA, 17 nt, Human
uucuugccucugugcug

SEQ ID NO: 2349854 - RNA, 22 nt, Human
uucuugccucugugcugugugu

SEQ ID NO: 2349855 - RNA, 12 nt, Human
uucuugccuuca

SEQ ID NO: 2349856 - RNA, 11 nt, Human
uucuucucccu

SEQ ID NO: 2349857 - RNA, 22 nt, Human
uucuucuccacuuucuagccag

SEQ ID NO: 2349858 - RNA, 20 nt, Human
uucuucggggaacuccugga

SEQ ID NO: 2349859 - RNA, 17 nt, Human
uucuucgggaagagagg

SEQ ID NO: 2349860 - RNA, 23 nt, Human
uucuucgagguggaucacagagg

SEQ ID NO: 2349861 - RNA, 15 nt, Human
uucuucgggaagaga

SEQ ID NO: 2349862 - RNA, 21 nt, Human
uucuucuagguucuaaaaauu

SEQ ID NO: 2349863 - RNA, 18 nt, Human
uucuucuagguucuaaaa

SEQ ID NO: 2349864 - RNA, 21 nt, Human
uucuugccuacuaugccagau

SEQ ID NO: 2349865 - RNA, 21 nt, Human
uucuuucuaguggucuuugua

SEQ ID NO: 2349866 - RNA, 22 nt, Human
uucuuucuaguggucuuuguaa

SEQ ID NO: 2349867 - RNA, 19 nt, Human
uucuuucuaguucagcugc

SEQ ID NO: 2349868 - RNA, 12 nt, Human
uucuuucuggcu

SEQ ID NO: 2349869 - RNA, 20 nt, Human
uucuuucuggcuaugcauuu

SEQ ID NO: 2349870 - RNA, 17 nt, Human
uucuuucuggcuaugca

SEQ ID NO: 2349871 - RNA, 17 nt, Human
uucuuugagacuggguc

SEQ ID NO: 2349872 - RNA, 16 nt, Human
uucuuugauaauguua

SEQ ID NO: 2349873 - RNA, 17 nt, Human
uucuuugauaauguuaa

SEQ ID NO: 2349874 - RNA, 18 nt, Human
uucuuugauaauguuaaa

SEQ ID NO: 2349875 - RNA, 11 nt, Human
uucuuugaaug

SEQ ID NO: 2349876 - RNA, 21 nt, Human
uucuuugauguuaacacauuu

SEQ ID NO: 2349877 - RNA, 22 nt, Human
uucuuugauguuaacacauuuu

SEQ ID NO: 2349878 - RNA, 13 nt, Human
uucuuugauguua

SEQ ID NO: 2349879 - RNA, 18 nt, Human
uucuuugauguuaacaca

SEQ ID NO: 2349880 - RNA, 20 nt, Human
uucuuugauguuaacacauu

SEQ ID NO: 2349881 - RNA, 22 nt, Human
uucuuugauaauguuaaauuug

SEQ ID NO: 2349882 - RNA, 14 nt, Human
aucccugccugguc

SEQ ID NO: 2349883 - RNA, 20 nt, Human
uucuguugucauugcuguug

SEQ ID NO: 2349884 - RNA, 15 nt, Human
aucccugccagcucu

SEQ ID NO: 2349885 - RNA, 14 nt, Human
aucccugccagcuc

SEQ ID NO: 2349886 - RNA, 15 nt, Human
aucccugccugguca

SEQ ID NO: 2349887 - RNA, 18 nt, Human
uucuguuuagauaauaca

SEQ ID NO: 2349888 - RNA, 13 nt, Human
uucuguuuagaua

SEQ ID NO: 2349889 - RNA, 15 nt, Human
uucuguuuccuuuuu

SEQ ID NO: 2349890 - RNA, 19 nt, Human
uucuguuuacaucaguuuu

SEQ ID NO: 2349891 - RNA, 16 nt, Human
uucuguuuuauaauuu

SEQ ID NO: 2349892 - RNA, 11 nt, Human
uucuguuucuu

SEQ ID NO: 2349893 - RNA, 16 nt, Human
uucuguuuggaggagc

SEQ ID NO: 2349894 - RNA, 17 nt, Human
uucuguuuuauaauuuu

SEQ ID NO: 2349895 - RNA, 21 nt, Human
uucuuaaaugggcuacuuugu

SEQ ID NO: 2349896 - RNA, 23 nt, Human
uucuuaaccagaucauugugaaa

SEQ ID NO: 2349897 - RNA, 22 nt, Human
uucuuaaccagaucauugugaa

SEQ ID NO: 2349898 - RNA, 15 nt, Human
uucuguuuucuguuu

SEQ ID NO: 2349899 - RNA, 19 nt, Human
uucuuaaauaauaaagauc

SEQ ID NO: 2349900 - RNA, 15 nt, Human
uucuuaaauaauaaa

SEQ ID NO: 2349901 - RNA, 12 nt, Human
uucuuagaaauu

SEQ ID NO: 2349902 - RNA, 15 nt, Human
uucuuacuaaacauu

SEQ ID NO: 2349903 - RNA, 18 nt, Human
uucuuacuaaacauuuug

SEQ ID NO: 2349904 - RNA, 21 nt, Human
uucuuagacuacauuuagaga

SEQ ID NO: 2349905 - RNA, 13 nt, Human
uucuuagaaauuu

SEQ ID NO: 2349906 - RNA, 22 nt, Human
uucuuagaaauuuauuuccuag

SEQ ID NO: 2349907 - RNA, 15 nt, Human
uucuuaccuguaugu

SEQ ID NO: 2349908 - RNA, 13 nt, Human
uucuuacauguuu

SEQ ID NO: 2349909 - RNA, 16 nt, Human
uucuuacaugcauuug

SEQ ID NO: 2349910 - RNA, 14 nt, Human
uucuuacaugcauu

SEQ ID NO: 2349911 - RNA, 14 nt, Human
uucuuacauguuuu

SEQ ID NO: 2349912 - RNA, 22 nt, Human
auccaagacagaauaaugaaug

SEQ ID NO: 2349913 - RNA, 22 nt, Human
auccaauggacugcauaaauaa

SEQ ID NO: 2349914 - RNA, 15 nt, Human
auccacacacagagg

SEQ ID NO: 2349915 - RNA, 23 nt, Human
auccacacacagaggaagagcag

SEQ ID NO: 2349916 - RNA, 19 nt, Human
auccacacacgcaggaacu

SEQ ID NO: 2349917 - RNA, 20 nt, Human
auccacacacagaggaagag

SEQ ID NO: 2349918 - RNA, 16 nt, Human
auccacacacagagga

SEQ ID NO: 2349919 - RNA, 13 nt, Human
auccacagagagu

SEQ ID NO: 2349920 - RNA, 17 nt, Human
auccacagagaguccca

SEQ ID NO: 2349921 - RNA, 19 nt, Human
auccacagagagucccacu

SEQ ID NO: 2349922 - RNA, 17 nt, Human
auccagguucagcuugu

SEQ ID NO: 2349923 - RNA, 13 nt, Human
auccacauuguuu

SEQ ID NO: 2349924 - RNA, 15 nt, Human
auccacauuguuuua

SEQ ID NO: 2349925 - RNA, 17 nt, Human
auccacauuguuuuaaa

SEQ ID NO: 2349926 - RNA, 20 nt, Human
auccacagagagucccacug

SEQ ID NO: 2349927 - RNA, 21 nt, Human
auccacagagagucccacugc

SEQ ID NO: 2349928 - RNA, 18 nt, Human
auccaucaucaugugugu

SEQ ID NO: 2349929 - RNA, 15 nt, Human
auccaguaucuugaa

SEQ ID NO: 2349930 - RNA, 20 nt, Human
auccaugaccuaguuuucca

SEQ ID NO: 2349931 - RNA, 18 nt, Human
auccaugaccuaguuuuc

SEQ ID NO: 2349932 - RNA, 21 nt, Human
auccaucuaaauaccugcccu

SEQ ID NO: 2349933 - RNA, 14 nt, Human
auccauccagaggc

SEQ ID NO: 2349934 - RNA, 14 nt, Human
auccaguaucuuga

SEQ ID NO: 2349935 - RNA, 16 nt, Human
auccaguaggauccag

SEQ ID NO: 2349936 - RNA, 20 nt, Human
auccaaccccccaccugcca

SEQ ID NO: 2349937 - RNA, 18 nt, Human
auccaaccccccaccugc

SEQ ID NO: 2349938 - RNA, 22 nt, Human
uucugccugccagcugcacuga

SEQ ID NO: 2349939 - RNA, 15 nt, Human
auccaaagcagacag

SEQ ID NO: 2349940 - RNA, 19 nt, Human
uucugccugccagcugcac

SEQ ID NO: 2349941 - RNA, 18 nt, Human
uucugccugccagcugca

SEQ ID NO: 2349942 - RNA, 15 nt, Human
uucugccugcccagg

SEQ ID NO: 2349943 - RNA, 16 nt, Human
uucugccugcccaggc

SEQ ID NO: 2349944 - RNA, 16 nt, Human
auccaagcaaauguga

SEQ ID NO: 2349945 - RNA, 20 nt, Human
auccaacuaaugccuuacuc

SEQ ID NO: 2349946 - RNA, 18 nt, Human
auccaacuaaugccuuac

SEQ ID NO: 2349947 - RNA, 16 nt, Human
auccaacuaaugccuu

SEQ ID NO: 2349948 - RNA, 19 nt, Human
auccaagauauuuuaaaau

SEQ ID NO: 2349949 - RNA, 14 nt, Human
auccaacuccagga

SEQ ID NO: 2349950 - RNA, 20 nt, Human
auccaauggguuuuucccug

SEQ ID NO: 2349951 - RNA, 16 nt, Human
aucccacuugccccug

SEQ ID NO: 2349952 - RNA, 19 nt, Human
auccaugggggcagggcau

SEQ ID NO: 2349953 - RNA, 16 nt, Human
auccaugggggcaggg

SEQ ID NO: 2349954 - RNA, 22 nt, Human
aucccacuuucuauagcagauu

SEQ ID NO: 2349955 - RNA, 20 nt, Human
aucccagagggugggcuuca

SEQ ID NO: 2349956 - RNA, 13 nt, Human
aucccagaaauua

SEQ ID NO: 2349957 - RNA, 19 nt, Human
auccaugaguuugcccugg

SEQ ID NO: 2349958 - RNA, 22 nt, Human
auccaugaccuaguuuuccaug

SEQ ID NO: 2349959 - RNA, 21 nt, Human
auccaugaccuaguuuuccau

SEQ ID NO: 2349960 - RNA, 20 nt, Human
auccauggggcugauuguau

SEQ ID NO: 2349961 - RNA, 19 nt, Human
aucccagcacuuugggagg

SEQ ID NO: 2349962 - RNA, 17 nt, Human
aucccagaaauuagaaa

SEQ ID NO: 2349963 - RNA, 14 nt, Human
aucccagcacuuug

SEQ ID NO: 2349964 - RNA, 22 nt, Human
aucccagcacuuugggaggcug

SEQ ID NO: 2349965 - RNA, 17 nt, Human
aucccagcacuuuggga

SEQ ID NO: 2349966 - RNA, 20 nt, Human
aucccagcacuuugggaggc

SEQ ID NO: 2349967 - RNA, 11 nt, Human
aucccagcccc

SEQ ID NO: 2349968 - RNA, 16 nt, Human
aucccaugagccucag

SEQ ID NO: 2349969 - RNA, 21 nt, Human
aucccagcacuuugggaggcc

SEQ ID NO: 2349970 - RNA, 15 nt, Human
aucccucugggcacu

SEQ ID NO: 2349971 - RNA, 20 nt, Human
aucccugaaucccccuugcc

SEQ ID NO: 2349972 - RNA, 22 nt, Human
aucccugaaucccccuugccac

SEQ ID NO: 2349973 - RNA, 22 nt, Human
aucccugaaggccccgcccagg

SEQ ID NO: 2349974 - RNA, 17 nt, Human
aucccugaaggccccgc

SEQ ID NO: 2349975 - RNA, 17 nt, Human
aucccaugagccucagc

SEQ ID NO: 2349976 - RNA, 18 nt, Human
aucccaugagccucagca

SEQ ID NO: 2349977 - RNA, 21 nt, Human
aggacugugacaggcagcaga

SEQ ID NO: 2349978 - RNA, 22 nt, Human
aggacugugacaggcagcagag

SEQ ID NO: 2349979 - RNA, 16 nt, Human
aggacugugacaggca

SEQ ID NO: 2349980 - RNA, 22 nt, Human
aggacuguauuugugacuaauu

SEQ ID NO: 2349981 - RNA, 17 nt, Human
aggacugugacaggcag

SEQ ID NO: 2349982 - RNA, 18 nt, Human
aggacugugacaggcagc

SEQ ID NO: 2349983 - RNA, 19 nt, Human
aggacugugacaggcagca

SEQ ID NO: 2349984 - RNA, 20 nt, Human
aggacugugacaggcagcag

SEQ ID NO: 2349985 - RNA, 19 nt, Human
aggacugaauuguccccag

SEQ ID NO: 2349986 - RNA, 17 nt, Human
aggacugaauugucccc

SEQ ID NO: 2349987 - RNA, 14 nt, Human
aggacauuucucua

SEQ ID NO: 2349988 - RNA, 20 nt, Human
aggacugaauuguccccagu

SEQ ID NO: 2349989 - RNA, 13 nt, Human
aggacugagcccc

SEQ ID NO: 2349990 - RNA, 16 nt, Human
aggacugagccccgca

SEQ ID NO: 2349991 - RNA, 24 nt, Human
aggacugagccccgcagaccuccc

SEQ ID NO: 2349992 - RNA, 12 nt, Human
aggacugaggga

SEQ ID NO: 2349993 - RNA, 18 nt, Human
aggacugagggacucuga

SEQ ID NO: 2349994 - RNA, 16 nt, Human
aggacuuggucugauu

SEQ ID NO: 2349995 - RNA, 20 nt, Human
aggacuuggucugauuucag

SEQ ID NO: 2349996 - RNA, 16 nt, Human
aggacuugugucucug

SEQ ID NO: 2349997 - RNA, 13 nt, Human
aggacuugugucu

SEQ ID NO: 2349998 - RNA, 22 nt, Human
aggacuguuuuuuccugagcuu

SEQ ID NO: 2349999 - RNA, 17 nt, Human
aggacuuaacggcucca

SEQ ID NO: 2350000 - RNA, 18 nt, Human
aggacuuaacggcuccag

SEQ ID NO: 2350001 - RNA, 20 nt, Human
aggacuuaacggcuccagga

SEQ ID NO: 2350002 - RNA, 18 nt, Human
aggacuguuuuuuccuga

SEQ ID NO: 2350003 - RNA, 21 nt, Human
aggacuguuuuuuccugagcu

SEQ ID NO: 2350004 - RNA, 19 nt, Human
aggacuuauuuaaacucug

SEQ ID NO: 2350005 - RNA, 21 nt, Human
aggacuuaacggcuccaggau

SEQ ID NO: 2350006 - RNA, 20 nt, Human
aggacuuccuguccagcucc

SEQ ID NO: 2350007 - RNA, 19 nt, Human
aggacucugccuccucuuc

SEQ ID NO: 2350008 - RNA, 15 nt, Human
aggacauuucccagg

SEQ ID NO: 2350009 - RNA, 17 nt, Human
aggacauuccaagacag

SEQ ID NO: 2350010 - RNA, 18 nt, Human
aggacauuccaagacagu

SEQ ID NO: 2350011 - RNA, 19 nt, Human
aggacauugcggacagcca

SEQ ID NO: 2350012 - RNA, 23 nt, Human
aggacauugcggacagccacggc

SEQ ID NO: 2350013 - RNA, 15 nt, Human
aggacauguuuuugu

SEQ ID NO: 2350014 - RNA, 16 nt, Human
aggacauguuuuuguu

SEQ ID NO: 2350015 - RNA, 21 nt, Human
aggacauguuuuuguuuucuu

SEQ ID NO: 2350016 - RNA, 23 nt, Human
aggacauguuuuuguuuucuuug

SEQ ID NO: 2350017 - RNA, 14 nt, Human
aggacauuccaaga

SEQ ID NO: 2350018 - RNA, 16 nt, Human
aggacauuccaagaca

SEQ ID NO: 2350019 - RNA, 15 nt, Human
aggacauugcggaca

SEQ ID NO: 2350020 - RNA, 17 nt, Human
aggacauugcggacagc

SEQ ID NO: 2350021 - RNA, 18 nt, Human
aggacauugcggacagcc

SEQ ID NO: 2350022 - RNA, 21 nt, Human
aggagcauuuggagagaaggc

SEQ ID NO: 2350023 - RNA, 22 nt, Human
aggagccccgaggccuucucug

SEQ ID NO: 2350024 - RNA, 18 nt, Human
aggagcccugggaggcuc

SEQ ID NO: 2350025 - RNA, 19 nt, Human
aggagcaggagccugagcc

SEQ ID NO: 2350026 - RNA, 20 nt, Human
aggagcagcuucaguuguuu

SEQ ID NO: 2350027 - RNA, 20 nt, Human
aggagcaggggcguggaggg

SEQ ID NO: 2350028 - RNA, 22 nt, Human
aggagcaaaggcugagaacacu

SEQ ID NO: 2350029 - RNA, 16 nt, Human
aggagcagccucagaa

SEQ ID NO: 2350030 - RNA, 19 nt, Human
aggagcagccucagaacaa

SEQ ID NO: 2350031 - RNA, 16 nt, Human
aggagcagcuucaguu

SEQ ID NO: 2350032 - RNA, 19 nt, Human
aggagcagugcaggcacag

SEQ ID NO: 2350033 - RNA, 16 nt, Human
aggagcauccaccucc

SEQ ID NO: 2350034 - RNA, 20 nt, Human
aggagcauccaccuccuucu

SEQ ID NO: 2350035 - RNA, 19 nt, Human
aggagcaguaucaugaagc

SEQ ID NO: 2350036 - RNA, 14 nt, Human
aggagcagugcagg

SEQ ID NO: 2350037 - RNA, 16 nt, Human
aggagcagugcaggca

SEQ ID NO: 2350038 - RNA, 14 nt, Human
aggagcagccacau

SEQ ID NO: 2350039 - RNA, 15 nt, Human
aggagauuuuccuuc

SEQ ID NO: 2350040 - RNA, 18 nt, Human
aggagauuuuccuuccua

SEQ ID NO: 2350041 - RNA, 15 nt, Human
aggagcaaaggcuga

SEQ ID NO: 2350042 - RNA, 16 nt, Human
aggagcaaaggcugag

SEQ ID NO: 2350043 - RNA, 18 nt, Human
aggagaaacagagacagg

SEQ ID NO: 2350044 - RNA, 16 nt, Human
aggagaaacagagaca

SEQ ID NO: 2350045 - RNA, 13 nt, Human
aggagauugagaa

SEQ ID NO: 2350046 - RNA, 14 nt, Human
aggagaaacagaga

SEQ ID NO: 2350047 - RNA, 13 nt, Human
aggagaaacacau

SEQ ID NO: 2350048 - RNA, 14 nt, Human
aggagaaacacauc

SEQ ID NO: 2350049 - RNA, 14 nt, Human
aggagaugggccuu

SEQ ID NO: 2350050 - RNA, 17 nt, Human
aggagauuggaaggaac

SEQ ID NO: 2350051 - RNA, 15 nt, Human
aggagauugagaagg

SEQ ID NO: 2350052 - RNA, 16 nt, Human
aggagauugagaagga

SEQ ID NO: 2350053 - RNA, 17 nt, Human
aggagauugagaaggag

SEQ ID NO: 2350054 - RNA, 19 nt, Human
aggagauugagaaggagag

SEQ ID NO: 2350055 - RNA, 21 nt, Human
aggagauugagaaggagagaa

SEQ ID NO: 2350056 - RNA, 22 nt, Human
aggagauugagaaggagagaaa

SEQ ID NO: 2350057 - RNA, 14 nt, Human
aggagauuuuccuu

SEQ ID NO: 2350058 - RNA, 21 nt, Human
aggacuuuccuaaauguuuaa

SEQ ID NO: 2350059 - RNA, 23 nt, Human
aggacuuuucuuuguggcuuccu

SEQ ID NO: 2350060 - RNA, 12 nt, Human
aggagaaacaca

SEQ ID NO: 2350061 - RNA, 13 nt, Human
aggagaaaaacaa

SEQ ID NO: 2350062 - RNA, 23 nt, Human
aggacuuggucugauuucaggau

SEQ ID NO: 2350063 - RNA, 17 nt, Human
aggacuuucugaagccu

SEQ ID NO: 2350064 - RNA, 11 nt, Human
aggacuuugca

SEQ ID NO: 2350065 - RNA, 11 nt, Human
aggagaaacug

SEQ ID NO: 2350066 - RNA, 19 nt, Human
uggaaaggagaggaaagaa

SEQ ID NO: 2350067 - RNA, 23 nt, Human
uggaaaggagaggaaagaacuca

SEQ ID NO: 2350068 - RNA, 14 nt, Human
uggaaaggagagga

SEQ ID NO: 2350069 - RNA, 15 nt, Human
uggaaaggagaggaa

SEQ ID NO: 2350070 - RNA, 16 nt, Human
uggaaaggagaggaaa

SEQ ID NO: 2350071 - RNA, 17 nt, Human
uggaaaggagaggaaag

SEQ ID NO: 2350072 - RNA, 13 nt, Human
uggaaaggcagcu

SEQ ID NO: 2350073 - RNA, 15 nt, Human
uggaaauauuaagaa

SEQ ID NO: 2350074 - RNA, 18 nt, Human
uggaaauacaguuguugg

SEQ ID NO: 2350075 - RNA, 22 nt, Human
uggaaauacaguuguuggccuc

SEQ ID NO: 2350076 - RNA, 21 nt, Human
uggaaauagaaauuuccagag

SEQ ID NO: 2350077 - RNA, 18 nt, Human
uggaaagccucugcugcc

SEQ ID NO: 2350078 - RNA, 16 nt, Human
uggaaagccucugcug

SEQ ID NO: 2350079 - RNA, 15 nt, Human
uggaaagccucugcu

SEQ ID NO: 2350080 - RNA, 20 nt, Human
uggaaagcuccuagcagaga

SEQ ID NO: 2350081 - RNA, 14 nt, Human
uggaaagccucugc

SEQ ID NO: 2350082 - RNA, 15 nt, Human
ugcuuuucugcccug

SEQ ID NO: 2350083 - RNA, 12 nt, Human
ugcuuuucucca

SEQ ID NO: 2350084 - RNA, 20 nt, Human
ugcuuuucuccaauaucagu

SEQ ID NO: 2350085 - RNA, 23 nt, Human
ugcuuuucuccaauaucagugcu

SEQ ID NO: 2350086 - RNA, 22 nt, Human
ugcuuuuccuuggggcaggcag

SEQ ID NO: 2350087 - RNA, 17 nt, Human
ugcuuugggcugcccug

SEQ ID NO: 2350088 - RNA, 17 nt, Human
ugcuuggguggagaagc

SEQ ID NO: 2350089 - RNA, 18 nt, Human
ugcuuggguggagaagcc

SEQ ID NO: 2350090 - RNA, 15 nt, Human
ugcuuggguggagaa

SEQ ID NO: 2350091 - RNA, 16 nt, Human
ugcuuggguggagaag

SEQ ID NO: 2350092 - RNA, 19 nt, Human
ugcuugggcuucauccucc

SEQ ID NO: 2350093 - RNA, 18 nt, Human
ugcuuugggcugcccugg

SEQ ID NO: 2350094 - RNA, 19 nt, Human
ugcuuugggcugcccuggu

SEQ ID NO: 2350095 - RNA, 20 nt, Human
ugcuuugggcugcccuggug

SEQ ID NO: 2350096 - RNA, 21 nt, Human
ugcuuugggcugcccuggugc

SEQ ID NO: 2350097 - RNA, 19 nt, Human
ugcuuggguggagaagcca

SEQ ID NO: 2350098 - RNA, 19 nt, Human
ugcuuuguaggugucucau

SEQ ID NO: 2350099 - RNA, 13 nt, Human
ugcuuuuaccaug

SEQ ID NO: 2350100 - RNA, 17 nt, Human
ugcuuuuaccaugcccc

SEQ ID NO: 2350101 - RNA, 18 nt, Human
ugcuuuucacugcugcaa

SEQ ID NO: 2350102 - RNA, 22 nt, Human
ugcuuuucacugcugcaaggcc

SEQ ID NO: 2350103 - RNA, 16 nt, Human
ugcuuuucacugcugc

SEQ ID NO: 2350104 - RNA, 17 nt, Human
ugcuuuucacugcugca

SEQ ID NO: 2350105 - RNA, 14 nt, Human
ugcuugccuagggc

SEQ ID NO: 2350106 - RNA, 18 nt, Human
ugcuugcccccaugcugg

SEQ ID NO: 2350107 - RNA, 17 nt, Human
ugcuugccacagagcgg

SEQ ID NO: 2350108 - RNA, 16 nt, Human
aggagcgggaccugug

SEQ ID NO: 2350109 - RNA, 18 nt, Human
aggagcgggaccuguggc

SEQ ID NO: 2350110 - RNA, 14 nt, Human
aggagccugcuggu

SEQ ID NO: 2350111 - RNA, 19 nt, Human
aggagcccugggaggcucu

SEQ ID NO: 2350112 - RNA, 11 nt, Human
aggagccuggc

SEQ ID NO: 2350113 - RNA, 22 nt, Human
aggagccugcuggucacagccu

SEQ ID NO: 2350114 - RNA, 19 nt, Human
ugcuugccugcguuuugga

SEQ ID NO: 2350115 - RNA, 22 nt, Human
ugcuugccuagggccuggucca

SEQ ID NO: 2350116 - RNA, 11 nt, Human
ugcuugccucu

SEQ ID NO: 2350117 - RNA, 19 nt, Human
ugcuugccuagggccuggu

SEQ ID NO: 2350118 - RNA, 21 nt, Human
ugcuuggaggaaggaaaccca

SEQ ID NO: 2350119 - RNA, 15 nt, Human
ugcuugccugauaua

SEQ ID NO: 2350120 - RNA, 15 nt, Human
ugcuugccucucugu

SEQ ID NO: 2350121 - RNA, 19 nt, Human
ugcuuggccuugggcuuca

SEQ ID NO: 2350122 - RNA, 19 nt, Human
ugcuuggcugcuuggccuu

SEQ ID NO: 2350123 - RNA, 15 nt, Human
ugcuugggaaggggc

SEQ ID NO: 2350124 - RNA, 19 nt, Human
ugcuugcugccuucuggau

SEQ ID NO: 2350125 - RNA, 12 nt, Human
ugcuugggcuuc

SEQ ID NO: 2350126 - RNA, 16 nt, Human
ugcuugggcuucaucc

SEQ ID NO: 2350127 - RNA, 20 nt, Human
uggacccagggaugacaugu

SEQ ID NO: 2350128 - RNA, 19 nt, Human
uggaccaggacaggaccag

SEQ ID NO: 2350129 - RNA, 18 nt, Human
uggaccaggacaggacca

SEQ ID NO: 2350130 - RNA, 14 nt, Human
uggaccaggacagg

SEQ ID NO: 2350131 - RNA, 13 nt, Human
uggaccaggacag

SEQ ID NO: 2350132 - RNA, 18 nt, Human
uggaccaguggucucaca

SEQ ID NO: 2350133 - RNA, 13 nt, Human
uggaccagugguc

SEQ ID NO: 2350134 - RNA, 15 nt, Human
uggacacagcucuuc

SEQ ID NO: 2350135 - RNA, 16 nt, Human
uggacacagcucuucu

SEQ ID NO: 2350136 - RNA, 17 nt, Human
uggaauuuauauacaac

SEQ ID NO: 2350137 - RNA, 18 nt, Human
uggacacagcucuucucc

SEQ ID NO: 2350138 - RNA, 19 nt, Human
uggaccuauguccuaagga

SEQ ID NO: 2350139 - RNA, 22 nt, Human
uggaccuaauccaagcaucccu

SEQ ID NO: 2350140 - RNA, 14 nt, Human
uggaccuaauccaa

SEQ ID NO: 2350141 - RNA, 22 nt, Human
uggaccuauguccuaaggacac

SEQ ID NO: 2350142 - RNA, 13 nt, Human
uggacccuuccau

SEQ ID NO: 2350143 - RNA, 17 nt, Human
uggaccuaaauggccuc

SEQ ID NO: 2350144 - RNA, 18 nt, Human
uggaccuaaauggccuca

SEQ ID NO: 2350145 - RNA, 21 nt, Human
uggaccuaaauggccucaugu

SEQ ID NO: 2350146 - RNA, 14 nt, Human
uggacccugaggcc

SEQ ID NO: 2350147 - RNA, 12 nt, Human
uggacccugagg

SEQ ID NO: 2350148 - RNA, 13 nt, Human
uggacccugaggc

SEQ ID NO: 2350149 - RNA, 19 nt, Human
aggcaacugaggcagacag

SEQ ID NO: 2350150 - RNA, 17 nt, Human
aggcaacugaggcagac

SEQ ID NO: 2350151 - RNA, 23 nt, Human
uggaauugauuugcauugaacac

SEQ ID NO: 2350152 - RNA, 18 nt, Human
uggaauuggagcucgugg

SEQ ID NO: 2350153 - RNA, 17 nt, Human
uggaauugggagcuugg

SEQ ID NO: 2350154 - RNA, 22 nt, Human
uggaauuggguggggggcuuca

SEQ ID NO: 2350155 - RNA, 22 nt, Human
uggaauuucucccagucauuua

SEQ ID NO: 2350156 - RNA, 16 nt, Human
aggcaacugaggcaga

SEQ ID NO: 2350157 - RNA, 15 nt, Human
aggcaacugaggcag

SEQ ID NO: 2350158 - RNA, 14 nt, Human
aggcaacugaggca

SEQ ID NO: 2350159 - RNA, 17 nt, Human
aggcaacucaucuuagg

SEQ ID NO: 2350160 - RNA, 16 nt, Human
aggcaacauccaaaau

SEQ ID NO: 2350161 - RNA, 17 nt, Human
aggcaaauguguacaug

SEQ ID NO: 2350162 - RNA, 17 nt, Human
aggcaaaauugcaaauc

SEQ ID NO: 2350163 - RNA, 13 nt, Human
aggcaaaauugca

SEQ ID NO: 2350164 - RNA, 19 nt, Human
aggcaaaauccuugcuuau

SEQ ID NO: 2350165 - RNA, 17 nt, Human
aggcaaaauccuugcuu

SEQ ID NO: 2350166 - RNA, 22 nt, Human
aggaugcccagggccacucugc

SEQ ID NO: 2350167 - RNA, 14 nt, Human
aggaugcccagggc

SEQ ID NO: 2350168 - RNA, 13 nt, Human
aggaugcccaggg

SEQ ID NO: 2350169 - RNA, 19 nt, Human
aggaugcagagucagcaga

SEQ ID NO: 2350170 - RNA, 21 nt, Human
aggaugaggccgcuagaggcc

SEQ ID NO: 2350171 - RNA, 23 nt, Human
aggaugaggccgcuagaggccug

SEQ ID NO: 2350172 - RNA, 19 nt, Human
aggaugcccaaagaugcag

SEQ ID NO: 2350173 - RNA, 20 nt, Human
aggaugaucuaggaagacuu

SEQ ID NO: 2350174 - RNA, 14 nt, Human
aggaugcccaaaga

SEQ ID NO: 2350175 - RNA, 19 nt, Human
aggauuuugauccaagcug

SEQ ID NO: 2350176 - RNA, 17 nt, Human
aggaugccccguccccc

SEQ ID NO: 2350177 - RNA, 16 nt, Human
aggaugcuaacaucua

SEQ ID NO: 2350178 - RNA, 17 nt, Human
aggaugcuaacaucuaa

SEQ ID NO: 2350179 - RNA, 15 nt, Human
aggcaaaaauguaaa

SEQ ID NO: 2350180 - RNA, 16 nt, Human
aggauuuuuuucugag

SEQ ID NO: 2350181 - RNA, 17 nt, Human
aggauuuuuuucugagc

SEQ ID NO: 2350182 - RNA, 20 nt, Human
aggauuuuaugcuuuaaaca

SEQ ID NO: 2350183 - RNA, 15 nt, Human
aggauuuuuaucuuu

SEQ ID NO: 2350184 - RNA, 19 nt, Human
aggaugcuaacaucuaaaa

SEQ ID NO: 2350185 - RNA, 17 nt, Human
aggaugcuaaaccuuag

SEQ ID NO: 2350186 - RNA, 17 nt, Human
aggauuuuaugcuuuaa

SEQ ID NO: 2350187 - RNA, 12 nt, Human
aggauaaaauaa

SEQ ID NO: 2350188 - RNA, 21 nt, Human
aggauacaaaagcaugugaga

SEQ ID NO: 2350189 - RNA, 15 nt, Human
aggauccugagccag

SEQ ID NO: 2350190 - RNA, 16 nt, Human
aggauccugagccaga

SEQ ID NO: 2350191 - RNA, 21 nt, Human
aggagggagcaucagugcccu

SEQ ID NO: 2350192 - RNA, 14 nt, Human
aggagggagaggga

SEQ ID NO: 2350193 - RNA, 15 nt, Human
aggagggagagggag

SEQ ID NO: 2350194 - RNA, 14 nt, Human
aggagggaggggga

SEQ ID NO: 2350195 - RNA, 22 nt, Human
aggaucucuugagccugggagg

SEQ ID NO: 2350196 - RNA, 21 nt, Human
aggaucucuugagccugggag

SEQ ID NO: 2350197 - RNA, 17 nt, Human
aggauccugagccagau

SEQ ID NO: 2350198 - RNA, 18 nt, Human
aggauccugagccagauu

SEQ ID NO: 2350199 - RNA, 23 nt, Human
aggaucuguuuuuaaaaaucaua

SEQ ID NO: 2350200 - RNA, 20 nt, Human
aggaucuguuuuuaaaaauc

SEQ ID NO: 2350201 - RNA, 14 nt, Human
aggaucuggagaac

SEQ ID NO: 2350202 - RNA, 17 nt, Human
aggaucuuuguggccaa

SEQ ID NO: 2350203 - RNA, 16 nt, Human
aggaucuuuguggcca

SEQ ID NO: 2350204 - RNA, 15 nt, Human
aggaucuuuguggcc

SEQ ID NO: 2350205 - RNA, 13 nt, Human
aggaucuuugugg

SEQ ID NO: 2350206 - RNA, 13 nt, Human
aggaugagcugga

SEQ ID NO: 2350207 - RNA, 15 nt, Human
aggaugagcuggaag

SEQ ID NO: 2350208 - RNA, 16 nt, Human
aggaugagcuggaagg

SEQ ID NO: 2350209 - RNA, 20 nt, Human
aggaucuuuguggccaagga

SEQ ID NO: 2350210 - RNA, 18 nt, Human
aggaucuuuguggccaag

SEQ ID NO: 2350211 - RNA, 20 nt, Human
aggaugagcucuacccaggg

SEQ ID NO: 2350212 - RNA, 16 nt, Human
aggaugaucuaggaag

SEQ ID NO: 2350213 - RNA, 17 nt, Human
aggaugaucuaggaaga

SEQ ID NO: 2350214 - RNA, 20 nt, Human
uggaaauuaagaagaaacua

SEQ ID NO: 2350215 - RNA, 18 nt, Human
uggaaauuaagaagaaac

SEQ ID NO: 2350216 - RNA, 23 nt, Human
uggaaaugggcagagcagagacc

SEQ ID NO: 2350217 - RNA, 23 nt, Human
uggaaauauucaugcuucuuccu

SEQ ID NO: 2350218 - RNA, 22 nt, Human
uggaaauaucaguuacucagcc

SEQ ID NO: 2350219 - RNA, 20 nt, Human
uggaaauauuaagaaagacu

SEQ ID NO: 2350220 - RNA, 22 nt, Human
aggagcugccuuggcucagaca

SEQ ID NO: 2350221 - RNA, 21 nt, Human
aggagcugccuuggcucagac

SEQ ID NO: 2350222 - RNA, 23 nt, Human
aggagcugccuuggcucagacau

SEQ ID NO: 2350223 - RNA, 11 nt, Human
aggagcugcua

SEQ ID NO: 2350224 - RNA, 19 nt, Human
aggagcugccuuggcucag

SEQ ID NO: 2350225 - RNA, 18 nt, Human
aggagcugccuuggcuca

SEQ ID NO: 2350226 - RNA, 18 nt, Human
uggaaauucccuucaucu

SEQ ID NO: 2350227 - RNA, 16 nt, Human
uggaaauugacgaggg

SEQ ID NO: 2350228 - RNA, 14 nt, Human
aggagcugcccaga

SEQ ID NO: 2350229 - RNA, 21 nt, Human
aggagcugcccagaguugcug

SEQ ID NO: 2350230 - RNA, 22 nt, Human
uggaaauucccuucaucuggaa

SEQ ID NO: 2350231 - RNA, 17 nt, Human
uggaaauucccuucauc

SEQ ID NO: 2350232 - RNA, 23 nt, Human
aggaggauugcuugagcccagga

SEQ ID NO: 2350233 - RNA, 21 nt, Human
aggaggauugcuugagcccag

SEQ ID NO: 2350234 - RNA, 20 nt, Human
aggaggauugcuugagccca

SEQ ID NO: 2350235 - RNA, 21 nt, Human
aggaggagguuuaggucaaga

SEQ ID NO: 2350236 - RNA, 23 nt, Human
aggaggaggcaauugggauggcg

SEQ ID NO: 2350237 - RNA, 18 nt, Human
aggaggaggugccaacag

SEQ ID NO: 2350238 - RNA, 14 nt, Human
aggaggaugggcuc

SEQ ID NO: 2350239 - RNA, 15 nt, Human
aggaggaugggcucg

SEQ ID NO: 2350240 - RNA, 22 nt, Human
aggaggaugggcucgcccacca

SEQ ID NO: 2350241 - RNA, 16 nt, Human
aggagcugcuggcuug

SEQ ID NO: 2350242 - RNA, 14 nt, Human
aggagcugcuggcu

SEQ ID NO: 2350243 - RNA, 12 nt, Human
aggaggaggagg

SEQ ID NO: 2350244 - RNA, 17 nt, Human
aggagcugcuggcuugc

SEQ ID NO: 2350245 - RNA, 13 nt, Human
aggagcugcuggc

SEQ ID NO: 2350246 - RNA, 12 nt, Human
aggagcugcugg

SEQ ID NO: 2350247 - RNA, 21 nt, Human
aggagcugcuauagccugggg

SEQ ID NO: 2350248 - RNA, 20 nt, Human
aggagcugcuauagccuggg

SEQ ID NO: 2350249 - RNA, 19 nt, Human
aggagcugcuauagccugg

SEQ ID NO: 2350250 - RNA, 13 nt, Human
aggagcugcuaua

SEQ ID NO: 2350251 - RNA, 20 nt, Human
aggaggcagcuguugcagug

SEQ ID NO: 2350252 - RNA, 14 nt, Human
aggaggcaggaccu

SEQ ID NO: 2350253 - RNA, 20 nt, Human
aggaggcuuggaaagcauca

SEQ ID NO: 2350254 - RNA, 12 nt, Human
aggaggccaccu

SEQ ID NO: 2350255 - RNA, 13 nt, Human
aggaggccaccuc

SEQ ID NO: 2350256 - RNA, 16 nt, Human
aggagggagacacugg

SEQ ID NO: 2350257 - RNA, 23 nt, Human
aggagggagacacuggccccuca

SEQ ID NO: 2350258 - RNA, 12 nt, Human
aggagggagagg

SEQ ID NO: 2350259 - RNA, 13 nt, Human
aggagggagaggg

SEQ ID NO: 2350260 - RNA, 21 nt, Human
ugcucugcuugacaacaucug

SEQ ID NO: 2350261 - RNA, 16 nt, Human
ugcucugcuugacaac

SEQ ID NO: 2350262 - RNA, 18 nt, Human
ugcugacauucaccugcc

SEQ ID NO: 2350263 - RNA, 13 nt, Human
ugcuccgugccuc

SEQ ID NO: 2350264 - RNA, 14 nt, Human
ugcuccgugccucc

SEQ ID NO: 2350265 - RNA, 16 nt, Human
ugcucugcugacagac

SEQ ID NO: 2350266 - RNA, 16 nt, Human
ugcugaccuccacagc

SEQ ID NO: 2350267 - RNA, 15 nt, Human
ugcugaccuccacag

SEQ ID NO: 2350268 - RNA, 15 nt, Human
ugcugacccuccugu

SEQ ID NO: 2350269 - RNA, 19 nt, Human
ugcucuggaaaaugugacc

SEQ ID NO: 2350270 - RNA, 23 nt, Human
ugcucuggaaaaugugacccaga

SEQ ID NO: 2350271 - RNA, 15 nt, Human
ugcugagucugaagg

SEQ ID NO: 2350272 - RNA, 14 nt, Human
ugcugagucugaag

SEQ ID NO: 2350273 - RNA, 20 nt, Human
ugcugacggccagggagaag

SEQ ID NO: 2350274 - RNA, 17 nt, Human
ugcugacggccagggag

SEQ ID NO: 2350275 - RNA, 15 nt, Human
ugcugacggccaggg

SEQ ID NO: 2350276 - RNA, 14 nt, Human
ugcugacggccagg

SEQ ID NO: 2350277 - RNA, 22 nt, Human
ugcugacggccagggagaagcu

SEQ ID NO: 2350278 - RNA, 21 nt, Human
ugcucugcugacagacacagg

SEQ ID NO: 2350279 - RNA, 22 nt, Human
ugcucugcugacagacacaggc

SEQ ID NO: 2350280 - RNA, 18 nt, Human
ugcuccgccucugcuggc

SEQ ID NO: 2350281 - RNA, 18 nt, Human
ugcucccugguucugaug

SEQ ID NO: 2350282 - RNA, 22 nt, Human
ugcucccugaagccagccuucu

SEQ ID NO: 2350283 - RNA, 18 nt, Human
ugcucccugaagccagcc

SEQ ID NO: 2350284 - RNA, 19 nt, Human
ugcucccugaagccagccu

SEQ ID NO: 2350285 - RNA, 20 nt, Human
ugcucccugaagccagccuu

SEQ ID NO: 2350286 - RNA, 21 nt, Human
ugcucccugaagccagccuuc

SEQ ID NO: 2350287 - RNA, 19 nt, Human
ugcucccuccccugcccug

SEQ ID NO: 2350288 - RNA, 15 nt, Human
ugcucccccauccuc

SEQ ID NO: 2350289 - RNA, 23 nt, Human
ugcucccccacccccuccccagg

SEQ ID NO: 2350290 - RNA, 21 nt, Human
ugcucccccacccccucccca

SEQ ID NO: 2350291 - RNA, 16 nt, Human
ugcucccccacccccu

SEQ ID NO: 2350292 - RNA, 14 nt, Human
ugcucccccacccc

SEQ ID NO: 2350293 - RNA, 20 nt, Human
ugcucccuccccugcccugg

SEQ ID NO: 2350294 - RNA, 13 nt, Human
ugcucccccaucc

SEQ ID NO: 2350295 - RNA, 13 nt, Human
ugcucccugaagc

SEQ ID NO: 2350296 - RNA, 14 nt, Human
ugcucccugaagcc

SEQ ID NO: 2350297 - RNA, 15 nt, Human
ugcucccugaagcca

SEQ ID NO: 2350298 - RNA, 17 nt, Human
ugcucccugaagccagc

SEQ ID NO: 2350299 - RNA, 17 nt, Human
ugcucccagcagcccua

SEQ ID NO: 2350300 - RNA, 20 nt, Human
ugcucccagcagcccuaagg

SEQ ID NO: 2350301 - RNA, 21 nt, Human
ugcucccagcagcccuaagga

SEQ ID NO: 2350302 - RNA, 16 nt, Human
ugcuccccagcccugg

SEQ ID NO: 2350303 - RNA, 17 nt, Human
ugcuccccagcccuggc

SEQ ID NO: 2350304 - RNA, 18 nt, Human
ugcuccccagcccuggcu

SEQ ID NO: 2350305 - RNA, 22 nt, Human
ugcuccccagcccuggcucugc

SEQ ID NO: 2350306 - RNA, 23 nt, Human
ugcuccccagcccuggcucugca

SEQ ID NO: 2350307 - RNA, 19 nt, Human
ugcuccacccuuggccugu

SEQ ID NO: 2350308 - RNA, 18 nt, Human
ugcuccacccuuggccug

SEQ ID NO: 2350309 - RNA, 17 nt, Human
ugcuccacccuuggccu

SEQ ID NO: 2350310 - RNA, 16 nt, Human
ugcuccacccuuggcc

SEQ ID NO: 2350311 - RNA, 23 nt, Human
ugcuccacccuuggccugucuca

SEQ ID NO: 2350312 - RNA, 22 nt, Human
ugcuccacccuuggccugucuc

SEQ ID NO: 2350313 - RNA, 22 nt, Human
ugcuccagccaaccccugugga

SEQ ID NO: 2350314 - RNA, 14 nt, Human
ugcuccagccuggc

SEQ ID NO: 2350315 - RNA, 23 nt, Human
ugcuccagccaaccccuguggag

SEQ ID NO: 2350316 - RNA, 20 nt, Human
ugcuccagccaaccccugug

SEQ ID NO: 2350317 - RNA, 18 nt, Human
ugcuccagccaaccccug

SEQ ID NO: 2350318 - RNA, 17 nt, Human
ugcuccagccaaccccu

SEQ ID NO: 2350319 - RNA, 15 nt, Human
ugcuccagccaaccc

SEQ ID NO: 2350320 - RNA, 21 nt, Human
ugcuccagaccugauccugga

SEQ ID NO: 2350321 - RNA, 14 nt, Human
ugcuccagaccuga

SEQ ID NO: 2350322 - RNA, 12 nt, Human
ugcuccagaccu

SEQ ID NO: 2350323 - RNA, 19 nt, Human
ugcuccagcuguucagcug

SEQ ID NO: 2350324 - RNA, 16 nt, Human
ugcuccagcuguucag

SEQ ID NO: 2350325 - RNA, 13 nt, Human
ugcucccagcagc

SEQ ID NO: 2350326 - RNA, 14 nt, Human
ugcucccagcagcc

SEQ ID NO: 2350327 - RNA, 15 nt, Human
ugcucccagcagccc

SEQ ID NO: 2350328 - RNA, 17 nt, Human
ugcuccagccuggcucc

SEQ ID NO: 2350329 - RNA, 15 nt, Human
ugcuccagccuggcu

SEQ ID NO: 2350330 - RNA, 16 nt, Human
ugcuccagccuggcuc

SEQ ID NO: 2350331 - RNA, 15 nt, Human
ugcuccaccacaucc

SEQ ID NO: 2350332 - RNA, 22 nt, Human
ugcuauuguagagccagagguc

SEQ ID NO: 2350333 - RNA, 19 nt, Human
agcugggacuacaggcacc

SEQ ID NO: 2350334 - RNA, 16 nt, Human
agcugggacuacaggc

SEQ ID NO: 2350335 - RNA, 18 nt, Human
agcugggacuacaggcac

SEQ ID NO: 2350336 - RNA, 18 nt, Human
aggaagcaccccaugcca

SEQ ID NO: 2350337 - RNA, 11 nt, Human
aggaagcagaa

SEQ ID NO: 2350338 - RNA, 12 nt, Human
aggaagcagaau

SEQ ID NO: 2350339 - RNA, 13 nt, Human
aggaagcagaaua

SEQ ID NO: 2350340 - RNA, 14 nt, Human
aggaagcagaauaa

SEQ ID NO: 2350341 - RNA, 15 nt, Human
aggaagcagaauaaa

SEQ ID NO: 2350342 - RNA, 16 nt, Human
aggaagcagaauaaag

SEQ ID NO: 2350343 - RNA, 17 nt, Human
aggaagcagaauaaagc

SEQ ID NO: 2350344 - RNA, 18 nt, Human
aggaagcagaauaaagca

SEQ ID NO: 2350345 - RNA, 19 nt, Human
aggaagcagaauaaagcaa

SEQ ID NO: 2350346 - RNA, 14 nt, Human
aggaagccagcagg

SEQ ID NO: 2350347 - RNA, 15 nt, Human
aggaagccagcaggc

SEQ ID NO: 2350348 - RNA, 13 nt, Human
aggaagacuuugg

SEQ ID NO: 2350349 - RNA, 14 nt, Human
aggaagacuuugga

SEQ ID NO: 2350350 - RNA, 23 nt, Human
aggaagcacaugccucucucagg

SEQ ID NO: 2350351 - RNA, 24 nt, Human
aggaagcacaugccucucucaggc

SEQ ID NO: 2350352 - RNA, 16 nt, Human
ugcugagucugaaggc

SEQ ID NO: 2350353 - RNA, 17 nt, Human
ugcugagucugaaggcu

SEQ ID NO: 2350354 - RNA, 18 nt, Human
ugcugagucugaaggcug

SEQ ID NO: 2350355 - RNA, 21 nt, Human
ugcugagucugaaggcugggu

SEQ ID NO: 2350356 - RNA, 22 nt, Human
ugcugagucugaaggcuggguu

SEQ ID NO: 2350357 - RNA, 23 nt, Human
ugcugagucugaaggcuggguuc

SEQ ID NO: 2350358 - RNA, 13 nt, Human
aggaagacuucau

SEQ ID NO: 2350359 - RNA, 19 nt, Human
aggaagacuucaucccucu

SEQ ID NO: 2350360 - RNA, 18 nt, Human
aggaaggaaacccagcuc

SEQ ID NO: 2350361 - RNA, 17 nt, Human
aggaagccagcaggcuc

SEQ ID NO: 2350362 - RNA, 17 nt, Human
aggaagcugcuccgugc

SEQ ID NO: 2350363 - RNA, 20 nt, Human
aggaagcagaauaaagcaau

SEQ ID NO: 2350364 - RNA, 18 nt, Human
aggaaggagagccugcug

SEQ ID NO: 2350365 - RNA, 21 nt, Human
aggaaggagagaaggggagga

SEQ ID NO: 2350366 - RNA, 15 nt, Human
aggaaggagaggaga

SEQ ID NO: 2350367 - RNA, 17 nt, Human
aggaaggagagccugcu

SEQ ID NO: 2350368 - RNA, 15 nt, Human
aggaaggagagccug

SEQ ID NO: 2350369 - RNA, 23 nt, Human
aggaaggagacucaccucugccu

SEQ ID NO: 2350370 - RNA, 19 nt, Human
aggaaggaaacccagcucu

SEQ ID NO: 2350371 - RNA, 12 nt, Human
aggaauugacuu

SEQ ID NO: 2350372 - RNA, 18 nt, Human
aggaauuucaccuguaaa

SEQ ID NO: 2350373 - RNA, 23 nt, Human
aggaauuguguuuauaauuuuaa

SEQ ID NO: 2350374 - RNA, 21 nt, Human
aggaauuucccaggacccuga

SEQ ID NO: 2350375 - RNA, 20 nt, Human
aggaauuucccaggacccug

SEQ ID NO: 2350376 - RNA, 19 nt, Human
aggaauuucccaggacccu

SEQ ID NO: 2350377 - RNA, 18 nt, Human
aggaauuucccaggaccc

SEQ ID NO: 2350378 - RNA, 17 nt, Human
aggaauuucccaggacc

SEQ ID NO: 2350379 - RNA, 15 nt, Human
aggaauuucccagga

SEQ ID NO: 2350380 - RNA, 22 nt, Human
aggaauuucaccuguaaaccug

SEQ ID NO: 2350381 - RNA, 11 nt, Human
aggaauuuaaa

SEQ ID NO: 2350382 - RNA, 23 nt, Human
aggaauugacccacaagaaauga

SEQ ID NO: 2350383 - RNA, 22 nt, Human
ugcugugaaaaaaaaaaugcug

SEQ ID NO: 2350384 - RNA, 14 nt, Human
ugcugugaaaaaaa

SEQ ID NO: 2350385 - RNA, 18 nt, Human
ugcugugaauuagcucac

SEQ ID NO: 2350386 - RNA, 19 nt, Human
ugcugugaauuagcucacu

SEQ ID NO: 2350387 - RNA, 21 nt, Human
ugcugugaauuuguguaagga

SEQ ID NO: 2350388 - RNA, 13 nt, Human
ugcugugaggcug

SEQ ID NO: 2350389 - RNA, 14 nt, Human
ugcugugaggcugu

SEQ ID NO: 2350390 - RNA, 13 nt, Human
ugcugugaaaaaa

SEQ ID NO: 2350391 - RNA, 12 nt, Human
ugcugugaaaaa

SEQ ID NO: 2350392 - RNA, 19 nt, Human
ugcuuagucacugccugca

SEQ ID NO: 2350393 - RNA, 20 nt, Human
ugcuuaguguacuuggagua

SEQ ID NO: 2350394 - RNA, 21 nt, Human
ugcuuagucacuuauuucaua

SEQ ID NO: 2350395 - RNA, 23 nt, Human
ugcuuagucacuuauuucauaaa

SEQ ID NO: 2350396 - RNA, 16 nt, Human
ugcugugaggcugucc

SEQ ID NO: 2350397 - RNA, 17 nt, Human
ugcugugaggcuguccu

SEQ ID NO: 2350398 - RNA, 18 nt, Human
ugcugugaggcuguccug

SEQ ID NO: 2350399 - RNA, 19 nt, Human
ugcugugaggcuguccugu

SEQ ID NO: 2350400 - RNA, 13 nt, Human
ugcuuauacacuu

SEQ ID NO: 2350401 - RNA, 18 nt, Human
ugcuuauagguggccucu

SEQ ID NO: 2350402 - RNA, 21 nt, Human
ugcuuaugacaucacuuguac

SEQ ID NO: 2350403 - RNA, 20 nt, Human
ugcuuaguccaauuccuugc

SEQ ID NO: 2350404 - RNA, 17 nt, Human
ugcuuauagguggccuc

SEQ ID NO: 2350405 - RNA, 13 nt, Human
ugcuucagccucc

SEQ ID NO: 2350406 - RNA, 14 nt, Human
ugcuucagccuccc

SEQ ID NO: 2350407 - RNA, 16 nt, Human
ugcuucacuucuccca

SEQ ID NO: 2350408 - RNA, 12 nt, Human
ugcuucaaggau

SEQ ID NO: 2350409 - RNA, 22 nt, Human
ugcuuaugcaguuuuucagagu

SEQ ID NO: 2350410 - RNA, 16 nt, Human
ugcuucaaggauccug

SEQ ID NO: 2350411 - RNA, 18 nt, Human
ugcuucaaggauccugag

SEQ ID NO: 2350412 - RNA, 19 nt, Human
ugcuucaaggauccugagc

SEQ ID NO: 2350413 - RNA, 20 nt, Human
aggacauccccccgccaaaa

SEQ ID NO: 2350414 - RNA, 24 nt, Human
aggacauaaugggguccuggccau

SEQ ID NO: 2350415 - RNA, 21 nt, Human
aggacaugauggagcgcaccu

SEQ ID NO: 2350416 - RNA, 20 nt, Human
aggacauaaugggguccugg

SEQ ID NO: 2350417 - RNA, 13 nt, Human
aggacaugaaacu

SEQ ID NO: 2350418 - RNA, 18 nt, Human
aggacaugaaacuccacc

SEQ ID NO: 2350419 - RNA, 17 nt, Human
aggacaugcugaagcca

SEQ ID NO: 2350420 - RNA, 22 nt, Human
aggacaugcgguagccagcaca

SEQ ID NO: 2350421 - RNA, 20 nt, Human
aggacaugcgguagccagca

SEQ ID NO: 2350422 - RNA, 22 nt, Human
aggacagggaggugaccccagg

SEQ ID NO: 2350423 - RNA, 12 nt, Human
aggacaggcccg

SEQ ID NO: 2350424 - RNA, 18 nt, Human
aggacaggaccagauuuu

SEQ ID NO: 2350425 - RNA, 23 nt, Human
aggacagccuguggcggugccug

SEQ ID NO: 2350426 - RNA, 12 nt, Human
aggacagcuguc

SEQ ID NO: 2350427 - RNA, 22 nt, Human
aggacagccuguggcggugccu

SEQ ID NO: 2350428 - RNA, 13 nt, Human
aggacagcugucc

SEQ ID NO: 2350429 - RNA, 15 nt, Human
aggacagcuguccuc

SEQ ID NO: 2350430 - RNA, 16 nt, Human
ugcuucaguggagaau

SEQ ID NO: 2350431 - RNA, 18 nt, Human
ugcuucaguggagaauua

SEQ ID NO: 2350432 - RNA, 23 nt, Human
ugcuucagccugaggcugagacu

SEQ ID NO: 2350433 - RNA, 22 nt, Human
ugcuucagccugaggcugagac

SEQ ID NO: 2350434 - RNA, 17 nt, Human
ugcuucagccugaggcu

SEQ ID NO: 2350435 - RNA, 15 nt, Human
ugcuucagccugagg

SEQ ID NO: 2350436 - RNA, 14 nt, Human
ugcuucagccugag

SEQ ID NO: 2350437 - RNA, 12 nt, Human
ugcuucagccug

SEQ ID NO: 2350438 - RNA, 16 nt, Human
ugcuucauacagggau

SEQ ID NO: 2350439 - RNA, 15 nt, Human
ugcuucauacaggga

SEQ ID NO: 2350440 - RNA, 14 nt, Human
ugcuucauacaggg

SEQ ID NO: 2350441 - RNA, 11 nt, Human
ugcuucauaca

SEQ ID NO: 2350442 - RNA, 18 nt, Human
ugcuucauaaaugaagca

SEQ ID NO: 2350443 - RNA, 20 nt, Human
ugcuucauaaaugaagcagc

SEQ ID NO: 2350444 - RNA, 14 nt, Human
ugcuucaucccuuu

SEQ ID NO: 2350445 - RNA, 14 nt, Human
aggacacugauaug

SEQ ID NO: 2350446 - RNA, 23 nt, Human
aggacacuaaccacgcuggaccu

SEQ ID NO: 2350447 - RNA, 19 nt, Human
aggacacuaaccacgcugg

SEQ ID NO: 2350448 - RNA, 21 nt, Human
ugcuguccucagguggccaug

SEQ ID NO: 2350449 - RNA, 19 nt, Human
ugcuguccucagguggcca

SEQ ID NO: 2350450 - RNA, 17 nt, Human
ugcugucuaaccuguga

SEQ ID NO: 2350451 - RNA, 18 nt, Human
ugcugucuaaccugugac

SEQ ID NO: 2350452 - RNA, 14 nt, Human
ugcugucuaugugg

SEQ ID NO: 2350453 - RNA, 19 nt, Human
ugcugucugaucugugcuu

SEQ ID NO: 2350454 - RNA, 14 nt, Human
ugcuguccucaggu

SEQ ID NO: 2350455 - RNA, 18 nt, Human
ugcuguccucagguggcc

SEQ ID NO: 2350456 - RNA, 12 nt, Human
ugcuguccucag

SEQ ID NO: 2350457 - RNA, 23 nt, Human
ugcuguccuaggccacaccaucu

SEQ ID NO: 2350458 - RNA, 16 nt, Human
ugcuguccuaggccac

SEQ ID NO: 2350459 - RNA, 21 nt, Human
ugcuguccccucuugccccaa

SEQ ID NO: 2350460 - RNA, 14 nt, Human
ugcuguccuaggcc

SEQ ID NO: 2350461 - RNA, 20 nt, Human
ugcugucaaguuccuuuggg

SEQ ID NO: 2350462 - RNA, 14 nt, Human
ugcuguacuagaga

SEQ ID NO: 2350463 - RNA, 19 nt, Human
ugcuguacuagagaucugg

SEQ ID NO: 2350464 - RNA, 21 nt, Human
ugcuguacuagagaucugguu

SEQ ID NO: 2350465 - RNA, 15 nt, Human
ugcuguccagacagc

SEQ ID NO: 2350466 - RNA, 10 nt, Human
ugcugucccc

SEQ ID NO: 2350467 - RNA, 19 nt, Human
ugcuguccagacagccugu

SEQ ID NO: 2350468 - RNA, 21 nt, Human
ugcuguccagacagccuguau

SEQ ID NO: 2350469 - RNA, 13 nt, Human
ugcuguccccucu

SEQ ID NO: 2350470 - RNA, 15 nt, Human
ugcuguccccucuug

SEQ ID NO: 2350471 - RNA, 17 nt, Human
ugcuguccccucuugcc

SEQ ID NO: 2350472 - RNA, 20 nt, Human
ugcuguccccucuugcccca

SEQ ID NO: 2350473 - RNA, 12 nt, Human
ugcugucccucc

SEQ ID NO: 2350474 - RNA, 13 nt, Human
ugcugucccuccc

SEQ ID NO: 2350475 - RNA, 16 nt, Human
ugcugucccucccccu

SEQ ID NO: 2350476 - RNA, 17 nt, Human
ugcugucccucccccuu

SEQ ID NO: 2350477 - RNA, 17 nt, Human
ugcugggacuggccagg

SEQ ID NO: 2350478 - RNA, 15 nt, Human
ugcugggacuggcca

SEQ ID NO: 2350479 - RNA, 21 nt, Human
ugcuggcuggaagggaggagc

SEQ ID NO: 2350480 - RNA, 16 nt, Human
ugcugggacugagcca

SEQ ID NO: 2350481 - RNA, 17 nt, Human
ugcugggacugagccag

SEQ ID NO: 2350482 - RNA, 20 nt, Human
ugcugggacugagccagucc

SEQ ID NO: 2350483 - RNA, 15 nt, Human
ugcugggagcuccac

SEQ ID NO: 2350484 - RNA, 16 nt, Human
ugcugggagcuccacu

SEQ ID NO: 2350485 - RNA, 17 nt, Human
ugcugggagcuccacuc

SEQ ID NO: 2350486 - RNA, 18 nt, Human
ugcugggagcuccacucu

SEQ ID NO: 2350487 - RNA, 20 nt, Human
ugcugggagcuccacucugc

SEQ ID NO: 2350488 - RNA, 21 nt, Human
ugcugggagcuccacucugcu

SEQ ID NO: 2350489 - RNA, 22 nt, Human
ugcugggagcuccacucugcuu

SEQ ID NO: 2350490 - RNA, 23 nt, Human
ugcugggagcuccacucugcuuc

SEQ ID NO: 2350491 - RNA, 14 nt, Human
ugcugggagcugaa

SEQ ID NO: 2350492 - RNA, 18 nt, Human
ugcugggagcugaaaaau

SEQ ID NO: 2350493 - RNA, 21 nt, Human
ugcugggagcugaaaaaucac

SEQ ID NO: 2350494 - RNA, 17 nt, Human
ugcugggaggagggaga

SEQ ID NO: 2350495 - RNA, 18 nt, Human
ugcugggaggagggagag

SEQ ID NO: 2350496 - RNA, 21 nt, Human
ugcuguacaucuauuuuggau

SEQ ID NO: 2350497 - RNA, 17 nt, Human
ugcuguacaucuauuuu

SEQ ID NO: 2350498 - RNA, 16 nt, Human
ugcuguacaucuauuu

SEQ ID NO: 2350499 - RNA, 15 nt, Human
ugcuguacaucuauu

SEQ ID NO: 2350500 - RNA, 18 nt, Human
ugcuguaacuuucugaaa

SEQ ID NO: 2350501 - RNA, 20 nt, Human
ugcugggaggagggagaggg

SEQ ID NO: 2350502 - RNA, 19 nt, Human
ugcugccgccccacccaga

SEQ ID NO: 2350503 - RNA, 21 nt, Human
ugcugccgccccacccagaug

SEQ ID NO: 2350504 - RNA, 21 nt, Human
ugcuggagccuguguaacagc

SEQ ID NO: 2350505 - RNA, 22 nt, Human
ugcuggagccuguguaacagcu

SEQ ID NO: 2350506 - RNA, 20 nt, Human
aggaauuuuauuuuuuucug

SEQ ID NO: 2350507 - RNA, 15 nt, Human
ugcugcccugugagu

SEQ ID NO: 2350508 - RNA, 14 nt, Human
ugcuggagcucugc

SEQ ID NO: 2350509 - RNA, 13 nt, Human
ugcuggagcucug

SEQ ID NO: 2350510 - RNA, 12 nt, Human
ugcugcccugug

SEQ ID NO: 2350511 - RNA, 13 nt, Human
ugcugcccuguga

SEQ ID NO: 2350512 - RNA, 14 nt, Human
ugcugcccugugag

SEQ ID NO: 2350513 - RNA, 18 nt, Human
ugcuggcuguuggcuggg

SEQ ID NO: 2350514 - RNA, 16 nt, Human
ugcuggcugguuagag

SEQ ID NO: 2350515 - RNA, 15 nt, Human
ugcuggcugccuuag

SEQ ID NO: 2350516 - RNA, 14 nt, Human
ugcuggcugccuua

SEQ ID NO: 2350517 - RNA, 15 nt, Human
ugcuggccccucacc

SEQ ID NO: 2350518 - RNA, 16 nt, Human
ugcuggcuggaaggga

SEQ ID NO: 2350519 - RNA, 13 nt, Human
ugcuggccccuca

SEQ ID NO: 2350520 - RNA, 12 nt, Human
ugcuggccccuc

SEQ ID NO: 2350521 - RNA, 21 nt, Human
ugcuggcugccuuagaaccuu

SEQ ID NO: 2350522 - RNA, 23 nt, Human
ugcuggcccagggcccagagccc

SEQ ID NO: 2350523 - RNA, 22 nt, Human
ugcuggcccagggcccagagcc

SEQ ID NO: 2350524 - RNA, 21 nt, Human
ugcuggcccagggcccagagc

SEQ ID NO: 2350525 - RNA, 20 nt, Human
ugcuggcccagggcccagag

SEQ ID NO: 2350526 - RNA, 19 nt, Human
ugcuggcccagggcccaga

SEQ ID NO: 2350527 - RNA, 18 nt, Human
ugcuggcccagggcccag

SEQ ID NO: 2350528 - RNA, 17 nt, Human
ugcuggcccagggccca

SEQ ID NO: 2350529 - RNA, 16 nt, Human
ugcuggcccagggccc

SEQ ID NO: 2350530 - RNA, 14 nt, Human
ugcuggcccagggc

SEQ ID NO: 2350531 - RNA, 13 nt, Human
ugcuggcccaggg

SEQ ID NO: 2350532 - RNA, 12 nt, Human
ugcuggcccagg

SEQ ID NO: 2350533 - RNA, 21 nt, Human
ugcuggaggugacaucucuua

SEQ ID NO: 2350534 - RNA, 23 nt, Human
ugcuggagccuguguaacagcuc

SEQ ID NO: 2350535 - RNA, 13 nt, Human
ugcuggaggacug

SEQ ID NO: 2350536 - RNA, 14 nt, Human
ugcuggagguggga

SEQ ID NO: 2350537 - RNA, 15 nt, Human
ugcuggaggugggag

SEQ ID NO: 2350538 - RNA, 16 nt, Human
ugcuggaggugggagc

SEQ ID NO: 2350539 - RNA, 21 nt, Human
aggcuggcagcucuccaguca

SEQ ID NO: 2350540 - RNA, 13 nt, Human
aggcuggccagcc

SEQ ID NO: 2350541 - RNA, 14 nt, Human
aggcuggccagccc

SEQ ID NO: 2350542 - RNA, 15 nt, Human
aggcuggccagcccc

SEQ ID NO: 2350543 - RNA, 16 nt, Human
aggcuggccagcccca

SEQ ID NO: 2350544 - RNA, 17 nt, Human
aggcuggccagccccac

SEQ ID NO: 2350545 - RNA, 15 nt, Human
aggcuggccagucca

SEQ ID NO: 2350546 - RNA, 22 nt, Human
aggcuggccagccccacagccc

SEQ ID NO: 2350547 - RNA, 18 nt, Human
aggcuggccagccccaca

SEQ ID NO: 2350548 - RNA, 19 nt, Human
aggcuggccagccccacag

SEQ ID NO: 2350549 - RNA, 20 nt, Human
aggcuggccagccccacagc

SEQ ID NO: 2350550 - RNA, 21 nt, Human
aggcuggccagccccacagcc

SEQ ID NO: 2350551 - RNA, 15 nt, Human
aggcuggcagguaug

SEQ ID NO: 2350552 - RNA, 19 nt, Human
aggcuggcagcucuccagu

SEQ ID NO: 2350553 - RNA, 20 nt, Human
aggcuggcagcucuccaguc

SEQ ID NO: 2350554 - RNA, 15 nt, Human
aggcuggcagcucuc

SEQ ID NO: 2350555 - RNA, 16 nt, Human
aggcuggcagcucucc

SEQ ID NO: 2350556 - RNA, 17 nt, Human
aggcuggcagcucucca

SEQ ID NO: 2350557 - RNA, 18 nt, Human
aggcuggcagcucuccag

SEQ ID NO: 2350558 - RNA, 20 nt, Human
aggcuggcaccgccuucucu

SEQ ID NO: 2350559 - RNA, 19 nt, Human
aggcuggcaccgccuucuc

SEQ ID NO: 2350560 - RNA, 18 nt, Human
aggcuggcacaggacaug

SEQ ID NO: 2350561 - RNA, 17 nt, Human
aggcuggcacaggacau

SEQ ID NO: 2350562 - RNA, 16 nt, Human
aggcuggcacaggaca

SEQ ID NO: 2350563 - RNA, 15 nt, Human
aggcuggaggcaggg

SEQ ID NO: 2350564 - RNA, 14 nt, Human
aggcuggaggcagg

SEQ ID NO: 2350565 - RNA, 13 nt, Human
aggcuggaggcag

SEQ ID NO: 2350566 - RNA, 18 nt, Human
aggcuggagcuggcgucu

SEQ ID NO: 2350567 - RNA, 17 nt, Human
aggcuggagcuggcguc

SEQ ID NO: 2350568 - RNA, 14 nt, Human
aggcuggagcuggc

SEQ ID NO: 2350569 - RNA, 12 nt, Human
aggcuggagcug

SEQ ID NO: 2350570 - RNA, 18 nt, Human
aggcuggagcccagggag

SEQ ID NO: 2350571 - RNA, 15 nt, Human
aggcuggagcccagg

SEQ ID NO: 2350572 - RNA, 13 nt, Human
aggcuggagccca

SEQ ID NO: 2350573 - RNA, 20 nt, Human
aggcuggagaagcucaccca

SEQ ID NO: 2350574 - RNA, 13 nt, Human
aggcuggagaagc

SEQ ID NO: 2350575 - RNA, 14 nt, Human
aggcuggagaagcu

SEQ ID NO: 2350576 - RNA, 23 nt, Human
aggcuggaggcagggccuugccc

SEQ ID NO: 2350577 - RNA, 20 nt, Human
aggcuggagugcaguggcau

SEQ ID NO: 2350578 - RNA, 20 nt, Human
aggcuggagugcaguggcgu

SEQ ID NO: 2350579 - RNA, 19 nt, Human
aggcuggaggcagggccuu

SEQ ID NO: 2350580 - RNA, 18 nt, Human
aggcuggaggcagggccu

SEQ ID NO: 2350581 - RNA, 17 nt, Human
aggcuggaggcagggcc

SEQ ID NO: 2350582 - RNA, 16 nt, Human
aggcuggaggcagggc

SEQ ID NO: 2350583 - RNA, 22 nt, Human
aggcuggauuuugaauuuucuu

SEQ ID NO: 2350584 - RNA, 22 nt, Human
aggcuggauccuagccuuaucc

SEQ ID NO: 2350585 - RNA, 14 nt, Human
aggcuggcacagga

SEQ ID NO: 2350586 - RNA, 20 nt, Human
aggcuggaguggaguggcgu

SEQ ID NO: 2350587 - RNA, 13 nt, Human
aggcuggcgugca

SEQ ID NO: 2350588 - RNA, 17 nt, Human
aggcuggcgugcagugg

SEQ ID NO: 2350589 - RNA, 19 nt, Human
aggcuggcccugcccuggu

SEQ ID NO: 2350590 - RNA, 14 nt, Human
aggcuggcgcagcc

SEQ ID NO: 2350591 - RNA, 15 nt, Human
aggcuggcgcagcca

SEQ ID NO: 2350592 - RNA, 17 nt, Human
aggcuggcgcagccaag

SEQ ID NO: 2350593 - RNA, 19 nt, Human
aggcuggcgcagccaaggc

SEQ ID NO: 2350594 - RNA, 20 nt, Human
aggcuggcgcagccaaggcc

SEQ ID NO: 2350595 - RNA, 14 nt, Human
aggcuggcccugcc

SEQ ID NO: 2350596 - RNA, 12 nt, Human
aggcuggcccug

SEQ ID NO: 2350597 - RNA, 17 nt, Human
aggcuggccaguccagg

SEQ ID NO: 2350598 - RNA, 18 nt, Human
aggcuggccaguccaggc

SEQ ID NO: 2350599 - RNA, 19 nt, Human
aggcuggccaguccaggcu

SEQ ID NO: 2350600 - RNA, 21 nt, Human
aggcuggccaguccaggcugc

SEQ ID NO: 2350601 - RNA, 18 nt, Human
aggcuggcccugcccugg

SEQ ID NO: 2350602 - RNA, 17 nt, Human
aggcuggcccugcccug

SEQ ID NO: 2350603 - RNA, 16 nt, Human
aggcuggcccugcccu

SEQ ID NO: 2350604 - RNA, 15 nt, Human
aggcuggcccugccc

SEQ ID NO: 2350605 - RNA, 12 nt, Human
aggcuggagaag

SEQ ID NO: 2350606 - RNA, 13 nt, Human
aggcugcuuggga

SEQ ID NO: 2350607 - RNA, 22 nt, Human
aggcugcuuagaauccaaacuu

SEQ ID NO: 2350608 - RNA, 21 nt, Human
aggcugcuuuccaaagccaau

SEQ ID NO: 2350609 - RNA, 19 nt, Human
aggcugcuuuccaaagcca

SEQ ID NO: 2350610 - RNA, 18 nt, Human
aggcugcuuuccaaagcc

SEQ ID NO: 2350611 - RNA, 17 nt, Human
aggcugcuuuccaaagc

SEQ ID NO: 2350612 - RNA, 15 nt, Human
aggcugcuuuccaaa

SEQ ID NO: 2350613 - RNA, 16 nt, Human
aggcugcuggaggaaa

SEQ ID NO: 2350614 - RNA, 15 nt, Human
aggcugcuggaggaa

SEQ ID NO: 2350615 - RNA, 12 nt, Human
aggcugcuggcg

SEQ ID NO: 2350616 - RNA, 14 nt, Human
aggcugcuggcgcc

SEQ ID NO: 2350617 - RNA, 14 nt, Human
aggcugcuggagga

SEQ ID NO: 2350618 - RNA, 13 nt, Human
aggcugcuggagg

SEQ ID NO: 2350619 - RNA, 23 nt, Human
aggcugcucuugaacuccugacc

SEQ ID NO: 2350620 - RNA, 17 nt, Human
aggcugcgucuggaggg

SEQ ID NO: 2350621 - RNA, 14 nt, Human
aggcugcuuuccaa

SEQ ID NO: 2350622 - RNA, 13 nt, Human
aggcugcuuucca

SEQ ID NO: 2350623 - RNA, 14 nt, Human
aggcugcuuagaau

SEQ ID NO: 2350624 - RNA, 21 nt, Human
aggcugcuggcgccucugcaa

SEQ ID NO: 2350625 - RNA, 15 nt, Human
aggcugcuggcgccu

SEQ ID NO: 2350626 - RNA, 18 nt, Human
aggcugcuggcgccucug

SEQ ID NO: 2350627 - RNA, 19 nt, Human
aggcugcuggcgccucugc

SEQ ID NO: 2350628 - RNA, 20 nt, Human
aggcugcuggcgccucugca

SEQ ID NO: 2350629 - RNA, 17 nt, Human
aggcucugcccugcccu

SEQ ID NO: 2350630 - RNA, 14 nt, Human
aggcucugcccugc

SEQ ID NO: 2350631 - RNA, 23 nt, Human
aggcucugcccugcccuagcucc

SEQ ID NO: 2350632 - RNA, 18 nt, Human
aggcucugcgccugcccc

SEQ ID NO: 2350633 - RNA, 15 nt, Human
aggcugcucagggcu

SEQ ID NO: 2350634 - RNA, 16 nt, Human
aggcugcgucuggagg

SEQ ID NO: 2350635 - RNA, 16 nt, Human
aggcugcucagggcug

SEQ ID NO: 2350636 - RNA, 17 nt, Human
aggcugcucagggcugg

SEQ ID NO: 2350637 - RNA, 18 nt, Human
aggcucuggagcccacug

SEQ ID NO: 2350638 - RNA, 19 nt, Human
aggcucuggagcccacugu

SEQ ID NO: 2350639 - RNA, 14 nt, Human
aggcucuggagccc

SEQ ID NO: 2350640 - RNA, 15 nt, Human
aggcucuggagccca

SEQ ID NO: 2350641 - RNA, 13 nt, Human
aggcucuggagcc

SEQ ID NO: 2350642 - RNA, 16 nt, Human
aggcucugcccuuggu

SEQ ID NO: 2350643 - RNA, 20 nt, Human
aggcucucaacaggggagag

SEQ ID NO: 2350644 - RNA, 22 nt, Human
aggcucgauuuuguaucugcag

SEQ ID NO: 2350645 - RNA, 17 nt, Human
aggcucgauuuuguauc

SEQ ID NO: 2350646 - RNA, 19 nt, Human
aggcucgauuuuguaucug

SEQ ID NO: 2350647 - RNA, 23 nt, Human
aggcucgauuuuguaucugcagg

SEQ ID NO: 2350648 - RNA, 23 nt, Human
aggcuccuuccugucuuccugca

SEQ ID NO: 2350649 - RNA, 14 nt, Human
aggcucgauuuugu

SEQ ID NO: 2350650 - RNA, 15 nt, Human
aggcucgauuuugua

SEQ ID NO: 2350651 - RNA, 16 nt, Human
aggcucgauuuuguau

SEQ ID NO: 2350652 - RNA, 16 nt, Human
aggcuccuuccugucu

SEQ ID NO: 2350653 - RNA, 15 nt, Human
aggcuccuuccuguc

SEQ ID NO: 2350654 - RNA, 13 nt, Human
aggcuccuuccug

SEQ ID NO: 2350655 - RNA, 21 nt, Human
aggcucgagcaugccuggaug

SEQ ID NO: 2350656 - RNA, 15 nt, Human
aggcucgagcaugcc

SEQ ID NO: 2350657 - RNA, 17 nt, Human
aggcucgagcaugccug

SEQ ID NO: 2350658 - RNA, 18 nt, Human
aggcucgagcaugccugg

SEQ ID NO: 2350659 - RNA, 19 nt, Human
aggcucgagcaugccugga

SEQ ID NO: 2350660 - RNA, 19 nt, Human
aggcuccuuuagcgcccag

SEQ ID NO: 2350661 - RNA, 12 nt, Human
aggcucgagcau

SEQ ID NO: 2350662 - RNA, 13 nt, Human
aggcuccugugcu

SEQ ID NO: 2350663 - RNA, 19 nt, Human
aggcuccugugcuacuuug

SEQ ID NO: 2350664 - RNA, 21 nt, Human
aggcuccugccaguguggaac

SEQ ID NO: 2350665 - RNA, 13 nt, Human
aggcuccugccac

SEQ ID NO: 2350666 - RNA, 20 nt, Human
aggcuccugccaccacgccc

SEQ ID NO: 2350667 - RNA, 16 nt, Human
aggccugggugcuggc

SEQ ID NO: 2350668 - RNA, 12 nt, Human
aggccugggugc

SEQ ID NO: 2350669 - RNA, 21 nt, Human
aggccugggucugugucucuu

SEQ ID NO: 2350670 - RNA, 19 nt, Human
aggccugggucugugucuc

SEQ ID NO: 2350671 - RNA, 17 nt, Human
aggccugggucuguguc

SEQ ID NO: 2350672 - RNA, 16 nt, Human
aggccugggucugugu

SEQ ID NO: 2350673 - RNA, 16 nt, Human
aggccuggccaggcac

SEQ ID NO: 2350674 - RNA, 19 nt, Human
aggccugggccgcugccac

SEQ ID NO: 2350675 - RNA, 22 nt, Human
aggccuguccugaccugucuca

SEQ ID NO: 2350676 - RNA, 23 nt, Human
aggccugggugcuggcugcccag

SEQ ID NO: 2350677 - RNA, 17 nt, Human
aggccugggugcuggcu

SEQ ID NO: 2350678 - RNA, 14 nt, Human
aggcuccugccacc

SEQ ID NO: 2350679 - RNA, 13 nt, Human
aggcucugcccug

SEQ ID NO: 2350680 - RNA, 17 nt, Human
aggcucugcacagaugg

SEQ ID NO: 2350681 - RNA, 15 nt, Human
aggcucugcacagau

SEQ ID NO: 2350682 - RNA, 13 nt, Human
aggcucugcacag

SEQ ID NO: 2350683 - RNA, 13 nt, Human
aggcucugcccuu

SEQ ID NO: 2350684 - RNA, 14 nt, Human
aggcucugcccuug

SEQ ID NO: 2350685 - RNA, 15 nt, Human
aggcucugcccuugg

SEQ ID NO: 2350686 - RNA, 12 nt, Human
aggcucugcccu

SEQ ID NO: 2350687 - RNA, 11 nt, Human
aggcucugccc

SEQ ID NO: 2350688 - RNA, 18 nt, Human
aggcucugaaagccagcu

SEQ ID NO: 2350689 - RNA, 19 nt, Human
aggcucugacccagugaga

SEQ ID NO: 2350690 - RNA, 21 nt, Human
aggcucucaggccagcugcuu

SEQ ID NO: 2350691 - RNA, 11 nt, Human
aggcucucagg

SEQ ID NO: 2350692 - RNA, 12 nt, Human
aggcucucaggc

SEQ ID NO: 2350693 - RNA, 14 nt, Human
aggcucucaggcca

SEQ ID NO: 2350694 - RNA, 15 nt, Human
aggcucucaggccag

SEQ ID NO: 2350695 - RNA, 16 nt, Human
aggcucucaggccagc

SEQ ID NO: 2350696 - RNA, 18 nt, Human
aggcucucaggccagcug

SEQ ID NO: 2350697 - RNA, 19 nt, Human
aggcucucaggccagcugc

SEQ ID NO: 2350698 - RNA, 20 nt, Human
aggcucucaggccagcugcu

SEQ ID NO: 2350699 - RNA, 18 nt, Human
ugggaacugcagaccugu

SEQ ID NO: 2350700 - RNA, 13 nt, Human
ugggaagacauga

SEQ ID NO: 2350701 - RNA, 21 nt, Human
ugggaagacauggggaggaag

SEQ ID NO: 2350702 - RNA, 23 nt, Human
ugggaagaccagcuuugcaguga

SEQ ID NO: 2350703 - RNA, 17 nt, Human
ugggaagacgaggcccu

SEQ ID NO: 2350704 - RNA, 18 nt, Human
ugggaagacgaggcccuc

SEQ ID NO: 2350705 - RNA, 21 nt, Human
ugggaagacgccugagcucac

SEQ ID NO: 2350706 - RNA, 18 nt, Human
ugggaagacgccugagcu

SEQ ID NO: 2350707 - RNA, 19 nt, Human
ugggaagacgccugagcuc

SEQ ID NO: 2350708 - RNA, 16 nt, Human
ugggaacugcagaccu

SEQ ID NO: 2350709 - RNA, 17 nt, Human
ugggaacugcagaccug

SEQ ID NO: 2350710 - RNA, 18 nt, Human
ugggaacgugacugcccc

SEQ ID NO: 2350711 - RNA, 15 nt, Human
ugggaacucaccugg

SEQ ID NO: 2350712 - RNA, 17 nt, Human
ugggaacucaccugggg

SEQ ID NO: 2350713 - RNA, 18 nt, Human
ugggaacucaccuggggc

SEQ ID NO: 2350714 - RNA, 16 nt, Human
ugggaacgugacugcc

SEQ ID NO: 2350715 - RNA, 20 nt, Human
ugggaacgagaggggaagag

SEQ ID NO: 2350716 - RNA, 24 nt, Human
ugggaacgcagaugauccaugagu

SEQ ID NO: 2350717 - RNA, 13 nt, Human
ugggaacuagacu

SEQ ID NO: 2350718 - RNA, 22 nt, Human
ugggaaggggacccccgccccc

SEQ ID NO: 2350719 - RNA, 21 nt, Human
ugggaagggagagcggggcag

SEQ ID NO: 2350720 - RNA, 15 nt, Human
ugggaagugaagacu

SEQ ID NO: 2350721 - RNA, 14 nt, Human
ugggaagugacuua

SEQ ID NO: 2350722 - RNA, 20 nt, Human
ugggaagugacuuagcagau

SEQ ID NO: 2350723 - RNA, 13 nt, Human
ugggaauaaauau

SEQ ID NO: 2350724 - RNA, 14 nt, Human
ugggaauaaauaug

SEQ ID NO: 2350725 - RNA, 15 nt, Human
ugggaauaaauaugc

SEQ ID NO: 2350726 - RNA, 19 nt, Human
ugggaaggggacccccgcc

SEQ ID NO: 2350727 - RNA, 13 nt, Human
ugggaagggagag

SEQ ID NO: 2350728 - RNA, 15 nt, Human
ugggaaggccagcug

SEQ ID NO: 2350729 - RNA, 16 nt, Human
ugggaaggccagcugc

SEQ ID NO: 2350730 - RNA, 12 nt, Human
ugggaaggaggg

SEQ ID NO: 2350731 - RNA, 20 nt, Human
ugggaagauaggcucugcac

SEQ ID NO: 2350732 - RNA, 17 nt, Human
ugggaagauaggcucug

SEQ ID NO: 2350733 - RNA, 22 nt, Human
ugggaagauaggcucugcacag

SEQ ID NO: 2350734 - RNA, 21 nt, Human
ugggaacgcagaugauccaug

SEQ ID NO: 2350735 - RNA, 15 nt, Human
ugggaacgagagggg

SEQ ID NO: 2350736 - RNA, 16 nt, Human
ugggaacgagagggga

SEQ ID NO: 2350737 - RNA, 17 nt, Human
ugggaaaggaguagaaa

SEQ ID NO: 2350738 - RNA, 17 nt, Human
ugggaaauaagagagaa

SEQ ID NO: 2350739 - RNA, 16 nt, Human
ugggaaaguauucugu

SEQ ID NO: 2350740 - RNA, 16 nt, Human
ugggaaaggaguagaa

SEQ ID NO: 2350741 - RNA, 22 nt, Human
ugggaaagccaccucucccuca

SEQ ID NO: 2350742 - RNA, 20 nt, Human
ugggaaagccaccucucccu

SEQ ID NO: 2350743 - RNA, 21 nt, Human
ugggaaagccaccucucccuc

SEQ ID NO: 2350744 - RNA, 16 nt, Human
ugggaaaggggaaguu

SEQ ID NO: 2350745 - RNA, 17 nt, Human
uggcuucccgcucagcc

SEQ ID NO: 2350746 - RNA, 15 nt, Human
ugggaaagccaccuc

SEQ ID NO: 2350747 - RNA, 16 nt, Human
ugggaaagccaccucu

SEQ ID NO: 2350748 - RNA, 15 nt, Human
uggcuucccgcucag

SEQ ID NO: 2350749 - RNA, 16 nt, Human
uggcuucccgcucagc

SEQ ID NO: 2350750 - RNA, 23 nt, Human
uggcuuccagguaucuccaggau

SEQ ID NO: 2350751 - RNA, 16 nt, Human
uggcuuccaugauggu

SEQ ID NO: 2350752 - RNA, 23 nt, Human
uggcuucacggaagagccuugcg

SEQ ID NO: 2350753 - RNA, 12 nt, Human
uggcuucaggag

SEQ ID NO: 2350754 - RNA, 13 nt, Human
uggcuucaggagg

SEQ ID NO: 2350755 - RNA, 22 nt, Human
uggcuuccagaaaaccccagca

SEQ ID NO: 2350756 - RNA, 16 nt, Human
uggcuucaucugucaa

SEQ ID NO: 2350757 - RNA, 18 nt, Human
uggcuucauuagagcagg

SEQ ID NO: 2350758 - RNA, 23 nt, Human
uggcuuccagaaaaccccagcau

SEQ ID NO: 2350759 - RNA, 20 nt, Human
uggcuucauuagagcaggcg

SEQ ID NO: 2350760 - RNA, 14 nt, Human
uggcuuccagguau

SEQ ID NO: 2350761 - RNA, 15 nt, Human
uggcuuccagguauc

SEQ ID NO: 2350762 - RNA, 20 nt, Human
uggcuuccagguaucuccag

SEQ ID NO: 2350763 - RNA, 21 nt, Human
uggcuuccagguaucuccagg

SEQ ID NO: 2350764 - RNA, 22 nt, Human
uggcuuccagguaucuccagga

SEQ ID NO: 2350765 - RNA, 20 nt, Human
uggcuuacuacaugugggag

SEQ ID NO: 2350766 - RNA, 23 nt, Human
uggcuuacuacaugugggagcuu

SEQ ID NO: 2350767 - RNA, 15 nt, Human
uggcuuauccagcug

SEQ ID NO: 2350768 - RNA, 22 nt, Human
uggcuucacggaagagccuugc

SEQ ID NO: 2350769 - RNA, 15 nt, Human
uggcuuaaugcuucu

SEQ ID NO: 2350770 - RNA, 16 nt, Human
uggcuuaaugcuucuu

SEQ ID NO: 2350771 - RNA, 22 nt, Human
uggcuguguucuggugaggccu

SEQ ID NO: 2350772 - RNA, 14 nt, Human
uggcuguucuggaa

SEQ ID NO: 2350773 - RNA, 18 nt, Human
uggcuguuggcagugagu

SEQ ID NO: 2350774 - RNA, 15 nt, Human
uggcuuaauguuuau

SEQ ID NO: 2350775 - RNA, 20 nt, Human
uggcuuaaugcuucuuucau

SEQ ID NO: 2350776 - RNA, 14 nt, Human
uggcuuaauguuua

SEQ ID NO: 2350777 - RNA, 16 nt, Human
uggcugcggcacccuu

SEQ ID NO: 2350778 - RNA, 17 nt, Human
uggcugcggcacccuug

SEQ ID NO: 2350779 - RNA, 14 nt, Human
uggcugcuagcacu

SEQ ID NO: 2350780 - RNA, 13 nt, Human
uggcugcuagcac

SEQ ID NO: 2350781 - RNA, 15 nt, Human
uggcugcuagcacuu

SEQ ID NO: 2350782 - RNA, 20 nt, Human
uggcugugucuaaacugcau

SEQ ID NO: 2350783 - RNA, 19 nt, Human
uggcugugucuaaacugca

SEQ ID NO: 2350784 - RNA, 20 nt, Human
uggcugccuccacucccacu

SEQ ID NO: 2350785 - RNA, 17 nt, Human
uggcugccuccacuccc

SEQ ID NO: 2350786 - RNA, 18 nt, Human
uggcugccuccacuccca

SEQ ID NO: 2350787 - RNA, 22 nt, Human
uggcugccuugugaaggaauua

SEQ ID NO: 2350788 - RNA, 17 nt, Human
uggcugccucauuuaga

SEQ ID NO: 2350789 - RNA, 17 nt, Human
uggcugcccuggcccug

SEQ ID NO: 2350790 - RNA, 14 nt, Human
uggcugccuccacu

SEQ ID NO: 2350791 - RNA, 16 nt, Human
uggcugccuccacucc

SEQ ID NO: 2350792 - RNA, 13 nt, Human
uggcugcccuggc

SEQ ID NO: 2350793 - RNA, 14 nt, Human
uggcugcccuggcc

SEQ ID NO: 2350794 - RNA, 15 nt, Human
uggcugcccuggccc

SEQ ID NO: 2350795 - RNA, 16 nt, Human
uggcugcccuggcccu

SEQ ID NO: 2350796 - RNA, 13 nt, Human
uggcuguuggcug

SEQ ID NO: 2350797 - RNA, 14 nt, Human
uggcugugucuccc

SEQ ID NO: 2350798 - RNA, 15 nt, Human
uggcuguuggcuggg

SEQ ID NO: 2350799 - RNA, 17 nt, Human
uggcuuaaaacaacacu

SEQ ID NO: 2350800 - RNA, 20 nt, Human
uggcugcaucccccccaccu

SEQ ID NO: 2350801 - RNA, 12 nt, Human
uggcugcaugcg

SEQ ID NO: 2350802 - RNA, 13 nt, Human
uggcugcccacac

SEQ ID NO: 2350803 - RNA, 14 nt, Human
uggcugccagcuau

SEQ ID NO: 2350804 - RNA, 21 nt, Human
uggcugcccagaccccucugg

SEQ ID NO: 2350805 - RNA, 17 nt, Human
uggcugccccaaccugc

SEQ ID NO: 2350806 - RNA, 20 nt, Human
uggcugccccaaccugcuga

SEQ ID NO: 2350807 - RNA, 22 nt, Human
uggcugccccauuuauccaccu

SEQ ID NO: 2350808 - RNA, 23 nt, Human
uggcugcccagaccccucuggcc

SEQ ID NO: 2350809 - RNA, 20 nt, Human
uggcugcccagaccccucug

SEQ ID NO: 2350810 - RNA, 22 nt, Human
uggcugccagcuauuuuuacua

SEQ ID NO: 2350811 - RNA, 18 nt, Human
uggcugccaaugggagcu

SEQ ID NO: 2350812 - RNA, 20 nt, Human
uggcugccaaugggagcuca

SEQ ID NO: 2350813 - RNA, 15 nt, Human
uggcugcagggaguc

SEQ ID NO: 2350814 - RNA, 23 nt, Human
uggcugagguuccucugccugcc

SEQ ID NO: 2350815 - RNA, 24 nt, Human
uggcugagguuccucugccugccc

SEQ ID NO: 2350816 - RNA, 19 nt, Human
uggcugcauaaauguggua

SEQ ID NO: 2350817 - RNA, 13 nt, Human
uggcugcagggag

SEQ ID NO: 2350818 - RNA, 14 nt, Human
uggcugcagggagu

SEQ ID NO: 2350819 - RNA, 20 nt, Human
uggcugaggauuucaagccu

SEQ ID NO: 2350820 - RNA, 23 nt, Human
uggcugaggaggccuccaucuca

SEQ ID NO: 2350821 - RNA, 15 nt, Human
uggcucuucugccca

SEQ ID NO: 2350822 - RNA, 22 nt, Human
uggcucuugaacugagcuugga

SEQ ID NO: 2350823 - RNA, 16 nt, Human
uggcucuugaacugag

SEQ ID NO: 2350824 - RNA, 12 nt, Human
uggcugcaaagg

SEQ ID NO: 2350825 - RNA, 17 nt, Human
uggcugagguuccucug

SEQ ID NO: 2350826 - RNA, 18 nt, Human
uggcugagguuccucugc

SEQ ID NO: 2350827 - RNA, 20 nt, Human
uggcugagguuccucugccu

SEQ ID NO: 2350828 - RNA, 21 nt, Human
uggcugagguuccucugccug

SEQ ID NO: 2350829 - RNA, 22 nt, Human
uggcugagguuccucugccugc

SEQ ID NO: 2350830 - RNA, 18 nt, Human
uggcucaaguccucuuuu

SEQ ID NO: 2350831 - RNA, 19 nt, Human
uggcucuuccaggcuggga

SEQ ID NO: 2350832 - RNA, 20 nt, Human
uggcucuuccaggcugggag

SEQ ID NO: 2350833 - RNA, 21 nt, Human
uggcucuuccaggcugggaga

SEQ ID NO: 2350834 - RNA, 17 nt, Human
uggcuagugucuaucag

SEQ ID NO: 2350835 - RNA, 23 nt, Human
uggcuagucaagcuccuccuccc

SEQ ID NO: 2350836 - RNA, 22 nt, Human
uggcuagucaagcuccuccucc

SEQ ID NO: 2350837 - RNA, 21 nt, Human
uggcuagucaagcuccuccuc

SEQ ID NO: 2350838 - RNA, 20 nt, Human
uggcuagucaagcuccuccu

SEQ ID NO: 2350839 - RNA, 18 nt, Human
uggcuagucaagcuccuc

SEQ ID NO: 2350840 - RNA, 17 nt, Human
uggcuagucaagcuccu

SEQ ID NO: 2350841 - RNA, 14 nt, Human
uggcuaugcauuug

SEQ ID NO: 2350842 - RNA, 17 nt, Human
uggcuaugcauuugaaa

SEQ ID NO: 2350843 - RNA, 15 nt, Human
uggcuaugcauuuga

SEQ ID NO: 2350844 - RNA, 16 nt, Human
uggcuagucagagaga

SEQ ID NO: 2350845 - RNA, 13 nt, Human
uggcuauaaauau

SEQ ID NO: 2350846 - RNA, 19 nt, Human
uggcuauaaauauauaaaa

SEQ ID NO: 2350847 - RNA, 14 nt, Human
uggcuauggccacc

SEQ ID NO: 2350848 - RNA, 16 nt, Human
uggcuaugagggccuu

SEQ ID NO: 2350849 - RNA, 19 nt, Human
uggcuaugcauuugaaaau

SEQ ID NO: 2350850 - RNA, 16 nt, Human
uggcuauuuaaagaca

SEQ ID NO: 2350851 - RNA, 15 nt, Human
uggcuauuuaaaacu

SEQ ID NO: 2350852 - RNA, 22 nt, Human
uggcuauuagagaucaaccccu

SEQ ID NO: 2350853 - RNA, 21 nt, Human
uggcuagaguccucacuccca

SEQ ID NO: 2350854 - RNA, 18 nt, Human
uggcuagaguccucacuc

SEQ ID NO: 2350855 - RNA, 15 nt, Human
uggcuagucaagcuc

SEQ ID NO: 2350856 - RNA, 17 nt, Human
uggcuaggggagcaggg

SEQ ID NO: 2350857 - RNA, 16 nt, Human
uggcuagaguccucac

SEQ ID NO: 2350858 - RNA, 15 nt, Human
uggcuagaguccuca

SEQ ID NO: 2350859 - RNA, 20 nt, Human
aggcuggcuuguccccuccu

SEQ ID NO: 2350860 - RNA, 22 nt, Human
uggcuagagguucaaagauauu

SEQ ID NO: 2350861 - RNA, 14 nt, Human
aggcugggagagcc

SEQ ID NO: 2350862 - RNA, 22 nt, Human
aggcuggcuuguccccuccuca

SEQ ID NO: 2350863 - RNA, 14 nt, Human
aggcuggcuugucc

SEQ ID NO: 2350864 - RNA, 17 nt, Human
aggcuggcuggggccua

SEQ ID NO: 2350865 - RNA, 17 nt, Human
aggcugggaccacguga

SEQ ID NO: 2350866 - RNA, 22 nt, Human
aggcuggcuggcccgucauguu

SEQ ID NO: 2350867 - RNA, 12 nt, Human
aggcuggcuggg

SEQ ID NO: 2350868 - RNA, 13 nt, Human
aggcuggcugggg

SEQ ID NO: 2350869 - RNA, 15 nt, Human
aggcuggcuggggcc

SEQ ID NO: 2350870 - RNA, 13 nt, Human
aggcuggcuggcc

SEQ ID NO: 2350871 - RNA, 22 nt, Human
aggcuggcgcagccaaggccga

SEQ ID NO: 2350872 - RNA, 19 nt, Human
aggcuggcuccagaugcag

SEQ ID NO: 2350873 - RNA, 18 nt, Human
aggcuggcgugcaguggu

SEQ ID NO: 2350874 - RNA, 20 nt, Human
aggcuggcgugcaguggugc

SEQ ID NO: 2350875 - RNA, 18 nt, Human
uggcacaucagaaaggaa

SEQ ID NO: 2350876 - RNA, 13 nt, Human
uggcaccagcgaa

SEQ ID NO: 2350877 - RNA, 21 nt, Human
uggcacaucagcacgauuucu

SEQ ID NO: 2350878 - RNA, 15 nt, Human
uggcacccggccccu

SEQ ID NO: 2350879 - RNA, 16 nt, Human
uggcacccggccccug

SEQ ID NO: 2350880 - RNA, 21 nt, Human
uggcagaguugaagacagagc

SEQ ID NO: 2350881 - RNA, 20 nt, Human
uggcacccaccguggaggag

SEQ ID NO: 2350882 - RNA, 18 nt, Human
uggcaccagcgaagggag

SEQ ID NO: 2350883 - RNA, 21 nt, Human
uggcacccaccguggaggagg

SEQ ID NO: 2350884 - RNA, 22 nt, Human
uggcacccaccguggaggagga

SEQ ID NO: 2350885 - RNA, 15 nt, Human
uggcagaguuguaaa

SEQ ID NO: 2350886 - RNA, 16 nt, Human
uggcagaguuguaaau

SEQ ID NO: 2350887 - RNA, 17 nt, Human
uggcagaguuguaaaua

SEQ ID NO: 2350888 - RNA, 22 nt, Human
uggcagaguugaagacagagcu

SEQ ID NO: 2350889 - RNA, 19 nt, Human
uggcagauaaucagccucu

SEQ ID NO: 2350890 - RNA, 18 nt, Human
uggcagaguuuguguguu

SEQ ID NO: 2350891 - RNA, 22 nt, Human
uggcagaguuuguguguugucu

SEQ ID NO: 2350892 - RNA, 19 nt, Human
uggcagaguuguaaauaua

SEQ ID NO: 2350893 - RNA, 20 nt, Human
uggcagaguuguaaauauau

SEQ ID NO: 2350894 - RNA, 23 nt, Human
uggcagaguuguaaauauauaaa

SEQ ID NO: 2350895 - RNA, 17 nt, Human
uggcagaguuugugugu

SEQ ID NO: 2350896 - RNA, 21 nt, Human
uggcagauaaucagccucuua

SEQ ID NO: 2350897 - RNA, 20 nt, Human
uggcagauaaucagccucuu

SEQ ID NO: 2350898 - RNA, 18 nt, Human
uggcaccagcagccugga

SEQ ID NO: 2350899 - RNA, 20 nt, Human
uggcacaucagcacgauuuc

SEQ ID NO: 2350900 - RNA, 22 nt, Human
uggcacaguuuucugagaaaga

SEQ ID NO: 2350901 - RNA, 14 nt, Human
uggaugucuuccuu

SEQ ID NO: 2350902 - RNA, 15 nt, Human
uggaugucuuccuug

SEQ ID NO: 2350903 - RNA, 23 nt, Human
uggaugugggguccccaucaucc

SEQ ID NO: 2350904 - RNA, 13 nt, Human
uggauguuuuaau

SEQ ID NO: 2350905 - RNA, 18 nt, Human
uggauguuuuaauuccau

SEQ ID NO: 2350906 - RNA, 20 nt, Human
uggauguuuuaauuccauga

SEQ ID NO: 2350907 - RNA, 14 nt, Human
uggcacaucagaaa

SEQ ID NO: 2350908 - RNA, 15 nt, Human
uggcacaucagaaag

SEQ ID NO: 2350909 - RNA, 17 nt, Human
uggaugucugccaauuu

SEQ ID NO: 2350910 - RNA, 20 nt, Human
uggaugucugccaauuuuug

SEQ ID NO: 2350911 - RNA, 12 nt, Human
uggauguucuga

SEQ ID NO: 2350912 - RNA, 22 nt, Human
uggauuaaacuuaaucuaaaug

SEQ ID NO: 2350913 - RNA, 20 nt, Human
uggcacaguuuucugagaaa

SEQ ID NO: 2350914 - RNA, 12 nt, Human
aggccagagaca

SEQ ID NO: 2350915 - RNA, 13 nt, Human
aggccacggcagc

SEQ ID NO: 2350916 - RNA, 22 nt, Human
aggccaccugcccccuucuccc

SEQ ID NO: 2350917 - RNA, 21 nt, Human
aggccaccugcccccuucucc

SEQ ID NO: 2350918 - RNA, 14 nt, Human
aggccacuccucca

SEQ ID NO: 2350919 - RNA, 13 nt, Human
aggccacuccucc

SEQ ID NO: 2350920 - RNA, 19 nt, Human
aggccacgugauguggagg

SEQ ID NO: 2350921 - RNA, 23 nt, Human
aggccacgugauguggagggcac

SEQ ID NO: 2350922 - RNA, 19 nt, Human
aggccacuccuccaaagga

SEQ ID NO: 2350923 - RNA, 22 nt, Human
aggccacaccaucuccuuucag

SEQ ID NO: 2350924 - RNA, 21 nt, Human
aggccacaccaucuccuuuca

SEQ ID NO: 2350925 - RNA, 16 nt, Human
aggccacaugaguccc

SEQ ID NO: 2350926 - RNA, 18 nt, Human
aggccacacucagcacaa

SEQ ID NO: 2350927 - RNA, 17 nt, Human
aggccacacucagcaca

SEQ ID NO: 2350928 - RNA, 22 nt, Human
aggccaccauauucagugcugu

SEQ ID NO: 2350929 - RNA, 12 nt, Human
aggccaccagga

SEQ ID NO: 2350930 - RNA, 13 nt, Human
aggccaccaggau

SEQ ID NO: 2350931 - RNA, 19 nt, Human
aggccacaugagucccagu

SEQ ID NO: 2350932 - RNA, 18 nt, Human
aggccacaugagucccag

SEQ ID NO: 2350933 - RNA, 19 nt, Human
aggccacauggggcugggc

SEQ ID NO: 2350934 - RNA, 22 nt, Human
aggccacauggggcugggcagc

SEQ ID NO: 2350935 - RNA, 23 nt, Human
aggccacauggggcugggcagcu

SEQ ID NO: 2350936 - RNA, 15 nt, Human
aggccacaugucacc

SEQ ID NO: 2350937 - RNA, 21 nt, Human
aggccacaugucaccguggac

SEQ ID NO: 2350938 - RNA, 17 nt, Human
uggcagcccuguaggga

SEQ ID NO: 2350939 - RNA, 14 nt, Human
uggcagcccuguag

SEQ ID NO: 2350940 - RNA, 16 nt, Human
uggcagccgugccuuc

SEQ ID NO: 2350941 - RNA, 12 nt, Human
uggcagcccugu

SEQ ID NO: 2350942 - RNA, 11 nt, Human
uggcagcccug

SEQ ID NO: 2350943 - RNA, 12 nt, Human
uggcagccccug

SEQ ID NO: 2350944 - RNA, 14 nt, Human
uggcagccgagcuc

SEQ ID NO: 2350945 - RNA, 22 nt, Human
uggcagccgugccuucagcucu

SEQ ID NO: 2350946 - RNA, 23 nt, Human
uggcagccgugccuucagcucua

SEQ ID NO: 2350947 - RNA, 22 nt, Human
uggcagccucccauccagggcc

SEQ ID NO: 2350948 - RNA, 21 nt, Human
uggcagccucccauccagggc

SEQ ID NO: 2350949 - RNA, 20 nt, Human
uggcagccucccauccaggg

SEQ ID NO: 2350950 - RNA, 19 nt, Human
uggcagccucccauccagg

SEQ ID NO: 2350951 - RNA, 16 nt, Human
uggcagccucuucaaa

SEQ ID NO: 2350952 - RNA, 15 nt, Human
uggcagccucuucaa

SEQ ID NO: 2350953 - RNA, 20 nt, Human
aggccacaagacccuugugg

SEQ ID NO: 2350954 - RNA, 22 nt, Human
uggagucaugguccgguguccu

SEQ ID NO: 2350955 - RNA, 15 nt, Human
uggaguccagucucu

SEQ ID NO: 2350956 - RNA, 14 nt, Human
uggaguccagucuc

SEQ ID NO: 2350957 - RNA, 15 nt, Human
uggagucaugccaag

SEQ ID NO: 2350958 - RNA, 19 nt, Human
uggagucagacagaugugg

SEQ ID NO: 2350959 - RNA, 14 nt, Human
uggaguccccucac

SEQ ID NO: 2350960 - RNA, 15 nt, Human
uggaguccccucacc

SEQ ID NO: 2350961 - RNA, 19 nt, Human
uggaguccccucaccuccu

SEQ ID NO: 2350962 - RNA, 20 nt, Human
uggaguccccucaccuccuc

SEQ ID NO: 2350963 - RNA, 21 nt, Human
uggaguccccucaccuccucu

SEQ ID NO: 2350964 - RNA, 14 nt, Human
uggagucggaaggg

SEQ ID NO: 2350965 - RNA, 13 nt, Human
uggagucuccagu

SEQ ID NO: 2350966 - RNA, 17 nt, Human
uggagucuccagugguu

SEQ ID NO: 2350967 - RNA, 21 nt, Human
aggccaagugcaggcuggcac

SEQ ID NO: 2350968 - RNA, 15 nt, Human
aggccaagugcaggc

SEQ ID NO: 2350969 - RNA, 14 nt, Human
aggccaagugcagg

SEQ ID NO: 2350970 - RNA, 18 nt, Human
aggccaagucaggcccuu

SEQ ID NO: 2350971 - RNA, 21 nt, Human
aggccaagaaacgucuucuaa

SEQ ID NO: 2350972 - RNA, 22 nt, Human
aggccaagugugauaaauaaac

SEQ ID NO: 2350973 - RNA, 23 nt, Human
aggccaaguuuguaucaggugcc

SEQ ID NO: 2350974 - RNA, 15 nt, Human
aggccacaagacccu

SEQ ID NO: 2350975 - RNA, 15 nt, Human
uggaugccugguggc

SEQ ID NO: 2350976 - RNA, 20 nt, Human
uggaguucaucuugaauugu

SEQ ID NO: 2350977 - RNA, 16 nt, Human
uggaguucaucuugaa

SEQ ID NO: 2350978 - RNA, 17 nt, Human
uggaguucaucuugaau

SEQ ID NO: 2350979 - RNA, 20 nt, Human
uggaugccugguggcagcug

SEQ ID NO: 2350980 - RNA, 23 nt, Human
uggaugggggaacucagauccag

SEQ ID NO: 2350981 - RNA, 16 nt, Human
uggaguuccugaaccu

SEQ ID NO: 2350982 - RNA, 20 nt, Human
uggaguuccugaaccugaug

SEQ ID NO: 2350983 - RNA, 18 nt, Human
uggaugccugguggcagc

SEQ ID NO: 2350984 - RNA, 19 nt, Human
uggaugccugguggcagcu

SEQ ID NO: 2350985 - RNA, 13 nt, Human
aggccaaaaaaau

SEQ ID NO: 2350986 - RNA, 23 nt, Human
aggccaaaauuaccaaaaaucuu

SEQ ID NO: 2350987 - RNA, 15 nt, Human
aggccaaaccucugu

SEQ ID NO: 2350988 - RNA, 14 nt, Human
aggccaaaccucug

SEQ ID NO: 2350989 - RNA, 16 nt, Human
aggccaaacucaccug

SEQ ID NO: 2350990 - RNA, 18 nt, Human
aggcauuuggcauuuauu

SEQ ID NO: 2350991 - RNA, 15 nt, Human
uggacggcaggcuca

SEQ ID NO: 2350992 - RNA, 18 nt, Human
uggacggcaggcucacug

SEQ ID NO: 2350993 - RNA, 20 nt, Human
uggacggcaggcucacugcc

SEQ ID NO: 2350994 - RNA, 18 nt, Human
aggcauuuguuugaacug

SEQ ID NO: 2350995 - RNA, 16 nt, Human
uggaccuugagaccac

SEQ ID NO: 2350996 - RNA, 17 nt, Human
uggaccucugcucugag

SEQ ID NO: 2350997 - RNA, 13 nt, Human
uggaccucugcuc

SEQ ID NO: 2350998 - RNA, 15 nt, Human
uggaccucugcucug

SEQ ID NO: 2350999 - RNA, 16 nt, Human
uggaccucugcucuga

SEQ ID NO: 2351000 - RNA, 13 nt, Human
uggacggcaggcu

SEQ ID NO: 2351001 - RNA, 22 nt, Human
uggaccuuuccugaggaagagg

SEQ ID NO: 2351002 - RNA, 18 nt, Human
uggacgagaaaacaauaa

SEQ ID NO: 2351003 - RNA, 22 nt, Human
aggccaacccaaaauaagcagg

SEQ ID NO: 2351004 - RNA, 17 nt, Human
aggccaagaaacgucuu

SEQ ID NO: 2351005 - RNA, 14 nt, Human
aggccaagaaacgu

SEQ ID NO: 2351006 - RNA, 18 nt, Human
aggccaaggugggaggau

SEQ ID NO: 2351007 - RNA, 23 nt, Human
aggccaaaggaagcacaugccuc

SEQ ID NO: 2351008 - RNA, 20 nt, Human
aggccaaaggaagcacaugc

SEQ ID NO: 2351009 - RNA, 21 nt, Human
aggccaaacuggcaaacuuca

SEQ ID NO: 2351010 - RNA, 22 nt, Human
aggccaaaccucuguucagugu

SEQ ID NO: 2351011 - RNA, 18 nt, Human
aggccaaaccucuguuca

SEQ ID NO: 2351012 - RNA, 17 nt, Human
aggccaaaccucuguuc

SEQ ID NO: 2351013 - RNA, 16 nt, Human
aggccaaaccucuguu

SEQ ID NO: 2351014 - RNA, 20 nt, Human
aggccaaacucaccugcccc

SEQ ID NO: 2351015 - RNA, 14 nt, Human
aggccaaaggaagc

SEQ ID NO: 2351016 - RNA, 15 nt, Human
aggccaaaggaagca

SEQ ID NO: 2351017 - RNA, 15 nt, Human
aggcccucgcugcca

SEQ ID NO: 2351018 - RNA, 22 nt, Human
aggcccucgcugccagcucugu

SEQ ID NO: 2351019 - RNA, 17 nt, Human
aggcccucgcugccagc

SEQ ID NO: 2351020 - RNA, 15 nt, Human
aggcccaaagccucg

SEQ ID NO: 2351021 - RNA, 13 nt, Human
aggcccaaagccu

SEQ ID NO: 2351022 - RNA, 12 nt, Human
aggcccaaagcc

SEQ ID NO: 2351023 - RNA, 15 nt, Human
aggcccucugcccac

SEQ ID NO: 2351024 - RNA, 15 nt, Human
aggcccucgggccca

SEQ ID NO: 2351025 - RNA, 16 nt, Human
aggcccucgggcccag

SEQ ID NO: 2351026 - RNA, 17 nt, Human
aggcccucgggcccagc

SEQ ID NO: 2351027 - RNA, 18 nt, Human
aggcccucgggcccagcc

SEQ ID NO: 2351028 - RNA, 13 nt, Human
aggccucagccag

SEQ ID NO: 2351029 - RNA, 19 nt, Human
aggcccucgggcccagccc

SEQ ID NO: 2351030 - RNA, 20 nt, Human
aggcccucgggcccagcccc

SEQ ID NO: 2351031 - RNA, 16 nt, Human
aggccuauaaugaagc

SEQ ID NO: 2351032 - RNA, 22 nt, Human
aggccuauaaugaagcuuuaua

SEQ ID NO: 2351033 - RNA, 13 nt, Human
aggcccucugccc

SEQ ID NO: 2351034 - RNA, 14 nt, Human
aggcccucugccca

SEQ ID NO: 2351035 - RNA, 12 nt, Human
aggccucccugu

SEQ ID NO: 2351036 - RNA, 13 nt, Human
aggccucccuguu

SEQ ID NO: 2351037 - RNA, 14 nt, Human
aggccucccuguuu

SEQ ID NO: 2351038 - RNA, 20 nt, Human
aggccucgaaaaccaucaca

SEQ ID NO: 2351039 - RNA, 21 nt, Human
aggccucucauuccagaggaa

SEQ ID NO: 2351040 - RNA, 13 nt, Human
aggccucuguguc

SEQ ID NO: 2351041 - RNA, 17 nt, Human
aggccugaggaugagcu

SEQ ID NO: 2351042 - RNA, 18 nt, Human
aggccugaggaugagcug

SEQ ID NO: 2351043 - RNA, 19 nt, Human
aggccugaggaugagcugg

SEQ ID NO: 2351044 - RNA, 20 nt, Human
aggccugaggaugagcugga

SEQ ID NO: 2351045 - RNA, 23 nt, Human
aggccugaggaugagcuggaagg

SEQ ID NO: 2351046 - RNA, 17 nt, Human
aggccuccaucucaugu

SEQ ID NO: 2351047 - RNA, 16 nt, Human
aggccucaguggacuu

SEQ ID NO: 2351048 - RNA, 15 nt, Human
aggccucaguggacu

SEQ ID NO: 2351049 - RNA, 23 nt, Human
aggccucaguggacuuuccaccc

SEQ ID NO: 2351050 - RNA, 14 nt, Human
aggccucccaaguu

SEQ ID NO: 2351051 - RNA, 13 nt, Human
aggccucagugga

SEQ ID NO: 2351052 - RNA, 15 nt, Human
aggccucagccagag

SEQ ID NO: 2351053 - RNA, 14 nt, Human
aggccucagccaga

SEQ ID NO: 2351054 - RNA, 16 nt, Human
aggccucagccagaga

SEQ ID NO: 2351055 - RNA, 13 nt, Human
aggccucccucaa

SEQ ID NO: 2351056 - RNA, 16 nt, Human
aggccucccacaguga

SEQ ID NO: 2351057 - RNA, 18 nt, Human
aggccucccacagugacu

SEQ ID NO: 2351058 - RNA, 12 nt, Human
aggccucccaca

SEQ ID NO: 2351059 - RNA, 13 nt, Human
aggccucccacag

SEQ ID NO: 2351060 - RNA, 14 nt, Human
aggccucccacagu

SEQ ID NO: 2351061 - RNA, 15 nt, Human
aggccucccacagug

SEQ ID NO: 2351062 - RNA, 22 nt, Human
aggccucccucucucuucugcu

SEQ ID NO: 2351063 - RNA, 15 nt, Human
aggccucccucucuc

SEQ ID NO: 2351064 - RNA, 15 nt, Human
aggccucccuagcca

SEQ ID NO: 2351065 - RNA, 15 nt, Human
uggcaugccuuccag

SEQ ID NO: 2351066 - RNA, 19 nt, Human
uggcaugccuuccagcacc

SEQ ID NO: 2351067 - RNA, 15 nt, Human
aggccugcucaggga

SEQ ID NO: 2351068 - RNA, 18 nt, Human
aggccugcucagggacug

SEQ ID NO: 2351069 - RNA, 21 nt, Human
aggccugccuccagggcugga

SEQ ID NO: 2351070 - RNA, 23 nt, Human
aggccugccagacggcacccacc

SEQ ID NO: 2351071 - RNA, 16 nt, Human
aggccugcccucaggg

SEQ ID NO: 2351072 - RNA, 17 nt, Human
aggccugccuccagggc

SEQ ID NO: 2351073 - RNA, 17 nt, Human
aggccugcccucaggga

SEQ ID NO: 2351074 - RNA, 22 nt, Human
aggccugcccucagggaucuug

SEQ ID NO: 2351075 - RNA, 13 nt, Human
aggccugccuguu

SEQ ID NO: 2351076 - RNA, 19 nt, Human
aggccugccuccagggcug

SEQ ID NO: 2351077 - RNA, 20 nt, Human
aggccugccuccagggcugg

SEQ ID NO: 2351078 - RNA, 17 nt, Human
uggcauggcuccagucu

SEQ ID NO: 2351079 - RNA, 16 nt, Human
uggccaaauuauuugu

SEQ ID NO: 2351080 - RNA, 18 nt, Human
uggccaaauuauuugugu

SEQ ID NO: 2351081 - RNA, 20 nt, Human
uggccaaauuauuuguguaa

SEQ ID NO: 2351082 - RNA, 22 nt, Human
uggccaacaucgugaaacccug

SEQ ID NO: 2351083 - RNA, 14 nt, Human
uggcauggccacca

SEQ ID NO: 2351084 - RNA, 16 nt, Human
uggcauggcuccaguc

SEQ ID NO: 2351085 - RNA, 15 nt, Human
uggcauggcuccagu

SEQ ID NO: 2351086 - RNA, 14 nt, Human
uggccaaaguguua

SEQ ID NO: 2351087 - RNA, 12 nt, Human
uggcaugggaau

SEQ ID NO: 2351088 - RNA, 15 nt, Human
uggcaugggaaugaa

SEQ ID NO: 2351089 - RNA, 16 nt, Human
uggccaaguucuuagu

SEQ ID NO: 2351090 - RNA, 20 nt, Human
uggccaggcuggucucgaac

SEQ ID NO: 2351091 - RNA, 23 nt, Human
uggccagggccuggaagacagag

SEQ ID NO: 2351092 - RNA, 12 nt, Human
uggccaggguga

SEQ ID NO: 2351093 - RNA, 13 nt, Human
uggccagggugag

SEQ ID NO: 2351094 - RNA, 23 nt, Human
uggccaguccaggcugccguggg

SEQ ID NO: 2351095 - RNA, 19 nt, Human
uggccagggugagagcugc

SEQ ID NO: 2351096 - RNA, 17 nt, Human
uggccaguccaggcugc

SEQ ID NO: 2351097 - RNA, 21 nt, Human
uggccaguccaggcugccgug

SEQ ID NO: 2351098 - RNA, 16 nt, Human
uggccaguccaggcug

SEQ ID NO: 2351099 - RNA, 17 nt, Human
uggccagggugagagcu

SEQ ID NO: 2351100 - RNA, 18 nt, Human
uggccagggugagagcug

SEQ ID NO: 2351101 - RNA, 15 nt, Human
uggccaggcuggucu

SEQ ID NO: 2351102 - RNA, 17 nt, Human
uggccaggcuggucuca

SEQ ID NO: 2351103 - RNA, 19 nt, Human
uggccaaggagcugcuaua

SEQ ID NO: 2351104 - RNA, 18 nt, Human
uggccaaggagcugcuau

SEQ ID NO: 2351105 - RNA, 17 nt, Human
uggccaaggagcugcua

SEQ ID NO: 2351106 - RNA, 16 nt, Human
uggccaaggagcugcu

SEQ ID NO: 2351107 - RNA, 15 nt, Human
uggccaaggagcugc

SEQ ID NO: 2351108 - RNA, 23 nt, Human
uggccaagcagggaggaagaagc

SEQ ID NO: 2351109 - RNA, 21 nt, Human
uggccccuucacuucugacca

SEQ ID NO: 2351110 - RNA, 13 nt, Human
uggccccuucacu

SEQ ID NO: 2351111 - RNA, 11 nt, Human
uggccccuuca

SEQ ID NO: 2351112 - RNA, 12 nt, Human
uggccccugggu

SEQ ID NO: 2351113 - RNA, 21 nt, Human
uggccccugcccggcugcgga

SEQ ID NO: 2351114 - RNA, 23 nt, Human
uggccaguggcuggaucugugag

SEQ ID NO: 2351115 - RNA, 16 nt, Human
uggccaguggcuggau

SEQ ID NO: 2351116 - RNA, 15 nt, Human
uggccaguggcugga

SEQ ID NO: 2351117 - RNA, 14 nt, Human
uggccaguggcugg

SEQ ID NO: 2351118 - RNA, 16 nt, Human
uggccccuucacuucu

SEQ ID NO: 2351119 - RNA, 15 nt, Human
uggcccgugacagac

SEQ ID NO: 2351120 - RNA, 18 nt, Human
uggcccgugacagacucc

SEQ ID NO: 2351121 - RNA, 18 nt, Human
uggcccucaaggccuccc

SEQ ID NO: 2351122 - RNA, 20 nt, Human
uggcccgugacagacuccug

SEQ ID NO: 2351123 - RNA, 23 nt, Human
uggcccgugacagacuccugagg

SEQ ID NO: 2351124 - RNA, 18 nt, Human
uggcccgacagccuggca

SEQ ID NO: 2351125 - RNA, 19 nt, Human
uggcccgacagccuggcac

SEQ ID NO: 2351126 - RNA, 14 nt, Human
uggcccgacagccu

SEQ ID NO: 2351127 - RNA, 15 nt, Human
uggcccgacagccug

SEQ ID NO: 2351128 - RNA, 16 nt, Human
uggcccgacagccugg

SEQ ID NO: 2351129 - RNA, 17 nt, Human
uggcccgacagccuggc

SEQ ID NO: 2351130 - RNA, 22 nt, Human
uggccggagcaaacucugcugu

SEQ ID NO: 2351131 - RNA, 15 nt, Human
uggccgggagccuga

SEQ ID NO: 2351132 - RNA, 23 nt, Human
uggccgggaccccgagccuggcu

SEQ ID NO: 2351133 - RNA, 17 nt, Human
uggccgggaccccgagc

SEQ ID NO: 2351134 - RNA, 15 nt, Human
uggccgggaccccga

SEQ ID NO: 2351135 - RNA, 17 nt, Human
uggccgcugaguggcag

SEQ ID NO: 2351136 - RNA, 19 nt, Human
uggccgcugaguggcaggg

SEQ ID NO: 2351137 - RNA, 24 nt, Human
uggccggcaaccccaguucugcuc

SEQ ID NO: 2351138 - RNA, 21 nt, Human
uggccgcgccaaauaaugucu

SEQ ID NO: 2351139 - RNA, 22 nt, Human
uggccgcgccaaauaaugucuc

SEQ ID NO: 2351140 - RNA, 23 nt, Human
uggccgcgccaaauaaugucucu

SEQ ID NO: 2351141 - RNA, 12 nt, Human
uggccgccucac

SEQ ID NO: 2351142 - RNA, 16 nt, Human
uggccgccucaccccc

SEQ ID NO: 2351143 - RNA, 18 nt, Human
uggccgccucacccccuc

SEQ ID NO: 2351144 - RNA, 21 nt, Human
uggccgcccccugccccccag

SEQ ID NO: 2351145 - RNA, 23 nt, Human
uggccgcccccugccccccagcc

SEQ ID NO: 2351146 - RNA, 19 nt, Human
uggccgaguccaagcuggg

SEQ ID NO: 2351147 - RNA, 17 nt, Human
uggccgaguccaagcug

SEQ ID NO: 2351148 - RNA, 19 nt, Human
uggcccucaaggccuccca

SEQ ID NO: 2351149 - RNA, 20 nt, Human
uggcccucaaggccucccac

SEQ ID NO: 2351150 - RNA, 21 nt, Human
uggcccucaaggccucccaca

SEQ ID NO: 2351151 - RNA, 22 nt, Human
uggcccucaaggccucccacag

SEQ ID NO: 2351152 - RNA, 13 nt, Human
uggccgcccccug

SEQ ID NO: 2351153 - RNA, 15 nt, Human
uggccgcccccugcc

SEQ ID NO: 2351154 - RNA, 17 nt, Human
uggccgcccccugcccc

SEQ ID NO: 2351155 - RNA, 22 nt, Human
aggccuggccagaugcaccagc

SEQ ID NO: 2351156 - RNA, 23 nt, Human
aggccuggccagaugcaccagcc

SEQ ID NO: 2351157 - RNA, 13 nt, Human
aggccuggccagg

SEQ ID NO: 2351158 - RNA, 14 nt, Human
aggccuggccaggc

SEQ ID NO: 2351159 - RNA, 15 nt, Human
aggccuggccaggca

SEQ ID NO: 2351160 - RNA, 23 nt, Human
aggccugggggcugggcagagga

SEQ ID NO: 2351161 - RNA, 15 nt, Human
aggccuggccagaug

SEQ ID NO: 2351162 - RNA, 16 nt, Human
aggccuggccagaugc

SEQ ID NO: 2351163 - RNA, 17 nt, Human
aggccuggccagaugca

SEQ ID NO: 2351164 - RNA, 21 nt, Human
aggccuggccagaugcaccag

SEQ ID NO: 2351165 - RNA, 17 nt, Human
uggccuggccaggagcu

SEQ ID NO: 2351166 - RNA, 16 nt, Human
uggccuggccaggagc

SEQ ID NO: 2351167 - RNA, 15 nt, Human
uggccuggccaggag

SEQ ID NO: 2351168 - RNA, 13 nt, Human
uggccuggccagg

SEQ ID NO: 2351169 - RNA, 21 nt, Human
uggccuggccaggagcucuuc

SEQ ID NO: 2351170 - RNA, 18 nt, Human
uggccuggccaggagcuc

SEQ ID NO: 2351171 - RNA, 21 nt, Human
uggccuggaucuccccacucu

SEQ ID NO: 2351172 - RNA, 12 nt, Human
uggccuggccag

SEQ ID NO: 2351173 - RNA, 18 nt, Human
uggccuggcacacaucag

SEQ ID NO: 2351174 - RNA, 12 nt, Human
uggccuggcaca

SEQ ID NO: 2351175 - RNA, 16 nt, Human
uggccuggcacacauc

SEQ ID NO: 2351176 - RNA, 19 nt, Human
uggccggcaaccccaguuc

SEQ ID NO: 2351177 - RNA, 16 nt, Human
uggccuggaggugggg

SEQ ID NO: 2351178 - RNA, 18 nt, Human
uggccuggaggugggguu

SEQ ID NO: 2351179 - RNA, 22 nt, Human
uggccuggaggugggguuggga

SEQ ID NO: 2351180 - RNA, 12 nt, Human
uggccuggaucu

SEQ ID NO: 2351181 - RNA, 14 nt, Human
uggccuggaucucc

SEQ ID NO: 2351182 - RNA, 14 nt, Human
uggccucugcacuc

SEQ ID NO: 2351183 - RNA, 15 nt, Human
uggccucugcacucc

SEQ ID NO: 2351184 - RNA, 17 nt, Human
uggccucugcacucccc

SEQ ID NO: 2351185 - RNA, 21 nt, Human
ugcauucugccgugugcccuc

SEQ ID NO: 2351186 - RNA, 20 nt, Human
ugcauuuaaaagauacaguu

SEQ ID NO: 2351187 - RNA, 20 nt, Human
ugcauucacccagacagcuc

SEQ ID NO: 2351188 - RNA, 14 nt, Human
ugcauucacccaga

SEQ ID NO: 2351189 - RNA, 14 nt, Human
ugcauucaaauuaa

SEQ ID NO: 2351190 - RNA, 12 nt, Human
ugcauucaaauu

SEQ ID NO: 2351191 - RNA, 16 nt, Human
ugcauucacccagaca

SEQ ID NO: 2351192 - RNA, 14 nt, Human
ugcauucccagugg

SEQ ID NO: 2351193 - RNA, 23 nt, Human
ugcauuccugauaugauuuaaaa

SEQ ID NO: 2351194 - RNA, 12 nt, Human
ugcauucuagua

SEQ ID NO: 2351195 - RNA, 24 nt, Human
ugcauuuaaauacagucuuccauu

SEQ ID NO: 2351196 - RNA, 22 nt, Human
ugcauuuaaauacagucuucca

SEQ ID NO: 2351197 - RNA, 16 nt, Human
ugcauuuaaauacagu

SEQ ID NO: 2351198 - RNA, 19 nt, Human
ugcauuuaugagcucuuca

SEQ ID NO: 2351199 - RNA, 18 nt, Human
ugcauuugaggucuguuc

SEQ ID NO: 2351200 - RNA, 19 nt, Human
ugcauuugaggucuguucu

SEQ ID NO: 2351201 - RNA, 17 nt, Human
agcggaacaaggaguca

SEQ ID NO: 2351202 - RNA, 22 nt, Human
agcggaacaaggagucagacau

SEQ ID NO: 2351203 - RNA, 19 nt, Human
agcggacaucagcugguca

SEQ ID NO: 2351204 - RNA, 23 nt, Human
agcggaaagcagcucaaaggcac

SEQ ID NO: 2351205 - RNA, 17 nt, Human
agcggaaagcagcucaa

SEQ ID NO: 2351206 - RNA, 14 nt, Human
agcggaaagcagcu

SEQ ID NO: 2351207 - RNA, 13 nt, Human
agcggaaagcagc

SEQ ID NO: 2351208 - RNA, 22 nt, Human
agcggaaaagguuuuauuuugu

SEQ ID NO: 2351209 - RNA, 17 nt, Human
agcgcuuucuggaaaag

SEQ ID NO: 2351210 - RNA, 21 nt, Human
agcgcuuucuggaaaagagga

SEQ ID NO: 2351211 - RNA, 22 nt, Human
agcgcuggccgggaccccgagc

SEQ ID NO: 2351212 - RNA, 16 nt, Human
agcgcuuucuggaaaa

SEQ ID NO: 2351213 - RNA, 21 nt, Human
agcgcugccgcaccccagagu

SEQ ID NO: 2351214 - RNA, 20 nt, Human
agcgcugccgcaccccagag

SEQ ID NO: 2351215 - RNA, 18 nt, Human
agcgccaagcaaccuggg

SEQ ID NO: 2351216 - RNA, 16 nt, Human
agcgcuggccgggacc

SEQ ID NO: 2351217 - RNA, 19 nt, Human
agcgcagguuuaguuuacu

SEQ ID NO: 2351218 - RNA, 16 nt, Human
agcgccaagcaaccug

SEQ ID NO: 2351219 - RNA, 21 nt, Human
agcgccaagcaaccugggucc

SEQ ID NO: 2351220 - RNA, 19 nt, Human
agcgcaccugcccccuggu

SEQ ID NO: 2351221 - RNA, 18 nt, Human
agcgcaccugcccccugg

SEQ ID NO: 2351222 - RNA, 21 nt, Human
agcgcaccugcccccuggugg

SEQ ID NO: 2351223 - RNA, 17 nt, Human
agcgcaccugcccccug

SEQ ID NO: 2351224 - RNA, 14 nt, Human
agcgcaccugcccc

SEQ ID NO: 2351225 - RNA, 12 nt, Human
agcgcaccugcc

SEQ ID NO: 2351226 - RNA, 21 nt, Human
agccuugcccggauucuggga

SEQ ID NO: 2351227 - RNA, 19 nt, Human
agccuugccagagauccaa

SEQ ID NO: 2351228 - RNA, 17 nt, Human
agccuugccagagaucc

SEQ ID NO: 2351229 - RNA, 15 nt, Human
agccuugccagagau

SEQ ID NO: 2351230 - RNA, 22 nt, Human
agcgauucuucugcuucagccu

SEQ ID NO: 2351231 - RNA, 23 nt, Human
agccuugaccauucuccaccugc

SEQ ID NO: 2351232 - RNA, 14 nt, Human
agccuugccagaga

SEQ ID NO: 2351233 - RNA, 13 nt, Human
agccuugccagag

SEQ ID NO: 2351234 - RNA, 22 nt, Human
agccuugaacuuugaccucugc

SEQ ID NO: 2351235 - RNA, 16 nt, Human
agccuugaacuuugac

SEQ ID NO: 2351236 - RNA, 22 nt, Human
agccuugaccauucuccaccug

SEQ ID NO: 2351237 - RNA, 22 nt, Human
agccuuccccuugcccagggcu

SEQ ID NO: 2351238 - RNA, 12 nt, Human
agccuuccucca

SEQ ID NO: 2351239 - RNA, 19 nt, Human
agccuuccuccacauccuu

SEQ ID NO: 2351240 - RNA, 21 nt, Human
agccuuccuccacauccuuuc

SEQ ID NO: 2351241 - RNA, 23 nt, Human
agccuuccuccacauccuuucua

SEQ ID NO: 2351242 - RNA, 14 nt, Human
agccuuccucugca

SEQ ID NO: 2351243 - RNA, 17 nt, Human
agccuuccucugcagcu

SEQ ID NO: 2351244 - RNA, 20 nt, Human
agccuuccccuugcccaggg

SEQ ID NO: 2351245 - RNA, 19 nt, Human
agccuucccccucccaggg

SEQ ID NO: 2351246 - RNA, 21 nt, Human
ugcagcugaccucuguugucc

SEQ ID NO: 2351247 - RNA, 15 nt, Human
agccuugaacuuuga

SEQ ID NO: 2351248 - RNA, 12 nt, Human
agccuucucugu

SEQ ID NO: 2351249 - RNA, 23 nt, Human
agccuuccucugcagcugaccuc

SEQ ID NO: 2351250 - RNA, 18 nt, Human
agccuuccucugcagcug

SEQ ID NO: 2351251 - RNA, 19 nt, Human
agccuuccucugcagcuga

SEQ ID NO: 2351252 - RNA, 21 nt, Human
agccuuccucugcagcugacc

SEQ ID NO: 2351253 - RNA, 22 nt, Human
agccuuccucugcagcugaccu

SEQ ID NO: 2351254 - RNA, 15 nt, Human
ugcagcugaccucug

SEQ ID NO: 2351255 - RNA, 20 nt, Human
ugcagcugaccucuguuguc

SEQ ID NO: 2351256 - RNA, 18 nt, Human
agccuuccagggguggga

SEQ ID NO: 2351257 - RNA, 20 nt, Human
agcgggaauggcagcugcca

SEQ ID NO: 2351258 - RNA, 21 nt, Human
agcggcuggacuuggagguag

SEQ ID NO: 2351259 - RNA, 23 nt, Human
agcggcuggcagcccaccccuca

SEQ ID NO: 2351260 - RNA, 19 nt, Human
agcggggacagcuccuucu

SEQ ID NO: 2351261 - RNA, 20 nt, Human
agcggggacagcuccuucug

SEQ ID NO: 2351262 - RNA, 19 nt, Human
agcggggcgaagcccaggc

SEQ ID NO: 2351263 - RNA, 21 nt, Human
agcggggccccagggcuaccc

SEQ ID NO: 2351264 - RNA, 14 nt, Human
agcgggaccugugg

SEQ ID NO: 2351265 - RNA, 15 nt, Human
agcgggaccuguggc

SEQ ID NO: 2351266 - RNA, 16 nt, Human
agcgggaccuguggcu

SEQ ID NO: 2351267 - RNA, 22 nt, Human
agcggggacagcuccuucuguc

SEQ ID NO: 2351268 - RNA, 13 nt, Human
agcgucccagucu

SEQ ID NO: 2351269 - RNA, 16 nt, Human
agcgucccagucucug

SEQ ID NO: 2351270 - RNA, 18 nt, Human
agcgucccagucucuggc

SEQ ID NO: 2351271 - RNA, 17 nt, Human
agcguccuccucuguga

SEQ ID NO: 2351272 - RNA, 16 nt, Human
agcguccuccucugug

SEQ ID NO: 2351273 - RNA, 15 nt, Human
agcguccuccucugu

SEQ ID NO: 2351274 - RNA, 19 nt, Human
agcgucccagucucuggca

SEQ ID NO: 2351275 - RNA, 18 nt, Human
ugccagcuuaucucaggg

SEQ ID NO: 2351276 - RNA, 20 nt, Human
ugccagcuuuuccucccuug

SEQ ID NO: 2351277 - RNA, 20 nt, Human
ugccagucccccugccccag

SEQ ID NO: 2351278 - RNA, 16 nt, Human
ugccaguccuagcugc

SEQ ID NO: 2351279 - RNA, 19 nt, Human
ugccagcuuuuccucccuu

SEQ ID NO: 2351280 - RNA, 17 nt, Human
ugccaguccuagcugca

SEQ ID NO: 2351281 - RNA, 12 nt, Human
ugccagucgcgc

SEQ ID NO: 2351282 - RNA, 16 nt, Human
ugccagucgcgcugcc

SEQ ID NO: 2351283 - RNA, 17 nt, Human
ugccagucgcgcugccu

SEQ ID NO: 2351284 - RNA, 18 nt, Human
ugccagucgcgcugccug

SEQ ID NO: 2351285 - RNA, 15 nt, Human
ugccagugccuuacc

SEQ ID NO: 2351286 - RNA, 13 nt, Human
ugccagugccuua

SEQ ID NO: 2351287 - RNA, 11 nt, Human
ugccagugccu

SEQ ID NO: 2351288 - RNA, 16 nt, Human
ugccagugacacuucc

SEQ ID NO: 2351289 - RNA, 13 nt, Human
agcggcuggcagc

SEQ ID NO: 2351290 - RNA, 16 nt, Human
ugccagugacagacag

SEQ ID NO: 2351291 - RNA, 23 nt, Human
ugccagucgcgcugccugugugg

SEQ ID NO: 2351292 - RNA, 23 nt, Human
ugccagucucacugugggaaggc

SEQ ID NO: 2351293 - RNA, 19 nt, Human
ugccagucgcgcugccugu

SEQ ID NO: 2351294 - RNA, 20 nt, Human
ugccagucgcgcugccugug

SEQ ID NO: 2351295 - RNA, 21 nt, Human
ugccagucgcgcugccugugu

SEQ ID NO: 2351296 - RNA, 22 nt, Human
ugccagucgcgcugccugugug

SEQ ID NO: 2351297 - RNA, 17 nt, Human
ugccagugacagacagg

SEQ ID NO: 2351298 - RNA, 19 nt, Human
ugccagugacagacaggcu

SEQ ID NO: 2351299 - RNA, 20 nt, Human
ugccagugacagacaggcuc

SEQ ID NO: 2351300 - RNA, 22 nt, Human
ugccagugacagacaggcucuu

SEQ ID NO: 2351301 - RNA, 15 nt, Human
ugccagccagcagcc

SEQ ID NO: 2351302 - RNA, 22 nt, Human
ugccagcucuguaucaggaccc

SEQ ID NO: 2351303 - RNA, 23 nt, Human
ugccagcucuguaucaggaccca

SEQ ID NO: 2351304 - RNA, 15 nt, Human
ugccagcugcacuga

SEQ ID NO: 2351305 - RNA, 23 nt, Human
ugccagcaaugacaucucagggg

SEQ ID NO: 2351306 - RNA, 12 nt, Human
ugccagccagca

SEQ ID NO: 2351307 - RNA, 11 nt, Human
ugccagccagc

SEQ ID NO: 2351308 - RNA, 11 nt, Human
ugccagccaca

SEQ ID NO: 2351309 - RNA, 21 nt, Human
ugccagaugccuuuauggcug

SEQ ID NO: 2351310 - RNA, 21 nt, Human
ugccagaggugggcagguggu

SEQ ID NO: 2351311 - RNA, 11 nt, Human
ugccagaugcu

SEQ ID NO: 2351312 - RNA, 12 nt, Human
ugccagaugcug

SEQ ID NO: 2351313 - RNA, 14 nt, Human
ugccagaugcugau

SEQ ID NO: 2351314 - RNA, 16 nt, Human
ugccagaugcugaugu

SEQ ID NO: 2351315 - RNA, 17 nt, Human
ugccagaugcugauguu

SEQ ID NO: 2351316 - RNA, 21 nt, Human
ugccagaugcugauguucagu

SEQ ID NO: 2351317 - RNA, 15 nt, Human
ugccagaggugggca

SEQ ID NO: 2351318 - RNA, 16 nt, Human
ugccagaggugggcag

SEQ ID NO: 2351319 - RNA, 17 nt, Human
ugccagaggugggcagg

SEQ ID NO: 2351320 - RNA, 18 nt, Human
ugccagaggugggcaggu

SEQ ID NO: 2351321 - RNA, 19 nt, Human
ugccagaggugggcaggug

SEQ ID NO: 2351322 - RNA, 20 nt, Human
ugccagaggugggcaggugg

SEQ ID NO: 2351323 - RNA, 22 nt, Human
ugccagaugcugauguucagug

SEQ ID NO: 2351324 - RNA, 13 nt, Human
ugccagcaaagcc

SEQ ID NO: 2351325 - RNA, 14 nt, Human
ugccagcaaagccc

SEQ ID NO: 2351326 - RNA, 15 nt, Human
ugccagcaaagcccc

SEQ ID NO: 2351327 - RNA, 16 nt, Human
ugccagcaaagcccca

SEQ ID NO: 2351328 - RNA, 24 nt, Human
ugccagcaaagccccaugcuggag

SEQ ID NO: 2351329 - RNA, 11 nt, Human
ugccagcaacu

SEQ ID NO: 2351330 - RNA, 12 nt, Human
ugccagcaacug

SEQ ID NO: 2351331 - RNA, 13 nt, Human
ugccagcaacuga

SEQ ID NO: 2351332 - RNA, 14 nt, Human
ugccagcaacugaa

SEQ ID NO: 2351333 - RNA, 15 nt, Human
ugccagcaacugaau

SEQ ID NO: 2351334 - RNA, 16 nt, Human
ugccagcaacugaaua

SEQ ID NO: 2351335 - RNA, 17 nt, Human
ugccagcaacugaauaa

SEQ ID NO: 2351336 - RNA, 18 nt, Human
ugccagcaacugaauaaa

SEQ ID NO: 2351337 - RNA, 22 nt, Human
ugccagcaaugacaucucaggg

SEQ ID NO: 2351338 - RNA, 13 nt, Human
ugccacugccucu

SEQ ID NO: 2351339 - RNA, 17 nt, Human
ugccacugccucuuccu

SEQ ID NO: 2351340 - RNA, 21 nt, Human
ugccacugcccgagcuggugc

SEQ ID NO: 2351341 - RNA, 20 nt, Human
ugccacugcccgagcuggug

SEQ ID NO: 2351342 - RNA, 20 nt, Human
ugcauuuaugagcucuucau

SEQ ID NO: 2351343 - RNA, 21 nt, Human
ugcauuugaggucuguucuuu

SEQ ID NO: 2351344 - RNA, 20 nt, Human
ugcauuugaggucuguucuu

SEQ ID NO: 2351345 - RNA, 21 nt, Human
ugccagagauggagguucucu

SEQ ID NO: 2351346 - RNA, 15 nt, Human
ugccagagauggagg

SEQ ID NO: 2351347 - RNA, 22 nt, Human
ugccacugcccgagcuggugca

SEQ ID NO: 2351348 - RNA, 14 nt, Human
ugccagagauccaa

SEQ ID NO: 2351349 - RNA, 20 nt, Human
ugccacugccucuuccuccc

SEQ ID NO: 2351350 - RNA, 18 nt, Human
ugccacugccucuuccuc

SEQ ID NO: 2351351 - RNA, 19 nt, Human
ugccacugccucuuccucc

SEQ ID NO: 2351352 - RNA, 12 nt, Human
ugccccauucuu

SEQ ID NO: 2351353 - RNA, 18 nt, Human
ugccccauucuuuuguaa

SEQ ID NO: 2351354 - RNA, 23 nt, Human
ugccccaugccuguccagccugg

SEQ ID NO: 2351355 - RNA, 15 nt, Human
ugccccaugccuguc

SEQ ID NO: 2351356 - RNA, 21 nt, Human
ugcccccaccacggccacugg

SEQ ID NO: 2351357 - RNA, 17 nt, Human
ugccccccauccuggcc

SEQ ID NO: 2351358 - RNA, 16 nt, Human
ugccccauuuauccac

SEQ ID NO: 2351359 - RNA, 12 nt, Human
ugccccaugccu

SEQ ID NO: 2351360 - RNA, 20 nt, Human
ugcccaggagagccagcccu

SEQ ID NO: 2351361 - RNA, 19 nt, Human
ugcccaggagagccagccc

SEQ ID NO: 2351362 - RNA, 21 nt, Human
ugccccauccuccagcaggga

SEQ ID NO: 2351363 - RNA, 20 nt, Human
ugccccauccuccagcaggg

SEQ ID NO: 2351364 - RNA, 16 nt, Human
ugccccauucaacauc

SEQ ID NO: 2351365 - RNA, 15 nt, Human
ugcccccggcccccu

SEQ ID NO: 2351366 - RNA, 17 nt, Human
ugcccccggcccccugg

SEQ ID NO: 2351367 - RNA, 18 nt, Human
ugcccccggcccccuggu

SEQ ID NO: 2351368 - RNA, 11 nt, Human
ugcccccuccu

SEQ ID NO: 2351369 - RNA, 21 nt, Human
ugcccccggcccccuggucuc

SEQ ID NO: 2351370 - RNA, 12 nt, Human
ugcccccuccuc

SEQ ID NO: 2351371 - RNA, 14 nt, Human
ugcccccuccucuc

SEQ ID NO: 2351372 - RNA, 16 nt, Human
ugcccccuccucuccc

SEQ ID NO: 2351373 - RNA, 17 nt, Human
ugcccccuccucuccca

SEQ ID NO: 2351374 - RNA, 20 nt, Human
ugcccccuccucucccaucc

SEQ ID NO: 2351375 - RNA, 21 nt, Human
ugcccccuccucucccauccc

SEQ ID NO: 2351376 - RNA, 13 nt, Human
ugcccccucgugc

SEQ ID NO: 2351377 - RNA, 15 nt, Human
ugcccccucgugcca

SEQ ID NO: 2351378 - RNA, 14 nt, Human
ugcccccggccccc

SEQ ID NO: 2351379 - RNA, 23 nt, Human
ugccccccucaaaccuccucuuc

SEQ ID NO: 2351380 - RNA, 18 nt, Human
ugccccccuugccagaca

SEQ ID NO: 2351381 - RNA, 23 nt, Human
ugccccccauccuggcccaucag

SEQ ID NO: 2351382 - RNA, 20 nt, Human
ugccccccucaaaccuccuc

SEQ ID NO: 2351383 - RNA, 22 nt, Human
ugccccccucaaaccuccucuu

SEQ ID NO: 2351384 - RNA, 18 nt, Human
ugccccccauccuggccc

SEQ ID NO: 2351385 - RNA, 19 nt, Human
ugccccccauccuggccca

SEQ ID NO: 2351386 - RNA, 20 nt, Human
ugccccccauccuggcccau

SEQ ID NO: 2351387 - RNA, 21 nt, Human
ugccccccauccuggcccauc

SEQ ID NO: 2351388 - RNA, 15 nt, Human
ugccccgccuccccg

SEQ ID NO: 2351389 - RNA, 13 nt, Human
ugccccggccacc

SEQ ID NO: 2351390 - RNA, 14 nt, Human
ugccccggccaccu

SEQ ID NO: 2351391 - RNA, 13 nt, Human
ugccccgcccagc

SEQ ID NO: 2351392 - RNA, 23 nt, Human
ugcccccuuucagaugucuucug

SEQ ID NO: 2351393 - RNA, 22 nt, Human
ugccccgcccccaguccccacc

SEQ ID NO: 2351394 - RNA, 23 nt, Human
ugccccgaacauguuuuucuucu

SEQ ID NO: 2351395 - RNA, 20 nt, Human
ugcccuaaaguguauuuuuu

SEQ ID NO: 2351396 - RNA, 15 nt, Human
ugccccggccaccuc

SEQ ID NO: 2351397 - RNA, 16 nt, Human
ugccccggccaccucu

SEQ ID NO: 2351398 - RNA, 17 nt, Human
ugccccggccaccucug

SEQ ID NO: 2351399 - RNA, 18 nt, Human
ugccccggccaccucugc

SEQ ID NO: 2351400 - RNA, 23 nt, Human
ugccccggccaccucugcggacc

SEQ ID NO: 2351401 - RNA, 21 nt, Human
ugccccggccccggccccagc

SEQ ID NO: 2351402 - RNA, 22 nt, Human
ugccccggccccggccccagcc

SEQ ID NO: 2351403 - RNA, 23 nt, Human
ugccccggccccggccccagcca

SEQ ID NO: 2351404 - RNA, 18 nt, Human
ugcccccucugcccugcg

SEQ ID NO: 2351405 - RNA, 16 nt, Human
ugcccccucgugccag

SEQ ID NO: 2351406 - RNA, 17 nt, Human
ugcccccucgugccagu

SEQ ID NO: 2351407 - RNA, 18 nt, Human
ugcccccucgugccaguc

SEQ ID NO: 2351408 - RNA, 18 nt, Human
ugcccccugaaacuuauu

SEQ ID NO: 2351409 - RNA, 16 nt, Human
ugcccccuuucagaug

SEQ ID NO: 2351410 - RNA, 18 nt, Human
ugcccccuuucagauguc

SEQ ID NO: 2351411 - RNA, 21 nt, Human
ugcccccuuucagaugucuuc

SEQ ID NO: 2351412 - RNA, 22 nt, Human
ugcccccuuucagaugucuucu

SEQ ID NO: 2351413 - RNA, 17 nt, Human
ugcccccucugcccugc

SEQ ID NO: 2351414 - RNA, 16 nt, Human
ugcccccucugcccug

SEQ ID NO: 2351415 - RNA, 15 nt, Human
ugcccccucugcccu

SEQ ID NO: 2351416 - RNA, 14 nt, Human
ugcccccucugccc

SEQ ID NO: 2351417 - RNA, 15 nt, Human
ugcccaacaccagcc

SEQ ID NO: 2351418 - RNA, 16 nt, Human
ugcccaacaccagccc

SEQ ID NO: 2351419 - RNA, 17 nt, Human
ugcccaacaccagcccc

SEQ ID NO: 2351420 - RNA, 14 nt, Human
ugcccaacaccagc

SEQ ID NO: 2351421 - RNA, 21 nt, Human
ugcccaaagugcuuccaaggc

SEQ ID NO: 2351422 - RNA, 18 nt, Human
ugcccaaagucuguguga

SEQ ID NO: 2351423 - RNA, 19 nt, Human
ugcccaaaaauaugguuga

SEQ ID NO: 2351424 - RNA, 17 nt, Human
ugcccaaagaugcagcc

SEQ ID NO: 2351425 - RNA, 20 nt, Human
ugcccaaagaugcagccggu

SEQ ID NO: 2351426 - RNA, 13 nt, Human
ugcccagccccuu

SEQ ID NO: 2351427 - RNA, 12 nt, Human
ugcccagccccu

SEQ ID NO: 2351428 - RNA, 18 nt, Human
ugcccaacaccagccccu

SEQ ID NO: 2351429 - RNA, 19 nt, Human
ugcccaacaccagccccug

SEQ ID NO: 2351430 - RNA, 21 nt, Human
ugcccaacaccagccccugcc

SEQ ID NO: 2351431 - RNA, 22 nt, Human
ugcccaacaccagccccugccc

SEQ ID NO: 2351432 - RNA, 16 nt, Human
ugcccagccccuucug

SEQ ID NO: 2351433 - RNA, 17 nt, Human
ugcccagccccuucuga

SEQ ID NO: 2351434 - RNA, 17 nt, Human
ugcccagcucagagggu

SEQ ID NO: 2351435 - RNA, 22 nt, Human
ugcccagcuauaccugugccuc

SEQ ID NO: 2351436 - RNA, 21 nt, Human
ugcccagcuauaccugugccu

SEQ ID NO: 2351437 - RNA, 20 nt, Human
ugcccagcuauaccugugcc

SEQ ID NO: 2351438 - RNA, 19 nt, Human
ugcccaacccuucccucac

SEQ ID NO: 2351439 - RNA, 14 nt, Human
ugcccagcuagcug

SEQ ID NO: 2351440 - RNA, 18 nt, Human
ugcccagcuauaccugug

SEQ ID NO: 2351441 - RNA, 23 nt, Human
ugcccaacaccagccccugcccc

SEQ ID NO: 2351442 - RNA, 20 nt, Human
ugcccagcuagcugcagagc

SEQ ID NO: 2351443 - RNA, 13 nt, Human
ugcccagcucucg

SEQ ID NO: 2351444 - RNA, 21 nt, Human
ugcccagcuagcugcagagcc

SEQ ID NO: 2351445 - RNA, 13 nt, Human
ugcccagcuuggg

SEQ ID NO: 2351446 - RNA, 14 nt, Human
ugcccagcuugggc

SEQ ID NO: 2351447 - RNA, 16 nt, Human
ugcccagcuugggccc

SEQ ID NO: 2351448 - RNA, 18 nt, Human
ugcccagcuugggcccag

SEQ ID NO: 2351449 - RNA, 20 nt, Human
ugcccagcuugggcccagcu

SEQ ID NO: 2351450 - RNA, 21 nt, Human
ugcccagcuugggcccagcug

SEQ ID NO: 2351451 - RNA, 23 nt, Human
ugcccagcuugggcccagcuggg

SEQ ID NO: 2351452 - RNA, 21 nt, Human
ugcccaggacggggccggcca

SEQ ID NO: 2351453 - RNA, 22 nt, Human
ugcccaggacggggccggccag

SEQ ID NO: 2351454 - RNA, 21 nt, Human
ugcccaggagagccagcccuc

SEQ ID NO: 2351455 - RNA, 18 nt, Human
ugcccaggagagccagcc

SEQ ID NO: 2351456 - RNA, 17 nt, Human
ugcccaggagagccagc

SEQ ID NO: 2351457 - RNA, 16 nt, Human
ugcccaggagagccag

SEQ ID NO: 2351458 - RNA, 15 nt, Human
ugcccaggccccugc

SEQ ID NO: 2351459 - RNA, 17 nt, Human
ugcccaggccccugcca

SEQ ID NO: 2351460 - RNA, 18 nt, Human
ugcccaggccccugccac

SEQ ID NO: 2351461 - RNA, 17 nt, Human
agcuacccgcagaguuc

SEQ ID NO: 2351462 - RNA, 19 nt, Human
agcuacagguuacaacaga

SEQ ID NO: 2351463 - RNA, 20 nt, Human
agcuacagguuacaacagau

SEQ ID NO: 2351464 - RNA, 22 nt, Human
agcuacagguuacaacagauuu

SEQ ID NO: 2351465 - RNA, 21 nt, Human
agcuaggccuggccagaugca

SEQ ID NO: 2351466 - RNA, 21 nt, Human
agcuacagguuacaacagauu

SEQ ID NO: 2351467 - RNA, 22 nt, Human
agcuacaggaagcaccccaugc

SEQ ID NO: 2351468 - RNA, 14 nt, Human
agcuacaggaagca

SEQ ID NO: 2351469 - RNA, 12 nt, Human
agcuacagguua

SEQ ID NO: 2351470 - RNA, 13 nt, Human
agcuacagguuac

SEQ ID NO: 2351471 - RNA, 14 nt, Human
agcuacagguuaca

SEQ ID NO: 2351472 - RNA, 18 nt, Human
agcuacagguuacaacag

SEQ ID NO: 2351473 - RNA, 23 nt, Human
agcgugaaggccgagaagcaaga

SEQ ID NO: 2351474 - RNA, 22 nt, Human
agcgugagacgccaccauuccu

SEQ ID NO: 2351475 - RNA, 22 nt, Human
agcgugaaggccgagaagcaag

SEQ ID NO: 2351476 - RNA, 19 nt, Human
agcguccuccucugugacc

SEQ ID NO: 2351477 - RNA, 17 nt, Human
agcuaucucucagugaa

SEQ ID NO: 2351478 - RNA, 16 nt, Human
agcuauccuggcucuu

SEQ ID NO: 2351479 - RNA, 22 nt, Human
agcuaucuggucaaccuccugg

SEQ ID NO: 2351480 - RNA, 17 nt, Human
agcuaucguaaaauuaa

SEQ ID NO: 2351481 - RNA, 20 nt, Human
agcuauguuauauugaaaaa

SEQ ID NO: 2351482 - RNA, 15 nt, Human
agcuauuacugucug

SEQ ID NO: 2351483 - RNA, 20 nt, Human
agcuauuacugucugguuuu

SEQ ID NO: 2351484 - RNA, 21 nt, Human
agcuauuacugucugguuuua

SEQ ID NO: 2351485 - RNA, 14 nt, Human
agcuauuagccagg

SEQ ID NO: 2351486 - RNA, 18 nt, Human
agcuauuagccaggauca

SEQ ID NO: 2351487 - RNA, 22 nt, Human
agcuauguuauauugaaaaaau

SEQ ID NO: 2351488 - RNA, 18 nt, Human
agcuauguuauauugaaa

SEQ ID NO: 2351489 - RNA, 19 nt, Human
agcuauaucuauauauaau

SEQ ID NO: 2351490 - RNA, 17 nt, Human
agcuaucaagugugcuu

SEQ ID NO: 2351491 - RNA, 22 nt, Human
agcuauauccauguacuguagu

SEQ ID NO: 2351492 - RNA, 20 nt, Human
agcuauauccauguacugua

SEQ ID NO: 2351493 - RNA, 15 nt, Human
agcuauaucuauaua

SEQ ID NO: 2351494 - RNA, 17 nt, Human
agcuauaucuauauaua

SEQ ID NO: 2351495 - RNA, 14 nt, Human
agcuaucaggaaca

SEQ ID NO: 2351496 - RNA, 22 nt, Human
agcuaucaagugugcuuuagcu

SEQ ID NO: 2351497 - RNA, 23 nt, Human
agcuaucaagugugcuuuagcuu

SEQ ID NO: 2351498 - RNA, 15 nt, Human
agcuauccuggcucu

SEQ ID NO: 2351499 - RNA, 20 nt, Human
agcuaucagaagaccacaaa

SEQ ID NO: 2351500 - RNA, 17 nt, Human
agcuauauccauguacu

SEQ ID NO: 2351501 - RNA, 18 nt, Human
agcuaguucguagcuuuc

SEQ ID NO: 2351502 - RNA, 17 nt, Human
agcuaguucguagcuuu

SEQ ID NO: 2351503 - RNA, 19 nt, Human
agcuaguggcuucaaaaua

SEQ ID NO: 2351504 - RNA, 14 nt, Human
agcucaggaccagg

SEQ ID NO: 2351505 - RNA, 20 nt, Human
agcuauuagccaggaucaug

SEQ ID NO: 2351506 - RNA, 22 nt, Human
agcuauuagccaggaucauggu

SEQ ID NO: 2351507 - RNA, 18 nt, Human
agcucaggaccugggacc

SEQ ID NO: 2351508 - RNA, 18 nt, Human
agcucaggaccaggcaau

SEQ ID NO: 2351509 - RNA, 19 nt, Human
agcuauucaguaauaacuc

SEQ ID NO: 2351510 - RNA, 12 nt, Human
agcucagggccu

SEQ ID NO: 2351511 - RNA, 13 nt, Human
agcucagggccug

SEQ ID NO: 2351512 - RNA, 17 nt, Human
agcucaggaggcuugga

SEQ ID NO: 2351513 - RNA, 13 nt, Human
agcucaggaucuc

SEQ ID NO: 2351514 - RNA, 14 nt, Human
agcucagggccugg

SEQ ID NO: 2351515 - RNA, 19 nt, Human
agcucagggccuggcucag

SEQ ID NO: 2351516 - RNA, 20 nt, Human
agcucagggccuggcucagg

SEQ ID NO: 2351517 - RNA, 14 nt, Human
agcucagggcuuca

SEQ ID NO: 2351518 - RNA, 15 nt, Human
agcucagggcuucau

SEQ ID NO: 2351519 - RNA, 17 nt, Human
ugccauuugcacccucc

SEQ ID NO: 2351520 - RNA, 16 nt, Human
ugccauuugcacccuc

SEQ ID NO: 2351521 - RNA, 23 nt, Human
agcuccaagaccuguugguucca

SEQ ID NO: 2351522 - RNA, 21 nt, Human
ugccauuugcacccuccgccu

SEQ ID NO: 2351523 - RNA, 19 nt, Human
ugccauuugcacccuccgc

SEQ ID NO: 2351524 - RNA, 22 nt, Human
ugccauuugcacccuccgccuu

SEQ ID NO: 2351525 - RNA, 16 nt, Human
agcuccaagcucccag

SEQ ID NO: 2351526 - RNA, 22 nt, Human
ugccauuuaaagcuuauuaaaa

SEQ ID NO: 2351527 - RNA, 17 nt, Human
agcucaggugucccugc

SEQ ID NO: 2351528 - RNA, 22 nt, Human
agcuccaaccugcaaagaucug

SEQ ID NO: 2351529 - RNA, 10 nt, Human
agcucaggug

SEQ ID NO: 2351530 - RNA, 16 nt, Human
agcucaggugggcgug

SEQ ID NO: 2351531 - RNA, 15 nt, Human
agcuccaagcuccca

SEQ ID NO: 2351532 - RNA, 15 nt, Human
agcuccaagccccau

SEQ ID NO: 2351533 - RNA, 20 nt, Human
agcuccaagaccuguugguu

SEQ ID NO: 2351534 - RNA, 22 nt, Human
agcuccaagaccuguugguucc

SEQ ID NO: 2351535 - RNA, 18 nt, Human
ugcccuacagaggucucu

SEQ ID NO: 2351536 - RNA, 23 nt, Human
ugcccuaaugcgcaggcuggccc

SEQ ID NO: 2351537 - RNA, 20 nt, Human
ugcccuccaucccgacaugg

SEQ ID NO: 2351538 - RNA, 12 nt, Human
ugcccucccauc

SEQ ID NO: 2351539 - RNA, 15 nt, Human
ugcccucccaucccg

SEQ ID NO: 2351540 - RNA, 15 nt, Human
ugcccuccccagagc

SEQ ID NO: 2351541 - RNA, 17 nt, Human
ugcccuccaucccgaca

SEQ ID NO: 2351542 - RNA, 14 nt, Human
ugcccuccaucccg

SEQ ID NO: 2351543 - RNA, 13 nt, Human
ugcccuccauccc

SEQ ID NO: 2351544 - RNA, 21 nt, Human
ugcccuccagcucuuuccucc

SEQ ID NO: 2351545 - RNA, 20 nt, Human
ugcccuaaugcgcaggcugg

SEQ ID NO: 2351546 - RNA, 19 nt, Human
ugccccggggaggggcgcu

SEQ ID NO: 2351547 - RNA, 22 nt, Human
ugcccuaaccucugagucacca

SEQ ID NO: 2351548 - RNA, 14 nt, Human
ugcccuccccucuc

SEQ ID NO: 2351549 - RNA, 17 nt, Human
ugcccuccccucucugc

SEQ ID NO: 2351550 - RNA, 16 nt, Human
ugcccuccccagagca

SEQ ID NO: 2351551 - RNA, 17 nt, Human
ugcccuccccagagcac

SEQ ID NO: 2351552 - RNA, 19 nt, Human
ugcccuccccagagcacug

SEQ ID NO: 2351553 - RNA, 20 nt, Human
ugcccuccccagagcacugg

SEQ ID NO: 2351554 - RNA, 21 nt, Human
ugcccuccccucucugcaccg

SEQ ID NO: 2351555 - RNA, 15 nt, Human
ugcccuccucuccca

SEQ ID NO: 2351556 - RNA, 14 nt, Human
ugcccuccucuccc

SEQ ID NO: 2351557 - RNA, 12 nt, Human
ugcccuccucuc

SEQ ID NO: 2351558 - RNA, 23 nt, Human
ugcccucgggcgagucacugccu

SEQ ID NO: 2351559 - RNA, 22 nt, Human
ugcccucgggcgagucacugcc

SEQ ID NO: 2351560 - RNA, 20 nt, Human
ugcccucgggcgagucacug

SEQ ID NO: 2351561 - RNA, 19 nt, Human
ugcccucgggcgagucacu

SEQ ID NO: 2351562 - RNA, 13 nt, Human
ugcccucgcugcu

SEQ ID NO: 2351563 - RNA, 14 nt, Human
ugcccucgcugcuu

SEQ ID NO: 2351564 - RNA, 15 nt, Human
ugcccucgcugcuuc

SEQ ID NO: 2351565 - RNA, 17 nt, Human
ugcccucgcugcuucug

SEQ ID NO: 2351566 - RNA, 16 nt, Human
ugcccuccucucccau

SEQ ID NO: 2351567 - RNA, 19 nt, Human
ugcccuccuuguccaccca

SEQ ID NO: 2351568 - RNA, 22 nt, Human
ugcccuccuuguccacccaccu

SEQ ID NO: 2351569 - RNA, 21 nt, Human
ugcccucguggccagcccggc

SEQ ID NO: 2351570 - RNA, 19 nt, Human
ugcccucguggccagcccg

SEQ ID NO: 2351571 - RNA, 20 nt, Human
ugcccucguggccagcccgg

SEQ ID NO: 2351572 - RNA, 15 nt, Human
ugcccucguggccag

SEQ ID NO: 2351573 - RNA, 16 nt, Human
ugcccucguggccagc

SEQ ID NO: 2351574 - RNA, 17 nt, Human
ugcccucguggccagcc

SEQ ID NO: 2351575 - RNA, 18 nt, Human
ugcccucguggccagccc

SEQ ID NO: 2351576 - RNA, 12 nt, Human
ugcccucuucau

SEQ ID NO: 2351577 - RNA, 12 nt, Human
ugcccugaccuc

SEQ ID NO: 2351578 - RNA, 13 nt, Human
ugcccugaccucc

SEQ ID NO: 2351579 - RNA, 14 nt, Human
ugcccugaccuccc

SEQ ID NO: 2351580 - RNA, 15 nt, Human
ugcccugaccuccca

SEQ ID NO: 2351581 - RNA, 16 nt, Human
ugcccugaccucccag

SEQ ID NO: 2351582 - RNA, 17 nt, Human
ugcccugaccucccagc

SEQ ID NO: 2351583 - RNA, 18 nt, Human
ugcccugaccucccagcc

SEQ ID NO: 2351584 - RNA, 20 nt, Human
ugcccugaccucccagcccu

SEQ ID NO: 2351585 - RNA, 21 nt, Human
ugcccugaccucccagcccua

SEQ ID NO: 2351586 - RNA, 22 nt, Human
ugcccugcacgucaugggaggg

SEQ ID NO: 2351587 - RNA, 22 nt, Human
ugcccugaguggaucuccaagg

SEQ ID NO: 2351588 - RNA, 22 nt, Human
ugcccugaccucccagcccuau

SEQ ID NO: 2351589 - RNA, 17 nt, Human
agcuccaagcucccagg

SEQ ID NO: 2351590 - RNA, 18 nt, Human
agcuccaagcucccaggc

SEQ ID NO: 2351591 - RNA, 19 nt, Human
agcuccaagcucccaggca

SEQ ID NO: 2351592 - RNA, 21 nt, Human
agcuccacacccucucccagg

SEQ ID NO: 2351593 - RNA, 23 nt, Human
ugcccugaguggaucuccaagga

SEQ ID NO: 2351594 - RNA, 23 nt, Human
agcuccacacccucucccaggac

SEQ ID NO: 2351595 - RNA, 22 nt, Human
agcuccacacccucucccagga

SEQ ID NO: 2351596 - RNA, 15 nt, Human
agcuccacccuggcc

SEQ ID NO: 2351597 - RNA, 17 nt, Human
agcuccacccuggccga

SEQ ID NO: 2351598 - RNA, 11 nt, Human
agcuccacucu

SEQ ID NO: 2351599 - RNA, 12 nt, Human
agcuccacucug

SEQ ID NO: 2351600 - RNA, 13 nt, Human
agcuccacucugc

SEQ ID NO: 2351601 - RNA, 14 nt, Human
agcuccacucugcu

SEQ ID NO: 2351602 - RNA, 16 nt, Human
agcuccacucugcuuc

SEQ ID NO: 2351603 - RNA, 17 nt, Human
agcuccacucugcuucu

SEQ ID NO: 2351604 - RNA, 18 nt, Human
agcuccacucugcuucuc

SEQ ID NO: 2351605 - RNA, 19 nt, Human
agcuccacucugcuucucu

SEQ ID NO: 2351606 - RNA, 22 nt, Human
agcuccacucugcuucucugac

SEQ ID NO: 2351607 - RNA, 13 nt, Human
agcuccagcucac

SEQ ID NO: 2351608 - RNA, 17 nt, Human
agcuccagcucaccagc

SEQ ID NO: 2351609 - RNA, 23 nt, Human
agcuccagacccccagcaacccu

SEQ ID NO: 2351610 - RNA, 18 nt, Human
agcuccagacccccagca

SEQ ID NO: 2351611 - RNA, 17 nt, Human
agcuccagacccccagc

SEQ ID NO: 2351612 - RNA, 16 nt, Human
agcuccagacccccag

SEQ ID NO: 2351613 - RNA, 14 nt, Human
agcuccagaccccc

SEQ ID NO: 2351614 - RNA, 18 nt, Human
agcuccacugucacccuc

SEQ ID NO: 2351615 - RNA, 21 nt, Human
agcuccacugucacccuccac

SEQ ID NO: 2351616 - RNA, 23 nt, Human
agcuccacugucacccuccaccu

SEQ ID NO: 2351617 - RNA, 23 nt, Human
agcuccacucugcuucucugacu

SEQ ID NO: 2351618 - RNA, 24 nt, Human
agcuccacucugcuucucugacuu

SEQ ID NO: 2351619 - RNA, 16 nt, Human
agcucuguguugccau

SEQ ID NO: 2351620 - RNA, 15 nt, Human
agcucuguguugcca

SEQ ID NO: 2351621 - RNA, 22 nt, Human
agcucuggcugaacccugugcu

SEQ ID NO: 2351622 - RNA, 12 nt, Human
agcucuggcuga

SEQ ID NO: 2351623 - RNA, 16 nt, Human
agcucuggcugaaccc

SEQ ID NO: 2351624 - RNA, 17 nt, Human
agcucuggcugaacccu

SEQ ID NO: 2351625 - RNA, 18 nt, Human
agcucuggcugaacccug

SEQ ID NO: 2351626 - RNA, 19 nt, Human
agcucuggcugaacccugu

SEQ ID NO: 2351627 - RNA, 20 nt, Human
agcucuggcugaacccugug

SEQ ID NO: 2351628 - RNA, 21 nt, Human
agcucuggcugaacccugugc

SEQ ID NO: 2351629 - RNA, 15 nt, Human
agcucuggaccagcc

SEQ ID NO: 2351630 - RNA, 17 nt, Human
agcucuggaccagccug

SEQ ID NO: 2351631 - RNA, 12 nt, Human
agcucuggaggg

SEQ ID NO: 2351632 - RNA, 16 nt, Human
agcucuggaggggagg

SEQ ID NO: 2351633 - RNA, 17 nt, Human
agcucuggaggggaggg

SEQ ID NO: 2351634 - RNA, 18 nt, Human
agcucuggaggggagggg

SEQ ID NO: 2351635 - RNA, 19 nt, Human
agcucuggaggggaggggg

SEQ ID NO: 2351636 - RNA, 20 nt, Human
agcucuggaggggaggggga

SEQ ID NO: 2351637 - RNA, 23 nt, Human
agcucuguguugccaugugugcu

SEQ ID NO: 2351638 - RNA, 18 nt, Human
agcucuguguugccaugu

SEQ ID NO: 2351639 - RNA, 20 nt, Human
agcucuuaauuguucauuuu

SEQ ID NO: 2351640 - RNA, 18 nt, Human
agcucuucaggccucccu

SEQ ID NO: 2351641 - RNA, 16 nt, Human
agcucuucauguuuca

SEQ ID NO: 2351642 - RNA, 13 nt, Human
agcucuucauguu

SEQ ID NO: 2351643 - RNA, 17 nt, Human
agcucuucaggccuccc

SEQ ID NO: 2351644 - RNA, 16 nt, Human
agcucuucaggccucc

SEQ ID NO: 2351645 - RNA, 15 nt, Human
agcucuucaggccuc

SEQ ID NO: 2351646 - RNA, 13 nt, Human
agcucuucaggcc

SEQ ID NO: 2351647 - RNA, 20 nt, Human
agcucuagacaacccugcaa

SEQ ID NO: 2351648 - RNA, 19 nt, Human
agcucuagacaacccugca

SEQ ID NO: 2351649 - RNA, 17 nt, Human
agcucuagacaacccug

SEQ ID NO: 2351650 - RNA, 16 nt, Human
agcucuagacaacccu

SEQ ID NO: 2351651 - RNA, 21 nt, Human
agcucuacccagggccugcag

SEQ ID NO: 2351652 - RNA, 20 nt, Human
agcucuacccagggccugca

SEQ ID NO: 2351653 - RNA, 19 nt, Human
agcucuacccagggccugc

SEQ ID NO: 2351654 - RNA, 17 nt, Human
agcucuacccagggccu

SEQ ID NO: 2351655 - RNA, 15 nt, Human
agcucuacccagggc

SEQ ID NO: 2351656 - RNA, 13 nt, Human
agcucuacccagg

SEQ ID NO: 2351657 - RNA, 20 nt, Human
agcucguguauccuggggcu

SEQ ID NO: 2351658 - RNA, 21 nt, Human
agcucugcagagcaggaaaca

SEQ ID NO: 2351659 - RNA, 12 nt, Human
agcucugcauua

SEQ ID NO: 2351660 - RNA, 14 nt, Human
agcucugcagccca

SEQ ID NO: 2351661 - RNA, 16 nt, Human
agcucugcagcccagg

SEQ ID NO: 2351662 - RNA, 23 nt, Human
agcucugcccauccugccccuga

SEQ ID NO: 2351663 - RNA, 21 nt, Human
agcucuggacagccccacccu

SEQ ID NO: 2351664 - RNA, 13 nt, Human
agcucugcauuau

SEQ ID NO: 2351665 - RNA, 12 nt, Human
agcucuggacca

SEQ ID NO: 2351666 - RNA, 18 nt, Human
agcucuggacagccccac

SEQ ID NO: 2351667 - RNA, 17 nt, Human
agcucuggacagcccca

SEQ ID NO: 2351668 - RNA, 19 nt, Human
agcuccagacccccagcaa

SEQ ID NO: 2351669 - RNA, 21 nt, Human
agcuccagcucaccagcccca

SEQ ID NO: 2351670 - RNA, 18 nt, Human
agcuccagcucaccagcc

SEQ ID NO: 2351671 - RNA, 19 nt, Human
agcuccagcucaccagccc

SEQ ID NO: 2351672 - RNA, 21 nt, Human
agcuccaucuccacuccagau

SEQ ID NO: 2351673 - RNA, 18 nt, Human
agcucccaagggauggug

SEQ ID NO: 2351674 - RNA, 20 nt, Human
agcucccaagggauggugcc

SEQ ID NO: 2351675 - RNA, 22 nt, Human
agcucccaagggauggugcccu

SEQ ID NO: 2351676 - RNA, 23 nt, Human
agcucccaagggauggugcccug

SEQ ID NO: 2351677 - RNA, 17 nt, Human
agcucccaccccacccc

SEQ ID NO: 2351678 - RNA, 15 nt, Human
agcucccaccccacc

SEQ ID NO: 2351679 - RNA, 13 nt, Human
agcucccacccca

SEQ ID NO: 2351680 - RNA, 23 nt, Human
agcucccaccccacccccuucag

SEQ ID NO: 2351681 - RNA, 20 nt, Human
agcuccuugggaggccccac

SEQ ID NO: 2351682 - RNA, 19 nt, Human
agcuccuugggaggcccca

SEQ ID NO: 2351683 - RNA, 18 nt, Human
agcucguguauccugggg

SEQ ID NO: 2351684 - RNA, 19 nt, Human
agcucguguauccuggggc

SEQ ID NO: 2351685 - RNA, 15 nt, Human
agcuccuugggaggc

SEQ ID NO: 2351686 - RNA, 23 nt, Human
agcuccuugggaggaagcagaau

SEQ ID NO: 2351687 - RNA, 21 nt, Human
agcuccuugggaggaagcaga

SEQ ID NO: 2351688 - RNA, 22 nt, Human
agcuccuugggaggaagcagaa

SEQ ID NO: 2351689 - RNA, 12 nt, Human
agcuccuuggga

SEQ ID NO: 2351690 - RNA, 17 nt, Human
agcuccuugggaggaag

SEQ ID NO: 2351691 - RNA, 18 nt, Human
agcuccuugggaggaagc

SEQ ID NO: 2351692 - RNA, 19 nt, Human
agcuccuugggaggaagca

SEQ ID NO: 2351693 - RNA, 20 nt, Human
agcuccuugggaggaagcag

SEQ ID NO: 2351694 - RNA, 22 nt, Human
agcuccuucuguccuacucugu

SEQ ID NO: 2351695 - RNA, 23 nt, Human
agcuccuucuguccuacucugug

SEQ ID NO: 2351696 - RNA, 23 nt, Human
agcucccccuguccccucagcuc

SEQ ID NO: 2351697 - RNA, 20 nt, Human
agcuccccgcuucugccugc

SEQ ID NO: 2351698 - RNA, 16 nt, Human
agcucccccugucccc

SEQ ID NO: 2351699 - RNA, 17 nt, Human
agcucccccuguccccu

SEQ ID NO: 2351700 - RNA, 19 nt, Human
agcucccccuguccccuca

SEQ ID NO: 2351701 - RNA, 21 nt, Human
agcucccccuguccccucagc

SEQ ID NO: 2351702 - RNA, 19 nt, Human
agcucccccgggaggggcc

SEQ ID NO: 2351703 - RNA, 23 nt, Human
agcucccccgggaggggcccgcu

SEQ ID NO: 2351704 - RNA, 23 nt, Human
agcucccccucccccacugccau

SEQ ID NO: 2351705 - RNA, 13 nt, Human
agcucccccuguc

SEQ ID NO: 2351706 - RNA, 14 nt, Human
agcucccccugucc

SEQ ID NO: 2351707 - RNA, 15 nt, Human
agcucccccuguccc

SEQ ID NO: 2351708 - RNA, 21 nt, Human
agcuccccaccaccccagcug

SEQ ID NO: 2351709 - RNA, 13 nt, Human
agcuccccagagu

SEQ ID NO: 2351710 - RNA, 20 nt, Human
agcuccccaccaccccagcu

SEQ ID NO: 2351711 - RNA, 17 nt, Human
agcuccccaccacccca

SEQ ID NO: 2351712 - RNA, 14 nt, Human
agcuccccaccacc

SEQ ID NO: 2351713 - RNA, 22 nt, Human
agcuccccaaaaaccucacccg

SEQ ID NO: 2351714 - RNA, 18 nt, Human
agcucccauuucuacucu

SEQ ID NO: 2351715 - RNA, 23 nt, Human
agcucccauuucuacucucccau

SEQ ID NO: 2351716 - RNA, 18 nt, Human
agcuccccagaguccucu

SEQ ID NO: 2351717 - RNA, 12 nt, Human
ugccucagguuc

SEQ ID NO: 2351718 - RNA, 21 nt, Human
ugccucaggaggcaggaccuu

SEQ ID NO: 2351719 - RNA, 14 nt, Human
ugccucagccuccg

SEQ ID NO: 2351720 - RNA, 18 nt, Human
ugccucaggaggcaggac

SEQ ID NO: 2351721 - RNA, 18 nt, Human
ugccuccccaacccugcc

SEQ ID NO: 2351722 - RNA, 16 nt, Human
ugccuccccaacccug

SEQ ID NO: 2351723 - RNA, 15 nt, Human
ugccuccccaacccu

SEQ ID NO: 2351724 - RNA, 17 nt, Human
ugccucccauucugacc

SEQ ID NO: 2351725 - RNA, 14 nt, Human
ugccucagguuccu

SEQ ID NO: 2351726 - RNA, 16 nt, Human
ugccucagguuccuau

SEQ ID NO: 2351727 - RNA, 22 nt, Human
ugccucccaucacccgcuaaga

SEQ ID NO: 2351728 - RNA, 17 nt, Human
ugccucagccuccugag

SEQ ID NO: 2351729 - RNA, 15 nt, Human
ugccucagccuccug

SEQ ID NO: 2351730 - RNA, 18 nt, Human
ugccucagccucccgagu

SEQ ID NO: 2351731 - RNA, 15 nt, Human
ugccucagccucccg

SEQ ID NO: 2351732 - RNA, 18 nt, Human
ugccucagaaaacaagga

SEQ ID NO: 2351733 - RNA, 12 nt, Human
ugccucagcccg

SEQ ID NO: 2351734 - RNA, 23 nt, Human
ugccuccccaacccugccccugc

SEQ ID NO: 2351735 - RNA, 17 nt, Human
ugccuccccauuuccca

SEQ ID NO: 2351736 - RNA, 20 nt, Human
ugccuccccauuucccaucu

SEQ ID NO: 2351737 - RNA, 21 nt, Human
ugccuccccauuucccaucug

SEQ ID NO: 2351738 - RNA, 22 nt, Human
ugccuccccaacccugccccug

SEQ ID NO: 2351739 - RNA, 21 nt, Human
ugccuccccaacccugccccu

SEQ ID NO: 2351740 - RNA, 20 nt, Human
ugccuccccaacccugcccc

SEQ ID NO: 2351741 - RNA, 19 nt, Human
ugccuccccaacccugccc

SEQ ID NO: 2351742 - RNA, 18 nt, Human
ugccuccccggcucgagc

SEQ ID NO: 2351743 - RNA, 22 nt, Human
ugccuccccauuucccaucugc

SEQ ID NO: 2351744 - RNA, 23 nt, Human
ugccuccccauuucccaucugca

SEQ ID NO: 2351745 - RNA, 11 nt, Human
ugccucucugc

SEQ ID NO: 2351746 - RNA, 12 nt, Human
ugccucucugca

SEQ ID NO: 2351747 - RNA, 17 nt, Human
ugccucucucaggccaa

SEQ ID NO: 2351748 - RNA, 15 nt, Human
agcucuucuccaggc

SEQ ID NO: 2351749 - RNA, 15 nt, Human
agcucuguuucgguu

SEQ ID NO: 2351750 - RNA, 16 nt, Human
agcucuucuccaggcu

SEQ ID NO: 2351751 - RNA, 23 nt, Human
ugcccugugaguacuacaguccu

SEQ ID NO: 2351752 - RNA, 15 nt, Human
ugcccugugggcccc

SEQ ID NO: 2351753 - RNA, 18 nt, Human
ugcccugugggcccccaa

SEQ ID NO: 2351754 - RNA, 22 nt, Human
ugcccuuaccugccaggaagcc

SEQ ID NO: 2351755 - RNA, 12 nt, Human
ugcccugugcaa

SEQ ID NO: 2351756 - RNA, 19 nt, Human
ugcccuguuaaaagaugaa

SEQ ID NO: 2351757 - RNA, 14 nt, Human
ugccgccucccagc

SEQ ID NO: 2351758 - RNA, 13 nt, Human
ugccgccucccag

SEQ ID NO: 2351759 - RNA, 16 nt, Human
ugccgccucaaugugg

SEQ ID NO: 2351760 - RNA, 15 nt, Human
ugccucaccccuugc

SEQ ID NO: 2351761 - RNA, 15 nt, Human
ugccgccgccucgcc

SEQ ID NO: 2351762 - RNA, 16 nt, Human
ugccgccgccucgccc

SEQ ID NO: 2351763 - RNA, 17 nt, Human
ugccgccgccucgccca

SEQ ID NO: 2351764 - RNA, 21 nt, Human
ugccgccgccucgcccaccgc

SEQ ID NO: 2351765 - RNA, 18 nt, Human
ugccgccgccucgcccac

SEQ ID NO: 2351766 - RNA, 20 nt, Human
ugccgccgccucgcccaccg

SEQ ID NO: 2351767 - RNA, 14 nt, Human
ugccgccccaccca

SEQ ID NO: 2351768 - RNA, 15 nt, Human
ugccgccccacccag

SEQ ID NO: 2351769 - RNA, 16 nt, Human
ugccgccccacccaga

SEQ ID NO: 2351770 - RNA, 13 nt, Human
ugcccuucccugu

SEQ ID NO: 2351771 - RNA, 15 nt, Human
ugcccuucaccccag

SEQ ID NO: 2351772 - RNA, 20 nt, Human
ugcccuucaccccaguggcc

SEQ ID NO: 2351773 - RNA, 15 nt, Human
ugcccuucccugucc

SEQ ID NO: 2351774 - RNA, 16 nt, Human
ugcccuucccuguccc

SEQ ID NO: 2351775 - RNA, 17 nt, Human
ugcccuucccugucccu

SEQ ID NO: 2351776 - RNA, 18 nt, Human
ugcccuucccugucccuc

SEQ ID NO: 2351777 - RNA, 17 nt, Human
ugcccuucacaguguuu

SEQ ID NO: 2351778 - RNA, 14 nt, Human
ugcccuucacccca

SEQ ID NO: 2351779 - RNA, 17 nt, Human
agcucugccgcaauggc

SEQ ID NO: 2351780 - RNA, 19 nt, Human
ugcccuuaccugccaggaa

SEQ ID NO: 2351781 - RNA, 20 nt, Human
ugccgcagcccugcagaggg

SEQ ID NO: 2351782 - RNA, 18 nt, Human
ugcccuuccucaguuuaa

SEQ ID NO: 2351783 - RNA, 20 nt, Human
ugcccuucccugucccucua

SEQ ID NO: 2351784 - RNA, 16 nt, Human
ugcccuuccucaguuu

SEQ ID NO: 2351785 - RNA, 19 nt, Human
ugccugcggaguugugcac

SEQ ID NO: 2351786 - RNA, 20 nt, Human
ugccugcgcccaccccgcuc

SEQ ID NO: 2351787 - RNA, 21 nt, Human
ugccugcgcccaccccgcucu

SEQ ID NO: 2351788 - RNA, 14 nt, Human
ugccugcgcccacc

SEQ ID NO: 2351789 - RNA, 21 nt, Human
ugccugccugucugucucucc

SEQ ID NO: 2351790 - RNA, 20 nt, Human
ugccugccugucugucucuc

SEQ ID NO: 2351791 - RNA, 12 nt, Human
ugccucugccuc

SEQ ID NO: 2351792 - RNA, 17 nt, Human
ugccugcccaggccccu

SEQ ID NO: 2351793 - RNA, 18 nt, Human
ugccugcccaggccccug

SEQ ID NO: 2351794 - RNA, 19 nt, Human
ugccugcccaggccccugc

SEQ ID NO: 2351795 - RNA, 14 nt, Human
ugccucugacacac

SEQ ID NO: 2351796 - RNA, 16 nt, Human
ugccucugacacacag

SEQ ID NO: 2351797 - RNA, 15 nt, Human
ugccucucugcaggu

SEQ ID NO: 2351798 - RNA, 23 nt, Human
ugccucucugcaggucccuaaua

SEQ ID NO: 2351799 - RNA, 11 nt, Human
ugccucugccu

SEQ ID NO: 2351800 - RNA, 21 nt, Human
ugccucugccaaaggauguga

SEQ ID NO: 2351801 - RNA, 22 nt, Human
ugccucugccaaaggaugugau

SEQ ID NO: 2351802 - RNA, 21 nt, Human
ugccucucugcaggucccuaa

SEQ ID NO: 2351803 - RNA, 12 nt, Human
ugccucucuguu

SEQ ID NO: 2351804 - RNA, 13 nt, Human
ugccucucuguuu

SEQ ID NO: 2351805 - RNA, 15 nt, Human
agcugggacuacagg

SEQ ID NO: 2351806 - RNA, 20 nt, Human
agcuggaggacuagaaccug

SEQ ID NO: 2351807 - RNA, 22 nt, Human
agcuggaggacuagaaccugga

SEQ ID NO: 2351808 - RNA, 14 nt, Human
agcuggagccuggu

SEQ ID NO: 2351809 - RNA, 15 nt, Human
agcuggagccuggug

SEQ ID NO: 2351810 - RNA, 17 nt, Human
agcuggagccuggugcc

SEQ ID NO: 2351811 - RNA, 19 nt, Human
agcuggagccuggugcccu

SEQ ID NO: 2351812 - RNA, 13 nt, Human
agcuggaggacua

SEQ ID NO: 2351813 - RNA, 23 nt, Human
agcugcuuuugucuaugggacuc

SEQ ID NO: 2351814 - RNA, 24 nt, Human
agcugcuuuugucuaugggacuca

SEQ ID NO: 2351815 - RNA, 14 nt, Human
agcugccugugccu

SEQ ID NO: 2351816 - RNA, 23 nt, Human
agcugccuguaguuaggaaauaa

SEQ ID NO: 2351817 - RNA, 22 nt, Human
agcugccuguaguuaggaaaua

SEQ ID NO: 2351818 - RNA, 20 nt, Human
agcugccuguaguuaggaaa

SEQ ID NO: 2351819 - RNA, 19 nt, Human
agcugccuguaguuaggaa

SEQ ID NO: 2351820 - RNA, 18 nt, Human
agcugccuguaguuagga

SEQ ID NO: 2351821 - RNA, 15 nt, Human
agcugccuguaguua

SEQ ID NO: 2351822 - RNA, 14 nt, Human
agcugccuguaguu

SEQ ID NO: 2351823 - RNA, 22 nt, Human
ugccugcuuuucacugcugcaa

SEQ ID NO: 2351824 - RNA, 13 nt, Human
agcugccuguuca

SEQ ID NO: 2351825 - RNA, 22 nt, Human
agcugcuuuugucuaugggacu

SEQ ID NO: 2351826 - RNA, 10 nt, Human
agcugccugu

SEQ ID NO: 2351827 - RNA, 19 nt, Human
ugccugcuuuucacugcug

SEQ ID NO: 2351828 - RNA, 21 nt, Human
ugccugcuuuucacugcugca

SEQ ID NO: 2351829 - RNA, 23 nt, Human
ugccugcugaaugauuuccaaag

SEQ ID NO: 2351830 - RNA, 10 nt, Human
ugccugcuga

SEQ ID NO: 2351831 - RNA, 14 nt, Human
ugcagacuagaauu

SEQ ID NO: 2351832 - RNA, 17 nt, Human
ugcagacuagaauucua

SEQ ID NO: 2351833 - RNA, 19 nt, Human
ugcagacuagaauucuagu

SEQ ID NO: 2351834 - RNA, 19 nt, Human
ugcagacucaauaaaauca

SEQ ID NO: 2351835 - RNA, 16 nt, Human
ugcagacucaauaaaa

SEQ ID NO: 2351836 - RNA, 22 nt, Human
ugcagacuagaauucuagugcu

SEQ ID NO: 2351837 - RNA, 23 nt, Human
ugcagacuagaauucuagugcug

SEQ ID NO: 2351838 - RNA, 14 nt, Human
ugcagaccuguccu

SEQ ID NO: 2351839 - RNA, 15 nt, Human
ugcagaccuguccuc

SEQ ID NO: 2351840 - RNA, 18 nt, Human
ugcagaccuguccuccug

SEQ ID NO: 2351841 - RNA, 19 nt, Human
ugcagaccuguccuccugg

SEQ ID NO: 2351842 - RNA, 20 nt, Human
ugcagaccuguccuccuggu

SEQ ID NO: 2351843 - RNA, 21 nt, Human
ugcagaccuguccuccuggug

SEQ ID NO: 2351844 - RNA, 23 nt, Human
ugcagaccuguccuccugguggg

SEQ ID NO: 2351845 - RNA, 15 nt, Human
ugcagacaugagugc

SEQ ID NO: 2351846 - RNA, 23 nt, Human
ugcagaccacgcccguccugccu

SEQ ID NO: 2351847 - RNA, 14 nt, Human
ugcagaacuaaacu

SEQ ID NO: 2351848 - RNA, 21 nt, Human
ugcacucuaaaagguucaggg

SEQ ID NO: 2351849 - RNA, 22 nt, Human
ugcacucuaacccuaggcauca

SEQ ID NO: 2351850 - RNA, 14 nt, Human
ugcagaagacagua

SEQ ID NO: 2351851 - RNA, 22 nt, Human
ugcagacaggcaagcaccuccu

SEQ ID NO: 2351852 - RNA, 15 nt, Human
ugcagaagacaguau

SEQ ID NO: 2351853 - RNA, 19 nt, Human
ugcacuccccugcugggug

SEQ ID NO: 2351854 - RNA, 17 nt, Human
agcccuggucucagcag

SEQ ID NO: 2351855 - RNA, 18 nt, Human
ugcacucuaaaagguuca

SEQ ID NO: 2351856 - RNA, 16 nt, Human
ugcacuccccugcugg

SEQ ID NO: 2351857 - RNA, 17 nt, Human
ugcacuccccugcuggg

SEQ ID NO: 2351858 - RNA, 15 nt, Human
ugcacacauuuuuua

SEQ ID NO: 2351859 - RNA, 13 nt, Human
ugcacacauuuuu

SEQ ID NO: 2351860 - RNA, 12 nt, Human
ugcacacauuuu

SEQ ID NO: 2351861 - RNA, 11 nt, Human
ugcacacauuu

SEQ ID NO: 2351862 - RNA, 17 nt, Human
agcccuugcauugcaga

SEQ ID NO: 2351863 - RNA, 18 nt, Human
agcccuuaucugugcuca

SEQ ID NO: 2351864 - RNA, 12 nt, Human
agcccuugccuc

SEQ ID NO: 2351865 - RNA, 13 nt, Human
agcccuugccucc

SEQ ID NO: 2351866 - RNA, 14 nt, Human
agcccuugccuccc

SEQ ID NO: 2351867 - RNA, 16 nt, Human
agcccuugccucccca

SEQ ID NO: 2351868 - RNA, 12 nt, Human
agcccuuggguu

SEQ ID NO: 2351869 - RNA, 12 nt, Human
agcccuuggcca

SEQ ID NO: 2351870 - RNA, 23 nt, Human
agcccuugccuccccauuuccca

SEQ ID NO: 2351871 - RNA, 11 nt, Human
agcccuuggcc

SEQ ID NO: 2351872 - RNA, 21 nt, Human
agcccuuagcagggaaacagc

SEQ ID NO: 2351873 - RNA, 21 nt, Human
agcccuguugacacaggucuu

SEQ ID NO: 2351874 - RNA, 20 nt, Human
agcccuguugacacaggucu

SEQ ID NO: 2351875 - RNA, 18 nt, Human
agcccuguugacacaggu

SEQ ID NO: 2351876 - RNA, 17 nt, Human
agcccuguugacacagg

SEQ ID NO: 2351877 - RNA, 23 nt, Human
agcccuguugacacaggucuuuc

SEQ ID NO: 2351878 - RNA, 15 nt, Human
agcccuuaucugugc

SEQ ID NO: 2351879 - RNA, 17 nt, Human
agccgagaucacgccac

SEQ ID NO: 2351880 - RNA, 21 nt, Human
agccgagauagccaaggccaa

SEQ ID NO: 2351881 - RNA, 20 nt, Human
agccgagauagccaaggcca

SEQ ID NO: 2351882 - RNA, 21 nt, Human
agcccuuuacuugaccuccua

SEQ ID NO: 2351883 - RNA, 12 nt, Human
agcccuuucugu

SEQ ID NO: 2351884 - RNA, 13 nt, Human
agcccuuucugug

SEQ ID NO: 2351885 - RNA, 16 nt, Human
agcccuuucugugugc

SEQ ID NO: 2351886 - RNA, 17 nt, Human
agcccuuucugugugca

SEQ ID NO: 2351887 - RNA, 18 nt, Human
agcccuuucugugugcac

SEQ ID NO: 2351888 - RNA, 19 nt, Human
agcccugucagugcagccc

SEQ ID NO: 2351889 - RNA, 17 nt, Human
agcccugucagugcagc

SEQ ID NO: 2351890 - RNA, 20 nt, Human
ugcagacucaguuugucaga

SEQ ID NO: 2351891 - RNA, 19 nt, Human
ugcagacucaguuugucag

SEQ ID NO: 2351892 - RNA, 20 nt, Human
agcccugucagugcagcccg

SEQ ID NO: 2351893 - RNA, 15 nt, Human
ugcagacucaguuug

SEQ ID NO: 2351894 - RNA, 14 nt, Human
ugcagacucaguuu

SEQ ID NO: 2351895 - RNA, 14 nt, Human
ugcagacucacugu

SEQ ID NO: 2351896 - RNA, 16 nt, Human
agcccugucagugcag

SEQ ID NO: 2351897 - RNA, 16 nt, Human
ugcagacucuacagag

SEQ ID NO: 2351898 - RNA, 17 nt, Human
ugcagacucuacagagg

SEQ ID NO: 2351899 - RNA, 17 nt, Human
agcccugucgagacacu

SEQ ID NO: 2351900 - RNA, 18 nt, Human
agcccugucgagacacuu

SEQ ID NO: 2351901 - RNA, 12 nt, Human
agcccuguggaa

SEQ ID NO: 2351902 - RNA, 21 nt, Human
agcccugucgagacacuugcc

SEQ ID NO: 2351903 - RNA, 23 nt, Human
agcccugucgagacacuugccuu

SEQ ID NO: 2351904 - RNA, 16 nt, Human
agcccuuagcagggaa

SEQ ID NO: 2351905 - RNA, 23 nt, Human
agcccuguggaugagcccucaga

SEQ ID NO: 2351906 - RNA, 22 nt, Human
agcccuguggaugagcccucag

SEQ ID NO: 2351907 - RNA, 19 nt, Human
agcccuguggaugagcccu

SEQ ID NO: 2351908 - RNA, 18 nt, Human
agcccuguggaugagccc

SEQ ID NO: 2351909 - RNA, 17 nt, Human
agccucacuugaaugug

SEQ ID NO: 2351910 - RNA, 16 nt, Human
agccucacuugaaugu

SEQ ID NO: 2351911 - RNA, 18 nt, Human
agccucacaguccuuacc

SEQ ID NO: 2351912 - RNA, 15 nt, Human
agccucacagaagaa

SEQ ID NO: 2351913 - RNA, 18 nt, Human
agccucaauaagccuugu

SEQ ID NO: 2351914 - RNA, 19 nt, Human
agccucaauaagccuuguc

SEQ ID NO: 2351915 - RNA, 20 nt, Human
agccucaauaagccuugucg

SEQ ID NO: 2351916 - RNA, 17 nt, Human
agccucacaguccuuac

SEQ ID NO: 2351917 - RNA, 22 nt, Human
agcccuuugggaggcugaggcg

SEQ ID NO: 2351918 - RNA, 21 nt, Human
agcccuuugggaggcugaggc

SEQ ID NO: 2351919 - RNA, 21 nt, Human
agccucaagucuuauuuccuc

SEQ ID NO: 2351920 - RNA, 20 nt, Human
agccucaaccuccugggcua

SEQ ID NO: 2351921 - RNA, 19 nt, Human
agccucaaccuccugggcu

SEQ ID NO: 2351922 - RNA, 18 nt, Human
agccgagaucacgccacu

SEQ ID NO: 2351923 - RNA, 22 nt, Human
agccucacuugaaugugucacu

SEQ ID NO: 2351924 - RNA, 15 nt, Human
agccucagccauuca

SEQ ID NO: 2351925 - RNA, 12 nt, Human
agccucagccau

SEQ ID NO: 2351926 - RNA, 11 nt, Human
agccucagucc

SEQ ID NO: 2351927 - RNA, 15 nt, Human
agccucaguccuccc

SEQ ID NO: 2351928 - RNA, 16 nt, Human
agccucaguccucccc

SEQ ID NO: 2351929 - RNA, 17 nt, Human
agccucaguccuccccu

SEQ ID NO: 2351930 - RNA, 14 nt, Human
agccucauccgagg

SEQ ID NO: 2351931 - RNA, 17 nt, Human
agccucauauuuaaaga

SEQ ID NO: 2351932 - RNA, 19 nt, Human
agccucauauuuaaagaca

SEQ ID NO: 2351933 - RNA, 14 nt, Human
agccucauauuuaa

SEQ ID NO: 2351934 - RNA, 15 nt, Human
agccucauauuuaaa

SEQ ID NO: 2351935 - RNA, 16 nt, Human
agccucauauuuaaag

SEQ ID NO: 2351936 - RNA, 22 nt, Human
agccucagucucccucccuugg

SEQ ID NO: 2351937 - RNA, 20 nt, Human
agccucaguccuccccucac

SEQ ID NO: 2351938 - RNA, 18 nt, Human
agccucaguccuccccuc

SEQ ID NO: 2351939 - RNA, 19 nt, Human
agccucaguccuccccuca

SEQ ID NO: 2351940 - RNA, 20 nt, Human
agccucagucucccucccuu

SEQ ID NO: 2351941 - RNA, 19 nt, Human
agccucagucucccucccu

SEQ ID NO: 2351942 - RNA, 16 nt, Human
agccucagucucccuc

SEQ ID NO: 2351943 - RNA, 13 nt, Human
agccucagucucc

SEQ ID NO: 2351944 - RNA, 18 nt, Human
agccucugcugccauggc

SEQ ID NO: 2351945 - RNA, 14 nt, Human
agccucugcugcca

SEQ ID NO: 2351946 - RNA, 22 nt, Human
agccucuggcauuagaauuauu

SEQ ID NO: 2351947 - RNA, 23 nt, Human
agccucuggcauuagaauuauuu

SEQ ID NO: 2351948 - RNA, 13 nt, Human
agccucugcugcc

SEQ ID NO: 2351949 - RNA, 12 nt, Human
agccucugcugc

SEQ ID NO: 2351950 - RNA, 16 nt, Human
agccucugcuccccag

SEQ ID NO: 2351951 - RNA, 15 nt, Human
agccucugcucccca

SEQ ID NO: 2351952 - RNA, 15 nt, Human
agccucuggcuagag

SEQ ID NO: 2351953 - RNA, 14 nt, Human
agccucuggcuaga

SEQ ID NO: 2351954 - RNA, 13 nt, Human
agccucuggcuag

SEQ ID NO: 2351955 - RNA, 12 nt, Human
agccucuggcua

SEQ ID NO: 2351956 - RNA, 20 nt, Human
agccucuggcuagaggccag

SEQ ID NO: 2351957 - RNA, 13 nt, Human
agccucuggguca

SEQ ID NO: 2351958 - RNA, 20 nt, Human
ugcagccucaaccuccuggg

SEQ ID NO: 2351959 - RNA, 21 nt, Human
ugcagccucaaccuccugggc

SEQ ID NO: 2351960 - RNA, 22 nt, Human
ugcagccucaaccuccugggcu

SEQ ID NO: 2351961 - RNA, 21 nt, Human
ugcagcucaaggaaaggccug

SEQ ID NO: 2351962 - RNA, 16 nt, Human
ugcagcucacuacccu

SEQ ID NO: 2351963 - RNA, 22 nt, Human
ugcagcucaaggaaaggccuga

SEQ ID NO: 2351964 - RNA, 12 nt, Human
agccucugaccc

SEQ ID NO: 2351965 - RNA, 15 nt, Human
agccucugaccccuc

SEQ ID NO: 2351966 - RNA, 17 nt, Human
agccucugaccccuccu

SEQ ID NO: 2351967 - RNA, 18 nt, Human
agccucugaccccuccuc

SEQ ID NO: 2351968 - RNA, 19 nt, Human
agccucugaccccuccuca

SEQ ID NO: 2351969 - RNA, 20 nt, Human
agccucugaccccuccucac

SEQ ID NO: 2351970 - RNA, 21 nt, Human
agccucugaccccuccucacu

SEQ ID NO: 2351971 - RNA, 18 nt, Human
agccucugagccccuggg

SEQ ID NO: 2351972 - RNA, 22 nt, Human
agccucugaccccuccucacug

SEQ ID NO: 2351973 - RNA, 21 nt, Human
agccucugacuuaagcugccu

SEQ ID NO: 2351974 - RNA, 13 nt, Human
agccucugcuccc

SEQ ID NO: 2351975 - RNA, 18 nt, Human
agccucucucccagucua

SEQ ID NO: 2351976 - RNA, 16 nt, Human
agccucucucccaguc

SEQ ID NO: 2351977 - RNA, 17 nt, Human
agccucucucccagucu

SEQ ID NO: 2351978 - RNA, 14 nt, Human
agccucucucccag

SEQ ID NO: 2351979 - RNA, 15 nt, Human
agccucucucccagu

SEQ ID NO: 2351980 - RNA, 16 nt, Human
agccuccaguccaagg

SEQ ID NO: 2351981 - RNA, 22 nt, Human
agccuccaguccaaggaaacca

SEQ ID NO: 2351982 - RNA, 23 nt, Human
agccucugaaaaccaauguucuc

SEQ ID NO: 2351983 - RNA, 17 nt, Human
agccuccaugcugccuc

SEQ ID NO: 2351984 - RNA, 15 nt, Human
agccuccagccucug

SEQ ID NO: 2351985 - RNA, 16 nt, Human
agccuccagccucugu

SEQ ID NO: 2351986 - RNA, 18 nt, Human
agccuccagccucuguuc

SEQ ID NO: 2351987 - RNA, 17 nt, Human
agccuccagcugccccg

SEQ ID NO: 2351988 - RNA, 12 nt, Human
agccuccagccu

SEQ ID NO: 2351989 - RNA, 13 nt, Human
agccuccagccuc

SEQ ID NO: 2351990 - RNA, 14 nt, Human
agccuccagccucu

SEQ ID NO: 2351991 - RNA, 18 nt, Human
agccucauccgaggcagg

SEQ ID NO: 2351992 - RNA, 17 nt, Human
agccucauccgaggcag

SEQ ID NO: 2351993 - RNA, 21 nt, Human
agccuccaagcuccaucucca

SEQ ID NO: 2351994 - RNA, 20 nt, Human
agccucauauuuaaagacag

SEQ ID NO: 2351995 - RNA, 13 nt, Human
agcccccccuucc

SEQ ID NO: 2351996 - RNA, 15 nt, Human
agcccccccuuccac

SEQ ID NO: 2351997 - RNA, 22 nt, Human
agcccccgccccgccccacauu

SEQ ID NO: 2351998 - RNA, 23 nt, Human
agcccccccaacacugugcccug

SEQ ID NO: 2351999 - RNA, 23 nt, Human
agcccccgccccgccccacauuc

SEQ ID NO: 2352000 - RNA, 16 nt, Human
agcccccuccuugucu

SEQ ID NO: 2352001 - RNA, 18 nt, Human
agcccccaggcugcugga

SEQ ID NO: 2352002 - RNA, 18 nt, Human
agcccccccaacacugug

SEQ ID NO: 2352003 - RNA, 17 nt, Human
agcccccaggcugcugg

SEQ ID NO: 2352004 - RNA, 19 nt, Human
agcccccccaacacugugc

SEQ ID NO: 2352005 - RNA, 20 nt, Human
agcccccccaacacugugcc

SEQ ID NO: 2352006 - RNA, 21 nt, Human
agcccccccaacacugugccc

SEQ ID NO: 2352007 - RNA, 22 nt, Human
agcccccccaacacugugcccu

SEQ ID NO: 2352008 - RNA, 23 nt, Human
agccccauucugccugcccaggc

SEQ ID NO: 2352009 - RNA, 22 nt, Human
agccccucuugccccccacccc

SEQ ID NO: 2352010 - RNA, 21 nt, Human
agccccucuugccccccaccc

SEQ ID NO: 2352011 - RNA, 23 nt, Human
agccccucuugccccccacccca

SEQ ID NO: 2352012 - RNA, 20 nt, Human
agccccucuugccccccacc

SEQ ID NO: 2352013 - RNA, 17 nt, Human
agccccucuugcccccc

SEQ ID NO: 2352014 - RNA, 16 nt, Human
agccccucuugccccc

SEQ ID NO: 2352015 - RNA, 20 nt, Human
agccccugauccugugaagu

SEQ ID NO: 2352016 - RNA, 12 nt, Human
agccccugcccc

SEQ ID NO: 2352017 - RNA, 10 nt, Human
agccccucuu

SEQ ID NO: 2352018 - RNA, 22 nt, Human
agccccucuggucgcuccugcc

SEQ ID NO: 2352019 - RNA, 20 nt, Human
agccccucuggucgcuccug

SEQ ID NO: 2352020 - RNA, 21 nt, Human
agccccucuggucgcuccugc

SEQ ID NO: 2352021 - RNA, 14 nt, Human
agcccccuggccuc

SEQ ID NO: 2352022 - RNA, 15 nt, Human
agcccgcggggacau

SEQ ID NO: 2352023 - RNA, 22 nt, Human
agcccgccugccaguccuagcu

SEQ ID NO: 2352024 - RNA, 23 nt, Human
agcccgccugccaguccuagcug

SEQ ID NO: 2352025 - RNA, 20 nt, Human
agcccgcggggacauuggga

SEQ ID NO: 2352026 - RNA, 12 nt, Human
agcccgccugcc

SEQ ID NO: 2352027 - RNA, 13 nt, Human
agcccgccugcca

SEQ ID NO: 2352028 - RNA, 14 nt, Human
agcccgccugccag

SEQ ID NO: 2352029 - RNA, 15 nt, Human
agcccgccugccagu

SEQ ID NO: 2352030 - RNA, 16 nt, Human
agcccgccugccaguc

SEQ ID NO: 2352031 - RNA, 18 nt, Human
agcccgccugccaguccu

SEQ ID NO: 2352032 - RNA, 19 nt, Human
agcccgccugccaguccua

SEQ ID NO: 2352033 - RNA, 21 nt, Human
agcccgccugccaguccuagc

SEQ ID NO: 2352034 - RNA, 14 nt, Human
agcccggaugcuuc

SEQ ID NO: 2352035 - RNA, 19 nt, Human
agcccgcugaguggacugg

SEQ ID NO: 2352036 - RNA, 20 nt, Human
agcccggaccuuggcagccc

SEQ ID NO: 2352037 - RNA, 11 nt, Human
agcccggccug

SEQ ID NO: 2352038 - RNA, 19 nt, Human
agcccggccugcucccagc

SEQ ID NO: 2352039 - RNA, 20 nt, Human
agcccggccugcucccagca

SEQ ID NO: 2352040 - RNA, 21 nt, Human
agcccggccugcucccagcag

SEQ ID NO: 2352041 - RNA, 22 nt, Human
agcccggccugcucccagcagc

SEQ ID NO: 2352042 - RNA, 20 nt, Human
agcccggcgccaccauccug

SEQ ID NO: 2352043 - RNA, 21 nt, Human
agcccggcgccaccauccugc

SEQ ID NO: 2352044 - RNA, 16 nt, Human
agcccggcgccccugc

SEQ ID NO: 2352045 - RNA, 18 nt, Human
agcccggcgccccugcca

SEQ ID NO: 2352046 - RNA, 21 nt, Human
agcccggcgccccugccaccu

SEQ ID NO: 2352047 - RNA, 22 nt, Human
agcccggcgccccugccaccuc

SEQ ID NO: 2352048 - RNA, 22 nt, Human
agccccuuuuucauauguugcu

SEQ ID NO: 2352049 - RNA, 23 nt, Human
agccccuuuuucauauguugcuc

SEQ ID NO: 2352050 - RNA, 14 nt, Human
agcccgaauacaaa

SEQ ID NO: 2352051 - RNA, 13 nt, Human
agccccugcccca

SEQ ID NO: 2352052 - RNA, 15 nt, Human
agccccugccccagc

SEQ ID NO: 2352053 - RNA, 16 nt, Human
agccccugccccagcc

SEQ ID NO: 2352054 - RNA, 17 nt, Human
agccccugccccagccc

SEQ ID NO: 2352055 - RNA, 18 nt, Human
agccccugccccagccca

SEQ ID NO: 2352056 - RNA, 21 nt, Human
agccccugccccagcccaagu

SEQ ID NO: 2352057 - RNA, 23 nt, Human
agccccugccccagcccaagucc

SEQ ID NO: 2352058 - RNA, 15 nt, Human
agcccgcacccccac

SEQ ID NO: 2352059 - RNA, 15 nt, Human
agcccgaauacaaac

SEQ ID NO: 2352060 - RNA, 18 nt, Human
agcccgcacccccacccu

SEQ ID NO: 2352061 - RNA, 17 nt, Human
agcccgcacccccaccc

SEQ ID NO: 2352062 - RNA, 16 nt, Human
agcccgcacccccacc

SEQ ID NO: 2352063 - RNA, 19 nt, Human
agcccgccaagguagccau

SEQ ID NO: 2352064 - RNA, 21 nt, Human
agcccgcacccccacccuuug

SEQ ID NO: 2352065 - RNA, 19 nt, Human
agcccgcacccccacccuu

SEQ ID NO: 2352066 - RNA, 21 nt, Human
ugcacacaccagagcccaccu

SEQ ID NO: 2352067 - RNA, 16 nt, Human
agcccuggucucagca

SEQ ID NO: 2352068 - RNA, 17 nt, Human
ugcacacaccagagccc

SEQ ID NO: 2352069 - RNA, 18 nt, Human
ugcacacaccagagccca

SEQ ID NO: 2352070 - RNA, 14 nt, Human
agcccugguggcag

SEQ ID NO: 2352071 - RNA, 16 nt, Human
agcccuggcugaagga

SEQ ID NO: 2352072 - RNA, 18 nt, Human
agcccuggcugaaggacu

SEQ ID NO: 2352073 - RNA, 20 nt, Human
agcccuggcugaaggacugu

SEQ ID NO: 2352074 - RNA, 21 nt, Human
agcccuggcugaaggacugug

SEQ ID NO: 2352075 - RNA, 15 nt, Human
agcccugguggcagu

SEQ ID NO: 2352076 - RNA, 16 nt, Human
agcccugguggcagug

SEQ ID NO: 2352077 - RNA, 17 nt, Human
agcccuggccagaggcu

SEQ ID NO: 2352078 - RNA, 14 nt, Human
agcccuggcucugc

SEQ ID NO: 2352079 - RNA, 15 nt, Human
agcccuggcucugca

SEQ ID NO: 2352080 - RNA, 12 nt, Human
agcccuggcuga

SEQ ID NO: 2352081 - RNA, 13 nt, Human
agcccuggcugaa

SEQ ID NO: 2352082 - RNA, 15 nt, Human
agcccuggcugaagg

SEQ ID NO: 2352083 - RNA, 16 nt, Human
agcccuggccagaggc

SEQ ID NO: 2352084 - RNA, 15 nt, Human
agcccuggccagagg

SEQ ID NO: 2352085 - RNA, 14 nt, Human
agcccuggccagag

SEQ ID NO: 2352086 - RNA, 23 nt, Human
agcccuggauuucagaaagagca

SEQ ID NO: 2352087 - RNA, 21 nt, Human
agcccuggcaggaugacccug

SEQ ID NO: 2352088 - RNA, 13 nt, Human
agcccuggccaga

SEQ ID NO: 2352089 - RNA, 17 nt, Human
agcccuggcaggaugac

SEQ ID NO: 2352090 - RNA, 13 nt, Human
agcccuggcagga

SEQ ID NO: 2352091 - RNA, 12 nt, Human
agcccuggcagg

SEQ ID NO: 2352092 - RNA, 17 nt, Human
agcccugcuggccgccu

SEQ ID NO: 2352093 - RNA, 21 nt, Human
agcccugcuggccgccucacc

SEQ ID NO: 2352094 - RNA, 19 nt, Human
agcccugcuuugggcugcc

SEQ ID NO: 2352095 - RNA, 20 nt, Human
agcccugcuuugggcugccc

SEQ ID NO: 2352096 - RNA, 17 nt, Human
agcccugcuuugggcug

SEQ ID NO: 2352097 - RNA, 12 nt, Human
agcccugcuggc

SEQ ID NO: 2352098 - RNA, 13 nt, Human
agcccugcuggcc

SEQ ID NO: 2352099 - RNA, 16 nt, Human
agcccugcuggccgcc

SEQ ID NO: 2352100 - RNA, 13 nt, Human
agcccggcugguu

SEQ ID NO: 2352101 - RNA, 15 nt, Human
agcccggcucccacc

SEQ ID NO: 2352102 - RNA, 15 nt, Human
agcccggcugguuuu

SEQ ID NO: 2352103 - RNA, 23 nt, Human
agcccagggagcggaaagcagcu

SEQ ID NO: 2352104 - RNA, 22 nt, Human
agcccagggagcggaaagcagc

SEQ ID NO: 2352105 - RNA, 21 nt, Human
agcccagggagcggaaagcag

SEQ ID NO: 2352106 - RNA, 20 nt, Human
agcccagggagcggaaagca

SEQ ID NO: 2352107 - RNA, 19 nt, Human
agcccagggagcggaaagc

SEQ ID NO: 2352108 - RNA, 18 nt, Human
agcccagggagcggaaag

SEQ ID NO: 2352109 - RNA, 21 nt, Human
agcccaggccuccuacagcuu

SEQ ID NO: 2352110 - RNA, 21 nt, Human
agcccaggcgggagcgguggc

SEQ ID NO: 2352111 - RNA, 19 nt, Human
agcccaggaguuugaggcu

SEQ ID NO: 2352112 - RNA, 11 nt, Human
agcccaggagu

SEQ ID NO: 2352113 - RNA, 10 nt, Human
agcccagggu

SEQ ID NO: 2352114 - RNA, 17 nt, Human
agcccagggcuccugca

SEQ ID NO: 2352115 - RNA, 23 nt, Human
agcccagggcuccugcacuuacu

SEQ ID NO: 2352116 - RNA, 14 nt, Human
agcccagggcuccu

SEQ ID NO: 2352117 - RNA, 15 nt, Human
agcccagggcuccug

SEQ ID NO: 2352118 - RNA, 16 nt, Human
agcccagggcuccugc

SEQ ID NO: 2352119 - RNA, 19 nt, Human
agcccauggcccucccagu

SEQ ID NO: 2352120 - RNA, 14 nt, Human
agcccauucauucc

SEQ ID NO: 2352121 - RNA, 15 nt, Human
agcccauucucucuc

SEQ ID NO: 2352122 - RNA, 23 nt, Human
agcccauucauuccauucuggaa

SEQ ID NO: 2352123 - RNA, 22 nt, Human
agcccauucauuccauucugga

SEQ ID NO: 2352124 - RNA, 17 nt, Human
agcccauucauuccauu

SEQ ID NO: 2352125 - RNA, 19 nt, Human
agcccauucucucuccugu

SEQ ID NO: 2352126 - RNA, 18 nt, Human
agcccauucucucuccug

SEQ ID NO: 2352127 - RNA, 17 nt, Human
agcccauucucucuccu

SEQ ID NO: 2352128 - RNA, 16 nt, Human
agcccauucucucucc

SEQ ID NO: 2352129 - RNA, 21 nt, Human
agcccauucucucuccugucc

SEQ ID NO: 2352130 - RNA, 20 nt, Human
agcccauucucucuccuguc

SEQ ID NO: 2352131 - RNA, 22 nt, Human
agcccauucucucuccugucca

SEQ ID NO: 2352132 - RNA, 13 nt, Human
agcccauuucaau

SEQ ID NO: 2352133 - RNA, 16 nt, Human
agccccaaaacucucc

SEQ ID NO: 2352134 - RNA, 17 nt, Human
agccccaaaacucuccu

SEQ ID NO: 2352135 - RNA, 20 nt, Human
agccccauucugccugccca

SEQ ID NO: 2352136 - RNA, 18 nt, Human
agccccaaaacucuccuc

SEQ ID NO: 2352137 - RNA, 21 nt, Human
agccccauucugccugcccag

SEQ ID NO: 2352138 - RNA, 22 nt, Human
agccccauucugccugcccagg

SEQ ID NO: 2352139 - RNA, 16 nt, Human
ugcaagugacaucucu

SEQ ID NO: 2352140 - RNA, 13 nt, Human
ugcaagugaaggu

SEQ ID NO: 2352141 - RNA, 18 nt, Human
ugcaagugaagguuuaca

SEQ ID NO: 2352142 - RNA, 16 nt, Human
ugcaagucauggcugu

SEQ ID NO: 2352143 - RNA, 17 nt, Human
ugcaagugucugugugc

SEQ ID NO: 2352144 - RNA, 16 nt, Human
ugcaagugucugugug

SEQ ID NO: 2352145 - RNA, 21 nt, Human
ugcaaguguaugcacgugugc

SEQ ID NO: 2352146 - RNA, 21 nt, Human
ugcaagugguagcaagaagug

SEQ ID NO: 2352147 - RNA, 18 nt, Human
ugcaagugucugugugca

SEQ ID NO: 2352148 - RNA, 19 nt, Human
ugcaauaaaucugacccag

SEQ ID NO: 2352149 - RNA, 20 nt, Human
ugcaauaaaucugacccagu

SEQ ID NO: 2352150 - RNA, 23 nt, Human
ugcaauaaaucugacccagugcc

SEQ ID NO: 2352151 - RNA, 21 nt, Human
ugcaauaaaucugacccagug

SEQ ID NO: 2352152 - RNA, 21 nt, Human
ugcaauaagaauuuagggaga

SEQ ID NO: 2352153 - RNA, 14 nt, Human
ugcaauaauacuuc

SEQ ID NO: 2352154 - RNA, 20 nt, Human
ugcaauagaacagagaaaga

SEQ ID NO: 2352155 - RNA, 18 nt, Human
ugcaauauaucuaaauug

SEQ ID NO: 2352156 - RNA, 19 nt, Human
ugcaauauaucuaaauuga

SEQ ID NO: 2352157 - RNA, 20 nt, Human
ugcaauauaucuaaauugaa

SEQ ID NO: 2352158 - RNA, 21 nt, Human
ugcaauauaucuaaauugaau

SEQ ID NO: 2352159 - RNA, 18 nt, Human
agcccaggagagagaaag

SEQ ID NO: 2352160 - RNA, 19 nt, Human
agcccaggagagagaaagc

SEQ ID NO: 2352161 - RNA, 12 nt, Human
agcccaggagga

SEQ ID NO: 2352162 - RNA, 17 nt, Human
agcccaggaggacugcc

SEQ ID NO: 2352163 - RNA, 22 nt, Human
agcccaggagagagaaagccag

SEQ ID NO: 2352164 - RNA, 19 nt, Human
ugauuuguuuuccucuuaa

SEQ ID NO: 2352165 - RNA, 18 nt, Human
ugauuuguacugaaaaau

SEQ ID NO: 2352166 - RNA, 15 nt, Human
ugauuuguacugaaa

SEQ ID NO: 2352167 - RNA, 21 nt, Human
ugcaaaccaucauugaaaucu

SEQ ID NO: 2352168 - RNA, 22 nt, Human
ugcaaaccugaccccugcucag

SEQ ID NO: 2352169 - RNA, 22 nt, Human
ugauuuuaaaccauaaaaagcu

SEQ ID NO: 2352170 - RNA, 16 nt, Human
ugcaaacgcugccugc

SEQ ID NO: 2352171 - RNA, 15 nt, Human
ugcaaacgcugccug

SEQ ID NO: 2352172 - RNA, 14 nt, Human
ugcaaacgcugccu

SEQ ID NO: 2352173 - RNA, 23 nt, Human
ugcaaaccugaccccugcucagu

SEQ ID NO: 2352174 - RNA, 15 nt, Human
ugcaaguaugugagu

SEQ ID NO: 2352175 - RNA, 16 nt, Human
ugcaaacucacugcuc

SEQ ID NO: 2352176 - RNA, 21 nt, Human
ugcaaacgcugccugccggua

SEQ ID NO: 2352177 - RNA, 21 nt, Human
ugcaaacgcugccugcccgua

SEQ ID NO: 2352178 - RNA, 19 nt, Human
ugcaaacgcugccugccca

SEQ ID NO: 2352179 - RNA, 17 nt, Human
ugcaaacgcugccugcc

SEQ ID NO: 2352180 - RNA, 21 nt, Human
ugcaaguauguuuuagcaugu

SEQ ID NO: 2352181 - RNA, 19 nt, Human
ugcaaguauguuuuagcau

SEQ ID NO: 2352182 - RNA, 22 nt, Human
ugcaaguaugugagugugucca

SEQ ID NO: 2352183 - RNA, 18 nt, Human
ugcaaguaugugagugug

SEQ ID NO: 2352184 - RNA, 13 nt, Human
ugcaagucagagg

SEQ ID NO: 2352185 - RNA, 22 nt, Human
ugcaaguauguuuuagcaugug

SEQ ID NO: 2352186 - RNA, 14 nt, Human
ugcaagucagagga

SEQ ID NO: 2352187 - RNA, 15 nt, Human
ugcaagucagaggau

SEQ ID NO: 2352188 - RNA, 16 nt, Human
ugcaagucagaggaug

SEQ ID NO: 2352189 - RNA, 23 nt, Human
ugcaagucaguccaggaugcuaa

SEQ ID NO: 2352190 - RNA, 21 nt, Human
ugcaagucagaggauggccag

SEQ ID NO: 2352191 - RNA, 14 nt, Human
ugcaagucauggcu

SEQ ID NO: 2352192 - RNA, 18 nt, Human
agccagcccagcccagcu

SEQ ID NO: 2352193 - RNA, 17 nt, Human
agccagcccagcccagc

SEQ ID NO: 2352194 - RNA, 16 nt, Human
agccagcccagcccag

SEQ ID NO: 2352195 - RNA, 15 nt, Human
agccagcccagccca

SEQ ID NO: 2352196 - RNA, 14 nt, Human
agccagcccagccc

SEQ ID NO: 2352197 - RNA, 12 nt, Human
agccagcccagc

SEQ ID NO: 2352198 - RNA, 21 nt, Human
agccagagaagugacagggaa

SEQ ID NO: 2352199 - RNA, 23 nt, Human
agccagcccucccuguccuccuc

SEQ ID NO: 2352200 - RNA, 22 nt, Human
agccagcccucccuguccuccu

SEQ ID NO: 2352201 - RNA, 20 nt, Human
agccagcccucccuguccuc

SEQ ID NO: 2352202 - RNA, 18 nt, Human
agccagcccucccugucc

SEQ ID NO: 2352203 - RNA, 16 nt, Human
agccagcccucccugu

SEQ ID NO: 2352204 - RNA, 15 nt, Human
agccagcccucccug

SEQ ID NO: 2352205 - RNA, 13 nt, Human
agccagcccuccc

SEQ ID NO: 2352206 - RNA, 12 nt, Human
agccagcccucc

SEQ ID NO: 2352207 - RNA, 18 nt, Human
agccagccuucuuccauc

SEQ ID NO: 2352208 - RNA, 21 nt, Human
agccagccuucuuccauccca

SEQ ID NO: 2352209 - RNA, 10 nt, Human
agccagagga

SEQ ID NO: 2352210 - RNA, 11 nt, Human
agccagaggag

SEQ ID NO: 2352211 - RNA, 20 nt, Human
agccacugcaccgggccaca

SEQ ID NO: 2352212 - RNA, 11 nt, Human
agccagagaag

SEQ ID NO: 2352213 - RNA, 14 nt, Human
agccagagaaguga

SEQ ID NO: 2352214 - RNA, 15 nt, Human
agccagagaagugac

SEQ ID NO: 2352215 - RNA, 16 nt, Human
agccagagaagugaca

SEQ ID NO: 2352216 - RNA, 17 nt, Human
agccagagaagugacag

SEQ ID NO: 2352217 - RNA, 18 nt, Human
agccagagaagugacagg

SEQ ID NO: 2352218 - RNA, 19 nt, Human
agccagagaagugacaggg

SEQ ID NO: 2352219 - RNA, 18 nt, Human
agccacugcaccgggcca

SEQ ID NO: 2352220 - RNA, 19 nt, Human
agccacugcaccgggccac

SEQ ID NO: 2352221 - RNA, 19 nt, Human
ugauuaaccacuucagcug

SEQ ID NO: 2352222 - RNA, 18 nt, Human
ugauuaaguaaugauaac

SEQ ID NO: 2352223 - RNA, 17 nt, Human
ugauggugaugaaaugu

SEQ ID NO: 2352224 - RNA, 20 nt, Human
ugauuaaauucuugcaaagu

SEQ ID NO: 2352225 - RNA, 15 nt, Human
ugauggugaugaaau

SEQ ID NO: 2352226 - RNA, 16 nt, Human
ugauggugaugaaaug

SEQ ID NO: 2352227 - RNA, 13 nt, Human
ugauggugcaaug

SEQ ID NO: 2352228 - RNA, 19 nt, Human
ugauuaaauucuugcaaag

SEQ ID NO: 2352229 - RNA, 15 nt, Human
ugauggugcaaugac

SEQ ID NO: 2352230 - RNA, 17 nt, Human
ugauuaauccagaauaa

SEQ ID NO: 2352231 - RNA, 13 nt, Human
ugauuaauccaga

SEQ ID NO: 2352232 - RNA, 16 nt, Human
ugauuaauccagaaua

SEQ ID NO: 2352233 - RNA, 23 nt, Human
ugauuaaguaaugauaacuggaa

SEQ ID NO: 2352234 - RNA, 21 nt, Human
agccacguuccuuacugcaga

SEQ ID NO: 2352235 - RNA, 20 nt, Human
agccacguuccuuacugcag

SEQ ID NO: 2352236 - RNA, 18 nt, Human
agccacguuccuuacugc

SEQ ID NO: 2352237 - RNA, 17 nt, Human
agccacguuccuuacug

SEQ ID NO: 2352238 - RNA, 17 nt, Human
ugauuaauggaaauguu

SEQ ID NO: 2352239 - RNA, 15 nt, Human
agccacgguguucug

SEQ ID NO: 2352240 - RNA, 16 nt, Human
agccacugcaccgggc

SEQ ID NO: 2352241 - RNA, 12 nt, Human
agccacuccucu

SEQ ID NO: 2352242 - RNA, 23 nt, Human
agccacguuccuuacugcagaau

SEQ ID NO: 2352243 - RNA, 22 nt, Human
agccacguuccuuacugcagaa

SEQ ID NO: 2352244 - RNA, 13 nt, Human
agccacuaacuag

SEQ ID NO: 2352245 - RNA, 22 nt, Human
agccacucaggaggcugaggca

SEQ ID NO: 2352246 - RNA, 15 nt, Human
agccacucaggaggc

SEQ ID NO: 2352247 - RNA, 14 nt, Human
agccacuaacuaga

SEQ ID NO: 2352248 - RNA, 14 nt, Human
ugaugacagacacu

SEQ ID NO: 2352249 - RNA, 20 nt, Human
ugaugaagaaaagugggcca

SEQ ID NO: 2352250 - RNA, 17 nt, Human
ugaugacaguaguacca

SEQ ID NO: 2352251 - RNA, 15 nt, Human
ugaugacagagcgag

SEQ ID NO: 2352252 - RNA, 14 nt, Human
ugaugaccaaaguc

SEQ ID NO: 2352253 - RNA, 18 nt, Human
ugaugaagaaaagugggc

SEQ ID NO: 2352254 - RNA, 23 nt, Human
ugaugaacuuucucuucauacuu

SEQ ID NO: 2352255 - RNA, 14 nt, Human
ugaugaacuuucuc

SEQ ID NO: 2352256 - RNA, 15 nt, Human
ugaugaacuuucucu

SEQ ID NO: 2352257 - RNA, 18 nt, Human
ugaugaacucuuaaucaa

SEQ ID NO: 2352258 - RNA, 17 nt, Human
ugaugaacuuauucugu

SEQ ID NO: 2352259 - RNA, 13 nt, Human
ugaugaacuuucu

SEQ ID NO: 2352260 - RNA, 18 nt, Human
ugauccuggaggcccagu

SEQ ID NO: 2352261 - RNA, 17 nt, Human
ugauccuggaggcccag

SEQ ID NO: 2352262 - RNA, 16 nt, Human
ugauccuggaggccca

SEQ ID NO: 2352263 - RNA, 11 nt, Human
ugaugaagaag

SEQ ID NO: 2352264 - RNA, 12 nt, Human
ugaugaagaagu

SEQ ID NO: 2352265 - RNA, 11 nt, Human
agcaccugccg

SEQ ID NO: 2352266 - RNA, 20 nt, Human
agcaccugccgaccucgucc

SEQ ID NO: 2352267 - RNA, 19 nt, Human
agcaccugccgaccucguc

SEQ ID NO: 2352268 - RNA, 16 nt, Human
agcaccugccgaccuc

SEQ ID NO: 2352269 - RNA, 15 nt, Human
agcaccugccgaccu

SEQ ID NO: 2352270 - RNA, 16 nt, Human
ugauccuaguuccacc

SEQ ID NO: 2352271 - RNA, 15 nt, Human
ugauccucccaccuc

SEQ ID NO: 2352272 - RNA, 22 nt, Human
agcaccugccgaccucguccuc

SEQ ID NO: 2352273 - RNA, 18 nt, Human
ugauccucauauggccca

SEQ ID NO: 2352274 - RNA, 22 nt, Human
ugauccuaaugaaugcauaaaa

SEQ ID NO: 2352275 - RNA, 21 nt, Human
agcaccugccgaccucguccu

SEQ ID NO: 2352276 - RNA, 17 nt, Human
ugauccuccaacuucau

SEQ ID NO: 2352277 - RNA, 15 nt, Human
ugauccuggaggccc

SEQ ID NO: 2352278 - RNA, 14 nt, Human
ugauccuggaggcc

SEQ ID NO: 2352279 - RNA, 22 nt, Human
ugauccucccaccucagccucc

SEQ ID NO: 2352280 - RNA, 16 nt, Human
ugauccucccaccuca

SEQ ID NO: 2352281 - RNA, 21 nt, Human
ugauccucccaccucagccuc

SEQ ID NO: 2352282 - RNA, 18 nt, Human
ugaugcuuucagauuaaa

SEQ ID NO: 2352283 - RNA, 23 nt, Human
ugaugcuucuucagagacuccug

SEQ ID NO: 2352284 - RNA, 18 nt, Human
ugauggaaauauuuauuu

SEQ ID NO: 2352285 - RNA, 20 nt, Human
ugauggacccaaugcacaca

SEQ ID NO: 2352286 - RNA, 14 nt, Human
ugaugggaaagcau

SEQ ID NO: 2352287 - RNA, 13 nt, Human
ugaugagaggaaa

SEQ ID NO: 2352288 - RNA, 14 nt, Human
ugaugagaggaaau

SEQ ID NO: 2352289 - RNA, 15 nt, Human
ugaugagaggaaauc

SEQ ID NO: 2352290 - RNA, 16 nt, Human
ugaugagaggaaauca

SEQ ID NO: 2352291 - RNA, 14 nt, Human
ugauggggcccugc

SEQ ID NO: 2352292 - RNA, 15 nt, Human
ugauggggcccugcc

SEQ ID NO: 2352293 - RNA, 16 nt, Human
ugauggggcccugccu

SEQ ID NO: 2352294 - RNA, 19 nt, Human
ugauggggcccugccuccu

SEQ ID NO: 2352295 - RNA, 14 nt, Human
ugaugggauuuggu

SEQ ID NO: 2352296 - RNA, 19 nt, Human
ugaugggaaagcauuguaa

SEQ ID NO: 2352297 - RNA, 15 nt, Human
ugauggagcagagca

SEQ ID NO: 2352298 - RNA, 18 nt, Human
ugauggagguuucauacu

SEQ ID NO: 2352299 - RNA, 21 nt, Human
ugauggagguuucauacucua

SEQ ID NO: 2352300 - RNA, 19 nt, Human
ugaugggagaguagauggu

SEQ ID NO: 2352301 - RNA, 22 nt, Human
agccagggcuaugggagcagcu

SEQ ID NO: 2352302 - RNA, 12 nt, Human
agccagggccag

SEQ ID NO: 2352303 - RNA, 13 nt, Human
agccagggccagg

SEQ ID NO: 2352304 - RNA, 14 nt, Human
agccagggccaggg

SEQ ID NO: 2352305 - RNA, 17 nt, Human
agccagggccagggguc

SEQ ID NO: 2352306 - RNA, 11 nt, Human
agccagggcug

SEQ ID NO: 2352307 - RNA, 23 nt, Human
agccagggcuaugggagcagcuu

SEQ ID NO: 2352308 - RNA, 12 nt, Human
agccagggcugc

SEQ ID NO: 2352309 - RNA, 13 nt, Human
agccaggugccuu

SEQ ID NO: 2352310 - RNA, 14 nt, Human
agccagggcugcua

SEQ ID NO: 2352311 - RNA, 21 nt, Human
agccagggcugcuagacggag

SEQ ID NO: 2352312 - RNA, 18 nt, Human
agccaggugccuuggagg

SEQ ID NO: 2352313 - RNA, 16 nt, Human
agccaguaaacagagg

SEQ ID NO: 2352314 - RNA, 14 nt, Human
agccaggugccuug

SEQ ID NO: 2352315 - RNA, 16 nt, Human
agccaggugccuugga

SEQ ID NO: 2352316 - RNA, 17 nt, Human
agccaggugccuuggag

SEQ ID NO: 2352317 - RNA, 13 nt, Human
agccaguaaaugg

SEQ ID NO: 2352318 - RNA, 14 nt, Human
agccaucccagccu

SEQ ID NO: 2352319 - RNA, 17 nt, Human
agccaucccagccuugg

SEQ ID NO: 2352320 - RNA, 18 nt, Human
agccaucccagccuuggc

SEQ ID NO: 2352321 - RNA, 19 nt, Human
agccaucccagccuuggca

SEQ ID NO: 2352322 - RNA, 13 nt, Human
agccaucauggau

SEQ ID NO: 2352323 - RNA, 18 nt, Human
agccaucauaggaaggga

SEQ ID NO: 2352324 - RNA, 21 nt, Human
agccaguaaaugggggugcau

SEQ ID NO: 2352325 - RNA, 18 nt, Human
agccaucaaaaugcuuuu

SEQ ID NO: 2352326 - RNA, 18 nt, Human
agccaguaaacagaggag

SEQ ID NO: 2352327 - RNA, 18 nt, Human
agccaucaacaagaguug

SEQ ID NO: 2352328 - RNA, 22 nt, Human
agccagcgggaauggcagcugc

SEQ ID NO: 2352329 - RNA, 16 nt, Human
agccagcguccuccuc

SEQ ID NO: 2352330 - RNA, 21 nt, Human
agccagcguccuccucuguga

SEQ ID NO: 2352331 - RNA, 19 nt, Human
agccagcguccuccucugu

SEQ ID NO: 2352332 - RNA, 18 nt, Human
agccagcguccuccucug

SEQ ID NO: 2352333 - RNA, 17 nt, Human
agccagcguccuccucu

SEQ ID NO: 2352334 - RNA, 19 nt, Human
agccagcucccucuauuua

SEQ ID NO: 2352335 - RNA, 17 nt, Human
agccagcucccucuauu

SEQ ID NO: 2352336 - RNA, 15 nt, Human
agccagcucccucua

SEQ ID NO: 2352337 - RNA, 14 nt, Human
agccagcucccucu

SEQ ID NO: 2352338 - RNA, 23 nt, Human
agccagcguccuccucugugacc

SEQ ID NO: 2352339 - RNA, 23 nt, Human
agccagccuucuuccaucccagg

SEQ ID NO: 2352340 - RNA, 15 nt, Human
agccagcucauuuca

SEQ ID NO: 2352341 - RNA, 20 nt, Human
agccaggcugccaaggccag

SEQ ID NO: 2352342 - RNA, 16 nt, Human
agccaggcucugugcu

SEQ ID NO: 2352343 - RNA, 17 nt, Human
agccaggcucugugcug

SEQ ID NO: 2352344 - RNA, 14 nt, Human
agccaggcucugug

SEQ ID NO: 2352345 - RNA, 16 nt, Human
agccagcucucagcca

SEQ ID NO: 2352346 - RNA, 15 nt, Human
agccagcucucagcc

SEQ ID NO: 2352347 - RNA, 14 nt, Human
agccagcucucagc

SEQ ID NO: 2352348 - RNA, 13 nt, Human
agccagcucucag

SEQ ID NO: 2352349 - RNA, 22 nt, Human
agccagcucccucuauuuaugu

SEQ ID NO: 2352350 - RNA, 11 nt, Human
agccagggcca

SEQ ID NO: 2352351 - RNA, 21 nt, Human
agccaggcugccaaggccaga

SEQ ID NO: 2352352 - RNA, 21 nt, Human
agccaggcucugugcugaccc

SEQ ID NO: 2352353 - RNA, 22 nt, Human
agccaucucucuacuccuaccu

SEQ ID NO: 2352354 - RNA, 19 nt, Human
agccaucccaugaacacac

SEQ ID NO: 2352355 - RNA, 14 nt, Human
agccaucugcccag

SEQ ID NO: 2352356 - RNA, 22 nt, Human
agccaucggugaaacuaacaga

SEQ ID NO: 2352357 - RNA, 22 nt, Human
agccaucuccaucuugaaggaa

SEQ ID NO: 2352358 - RNA, 15 nt, Human
agccaucugcccagg

SEQ ID NO: 2352359 - RNA, 16 nt, Human
agccaucugcccaggg

SEQ ID NO: 2352360 - RNA, 18 nt, Human
agccaucugcccaggggu

SEQ ID NO: 2352361 - RNA, 19 nt, Human
agccaucugcccaggggug

SEQ ID NO: 2352362 - RNA, 15 nt, Human
agccaucuugguaaa

SEQ ID NO: 2352363 - RNA, 17 nt, Human
agccaucuugguaaauu

SEQ ID NO: 2352364 - RNA, 19 nt, Human
agccaucuugguaaauuuc

SEQ ID NO: 2352365 - RNA, 17 nt, Human
agccaugaccuuacauu

SEQ ID NO: 2352366 - RNA, 20 nt, Human
agccaugacuugagaaacaa

SEQ ID NO: 2352367 - RNA, 18 nt, Human
agccaugaccuuacauuu

SEQ ID NO: 2352368 - RNA, 21 nt, Human
agccaugagaugauacaucca

SEQ ID NO: 2352369 - RNA, 20 nt, Human
agccaugaggaguugcuguu

SEQ ID NO: 2352370 - RNA, 19 nt, Human
agccaugaggaguugcugu

SEQ ID NO: 2352371 - RNA, 18 nt, Human
agccaugaggaguugcug

SEQ ID NO: 2352372 - RNA, 18 nt, Human
agccaugauaacugcaau

SEQ ID NO: 2352373 - RNA, 23 nt, Human
agccaugauguggaguggggcag

SEQ ID NO: 2352374 - RNA, 16 nt, Human
agccaugcgcccccuc

SEQ ID NO: 2352375 - RNA, 23 nt, Human
agccaugcgcccccuccgcccug

SEQ ID NO: 2352376 - RNA, 18 nt, Human
agccauggacucuacacu

SEQ ID NO: 2352377 - RNA, 12 nt, Human
agccaugggacc

SEQ ID NO: 2352378 - RNA, 15 nt, Human
agccaugcugggaag

SEQ ID NO: 2352379 - RNA, 19 nt, Human
agccaugcugggaagacgc

SEQ ID NO: 2352380 - RNA, 14 nt, Human
agcccacuguacuu

SEQ ID NO: 2352381 - RNA, 16 nt, Human
agcccacuguacuugc

SEQ ID NO: 2352382 - RNA, 14 nt, Human
agcccacuguccug

SEQ ID NO: 2352383 - RNA, 17 nt, Human
agccaugggaccaaacc

SEQ ID NO: 2352384 - RNA, 19 nt, Human
agcccacugcccacccccu

SEQ ID NO: 2352385 - RNA, 20 nt, Human
agcccacugcccacccccuc

SEQ ID NO: 2352386 - RNA, 13 nt, Human
agccaugggacca

SEQ ID NO: 2352387 - RNA, 15 nt, Human
agccaugggaccaaa

SEQ ID NO: 2352388 - RNA, 16 nt, Human
agccaugggaccaaac

SEQ ID NO: 2352389 - RNA, 23 nt, Human
agcccacuguccugggccugcag

SEQ ID NO: 2352390 - RNA, 13 nt, Human
agcccagagguaa

SEQ ID NO: 2352391 - RNA, 22 nt, Human
agcccacuguccugggccugca

SEQ ID NO: 2352392 - RNA, 20 nt, Human
agcccacuguccugggccug

SEQ ID NO: 2352393 - RNA, 16 nt, Human
agcccagaggagggca

SEQ ID NO: 2352394 - RNA, 20 nt, Human
agcccagagguaacagaaca

SEQ ID NO: 2352395 - RNA, 21 nt, Human
agcccagagguaacagaacag

SEQ ID NO: 2352396 - RNA, 15 nt, Human
agcccagagguaaca

SEQ ID NO: 2352397 - RNA, 16 nt, Human
agcccagagguaacag

SEQ ID NO: 2352398 - RNA, 17 nt, Human
agcccagagguaacaga

SEQ ID NO: 2352399 - RNA, 18 nt, Human
agcccagagguaacagaa

SEQ ID NO: 2352400 - RNA, 15 nt, Human
agcccagcacugcuu

SEQ ID NO: 2352401 - RNA, 16 nt, Human
agcccagaucagcucc

SEQ ID NO: 2352402 - RNA, 17 nt, Human
agcccagaucagcuccu

SEQ ID NO: 2352403 - RNA, 18 nt, Human
agcccagaucagcuccua

SEQ ID NO: 2352404 - RNA, 22 nt, Human
agcccagauguuuuacgucugg

SEQ ID NO: 2352405 - RNA, 13 nt, Human
agcccacuucugc

SEQ ID NO: 2352406 - RNA, 19 nt, Human
agcccacuguccugggccu

SEQ ID NO: 2352407 - RNA, 18 nt, Human
agcccacuguccugggcc

SEQ ID NO: 2352408 - RNA, 17 nt, Human
agcccacuguccugggc

SEQ ID NO: 2352409 - RNA, 15 nt, Human
agcccacuguccugg

SEQ ID NO: 2352410 - RNA, 14 nt, Human
agcccacuucugcc

SEQ ID NO: 2352411 - RNA, 15 nt, Human
agcccacuucugcca

SEQ ID NO: 2352412 - RNA, 21 nt, Human
ugauuucagcaccuacagugu

SEQ ID NO: 2352413 - RNA, 17 nt, Human
ugauuucagcucacugc

SEQ ID NO: 2352414 - RNA, 20 nt, Human
ugauuucagcaccuacagug

SEQ ID NO: 2352415 - RNA, 22 nt, Human
ugauuuaguguuuuuaccucug

SEQ ID NO: 2352416 - RNA, 22 nt, Human
ugauuuaggagaagccaggaau

SEQ ID NO: 2352417 - RNA, 21 nt, Human
ugauuuaggagaagccaggaa

SEQ ID NO: 2352418 - RNA, 21 nt, Human
ugauuuagaacuguaugucag

SEQ ID NO: 2352419 - RNA, 16 nt, Human
ugauuuacgcucauug

SEQ ID NO: 2352420 - RNA, 20 nt, Human
ugauuuaggagaagccagga

SEQ ID NO: 2352421 - RNA, 16 nt, Human
ugauuuaggagaagcc

SEQ ID NO: 2352422 - RNA, 23 nt, Human
ugauuucaggauacucugucaga

SEQ ID NO: 2352423 - RNA, 18 nt, Human
ugauuucaggauacucug

SEQ ID NO: 2352424 - RNA, 11 nt, Human
ugauuucagga

SEQ ID NO: 2352425 - RNA, 19 nt, Human
ugauuucaggauacucugu

SEQ ID NO: 2352426 - RNA, 18 nt, Human
ugauuuccguuaaaauac

SEQ ID NO: 2352427 - RNA, 15 nt, Human
ugauuucauuaauac

SEQ ID NO: 2352428 - RNA, 22 nt, Human
ugauuuccguuaaaauaccagc

SEQ ID NO: 2352429 - RNA, 17 nt, Human
ugauuucugccuuccuu

SEQ ID NO: 2352430 - RNA, 19 nt, Human
ugauuucuucuguuuucug

SEQ ID NO: 2352431 - RNA, 15 nt, Human
ugauuucuuuccaga

SEQ ID NO: 2352432 - RNA, 16 nt, Human
ugauuucuuuccagag

SEQ ID NO: 2352433 - RNA, 17 nt, Human
ugauuuggggauauuuu

SEQ ID NO: 2352434 - RNA, 19 nt, Human
ugauuugaagaacauguga

SEQ ID NO: 2352435 - RNA, 17 nt, Human
ugauuugaagaacaugu

SEQ ID NO: 2352436 - RNA, 20 nt, Human
ugauuuggugaccaacuguc

SEQ ID NO: 2352437 - RNA, 19 nt, Human
ugauuuggugaccaacugu

SEQ ID NO: 2352438 - RNA, 13 nt, Human
ugauuuggugacc

SEQ ID NO: 2352439 - RNA, 23 nt, Human
ugauuuccuugaauguggcuuga

SEQ ID NO: 2352440 - RNA, 19 nt, Human
ugauuuccuugaauguggc

SEQ ID NO: 2352441 - RNA, 17 nt, Human
ugauuuccuugaaugug

SEQ ID NO: 2352442 - RNA, 16 nt, Human
ugauuuccuugaaugu

SEQ ID NO: 2352443 - RNA, 15 nt, Human
ugauuuccuugaaug

SEQ ID NO: 2352444 - RNA, 14 nt, Human
ugauuuccuugaau

SEQ ID NO: 2352445 - RNA, 13 nt, Human
ugauuuccuugaa

SEQ ID NO: 2352446 - RNA, 17 nt, Human
ugauuucuagaaagccu

SEQ ID NO: 2352447 - RNA, 13 nt, Human
ugauuucuauuca

SEQ ID NO: 2352448 - RNA, 14 nt, Human
ugauuucuauucaa

SEQ ID NO: 2352449 - RNA, 20 nt, Human
ugauuucuauucaagguggc

SEQ ID NO: 2352450 - RNA, 13 nt, Human
ugauucuccugcc

SEQ ID NO: 2352451 - RNA, 16 nt, Human
ugauucucaugccuca

SEQ ID NO: 2352452 - RNA, 13 nt, Human
ugauuuacaguuu

SEQ ID NO: 2352453 - RNA, 15 nt, Human
ugauuuacaguuuca

SEQ ID NO: 2352454 - RNA, 17 nt, Human
ugauuuacaguuucaaa

SEQ ID NO: 2352455 - RNA, 15 nt, Human
ugauucucaugccuc

SEQ ID NO: 2352456 - RNA, 14 nt, Human
ugauucucaugccu

SEQ ID NO: 2352457 - RNA, 13 nt, Human
ugauucucaugcc

SEQ ID NO: 2352458 - RNA, 12 nt, Human
ugauuccuuccu

SEQ ID NO: 2352459 - RNA, 21 nt, Human
ugauucucagggucucugcug

SEQ ID NO: 2352460 - RNA, 22 nt, Human
ugauucucagggucucugcugc

SEQ ID NO: 2352461 - RNA, 23 nt, Human
ugauucucagggucucugcugcc

SEQ ID NO: 2352462 - RNA, 17 nt, Human
ugauucccuccugcuac

SEQ ID NO: 2352463 - RNA, 19 nt, Human
ugauucauaguaacuucuu

SEQ ID NO: 2352464 - RNA, 19 nt, Human
ugauucaugccaauuagca

SEQ ID NO: 2352465 - RNA, 18 nt, Human
ugauucccuccugcuacu

SEQ ID NO: 2352466 - RNA, 14 nt, Human
ugauuccuuccugu

SEQ ID NO: 2352467 - RNA, 22 nt, Human
ugauucccaagcucugcuccuc

SEQ ID NO: 2352468 - RNA, 23 nt, Human
ugauucccaagcucugcuccucu

SEQ ID NO: 2352469 - RNA, 20 nt, Human
agcccagcuggugggaagcg

SEQ ID NO: 2352470 - RNA, 18 nt, Human
ugauucauaguaacuucu

SEQ ID NO: 2352471 - RNA, 16 nt, Human
ugauucauaguaacuu

SEQ ID NO: 2352472 - RNA, 21 nt, Human
ugauucauaaugacuuaagca

SEQ ID NO: 2352473 - RNA, 16 nt, Human
ugauucauaaugacuu

SEQ ID NO: 2352474 - RNA, 20 nt, Human
agcccagcagggccucaaag

SEQ ID NO: 2352475 - RNA, 15 nt, Human
agcccagcagggccu

SEQ ID NO: 2352476 - RNA, 21 nt, Human
agcccagcacugcuugaggaa

SEQ ID NO: 2352477 - RNA, 13 nt, Human
agcccagccacgu

SEQ ID NO: 2352478 - RNA, 21 nt, Human
agcccagccauuaccauggag

SEQ ID NO: 2352479 - RNA, 17 nt, Human
agcccagcugggucagg

SEQ ID NO: 2352480 - RNA, 20 nt, Human
agcccagcugggucaggcag

SEQ ID NO: 2352481 - RNA, 19 nt, Human
agcccagcugggucaggca

SEQ ID NO: 2352482 - RNA, 16 nt, Human
agcccagcugguggga

SEQ ID NO: 2352483 - RNA, 13 nt, Human
agcccagcuggug

SEQ ID NO: 2352484 - RNA, 21 nt, Human
agcccagcugggucaggcagg

SEQ ID NO: 2352485 - RNA, 23 nt, Human
agcccagcuugaaaccuucacuu

SEQ ID NO: 2352486 - RNA, 14 nt, Human
agcccaggaaaggc

SEQ ID NO: 2352487 - RNA, 22 nt, Human
uguuugggcagaagggagaagg

SEQ ID NO: 2352488 - RNA, 16 nt, Human
uguuugggcagaaggg

SEQ ID NO: 2352489 - RNA, 19 nt, Human
uguuuuacgucugggagaa

SEQ ID NO: 2352490 - RNA, 19 nt, Human
uguuuggggaugagaaagg

SEQ ID NO: 2352491 - RNA, 15 nt, Human
uguuuggggaugaga

SEQ ID NO: 2352492 - RNA, 19 nt, Human
uguuuggagacauuccugg

SEQ ID NO: 2352493 - RNA, 12 nt, Human
uguuuggagagc

SEQ ID NO: 2352494 - RNA, 15 nt, Human
uguuuggaggagcaa

SEQ ID NO: 2352495 - RNA, 14 nt, Human
uguuugcucucccg

SEQ ID NO: 2352496 - RNA, 23 nt, Human
uguuugcucucccgguucuucca

SEQ ID NO: 2352497 - RNA, 15 nt, Human
uguuuggagacauuc

SEQ ID NO: 2352498 - RNA, 20 nt, Human
uguuugccuucuacuuuuaa

SEQ ID NO: 2352499 - RNA, 22 nt, Human
uguuugccauacuuugucugaa

SEQ ID NO: 2352500 - RNA, 17 nt, Human
uguuugcuaucuuaauu

SEQ ID NO: 2352501 - RNA, 22 nt, Human
uguuugcaugugaaaaucaaau

SEQ ID NO: 2352502 - RNA, 15 nt, Human
uguuugccauacuuu

SEQ ID NO: 2352503 - RNA, 19 nt, Human
uguuugcuaagcauuccaa

SEQ ID NO: 2352504 - RNA, 14 nt, Human
uguuugccucugcc

SEQ ID NO: 2352505 - RNA, 15 nt, Human
uguuugcaucugaaa

SEQ ID NO: 2352506 - RNA, 16 nt, Human
uguuugccucugccuc

SEQ ID NO: 2352507 - RNA, 15 nt, Human
uguuugcuaagcauu

SEQ ID NO: 2352508 - RNA, 13 nt, Human
uguugucaaagag

SEQ ID NO: 2352509 - RNA, 11 nt, Human
uguugucauug

SEQ ID NO: 2352510 - RNA, 14 nt, Human
uguugucauugcug

SEQ ID NO: 2352511 - RNA, 14 nt, Human
uguugucagcugaa

SEQ ID NO: 2352512 - RNA, 13 nt, Human
uguugucccuucu

SEQ ID NO: 2352513 - RNA, 12 nt, Human
uguugucccuuc

SEQ ID NO: 2352514 - RNA, 15 nt, Human
uguugucauugcugu

SEQ ID NO: 2352515 - RNA, 15 nt, Human
uguuuucucuugaga

SEQ ID NO: 2352516 - RNA, 23 nt, Human
uguuuuccucccuucugcuacug

SEQ ID NO: 2352517 - RNA, 15 nt, Human
uguuuuccuuucuca

SEQ ID NO: 2352518 - RNA, 17 nt, Human
uguuuucaguguacaug

SEQ ID NO: 2352519 - RNA, 22 nt, Human
uguuuuccucccuucugcuacu

SEQ ID NO: 2352520 - RNA, 21 nt, Human
uguuuuccucccuucugcuac

SEQ ID NO: 2352521 - RNA, 14 nt, Human
uguuuuccucccuu

SEQ ID NO: 2352522 - RNA, 19 nt, Human
uguuuuccgugaaaacgga

SEQ ID NO: 2352523 - RNA, 16 nt, Human
uguuuuccgugaaaac

SEQ ID NO: 2352524 - RNA, 16 nt, Human
aguucucuccuucuuc

SEQ ID NO: 2352525 - RNA, 20 nt, Human
aguucucuucacucaaggau

SEQ ID NO: 2352526 - RNA, 21 nt, Human
uguuuucucuggaguauucua

SEQ ID NO: 2352527 - RNA, 16 nt, Human
aguucucucguaacug

SEQ ID NO: 2352528 - RNA, 17 nt, Human
aguucucucguaacugg

SEQ ID NO: 2352529 - RNA, 13 nt, Human
aguucucuccuuc

SEQ ID NO: 2352530 - RNA, 12 nt, Human
aguucucuccuu

SEQ ID NO: 2352531 - RNA, 19 nt, Human
uguuuuagacaaauacuca

SEQ ID NO: 2352532 - RNA, 18 nt, Human
uguuuuacugugaaacug

SEQ ID NO: 2352533 - RNA, 20 nt, Human
uguuuuagacaaauacucau

SEQ ID NO: 2352534 - RNA, 15 nt, Human
uguuuuacugugaaa

SEQ ID NO: 2352535 - RNA, 16 nt, Human
uguuuuacuaaagaaa

SEQ ID NO: 2352536 - RNA, 21 nt, Human
uguuuuacuaaagaaagauua

SEQ ID NO: 2352537 - RNA, 21 nt, Human
uguuuuagacaaauacucaug

SEQ ID NO: 2352538 - RNA, 22 nt, Human
uguuuuagacaaauacucaugu

SEQ ID NO: 2352539 - RNA, 23 nt, Human
uguuuuagacaaauacucaugug

SEQ ID NO: 2352540 - RNA, 24 nt, Human
uguuuuagacaaauacucaugugu

SEQ ID NO: 2352541 - RNA, 13 nt, Human
uguuuuauaauuu

SEQ ID NO: 2352542 - RNA, 20 nt, Human
uguuuuauaauuuugugaag

SEQ ID NO: 2352543 - RNA, 15 nt, Human
uguuuucaguguaca

SEQ ID NO: 2352544 - RNA, 15 nt, Human
uguuuucagacucag

SEQ ID NO: 2352545 - RNA, 23 nt, Human
uguuuuauuuuuuauuguuuuca

SEQ ID NO: 2352546 - RNA, 18 nt, Human
uguuuuauuuuuuauugu

SEQ ID NO: 2352547 - RNA, 19 nt, Human
uguuuuagaguuaacaaug

SEQ ID NO: 2352548 - RNA, 23 nt, Human
uguuuuagguuaaaaaaaggcau

SEQ ID NO: 2352549 - RNA, 16 nt, Human
uguuuuaguuaaauuu

SEQ ID NO: 2352550 - RNA, 17 nt, Human
uguuuuaguuaaauuuc

SEQ ID NO: 2352551 - RNA, 18 nt, Human
aguugauucagcucugca

SEQ ID NO: 2352552 - RNA, 17 nt, Human
aguugauucagcucugc

SEQ ID NO: 2352553 - RNA, 15 nt, Human
aguugauucagcucu

SEQ ID NO: 2352554 - RNA, 14 nt, Human
aguugauucagcuc

SEQ ID NO: 2352555 - RNA, 23 nt, Human
aguugauuuuacaauugaaauga

SEQ ID NO: 2352556 - RNA, 21 nt, Human
aguugauuuuacaauugaaau

SEQ ID NO: 2352557 - RNA, 18 nt, Human
aguugauuuaguguuuuu

SEQ ID NO: 2352558 - RNA, 13 nt, Human
aguugcaauaaua

SEQ ID NO: 2352559 - RNA, 14 nt, Human
aguugcaauaauac

SEQ ID NO: 2352560 - RNA, 17 nt, Human
aguugcaauaauacuuc

SEQ ID NO: 2352561 - RNA, 22 nt, Human
aguugcaauaauacuucucaaa

SEQ ID NO: 2352562 - RNA, 15 nt, Human
aguugcaauagaaca

SEQ ID NO: 2352563 - RNA, 17 nt, Human
aguugcaauagaacaga

SEQ ID NO: 2352564 - RNA, 19 nt, Human
aguugcaaucguaauguac

SEQ ID NO: 2352565 - RNA, 23 nt, Human
aguugauucagcucugcaagaau

SEQ ID NO: 2352566 - RNA, 19 nt, Human
aguugcaacuuuguauaaa

SEQ ID NO: 2352567 - RNA, 16 nt, Human
aguugauguugcauuu

SEQ ID NO: 2352568 - RNA, 15 nt, Human
aguugauguugcauu

SEQ ID NO: 2352569 - RNA, 23 nt, Human
aguugaucuggaacccagacuca

SEQ ID NO: 2352570 - RNA, 13 nt, Human
aguugauucagcu

SEQ ID NO: 2352571 - RNA, 13 nt, Human
aguugaucuggaa

SEQ ID NO: 2352572 - RNA, 17 nt, Human
aguugaucuggaaccca

SEQ ID NO: 2352573 - RNA, 15 nt, Human
aguugaucuggaacc

SEQ ID NO: 2352574 - RNA, 21 nt, Human
aguugaucuggaacccagacu

SEQ ID NO: 2352575 - RNA, 20 nt, Human
aguugaucuggaacccagac

SEQ ID NO: 2352576 - RNA, 19 nt, Human
aguugaucuggaacccaga

SEQ ID NO: 2352577 - RNA, 18 nt, Human
aguugaucuggaacccag

SEQ ID NO: 2352578 - RNA, 22 nt, Human
aguugauagcacagacccugcc

SEQ ID NO: 2352579 - RNA, 23 nt, Human
aguugauagcacagacccugccc

SEQ ID NO: 2352580 - RNA, 15 nt, Human
aguugauauagaaca

SEQ ID NO: 2352581 - RNA, 18 nt, Human
aguucuuugggccagaca

SEQ ID NO: 2352582 - RNA, 21 nt, Human
aguugaucgccuuucccaggu

SEQ ID NO: 2352583 - RNA, 17 nt, Human
aguugauauagaacagu

SEQ ID NO: 2352584 - RNA, 19 nt, Human
aguugauauagaacagugc

SEQ ID NO: 2352585 - RNA, 21 nt, Human
aguugauaugccuuuucccaa

SEQ ID NO: 2352586 - RNA, 18 nt, Human
aguucuguagaaaugguu

SEQ ID NO: 2352587 - RNA, 16 nt, Human
aguucuguagaaaugg

SEQ ID NO: 2352588 - RNA, 17 nt, Human
aguucuguagaaauggu

SEQ ID NO: 2352589 - RNA, 13 nt, Human
aguucuguagaaa

SEQ ID NO: 2352590 - RNA, 15 nt, Human
aguucuguagaaaug

SEQ ID NO: 2352591 - RNA, 16 nt, Human
aguucugaagaagaug

SEQ ID NO: 2352592 - RNA, 15 nt, Human
aguucugaagaagau

SEQ ID NO: 2352593 - RNA, 13 nt, Human
aguucugaagaag

SEQ ID NO: 2352594 - RNA, 14 nt, Human
aguucugaagaaga

SEQ ID NO: 2352595 - RNA, 14 nt, Human
aguugauagcacag

SEQ ID NO: 2352596 - RNA, 17 nt, Human
aguucuuugggccagac

SEQ ID NO: 2352597 - RNA, 16 nt, Human
aguucuuugggccaga

SEQ ID NO: 2352598 - RNA, 15 nt, Human
aguucuuugggccag

SEQ ID NO: 2352599 - RNA, 12 nt, Human
aguucuugugcc

SEQ ID NO: 2352600 - RNA, 22 nt, Human
aguucuugucugauuggcucac

SEQ ID NO: 2352601 - RNA, 13 nt, Human
aguucuugugcca

SEQ ID NO: 2352602 - RNA, 14 nt, Human
aguucuugugccau

SEQ ID NO: 2352603 - RNA, 18 nt, Human
aguucuucgggaagagag

SEQ ID NO: 2352604 - RNA, 19 nt, Human
aguucuucgggaagagagg

SEQ ID NO: 2352605 - RNA, 20 nt, Human
aguucuucgggaagagagga

SEQ ID NO: 2352606 - RNA, 22 nt, Human
aguucuucgggaagagaggagu

SEQ ID NO: 2352607 - RNA, 13 nt, Human
aguucuucuccaa

SEQ ID NO: 2352608 - RNA, 15 nt, Human
aguugauagcacaga

SEQ ID NO: 2352609 - RNA, 19 nt, Human
aguugauagcacagacccu

SEQ ID NO: 2352610 - RNA, 20 nt, Human
aguugauagcacagacccug

SEQ ID NO: 2352611 - RNA, 21 nt, Human
aguugauagcacagacccugc

SEQ ID NO: 2352612 - RNA, 15 nt, Human
aguuuccuuggcugg

SEQ ID NO: 2352613 - RNA, 17 nt, Human
aguuuccuuggcuggug

SEQ ID NO: 2352614 - RNA, 18 nt, Human
aguuuccuuggcuggugc

SEQ ID NO: 2352615 - RNA, 23 nt, Human
aguuuccucaggcugcuggagga

SEQ ID NO: 2352616 - RNA, 20 nt, Human
aguuuccucaggcugcugga

SEQ ID NO: 2352617 - RNA, 12 nt, Human
aguuuccugaaa

SEQ ID NO: 2352618 - RNA, 15 nt, Human
aguuucguuuucaaa

SEQ ID NO: 2352619 - RNA, 15 nt, Human
aguuucucagcuccc

SEQ ID NO: 2352620 - RNA, 19 nt, Human
aguuuccuuggcuggugca

SEQ ID NO: 2352621 - RNA, 16 nt, Human
aguuucguuuucaaaa

SEQ ID NO: 2352622 - RNA, 16 nt, Human
aguuucucagcuccca

SEQ ID NO: 2352623 - RNA, 21 nt, Human
aguuucuccaagcaggacaug

SEQ ID NO: 2352624 - RNA, 13 nt, Human
aguuucuccaagc

SEQ ID NO: 2352625 - RNA, 15 nt, Human
aguuucuccaagcag

SEQ ID NO: 2352626 - RNA, 15 nt, Human
aguuuauuuuaagac

SEQ ID NO: 2352627 - RNA, 15 nt, Human
aguuucaaaaacugu

SEQ ID NO: 2352628 - RNA, 18 nt, Human
aguuuccucaggcugcug

SEQ ID NO: 2352629 - RNA, 16 nt, Human
aguuucaaugugauuc

SEQ ID NO: 2352630 - RNA, 22 nt, Human
aguuucaaugugauucuaaugu

SEQ ID NO: 2352631 - RNA, 12 nt, Human
aguuucaaugug

SEQ ID NO: 2352632 - RNA, 14 nt, Human
aguuucaaugugau

SEQ ID NO: 2352633 - RNA, 15 nt, Human
aguuucaaugugauu

SEQ ID NO: 2352634 - RNA, 21 nt, Human
uuaaauuauaacuuaaaauau

SEQ ID NO: 2352635 - RNA, 21 nt, Human
uuaaauucaguccuaagaaag

SEQ ID NO: 2352636 - RNA, 12 nt, Human
uuaaauaaaugu

SEQ ID NO: 2352637 - RNA, 21 nt, Human
uuaaauaaaguaucaugcauu

SEQ ID NO: 2352638 - RNA, 13 nt, Human
uuaaauucuugca

SEQ ID NO: 2352639 - RNA, 16 nt, Human
uuaaauucuugcaaag

SEQ ID NO: 2352640 - RNA, 23 nt, Human
uuaaauucuccaguuuuuuguua

SEQ ID NO: 2352641 - RNA, 22 nt, Human
aguuuucaagucaaauuaauaa

SEQ ID NO: 2352642 - RNA, 16 nt, Human
aguuuucagaaccucu

SEQ ID NO: 2352643 - RNA, 21 nt, Human
aguuuucaagucaaauuaaua

SEQ ID NO: 2352644 - RNA, 22 nt, Human
aguuuucacucuuauugcccac

SEQ ID NO: 2352645 - RNA, 16 nt, Human
aguuuuauugagaauu

SEQ ID NO: 2352646 - RNA, 21 nt, Human
aguuuuauugagaauuuuaaa

SEQ ID NO: 2352647 - RNA, 15 nt, Human
aguuuuaucauuuuc

SEQ ID NO: 2352648 - RNA, 23 nt, Human
aguuuuauuaauaaacauucuau

SEQ ID NO: 2352649 - RNA, 20 nt, Human
aguuuucccuugaggaaaca

SEQ ID NO: 2352650 - RNA, 18 nt, Human
aguuuucccuugaggaaa

SEQ ID NO: 2352651 - RNA, 21 nt, Human
aguuuuccaugaaaacguuuu

SEQ ID NO: 2352652 - RNA, 16 nt, Human
aguuuuccaugaaaac

SEQ ID NO: 2352653 - RNA, 13 nt, Human
aguuuuccaugaa

SEQ ID NO: 2352654 - RNA, 12 nt, Human
aguuuuccauga

SEQ ID NO: 2352655 - RNA, 21 nt, Human
aguuuucagaaccucuucccc

SEQ ID NO: 2352656 - RNA, 20 nt, Human
aguuuucagaaccucuuccc

SEQ ID NO: 2352657 - RNA, 18 nt, Human
aguuuucagaaccucuuc

SEQ ID NO: 2352658 - RNA, 17 nt, Human
aguuuucagaaccucuu

SEQ ID NO: 2352659 - RNA, 22 nt, Human
aguuuucagaaccucuucccca

SEQ ID NO: 2352660 - RNA, 12 nt, Human
aguuuucagugg

SEQ ID NO: 2352661 - RNA, 11 nt, Human
aguuuucaguu

SEQ ID NO: 2352662 - RNA, 15 nt, Human
aguuuucaguuugua

SEQ ID NO: 2352663 - RNA, 17 nt, Human
aguuuucaguuuguaua

SEQ ID NO: 2352664 - RNA, 20 nt, Human
aguuuggggguuuugcuguu

SEQ ID NO: 2352665 - RNA, 21 nt, Human
aguuucucagcucccauuucu

SEQ ID NO: 2352666 - RNA, 22 nt, Human
aguuuggccgggugcgguggcu

SEQ ID NO: 2352667 - RNA, 22 nt, Human
aguuuguacagacguaugcuua

SEQ ID NO: 2352668 - RNA, 20 nt, Human
aguuugguucacuuacagau

SEQ ID NO: 2352669 - RNA, 14 nt, Human
aguuugucagacuu

SEQ ID NO: 2352670 - RNA, 18 nt, Human
aguuugucacaugaaaca

SEQ ID NO: 2352671 - RNA, 16 nt, Human
aguuuguccuguagag

SEQ ID NO: 2352672 - RNA, 22 nt, Human
aguuuguaugccaagugagaag

SEQ ID NO: 2352673 - RNA, 14 nt, Human
aguuuguauaacuu

SEQ ID NO: 2352674 - RNA, 13 nt, Human
aguuuguauauac

SEQ ID NO: 2352675 - RNA, 23 nt, Human
aguuuguacagacguaugcuuau

SEQ ID NO: 2352676 - RNA, 15 nt, Human
aguuuguacaugcau

SEQ ID NO: 2352677 - RNA, 17 nt, Human
aguuuguauaacuucuu

SEQ ID NO: 2352678 - RNA, 18 nt, Human
aguuuguacaugcauuca

SEQ ID NO: 2352679 - RNA, 14 nt, Human
aguuuuaucauuuu

SEQ ID NO: 2352680 - RNA, 20 nt, Human
aguuuuaucauuuucaaaau

SEQ ID NO: 2352681 - RNA, 17 nt, Human
aguuugucgcucaugug

SEQ ID NO: 2352682 - RNA, 19 nt, Human
aguuugucgcucaugugug

SEQ ID NO: 2352683 - RNA, 21 nt, Human
aguuugucgcucaugugugca

SEQ ID NO: 2352684 - RNA, 18 nt, Human
uuaaaccucucuucuacc

SEQ ID NO: 2352685 - RNA, 13 nt, Human
uuaaacggauuau

SEQ ID NO: 2352686 - RNA, 14 nt, Human
uuaaacggauuauu

SEQ ID NO: 2352687 - RNA, 15 nt, Human
uuaaacggauuauuu

SEQ ID NO: 2352688 - RNA, 20 nt, Human
uuaaacccuggaucaguccu

SEQ ID NO: 2352689 - RNA, 13 nt, Human
uuaaacccauuuu

SEQ ID NO: 2352690 - RNA, 16 nt, Human
uuaaacccauuuuagu

SEQ ID NO: 2352691 - RNA, 14 nt, Human
uuaaaaucauuucu

SEQ ID NO: 2352692 - RNA, 17 nt, Human
uuaaaccgccaaggcug

SEQ ID NO: 2352693 - RNA, 16 nt, Human
uuaaaauauuccugca

SEQ ID NO: 2352694 - RNA, 19 nt, Human
uuaaaauauuccugcauuu

SEQ ID NO: 2352695 - RNA, 14 nt, Human
uuaaaauauuuuau

SEQ ID NO: 2352696 - RNA, 12 nt, Human
uuaaaauauuuu

SEQ ID NO: 2352697 - RNA, 14 nt, Human
uuaaaauauggcua

SEQ ID NO: 2352698 - RNA, 17 nt, Human
uuaaaauauuuauuuau

SEQ ID NO: 2352699 - RNA, 12 nt, Human
uuaaaauauauu

SEQ ID NO: 2352700 - RNA, 13 nt, Human
uuaaaauaucuuu

SEQ ID NO: 2352701 - RNA, 19 nt, Human
uuaaaauaucuuuugaccu

SEQ ID NO: 2352702 - RNA, 17 nt, Human
uuaaauaaaguaucaug

SEQ ID NO: 2352703 - RNA, 19 nt, Human
uuaaauaaaguaucaugca

SEQ ID NO: 2352704 - RNA, 20 nt, Human
uuaaauaaaagugaucaaua

SEQ ID NO: 2352705 - RNA, 14 nt, Human
uuaaauaaaaguga

SEQ ID NO: 2352706 - RNA, 13 nt, Human
uuaaauaaaagug

SEQ ID NO: 2352707 - RNA, 22 nt, Human
uuaaacggauuauuuuuucaga

SEQ ID NO: 2352708 - RNA, 16 nt, Human
uuaaacggauuauuuu

SEQ ID NO: 2352709 - RNA, 21 nt, Human
uuaaacggauuauuuuuucag

SEQ ID NO: 2352710 - RNA, 15 nt, Human
uuaaauaaaucauaa

SEQ ID NO: 2352711 - RNA, 13 nt, Human
uuaaauaaaucau

SEQ ID NO: 2352712 - RNA, 19 nt, Human
uuaaauaaugugaaacugg

SEQ ID NO: 2352713 - RNA, 22 nt, Human
uuaaauaaugugaaacuggauu

SEQ ID NO: 2352714 - RNA, 21 nt, Human
uuaaauaaugugaaacuggau

SEQ ID NO: 2352715 - RNA, 20 nt, Human
uuaaauaaugugaaacugga

SEQ ID NO: 2352716 - RNA, 13 nt, Human
uuaaaaaacuugu

SEQ ID NO: 2352717 - RNA, 11 nt, Human
uuaaaaaacaa

SEQ ID NO: 2352718 - RNA, 18 nt, Human
uuaaaaaguggaaaaaua

SEQ ID NO: 2352719 - RNA, 14 nt, Human
uuaaaaagucuuca

SEQ ID NO: 2352720 - RNA, 13 nt, Human
uuaaaaauauaaa

SEQ ID NO: 2352721 - RNA, 17 nt, Human
uuaaaacaacacucaca

SEQ ID NO: 2352722 - RNA, 19 nt, Human
uuaaaaauguaaauauucu

SEQ ID NO: 2352723 - RNA, 21 nt, Human
uuaaaaauguuaaaauguauu

SEQ ID NO: 2352724 - RNA, 13 nt, Human
uuaaaaauguaaa

SEQ ID NO: 2352725 - RNA, 14 nt, Human
uuaaaaauguaaau

SEQ ID NO: 2352726 - RNA, 16 nt, Human
uuaaaaauguaaauau

SEQ ID NO: 2352727 - RNA, 17 nt, Human
uuaaaaauguaaauauu

SEQ ID NO: 2352728 - RNA, 20 nt, Human
uuaaaaauauggaacuucua

SEQ ID NO: 2352729 - RNA, 22 nt, Human
uuaaaaauauggaacuucuaau

SEQ ID NO: 2352730 - RNA, 23 nt, Human
uuaaaaauauggaacuucuaaua

SEQ ID NO: 2352731 - RNA, 15 nt, Human
uuaaaaauauaaaac

SEQ ID NO: 2352732 - RNA, 16 nt, Human
uuaaaaauauaaaacu

SEQ ID NO: 2352733 - RNA, 20 nt, Human
uuaaaaaugguuuaaauggu

SEQ ID NO: 2352734 - RNA, 19 nt, Human
aguugcaauugaauuaaau

SEQ ID NO: 2352735 - RNA, 18 nt, Human
aguugcaauugaauuaaa

SEQ ID NO: 2352736 - RNA, 20 nt, Human
aguugcaauugaauuaaauu

SEQ ID NO: 2352737 - RNA, 16 nt, Human
aguugcacagcuauga

SEQ ID NO: 2352738 - RNA, 22 nt, Human
aguugcauagguuuaauaauuu

SEQ ID NO: 2352739 - RNA, 20 nt, Human
aguugcauggcaucaccucc

SEQ ID NO: 2352740 - RNA, 21 nt, Human
aguugcauggcaucaccucca

SEQ ID NO: 2352741 - RNA, 20 nt, Human
aguugccagucaccccggcc

SEQ ID NO: 2352742 - RNA, 21 nt, Human
uuaaaaaaauugguuggagaa

SEQ ID NO: 2352743 - RNA, 16 nt, Human
uuaaaaaaauuuaagu

SEQ ID NO: 2352744 - RNA, 15 nt, Human
uuaaaaaagaaacau

SEQ ID NO: 2352745 - RNA, 18 nt, Human
uuaaaaaagaaacauuug

SEQ ID NO: 2352746 - RNA, 13 nt, Human
uguugucagcuga

SEQ ID NO: 2352747 - RNA, 13 nt, Human
uguuguauaaauu

SEQ ID NO: 2352748 - RNA, 11 nt, Human
uguuguauaaa

SEQ ID NO: 2352749 - RNA, 14 nt, Human
uguuguauaaauuu

SEQ ID NO: 2352750 - RNA, 15 nt, Human
uguuguaugccuuua

SEQ ID NO: 2352751 - RNA, 13 nt, Human
uguuguauuuuaa

SEQ ID NO: 2352752 - RNA, 21 nt, Human
uguuguaaauauuuauguaaa

SEQ ID NO: 2352753 - RNA, 14 nt, Human
uguuguaaauauuu

SEQ ID NO: 2352754 - RNA, 23 nt, Human
uguuguacauuuaugauuuaaua

SEQ ID NO: 2352755 - RNA, 13 nt, Human
uguuguacauuua

SEQ ID NO: 2352756 - RNA, 14 nt, Human
uguuguacauuuau

SEQ ID NO: 2352757 - RNA, 15 nt, Human
uguuguacauuuaug

SEQ ID NO: 2352758 - RNA, 16 nt, Human
uguuguacauuuauga

SEQ ID NO: 2352759 - RNA, 17 nt, Human
uguuguacauuuaugau

SEQ ID NO: 2352760 - RNA, 18 nt, Human
uguuguacauuuaugauu

SEQ ID NO: 2352761 - RNA, 20 nt, Human
uguuguacauuuaugauuua

SEQ ID NO: 2352762 - RNA, 22 nt, Human
uguuguacauuuaugauuuaau

SEQ ID NO: 2352763 - RNA, 19 nt, Human
aguucgagaccagccuggc

SEQ ID NO: 2352764 - RNA, 18 nt, Human
aguucgagaccagccugg

SEQ ID NO: 2352765 - RNA, 21 nt, Human
aguucgagaccagccuggcca

SEQ ID NO: 2352766 - RNA, 15 nt, Human
aguucuaaauuuugu

SEQ ID NO: 2352767 - RNA, 13 nt, Human
uguugggccagga

SEQ ID NO: 2352768 - RNA, 18 nt, Human
uguugggagugaggaugu

SEQ ID NO: 2352769 - RNA, 18 nt, Human
uguugggauacugcaggg

SEQ ID NO: 2352770 - RNA, 16 nt, Human
uguugggccaggagcc

SEQ ID NO: 2352771 - RNA, 15 nt, Human
uguugggauuccuga

SEQ ID NO: 2352772 - RNA, 17 nt, Human
uguugggauuccugacc

SEQ ID NO: 2352773 - RNA, 18 nt, Human
uguugggauuccugaccc

SEQ ID NO: 2352774 - RNA, 17 nt, Human
aguucgagaccagccug

SEQ ID NO: 2352775 - RNA, 14 nt, Human
aguucgagaccagc

SEQ ID NO: 2352776 - RNA, 18 nt, Human
aguucgagaccaaccuga

SEQ ID NO: 2352777 - RNA, 23 nt, Human
aguuccugucccuucucuuaauu

SEQ ID NO: 2352778 - RNA, 21 nt, Human
aguuccugucccuucucuuaa

SEQ ID NO: 2352779 - RNA, 20 nt, Human
aguuccuucagcuuccauuu

SEQ ID NO: 2352780 - RNA, 14 nt, Human
aguuccuuauguau

SEQ ID NO: 2352781 - RNA, 20 nt, Human
aguuccuugaucuguauaua

SEQ ID NO: 2352782 - RNA, 18 nt, Human
aguucccuuggccucaga

SEQ ID NO: 2352783 - RNA, 17 nt, Human
aguucccuuggccucag

SEQ ID NO: 2352784 - RNA, 16 nt, Human
aguucccuuggccuca

SEQ ID NO: 2352785 - RNA, 15 nt, Human
aguucccuuggccuc

SEQ ID NO: 2352786 - RNA, 20 nt, Human
aguuccugucccuucucuua

SEQ ID NO: 2352787 - RNA, 17 nt, Human
aguuccuagccaccgcc

SEQ ID NO: 2352788 - RNA, 16 nt, Human
aguuccgauuucccag

SEQ ID NO: 2352789 - RNA, 13 nt, Human
aguucccuuggcc

SEQ ID NO: 2352790 - RNA, 21 nt, Human
aguucccugaaaacccagaga

SEQ ID NO: 2352791 - RNA, 24 nt, Human
aguucccugaaaacccagagagga

SEQ ID NO: 2352792 - RNA, 20 nt, Human
aguucccugaaaacccagag

SEQ ID NO: 2352793 - RNA, 19 nt, Human
aguucccugaaaacccaga

SEQ ID NO: 2352794 - RNA, 14 nt, Human
aguucccugaaaac

SEQ ID NO: 2352795 - RNA, 17 nt, Human
aguucccuacuuccugu

SEQ ID NO: 2352796 - RNA, 21 nt, Human
aguuauuuuuauuuauuuaaa

SEQ ID NO: 2352797 - RNA, 13 nt, Human
aguucaaacaaga

SEQ ID NO: 2352798 - RNA, 19 nt, Human
aguuauuuuaauuaucuuu

SEQ ID NO: 2352799 - RNA, 21 nt, Human
aguuauuuauuuauuggagau

SEQ ID NO: 2352800 - RNA, 14 nt, Human
aguuauuuucuaca

SEQ ID NO: 2352801 - RNA, 23 nt, Human
aguuauuuucuacagugguuuua

SEQ ID NO: 2352802 - RNA, 22 nt, Human
aguuauuuaugccucuguauuu

SEQ ID NO: 2352803 - RNA, 18 nt, Human
aguuauuguacagcuguu

SEQ ID NO: 2352804 - RNA, 19 nt, Human
aguuauuguacagcuguuu

SEQ ID NO: 2352805 - RNA, 21 nt, Human
aguuauuguacagcuguuuaa

SEQ ID NO: 2352806 - RNA, 22 nt, Human
aguuauuguacagcuguuuaag

SEQ ID NO: 2352807 - RNA, 18 nt, Human
aguucaaauucuucugaa

SEQ ID NO: 2352808 - RNA, 15 nt, Human
aguguuucccauaau

SEQ ID NO: 2352809 - RNA, 22 nt, Human
aguguuuauuuuucauauugug

SEQ ID NO: 2352810 - RNA, 15 nt, Human
aguguuuauuuuuca

SEQ ID NO: 2352811 - RNA, 17 nt, Human
aguguuuauuuuucaua

SEQ ID NO: 2352812 - RNA, 19 nt, Human
aguguuuauuuuucauauu

SEQ ID NO: 2352813 - RNA, 21 nt, Human
aguguuuauuuuucauauugu

SEQ ID NO: 2352814 - RNA, 18 nt, Human
uguucuuuccaaaguaca

SEQ ID NO: 2352815 - RNA, 19 nt, Human
aguguuucgacagcugauu

SEQ ID NO: 2352816 - RNA, 16 nt, Human
aguguuucccauaauu

SEQ ID NO: 2352817 - RNA, 13 nt, Human
aguguuuccuuuu

SEQ ID NO: 2352818 - RNA, 16 nt, Human
aguguuuccuuuuugg

SEQ ID NO: 2352819 - RNA, 13 nt, Human
aguguuucugugc

SEQ ID NO: 2352820 - RNA, 16 nt, Human
aguuacauuaauguua

SEQ ID NO: 2352821 - RNA, 13 nt, Human
aguguuucuguua

SEQ ID NO: 2352822 - RNA, 14 nt, Human
aguguuucuguuau

SEQ ID NO: 2352823 - RNA, 14 nt, Human
aguguuucugugca

SEQ ID NO: 2352824 - RNA, 15 nt, Human
aguguuucugugcau

SEQ ID NO: 2352825 - RNA, 17 nt, Human
aguguuucugugcaugg

SEQ ID NO: 2352826 - RNA, 12 nt, Human
aguguuucuguu

SEQ ID NO: 2352827 - RNA, 17 nt, Human
aguuagggaauggcaca

SEQ ID NO: 2352828 - RNA, 18 nt, Human
aguuaggcuauucacaac

SEQ ID NO: 2352829 - RNA, 16 nt, Human
aguuaggauagcauuu

SEQ ID NO: 2352830 - RNA, 18 nt, Human
aguuaggauagcauuuuu

SEQ ID NO: 2352831 - RNA, 22 nt, Human
aguuaggaaauaaaaccuuuca

SEQ ID NO: 2352832 - RNA, 21 nt, Human
aguuaggaaauaaaaccuuuc

SEQ ID NO: 2352833 - RNA, 20 nt, Human
aguuaggaaauaaaaccuuu

SEQ ID NO: 2352834 - RNA, 18 nt, Human
aguuaggaaauaaaaccu

SEQ ID NO: 2352835 - RNA, 17 nt, Human
aguuaggaaauaaaacc

SEQ ID NO: 2352836 - RNA, 18 nt, Human
aguuacuaagaagaaaau

SEQ ID NO: 2352837 - RNA, 23 nt, Human
aguuacuaagaagaaaauugcug

SEQ ID NO: 2352838 - RNA, 17 nt, Human
aguuaguuucuuuggga

SEQ ID NO: 2352839 - RNA, 23 nt, Human
aguuaguucucucguaacugguu

SEQ ID NO: 2352840 - RNA, 16 nt, Human
aguuaguuucuuuggg

SEQ ID NO: 2352841 - RNA, 17 nt, Human
aguuaguagcauguuga

SEQ ID NO: 2352842 - RNA, 16 nt, Human
aguuaguagcauguug

SEQ ID NO: 2352843 - RNA, 17 nt, Human
aguuagucuacucuuaa

SEQ ID NO: 2352844 - RNA, 14 nt, Human
aguuaguagcaugu

SEQ ID NO: 2352845 - RNA, 15 nt, Human
aguuaguagcauguu

SEQ ID NO: 2352846 - RNA, 22 nt, Human
aguuagucuacucuuaagccau

SEQ ID NO: 2352847 - RNA, 20 nt, Human
aguuaguggauuacugccau

SEQ ID NO: 2352848 - RNA, 17 nt, Human
aguuaguggauuacugc

SEQ ID NO: 2352849 - RNA, 23 nt, Human
aguuagucuacucuuaagccauc

SEQ ID NO: 2352850 - RNA, 12 nt, Human
aguuauaaauca

SEQ ID NO: 2352851 - RNA, 21 nt, Human
aguuauaaguagcaggccaag

SEQ ID NO: 2352852 - RNA, 15 nt, Human
aguuauagaugucua

SEQ ID NO: 2352853 - RNA, 17 nt, Human
aguuauagaugucuagg

SEQ ID NO: 2352854 - RNA, 19 nt, Human
aguuauagaugucuaggua

SEQ ID NO: 2352855 - RNA, 17 nt, Human
aguuaucuaaaagaaau

SEQ ID NO: 2352856 - RNA, 19 nt, Human
aguuauaguauaucuggac

SEQ ID NO: 2352857 - RNA, 19 nt, Human
aguuaugccgcuagauaca

SEQ ID NO: 2352858 - RNA, 20 nt, Human
aguuaugauuuuuuuuucau

SEQ ID NO: 2352859 - RNA, 19 nt, Human
aguuauggcuauaggugcu

SEQ ID NO: 2352860 - RNA, 18 nt, Human
aguuauggccuauacacu

SEQ ID NO: 2352861 - RNA, 21 nt, Human
aguuauggccuauacacuauu

SEQ ID NO: 2352862 - RNA, 14 nt, Human
aguuaugugaauga

SEQ ID NO: 2352863 - RNA, 13 nt, Human
aguuaugugaaug

SEQ ID NO: 2352864 - RNA, 15 nt, Human
aguuaugugaaugau

SEQ ID NO: 2352865 - RNA, 20 nt, Human
aguuauuauauuuacaaaug

SEQ ID NO: 2352866 - RNA, 18 nt, Human
aguuauugacaaacucuc

SEQ ID NO: 2352867 - RNA, 17 nt, Human
aguuauugacaaacucu

SEQ ID NO: 2352868 - RNA, 13 nt, Human
aguuauugcaguu

SEQ ID NO: 2352869 - RNA, 16 nt, Human
aguuauugcaguuuau

SEQ ID NO: 2352870 - RNA, 18 nt, Human
aguuauugcaguuuauca

SEQ ID NO: 2352871 - RNA, 19 nt, Human
aguuauugcaguuuaucau

SEQ ID NO: 2352872 - RNA, 22 nt, Human
aguuauugcaguuuaucauuca

SEQ ID NO: 2352873 - RNA, 12 nt, Human
aguuauuguaca

SEQ ID NO: 2352874 - RNA, 13 nt, Human
aguuauuguacag

SEQ ID NO: 2352875 - RNA, 13 nt, Human
aguggcagggcuc

SEQ ID NO: 2352876 - RNA, 14 nt, Human
aguggcagggcuca

SEQ ID NO: 2352877 - RNA, 17 nt, Human
aguggcagggcucagga

SEQ ID NO: 2352878 - RNA, 18 nt, Human
aguggcagggcucaggau

SEQ ID NO: 2352879 - RNA, 14 nt, Human
aguggcagcugcuu

SEQ ID NO: 2352880 - RNA, 20 nt, Human
aguggcagcugcuuuugucu

SEQ ID NO: 2352881 - RNA, 12 nt, Human
aguggcagcugc

SEQ ID NO: 2352882 - RNA, 13 nt, Human
aguggcagcugcu

SEQ ID NO: 2352883 - RNA, 12 nt, Human
ugugcaaauccu

SEQ ID NO: 2352884 - RNA, 15 nt, Human
ugugcaaauuaacag

SEQ ID NO: 2352885 - RNA, 18 nt, Human
ugugcaacaggguaugga

SEQ ID NO: 2352886 - RNA, 20 nt, Human
ugugcaacaggguauggacu

SEQ ID NO: 2352887 - RNA, 11 nt, Human
aguggcagcug

SEQ ID NO: 2352888 - RNA, 15 nt, Human
aguggggcucgccau

SEQ ID NO: 2352889 - RNA, 11 nt, Human
aguggcagggg

SEQ ID NO: 2352890 - RNA, 16 nt, Human
agugggggagagcagg

SEQ ID NO: 2352891 - RNA, 19 nt, Human
agugggggagagcaggcug

SEQ ID NO: 2352892 - RNA, 18 nt, Human
aguggggcucgccaugcc

SEQ ID NO: 2352893 - RNA, 18 nt, Human
aguggcaggggacaggag

SEQ ID NO: 2352894 - RNA, 19 nt, Human
agugggggaguggccacag

SEQ ID NO: 2352895 - RNA, 20 nt, Human
agugggggaguggccacaga

SEQ ID NO: 2352896 - RNA, 18 nt, Human
agugggugaauaauacag

SEQ ID NO: 2352897 - RNA, 13 nt, Human
agugggugaauaa

SEQ ID NO: 2352898 - RNA, 18 nt, Human
agugggggaucacagccu

SEQ ID NO: 2352899 - RNA, 21 nt, Human
agugggguuaucucuguguua

SEQ ID NO: 2352900 - RNA, 21 nt, Human
agugggggagagcaggcuggc

SEQ ID NO: 2352901 - RNA, 23 nt, Human
agugggggagagcaggcuggcag

SEQ ID NO: 2352902 - RNA, 20 nt, Human
agugggguuaucucuguguu

SEQ ID NO: 2352903 - RNA, 19 nt, Human
agugggguugcaaccacug

SEQ ID NO: 2352904 - RNA, 22 nt, Human
agugggguugcaaccacugcaa

SEQ ID NO: 2352905 - RNA, 14 nt, Human
agugggucccacuu

SEQ ID NO: 2352906 - RNA, 13 nt, Human
aguguacagucuu

SEQ ID NO: 2352907 - RNA, 16 nt, Human
aguguaauuucuuugc

SEQ ID NO: 2352908 - RNA, 21 nt, Human
aguguaauuucuuugccuguu

SEQ ID NO: 2352909 - RNA, 15 nt, Human
aguguacagucuugu

SEQ ID NO: 2352910 - RNA, 16 nt, Human
aguguacagucuugua

SEQ ID NO: 2352911 - RNA, 22 nt, Human
aguguacauggaauaacaugua

SEQ ID NO: 2352912 - RNA, 21 nt, Human
aguguacauggaauaacaugu

SEQ ID NO: 2352913 - RNA, 11 nt, Human
aguguaaaaua

SEQ ID NO: 2352914 - RNA, 20 nt, Human
agugguuuuauacugaagga

SEQ ID NO: 2352915 - RNA, 21 nt, Human
agugguuuuauacugaaggaa

SEQ ID NO: 2352916 - RNA, 23 nt, Human
agugguuuuauacugaaggaaaa

SEQ ID NO: 2352917 - RNA, 13 nt, Human
aguguaaaauaag

SEQ ID NO: 2352918 - RNA, 13 nt, Human
aguguaaguguga

SEQ ID NO: 2352919 - RNA, 19 nt, Human
agugguuguuaguuauaga

SEQ ID NO: 2352920 - RNA, 17 nt, Human
agugguuuuauacugaa

SEQ ID NO: 2352921 - RNA, 18 nt, Human
agugguuuuauacugaag

SEQ ID NO: 2352922 - RNA, 11 nt, Human
aguggugccua

SEQ ID NO: 2352923 - RNA, 15 nt, Human
aguggguuucacaag

SEQ ID NO: 2352924 - RNA, 18 nt, Human
aguggguuauucuggagu

SEQ ID NO: 2352925 - RNA, 19 nt, Human
aguggguuauucuggaguu

SEQ ID NO: 2352926 - RNA, 21 nt, Human
aguggguuucacaagugaaaa

SEQ ID NO: 2352927 - RNA, 18 nt, Human
agugggugguggaucugu

SEQ ID NO: 2352928 - RNA, 15 nt, Human
aguggguuauucugg

SEQ ID NO: 2352929 - RNA, 16 nt, Human
aguggguuauucugga

SEQ ID NO: 2352930 - RNA, 22 nt, Human
agugggugagaugcuggagaag

SEQ ID NO: 2352931 - RNA, 18 nt, Human
agugggugagaugcugga

SEQ ID NO: 2352932 - RNA, 19 nt, Human
agugggugagaugcuggag

SEQ ID NO: 2352933 - RNA, 19 nt, Human
agugggugaauaauacagu

SEQ ID NO: 2352934 - RNA, 14 nt, Human
agugggucccagau

SEQ ID NO: 2352935 - RNA, 16 nt, Human
agugggucccacuucc

SEQ ID NO: 2352936 - RNA, 17 nt, Human
agugggucccacuuccc

SEQ ID NO: 2352937 - RNA, 21 nt, Human
agugggucccacuuccccucc

SEQ ID NO: 2352938 - RNA, 22 nt, Human
agugggucccacuuccccuccu

SEQ ID NO: 2352939 - RNA, 20 nt, Human
aguggucuuucuggagaggu

SEQ ID NO: 2352940 - RNA, 13 nt, Human
aguggucuuugua

SEQ ID NO: 2352941 - RNA, 14 nt, Human
aguggucuuuguaa

SEQ ID NO: 2352942 - RNA, 15 nt, Human
aguggucuuuguaag

SEQ ID NO: 2352943 - RNA, 16 nt, Human
aguggucuuuguaaga

SEQ ID NO: 2352944 - RNA, 17 nt, Human
aguggucuuuguaagag

SEQ ID NO: 2352945 - RNA, 18 nt, Human
aguggucuuuguaagagu

SEQ ID NO: 2352946 - RNA, 19 nt, Human
aguggucuuuguaagagug

SEQ ID NO: 2352947 - RNA, 18 nt, Human
aguggucuuucuggagag

SEQ ID NO: 2352948 - RNA, 16 nt, Human
aguggucuuucuggag

SEQ ID NO: 2352949 - RNA, 15 nt, Human
aguggucuuucugga

SEQ ID NO: 2352950 - RNA, 13 nt, Human
aguggucuuucug

SEQ ID NO: 2352951 - RNA, 20 nt, Human
aguggucuuuccuaucaugg

SEQ ID NO: 2352952 - RNA, 22 nt, Human
aguggucgcuuacuuugaguga

SEQ ID NO: 2352953 - RNA, 16 nt, Human
aguggugcgaucuggg

SEQ ID NO: 2352954 - RNA, 20 nt, Human
aguggucuuuguaagagugu

SEQ ID NO: 2352955 - RNA, 21 nt, Human
aguggucuuuguaagagugua

SEQ ID NO: 2352956 - RNA, 22 nt, Human
aguggucuuuguaagaguguag

SEQ ID NO: 2352957 - RNA, 24 nt, Human
aguggucuuuguaagaguguagaa

SEQ ID NO: 2352958 - RNA, 21 nt, Human
agugguuccuaauccucuagg

SEQ ID NO: 2352959 - RNA, 19 nt, Human
uguucaaaaaaacacuagu

SEQ ID NO: 2352960 - RNA, 21 nt, Human
uguuauuuuuguuucuuccaa

SEQ ID NO: 2352961 - RNA, 16 nt, Human
uguuauuuuuguuucu

SEQ ID NO: 2352962 - RNA, 18 nt, Human
uguuauuuuuuaauuauu

SEQ ID NO: 2352963 - RNA, 18 nt, Human
uguuauuuucuguugaag

SEQ ID NO: 2352964 - RNA, 14 nt, Human
uguuauuuugcaac

SEQ ID NO: 2352965 - RNA, 19 nt, Human
uguuauuuucuuugaaauu

SEQ ID NO: 2352966 - RNA, 22 nt, Human
uguuauuuuuauaucagccuga

SEQ ID NO: 2352967 - RNA, 20 nt, Human
uguucccauguagcccccug

SEQ ID NO: 2352968 - RNA, 22 nt, Human
uguucaaagccagcguccuccu

SEQ ID NO: 2352969 - RNA, 21 nt, Human
uguucaaagccagcguccucc

SEQ ID NO: 2352970 - RNA, 16 nt, Human
uguucccauucuugca

SEQ ID NO: 2352971 - RNA, 17 nt, Human
uguucccauuucagcug

SEQ ID NO: 2352972 - RNA, 16 nt, Human
uguucccauuucagcu

SEQ ID NO: 2352973 - RNA, 18 nt, Human
uguuauggcuuaaugaca

SEQ ID NO: 2352974 - RNA, 17 nt, Human
uguuauguagauaacaa

SEQ ID NO: 2352975 - RNA, 14 nt, Human
uguuauggaaacug

SEQ ID NO: 2352976 - RNA, 15 nt, Human
uguuaugcugugaca

SEQ ID NO: 2352977 - RNA, 22 nt, Human
uguuauguaaaaggccaaaccu

SEQ ID NO: 2352978 - RNA, 17 nt, Human
uguuauuuguacaguuc

SEQ ID NO: 2352979 - RNA, 16 nt, Human
uguuauuuguacaguu

SEQ ID NO: 2352980 - RNA, 14 nt, Human
uguuauuuucagua

SEQ ID NO: 2352981 - RNA, 18 nt, Human
uguuauuuucaguauuuu

SEQ ID NO: 2352982 - RNA, 20 nt, Human
uguuauuaaacguaugcaug

SEQ ID NO: 2352983 - RNA, 21 nt, Human
uguuauuaaacguaugcaugu

SEQ ID NO: 2352984 - RNA, 22 nt, Human
uguuauuaaacguaugcaugug

SEQ ID NO: 2352985 - RNA, 23 nt, Human
uguuauuaaacguaugcauguga

SEQ ID NO: 2352986 - RNA, 18 nt, Human
aguguagcccacacuuga

SEQ ID NO: 2352987 - RNA, 13 nt, Human
aguguagccuugc

SEQ ID NO: 2352988 - RNA, 23 nt, Human
aguguagaucagagcagcaguga

SEQ ID NO: 2352989 - RNA, 15 nt, Human
aguguagaucagagc

SEQ ID NO: 2352990 - RNA, 16 nt, Human
aguguaccauuugccu

SEQ ID NO: 2352991 - RNA, 22 nt, Human
aguguagaagcauuccuucuuu

SEQ ID NO: 2352992 - RNA, 17 nt, Human
aguguacagucuuguau

SEQ ID NO: 2352993 - RNA, 20 nt, Human
aguguaauuucuuugccugu

SEQ ID NO: 2352994 - RNA, 13 nt, Human
aguguaccauaau

SEQ ID NO: 2352995 - RNA, 23 nt, Human
aguguacauggaauaacauguaa

SEQ ID NO: 2352996 - RNA, 18 nt, Human
aguguagccuugcccgga

SEQ ID NO: 2352997 - RNA, 17 nt, Human
aguguagccuugcccgg

SEQ ID NO: 2352998 - RNA, 15 nt, Human
aguguagccuugccc

SEQ ID NO: 2352999 - RNA, 21 nt, Human
aguguagcccacacuugagag

SEQ ID NO: 2353000 - RNA, 23 nt, Human
aguguagcccacacuugagagga

SEQ ID NO: 2353001 - RNA, 13 nt, Human
aguguaggcagac

SEQ ID NO: 2353002 - RNA, 14 nt, Human
aguguaggcagaca

SEQ ID NO: 2353003 - RNA, 15 nt, Human
aguguaggcagacac

SEQ ID NO: 2353004 - RNA, 16 nt, Human
aguguaggcagacaca

SEQ ID NO: 2353005 - RNA, 18 nt, Human
aguguaggcagacacagg

SEQ ID NO: 2353006 - RNA, 20 nt, Human
aguguaggcagacacaggga

SEQ ID NO: 2353007 - RNA, 22 nt, Human
aguguaggcagacacagggacu

SEQ ID NO: 2353008 - RNA, 23 nt, Human
aguguaggcagacacagggacuu

SEQ ID NO: 2353009 - RNA, 16 nt, Human
uguucuuaagacguga

SEQ ID NO: 2353010 - RNA, 15 nt, Human
uguuccccucacugg

SEQ ID NO: 2353011 - RNA, 16 nt, Human
uguucuuaauugcacu

SEQ ID NO: 2353012 - RNA, 17 nt, Human
uguucuuaauugcacuc

SEQ ID NO: 2353013 - RNA, 22 nt, Human
uguucuuaccuguaugucucca

SEQ ID NO: 2353014 - RNA, 17 nt, Human
uguucuuaccuguaugu

SEQ ID NO: 2353015 - RNA, 18 nt, Human
uguucuuaauugcacucu

SEQ ID NO: 2353016 - RNA, 18 nt, Human
uguucuugguuuguaaau

SEQ ID NO: 2353017 - RNA, 17 nt, Human
uguucuugguuuguaaa

SEQ ID NO: 2353018 - RNA, 14 nt, Human
uguucuuuccaaag

SEQ ID NO: 2353019 - RNA, 13 nt, Human
uguucuuuccaaa

SEQ ID NO: 2353020 - RNA, 19 nt, Human
uguucuugguuuguaaauu

SEQ ID NO: 2353021 - RNA, 14 nt, Human
uguucugggacaca

SEQ ID NO: 2353022 - RNA, 15 nt, Human
uguucugggacacag

SEQ ID NO: 2353023 - RNA, 16 nt, Human
uguucuuaauucuuag

SEQ ID NO: 2353024 - RNA, 14 nt, Human
uguucuuaauucuu

SEQ ID NO: 2353025 - RNA, 22 nt, Human
uguuccccacugacagccuccc

SEQ ID NO: 2353026 - RNA, 13 nt, Human
uguuccccagaga

SEQ ID NO: 2353027 - RNA, 14 nt, Human
uguuccccagagaa

SEQ ID NO: 2353028 - RNA, 13 nt, Human
uguuccccaucug

SEQ ID NO: 2353029 - RNA, 15 nt, Human
uguucccccugugca

SEQ ID NO: 2353030 - RNA, 18 nt, Human
uguuccccauggccacuu

SEQ ID NO: 2353031 - RNA, 16 nt, Human
uguucccccgccgcuu

SEQ ID NO: 2353032 - RNA, 12 nt, Human
uguucugggaca

SEQ ID NO: 2353033 - RNA, 16 nt, Human
uguucccccugugcag

SEQ ID NO: 2353034 - RNA, 21 nt, Human
uguucccccgccgcuuuucuc

SEQ ID NO: 2353035 - RNA, 14 nt, Human
uguuccccucacug

SEQ ID NO: 2353036 - RNA, 13 nt, Human
uguucugggacac

SEQ ID NO: 2353037 - RNA, 22 nt, Human
uuagcaggagaggagagccaga

SEQ ID NO: 2353038 - RNA, 23 nt, Human
uuagcaggagaggagagccagag

SEQ ID NO: 2353039 - RNA, 16 nt, Human
uuagcaguuugcuuug

SEQ ID NO: 2353040 - RNA, 14 nt, Human
uuagccccauaauu

SEQ ID NO: 2353041 - RNA, 13 nt, Human
uuagccgggcgug

SEQ ID NO: 2353042 - RNA, 17 nt, Human
uuagcccccacccacuu

SEQ ID NO: 2353043 - RNA, 12 nt, Human
uuagcccccacc

SEQ ID NO: 2353044 - RNA, 13 nt, Human
uuagcccccaccc

SEQ ID NO: 2353045 - RNA, 12 nt, Human
uuauaaauauga

SEQ ID NO: 2353046 - RNA, 14 nt, Human
uuauaaaucgcuuu

SEQ ID NO: 2353047 - RNA, 21 nt, Human
uuauaaauaugaagcucaccu

SEQ ID NO: 2353048 - RNA, 15 nt, Human
uuagccucccugaaa

SEQ ID NO: 2353049 - RNA, 17 nt, Human
uuagccugaguagaaag

SEQ ID NO: 2353050 - RNA, 11 nt, Human
uuauaaauuau

SEQ ID NO: 2353051 - RNA, 13 nt, Human
uuauaaauuaugu

SEQ ID NO: 2353052 - RNA, 14 nt, Human
uuauaaauuauguu

SEQ ID NO: 2353053 - RNA, 15 nt, Human
uuauaaauuauguuu

SEQ ID NO: 2353054 - RNA, 16 nt, Human
uuauaaauuauguuua

SEQ ID NO: 2353055 - RNA, 17 nt, Human
uuauaaauuauguuuau

SEQ ID NO: 2353056 - RNA, 21 nt, Human
uuauaaauuauguuuauauaa

SEQ ID NO: 2353057 - RNA, 18 nt, Human
uuauaaaucgcuuuugau

SEQ ID NO: 2353058 - RNA, 17 nt, Human
uuauaaaucgcuuuuga

SEQ ID NO: 2353059 - RNA, 14 nt, Human
uuauaaaugcuauu

SEQ ID NO: 2353060 - RNA, 17 nt, Human
uuauaacuuaaaauauu

SEQ ID NO: 2353061 - RNA, 15 nt, Human
uuauaacuuaaaaaa

SEQ ID NO: 2353062 - RNA, 13 nt, Human
uuauaacuuaaaa

SEQ ID NO: 2353063 - RNA, 18 nt, Human
uuauacccccugcaaagc

SEQ ID NO: 2353064 - RNA, 22 nt, Human
uuauaacucaucauaaaauaaa

SEQ ID NO: 2353065 - RNA, 21 nt, Human
uuauaacucaucauaaaauaa

SEQ ID NO: 2353066 - RNA, 20 nt, Human
uuauaacucaucauaaaaua

SEQ ID NO: 2353067 - RNA, 19 nt, Human
uuauaacucaucauaaaau

SEQ ID NO: 2353068 - RNA, 18 nt, Human
uuauaacugaaggagaag

SEQ ID NO: 2353069 - RNA, 19 nt, Human
uuauaacucugcacuacuc

SEQ ID NO: 2353070 - RNA, 22 nt, Human
uuauaacuacuccggagacagg

SEQ ID NO: 2353071 - RNA, 16 nt, Human
uuauaacucugcacua

SEQ ID NO: 2353072 - RNA, 18 nt, Human
uuauaacucaucauaaaa

SEQ ID NO: 2353073 - RNA, 17 nt, Human
uuauaacucaucauaaa

SEQ ID NO: 2353074 - RNA, 16 nt, Human
uuauaacucaucauaa

SEQ ID NO: 2353075 - RNA, 18 nt, Human
uuauacuuuguaaagaca

SEQ ID NO: 2353076 - RNA, 14 nt, Human
uuauacuguauuaa

SEQ ID NO: 2353077 - RNA, 14 nt, Human
uuauagaaaguuca

SEQ ID NO: 2353078 - RNA, 15 nt, Human
uuauagaauauuuau

SEQ ID NO: 2353079 - RNA, 23 nt, Human
uuauagaauauuuauuaccucug

SEQ ID NO: 2353080 - RNA, 15 nt, Human
uuauagacaaauaau

SEQ ID NO: 2353081 - RNA, 21 nt, Human
uuauagaggcuagcuucugcu

SEQ ID NO: 2353082 - RNA, 19 nt, Human
uuauagagggccaagacuu

SEQ ID NO: 2353083 - RNA, 23 nt, Human
uuauagaguguacuuaacuauuc

SEQ ID NO: 2353084 - RNA, 22 nt, Human
uuauacuguacuuaauaaauuc

SEQ ID NO: 2353085 - RNA, 16 nt, Human
uuauacuaagaaaaga

SEQ ID NO: 2353086 - RNA, 16 nt, Human
uuauacucuuucugua

SEQ ID NO: 2353087 - RNA, 12 nt, Human
uuauacuaagaa

SEQ ID NO: 2353088 - RNA, 18 nt, Human
uuauacguguagcuauau

SEQ ID NO: 2353089 - RNA, 21 nt, Human
uuauacguguagcuauaucua

SEQ ID NO: 2353090 - RNA, 15 nt, Human
uuauacguguagcua

SEQ ID NO: 2353091 - RNA, 17 nt, Human
uuauacguguagcuaua

SEQ ID NO: 2353092 - RNA, 16 nt, Human
uuauagccgaaaugau

SEQ ID NO: 2353093 - RNA, 17 nt, Human
uuauagcaaacuuggaa

SEQ ID NO: 2353094 - RNA, 15 nt, Human
uuauagauuugaccu

SEQ ID NO: 2353095 - RNA, 15 nt, Human
uuauagaugucuagg

SEQ ID NO: 2353096 - RNA, 21 nt, Human
uuauagaucccccagacuuua

SEQ ID NO: 2353097 - RNA, 21 nt, Human
uuauagaugggaaugaagcuu

SEQ ID NO: 2353098 - RNA, 16 nt, Human
uuauagcucaguuuau

SEQ ID NO: 2353099 - RNA, 17 nt, Human
uuauagcuauuacuguc

SEQ ID NO: 2353100 - RNA, 22 nt, Human
uuauagccacaucccuuugaaa

SEQ ID NO: 2353101 - RNA, 16 nt, Human
uuauaggaucauuugu

SEQ ID NO: 2353102 - RNA, 21 nt, Human
uuauagugauguaaucuugaa

SEQ ID NO: 2353103 - RNA, 15 nt, Human
uuauaguauaucugg

SEQ ID NO: 2353104 - RNA, 18 nt, Human
uuauaguauaucuggaca

SEQ ID NO: 2353105 - RNA, 18 nt, Human
uuauaggucacuccuggg

SEQ ID NO: 2353106 - RNA, 17 nt, Human
uuauaggucacuccugg

SEQ ID NO: 2353107 - RNA, 19 nt, Human
uuauagguggccucuccuu

SEQ ID NO: 2353108 - RNA, 23 nt, Human
auaauuuuuaaaguauauauuua

SEQ ID NO: 2353109 - RNA, 21 nt, Human
auaauuuuuaaaguauauauu

SEQ ID NO: 2353110 - RNA, 19 nt, Human
auaauuuuuaaaguauaua

SEQ ID NO: 2353111 - RNA, 18 nt, Human
auaauuuuuaaaguauau

SEQ ID NO: 2353112 - RNA, 15 nt, Human
auaauuuuuuauuca

SEQ ID NO: 2353113 - RNA, 16 nt, Human
auaauuuuuuauucaa

SEQ ID NO: 2353114 - RNA, 20 nt, Human
auaauuuuuuucaauauuua

SEQ ID NO: 2353115 - RNA, 17 nt, Human
auaauuuuuuauucaag

SEQ ID NO: 2353116 - RNA, 21 nt, Human
auaauuuuuuucaauauuuau

SEQ ID NO: 2353117 - RNA, 22 nt, Human
auaauuuuuuucaauauuuauu

SEQ ID NO: 2353118 - RNA, 21 nt, Human
auaauuuuuauauuugaaaua

SEQ ID NO: 2353119 - RNA, 22 nt, Human
auaauuuuuauauuugaaauau

SEQ ID NO: 2353120 - RNA, 15 nt, Human
auacaaaagcaugug

SEQ ID NO: 2353121 - RNA, 13 nt, Human
auacaaaagcaug

SEQ ID NO: 2353122 - RNA, 12 nt, Human
auacaaaagcau

SEQ ID NO: 2353123 - RNA, 22 nt, Human
auacaaaaaaaaaaaaaaauua

SEQ ID NO: 2353124 - RNA, 15 nt, Human
auaauuuuuaaagua

SEQ ID NO: 2353125 - RNA, 14 nt, Human
auaauuuuuauauu

SEQ ID NO: 2353126 - RNA, 16 nt, Human
auaauuuuuauauuug

SEQ ID NO: 2353127 - RNA, 19 nt, Human
auaauuuuuauauuugaaa

SEQ ID NO: 2353128 - RNA, 13 nt, Human
auaauuuugugaa

SEQ ID NO: 2353129 - RNA, 14 nt, Human
auaauuuugugaag

SEQ ID NO: 2353130 - RNA, 15 nt, Human
auaauuuugugaagc

SEQ ID NO: 2353131 - RNA, 20 nt, Human
auaauuuugugaagcaaaau

SEQ ID NO: 2353132 - RNA, 18 nt, Human
uuauauaguuuacuauuu

SEQ ID NO: 2353133 - RNA, 21 nt, Human
uuauauagguuuuguuugcua

SEQ ID NO: 2353134 - RNA, 23 nt, Human
uuauauagguuuuguuugcuauc

SEQ ID NO: 2353135 - RNA, 15 nt, Human
uuauauauacaguaa

SEQ ID NO: 2353136 - RNA, 21 nt, Human
uuauauagggaucaaccagcu

SEQ ID NO: 2353137 - RNA, 18 nt, Human
uuauauagguugugcaaa

SEQ ID NO: 2353138 - RNA, 19 nt, Human
uuauauagauuauaacuug

SEQ ID NO: 2353139 - RNA, 14 nt, Human
uuauauauguauuu

SEQ ID NO: 2353140 - RNA, 19 nt, Human
uuauauauauauauauuuc

SEQ ID NO: 2353141 - RNA, 15 nt, Human
auaauuuuaugaaug

SEQ ID NO: 2353142 - RNA, 19 nt, Human
auaauuuuaugaaugucuu

SEQ ID NO: 2353143 - RNA, 23 nt, Human
auaauuuucuucaugcaaugaca

SEQ ID NO: 2353144 - RNA, 22 nt, Human
auaauuuucuucaugcaaugac

SEQ ID NO: 2353145 - RNA, 17 nt, Human
auaauuuucuucaugca

SEQ ID NO: 2353146 - RNA, 13 nt, Human
auaauuuucuuca

SEQ ID NO: 2353147 - RNA, 17 nt, Human
uuauauauguauuuaua

SEQ ID NO: 2353148 - RNA, 12 nt, Human
uuauauauguga

SEQ ID NO: 2353149 - RNA, 13 nt, Human
uuauauaugugaa

SEQ ID NO: 2353150 - RNA, 14 nt, Human
auaauuuuaagaaa

SEQ ID NO: 2353151 - RNA, 15 nt, Human
auaauuuuaagaaau

SEQ ID NO: 2353152 - RNA, 21 nt, Human
auaauuuuaagaaaucaaaga

SEQ ID NO: 2353153 - RNA, 22 nt, Human
uuauauagauuauaacuugucu

SEQ ID NO: 2353154 - RNA, 13 nt, Human
uuauauaaaugcu

SEQ ID NO: 2353155 - RNA, 14 nt, Human
uuauauaaaugcuu

SEQ ID NO: 2353156 - RNA, 15 nt, Human
uuauaguuuguacau

SEQ ID NO: 2353157 - RNA, 16 nt, Human
uuauaguuuguacaug

SEQ ID NO: 2353158 - RNA, 12 nt, Human
uuauaguuugua

SEQ ID NO: 2353159 - RNA, 18 nt, Human
uuauauaagcuuguauuc

SEQ ID NO: 2353160 - RNA, 20 nt, Human
uuauaguugugggugggaga

SEQ ID NO: 2353161 - RNA, 15 nt, Human
uuauaguuguaacua

SEQ ID NO: 2353162 - RNA, 18 nt, Human
auacaaauuagaaaaugu

SEQ ID NO: 2353163 - RNA, 14 nt, Human
auacagauuuugau

SEQ ID NO: 2353164 - RNA, 16 nt, Human
auacagauuuugauag

SEQ ID NO: 2353165 - RNA, 17 nt, Human
auacagauuuugauagc

SEQ ID NO: 2353166 - RNA, 18 nt, Human
auacagauuuugauagca

SEQ ID NO: 2353167 - RNA, 19 nt, Human
auacagauuuugauagcaa

SEQ ID NO: 2353168 - RNA, 22 nt, Human
auacagauuuugauagcaaagc

SEQ ID NO: 2353169 - RNA, 16 nt, Human
auacagcaacaauuua

SEQ ID NO: 2353170 - RNA, 18 nt, Human
auacagccaaagauaauc

SEQ ID NO: 2353171 - RNA, 20 nt, Human
auacagcccucccccagcag

SEQ ID NO: 2353172 - RNA, 20 nt, Human
auacagcauuacaaauugcu

SEQ ID NO: 2353173 - RNA, 13 nt, Human
auacagcucagaa

SEQ ID NO: 2353174 - RNA, 11 nt, Human
auacagcucua

SEQ ID NO: 2353175 - RNA, 19 nt, Human
auacaaacauauuuguuaa

SEQ ID NO: 2353176 - RNA, 22 nt, Human
auacaaacaauggaaacugaau

SEQ ID NO: 2353177 - RNA, 16 nt, Human
auacaaacaauggaaa

SEQ ID NO: 2353178 - RNA, 18 nt, Human
auacaaacaauggaaacu

SEQ ID NO: 2353179 - RNA, 23 nt, Human
auaauuuuuuuauuacugauuuu

SEQ ID NO: 2353180 - RNA, 14 nt, Human
auacaaauuagaaa

SEQ ID NO: 2353181 - RNA, 17 nt, Human
auacaaauuagaaaaug

SEQ ID NO: 2353182 - RNA, 15 nt, Human
auacaaauuagaaaa

SEQ ID NO: 2353183 - RNA, 14 nt, Human
auacaggaaaagcu

SEQ ID NO: 2353184 - RNA, 19 nt, Human
auacaggaaaagcugcuga

SEQ ID NO: 2353185 - RNA, 20 nt, Human
auacaggaaaagcugcugac

SEQ ID NO: 2353186 - RNA, 22 nt, Human
auacaggaaaagcugcugacag

SEQ ID NO: 2353187 - RNA, 17 nt, Human
auacaguaacuuuaugu

SEQ ID NO: 2353188 - RNA, 18 nt, Human
auacaguaacuuuaugug

SEQ ID NO: 2353189 - RNA, 21 nt, Human
auacagggcaugcauuuugca

SEQ ID NO: 2353190 - RNA, 21 nt, Human
auacaguucggugagcuacaa

SEQ ID NO: 2353191 - RNA, 16 nt, Human
auacaugacucagcau

SEQ ID NO: 2353192 - RNA, 21 nt, Human
auacauauuuuauagaacuuc

SEQ ID NO: 2353193 - RNA, 20 nt, Human
auacaucccuuaccugggaa

SEQ ID NO: 2353194 - RNA, 14 nt, Human
auacauauuuccaa

SEQ ID NO: 2353195 - RNA, 20 nt, Human
auacaguuguuggccuccgg

SEQ ID NO: 2353196 - RNA, 22 nt, Human
auacaguuugucacaugaaaca

SEQ ID NO: 2353197 - RNA, 21 nt, Human
auacauaucuuuauuaaucac

SEQ ID NO: 2353198 - RNA, 22 nt, Human
auacauaugaguguggaagccg

SEQ ID NO: 2353199 - RNA, 19 nt, Human
auacaguacaggcagcaca

SEQ ID NO: 2353200 - RNA, 16 nt, Human
auacaguacaggcagc

SEQ ID NO: 2353201 - RNA, 15 nt, Human
auacaguacaggcag

SEQ ID NO: 2353202 - RNA, 19 nt, Human
auacaguaagcugcucuau

SEQ ID NO: 2353203 - RNA, 19 nt, Human
auacaguaacuuuaugugu

SEQ ID NO: 2353204 - RNA, 20 nt, Human
auacaguaacuuuaugugua

SEQ ID NO: 2353205 - RNA, 17 nt, Human
auacagucccuaaagaa

SEQ ID NO: 2353206 - RNA, 18 nt, Human
auacagucccuaaagaaa

SEQ ID NO: 2353207 - RNA, 20 nt, Human
auacagucccuaaagaaaaa

SEQ ID NO: 2353208 - RNA, 22 nt, Human
auacagucccuaaagaaaaaaa

SEQ ID NO: 2353209 - RNA, 16 nt, Human
auacaguuguuggccu

SEQ ID NO: 2353210 - RNA, 19 nt, Human
auaccaaaauuauuucaga

SEQ ID NO: 2353211 - RNA, 20 nt, Human
auaccaaaauuauuucagaa

SEQ ID NO: 2353212 - RNA, 18 nt, Human
auaccaaaauuauuucag

SEQ ID NO: 2353213 - RNA, 14 nt, Human
auaccaaguauuua

SEQ ID NO: 2353214 - RNA, 22 nt, Human
auacauuucuccuuugauaaaa

SEQ ID NO: 2353215 - RNA, 19 nt, Human
auacauuugaggggaaaac

SEQ ID NO: 2353216 - RNA, 16 nt, Human
auacauuugauaaagu

SEQ ID NO: 2353217 - RNA, 23 nt, Human
auacauuuauaauguuugcuauu

SEQ ID NO: 2353218 - RNA, 17 nt, Human
auacauuuaugaauuaa

SEQ ID NO: 2353219 - RNA, 20 nt, Human
auacauuucuccuuugauaa

SEQ ID NO: 2353220 - RNA, 21 nt, Human
auacauuucuccuuugauaaa

SEQ ID NO: 2353221 - RNA, 21 nt, Human
auacauuuauaauguuugcua

SEQ ID NO: 2353222 - RNA, 20 nt, Human
auacauuuauaauguuugcu

SEQ ID NO: 2353223 - RNA, 15 nt, Human
auacauuuauaaugu

SEQ ID NO: 2353224 - RNA, 16 nt, Human
auacauugucucuaaa

SEQ ID NO: 2353225 - RNA, 21 nt, Human
auacauugucucuaaauugug

SEQ ID NO: 2353226 - RNA, 15 nt, Human
auacauugaauuaga

SEQ ID NO: 2353227 - RNA, 17 nt, Human
auacauugaauuagaaa

SEQ ID NO: 2353228 - RNA, 19 nt, Human
auacauugaauuagaaaca

SEQ ID NO: 2353229 - RNA, 20 nt, Human
uuaucaaaucagucagugca

SEQ ID NO: 2353230 - RNA, 14 nt, Human
uuaucaacauuugu

SEQ ID NO: 2353231 - RNA, 21 nt, Human
uuaucaccgugggcucccuga

SEQ ID NO: 2353232 - RNA, 11 nt, Human
uuaucaagugu

SEQ ID NO: 2353233 - RNA, 14 nt, Human
uuaucaagugucuu

SEQ ID NO: 2353234 - RNA, 18 nt, Human
uuaucacugacacaaaaa

SEQ ID NO: 2353235 - RNA, 20 nt, Human
uuaucaguaagaaaaagaag

SEQ ID NO: 2353236 - RNA, 13 nt, Human
auacucaugugua

SEQ ID NO: 2353237 - RNA, 12 nt, Human
auacucaugugu

SEQ ID NO: 2353238 - RNA, 18 nt, Human
auacucauccuuguauaa

SEQ ID NO: 2353239 - RNA, 11 nt, Human
auacucaugug

SEQ ID NO: 2353240 - RNA, 18 nt, Human
auacucauaaugugaagu

SEQ ID NO: 2353241 - RNA, 19 nt, Human
auacucauaaugugaagug

SEQ ID NO: 2353242 - RNA, 20 nt, Human
auacucauaaugugaagugu

SEQ ID NO: 2353243 - RNA, 15 nt, Human
auacucauccuugua

SEQ ID NO: 2353244 - RNA, 15 nt, Human
auacucauaauguga

SEQ ID NO: 2353245 - RNA, 16 nt, Human
auacucauaaugugaa

SEQ ID NO: 2353246 - RNA, 17 nt, Human
auacucauaaugugaag

SEQ ID NO: 2353247 - RNA, 15 nt, Human
uuaucaacaauagug

SEQ ID NO: 2353248 - RNA, 13 nt, Human
uuaucaaaucagu

SEQ ID NO: 2353249 - RNA, 15 nt, Human
uuaucaaaacuuucu

SEQ ID NO: 2353250 - RNA, 16 nt, Human
uuaucaaaacuuucuu

SEQ ID NO: 2353251 - RNA, 16 nt, Human
uuaucaugcugucuuu

SEQ ID NO: 2353252 - RNA, 13 nt, Human
uuaucaugcuguc

SEQ ID NO: 2353253 - RNA, 16 nt, Human
uuaucaugcaaaugcu

SEQ ID NO: 2353254 - RNA, 19 nt, Human
uuaucauggucucagucau

SEQ ID NO: 2353255 - RNA, 12 nt, Human
uuaucaugugua

SEQ ID NO: 2353256 - RNA, 13 nt, Human
uuaucauguguaa

SEQ ID NO: 2353257 - RNA, 14 nt, Human
uuaucauguguaau

SEQ ID NO: 2353258 - RNA, 22 nt, Human
uuaucaugugaaaucauucauu

SEQ ID NO: 2353259 - RNA, 18 nt, Human
uuaucaugugaaaucauu

SEQ ID NO: 2353260 - RNA, 20 nt, Human
uuaucaugugaaaucauuca

SEQ ID NO: 2353261 - RNA, 17 nt, Human
uuaucagugacagaguu

SEQ ID NO: 2353262 - RNA, 16 nt, Human
uuaucauccacauugu

SEQ ID NO: 2353263 - RNA, 16 nt, Human
uuaucagugacagagu

SEQ ID NO: 2353264 - RNA, 21 nt, Human
uuaucaguaagaaaaagaaga

SEQ ID NO: 2353265 - RNA, 23 nt, Human
uuaucagucauaacuaaauaaag

SEQ ID NO: 2353266 - RNA, 15 nt, Human
uuaucagucaauauu

SEQ ID NO: 2353267 - RNA, 14 nt, Human
uuaucagucaauau

SEQ ID NO: 2353268 - RNA, 23 nt, Human
uuaucagucaauauuuuuagaua

SEQ ID NO: 2353269 - RNA, 21 nt, Human
uuaucagucauaacuaaauaa

SEQ ID NO: 2353270 - RNA, 11 nt, Human
uuaucaugcaa

SEQ ID NO: 2353271 - RNA, 18 nt, Human
uuaucauccacauuguuu

SEQ ID NO: 2353272 - RNA, 19 nt, Human
uuaucaugacauguuauau

SEQ ID NO: 2353273 - RNA, 20 nt, Human
uuaucauccacauuguuuua

SEQ ID NO: 2353274 - RNA, 17 nt, Human
uuaucaugugaaaucau

SEQ ID NO: 2353275 - RNA, 23 nt, Human
auacuauuuaguuuuuguaauuu

SEQ ID NO: 2353276 - RNA, 15 nt, Human
auacuauuuuuacug

SEQ ID NO: 2353277 - RNA, 20 nt, Human
auacuauuuuuacugccacu

SEQ ID NO: 2353278 - RNA, 18 nt, Human
auacuauuuuuacugcca

SEQ ID NO: 2353279 - RNA, 19 nt, Human
auacuauuuuuacugccac

SEQ ID NO: 2353280 - RNA, 20 nt, Human
auacuauuuaguuuuuguaa

SEQ ID NO: 2353281 - RNA, 21 nt, Human
auacuauuuaaagccuccuca

SEQ ID NO: 2353282 - RNA, 22 nt, Human
auacuauuuaaagccuccucau

SEQ ID NO: 2353283 - RNA, 13 nt, Human
auacuacuccugu

SEQ ID NO: 2353284 - RNA, 17 nt, Human
auacuaccuugaaaaua

SEQ ID NO: 2353285 - RNA, 15 nt, Human
auacuaccuugaaaa

SEQ ID NO: 2353286 - RNA, 14 nt, Human
auacuaccuugaaa

SEQ ID NO: 2353287 - RNA, 20 nt, Human
auacuacaguuuguuaguau

SEQ ID NO: 2353288 - RNA, 16 nt, Human
auacuacaguuuguua

SEQ ID NO: 2353289 - RNA, 15 nt, Human
auacuacaguuuguu

SEQ ID NO: 2353290 - RNA, 13 nt, Human
auacuacaguuug

SEQ ID NO: 2353291 - RNA, 19 nt, Human
auaccauggugaauuaauc

SEQ ID NO: 2353292 - RNA, 12 nt, Human
auaccagugugg

SEQ ID NO: 2353293 - RNA, 16 nt, Human
auaccagguugaaaga

SEQ ID NO: 2353294 - RNA, 14 nt, Human
auaccagguugaaa

SEQ ID NO: 2353295 - RNA, 17 nt, Human
auaccagugaaccaaag

SEQ ID NO: 2353296 - RNA, 19 nt, Human
auaccagugaaccaaagag

SEQ ID NO: 2353297 - RNA, 17 nt, Human
auaccaggccgccccag

SEQ ID NO: 2353298 - RNA, 22 nt, Human
auaccagccccuguauggcacu

SEQ ID NO: 2353299 - RNA, 18 nt, Human
auaccagcuuagauuuua

SEQ ID NO: 2353300 - RNA, 22 nt, Human
auaccagcgaggaggcuccaga

SEQ ID NO: 2353301 - RNA, 16 nt, Human
auaccagcgaggaggc

SEQ ID NO: 2353302 - RNA, 14 nt, Human
auacuaagaaaaga

SEQ ID NO: 2353303 - RNA, 20 nt, Human
auaccagugaaccaaagaga

SEQ ID NO: 2353304 - RNA, 21 nt, Human
auacuaaccagcagaaaugcc

SEQ ID NO: 2353305 - RNA, 19 nt, Human
auaccagccaguaaauggg

SEQ ID NO: 2353306 - RNA, 21 nt, Human
auaccaaugaaaaaauguaua

SEQ ID NO: 2353307 - RNA, 17 nt, Human
auaccaaguauuuauua

SEQ ID NO: 2353308 - RNA, 20 nt, Human
auaccaaugcuuuuaucaaa

SEQ ID NO: 2353309 - RNA, 17 nt, Human
auaccagccaguaaaug

SEQ ID NO: 2353310 - RNA, 19 nt, Human
auaccaaugaaaaaaugua

SEQ ID NO: 2353311 - RNA, 22 nt, Human
auaccacaggaaccacaagacu

SEQ ID NO: 2353312 - RNA, 20 nt, Human
auaaucagugugucuaaauu

SEQ ID NO: 2353313 - RNA, 17 nt, Human
auaaucagccucuuaaa

SEQ ID NO: 2353314 - RNA, 16 nt, Human
auaaucagccucuuaa

SEQ ID NO: 2353315 - RNA, 15 nt, Human
auaaucagccucuua

SEQ ID NO: 2353316 - RNA, 14 nt, Human
auaaucagccucuu

SEQ ID NO: 2353317 - RNA, 13 nt, Human
auaaucuuugggu

SEQ ID NO: 2353318 - RNA, 17 nt, Human
auaauccagucuucacu

SEQ ID NO: 2353319 - RNA, 15 nt, Human
auaaucccagcacuu

SEQ ID NO: 2353320 - RNA, 21 nt, Human
auaaucuuucacaggggacag

SEQ ID NO: 2353321 - RNA, 19 nt, Human
auaauacaguaucucaggg

SEQ ID NO: 2353322 - RNA, 12 nt, Human
auaauaauauau

SEQ ID NO: 2353323 - RNA, 22 nt, Human
auaauacacuaauuccuuucua

SEQ ID NO: 2353324 - RNA, 21 nt, Human
auaauacagccaaagauaauc

SEQ ID NO: 2353325 - RNA, 17 nt, Human
auaauacagccaaagau

SEQ ID NO: 2353326 - RNA, 21 nt, Human
auaauacacuaauuccuuucu

SEQ ID NO: 2353327 - RNA, 18 nt, Human
auaaucacgcuuuccuga

SEQ ID NO: 2353328 - RNA, 16 nt, Human
auaaucacgcuuuccu

SEQ ID NO: 2353329 - RNA, 13 nt, Human
auaaucagccucu

SEQ ID NO: 2353330 - RNA, 21 nt, Human
auaaucagcaagaauuugauc

SEQ ID NO: 2353331 - RNA, 19 nt, Human
auaaucacuuuuuuccaca

SEQ ID NO: 2353332 - RNA, 22 nt, Human
auaauuaucggaagcagugccu

SEQ ID NO: 2353333 - RNA, 21 nt, Human
auaauuaucggaagcagugcc

SEQ ID NO: 2353334 - RNA, 20 nt, Human
auaauuaucggaagcagugc

SEQ ID NO: 2353335 - RNA, 19 nt, Human
auaauuaucggaagcagug

SEQ ID NO: 2353336 - RNA, 16 nt, Human
auaauuaucggaagca

SEQ ID NO: 2353337 - RNA, 17 nt, Human
auaauuauccagaguuu

SEQ ID NO: 2353338 - RNA, 19 nt, Human
auaauucccuaucuuuuag

SEQ ID NO: 2353339 - RNA, 17 nt, Human
auaauucccuaucuuuu

SEQ ID NO: 2353340 - RNA, 12 nt, Human
auaauucccuau

SEQ ID NO: 2353341 - RNA, 14 nt, Human
auaauuaugacagu

SEQ ID NO: 2353342 - RNA, 16 nt, Human
auaauuaugacaguua

SEQ ID NO: 2353343 - RNA, 14 nt, Human
auaauucuacuuug

SEQ ID NO: 2353344 - RNA, 14 nt, Human
auaaugaagcuuua

SEQ ID NO: 2353345 - RNA, 14 nt, Human
auaaugaauacuuu

SEQ ID NO: 2353346 - RNA, 12 nt, Human
auaauuguauca

SEQ ID NO: 2353347 - RNA, 17 nt, Human
auaauuguaucagaggc

SEQ ID NO: 2353348 - RNA, 23 nt, Human
auaauuguaucagaggccuauaa

SEQ ID NO: 2353349 - RNA, 13 nt, Human
auaauuguaucgu

SEQ ID NO: 2353350 - RNA, 23 nt, Human
uuagaugcaguucugaagaagau

SEQ ID NO: 2353351 - RNA, 22 nt, Human
uuagaugcaguucugaagaaga

SEQ ID NO: 2353352 - RNA, 11 nt, Human
auaauucugua

SEQ ID NO: 2353353 - RNA, 19 nt, Human
auaauugaguuuucagugg

SEQ ID NO: 2353354 - RNA, 15 nt, Human
auaauugaucaaauu

SEQ ID NO: 2353355 - RNA, 14 nt, Human
auaauugaucaaau

SEQ ID NO: 2353356 - RNA, 13 nt, Human
auaauugcauuca

SEQ ID NO: 2353357 - RNA, 14 nt, Human
auaauugcauucau

SEQ ID NO: 2353358 - RNA, 20 nt, Human
auaauucccuaucuuuuagu

SEQ ID NO: 2353359 - RNA, 12 nt, Human
auaauucuaaag

SEQ ID NO: 2353360 - RNA, 21 nt, Human
uuagcagcagccuuuaaugca

SEQ ID NO: 2353361 - RNA, 12 nt, Human
uuagcagacagg

SEQ ID NO: 2353362 - RNA, 20 nt, Human
uuagcaggagaggagagcca

SEQ ID NO: 2353363 - RNA, 15 nt, Human
uuagcagcuuccaga

SEQ ID NO: 2353364 - RNA, 12 nt, Human
uuagcaccaggg

SEQ ID NO: 2353365 - RNA, 23 nt, Human
uuagauggauucuccacucaguu

SEQ ID NO: 2353366 - RNA, 13 nt, Human
uuagaugugauuu

SEQ ID NO: 2353367 - RNA, 14 nt, Human
uuagauuagcucug

SEQ ID NO: 2353368 - RNA, 17 nt, Human
uuagauggauucuccac

SEQ ID NO: 2353369 - RNA, 16 nt, Human
uuagauggauucucca

SEQ ID NO: 2353370 - RNA, 22 nt, Human
auaauuguaucguauagcugua

SEQ ID NO: 2353371 - RNA, 20 nt, Human
auaauuguaucguauagcug

SEQ ID NO: 2353372 - RNA, 21 nt, Human
auaauuguaucguauagcugu

SEQ ID NO: 2353373 - RNA, 16 nt, Human
uuagauuagcucugga

SEQ ID NO: 2353374 - RNA, 17 nt, Human
uuagauuagcucuggac

SEQ ID NO: 2353375 - RNA, 23 nt, Human
uuagauugaaaacuuuucucaga

SEQ ID NO: 2353376 - RNA, 22 nt, Human
auaaguuaacuauuuuauuuuc

SEQ ID NO: 2353377 - RNA, 16 nt, Human
auaagcagauuuaaca

SEQ ID NO: 2353378 - RNA, 18 nt, Human
auaagcacugugcuaaua

SEQ ID NO: 2353379 - RNA, 16 nt, Human
auaagcaagagagaug

SEQ ID NO: 2353380 - RNA, 14 nt, Human
auaagcacugugcu

SEQ ID NO: 2353381 - RNA, 17 nt, Human
auaagcacugugcuaau

SEQ ID NO: 2353382 - RNA, 17 nt, Human
auaaguuaacuuccaau

SEQ ID NO: 2353383 - RNA, 17 nt, Human
auaagcaagagagaugu

SEQ ID NO: 2353384 - RNA, 15 nt, Human
auaagcaagagagau

SEQ ID NO: 2353385 - RNA, 14 nt, Human
auaagcaagagaga

SEQ ID NO: 2353386 - RNA, 12 nt, Human
auaagcaagaga

SEQ ID NO: 2353387 - RNA, 23 nt, Human
auaagcaaagggagcacuggguu

SEQ ID NO: 2353388 - RNA, 20 nt, Human
auaagaagggauggauucca

SEQ ID NO: 2353389 - RNA, 18 nt, Human
auaagaauaaaauguuga

SEQ ID NO: 2353390 - RNA, 21 nt, Human
auaagaagggauggauuccaa

SEQ ID NO: 2353391 - RNA, 15 nt, Human
auaagaauaaaaugu

SEQ ID NO: 2353392 - RNA, 23 nt, Human
auaagaaccuuuugagugccuua

SEQ ID NO: 2353393 - RNA, 15 nt, Human
auaagaaaguuucac

SEQ ID NO: 2353394 - RNA, 13 nt, Human
uuaccuaauuaga

SEQ ID NO: 2353395 - RNA, 11 nt, Human
uuaccucugau

SEQ ID NO: 2353396 - RNA, 21 nt, Human
uuaccucugauaccucaaccc

SEQ ID NO: 2353397 - RNA, 15 nt, Human
uuaccucuuaacaau

SEQ ID NO: 2353398 - RNA, 20 nt, Human
uuaccucuuaacaauuucug

SEQ ID NO: 2353399 - RNA, 12 nt, Human
uuaccucuuuaa

SEQ ID NO: 2353400 - RNA, 21 nt, Human
uuaccuaaacagauauaaaug

SEQ ID NO: 2353401 - RNA, 17 nt, Human
uuaccuaaacagauaua

SEQ ID NO: 2353402 - RNA, 18 nt, Human
uuaccuaaacagauauaa

SEQ ID NO: 2353403 - RNA, 19 nt, Human
uuaccuaaacagauauaaa

SEQ ID NO: 2353404 - RNA, 20 nt, Human
uuaccuaaacagauauaaau

SEQ ID NO: 2353405 - RNA, 15 nt, Human
uuaccgcguuguaaa

SEQ ID NO: 2353406 - RNA, 16 nt, Human
uuaccgcguuguaaaa

SEQ ID NO: 2353407 - RNA, 18 nt, Human
uuaccgcguuguaaaaua

SEQ ID NO: 2353408 - RNA, 21 nt, Human
uuaccgcguuguaaaauauag

SEQ ID NO: 2353409 - RNA, 14 nt, Human
uuaccguuucuucc

SEQ ID NO: 2353410 - RNA, 16 nt, Human
uuaccguuucuucccu

SEQ ID NO: 2353411 - RNA, 16 nt, Human
uuaccuaaacagauau

SEQ ID NO: 2353412 - RNA, 17 nt, Human
uuaccugaucaaugaca

SEQ ID NO: 2353413 - RNA, 18 nt, Human
uuaccugaucaaugacag

SEQ ID NO: 2353414 - RNA, 19 nt, Human
uuaccugaucaaugacaga

SEQ ID NO: 2353415 - RNA, 22 nt, Human
uuaccugaaaacacugugcaca

SEQ ID NO: 2353416 - RNA, 20 nt, Human
uuaccugaaaacacugugca

SEQ ID NO: 2353417 - RNA, 18 nt, Human
uuaccugaaaacacugug

SEQ ID NO: 2353418 - RNA, 22 nt, Human
auaagaaccuuuugagugccuu

SEQ ID NO: 2353419 - RNA, 20 nt, Human
uuaccugaucaaugacagag

SEQ ID NO: 2353420 - RNA, 23 nt, Human
uuaccugaucaaugacagagccu

SEQ ID NO: 2353421 - RNA, 22 nt, Human
auaaguuaacuuccaauuuaca

SEQ ID NO: 2353422 - RNA, 13 nt, Human
auaaguuauugca

SEQ ID NO: 2353423 - RNA, 14 nt, Human
auaaguuauugcag

SEQ ID NO: 2353424 - RNA, 16 nt, Human
auaaguuauugcaguu

SEQ ID NO: 2353425 - RNA, 20 nt, Human
auaaguuauugcaguuuauc

SEQ ID NO: 2353426 - RNA, 18 nt, Human
auaaguucaaauucuucu

SEQ ID NO: 2353427 - RNA, 21 nt, Human
auaaguuauugcaguuuauca

SEQ ID NO: 2353428 - RNA, 24 nt, Human
auaaguuauugcaguuuaucauuc

SEQ ID NO: 2353429 - RNA, 24 nt, Human
auaaguucaaauucuucugaacuc

SEQ ID NO: 2353430 - RNA, 21 nt, Human
auaaguucaaauucuucugaa

SEQ ID NO: 2353431 - RNA, 20 nt, Human
auaaguucaaauucuucuga

SEQ ID NO: 2353432 - RNA, 23 nt, Human
auaaguucuaguugcuuguaaaa

SEQ ID NO: 2353433 - RNA, 20 nt, Human
auaaguucuuaugccauguu

SEQ ID NO: 2353434 - RNA, 20 nt, Human
auaaguuucacugacuuaga

SEQ ID NO: 2353435 - RNA, 21 nt, Human
auaaguuucugggaccucagu

SEQ ID NO: 2353436 - RNA, 18 nt, Human
auaaguuucuuugcuuca

SEQ ID NO: 2353437 - RNA, 13 nt, Human
auaaguuugaagg

SEQ ID NO: 2353438 - RNA, 15 nt, Human
auaaguuugaaggaa

SEQ ID NO: 2353439 - RNA, 19 nt, Human
auaaguuugaaggaaacag

SEQ ID NO: 2353440 - RNA, 12 nt, Human
auaaguuuauuu

SEQ ID NO: 2353441 - RNA, 14 nt, Human
auaaguuuauuucu

SEQ ID NO: 2353442 - RNA, 18 nt, Human
auaaguuuauuucuuaaa

SEQ ID NO: 2353443 - RNA, 22 nt, Human
auaaguuuauuucuuaaaucua

SEQ ID NO: 2353444 - RNA, 15 nt, Human
auaauaagcuaaaga

SEQ ID NO: 2353445 - RNA, 13 nt, Human
auaauaagcuaaa

SEQ ID NO: 2353446 - RNA, 23 nt, Human
auaauaaauucccuggccuuuca

SEQ ID NO: 2353447 - RNA, 13 nt, Human
auaaguuuuaugu

SEQ ID NO: 2353448 - RNA, 20 nt, Human
auaaguuugaaggaaacagu

SEQ ID NO: 2353449 - RNA, 21 nt, Human
auaaguuugaaggaaacaguu

SEQ ID NO: 2353450 - RNA, 17 nt, Human
auaaguuugcaauuugg

SEQ ID NO: 2353451 - RNA, 18 nt, Human
auaaguuugcaauuuggg

SEQ ID NO: 2353452 - RNA, 21 nt, Human
auaauacaccacuacauucug

SEQ ID NO: 2353453 - RNA, 23 nt, Human
auaauacaccacuacauucuguu

SEQ ID NO: 2353454 - RNA, 13 nt, Human
auaaauaaaacau

SEQ ID NO: 2353455 - RNA, 17 nt, Human
auaaauaaaaauggaua

SEQ ID NO: 2353456 - RNA, 15 nt, Human
auaaauaaaaaugga

SEQ ID NO: 2353457 - RNA, 14 nt, Human
auaaaguaucuaca

SEQ ID NO: 2353458 - RNA, 19 nt, Human
auaaaguaugguauugaaa

SEQ ID NO: 2353459 - RNA, 12 nt, Human
auaaaguauuua

SEQ ID NO: 2353460 - RNA, 14 nt, Human
auaaaguauuuaau

SEQ ID NO: 2353461 - RNA, 15 nt, Human
auaaaguauuuaauu

SEQ ID NO: 2353462 - RNA, 17 nt, Human
auaaaguauuuaauuag

SEQ ID NO: 2353463 - RNA, 19 nt, Human
auaaaguauuuaauuagug

SEQ ID NO: 2353464 - RNA, 21 nt, Human
auaaaguauuuaauuagugcu

SEQ ID NO: 2353465 - RNA, 21 nt, Human
auaaacuuagaauaaaauugu

SEQ ID NO: 2353466 - RNA, 16 nt, Human
auaaaguaguccugug

SEQ ID NO: 2353467 - RNA, 18 nt, Human
auaaaguaguaaaaauua

SEQ ID NO: 2353468 - RNA, 15 nt, Human
auaaaguaucaugca

SEQ ID NO: 2353469 - RNA, 17 nt, Human
auaaaguaucaugcauu

SEQ ID NO: 2353470 - RNA, 18 nt, Human
auaaaguaucaugcauuc

SEQ ID NO: 2353471 - RNA, 17 nt, Human
auaaaguaguccuguga

SEQ ID NO: 2353472 - RNA, 15 nt, Human
auaaacuuuaccuuu

SEQ ID NO: 2353473 - RNA, 13 nt, Human
auaaacuuuaccu

SEQ ID NO: 2353474 - RNA, 23 nt, Human
auaaacuuagugcggacaaguuu

SEQ ID NO: 2353475 - RNA, 16 nt, Human
auaaacuguguuuacu

SEQ ID NO: 2353476 - RNA, 14 nt, Human
auaaacugugugca

SEQ ID NO: 2353477 - RNA, 20 nt, Human
auaaacugacuuuauccuca

SEQ ID NO: 2353478 - RNA, 16 nt, Human
auaaacuuuaauauaa

SEQ ID NO: 2353479 - RNA, 14 nt, Human
auaaacuuagaaua

SEQ ID NO: 2353480 - RNA, 15 nt, Human
auaaacuuagaauaa

SEQ ID NO: 2353481 - RNA, 20 nt, Human
auaaacuuuaauauaaagua

SEQ ID NO: 2353482 - RNA, 22 nt, Human
auaaacuuuaauauaaaguagu

SEQ ID NO: 2353483 - RNA, 12 nt, Human
auaaacugugug

SEQ ID NO: 2353484 - RNA, 15 nt, Human
auaaacugacuuuau

SEQ ID NO: 2353485 - RNA, 18 nt, Human
auaaacugacuuuauccu

SEQ ID NO: 2353486 - RNA, 18 nt, Human
auaaacuggcagcucagc

SEQ ID NO: 2353487 - RNA, 14 nt, Human
auaaacuaucaguu

SEQ ID NO: 2353488 - RNA, 15 nt, Human
auaaacucuaaacau

SEQ ID NO: 2353489 - RNA, 12 nt, Human
auaaacugacuu

SEQ ID NO: 2353490 - RNA, 13 nt, Human
auaaacugacuuu

SEQ ID NO: 2353491 - RNA, 20 nt, Human
auaaacgcgggaaaaaagau

SEQ ID NO: 2353492 - RNA, 20 nt, Human
auaaacgugaugaucagcug

SEQ ID NO: 2353493 - RNA, 19 nt, Human
auaaacuagauuacauuca

SEQ ID NO: 2353494 - RNA, 17 nt, Human
auaaacuagauuacauu

SEQ ID NO: 2353495 - RNA, 22 nt, Human
auaaacauuuguagcauccucu

SEQ ID NO: 2353496 - RNA, 13 nt, Human
auaaacauuguau

SEQ ID NO: 2353497 - RNA, 23 nt, Human
auaaacauuaagauugaggccug

SEQ ID NO: 2353498 - RNA, 21 nt, Human
auaaacauccuucaagaacuc

SEQ ID NO: 2353499 - RNA, 17 nt, Human
auaaacaucacacacac

SEQ ID NO: 2353500 - RNA, 22 nt, Human
auaaacaguggaauauaaggaa

SEQ ID NO: 2353501 - RNA, 16 nt, Human
auaaacaucacacaca

SEQ ID NO: 2353502 - RNA, 14 nt, Human
auaaacacugugua

SEQ ID NO: 2353503 - RNA, 11 nt, Human
aguuuuccuga

SEQ ID NO: 2353504 - RNA, 12 nt, Human
auaaacacugug

SEQ ID NO: 2353505 - RNA, 18 nt, Human
auaaacacucuugaaaaa

SEQ ID NO: 2353506 - RNA, 21 nt, Human
auaaacccaguugccaucugc

SEQ ID NO: 2353507 - RNA, 21 nt, Human
auaaaccagguuuagacagua

SEQ ID NO: 2353508 - RNA, 17 nt, Human
auaaaccuaaaaaagau

SEQ ID NO: 2353509 - RNA, 18 nt, Human
auaaaccuaaaaaagaua

SEQ ID NO: 2353510 - RNA, 16 nt, Human
auaaaccucaaaaugu

SEQ ID NO: 2353511 - RNA, 15 nt, Human
auaaacgauuuaauu

SEQ ID NO: 2353512 - RNA, 16 nt, Human
auaaaccuuaaguaag

SEQ ID NO: 2353513 - RNA, 18 nt, Human
auaaacgauuuaauucuc

SEQ ID NO: 2353514 - RNA, 19 nt, Human
auaaacgauuuaauucucu

SEQ ID NO: 2353515 - RNA, 20 nt, Human
auaaacgauuuaauucucuu

SEQ ID NO: 2353516 - RNA, 19 nt, Human
auaaaccuaaaaaagauau

SEQ ID NO: 2353517 - RNA, 20 nt, Human
auaaaccuaaaaaagauaua

SEQ ID NO: 2353518 - RNA, 22 nt, Human
auaaaccuaaaaaagauauauu

SEQ ID NO: 2353519 - RNA, 18 nt, Human
auaaaccucuaauuuauu

SEQ ID NO: 2353520 - RNA, 19 nt, Human
auaaaccucuaauuuauuu

SEQ ID NO: 2353521 - RNA, 20 nt, Human
auaaaccucuaauuuauuuu

SEQ ID NO: 2353522 - RNA, 22 nt, Human
auaaaccucuaauuuauuuugu

SEQ ID NO: 2353523 - RNA, 23 nt, Human
aguuuuccuucucaucugugauu

SEQ ID NO: 2353524 - RNA, 18 nt, Human
aguuuucugagaaagacu

SEQ ID NO: 2353525 - RNA, 17 nt, Human
aguuuucuccucccagg

SEQ ID NO: 2353526 - RNA, 23 nt, Human
auaaacacucuugaaaaaugcau

SEQ ID NO: 2353527 - RNA, 17 nt, Human
aguuuucugagaaagac

SEQ ID NO: 2353528 - RNA, 14 nt, Human
aguuuucugagaaa

SEQ ID NO: 2353529 - RNA, 22 nt, Human
aguuuuccuucucaucugugau

SEQ ID NO: 2353530 - RNA, 18 nt, Human
aguuuuccuucucaucug

SEQ ID NO: 2353531 - RNA, 14 nt, Human
aguuuuccuucuca

SEQ ID NO: 2353532 - RNA, 12 nt, Human
aguuuuccuucu

SEQ ID NO: 2353533 - RNA, 22 nt, Human
aguuuuccuaagugauuguaug

SEQ ID NO: 2353534 - RNA, 13 nt, Human
aguuuucugagaa

SEQ ID NO: 2353535 - RNA, 12 nt, Human
aguuuucugaga

SEQ ID NO: 2353536 - RNA, 16 nt, Human
uuacccacacacagau

SEQ ID NO: 2353537 - RNA, 20 nt, Human
uuacccaagcaaaaucaugg

SEQ ID NO: 2353538 - RNA, 12 nt, Human
uuacccaagcaa

SEQ ID NO: 2353539 - RNA, 13 nt, Human
uuacccaagcaaa

SEQ ID NO: 2353540 - RNA, 24 nt, Human
uuacccaaaaacuaaaucucuaau

SEQ ID NO: 2353541 - RNA, 16 nt, Human
uuacccuuuagacugu

SEQ ID NO: 2353542 - RNA, 13 nt, Human
uuacccuuuagac

SEQ ID NO: 2353543 - RNA, 22 nt, Human
uuacccugcgauuuugccugug

SEQ ID NO: 2353544 - RNA, 23 nt, Human
uuaccauuuugggguacccacug

SEQ ID NO: 2353545 - RNA, 16 nt, Human
uuaccaugugccugau

SEQ ID NO: 2353546 - RNA, 13 nt, Human
uuacaugcauuug

SEQ ID NO: 2353547 - RNA, 22 nt, Human
uuacaugcauacuucaaaagua

SEQ ID NO: 2353548 - RNA, 22 nt, Human
uuacaugcauuacugcaugcac

SEQ ID NO: 2353549 - RNA, 19 nt, Human
uuacaugcauacuucaaaa

SEQ ID NO: 2353550 - RNA, 21 nt, Human
uuacaugcauacuucaaaagu

SEQ ID NO: 2353551 - RNA, 23 nt, Human
uuacaugcaauuuauuaaaauga

SEQ ID NO: 2353552 - RNA, 22 nt, Human
uuacaugcaauuuauuaaaaug

SEQ ID NO: 2353553 - RNA, 12 nt, Human
uuacaugcauac

SEQ ID NO: 2353554 - RNA, 14 nt, Human
uuacaugcauacuu

SEQ ID NO: 2353555 - RNA, 15 nt, Human
uuacaugcauacuuc

SEQ ID NO: 2353556 - RNA, 18 nt, Human
uuacaugcauacuucaaa

SEQ ID NO: 2353557 - RNA, 12 nt, Human
auaacugugaag

SEQ ID NO: 2353558 - RNA, 15 nt, Human
uuacaggaaguacug

SEQ ID NO: 2353559 - RNA, 16 nt, Human
uuacaggaaguacugg

SEQ ID NO: 2353560 - RNA, 15 nt, Human
uuacaucuuucacau

SEQ ID NO: 2353561 - RNA, 21 nt, Human
uuacaucuguuuuaaauuuau

SEQ ID NO: 2353562 - RNA, 18 nt, Human
uuacaucuguuuuaaauu

SEQ ID NO: 2353563 - RNA, 14 nt, Human
uuacaugacacagc

SEQ ID NO: 2353564 - RNA, 17 nt, Human
uuacaugaauugcauuu

SEQ ID NO: 2353565 - RNA, 17 nt, Human
uuacaugauucauuuua

SEQ ID NO: 2353566 - RNA, 16 nt, Human
uuacaugauucauuuu

SEQ ID NO: 2353567 - RNA, 18 nt, Human
uuacaggaaguacuggag

SEQ ID NO: 2353568 - RNA, 22 nt, Human
uuacaggaaguacuggagaaaa

SEQ ID NO: 2353569 - RNA, 22 nt, Human
auaaaugucuuuuuuuuaaugu

SEQ ID NO: 2353570 - RNA, 23 nt, Human
auaaaugucuuuuuuuuaaugug

SEQ ID NO: 2353571 - RNA, 19 nt, Human
auaaaugugccuucauuuu

SEQ ID NO: 2353572 - RNA, 13 nt, Human
auaaauuauaagu

SEQ ID NO: 2353573 - RNA, 13 nt, Human
auaaauuauguuu

SEQ ID NO: 2353574 - RNA, 14 nt, Human
auaaauuauguuua

SEQ ID NO: 2353575 - RNA, 15 nt, Human
auaaauuauguuuau

SEQ ID NO: 2353576 - RNA, 21 nt, Human
auaaauuauuaguuuacauca

SEQ ID NO: 2353577 - RNA, 14 nt, Human
auaacauuaccuua

SEQ ID NO: 2353578 - RNA, 19 nt, Human
auaacauuaccuuacugug

SEQ ID NO: 2353579 - RNA, 20 nt, Human
auaacauuaccuuacugugg

SEQ ID NO: 2353580 - RNA, 21 nt, Human
auaaaugucauuaaaauaaau

SEQ ID NO: 2353581 - RNA, 12 nt, Human
auaaaugucugu

SEQ ID NO: 2353582 - RNA, 15 nt, Human
auaaaugucuguuga

SEQ ID NO: 2353583 - RNA, 12 nt, Human
auaaaugucuuu

SEQ ID NO: 2353584 - RNA, 20 nt, Human
auaaaugucuuuuuuuuaau

SEQ ID NO: 2353585 - RNA, 12 nt, Human
auaaauaaauau

SEQ ID NO: 2353586 - RNA, 14 nt, Human
auaaauaaaaugac

SEQ ID NO: 2353587 - RNA, 13 nt, Human
auaaauaaauaua

SEQ ID NO: 2353588 - RNA, 14 nt, Human
auaaauaaauauau

SEQ ID NO: 2353589 - RNA, 16 nt, Human
auaaauaaaugcaaua

SEQ ID NO: 2353590 - RNA, 15 nt, Human
auaaauaaauauaua

SEQ ID NO: 2353591 - RNA, 12 nt, Human
auaaauaaaugu

SEQ ID NO: 2353592 - RNA, 13 nt, Human
auaaauaaaguuu

SEQ ID NO: 2353593 - RNA, 19 nt, Human
auaaauaaaguuuguugaa

SEQ ID NO: 2353594 - RNA, 16 nt, Human
auaacugaaggagaag

SEQ ID NO: 2353595 - RNA, 12 nt, Human
auaacugagaau

SEQ ID NO: 2353596 - RNA, 18 nt, Human
auaacugaaggagaaggu

SEQ ID NO: 2353597 - RNA, 18 nt, Human
auaacugccuuaaaacuu

SEQ ID NO: 2353598 - RNA, 12 nt, Human
auaacuggaaac

SEQ ID NO: 2353599 - RNA, 23 nt, Human
auaaccacaaagcacaguuugaa

SEQ ID NO: 2353600 - RNA, 20 nt, Human
auaaccaaagcccaaagugg

SEQ ID NO: 2353601 - RNA, 13 nt, Human
auaaccacuuaaa

SEQ ID NO: 2353602 - RNA, 22 nt, Human
auaaccacuuaaaaaaugucca

SEQ ID NO: 2353603 - RNA, 20 nt, Human
auaaccaguguuguggauuu

SEQ ID NO: 2353604 - RNA, 14 nt, Human
auaacugaaggaga

SEQ ID NO: 2353605 - RNA, 15 nt, Human
auaacugaaaaugug

SEQ ID NO: 2353606 - RNA, 19 nt, Human
auaaccagcuguaacacag

SEQ ID NO: 2353607 - RNA, 13 nt, Human
auaacugaaaaug

SEQ ID NO: 2353608 - RNA, 22 nt, Human
auaacucuguggcauuauugca

SEQ ID NO: 2353609 - RNA, 14 nt, Human
auaaccagcuguaa

SEQ ID NO: 2353610 - RNA, 13 nt, Human
uguagaagcauuc

SEQ ID NO: 2353611 - RNA, 15 nt, Human
uguagaagcauuccu

SEQ ID NO: 2353612 - RNA, 16 nt, Human
uguagaagcauuccuu

SEQ ID NO: 2353613 - RNA, 21 nt, Human
uguagaaggagacagagcugg

SEQ ID NO: 2353614 - RNA, 17 nt, Human
uguagaaggagacagag

SEQ ID NO: 2353615 - RNA, 17 nt, Human
uguagaagcauuccuuc

SEQ ID NO: 2353616 - RNA, 22 nt, Human
uguagaagcauuccuucuuuga

SEQ ID NO: 2353617 - RNA, 22 nt, Human
uguagaaguaggaagugaaaau

SEQ ID NO: 2353618 - RNA, 16 nt, Human
uguagaaugauuucau

SEQ ID NO: 2353619 - RNA, 21 nt, Human
uguagaccuagggaggaccuu

SEQ ID NO: 2353620 - RNA, 18 nt, Human
uguagaauguauuguacc

SEQ ID NO: 2353621 - RNA, 17 nt, Human
uguagaauguauuguac

SEQ ID NO: 2353622 - RNA, 19 nt, Human
uguagaauguauuguaccu

SEQ ID NO: 2353623 - RNA, 18 nt, Human
uguagaaugauuucaugc

SEQ ID NO: 2353624 - RNA, 17 nt, Human
uguagaaugauuucaug

SEQ ID NO: 2353625 - RNA, 16 nt, Human
uguacuugaugacaga

SEQ ID NO: 2353626 - RNA, 21 nt, Human
uguacuucacugucaggaaga

SEQ ID NO: 2353627 - RNA, 21 nt, Human
uguacuucgucuucuaauuuc

SEQ ID NO: 2353628 - RNA, 14 nt, Human
uguacuucaaguua

SEQ ID NO: 2353629 - RNA, 22 nt, Human
uguacuuaauaaauucagauau

SEQ ID NO: 2353630 - RNA, 13 nt, Human
uguacuucacugu

SEQ ID NO: 2353631 - RNA, 14 nt, Human
uguacuucacuguc

SEQ ID NO: 2353632 - RNA, 21 nt, Human
uguacuuaauaaauucagaua

SEQ ID NO: 2353633 - RNA, 20 nt, Human
uguacuuaauaaauucagau

SEQ ID NO: 2353634 - RNA, 16 nt, Human
uguacuuaauaaauuc

SEQ ID NO: 2353635 - RNA, 16 nt, Human
uguacauuucugaaau

SEQ ID NO: 2353636 - RNA, 15 nt, Human
uguacuugcucuuga

SEQ ID NO: 2353637 - RNA, 18 nt, Human
uguacauuuccaaauuca

SEQ ID NO: 2353638 - RNA, 10 nt, Human
uguacauuuc

SEQ ID NO: 2353639 - RNA, 15 nt, Human
uguacauucuaaaau

SEQ ID NO: 2353640 - RNA, 20 nt, Human
uguacauuuaugauuuaaua

SEQ ID NO: 2353641 - RNA, 21 nt, Human
uguacauuuaugauuuaauaa

SEQ ID NO: 2353642 - RNA, 21 nt, Human
uguacauguguagccugugca

SEQ ID NO: 2353643 - RNA, 14 nt, Human
uguacauuaauuac

SEQ ID NO: 2353644 - RNA, 22 nt, Human
uguacauuagucauucaauaaa

SEQ ID NO: 2353645 - RNA, 13 nt, Human
uguacauuucuga

SEQ ID NO: 2353646 - RNA, 15 nt, Human
uguacuuaacuauuc

SEQ ID NO: 2353647 - RNA, 22 nt, Human
uguacauuuccaaauucacaag

SEQ ID NO: 2353648 - RNA, 21 nt, Human
uguacauuuccaaauucacaa

SEQ ID NO: 2353649 - RNA, 20 nt, Human
uguacaugaaaacacauuuu

SEQ ID NO: 2353650 - RNA, 17 nt, Human
uguacauguguagccug

SEQ ID NO: 2353651 - RNA, 20 nt, Human
uguacauguguagccugugc

SEQ ID NO: 2353652 - RNA, 19 nt, Human
uguacaugaaaacacauuu

SEQ ID NO: 2353653 - RNA, 18 nt, Human
uguacaugaaaacacauu

SEQ ID NO: 2353654 - RNA, 17 nt, Human
uguacaugaaaacacau

SEQ ID NO: 2353655 - RNA, 18 nt, Human
uguacauauguaaaauaa

SEQ ID NO: 2353656 - RNA, 16 nt, Human
uguacauauguaaaau

SEQ ID NO: 2353657 - RNA, 15 nt, Human
uguacauauguaaaa

SEQ ID NO: 2353658 - RNA, 13 nt, Human
uguacauauguaa

SEQ ID NO: 2353659 - RNA, 21 nt, Human
uguacauauguaaaauaaaau

SEQ ID NO: 2353660 - RNA, 19 nt, Human
uguacauauguaaaauaaa

SEQ ID NO: 2353661 - RNA, 15 nt, Human
uguacauaugugcug

SEQ ID NO: 2353662 - RNA, 17 nt, Human
uguacauaugugcugga

SEQ ID NO: 2353663 - RNA, 20 nt, Human
uguacauauuugagacuagu

SEQ ID NO: 2353664 - RNA, 18 nt, Human
uguacauauuuguggaau

SEQ ID NO: 2353665 - RNA, 19 nt, Human
uguacauauuuguggaaua

SEQ ID NO: 2353666 - RNA, 20 nt, Human
uguacauaugugcuggaauu

SEQ ID NO: 2353667 - RNA, 14 nt, Human
uguacaucuauuuu

SEQ ID NO: 2353668 - RNA, 22 nt, Human
uguacaucccauguaacagaaa

SEQ ID NO: 2353669 - RNA, 23 nt, Human
uguacaucccauguaacagaaag

SEQ ID NO: 2353670 - RNA, 17 nt, Human
uguacaucccauguaac

SEQ ID NO: 2353671 - RNA, 18 nt, Human
uguacaucccauguaaca

SEQ ID NO: 2353672 - RNA, 20 nt, Human
uguacaucccauguaacaga

SEQ ID NO: 2353673 - RNA, 21 nt, Human
uguacaucccauguaacagaa

SEQ ID NO: 2353674 - RNA, 23 nt, Human
uguacaaaguagaagucuuagau

SEQ ID NO: 2353675 - RNA, 19 nt, Human
uguacaaaguagaagucuu

SEQ ID NO: 2353676 - RNA, 21 nt, Human
uguacaaaaucgauuggcuuu

SEQ ID NO: 2353677 - RNA, 14 nt, Human
uguacauauaagug

SEQ ID NO: 2353678 - RNA, 21 nt, Human
uguaauuuuaaauaaaaguga

SEQ ID NO: 2353679 - RNA, 22 nt, Human
uguacaaaauaaacaaauaaca

SEQ ID NO: 2353680 - RNA, 16 nt, Human
uguaauuuuauaugaa

SEQ ID NO: 2353681 - RNA, 15 nt, Human
uguaaggcaugaagg

SEQ ID NO: 2353682 - RNA, 14 nt, Human
uguaaggcaugaag

SEQ ID NO: 2353683 - RNA, 21 nt, Human
uguaauuugugauacaaugcu

SEQ ID NO: 2353684 - RNA, 17 nt, Human
uguaauuugugauacaa

SEQ ID NO: 2353685 - RNA, 13 nt, Human
uguaagcugaagu

SEQ ID NO: 2353686 - RNA, 14 nt, Human
uguaagcuguuuau

SEQ ID NO: 2353687 - RNA, 15 nt, Human
uguaagcuguuuauu

SEQ ID NO: 2353688 - RNA, 16 nt, Human
uguaagcuguuuauuu

SEQ ID NO: 2353689 - RNA, 22 nt, Human
uguaagcuguuuauuuuauauu

SEQ ID NO: 2353690 - RNA, 18 nt, Human
uguaaggaaugauuaauu

SEQ ID NO: 2353691 - RNA, 15 nt, Human
uguaaggcaaucaug

SEQ ID NO: 2353692 - RNA, 16 nt, Human
uguaauuugugauaca

SEQ ID NO: 2353693 - RNA, 22 nt, Human
uguaagaaacacacugaggcag

SEQ ID NO: 2353694 - RNA, 17 nt, Human
uguaagaaacacacuga

SEQ ID NO: 2353695 - RNA, 13 nt, Human
agguuuaacucag

SEQ ID NO: 2353696 - RNA, 17 nt, Human
uguaagaaaauaucacu

SEQ ID NO: 2353697 - RNA, 18 nt, Human
uguaagaaaauaucacuu

SEQ ID NO: 2353698 - RNA, 22 nt, Human
uguaagcucuacugaggugcua

SEQ ID NO: 2353699 - RNA, 18 nt, Human
uguaagaaauacuguaca

SEQ ID NO: 2353700 - RNA, 12 nt, Human
uguaagaaauac

SEQ ID NO: 2353701 - RNA, 18 nt, Human
uguaagaacuacaaacaa

SEQ ID NO: 2353702 - RNA, 14 nt, Human
uguaagcugaaaau

SEQ ID NO: 2353703 - RNA, 16 nt, Human
uguaagcugaaaauau

SEQ ID NO: 2353704 - RNA, 13 nt, Human
uguaaggaaugau

SEQ ID NO: 2353705 - RNA, 14 nt, Human
uguaaggaaugauu

SEQ ID NO: 2353706 - RNA, 15 nt, Human
uguaaggaaugauua

SEQ ID NO: 2353707 - RNA, 20 nt, Human
agguguucuacacucaucuu

SEQ ID NO: 2353708 - RNA, 18 nt, Human
agguguugauuuucuguu

SEQ ID NO: 2353709 - RNA, 21 nt, Human
agguguugauuuucuguugua

SEQ ID NO: 2353710 - RNA, 12 nt, Human
agguguugccaa

SEQ ID NO: 2353711 - RNA, 21 nt, Human
agguguugccaaauauguccu

SEQ ID NO: 2353712 - RNA, 16 nt, Human
agguguugucccuucu

SEQ ID NO: 2353713 - RNA, 15 nt, Human
agguguugucccuuc

SEQ ID NO: 2353714 - RNA, 22 nt, Human
agguguugccaaauauguccug

SEQ ID NO: 2353715 - RNA, 23 nt, Human
agguguugccaaauauguccugg

SEQ ID NO: 2353716 - RNA, 17 nt, Human
agguguucuacacucau

SEQ ID NO: 2353717 - RNA, 22 nt, Human
agguguucaagaccagccugac

SEQ ID NO: 2353718 - RNA, 16 nt, Human
agguguuacuguaauu

SEQ ID NO: 2353719 - RNA, 15 nt, Human
agguguuacuguaau

SEQ ID NO: 2353720 - RNA, 16 nt, Human
agguugucugaaguca

SEQ ID NO: 2353721 - RNA, 13 nt, Human
agguguuuaaaga

SEQ ID NO: 2353722 - RNA, 17 nt, Human
agguguuuaaagagagg

SEQ ID NO: 2353723 - RNA, 18 nt, Human
agguguuuaaagagaggu

SEQ ID NO: 2353724 - RNA, 20 nt, Human
agguguuuaaagagagguua

SEQ ID NO: 2353725 - RNA, 20 nt, Human
agguugucugaagucacugc

SEQ ID NO: 2353726 - RNA, 16 nt, Human
agguuguuccuaaaau

SEQ ID NO: 2353727 - RNA, 17 nt, Human
agguuuaaacuucucug

SEQ ID NO: 2353728 - RNA, 21 nt, Human
agguggggucuuugugagagu

SEQ ID NO: 2353729 - RNA, 22 nt, Human
aggugggguugggauugggggc

SEQ ID NO: 2353730 - RNA, 22 nt, Human
agguggggucuuugugagagug

SEQ ID NO: 2353731 - RNA, 23 nt, Human
agguggguuuucuucccaucacu

SEQ ID NO: 2353732 - RNA, 23 nt, Human
agguggguuuucaucaagacugg

SEQ ID NO: 2353733 - RNA, 14 nt, Human
agguggggcagcuu

SEQ ID NO: 2353734 - RNA, 23 nt, Human
agguggggucacucuggcagcuc

SEQ ID NO: 2353735 - RNA, 13 nt, Human
agguggggaguca

SEQ ID NO: 2353736 - RNA, 23 nt, Human
agguggggaggggguuugggggc

SEQ ID NO: 2353737 - RNA, 22 nt, Human
agguggggaggggguuuggggg

SEQ ID NO: 2353738 - RNA, 11 nt, Human
agguggggagg

SEQ ID NO: 2353739 - RNA, 21 nt, Human
agguggggagacugggcugag

SEQ ID NO: 2353740 - RNA, 19 nt, Human
agguggggagacugggcug

SEQ ID NO: 2353741 - RNA, 13 nt, Human
agguggggcagcu

SEQ ID NO: 2353742 - RNA, 22 nt, Human
aggugauccacucgccuucauc

SEQ ID NO: 2353743 - RNA, 22 nt, Human
aggugcaacaagguccucuguc

SEQ ID NO: 2353744 - RNA, 23 nt, Human
aggugugaaccaccacacccagc

SEQ ID NO: 2353745 - RNA, 18 nt, Human
aggugugacugaauuucu

SEQ ID NO: 2353746 - RNA, 14 nt, Human
agguggucugaaug

SEQ ID NO: 2353747 - RNA, 19 nt, Human
aggugguccugagaccuga

SEQ ID NO: 2353748 - RNA, 18 nt, Human
aggugguaugugugugua

SEQ ID NO: 2353749 - RNA, 15 nt, Human
aggugguaugugugu

SEQ ID NO: 2353750 - RNA, 22 nt, Human
agguggguuuucuucccaucac

SEQ ID NO: 2353751 - RNA, 21 nt, Human
agguggguuuucuucccauca

SEQ ID NO: 2353752 - RNA, 19 nt, Human
agguggguuuucuucccau

SEQ ID NO: 2353753 - RNA, 22 nt, Human
aggugugaaccaccacacccag

SEQ ID NO: 2353754 - RNA, 18 nt, Human
agguggucugaauguucu

SEQ ID NO: 2353755 - RNA, 17 nt, Human
agguggucugaauguuc

SEQ ID NO: 2353756 - RNA, 16 nt, Human
agguggucugaauguu

SEQ ID NO: 2353757 - RNA, 15 nt, Human
agguggucugaaugu

SEQ ID NO: 2353758 - RNA, 20 nt, Human
aggugugagccaccacgccc

SEQ ID NO: 2353759 - RNA, 20 nt, Human
aggugugacugaauuucuuu

SEQ ID NO: 2353760 - RNA, 14 nt, Human
aggugugagucacc

SEQ ID NO: 2353761 - RNA, 20 nt, Human
aggugugagucaccaagccc

SEQ ID NO: 2353762 - RNA, 22 nt, Human
ugguuuuccuaaaugcagugaa

SEQ ID NO: 2353763 - RNA, 16 nt, Human
ugguuuuccuaaaugc

SEQ ID NO: 2353764 - RNA, 22 nt, Human
ugguuuuccccucccuggguuc

SEQ ID NO: 2353765 - RNA, 12 nt, Human
ugguuuucuguu

SEQ ID NO: 2353766 - RNA, 14 nt, Human
ugguuugcagauga

SEQ ID NO: 2353767 - RNA, 16 nt, Human
ugguuuuauacugaag

SEQ ID NO: 2353768 - RNA, 23 nt, Human
ugguuuuauacugaaggaaaaac

SEQ ID NO: 2353769 - RNA, 18 nt, Human
ugguuuuaguugcaacuu

SEQ ID NO: 2353770 - RNA, 18 nt, Human
ugguuuuaacaauuuccu

SEQ ID NO: 2353771 - RNA, 12 nt, Human
ugguuuuaacaa

SEQ ID NO: 2353772 - RNA, 15 nt, Human
ugguuugcaaggaag

SEQ ID NO: 2353773 - RNA, 17 nt, Human
ugguuugcaaggaagcc

SEQ ID NO: 2353774 - RNA, 15 nt, Human
ugguuugcagagcuu

SEQ ID NO: 2353775 - RNA, 17 nt, Human
ugguuugagcuuaguga

SEQ ID NO: 2353776 - RNA, 23 nt, Human
ugguuugagcuuagugaaauuac

SEQ ID NO: 2353777 - RNA, 21 nt, Human
ugguuugagacacugguuuac

SEQ ID NO: 2353778 - RNA, 23 nt, Human
ugguuucuucaacaggagaauuu

SEQ ID NO: 2353779 - RNA, 21 nt, Human
ugguuuguaaauuaacuuuua

SEQ ID NO: 2353780 - RNA, 21 nt, Human
ugguuuccacgaugaaaaacu

SEQ ID NO: 2353781 - RNA, 21 nt, Human
ugguuucacggugccagguuu

SEQ ID NO: 2353782 - RNA, 18 nt, Human
ugguuucacuggcccaag

SEQ ID NO: 2353783 - RNA, 13 nt, Human
ugguuuccuuccu

SEQ ID NO: 2353784 - RNA, 20 nt, Human
ugguuuccacgaugaaaaac

SEQ ID NO: 2353785 - RNA, 15 nt, Human
ugguuucgaacuccu

SEQ ID NO: 2353786 - RNA, 12 nt, Human
ugguuucuccag

SEQ ID NO: 2353787 - RNA, 16 nt, Human
ugguuucuagacuugu

SEQ ID NO: 2353788 - RNA, 11 nt, Human
ugguuuauaga

SEQ ID NO: 2353789 - RNA, 18 nt, Human
ugguuuaacuucugccug

SEQ ID NO: 2353790 - RNA, 16 nt, Human
ugguuucacuggccca

SEQ ID NO: 2353791 - RNA, 16 nt, Human
ugguuucaaagauuca

SEQ ID NO: 2353792 - RNA, 12 nt, Human
ugguuuauguca

SEQ ID NO: 2353793 - RNA, 21 nt, Human
ugguuuauagagggccaagac

SEQ ID NO: 2353794 - RNA, 11 nt, Human
ugguuuauguc

SEQ ID NO: 2353795 - RNA, 15 nt, Human
ugguuucagaaaugu

SEQ ID NO: 2353796 - RNA, 14 nt, Human
ugguuucagaaaug

SEQ ID NO: 2353797 - RNA, 21 nt, Human
uguaaauacacauagcaugua

SEQ ID NO: 2353798 - RNA, 12 nt, Human
uguaaauacacc

SEQ ID NO: 2353799 - RNA, 13 nt, Human
uguaaauacauaa

SEQ ID NO: 2353800 - RNA, 12 nt, Human
uguaaauacaua

SEQ ID NO: 2353801 - RNA, 12 nt, Human
uguaaauauaua

SEQ ID NO: 2353802 - RNA, 13 nt, Human
uguaaauauauaa

SEQ ID NO: 2353803 - RNA, 14 nt, Human
uguaaauauauaaa

SEQ ID NO: 2353804 - RNA, 15 nt, Human
uguaaauauauaaau

SEQ ID NO: 2353805 - RNA, 16 nt, Human
uguaaauauauaaaua

SEQ ID NO: 2353806 - RNA, 17 nt, Human
uguaaauauauaaauau

SEQ ID NO: 2353807 - RNA, 18 nt, Human
uguaaauauauaaauaua

SEQ ID NO: 2353808 - RNA, 19 nt, Human
uguaaauauauaaauauau

SEQ ID NO: 2353809 - RNA, 21 nt, Human
uguaaauauauaaauauauau

SEQ ID NO: 2353810 - RNA, 22 nt, Human
uguaaauauguuuuuuagauca

SEQ ID NO: 2353811 - RNA, 14 nt, Human
uguaaauauucuau

SEQ ID NO: 2353812 - RNA, 15 nt, Human
uguaaauauucuaua

SEQ ID NO: 2353813 - RNA, 16 nt, Human
uguaaauauucuauau

SEQ ID NO: 2353814 - RNA, 12 nt, Human
uguaaauauuua

SEQ ID NO: 2353815 - RNA, 20 nt, Human
uguaaauauucuauaugaau

SEQ ID NO: 2353816 - RNA, 13 nt, Human
uguaaauauuuau

SEQ ID NO: 2353817 - RNA, 21 nt, Human
aggugauccacccaccucagc

SEQ ID NO: 2353818 - RNA, 23 nt, Human
aggugauccacccaccucagccu

SEQ ID NO: 2353819 - RNA, 12 nt, Human
uguaaagcauuc

SEQ ID NO: 2353820 - RNA, 17 nt, Human
uguaaagcauuccaaca

SEQ ID NO: 2353821 - RNA, 18 nt, Human
uguaaagauauuuuuauc

SEQ ID NO: 2353822 - RNA, 22 nt, Human
uguaaagagaccuaccucaggu

SEQ ID NO: 2353823 - RNA, 23 nt, Human
uguaaagagaccuaccucagguu

SEQ ID NO: 2353824 - RNA, 23 nt, Human
uguaaagaaagagagaaaauaaa

SEQ ID NO: 2353825 - RNA, 21 nt, Human
uguaaagagaccuaccucagg

SEQ ID NO: 2353826 - RNA, 15 nt, Human
ugguuuucuguucuu

SEQ ID NO: 2353827 - RNA, 13 nt, Human
ugguuuucuguuc

SEQ ID NO: 2353828 - RNA, 18 nt, Human
uguaaagcauuccaacaa

SEQ ID NO: 2353829 - RNA, 18 nt, Human
uguaaagccaacacccug

SEQ ID NO: 2353830 - RNA, 17 nt, Human
ugguuaaucuuuccuga

SEQ ID NO: 2353831 - RNA, 18 nt, Human
ugguuaagucuguuuuau

SEQ ID NO: 2353832 - RNA, 15 nt, Human
ugguuaagucuguuu

SEQ ID NO: 2353833 - RNA, 22 nt, Human
ugguuauuuagggaacugcuug

SEQ ID NO: 2353834 - RNA, 15 nt, Human
ugguuauuucucuga

SEQ ID NO: 2353835 - RNA, 17 nt, Human
ugguucacucuuggagc

SEQ ID NO: 2353836 - RNA, 17 nt, Human
ugguguugcagaagguu

SEQ ID NO: 2353837 - RNA, 16 nt, Human
ugguguuguaugccuu

SEQ ID NO: 2353838 - RNA, 18 nt, Human
ugguguuucuagcacugg

SEQ ID NO: 2353839 - RNA, 21 nt, Human
ugguguuucuagcacuggccu

SEQ ID NO: 2353840 - RNA, 20 nt, Human
ugguguuuucuuaugcagga

SEQ ID NO: 2353841 - RNA, 16 nt, Human
ugguguuucucccucu

SEQ ID NO: 2353842 - RNA, 20 nt, Human
ugguguuuuggggaugagag

SEQ ID NO: 2353843 - RNA, 15 nt, Human
ugguguuuccuggca

SEQ ID NO: 2353844 - RNA, 17 nt, Human
ugguguuuccuggcacu

SEQ ID NO: 2353845 - RNA, 17 nt, Human
ugguuuacacuuuaugc

SEQ ID NO: 2353846 - RNA, 16 nt, Human
ugguucagcuaagcua

SEQ ID NO: 2353847 - RNA, 23 nt, Human
ugguucaggguuggccccugccc

SEQ ID NO: 2353848 - RNA, 20 nt, Human
ugguucaggguuggccccug

SEQ ID NO: 2353849 - RNA, 22 nt, Human
ugguucaggguuggccccugcc

SEQ ID NO: 2353850 - RNA, 13 nt, Human
ugguuauuucucu

SEQ ID NO: 2353851 - RNA, 22 nt, Human
ugguucacucuuggagccugca

SEQ ID NO: 2353852 - RNA, 21 nt, Human
ugguucacucuuggagccugc

SEQ ID NO: 2353853 - RNA, 20 nt, Human
ugguucacucuuggagccug

SEQ ID NO: 2353854 - RNA, 13 nt, Human
ugguguugcagaa

SEQ ID NO: 2353855 - RNA, 22 nt, Human
ugguguucaaaaaacuuguaaa

SEQ ID NO: 2353856 - RNA, 21 nt, Human
ugguguucaaaaaacuuguaa

SEQ ID NO: 2353857 - RNA, 15 nt, Human
ugguguguguaugcg

SEQ ID NO: 2353858 - RNA, 19 nt, Human
uggugugucccccucuguc

SEQ ID NO: 2353859 - RNA, 16 nt, Human
ugguguggcaaagccu

SEQ ID NO: 2353860 - RNA, 16 nt, Human
uggugugaucgucuga

SEQ ID NO: 2353861 - RNA, 16 nt, Human
uggugugaccugaggg

SEQ ID NO: 2353862 - RNA, 18 nt, Human
uggugugacccucugaau

SEQ ID NO: 2353863 - RNA, 17 nt, Human
uggugugaccugagggc

SEQ ID NO: 2353864 - RNA, 18 nt, Human
uggugugaucgucugacu

SEQ ID NO: 2353865 - RNA, 12 nt, Human
ugguggcagcug

SEQ ID NO: 2353866 - RNA, 17 nt, Human
ugguggcacugagcccc

SEQ ID NO: 2353867 - RNA, 19 nt, Human
ugguggcacugagcccccc

SEQ ID NO: 2353868 - RNA, 17 nt, Human
aggugaaggaauauaug

SEQ ID NO: 2353869 - RNA, 23 nt, Human
aggugaaggaauauauggcagag

SEQ ID NO: 2353870 - RNA, 14 nt, Human
aggugaaggaauau

SEQ ID NO: 2353871 - RNA, 16 nt, Human
aggugaaggaauauau

SEQ ID NO: 2353872 - RNA, 15 nt, Human
ugguggcagagugga

SEQ ID NO: 2353873 - RNA, 12 nt, Human
ugguggcagcuc

SEQ ID NO: 2353874 - RNA, 16 nt, Human
ugguggcagcucaccu

SEQ ID NO: 2353875 - RNA, 19 nt, Human
ugguggcagcucaccucuc

SEQ ID NO: 2353876 - RNA, 20 nt, Human
ugguggcagcucaccucucc

SEQ ID NO: 2353877 - RNA, 23 nt, Human
ugguggcagcucaccucucccuu

SEQ ID NO: 2353878 - RNA, 13 nt, Human
ugggaauauuuga

SEQ ID NO: 2353879 - RNA, 23 nt, Human
ugggaauaagugccaggauggaa

SEQ ID NO: 2353880 - RNA, 14 nt, Human
ugggaauauuugaa

SEQ ID NO: 2353881 - RNA, 15 nt, Human
ugggaauauuugaau

SEQ ID NO: 2353882 - RNA, 16 nt, Human
ugggaauauuugaauc

SEQ ID NO: 2353883 - RNA, 18 nt, Human
ugggaauauuugaaucuu

SEQ ID NO: 2353884 - RNA, 22 nt, Human
ugggaauauuugaaucuugucu

SEQ ID NO: 2353885 - RNA, 23 nt, Human
aggggacacuucccucuguuucu

SEQ ID NO: 2353886 - RNA, 14 nt, Human
ugggaaucaagauu

SEQ ID NO: 2353887 - RNA, 19 nt, Human
ugggaauauuugaaucuug

SEQ ID NO: 2353888 - RNA, 20 nt, Human
ugggaauauuugaaucuugu

SEQ ID NO: 2353889 - RNA, 15 nt, Human
aggggacccccgccc

SEQ ID NO: 2353890 - RNA, 18 nt, Human
aggggacccccgcccccu

SEQ ID NO: 2353891 - RNA, 19 nt, Human
aggggacccccgcccccug

SEQ ID NO: 2353892 - RNA, 14 nt, Human
aggggacccccgcc

SEQ ID NO: 2353893 - RNA, 22 nt, Human
aggggacccccgcccccugccc

SEQ ID NO: 2353894 - RNA, 13 nt, Human
aggggaggagggc

SEQ ID NO: 2353895 - RNA, 14 nt, Human
aggggacgcuggua

SEQ ID NO: 2353896 - RNA, 19 nt, Human
aggggaggaucacuggagc

SEQ ID NO: 2353897 - RNA, 14 nt, Human
aggggaggagggcg

SEQ ID NO: 2353898 - RNA, 23 nt, Human
aggggacgcugguagagauggag

SEQ ID NO: 2353899 - RNA, 21 nt, Human
aggggaggcagccggcaccca

SEQ ID NO: 2353900 - RNA, 13 nt, Human
aggggaggcagcc

SEQ ID NO: 2353901 - RNA, 18 nt, Human
aggggagggggauccgac

SEQ ID NO: 2353902 - RNA, 16 nt, Human
aggggaggggggcaca

SEQ ID NO: 2353903 - RNA, 16 nt, Human
aggggaggguggcagg

SEQ ID NO: 2353904 - RNA, 19 nt, Human
aggggaggguggcagguga

SEQ ID NO: 2353905 - RNA, 23 nt, Human
aggggcuggccuuccugcccuac

SEQ ID NO: 2353906 - RNA, 16 nt, Human
aggggcuggcuucagg

SEQ ID NO: 2353907 - RNA, 17 nt, Human
aggggcuggcuucagga

SEQ ID NO: 2353908 - RNA, 19 nt, Human
aggggcuggcuucaggagg

SEQ ID NO: 2353909 - RNA, 19 nt, Human
aggggcuggccuuccugcc

SEQ ID NO: 2353910 - RNA, 16 nt, Human
aggggaguugugucug

SEQ ID NO: 2353911 - RNA, 16 nt, Human
aggggauagagagaga

SEQ ID NO: 2353912 - RNA, 20 nt, Human
aggggcuuucuggagaggag

SEQ ID NO: 2353913 - RNA, 17 nt, Human
aggggcuuucuggagag

SEQ ID NO: 2353914 - RNA, 13 nt, Human
agggggcugggac

SEQ ID NO: 2353915 - RNA, 16 nt, Human
aggggcuuucuggaga

SEQ ID NO: 2353916 - RNA, 14 nt, Human
aggggcuuucugga

SEQ ID NO: 2353917 - RNA, 15 nt, Human
aggggucggcugacc

SEQ ID NO: 2353918 - RNA, 21 nt, Human
aggggucggcugaccaugcuc

SEQ ID NO: 2353919 - RNA, 18 nt, Human
aggggucccagccacccc

SEQ ID NO: 2353920 - RNA, 15 nt, Human
aggggucccagccac

SEQ ID NO: 2353921 - RNA, 19 nt, Human
aggggucccagccaccccg

SEQ ID NO: 2353922 - RNA, 19 nt, Human
aggggucuccaggaggaga

SEQ ID NO: 2353923 - RNA, 13 nt, Human
aggggucucccug

SEQ ID NO: 2353924 - RNA, 18 nt, Human
aggggucuccaggaggag

SEQ ID NO: 2353925 - RNA, 16 nt, Human
agggguccuuggugug

SEQ ID NO: 2353926 - RNA, 15 nt, Human
aggggucucccugga

SEQ ID NO: 2353927 - RNA, 16 nt, Human
aggggucucccuggag

SEQ ID NO: 2353928 - RNA, 19 nt, Human
aggggucucccuggagugc

SEQ ID NO: 2353929 - RNA, 15 nt, Human
aggguaaggugccuu

SEQ ID NO: 2353930 - RNA, 17 nt, Human
aggggucucccuggagu

SEQ ID NO: 2353931 - RNA, 24 nt, Human
aggggucagggaccaaggaccccu

SEQ ID NO: 2353932 - RNA, 20 nt, Human
aggggucagggaccaaggac

SEQ ID NO: 2353933 - RNA, 14 nt, Human
aggggucagggacc

SEQ ID NO: 2353934 - RNA, 16 nt, Human
aggggucaggcuccau

SEQ ID NO: 2353935 - RNA, 21 nt, Human
agggggguugugaggccuggc

SEQ ID NO: 2353936 - RNA, 16 nt, Human
aggggguccacccagc

SEQ ID NO: 2353937 - RNA, 16 nt, Human
agggggucccaguggg

SEQ ID NO: 2353938 - RNA, 19 nt, Human
agggggucccagugggagg

SEQ ID NO: 2353939 - RNA, 20 nt, Human
agggggucccagugggaggg

SEQ ID NO: 2353940 - RNA, 24 nt, Human
agggggucccagugggaggggcag

SEQ ID NO: 2353941 - RNA, 17 nt, Human
aggggggcugccuggcc

SEQ ID NO: 2353942 - RNA, 23 nt, Human
aggggggcacaugcugagucucc

SEQ ID NO: 2353943 - RNA, 17 nt, Human
aggggggaagaucaggu

SEQ ID NO: 2353944 - RNA, 14 nt, Human
aggggggaagauca

SEQ ID NO: 2353945 - RNA, 13 nt, Human
aggggggagcugg

SEQ ID NO: 2353946 - RNA, 14 nt, Human
aggggggagcuggg

SEQ ID NO: 2353947 - RNA, 16 nt, Human
agggggcuugaagcca

SEQ ID NO: 2353948 - RNA, 18 nt, Human
agggggcuugaagccaaa

SEQ ID NO: 2353949 - RNA, 19 nt, Human
agggggcuugaagccaaag

SEQ ID NO: 2353950 - RNA, 15 nt, Human
aggguagcagguacc

SEQ ID NO: 2353951 - RNA, 14 nt, Human
aggguagcccgccu

SEQ ID NO: 2353952 - RNA, 21 nt, Human
aggguaggagguuuggauggg

SEQ ID NO: 2353953 - RNA, 16 nt, Human
aggguagcccgccugc

SEQ ID NO: 2353954 - RNA, 23 nt, Human
aggguagcccgccugccaguccu

SEQ ID NO: 2353955 - RNA, 19 nt, Human
aggguacuaaggaaucuuu

SEQ ID NO: 2353956 - RNA, 19 nt, Human
aggguaccuugaacacugg

SEQ ID NO: 2353957 - RNA, 23 nt, Human
aggguaccuugaacacuggggga

SEQ ID NO: 2353958 - RNA, 22 nt, Human
aggguaauaaacuuagaauaaa

SEQ ID NO: 2353959 - RNA, 17 nt, Human
aggguagucugguuucu

SEQ ID NO: 2353960 - RNA, 21 nt, Human
agggucuugguuccagccugc

SEQ ID NO: 2353961 - RNA, 18 nt, Human
aggguaucaaauaaaauu

SEQ ID NO: 2353962 - RNA, 22 nt, Human
agggucuugguuccagccugcc

SEQ ID NO: 2353963 - RNA, 16 nt, Human
aggguaucaggugcug

SEQ ID NO: 2353964 - RNA, 12 nt, Human
aggguagggugg

SEQ ID NO: 2353965 - RNA, 16 nt, Human
uggucaucuuuuucuc

SEQ ID NO: 2353966 - RNA, 23 nt, Human
ugguccaaaagauugcugaaauu

SEQ ID NO: 2353967 - RNA, 21 nt, Human
ugguccaaaagauugcugaaa

SEQ ID NO: 2353968 - RNA, 18 nt, Human
uggucauuuuauguuaag

SEQ ID NO: 2353969 - RNA, 15 nt, Human
ugguccagcuugcuc

SEQ ID NO: 2353970 - RNA, 12 nt, Human
ugguccaggaga

SEQ ID NO: 2353971 - RNA, 17 nt, Human
ugguccagggaagcugg

SEQ ID NO: 2353972 - RNA, 16 nt, Human
ugguccaggagaaggc

SEQ ID NO: 2353973 - RNA, 22 nt, Human
ugguccagcuugcucuucagug

SEQ ID NO: 2353974 - RNA, 14 nt, Human
ugguccaggguuga

SEQ ID NO: 2353975 - RNA, 21 nt, Human
ugguccagggcuagugacuug

SEQ ID NO: 2353976 - RNA, 19 nt, Human
ugguccagggaagcuggcc

SEQ ID NO: 2353977 - RNA, 13 nt, Human
ugguccagggcua

SEQ ID NO: 2353978 - RNA, 15 nt, Human
ugguccauagagagc

SEQ ID NO: 2353979 - RNA, 16 nt, Human
ugguccauagagagca

SEQ ID NO: 2353980 - RNA, 17 nt, Human
ugguaaagacuggcuuu

SEQ ID NO: 2353981 - RNA, 22 nt, Human
ugguaauuuaagauuccagaga

SEQ ID NO: 2353982 - RNA, 19 nt, Human
ugguaaacgcugucccuag

SEQ ID NO: 2353983 - RNA, 16 nt, Human
ugguaaagacuggcuu

SEQ ID NO: 2353984 - RNA, 13 nt, Human
ugguaaacuauuu

SEQ ID NO: 2353985 - RNA, 21 nt, Human
ugguaaacuauuugucuuuca

SEQ ID NO: 2353986 - RNA, 19 nt, Human
ugguaauuuguaucugaag

SEQ ID NO: 2353987 - RNA, 21 nt, Human
ugguaauuuguaucugaagga

SEQ ID NO: 2353988 - RNA, 13 nt, Human
ugguaauuguugc

SEQ ID NO: 2353989 - RNA, 22 nt, Human
ugguaauuuguaucugaaggag

SEQ ID NO: 2353990 - RNA, 15 nt, Human
ugguacauggccagu

SEQ ID NO: 2353991 - RNA, 16 nt, Human
ugguacauggccagug

SEQ ID NO: 2353992 - RNA, 21 nt, Human
uggucaccaaaucagcugcua

SEQ ID NO: 2353993 - RNA, 23 nt, Human
uggucaccaaaucagcugcuacu

SEQ ID NO: 2353994 - RNA, 14 nt, Human
uggucaccagcucc

SEQ ID NO: 2353995 - RNA, 15 nt, Human
uggucaccagcuccu

SEQ ID NO: 2353996 - RNA, 14 nt, Human
uggucaccaugaaa

SEQ ID NO: 2353997 - RNA, 16 nt, Human
uggucaccaugaaacu

SEQ ID NO: 2353998 - RNA, 15 nt, Human
ugggugaagacagag

SEQ ID NO: 2353999 - RNA, 22 nt, Human
ugggucuucagggggccaggug

SEQ ID NO: 2354000 - RNA, 21 nt, Human
ugggucuguuuuccuuucuca

SEQ ID NO: 2354001 - RNA, 22 nt, Human
ugggucuguuuuccuuucucac

SEQ ID NO: 2354002 - RNA, 22 nt, Human
ugggucuuguuuuuuuuuucca

SEQ ID NO: 2354003 - RNA, 19 nt, Human
uggguggaaccaggaaccu

SEQ ID NO: 2354004 - RNA, 16 nt, Human
uggguggacaggggcc

SEQ ID NO: 2354005 - RNA, 14 nt, Human
uggguggagaagcc

SEQ ID NO: 2354006 - RNA, 15 nt, Human
uggguggagaagcca

SEQ ID NO: 2354007 - RNA, 16 nt, Human
uggguggagaagccau

SEQ ID NO: 2354008 - RNA, 17 nt, Human
uggguggagaagccauu

SEQ ID NO: 2354009 - RNA, 14 nt, Human
uggguggaugccug

SEQ ID NO: 2354010 - RNA, 24 nt, Human
uggguuuucuucccaucacuggag

SEQ ID NO: 2354011 - RNA, 14 nt, Human
uggguuuucuuccc

SEQ ID NO: 2354012 - RNA, 19 nt, Human
uggguuuucuuaaccaucu

SEQ ID NO: 2354013 - RNA, 21 nt, Human
uggguggagaagccauugucu

SEQ ID NO: 2354014 - RNA, 22 nt, Human
uggguggagaagccauugucuu

SEQ ID NO: 2354015 - RNA, 23 nt, Human
uggguggagaagccauugucuuc

SEQ ID NO: 2354016 - RNA, 20 nt, Human
uggguggauauaaauauaua

SEQ ID NO: 2354017 - RNA, 23 nt, Human
uggguggaugccugguggcagcu

SEQ ID NO: 2354018 - RNA, 22 nt, Human
uggguuuuuguuaccuuuaugg

SEQ ID NO: 2354019 - RNA, 15 nt, Human
uggguuuuuguuacc

SEQ ID NO: 2354020 - RNA, 14 nt, Human
uggguuuuucccug

SEQ ID NO: 2354021 - RNA, 21 nt, Human
uggguuuuguauucucugagc

SEQ ID NO: 2354022 - RNA, 19 nt, Human
uggguuuuguauucucuga

SEQ ID NO: 2354023 - RNA, 21 nt, Human
agggugcugcuucccucugcc

SEQ ID NO: 2354024 - RNA, 23 nt, Human
agggugcuacguacaugugaggc

SEQ ID NO: 2354025 - RNA, 17 nt, Human
agggugcugcuucccuc

SEQ ID NO: 2354026 - RNA, 22 nt, Human
agggugcuacguacaugugagg

SEQ ID NO: 2354027 - RNA, 20 nt, Human
agggugcaguaucaugcccu

SEQ ID NO: 2354028 - RNA, 15 nt, Human
agggugaugccaggu

SEQ ID NO: 2354029 - RNA, 19 nt, Human
agggugaugccagguucua

SEQ ID NO: 2354030 - RNA, 15 nt, Human
ugggucugugugugu

SEQ ID NO: 2354031 - RNA, 23 nt, Human
aggguggacuuagaaagcagggg

SEQ ID NO: 2354032 - RNA, 14 nt, Human
ugggucuguuuucc

SEQ ID NO: 2354033 - RNA, 15 nt, Human
ugggucuguuuuccu

SEQ ID NO: 2354034 - RNA, 19 nt, Human
ugggucuguuuuccuuucu

SEQ ID NO: 2354035 - RNA, 13 nt, Human
ugggucugugugu

SEQ ID NO: 2354036 - RNA, 16 nt, Human
aggguggacuuagaaa

SEQ ID NO: 2354037 - RNA, 20 nt, Human
aggguggacuuagaaagcag

SEQ ID NO: 2354038 - RNA, 21 nt, Human
aggguggacuuagaaagcagg

SEQ ID NO: 2354039 - RNA, 22 nt, Human
aggguggacuuagaaagcaggg

SEQ ID NO: 2354040 - RNA, 13 nt, Human
agggucuuuucau

SEQ ID NO: 2354041 - RNA, 18 nt, Human
agggucuuuucaucuggg

SEQ ID NO: 2354042 - RNA, 21 nt, Human
agggucuuuucaucugggaaa

SEQ ID NO: 2354043 - RNA, 13 nt, Human
agggugaggaugg

SEQ ID NO: 2354044 - RNA, 14 nt, Human
agggugagagcugc

SEQ ID NO: 2354045 - RNA, 14 nt, Human
agggugaugccagg

SEQ ID NO: 2354046 - RNA, 22 nt, Human
agggugaugggaaagcauugua

SEQ ID NO: 2354047 - RNA, 21 nt, Human
agggugaugggaaagcauugu

SEQ ID NO: 2354048 - RNA, 15 nt, Human
aggucaggaguucga

SEQ ID NO: 2354049 - RNA, 20 nt, Human
aggucaggaguuccuaacca

SEQ ID NO: 2354050 - RNA, 18 nt, Human
aggucaaguaagaagaca

SEQ ID NO: 2354051 - RNA, 22 nt, Human
aggucauacuaucuacucuccu

SEQ ID NO: 2354052 - RNA, 21 nt, Human
aggucauacaauccauucuua

SEQ ID NO: 2354053 - RNA, 20 nt, Human
aggucauacaauccauucuu

SEQ ID NO: 2354054 - RNA, 23 nt, Human
aggucauuuuuuuuaagaaaaag

SEQ ID NO: 2354055 - RNA, 22 nt, Human
aggucauuuuuuuuaagaaaaa

SEQ ID NO: 2354056 - RNA, 17 nt, Human
aggucaaguaagaagac

SEQ ID NO: 2354057 - RNA, 18 nt, Human
aggucaagcccaggagga

SEQ ID NO: 2354058 - RNA, 16 nt, Human
aggucaagcccaggag

SEQ ID NO: 2354059 - RNA, 19 nt, Human
aggucaagaagaagaugga

SEQ ID NO: 2354060 - RNA, 21 nt, Human
aggucaacagagaaggcagga

SEQ ID NO: 2354061 - RNA, 19 nt, Human
aggucaacagagaaggcag

SEQ ID NO: 2354062 - RNA, 17 nt, Human
aggucaacagagaaggc

SEQ ID NO: 2354063 - RNA, 21 nt, Human
aggucaaggcugcagugagcc

SEQ ID NO: 2354064 - RNA, 15 nt, Human
aggucagugcaaaua

SEQ ID NO: 2354065 - RNA, 21 nt, Human
aggucuuuugacauguggaaa

SEQ ID NO: 2354066 - RNA, 16 nt, Human
agguccaauuuguaaa

SEQ ID NO: 2354067 - RNA, 22 nt, Human
aggucuugaacuccuggccuca

SEQ ID NO: 2354068 - RNA, 21 nt, Human
aggugaaagggagcuaucagg

SEQ ID NO: 2354069 - RNA, 19 nt, Human
aggugaaaguuaauccacu

SEQ ID NO: 2354070 - RNA, 16 nt, Human
aggugaaagggagcua

SEQ ID NO: 2354071 - RNA, 14 nt, Human
aggugaaagggagc

SEQ ID NO: 2354072 - RNA, 20 nt, Human
aggucuugaacuccuggccu

SEQ ID NO: 2354073 - RNA, 21 nt, Human
aggucuugaacuccuggccuc

SEQ ID NO: 2354074 - RNA, 17 nt, Human
aggucauagcugagauu

SEQ ID NO: 2354075 - RNA, 14 nt, Human
agguccaagauacc

SEQ ID NO: 2354076 - RNA, 17 nt, Human
agguccacaacacacag

SEQ ID NO: 2354077 - RNA, 20 nt, Human
agguaugaccuucuaggaag

SEQ ID NO: 2354078 - RNA, 13 nt, Human
agguaugaauaag

SEQ ID NO: 2354079 - RNA, 15 nt, Human
agguaucuccaggau

SEQ ID NO: 2354080 - RNA, 21 nt, Human
agguaucauuuucugcauuua

SEQ ID NO: 2354081 - RNA, 13 nt, Human
agguaucuccagg

SEQ ID NO: 2354082 - RNA, 14 nt, Human
agguaucuccagga

SEQ ID NO: 2354083 - RNA, 17 nt, Human
agguaugcaaucaaauc

SEQ ID NO: 2354084 - RNA, 22 nt, Human
agguaugaccuucuaggaagcu

SEQ ID NO: 2354085 - RNA, 23 nt, Human
agguaugaccuucuaggaagcuc

SEQ ID NO: 2354086 - RNA, 14 nt, Human
agguauuucaaaac

SEQ ID NO: 2354087 - RNA, 14 nt, Human
aggucaacagagaa

SEQ ID NO: 2354088 - RNA, 16 nt, Human
agguaugaggucuagg

SEQ ID NO: 2354089 - RNA, 14 nt, Human
agguauuuaucuuu

SEQ ID NO: 2354090 - RNA, 19 nt, Human
agguaggagaauugcuuga

SEQ ID NO: 2354091 - RNA, 14 nt, Human
agguagcugccccu

SEQ ID NO: 2354092 - RNA, 23 nt, Human
agguagcuuugagguggaagagg

SEQ ID NO: 2354093 - RNA, 20 nt, Human
agguagcccuggccagaggc

SEQ ID NO: 2354094 - RNA, 19 nt, Human
agguagcccuggccagagg

SEQ ID NO: 2354095 - RNA, 21 nt, Human
agguagcccuggccagaggcu

SEQ ID NO: 2354096 - RNA, 19 nt, Human
agguagcugccccuggcuc

SEQ ID NO: 2354097 - RNA, 17 nt, Human
agguaucaguugcaaua

SEQ ID NO: 2354098 - RNA, 22 nt, Human
agguaucaguugcaauaauacu

SEQ ID NO: 2354099 - RNA, 14 nt, Human
aggguuggagcagu

SEQ ID NO: 2354100 - RNA, 14 nt, Human
aggguugaucacac

SEQ ID NO: 2354101 - RNA, 23 nt, Human
aggguuggguucaucugagcaag

SEQ ID NO: 2354102 - RNA, 17 nt, Human
aggguugggcugguguc

SEQ ID NO: 2354103 - RNA, 21 nt, Human
aggguuguuaauggugcaaau

SEQ ID NO: 2354104 - RNA, 21 nt, Human
aggguuuaauccccaguaaaa

SEQ ID NO: 2354105 - RNA, 20 nt, Human
aggguugguccucuugccuc

SEQ ID NO: 2354106 - RNA, 20 nt, Human
aggguuuauguuuaggaugu

SEQ ID NO: 2354107 - RNA, 22 nt, Human
aggguuuggcugugucuaaacu

SEQ ID NO: 2354108 - RNA, 23 nt, Human
aggguuuggcugugucuaaacug

SEQ ID NO: 2354109 - RNA, 16 nt, Human
agguagcccuggccag

SEQ ID NO: 2354110 - RNA, 20 nt, Human
agguagauguucagauugcu

SEQ ID NO: 2354111 - RNA, 17 nt, Human
agguagaguuugaagga

SEQ ID NO: 2354112 - RNA, 20 nt, Human
agguagaguuugaaggaggu

SEQ ID NO: 2354113 - RNA, 21 nt, Human
agguagaguuugaaggaggug

SEQ ID NO: 2354114 - RNA, 23 nt, Human
agguagaguuugaaggaggugag

SEQ ID NO: 2354115 - RNA, 17 nt, Human
aggguuucgagaagcug

SEQ ID NO: 2354116 - RNA, 17 nt, Human
aggguuucagagagccu

SEQ ID NO: 2354117 - RNA, 22 nt, Human
aggguuuaauccccaguaaaau

SEQ ID NO: 2354118 - RNA, 17 nt, Human
aggguuucugagcugcu

SEQ ID NO: 2354119 - RNA, 19 nt, Human
aggguuucgagaagcugcu

SEQ ID NO: 2354120 - RNA, 18 nt, Human
aggguuucugagcugcuc

SEQ ID NO: 2354121 - RNA, 20 nt, Human
aggguuuggcugugucuaaa

SEQ ID NO: 2354122 - RNA, 21 nt, Human
aggguuuggcugugucuaaac

SEQ ID NO: 2354123 - RNA, 18 nt, Human
uggugaaauuuauuaguu

SEQ ID NO: 2354124 - RNA, 13 nt, Human
uggugaauauugu

SEQ ID NO: 2354125 - RNA, 18 nt, Human
aggguucaaaaugucugu

SEQ ID NO: 2354126 - RNA, 14 nt, Human
aggguucaaaaugu

SEQ ID NO: 2354127 - RNA, 18 nt, Human
aggguuauugcauuugga

SEQ ID NO: 2354128 - RNA, 19 nt, Human
uggugaaauuuauuaguua

SEQ ID NO: 2354129 - RNA, 18 nt, Human
aggguucccccagcccug

SEQ ID NO: 2354130 - RNA, 17 nt, Human
aggguucccccagcccu

SEQ ID NO: 2354131 - RNA, 15 nt, Human
aggguucccccagcc

SEQ ID NO: 2354132 - RNA, 22 nt, Human
aggguucaaaaugucuguagcu

SEQ ID NO: 2354133 - RNA, 18 nt, Human
aggguucagagacucagg

SEQ ID NO: 2354134 - RNA, 16 nt, Human
aggguucagagacuca

SEQ ID NO: 2354135 - RNA, 21 nt, Human
aggguugaguuacuuccuauc

SEQ ID NO: 2354136 - RNA, 20 nt, Human
aggguucuccucuccccucu

SEQ ID NO: 2354137 - RNA, 18 nt, Human
aggguugaccccagagga

SEQ ID NO: 2354138 - RNA, 17 nt, Human
aggguugaccccagagg

SEQ ID NO: 2354139 - RNA, 16 nt, Human
aggguugaccccagag

SEQ ID NO: 2354140 - RNA, 19 nt, Human
aggguucccccagcccugu

SEQ ID NO: 2354141 - RNA, 21 nt, Human
aggguuccuguagaccuaggg

SEQ ID NO: 2354142 - RNA, 17 nt, Human
aggguucuccucucccc

SEQ ID NO: 2354143 - RNA, 23 nt, Human
aggguuccuguagaccuagggag

SEQ ID NO: 2354144 - RNA, 14 nt, Human
aggguucuggcugc

SEQ ID NO: 2354145 - RNA, 13 nt, Human
aggguuggccccu

SEQ ID NO: 2354146 - RNA, 14 nt, Human
aggguuggccccug

SEQ ID NO: 2354147 - RNA, 13 nt, Human
aggguugggcugg

SEQ ID NO: 2354148 - RNA, 15 nt, Human
aggguugggcuggug

SEQ ID NO: 2354149 - RNA, 19 nt, Human
uggugaacagaacaaaagg

SEQ ID NO: 2354150 - RNA, 14 nt, Human
uggucuucagccuc

SEQ ID NO: 2354151 - RNA, 15 nt, Human
uggugaaaauguacu

SEQ ID NO: 2354152 - RNA, 17 nt, Human
aggguggugaccucugc

SEQ ID NO: 2354153 - RNA, 18 nt, Human
aggguggugaccucugcc

SEQ ID NO: 2354154 - RNA, 19 nt, Human
aggguggugaccucugccu

SEQ ID NO: 2354155 - RNA, 14 nt, Human
uggucugcaggcag

SEQ ID NO: 2354156 - RNA, 18 nt, Human
uggucugcucgggcccag

SEQ ID NO: 2354157 - RNA, 19 nt, Human
uggucugcucgggcccagg

SEQ ID NO: 2354158 - RNA, 21 nt, Human
uggucugcucgggcccaggcc

SEQ ID NO: 2354159 - RNA, 15 nt, Human
uggucugcaggcagg

SEQ ID NO: 2354160 - RNA, 17 nt, Human
uggucugcucgggccca

SEQ ID NO: 2354161 - RNA, 16 nt, Human
uggucugggacucucu

SEQ ID NO: 2354162 - RNA, 16 nt, Human
uggucugggacuuccu

SEQ ID NO: 2354163 - RNA, 17 nt, Human
uggucugggacuuccuu

SEQ ID NO: 2354164 - RNA, 19 nt, Human
uggucugggacuuccuugc

SEQ ID NO: 2354165 - RNA, 16 nt, Human
uggucugauuucagga

SEQ ID NO: 2354166 - RNA, 22 nt, Human
uggucugaggggcaacugaguc

SEQ ID NO: 2354167 - RNA, 12 nt, Human
uggucugaaugu

SEQ ID NO: 2354168 - RNA, 22 nt, Human
uggucucugcugaagguuguaa

SEQ ID NO: 2354169 - RNA, 18 nt, Human
uggucugacccacugcuu

SEQ ID NO: 2354170 - RNA, 21 nt, Human
uggucugggacuuccuugcuc

SEQ ID NO: 2354171 - RNA, 14 nt, Human
uggucuguuggcag

SEQ ID NO: 2354172 - RNA, 18 nt, Human
uggucuguuggcaggcug

SEQ ID NO: 2354173 - RNA, 16 nt, Human
uggucuuauuuguaaa

SEQ ID NO: 2354174 - RNA, 12 nt, Human
uggucuguguga

SEQ ID NO: 2354175 - RNA, 22 nt, Human
uggucugugagaugcuagaacu

SEQ ID NO: 2354176 - RNA, 22 nt, Human
ugguccaugggccauaugaaaa

SEQ ID NO: 2354177 - RNA, 17 nt, Human
ugguccauggaaugcuu

SEQ ID NO: 2354178 - RNA, 20 nt, Human
ugguccauggaaugcuugaa

SEQ ID NO: 2354179 - RNA, 21 nt, Human
uggucccaacaggaggacaau

SEQ ID NO: 2354180 - RNA, 19 nt, Human
ugguccauagagagcaaga

SEQ ID NO: 2354181 - RNA, 21 nt, Human
uggucucgaacuccugaccuu

SEQ ID NO: 2354182 - RNA, 20 nt, Human
uggucucgaacuccugaccu

SEQ ID NO: 2354183 - RNA, 14 nt, Human
uggucucuaggcug

SEQ ID NO: 2354184 - RNA, 16 nt, Human
uggucucuaggcuggg

SEQ ID NO: 2354185 - RNA, 17 nt, Human
uggucucuaggcugggg

SEQ ID NO: 2354186 - RNA, 18 nt, Human
uggucucuaggcugggga

SEQ ID NO: 2354187 - RNA, 19 nt, Human
uggucucuaggcuggggaa

SEQ ID NO: 2354188 - RNA, 19 nt, Human
uggucucgaacuccugacc

SEQ ID NO: 2354189 - RNA, 15 nt, Human
uggucucgaacuccu

SEQ ID NO: 2354190 - RNA, 13 nt, Human
uggucccacccca

SEQ ID NO: 2354191 - RNA, 17 nt, Human
ugugaugcuuugaagua

SEQ ID NO: 2354192 - RNA, 16 nt, Human
agugagccgagauugu

SEQ ID NO: 2354193 - RNA, 15 nt, Human
ugugauggggcccug

SEQ ID NO: 2354194 - RNA, 16 nt, Human
ugugauggggcccugc

SEQ ID NO: 2354195 - RNA, 14 nt, Human
agugagagcugggu

SEQ ID NO: 2354196 - RNA, 22 nt, Human
agugagagagaugggagcuccu

SEQ ID NO: 2354197 - RNA, 15 nt, Human
agugagcacucccaa

SEQ ID NO: 2354198 - RNA, 16 nt, Human
agugagcacucccaag

SEQ ID NO: 2354199 - RNA, 23 nt, Human
agugagagcgugcuccagccugg

SEQ ID NO: 2354200 - RNA, 21 nt, Human
agugagcagucaggaaagaga

SEQ ID NO: 2354201 - RNA, 17 nt, Human
ugugauggggcccugcc

SEQ ID NO: 2354202 - RNA, 11 nt, Human
ugugauguguc

SEQ ID NO: 2354203 - RNA, 15 nt, Human
ugugaugugaagcca

SEQ ID NO: 2354204 - RNA, 14 nt, Human
ugugauucaaucug

SEQ ID NO: 2354205 - RNA, 22 nt, Human
ugugauuuggaagggaaacuuu

SEQ ID NO: 2354206 - RNA, 15 nt, Human
ugugauuauuucacu

SEQ ID NO: 2354207 - RNA, 17 nt, Human
ugugauuauuucacuuu

SEQ ID NO: 2354208 - RNA, 11 nt, Human
ugugauuuuuu

SEQ ID NO: 2354209 - RNA, 19 nt, Human
ugugauuuuaacucugucu

SEQ ID NO: 2354210 - RNA, 18 nt, Human
ugugauuuuaacucuguc

SEQ ID NO: 2354211 - RNA, 20 nt, Human
ugugauuuuaacucugucuu

SEQ ID NO: 2354212 - RNA, 17 nt, Human
ugugauuuuaacucugu

SEQ ID NO: 2354213 - RNA, 16 nt, Human
ugugauuuuaacucug

SEQ ID NO: 2354214 - RNA, 14 nt, Human
ugugauuuuaacuc

SEQ ID NO: 2354215 - RNA, 18 nt, Human
ugugauuauuucacuuua

SEQ ID NO: 2354216 - RNA, 14 nt, Human
agugaaagcaucac

SEQ ID NO: 2354217 - RNA, 22 nt, Human
agugaaaccuuuagggcagcuu

SEQ ID NO: 2354218 - RNA, 17 nt, Human
agugaaagacaagcugc

SEQ ID NO: 2354219 - RNA, 13 nt, Human
agugagacagaag

SEQ ID NO: 2354220 - RNA, 21 nt, Human
agugagacaguccagccugga

SEQ ID NO: 2354221 - RNA, 17 nt, Human
agugagacccugucuca

SEQ ID NO: 2354222 - RNA, 21 nt, Human
agugagacccugucucaaaaa

SEQ ID NO: 2354223 - RNA, 13 nt, Human
agugagacucugu

SEQ ID NO: 2354224 - RNA, 17 nt, Human
agugagacccugucucu

SEQ ID NO: 2354225 - RNA, 16 nt, Human
agugagacccugucuc

SEQ ID NO: 2354226 - RNA, 21 nt, Human
agugagacccagcccucaucc

SEQ ID NO: 2354227 - RNA, 22 nt, Human
agugagacucugucucaaaaaa

SEQ ID NO: 2354228 - RNA, 16 nt, Human
agugagacucugucuc

SEQ ID NO: 2354229 - RNA, 17 nt, Human
agugagacucugucuca

SEQ ID NO: 2354230 - RNA, 14 nt, Human
agugaaaauaggua

SEQ ID NO: 2354231 - RNA, 20 nt, Human
agugaaaacaagugcuggca

SEQ ID NO: 2354232 - RNA, 12 nt, Human
agugaaaacaag

SEQ ID NO: 2354233 - RNA, 19 nt, Human
agugaaaacaagugcuggc

SEQ ID NO: 2354234 - RNA, 14 nt, Human
agugaaaaaugaga

SEQ ID NO: 2354235 - RNA, 17 nt, Human
agucuuuuguucgcaug

SEQ ID NO: 2354236 - RNA, 15 nt, Human
agugaaaauugucuu

SEQ ID NO: 2354237 - RNA, 19 nt, Human
agugaaaccuuuagggcag

SEQ ID NO: 2354238 - RNA, 20 nt, Human
agugaaaccuuuagggcagc

SEQ ID NO: 2354239 - RNA, 21 nt, Human
agugaaaccuuuagggcagcu

SEQ ID NO: 2354240 - RNA, 20 nt, Human
agugaaacucguuaauuugu

SEQ ID NO: 2354241 - RNA, 17 nt, Human
agugaaagaaaauaaca

SEQ ID NO: 2354242 - RNA, 16 nt, Human
agugaaagaggcagcu

SEQ ID NO: 2354243 - RNA, 14 nt, Human
agugagacagcucu

SEQ ID NO: 2354244 - RNA, 22 nt, Human
agugaaagaggcagcuugaaac

SEQ ID NO: 2354245 - RNA, 14 nt, Human
ugugagauguaauu

SEQ ID NO: 2354246 - RNA, 19 nt, Human
ugugagcaagcauuuaugu

SEQ ID NO: 2354247 - RNA, 14 nt, Human
ugugagcaagaagu

SEQ ID NO: 2354248 - RNA, 19 nt, Human
ugugagcacaaagguagcu

SEQ ID NO: 2354249 - RNA, 22 nt, Human
ugugagaugcuagaacucccuu

SEQ ID NO: 2354250 - RNA, 21 nt, Human
ugugaagccaauucagacagg

SEQ ID NO: 2354251 - RNA, 20 nt, Human
ugugaagccaauucagacag

SEQ ID NO: 2354252 - RNA, 10 nt, Human
ugugaagcca

SEQ ID NO: 2354253 - RNA, 12 nt, Human
ugugaagcauuc

SEQ ID NO: 2354254 - RNA, 22 nt, Human
ugugaagaucacguuccuuccc

SEQ ID NO: 2354255 - RNA, 18 nt, Human
ugugaagagggagaagca

SEQ ID NO: 2354256 - RNA, 15 nt, Human
ugugaacugacaggc

SEQ ID NO: 2354257 - RNA, 22 nt, Human
ugugaagaugauauacuauuuu

SEQ ID NO: 2354258 - RNA, 14 nt, Human
ugugaagcaaaauu

SEQ ID NO: 2354259 - RNA, 23 nt, Human
ugugaacugaacucugacaacag

SEQ ID NO: 2354260 - RNA, 14 nt, Human
ugugaacugaacuc

SEQ ID NO: 2354261 - RNA, 18 nt, Human
ugugaacuggacccuguu

SEQ ID NO: 2354262 - RNA, 21 nt, Human
ugugaacucagccaagcacag

SEQ ID NO: 2354263 - RNA, 18 nt, Human
agucucauuacuuuugaa

SEQ ID NO: 2354264 - RNA, 17 nt, Human
agucucauuacuuuuga

SEQ ID NO: 2354265 - RNA, 19 nt, Human
agucuccagugguugcugu

SEQ ID NO: 2354266 - RNA, 15 nt, Human
agucuccaccaggaa

SEQ ID NO: 2354267 - RNA, 14 nt, Human
agucuccaccagga

SEQ ID NO: 2354268 - RNA, 15 nt, Human
agucucccucacagc

SEQ ID NO: 2354269 - RNA, 20 nt, Human
agucucccucacagcacaga

SEQ ID NO: 2354270 - RNA, 16 nt, Human
agucuccaccaggaac

SEQ ID NO: 2354271 - RNA, 22 nt, Human
agucuccagugguugcuguuga

SEQ ID NO: 2354272 - RNA, 13 nt, Human
agucucccaaggc

SEQ ID NO: 2354273 - RNA, 14 nt, Human
agucucccaaggcu

SEQ ID NO: 2354274 - RNA, 19 nt, Human
agucuccaaagucucugga

SEQ ID NO: 2354275 - RNA, 14 nt, Human
ugugagcagugagu

SEQ ID NO: 2354276 - RNA, 18 nt, Human
ugugagcaucacaguuuu

SEQ ID NO: 2354277 - RNA, 15 nt, Human
ugugagcccagcugg

SEQ ID NO: 2354278 - RNA, 14 nt, Human
ugugagcccagcug

SEQ ID NO: 2354279 - RNA, 18 nt, Human
agucucccucccuugggg

SEQ ID NO: 2354280 - RNA, 14 nt, Human
agucucccucccuu

SEQ ID NO: 2354281 - RNA, 19 nt, Human
agucucugaagugaaacug

SEQ ID NO: 2354282 - RNA, 18 nt, Human
agucucugaagugaaacu

SEQ ID NO: 2354283 - RNA, 23 nt, Human
agucucccucacagcacagagaa

SEQ ID NO: 2354284 - RNA, 16 nt, Human
agucucugagcaguga

SEQ ID NO: 2354285 - RNA, 15 nt, Human
agucucugagggcuu

SEQ ID NO: 2354286 - RNA, 19 nt, Human
agucucugagggcuuccuu

SEQ ID NO: 2354287 - RNA, 13 nt, Human
agucucugagcag

SEQ ID NO: 2354288 - RNA, 11 nt, Human
agucucugagc

SEQ ID NO: 2354289 - RNA, 13 nt, Human
agucuuaaaauaa

SEQ ID NO: 2354290 - RNA, 17 nt, Human
agucuuaaaauaacuua

SEQ ID NO: 2354291 - RNA, 16 nt, Human
agucucugugcuuuga

SEQ ID NO: 2354292 - RNA, 23 nt, Human
agucuuaaaauaacuuauaucau

SEQ ID NO: 2354293 - RNA, 13 nt, Human
agucuuaagaacu

SEQ ID NO: 2354294 - RNA, 24 nt, Human
agucuuagacuugaaauacuacuu

SEQ ID NO: 2354295 - RNA, 16 nt, Human
agucuuacgaauacuu

SEQ ID NO: 2354296 - RNA, 17 nt, Human
agucucugcuggcccag

SEQ ID NO: 2354297 - RNA, 16 nt, Human
agucucugcuggccca

SEQ ID NO: 2354298 - RNA, 21 nt, Human
agucucugagggcuuccuuug

SEQ ID NO: 2354299 - RNA, 18 nt, Human
agucuguuuuaugacuuc

SEQ ID NO: 2354300 - RNA, 17 nt, Human
agucuguuuuaugacuu

SEQ ID NO: 2354301 - RNA, 14 nt, Human
agucuguuuuauga

SEQ ID NO: 2354302 - RNA, 13 nt, Human
agucuguuuuaug

SEQ ID NO: 2354303 - RNA, 13 nt, Human
agucuucccugau

SEQ ID NO: 2354304 - RNA, 17 nt, Human
agucuuccauuugcaag

SEQ ID NO: 2354305 - RNA, 16 nt, Human
agucuuccauuugcaa

SEQ ID NO: 2354306 - RNA, 22 nt, Human
agucuuaauauauauauccaga

SEQ ID NO: 2354307 - RNA, 15 nt, Human
agucuuccauuugca

SEQ ID NO: 2354308 - RNA, 19 nt, Human
agucuuccugacacuuuaa

SEQ ID NO: 2354309 - RNA, 18 nt, Human
agucuuccugacacuuua

SEQ ID NO: 2354310 - RNA, 17 nt, Human
agucuuccugacacuuu

SEQ ID NO: 2354311 - RNA, 19 nt, Human
agucuuccauuugcaaggg

SEQ ID NO: 2354312 - RNA, 12 nt, Human
agucuuccugac

SEQ ID NO: 2354313 - RNA, 16 nt, Human
agucuuccugacacuu

SEQ ID NO: 2354314 - RNA, 15 nt, Human
agucuuccugacacu

SEQ ID NO: 2354315 - RNA, 15 nt, Human
agucuuuuccaugaa

SEQ ID NO: 2354316 - RNA, 13 nt, Human
agucuuuuccaug

SEQ ID NO: 2354317 - RNA, 18 nt, Human
agucuucucauagcauua

SEQ ID NO: 2354318 - RNA, 13 nt, Human
agucuucucauag

SEQ ID NO: 2354319 - RNA, 12 nt, Human
agucuucucaua

SEQ ID NO: 2354320 - RNA, 21 nt, Human
agucuucucauagcauuaacu

SEQ ID NO: 2354321 - RNA, 20 nt, Human
agucuucucauagcauuaac

SEQ ID NO: 2354322 - RNA, 14 nt, Human
agucuuuugcuuuu

SEQ ID NO: 2354323 - RNA, 18 nt, Human
agucuuuugcuuuuggca

SEQ ID NO: 2354324 - RNA, 22 nt, Human
agucuuuuguucgcauggucac

SEQ ID NO: 2354325 - RNA, 19 nt, Human
agucuuuugcuuuuggcaa

SEQ ID NO: 2354326 - RNA, 20 nt, Human
agucuuuugcuuuuggcaaa

SEQ ID NO: 2354327 - RNA, 23 nt, Human
agugaaaaaggaggaagagaaaa

SEQ ID NO: 2354328 - RNA, 20 nt, Human
agugaaaaaggaggaagaga

SEQ ID NO: 2354329 - RNA, 17 nt, Human
agugaaaaaggaggaag

SEQ ID NO: 2354330 - RNA, 11 nt, Human
agugaaaaagg

SEQ ID NO: 2354331 - RNA, 13 nt, Human
ugucucuuucaug

SEQ ID NO: 2354332 - RNA, 14 nt, Human
ugucucuuuucucu

SEQ ID NO: 2354333 - RNA, 18 nt, Human
ugucucuuuucucuuucu

SEQ ID NO: 2354334 - RNA, 22 nt, Human
ugucucuuuaaugucacaggca

SEQ ID NO: 2354335 - RNA, 21 nt, Human
ugucucuuuaaugucacaggc

SEQ ID NO: 2354336 - RNA, 22 nt, Human
ugucucuugguccugcugcagu

SEQ ID NO: 2354337 - RNA, 22 nt, Human
ugucugaaaaauuccuuugugu

SEQ ID NO: 2354338 - RNA, 14 nt, Human
ugucuuaauuaaaa

SEQ ID NO: 2354339 - RNA, 17 nt, Human
ugucuucaacagcuccc

SEQ ID NO: 2354340 - RNA, 13 nt, Human
ugucuuauauaua

SEQ ID NO: 2354341 - RNA, 22 nt, Human
ugucuuauauauauuucuuugu

SEQ ID NO: 2354342 - RNA, 12 nt, Human
ugucugaaaaau

SEQ ID NO: 2354343 - RNA, 14 nt, Human
ugucuuaauuauua

SEQ ID NO: 2354344 - RNA, 15 nt, Human
ugucuuaauuauuau

SEQ ID NO: 2354345 - RNA, 19 nt, Human
ugucucuggcgugugggua

SEQ ID NO: 2354346 - RNA, 18 nt, Human
ugucucuggcgugugggu

SEQ ID NO: 2354347 - RNA, 17 nt, Human
ugucucugccucccuca

SEQ ID NO: 2354348 - RNA, 13 nt, Human
ugucucuggccug

SEQ ID NO: 2354349 - RNA, 13 nt, Human
ugucucugccucc

SEQ ID NO: 2354350 - RNA, 22 nt, Human
ugucucugccucccucacccug

SEQ ID NO: 2354351 - RNA, 16 nt, Human
ugucucugucauggua

SEQ ID NO: 2354352 - RNA, 23 nt, Human
ugucucugggcuuggggcuuccu

SEQ ID NO: 2354353 - RNA, 13 nt, Human
ugucucugugaga

SEQ ID NO: 2354354 - RNA, 14 nt, Human
ugucucuugaguuu

SEQ ID NO: 2354355 - RNA, 17 nt, Human
ugucucuugaguuuguc

SEQ ID NO: 2354356 - RNA, 21 nt, Human
ugucucuuccauaugaccuca

SEQ ID NO: 2354357 - RNA, 13 nt, Human
ugucucuuccaua

SEQ ID NO: 2354358 - RNA, 16 nt, Human
ugucucuucugagcua

SEQ ID NO: 2354359 - RNA, 13 nt, Human
ugucucuucugag

SEQ ID NO: 2354360 - RNA, 18 nt, Human
ugucucuugguccugcug

SEQ ID NO: 2354361 - RNA, 19 nt, Human
ugucucuugguccugcugc

SEQ ID NO: 2354362 - RNA, 20 nt, Human
ugucucuugguccugcugca

SEQ ID NO: 2354363 - RNA, 21 nt, Human
ugucucuugguccugcugcag

SEQ ID NO: 2354364 - RNA, 17 nt, Human
ugucuccuuaacacuga

SEQ ID NO: 2354365 - RNA, 18 nt, Human
ugucuccuuaacacugag

SEQ ID NO: 2354366 - RNA, 12 nt, Human
ugucuccuaucc

SEQ ID NO: 2354367 - RNA, 19 nt, Human
ugucuccuuugcaggcuca

SEQ ID NO: 2354368 - RNA, 22 nt, Human
ugucuccuuucaccccagggcc

SEQ ID NO: 2354369 - RNA, 21 nt, Human
ugucuccuuucaccccagggc

SEQ ID NO: 2354370 - RNA, 23 nt, Human
aguccccuguuuguuucugaaag

SEQ ID NO: 2354371 - RNA, 13 nt, Human
agucccugccaau

SEQ ID NO: 2354372 - RNA, 14 nt, Human
agucccugccaaug

SEQ ID NO: 2354373 - RNA, 16 nt, Human
agucccugccaaugga

SEQ ID NO: 2354374 - RNA, 21 nt, Human
ugucucgugguaggacuguag

SEQ ID NO: 2354375 - RNA, 15 nt, Human
ugucucuagccacuu

SEQ ID NO: 2354376 - RNA, 16 nt, Human
ugucucuagccacuuu

SEQ ID NO: 2354377 - RNA, 17 nt, Human
ugucucuacuaaaaaua

SEQ ID NO: 2354378 - RNA, 18 nt, Human
ugucucgugguaggacug

SEQ ID NO: 2354379 - RNA, 19 nt, Human
ugucucgugguaggacugu

SEQ ID NO: 2354380 - RNA, 20 nt, Human
ugucucgugguaggacugua

SEQ ID NO: 2354381 - RNA, 13 nt, Human
ugucucucagaau

SEQ ID NO: 2354382 - RNA, 19 nt, Human
ugucucuagccacuuuggu

SEQ ID NO: 2354383 - RNA, 12 nt, Human
ugucucucauga

SEQ ID NO: 2354384 - RNA, 13 nt, Human
ugucucugagagu

SEQ ID NO: 2354385 - RNA, 22 nt, Human
ugucucuggauuauauuaugaa

SEQ ID NO: 2354386 - RNA, 18 nt, Human
ugucuuguguuucuuuag

SEQ ID NO: 2354387 - RNA, 13 nt, Human
ugucuuguucugu

SEQ ID NO: 2354388 - RNA, 23 nt, Human
ugucuugcuauggggagaaaaga

SEQ ID NO: 2354389 - RNA, 13 nt, Human
ugucuuggacacu

SEQ ID NO: 2354390 - RNA, 15 nt, Human
ugucuuggacacugu

SEQ ID NO: 2354391 - RNA, 21 nt, Human
ugucuuuaggcagcagcuuuu

SEQ ID NO: 2354392 - RNA, 19 nt, Human
ugucuuuaggcagcagcuu

SEQ ID NO: 2354393 - RNA, 15 nt, Human
ugucuuuaaggaaaa

SEQ ID NO: 2354394 - RNA, 14 nt, Human
ugucuuuaaggaaa

SEQ ID NO: 2354395 - RNA, 16 nt, Human
ugucuuucagauacau

SEQ ID NO: 2354396 - RNA, 15 nt, Human
ugucuuucagauaca

SEQ ID NO: 2354397 - RNA, 15 nt, Human
ugugaaccaccacac

SEQ ID NO: 2354398 - RNA, 21 nt, Human
ugugaacgauuuagaaagaag

SEQ ID NO: 2354399 - RNA, 17 nt, Human
ugugaaccgaggggcuc

SEQ ID NO: 2354400 - RNA, 20 nt, Human
ugucuuucagauacaugguu

SEQ ID NO: 2354401 - RNA, 19 nt, Human
ugucuuucagauacauggu

SEQ ID NO: 2354402 - RNA, 14 nt, Human
ugugaacauggacu

SEQ ID NO: 2354403 - RNA, 12 nt, Human
ugugaacauuua

SEQ ID NO: 2354404 - RNA, 14 nt, Human
ugugaacucagcca

SEQ ID NO: 2354405 - RNA, 15 nt, Human
ugugaacucagccaa

SEQ ID NO: 2354406 - RNA, 16 nt, Human
ugugaacucagccaag

SEQ ID NO: 2354407 - RNA, 18 nt, Human
ugugaacucagccaagca

SEQ ID NO: 2354408 - RNA, 19 nt, Human
ugugaacucagccaagcac

SEQ ID NO: 2354409 - RNA, 20 nt, Human
ugugaacucagccaagcaca

SEQ ID NO: 2354410 - RNA, 20 nt, Human
ugugaacuaaacuuucacac

SEQ ID NO: 2354411 - RNA, 19 nt, Human
ugugaacuaaacuuucaca

SEQ ID NO: 2354412 - RNA, 14 nt, Human
ugugaacuaaacuu

SEQ ID NO: 2354413 - RNA, 16 nt, Human
ugugaaccaccacacc

SEQ ID NO: 2354414 - RNA, 17 nt, Human
ugugaaccaccacaccc

SEQ ID NO: 2354415 - RNA, 22 nt, Human
ugugaaccaccacacccagccc

SEQ ID NO: 2354416 - RNA, 23 nt, Human
ugugaaccaccacacccagccca

SEQ ID NO: 2354417 - RNA, 15 nt, Human
ugucuugcaauggca

SEQ ID NO: 2354418 - RNA, 22 nt, Human
ugucuugaugcaugcacuguuc

SEQ ID NO: 2354419 - RNA, 16 nt, Human
ugucuucuucugugcu

SEQ ID NO: 2354420 - RNA, 19 nt, Human
ugucuugaaagauucaggu

SEQ ID NO: 2354421 - RNA, 17 nt, Human
ugucuugaaugucuuuu

SEQ ID NO: 2354422 - RNA, 20 nt, Human
ugucuugaaugucuuuugaa

SEQ ID NO: 2354423 - RNA, 23 nt, Human
ugucuucucaggcucugcccugc

SEQ ID NO: 2354424 - RNA, 14 nt, Human
ugucuucuccccag

SEQ ID NO: 2354425 - RNA, 12 nt, Human
ugucuucugccu

SEQ ID NO: 2354426 - RNA, 13 nt, Human
ugucuucugccug

SEQ ID NO: 2354427 - RNA, 14 nt, Human
ugucuucugccugu

SEQ ID NO: 2354428 - RNA, 15 nt, Human
ugucuucugccuguu

SEQ ID NO: 2354429 - RNA, 17 nt, Human
ugucuucugccuguuau

SEQ ID NO: 2354430 - RNA, 18 nt, Human
ugucuucugccuguuaua

SEQ ID NO: 2354431 - RNA, 17 nt, Human
ugucuugcaauggcagc

SEQ ID NO: 2354432 - RNA, 18 nt, Human
ugucuugcaauggcagcc

SEQ ID NO: 2354433 - RNA, 20 nt, Human
ugucuugcaauggcagccuu

SEQ ID NO: 2354434 - RNA, 21 nt, Human
ugucuugcaauggcagccuug

SEQ ID NO: 2354435 - RNA, 17 nt, Human
ugucuuccauaauguau

SEQ ID NO: 2354436 - RNA, 14 nt, Human
ugucuuccauaaug

SEQ ID NO: 2354437 - RNA, 13 nt, Human
ugucuuccauaau

SEQ ID NO: 2354438 - RNA, 12 nt, Human
ugucuuccauaa

SEQ ID NO: 2354439 - RNA, 21 nt, Human
ugucuucauuucauuguauga

SEQ ID NO: 2354440 - RNA, 23 nt, Human
ugucuucauuucauuguaugaug

SEQ ID NO: 2354441 - RNA, 15 nt, Human
ugucuucauagcaga

SEQ ID NO: 2354442 - RNA, 13 nt, Human
ugucuucaccuga

SEQ ID NO: 2354443 - RNA, 16 nt, Human
ugucuucauuucauug

SEQ ID NO: 2354444 - RNA, 17 nt, Human
ugucuucauuucauugu

SEQ ID NO: 2354445 - RNA, 19 nt, Human
ugucuucauuucauuguau

SEQ ID NO: 2354446 - RNA, 19 nt, Human
ugucuucacagcucugugu

SEQ ID NO: 2354447 - RNA, 24 nt, Human
ugucuucaccugauucaacuaaaa

SEQ ID NO: 2354448 - RNA, 22 nt, Human
ugucuucauaccuacauguauu

SEQ ID NO: 2354449 - RNA, 14 nt, Human
ugucuucacaacag

SEQ ID NO: 2354450 - RNA, 22 nt, Human
ugucuucucaggcucugcccug

SEQ ID NO: 2354451 - RNA, 21 nt, Human
ugucuucucaggcucugcccu

SEQ ID NO: 2354452 - RNA, 16 nt, Human
ugucuucucaggcucu

SEQ ID NO: 2354453 - RNA, 18 nt, Human
ugucuucguacaguucuu

SEQ ID NO: 2354454 - RNA, 14 nt, Human
ugucuuccuguggg

SEQ ID NO: 2354455 - RNA, 14 nt, Human
ugucuuccuuggag

SEQ ID NO: 2354456 - RNA, 16 nt, Human
ugucuucggaaaccuu

SEQ ID NO: 2354457 - RNA, 19 nt, Human
ugucuucggaaaccuuggu

SEQ ID NO: 2354458 - RNA, 20 nt, Human
ugucuucggaaaccuuggug

SEQ ID NO: 2354459 - RNA, 21 nt, Human
ugucuucggaaaccuuggugu

SEQ ID NO: 2354460 - RNA, 16 nt, Human
ugucuucguacaguuc

SEQ ID NO: 2354461 - RNA, 17 nt, Human
ugucuucguacaguucu

SEQ ID NO: 2354462 - RNA, 18 nt, Human
ugucuuccugcauucacc

SEQ ID NO: 2354463 - RNA, 13 nt, Human
ugucuuccugugg

SEQ ID NO: 2354464 - RNA, 17 nt, Human
ugucuuccugcauucac

SEQ ID NO: 2354465 - RNA, 13 nt, Human
ugucuuccugcau

SEQ ID NO: 2354466 - RNA, 16 nt, Human
ugucuuccucccaagu

SEQ ID NO: 2354467 - RNA, 22 nt, Human
ugucuucccaggguagcccgcc

SEQ ID NO: 2354468 - RNA, 13 nt, Human
ugucuucccaggg

SEQ ID NO: 2354469 - RNA, 14 nt, Human
ugucuucccagggu

SEQ ID NO: 2354470 - RNA, 16 nt, Human
ugucuucccaggguag

SEQ ID NO: 2354471 - RNA, 21 nt, Human
ugucuucccaggguagcccgc

SEQ ID NO: 2354472 - RNA, 21 nt, Human
aguccauauuucaauuuccaa

SEQ ID NO: 2354473 - RNA, 17 nt, Human
aguccagugaccugcug

SEQ ID NO: 2354474 - RNA, 15 nt, Human
aguccagucucuucu

SEQ ID NO: 2354475 - RNA, 21 nt, Human
agucaucuugaccaagcagga

SEQ ID NO: 2354476 - RNA, 21 nt, Human
agucaugaagcccaagugaaa

SEQ ID NO: 2354477 - RNA, 14 nt, Human
agucaugaagccca

SEQ ID NO: 2354478 - RNA, 13 nt, Human
agucaugaagccc

SEQ ID NO: 2354479 - RNA, 20 nt, Human
agucaucuugaccaagcagg

SEQ ID NO: 2354480 - RNA, 21 nt, Human
agucccaccuuggcugcaggg

SEQ ID NO: 2354481 - RNA, 23 nt, Human
agucccaccuuggcugcagggag

SEQ ID NO: 2354482 - RNA, 20 nt, Human
agucccaccuuggcugcagg

SEQ ID NO: 2354483 - RNA, 13 nt, Human
aguccccaggccc

SEQ ID NO: 2354484 - RNA, 17 nt, Human
aguccccaggccccagg

SEQ ID NO: 2354485 - RNA, 16 nt, Human
aguccccaggccccag

SEQ ID NO: 2354486 - RNA, 19 nt, Human
aguccccaggccccaggaa

SEQ ID NO: 2354487 - RNA, 18 nt, Human
aguccccaccccugcccc

SEQ ID NO: 2354488 - RNA, 20 nt, Human
aguccccaccccugccccca

SEQ ID NO: 2354489 - RNA, 13 nt, Human
aguccccaccccu

SEQ ID NO: 2354490 - RNA, 15 nt, Human
aguccccaccccugc

SEQ ID NO: 2354491 - RNA, 16 nt, Human
aguccccaccccugcc

SEQ ID NO: 2354492 - RNA, 17 nt, Human
aguccccaccccugccc

SEQ ID NO: 2354493 - RNA, 14 nt, Human
aguccccuguuugu

SEQ ID NO: 2354494 - RNA, 19 nt, Human
aguccccuguuuguuucug

SEQ ID NO: 2354495 - RNA, 23 nt, Human
aguccauauuucaauuuccaaga

SEQ ID NO: 2354496 - RNA, 12 nt, Human
agucccacugcc

SEQ ID NO: 2354497 - RNA, 17 nt, Human
agucccacugccucagg

SEQ ID NO: 2354498 - RNA, 20 nt, Human
agucccaggcugagccucag

SEQ ID NO: 2354499 - RNA, 15 nt, Human
agucccagugggagg

SEQ ID NO: 2354500 - RNA, 11 nt, Human
aguccccaccc

SEQ ID NO: 2354501 - RNA, 12 nt, Human
aguccccacccc

SEQ ID NO: 2354502 - RNA, 18 nt, Human
agucccacugccucaggu

SEQ ID NO: 2354503 - RNA, 20 nt, Human
agucccacugccucagguuc

SEQ ID NO: 2354504 - RNA, 13 nt, Human
agucccaguggga

SEQ ID NO: 2354505 - RNA, 13 nt, Human
agucauccaaucu

SEQ ID NO: 2354506 - RNA, 20 nt, Human
agucagugcccaacuguuau

SEQ ID NO: 2354507 - RNA, 20 nt, Human
agucaucuccaucagcugua

SEQ ID NO: 2354508 - RNA, 19 nt, Human
agucaucuccaucagcugu

SEQ ID NO: 2354509 - RNA, 18 nt, Human
agucaucuccaucagcug

SEQ ID NO: 2354510 - RNA, 17 nt, Human
agucaucuccaucagcu

SEQ ID NO: 2354511 - RNA, 15 nt, Human
agucaucucaaccau

SEQ ID NO: 2354512 - RNA, 14 nt, Human
agucaucucaacca

SEQ ID NO: 2354513 - RNA, 16 nt, Human
agucagugcaaauguc

SEQ ID NO: 2354514 - RNA, 23 nt, Human
agucagugcaaaugucagauaca

SEQ ID NO: 2354515 - RNA, 16 nt, Human
agucagugccaggucc

SEQ ID NO: 2354516 - RNA, 21 nt, Human
agucagucaugauggcaccac

SEQ ID NO: 2354517 - RNA, 23 nt, Human
agucagaugcccagagggcccag

SEQ ID NO: 2354518 - RNA, 14 nt, Human
agucagaugcccag

SEQ ID NO: 2354519 - RNA, 14 nt, Human
agucagguccaauu

SEQ ID NO: 2354520 - RNA, 13 nt, Human
agucaguauuguu

SEQ ID NO: 2354521 - RNA, 14 nt, Human
agucaguauuguuu

SEQ ID NO: 2354522 - RNA, 15 nt, Human
agucaguauuguuuu

SEQ ID NO: 2354523 - RNA, 17 nt, Human
agucaguauuguuuugg

SEQ ID NO: 2354524 - RNA, 19 nt, Human
agucagggguucccuuuuu

SEQ ID NO: 2354525 - RNA, 21 nt, Human
uguccuucucucaccuccuaa

SEQ ID NO: 2354526 - RNA, 18 nt, Human
uguccuucucucaccucc

SEQ ID NO: 2354527 - RNA, 19 nt, Human
uguccuucucucaccuccu

SEQ ID NO: 2354528 - RNA, 16 nt, Human
uguccuugcaccugca

SEQ ID NO: 2354529 - RNA, 18 nt, Human
uguccuuggaaguuucau

SEQ ID NO: 2354530 - RNA, 15 nt, Human
uguccuugcaccugc

SEQ ID NO: 2354531 - RNA, 13 nt, Human
uguccuugcaccu

SEQ ID NO: 2354532 - RNA, 14 nt, Human
uguccuugugcaug

SEQ ID NO: 2354533 - RNA, 15 nt, Human
uguccuuguguguuu

SEQ ID NO: 2354534 - RNA, 11 nt, Human
ugucuaaacug

SEQ ID NO: 2354535 - RNA, 13 nt, Human
uguccuuucccuc

SEQ ID NO: 2354536 - RNA, 18 nt, Human
ugucuaaauuugaauguu

SEQ ID NO: 2354537 - RNA, 13 nt, Human
ugucuaaacugca

SEQ ID NO: 2354538 - RNA, 19 nt, Human
ugucuaaagagcuuuaguc

SEQ ID NO: 2354539 - RNA, 15 nt, Human
ugucuaagauaguaa

SEQ ID NO: 2354540 - RNA, 14 nt, Human
ugucuaagauagua

SEQ ID NO: 2354541 - RNA, 21 nt, Human
ugucccuaguaaaaauacaaa

SEQ ID NO: 2354542 - RNA, 17 nt, Human
ugucccuaugcauauca

SEQ ID NO: 2354543 - RNA, 14 nt, Human
ugucccuaggucag

SEQ ID NO: 2354544 - RNA, 21 nt, Human
uguccagaagaauauucagga

SEQ ID NO: 2354545 - RNA, 21 nt, Human
ugucccucacuguugaauuuu

SEQ ID NO: 2354546 - RNA, 19 nt, Human
ugucccucaaaugacccaa

SEQ ID NO: 2354547 - RNA, 12 nt, Human
ugucccucccac

SEQ ID NO: 2354548 - RNA, 13 nt, Human
ugucccucccacc

SEQ ID NO: 2354549 - RNA, 14 nt, Human
ugucccucccaccu

SEQ ID NO: 2354550 - RNA, 15 nt, Human
ugucccucccaccuc

SEQ ID NO: 2354551 - RNA, 16 nt, Human
ugucccucccaccucu

SEQ ID NO: 2354552 - RNA, 15 nt, Human
ugucccucucaggca

SEQ ID NO: 2354553 - RNA, 21 nt, Human
ugucccucucggaaggcuggc

SEQ ID NO: 2354554 - RNA, 14 nt, Human
ugucccucucaggc

SEQ ID NO: 2354555 - RNA, 11 nt, Human
ugucccucuca

SEQ ID NO: 2354556 - RNA, 20 nt, Human
ugucccucccaccucuguga

SEQ ID NO: 2354557 - RNA, 13 nt, Human
ugucccucuaaag

SEQ ID NO: 2354558 - RNA, 12 nt, Human
ugucccuccggg

SEQ ID NO: 2354559 - RNA, 12 nt, Human
ugucccuccugg

SEQ ID NO: 2354560 - RNA, 14 nt, Human
ugucccucccccuu

SEQ ID NO: 2354561 - RNA, 17 nt, Human
ugucccucccaccucug

SEQ ID NO: 2354562 - RNA, 18 nt, Human
ugucccucccaccucugu

SEQ ID NO: 2354563 - RNA, 20 nt, Human
ugucccuuucugugugaaga

SEQ ID NO: 2354564 - RNA, 14 nt, Human
ugucccuuggagcu

SEQ ID NO: 2354565 - RNA, 20 nt, Human
ugucccuucugucccucaca

SEQ ID NO: 2354566 - RNA, 22 nt, Human
ugucccuugccucaaugccagu

SEQ ID NO: 2354567 - RNA, 14 nt, Human
ugucccugcacuug

SEQ ID NO: 2354568 - RNA, 18 nt, Human
ugucccuucugucccuca

SEQ ID NO: 2354569 - RNA, 16 nt, Human
ugucccucugccccau

SEQ ID NO: 2354570 - RNA, 15 nt, Human
ugucccucugcccca

SEQ ID NO: 2354571 - RNA, 14 nt, Human
ugucccucugcccc

SEQ ID NO: 2354572 - RNA, 17 nt, Human
ugucccuuucuuggcca

SEQ ID NO: 2354573 - RNA, 16 nt, Human
ugucccuuucuuggcc

SEQ ID NO: 2354574 - RNA, 18 nt, Human
ugucccuuucuuggccag

SEQ ID NO: 2354575 - RNA, 12 nt, Human
ugucccuuuucc

SEQ ID NO: 2354576 - RNA, 22 nt, Human
uguccuguaaagguuacaagcc

SEQ ID NO: 2354577 - RNA, 15 nt, Human
uguccuguaaagguu

SEQ ID NO: 2354578 - RNA, 16 nt, Human
uguccuggugucacuu

SEQ ID NO: 2354579 - RNA, 21 nt, Human
uguccuggugucacuuacugu

SEQ ID NO: 2354580 - RNA, 13 nt, Human
uguccugguguca

SEQ ID NO: 2354581 - RNA, 15 nt, Human
uguccugguucccgu

SEQ ID NO: 2354582 - RNA, 20 nt, Human
uguccuuacccaucugcacc

SEQ ID NO: 2354583 - RNA, 18 nt, Human
uguccuuagaacauuuua

SEQ ID NO: 2354584 - RNA, 12 nt, Human
uguccuuagaac

SEQ ID NO: 2354585 - RNA, 11 nt, Human
uguccuuagca

SEQ ID NO: 2354586 - RNA, 14 nt, Human
uguccuucccugca

SEQ ID NO: 2354587 - RNA, 16 nt, Human
uguccuucccugcauu

SEQ ID NO: 2354588 - RNA, 22 nt, Human
uguccuucccugcauuucugag

SEQ ID NO: 2354589 - RNA, 20 nt, Human
uguccuguagagguuuuguu

SEQ ID NO: 2354590 - RNA, 16 nt, Human
uguccuguacauugug

SEQ ID NO: 2354591 - RNA, 24 nt, Human
uguccuguaguugcguggacucug

SEQ ID NO: 2354592 - RNA, 19 nt, Human
uguccacagaugccuccac

SEQ ID NO: 2354593 - RNA, 18 nt, Human
uguccacagaugccucca

SEQ ID NO: 2354594 - RNA, 14 nt, Human
uguccacagaugcc

SEQ ID NO: 2354595 - RNA, 23 nt, Human
ugucagcuacugcggaaaaggaa

SEQ ID NO: 2354596 - RNA, 21 nt, Human
uguccacccaccuaugugcca

SEQ ID NO: 2354597 - RNA, 20 nt, Human
uguccacagaugccuccacc

SEQ ID NO: 2354598 - RNA, 23 nt, Human
ugucagcuccccucggagaagag

SEQ ID NO: 2354599 - RNA, 21 nt, Human
ugucagcuccccucggagaag

SEQ ID NO: 2354600 - RNA, 20 nt, Human
ugucagcuccccucggagaa

SEQ ID NO: 2354601 - RNA, 16 nt, Human
ugucagccauuccugu

SEQ ID NO: 2354602 - RNA, 21 nt, Human
ugucagcuacuaaugauguuu

SEQ ID NO: 2354603 - RNA, 19 nt, Human
ugucagcuacuaaugaugu

SEQ ID NO: 2354604 - RNA, 18 nt, Human
ugucagcuacuaaugaug

SEQ ID NO: 2354605 - RNA, 22 nt, Human
ugucagccgggcccugaguaau

SEQ ID NO: 2354606 - RNA, 23 nt, Human
ugucagcgcagguuuaguuuacu

SEQ ID NO: 2354607 - RNA, 20 nt, Human
ugucagccgagccgggccug

SEQ ID NO: 2354608 - RNA, 21 nt, Human
ugucagccgagccgggccugg

SEQ ID NO: 2354609 - RNA, 22 nt, Human
ugucagccgagccgggccuggg

SEQ ID NO: 2354610 - RNA, 23 nt, Human
ugucagccgagccgggccugggg

SEQ ID NO: 2354611 - RNA, 15 nt, Human
ugucagccgggcccu

SEQ ID NO: 2354612 - RNA, 16 nt, Human
ugucagccgggcccug

SEQ ID NO: 2354613 - RNA, 17 nt, Human
ugucagccgggcccuga

SEQ ID NO: 2354614 - RNA, 21 nt, Human
ugucagccgggcccugaguaa

SEQ ID NO: 2354615 - RNA, 14 nt, Human
uguccaccuggccc

SEQ ID NO: 2354616 - RNA, 13 nt, Human
uguccaccuggcc

SEQ ID NO: 2354617 - RNA, 12 nt, Human
uguccaccuggc

SEQ ID NO: 2354618 - RNA, 11 nt, Human
uguccaccugg

SEQ ID NO: 2354619 - RNA, 15 nt, Human
uguccaccuggcccc

SEQ ID NO: 2354620 - RNA, 16 nt, Human
uguccacgacugucuc

SEQ ID NO: 2354621 - RNA, 18 nt, Human
uguccacgacugucucca

SEQ ID NO: 2354622 - RNA, 17 nt, Human
uguccacgacugucucc

SEQ ID NO: 2354623 - RNA, 23 nt, Human
uguccagcuccaaccugcaaaga

SEQ ID NO: 2354624 - RNA, 20 nt, Human
uguccagcuccaaccugcaa

SEQ ID NO: 2354625 - RNA, 16 nt, Human
uguccagcuccaaccu

SEQ ID NO: 2354626 - RNA, 12 nt, Human
uguccagcucca

SEQ ID NO: 2354627 - RNA, 11 nt, Human
uguccagcucc

SEQ ID NO: 2354628 - RNA, 16 nt, Human
uguccagaagaauauu

SEQ ID NO: 2354629 - RNA, 20 nt, Human
uguccagaagaauauucagg

SEQ ID NO: 2354630 - RNA, 19 nt, Human
uguccacgacugucuccau

SEQ ID NO: 2354631 - RNA, 13 nt, Human
uguccacugugua

SEQ ID NO: 2354632 - RNA, 15 nt, Human
uguccagaagaauau

SEQ ID NO: 2354633 - RNA, 19 nt, Human
uguccaggcacugcugccc

SEQ ID NO: 2354634 - RNA, 21 nt, Human
uguccagcugagcgccaggau

SEQ ID NO: 2354635 - RNA, 17 nt, Human
uguccagcugagcgcca

SEQ ID NO: 2354636 - RNA, 20 nt, Human
uguccaggcacugcugccca

SEQ ID NO: 2354637 - RNA, 21 nt, Human
uguccaggcacugcugcccag

SEQ ID NO: 2354638 - RNA, 19 nt, Human
ugucccuacaccccucccc

SEQ ID NO: 2354639 - RNA, 13 nt, Human
uguccagggcccu

SEQ ID NO: 2354640 - RNA, 20 nt, Human
ugucccuaccgagucucuuc

SEQ ID NO: 2354641 - RNA, 21 nt, Human
ugucccuaccgagucucuucu

SEQ ID NO: 2354642 - RNA, 22 nt, Human
ugucccuaccgagucucuucuc

SEQ ID NO: 2354643 - RNA, 16 nt, Human
agguuuggugugugga

SEQ ID NO: 2354644 - RNA, 12 nt, Human
agguuuguauau

SEQ ID NO: 2354645 - RNA, 22 nt, Human
agguuugguguguggagaugca

SEQ ID NO: 2354646 - RNA, 21 nt, Human
agguuugggaccccugguggu

SEQ ID NO: 2354647 - RNA, 16 nt, Human
agguuugggaccccug

SEQ ID NO: 2354648 - RNA, 19 nt, Human
uguauccaugggggcaggg

SEQ ID NO: 2354649 - RNA, 13 nt, Human
uguauccauuauc

SEQ ID NO: 2354650 - RNA, 14 nt, Human
uguauccauuauca

SEQ ID NO: 2354651 - RNA, 17 nt, Human
uguauccauuaucaugu

SEQ ID NO: 2354652 - RNA, 18 nt, Human
uguauccauuaucaugug

SEQ ID NO: 2354653 - RNA, 19 nt, Human
uguauccauuaucaugugu

SEQ ID NO: 2354654 - RNA, 20 nt, Human
uguauccauuaucaugugua

SEQ ID NO: 2354655 - RNA, 22 nt, Human
uguauccauuaucauguguaau

SEQ ID NO: 2354656 - RNA, 16 nt, Human
uguauccaugggggca

SEQ ID NO: 2354657 - RNA, 13 nt, Human
agguuuguauauu

SEQ ID NO: 2354658 - RNA, 20 nt, Human
agguuuguauauugucagau

SEQ ID NO: 2354659 - RNA, 22 nt, Human
uguauccauccauggggcugau

SEQ ID NO: 2354660 - RNA, 22 nt, Human
agguuucuggucucuaggcugg

SEQ ID NO: 2354661 - RNA, 23 nt, Human
agguuucuggucucuaggcuggg

SEQ ID NO: 2354662 - RNA, 14 nt, Human
agguuugaguagag

SEQ ID NO: 2354663 - RNA, 17 nt, Human
agguuugagaagcacug

SEQ ID NO: 2354664 - RNA, 21 nt, Human
agguuuggaugggagugagac

SEQ ID NO: 2354665 - RNA, 12 nt, Human
uguagagccagg

SEQ ID NO: 2354666 - RNA, 15 nt, Human
uguagagccaggguc

SEQ ID NO: 2354667 - RNA, 14 nt, Human
uguauguguaagua

SEQ ID NO: 2354668 - RNA, 22 nt, Human
uguaugugggggucuguguguu

SEQ ID NO: 2354669 - RNA, 21 nt, Human
uguaugugggggucugugugu

SEQ ID NO: 2354670 - RNA, 15 nt, Human
uguaucccaugagcc

SEQ ID NO: 2354671 - RNA, 16 nt, Human
uguauuaagaaugaaa

SEQ ID NO: 2354672 - RNA, 12 nt, Human
uguauuaagaau

SEQ ID NO: 2354673 - RNA, 17 nt, Human
uguauuaaaaaaaacaa

SEQ ID NO: 2354674 - RNA, 19 nt, Human
uguauuaaaaaaaacaaaa

SEQ ID NO: 2354675 - RNA, 20 nt, Human
uguauuaaaaaaaacaaaaa

SEQ ID NO: 2354676 - RNA, 21 nt, Human
uguauuaaaaaaaacaaaaag

SEQ ID NO: 2354677 - RNA, 22 nt, Human
uguauuaaaaaaaacaaaaaga

SEQ ID NO: 2354678 - RNA, 15 nt, Human
ugucaacuaugauau

SEQ ID NO: 2354679 - RNA, 18 nt, Human
ugucaaauaaacacugug

SEQ ID NO: 2354680 - RNA, 17 nt, Human
ugucaaagagagggcuu

SEQ ID NO: 2354681 - RNA, 12 nt, Human
ugucaaagcagg

SEQ ID NO: 2354682 - RNA, 15 nt, Human
ugucaaauaaacacu

SEQ ID NO: 2354683 - RNA, 17 nt, Human
ugucaaauaaacacugu

SEQ ID NO: 2354684 - RNA, 16 nt, Human
ugucaaaguggugaga

SEQ ID NO: 2354685 - RNA, 19 nt, Human
ugucaaaguggugagaggc

SEQ ID NO: 2354686 - RNA, 13 nt, Human
aguagcugggacu

SEQ ID NO: 2354687 - RNA, 14 nt, Human
aguagcugggacua

SEQ ID NO: 2354688 - RNA, 20 nt, Human
ugucaacuucuggcuccuca

SEQ ID NO: 2354689 - RNA, 15 nt, Human
ugucaacuucuggcu

SEQ ID NO: 2354690 - RNA, 18 nt, Human
ugucaacuucuggcuccu

SEQ ID NO: 2354691 - RNA, 15 nt, Human
ugucaacugaccuaa

SEQ ID NO: 2354692 - RNA, 15 nt, Human
ugucaacuucaacau

SEQ ID NO: 2354693 - RNA, 14 nt, Human
ugucaacuucuggc

SEQ ID NO: 2354694 - RNA, 21 nt, Human
uguauuaaguuguuaauaaaa

SEQ ID NO: 2354695 - RNA, 16 nt, Human
uguauuacuagaagau

SEQ ID NO: 2354696 - RNA, 19 nt, Human
uguauuacuagaagaugaa

SEQ ID NO: 2354697 - RNA, 14 nt, Human
uguauuaagccacu

SEQ ID NO: 2354698 - RNA, 18 nt, Human
uguauuaagagugaaaau

SEQ ID NO: 2354699 - RNA, 12 nt, Human
uguauuaagagu

SEQ ID NO: 2354700 - RNA, 16 nt, Human
uguauuaagagugaaa

SEQ ID NO: 2354701 - RNA, 17 nt, Human
uguauuaagagugaaaa

SEQ ID NO: 2354702 - RNA, 21 nt, Human
uguauuaggugucauuuccau

SEQ ID NO: 2354703 - RNA, 19 nt, Human
uguauuagauguucucuau

SEQ ID NO: 2354704 - RNA, 15 nt, Human
uguauuagucacaga

SEQ ID NO: 2354705 - RNA, 13 nt, Human
uguauuagauguu

SEQ ID NO: 2354706 - RNA, 14 nt, Human
uguauuagauguuc

SEQ ID NO: 2354707 - RNA, 16 nt, Human
uguauuagauguucuc

SEQ ID NO: 2354708 - RNA, 18 nt, Human
uguauuagauguucucua

SEQ ID NO: 2354709 - RNA, 23 nt, Human
uguauuacuagaagaugaauaca

SEQ ID NO: 2354710 - RNA, 11 nt, Human
uguauuaugug

SEQ ID NO: 2354711 - RNA, 18 nt, Human
ugucaaacuguagaaaug

SEQ ID NO: 2354712 - RNA, 12 nt, Human
ugucaaagaagg

SEQ ID NO: 2354713 - RNA, 14 nt, Human
ugucaaagaagguu

SEQ ID NO: 2354714 - RNA, 16 nt, Human
ugucaaacuguagaaa

SEQ ID NO: 2354715 - RNA, 14 nt, Human
ugucaaagugguga

SEQ ID NO: 2354716 - RNA, 15 nt, Human
ugucaaaguggugag

SEQ ID NO: 2354717 - RNA, 17 nt, Human
aguagcuggauuacagg

SEQ ID NO: 2354718 - RNA, 22 nt, Human
aguagcugggacuacaggcacc

SEQ ID NO: 2354719 - RNA, 19 nt, Human
aguagcugggacuacaggc

SEQ ID NO: 2354720 - RNA, 21 nt, Human
aguagcugggacuacaggcac

SEQ ID NO: 2354721 - RNA, 19 nt, Human
aguauguuaagcucuuuau

SEQ ID NO: 2354722 - RNA, 19 nt, Human
aguauguguuugugugugu

SEQ ID NO: 2354723 - RNA, 16 nt, Human
aguauguuaagcucuu

SEQ ID NO: 2354724 - RNA, 18 nt, Human
aguauguguuugugugug

SEQ ID NO: 2354725 - RNA, 21 nt, Human
aguauuagaauaccacaggaa

SEQ ID NO: 2354726 - RNA, 18 nt, Human
aguauguuagugcaaauu

SEQ ID NO: 2354727 - RNA, 21 nt, Human
aguauguuagugcaaauuguc

SEQ ID NO: 2354728 - RNA, 20 nt, Human
aguauuauaggccaaacugg

SEQ ID NO: 2354729 - RNA, 17 nt, Human
aguauugcaucuguaua

SEQ ID NO: 2354730 - RNA, 15 nt, Human
aguauuauaccuuuu

SEQ ID NO: 2354731 - RNA, 14 nt, Human
aguauguugucaaa

SEQ ID NO: 2354732 - RNA, 13 nt, Human
aguauuauaaauu

SEQ ID NO: 2354733 - RNA, 18 nt, Human
aguauuauaaauuauguu

SEQ ID NO: 2354734 - RNA, 19 nt, Human
aguauuauaaauuauguuu

SEQ ID NO: 2354735 - RNA, 20 nt, Human
aguauuauaaauuauguuua

SEQ ID NO: 2354736 - RNA, 14 nt, Human
aguauuauaccuuu

SEQ ID NO: 2354737 - RNA, 18 nt, Human
aguauuggggucugaccc

SEQ ID NO: 2354738 - RNA, 22 nt, Human
aguauugcaucuguauaaguaa

SEQ ID NO: 2354739 - RNA, 20 nt, Human
aguauugcaucuguauaagu

SEQ ID NO: 2354740 - RNA, 22 nt, Human
agucacagagauaauucuagcu

SEQ ID NO: 2354741 - RNA, 19 nt, Human
aguauuuaauuagugcuaa

SEQ ID NO: 2354742 - RNA, 21 nt, Human
aguauuuaauuagugcuaagu

SEQ ID NO: 2354743 - RNA, 21 nt, Human
aguauuuaauucauguugccu

SEQ ID NO: 2354744 - RNA, 11 nt, Human
aguauuuaauu

SEQ ID NO: 2354745 - RNA, 13 nt, Human
aguauuuaauuag

SEQ ID NO: 2354746 - RNA, 14 nt, Human
aguauuuaauuagu

SEQ ID NO: 2354747 - RNA, 15 nt, Human
aguauuuaauuagug

SEQ ID NO: 2354748 - RNA, 16 nt, Human
aguauuuaauuagugc

SEQ ID NO: 2354749 - RNA, 17 nt, Human
aguauuuaauuagugcu

SEQ ID NO: 2354750 - RNA, 15 nt, Human
aguauuguccagguc

SEQ ID NO: 2354751 - RNA, 16 nt, Human
aguauuguccaggucu

SEQ ID NO: 2354752 - RNA, 15 nt, Human
ugucagcauagaagu

SEQ ID NO: 2354753 - RNA, 17 nt, Human
agucacugagacagccc

SEQ ID NO: 2354754 - RNA, 15 nt, Human
agucacugagacagc

SEQ ID NO: 2354755 - RNA, 16 nt, Human
agucacugagacagcc

SEQ ID NO: 2354756 - RNA, 15 nt, Human
agucacaucacagga

SEQ ID NO: 2354757 - RNA, 14 nt, Human
agucacaucucuuc

SEQ ID NO: 2354758 - RNA, 16 nt, Human
agucacaucucuuccu

SEQ ID NO: 2354759 - RNA, 23 nt, Human
agucacauggccuaugcacauau

SEQ ID NO: 2354760 - RNA, 14 nt, Human
agucacaucacagg

SEQ ID NO: 2354761 - RNA, 13 nt, Human
agucacagccacc

SEQ ID NO: 2354762 - RNA, 20 nt, Human
agucacauuccaagccucau

SEQ ID NO: 2354763 - RNA, 18 nt, Human
ugaacaaaaaauaaaaau

SEQ ID NO: 2354764 - RNA, 15 nt, Human
ugaacaaagcagcca

SEQ ID NO: 2354765 - RNA, 14 nt, Human
ugaacaaagcagcc

SEQ ID NO: 2354766 - RNA, 18 nt, Human
ugaacaaauugaacucuu

SEQ ID NO: 2354767 - RNA, 17 nt, Human
ugaacaaagcagccacg

SEQ ID NO: 2354768 - RNA, 16 nt, Human
ugaacaaagcagccac

SEQ ID NO: 2354769 - RNA, 19 nt, Human
ugaaauuuuuauuaaauua

SEQ ID NO: 2354770 - RNA, 22 nt, Human
ugaaauuucagauucccagagc

SEQ ID NO: 2354771 - RNA, 20 nt, Human
ugaaauuuuuauuaaauuau

SEQ ID NO: 2354772 - RNA, 18 nt, Human
ugaaauagucugugugaa

SEQ ID NO: 2354773 - RNA, 17 nt, Human
ugaaauagucuguguga

SEQ ID NO: 2354774 - RNA, 16 nt, Human
ugaaauagucugugug

SEQ ID NO: 2354775 - RNA, 13 nt, Human
ugaaauagucugu

SEQ ID NO: 2354776 - RNA, 23 nt, Human
ugaaauagacccacaagaggcag

SEQ ID NO: 2354777 - RNA, 22 nt, Human
ugaaauuuaauauagcuauuuu

SEQ ID NO: 2354778 - RNA, 12 nt, Human
ugaaauuucaga

SEQ ID NO: 2354779 - RNA, 12 nt, Human
ugaaauuguaaa

SEQ ID NO: 2354780 - RNA, 16 nt, Human
ugaaauuuauacacca

SEQ ID NO: 2354781 - RNA, 23 nt, Human
ugaaauuuauacaccaauugauu

SEQ ID NO: 2354782 - RNA, 20 nt, Human
ugaaauuuauuaguuaauau

SEQ ID NO: 2354783 - RNA, 21 nt, Human
ugaaauuuauuaguuaauaua

SEQ ID NO: 2354784 - RNA, 22 nt, Human
ugaaauuuauuaguuaauauau

SEQ ID NO: 2354785 - RNA, 16 nt, Human
ugaaauaccagugugg

SEQ ID NO: 2354786 - RNA, 14 nt, Human
ugaaauaccagugu

SEQ ID NO: 2354787 - RNA, 23 nt, Human
ugaaauaccagugaaccaaagag

SEQ ID NO: 2354788 - RNA, 22 nt, Human
ugaaauaccagugaaccaaaga

SEQ ID NO: 2354789 - RNA, 13 nt, Human
ugaaauacuacuu

SEQ ID NO: 2354790 - RNA, 16 nt, Human
ugaaauacuguuugag

SEQ ID NO: 2354791 - RNA, 14 nt, Human
ugaaauacuguuug

SEQ ID NO: 2354792 - RNA, 21 nt, Human
ugaaauaaagaaauugcaaua

SEQ ID NO: 2354793 - RNA, 14 nt, Human
ugaaauaacuccuu

SEQ ID NO: 2354794 - RNA, 20 nt, Human
ugaaauaaagaaauugcaau

SEQ ID NO: 2354795 - RNA, 14 nt, Human
ugaaauaagccaga

SEQ ID NO: 2354796 - RNA, 17 nt, Human
ugaaauaacauggccuu

SEQ ID NO: 2354797 - RNA, 16 nt, Human
ugaaauaacauggccu

SEQ ID NO: 2354798 - RNA, 16 nt, Human
ugaaagaaaggacucu

SEQ ID NO: 2354799 - RNA, 14 nt, Human
agagauggaggagg

SEQ ID NO: 2354800 - RNA, 13 nt, Human
agagauggaggag

SEQ ID NO: 2354801 - RNA, 12 nt, Human
agagauggagga

SEQ ID NO: 2354802 - RNA, 19 nt, Human
agagauuaccuccugagaa

SEQ ID NO: 2354803 - RNA, 16 nt, Human
agagauuaccuccuga

SEQ ID NO: 2354804 - RNA, 12 nt, Human
agagauguuuuu

SEQ ID NO: 2354805 - RNA, 20 nt, Human
agagauguuuuuaaaaguuu

SEQ ID NO: 2354806 - RNA, 21 nt, Human
agagauguuuuuaaaaguuuc

SEQ ID NO: 2354807 - RNA, 16 nt, Human
agagauugugguuuca

SEQ ID NO: 2354808 - RNA, 20 nt, Human
agagauuaccuccugagaaa

SEQ ID NO: 2354809 - RNA, 22 nt, Human
ugaaauaaaacuggcuuuggcu

SEQ ID NO: 2354810 - RNA, 19 nt, Human
ugaaauaaaacuggcuuug

SEQ ID NO: 2354811 - RNA, 17 nt, Human
ugaaauaaaacuggcuu

SEQ ID NO: 2354812 - RNA, 21 nt, Human
agagauuggaaugggcagcuc

SEQ ID NO: 2354813 - RNA, 22 nt, Human
agagauguuuuuaaaaguuuca

SEQ ID NO: 2354814 - RNA, 20 nt, Human
agagauuggaaugggcagcu

SEQ ID NO: 2354815 - RNA, 22 nt, Human
agagauuggaaugggcagcuca

SEQ ID NO: 2354816 - RNA, 21 nt, Human
ugaaccaccacacccagccca

SEQ ID NO: 2354817 - RNA, 13 nt, Human
ugaacaaauuuac

SEQ ID NO: 2354818 - RNA, 22 nt, Human
ugaaccaccacacccagcccac

SEQ ID NO: 2354819 - RNA, 12 nt, Human
ugaacccaggag

SEQ ID NO: 2354820 - RNA, 22 nt, Human
ugaacccaggacgcuucugaau

SEQ ID NO: 2354821 - RNA, 21 nt, Human
ugaacccaggacgcuucugaa

SEQ ID NO: 2354822 - RNA, 20 nt, Human
ugaacccaggacgcuucuga

SEQ ID NO: 2354823 - RNA, 21 nt, Human
ugaaccaucauuauaaacgug

SEQ ID NO: 2354824 - RNA, 17 nt, Human
ugaaccauuaaagucga

SEQ ID NO: 2354825 - RNA, 23 nt, Human
ugaaccacuucccucaucucucc

SEQ ID NO: 2354826 - RNA, 21 nt, Human
ugaacaaauugaacucuuuga

SEQ ID NO: 2354827 - RNA, 14 nt, Human
ugaaccacuucccu

SEQ ID NO: 2354828 - RNA, 15 nt, Human
ugaaccacuucccuc

SEQ ID NO: 2354829 - RNA, 16 nt, Human
ugaaccacuucccuca

SEQ ID NO: 2354830 - RNA, 15 nt, Human
ugaacccuugcuugc

SEQ ID NO: 2354831 - RNA, 19 nt, Human
ugaacccugugcugguguc

SEQ ID NO: 2354832 - RNA, 20 nt, Human
ugaaccgaggggcucaggaa

SEQ ID NO: 2354833 - RNA, 13 nt, Human
ugaacccuugcuu

SEQ ID NO: 2354834 - RNA, 14 nt, Human
ugaacccugugcug

SEQ ID NO: 2354835 - RNA, 15 nt, Human
ugaacccugugcugg

SEQ ID NO: 2354836 - RNA, 19 nt, Human
ugaacccaggagguggagg

SEQ ID NO: 2354837 - RNA, 19 nt, Human
ugaacccauuuugagugac

SEQ ID NO: 2354838 - RNA, 14 nt, Human
ugaacccaggaggu

SEQ ID NO: 2354839 - RNA, 13 nt, Human
ugaacccaggagg

SEQ ID NO: 2354840 - RNA, 13 nt, Human
ugaacccugugcu

SEQ ID NO: 2354841 - RNA, 14 nt, Human
ugaacccccaugau

SEQ ID NO: 2354842 - RNA, 22 nt, Human
ugaacccgggacgcagggguug

SEQ ID NO: 2354843 - RNA, 18 nt, Human
ugaacccgggaggcagag

SEQ ID NO: 2354844 - RNA, 22 nt, Human
ugaacccauauuuguacaccaa

SEQ ID NO: 2354845 - RNA, 16 nt, Human
ugaacuaauaaaagca

SEQ ID NO: 2354846 - RNA, 23 nt, Human
ugaacuagaguuuagcuggaaaa

SEQ ID NO: 2354847 - RNA, 19 nt, Human
ugaacuaaacuuucacacc

SEQ ID NO: 2354848 - RNA, 17 nt, Human
ugaacuaaacuuucaca

SEQ ID NO: 2354849 - RNA, 15 nt, Human
ugaacggugagcauu

SEQ ID NO: 2354850 - RNA, 15 nt, Human
ugaacggggagaaaa

SEQ ID NO: 2354851 - RNA, 22 nt, Human
ugaaccgaggggcucaggaaaa

SEQ ID NO: 2354852 - RNA, 13 nt, Human
ugaacggggagaa

SEQ ID NO: 2354853 - RNA, 16 nt, Human
ugaacggggagaaaag

SEQ ID NO: 2354854 - RNA, 20 nt, Human
ugaagaacaguaacugccau

SEQ ID NO: 2354855 - RNA, 15 nt, Human
ugaagaacaguaacu

SEQ ID NO: 2354856 - RNA, 14 nt, Human
ugaagaacauguga

SEQ ID NO: 2354857 - RNA, 13 nt, Human
ugaagaacaugug

SEQ ID NO: 2354858 - RNA, 20 nt, Human
ugaagaaccaguccccccac

SEQ ID NO: 2354859 - RNA, 19 nt, Human
ugaagaaccagucccccca

SEQ ID NO: 2354860 - RNA, 19 nt, Human
ugaagaacugaggaggaaa

SEQ ID NO: 2354861 - RNA, 13 nt, Human
ugaagaacugagg

SEQ ID NO: 2354862 - RNA, 14 nt, Human
ugaagaacugcagg

SEQ ID NO: 2354863 - RNA, 15 nt, Human
ugaagaacugcaggc

SEQ ID NO: 2354864 - RNA, 16 nt, Human
ugaagaacugcaggcc

SEQ ID NO: 2354865 - RNA, 17 nt, Human
ugaagaacugcaggccc

SEQ ID NO: 2354866 - RNA, 20 nt, Human
ugaagaacugcaggcccugg

SEQ ID NO: 2354867 - RNA, 11 nt, Human
ugaacuccugg

SEQ ID NO: 2354868 - RNA, 13 nt, Human
ugaagaacaguaa

SEQ ID NO: 2354869 - RNA, 22 nt, Human
ugaacucagccaagcacagugg

SEQ ID NO: 2354870 - RNA, 23 nt, Human
ugaacucagccaagcacaguggu

SEQ ID NO: 2354871 - RNA, 15 nt, Human
ugaacuccugaccuc

SEQ ID NO: 2354872 - RNA, 20 nt, Human
ugaacucacuuuccuccuga

SEQ ID NO: 2354873 - RNA, 20 nt, Human
ugaacuaccuugguuccccc

SEQ ID NO: 2354874 - RNA, 21 nt, Human
ugaacuacgcuugcucauuuu

SEQ ID NO: 2354875 - RNA, 18 nt, Human
ugaacucagaucugucug

SEQ ID NO: 2354876 - RNA, 22 nt, Human
ugaacucagaucugucugauag

SEQ ID NO: 2354877 - RNA, 13 nt, Human
ugaacucagccaa

SEQ ID NO: 2354878 - RNA, 14 nt, Human
ugaacucagccaag

SEQ ID NO: 2354879 - RNA, 15 nt, Human
ugaacucagccaagc

SEQ ID NO: 2354880 - RNA, 16 nt, Human
ugaacucagccaagca

SEQ ID NO: 2354881 - RNA, 17 nt, Human
ugaacucagccaagcac

SEQ ID NO: 2354882 - RNA, 18 nt, Human
ugaacucagccaagcaca

SEQ ID NO: 2354883 - RNA, 19 nt, Human
ugaacucagccaagcacag

SEQ ID NO: 2354884 - RNA, 20 nt, Human
ugaacucagccaagcacagu

SEQ ID NO: 2354885 - RNA, 21 nt, Human
ugaacucagccaagcacagug

SEQ ID NO: 2354886 - RNA, 21 nt, Human
ugaagaaucuguuucccagca

SEQ ID NO: 2354887 - RNA, 22 nt, Human
ugaagaagcuaaauccuuuacu

SEQ ID NO: 2354888 - RNA, 18 nt, Human
ugaagaacugcaggcccu

SEQ ID NO: 2354889 - RNA, 13 nt, Human
ugaagacagagcu

SEQ ID NO: 2354890 - RNA, 23 nt, Human
ugaagacaaugacuuacuguaca

SEQ ID NO: 2354891 - RNA, 22 nt, Human
ugaagacaaugacuuacuguac

SEQ ID NO: 2354892 - RNA, 23 nt, Human
ugaaguacccguucacauuuuug

SEQ ID NO: 2354893 - RNA, 20 nt, Human
ugaaguacauauuaggaaaa

SEQ ID NO: 2354894 - RNA, 13 nt, Human
ugaaguacauauu

SEQ ID NO: 2354895 - RNA, 18 nt, Human
ugaaguacccguucacau

SEQ ID NO: 2354896 - RNA, 15 nt, Human
ugaaguauacuguau

SEQ ID NO: 2354897 - RNA, 14 nt, Human
ugaaguaguuugua

SEQ ID NO: 2354898 - RNA, 15 nt, Human
ugaaguaguuuguau

SEQ ID NO: 2354899 - RNA, 22 nt, Human
ugaaguauauaaugguuucaaa

SEQ ID NO: 2354900 - RNA, 16 nt, Human
ugaaguauauaauggu

SEQ ID NO: 2354901 - RNA, 17 nt, Human
ugaaguauuucucacuc

SEQ ID NO: 2354902 - RNA, 20 nt, Human
ugaaguaaugaauuuuuaug

SEQ ID NO: 2354903 - RNA, 14 nt, Human
ugaaguaaugaauu

SEQ ID NO: 2354904 - RNA, 15 nt, Human
ugaaguaagcaaaga

SEQ ID NO: 2354905 - RNA, 17 nt, Human
ugaaguacucauacaug

SEQ ID NO: 2354906 - RNA, 12 nt, Human
ugaauaauacag

SEQ ID NO: 2354907 - RNA, 15 nt, Human
ugaauaaccacuuaa

SEQ ID NO: 2354908 - RNA, 21 nt, Human
ugaauaaauucuauaggaaca

SEQ ID NO: 2354909 - RNA, 19 nt, Human
ugaauaaauucuauaggaa

SEQ ID NO: 2354910 - RNA, 15 nt, Human
ugaauaaaugucuug

SEQ ID NO: 2354911 - RNA, 20 nt, Human
ugaaguauuuugcuggaaua

SEQ ID NO: 2354912 - RNA, 13 nt, Human
ugaagucacacag

SEQ ID NO: 2354913 - RNA, 13 nt, Human
ugaaucaaagaca

SEQ ID NO: 2354914 - RNA, 20 nt, Human
ugaauauuuauauuucacua

SEQ ID NO: 2354915 - RNA, 19 nt, Human
ugaauacagggcaugcauu

SEQ ID NO: 2354916 - RNA, 19 nt, Human
ugaauauuuauauuucacu

SEQ ID NO: 2354917 - RNA, 21 nt, Human
ugaauauuuccauauggauuu

SEQ ID NO: 2354918 - RNA, 21 nt, Human
ugaauauuuguuauguagaua

SEQ ID NO: 2354919 - RNA, 18 nt, Human
ugaauauuuaguguucau

SEQ ID NO: 2354920 - RNA, 22 nt, Human
ugaauacaaacaauggaaacug

SEQ ID NO: 2354921 - RNA, 23 nt, Human
ugaauacaaacaauggaaacuga

SEQ ID NO: 2354922 - RNA, 15 nt, Human
ugaauacaaacaaug

SEQ ID NO: 2354923 - RNA, 16 nt, Human
ugaauacaaacaaugg

SEQ ID NO: 2354924 - RNA, 17 nt, Human
ugaauacaaacaaugga

SEQ ID NO: 2354925 - RNA, 20 nt, Human
ugaauacaaacaauggaaac

SEQ ID NO: 2354926 - RNA, 15 nt, Human
ugaauacaaagugau

SEQ ID NO: 2354927 - RNA, 13 nt, Human
ugaauaauacagu

SEQ ID NO: 2354928 - RNA, 18 nt, Human
ugaauaaugguaccagau

SEQ ID NO: 2354929 - RNA, 22 nt, Human
ugaauaagccauucugacucau

SEQ ID NO: 2354930 - RNA, 17 nt, Human
ugaauaagccauucuga

SEQ ID NO: 2354931 - RNA, 22 nt, Human
ugaauaauuucccaauuaggaa

SEQ ID NO: 2354932 - RNA, 13 nt, Human
ugaauaauuucuu

SEQ ID NO: 2354933 - RNA, 15 nt, Human
ugaauaauuucccaa

SEQ ID NO: 2354934 - RNA, 14 nt, Human
ugaauaauuuccca

SEQ ID NO: 2354935 - RNA, 20 nt, Human
ugaauaaugguaccagauaa

SEQ ID NO: 2354936 - RNA, 23 nt, Human
ugaauaauguaagacaaauaugu

SEQ ID NO: 2354937 - RNA, 13 nt, Human
ugaagcaaacaca

SEQ ID NO: 2354938 - RNA, 15 nt, Human
ugaagcaaacacauu

SEQ ID NO: 2354939 - RNA, 14 nt, Human
ugaagcaaacacau

SEQ ID NO: 2354940 - RNA, 22 nt, Human
ugaagggaaaggauauuuucuu

SEQ ID NO: 2354941 - RNA, 21 nt, Human
ugaagggaaaggauauuuucu

SEQ ID NO: 2354942 - RNA, 18 nt, Human
ugaagggaaaggauauuu

SEQ ID NO: 2354943 - RNA, 14 nt, Human
ugaagggagagcca

SEQ ID NO: 2354944 - RNA, 20 nt, Human
ugaagggaccuugaagggua

SEQ ID NO: 2354945 - RNA, 17 nt, Human
ugaagauuuaccacuug

SEQ ID NO: 2354946 - RNA, 20 nt, Human
ugaagauuuaccacuugugu

SEQ ID NO: 2354947 - RNA, 18 nt, Human
ugaagguuucugaaaauu

SEQ ID NO: 2354948 - RNA, 17 nt, Human
ugaagggccagagccag

SEQ ID NO: 2354949 - RNA, 16 nt, Human
ugaagggccagagcca

SEQ ID NO: 2354950 - RNA, 15 nt, Human
ugaagggccagagcc

SEQ ID NO: 2354951 - RNA, 24 nt, Human
ugaagggauuuuagucacacgugg

SEQ ID NO: 2354952 - RNA, 16 nt, Human
ugaagggaggugggga

SEQ ID NO: 2354953 - RNA, 21 nt, Human
ugaagggagguggggaugaga

SEQ ID NO: 2354954 - RNA, 19 nt, Human
ugaagggagagccagcucc

SEQ ID NO: 2354955 - RNA, 11 nt, Human
ugaagggaggu

SEQ ID NO: 2354956 - RNA, 17 nt, Human
ugaagggagagccagcu

SEQ ID NO: 2354957 - RNA, 16 nt, Human
ugaagggagagccagc

SEQ ID NO: 2354958 - RNA, 14 nt, Human
ugaagggccagagc

SEQ ID NO: 2354959 - RNA, 12 nt, Human
ugaagggccaga

SEQ ID NO: 2354960 - RNA, 19 nt, Human
ugaagggcaggugcuucag

SEQ ID NO: 2354961 - RNA, 15 nt, Human
ugaagggcaggugcu

SEQ ID NO: 2354962 - RNA, 13 nt, Human
ugaaguaagcaaa

SEQ ID NO: 2354963 - RNA, 14 nt, Human
ugaaguaagcaaag

SEQ ID NO: 2354964 - RNA, 15 nt, Human
ugaaguaauaugcac

SEQ ID NO: 2354965 - RNA, 22 nt, Human
ugaaguaauaugcacacauuuu

SEQ ID NO: 2354966 - RNA, 21 nt, Human
ugaaguaauaugcacacauuu

SEQ ID NO: 2354967 - RNA, 20 nt, Human
ugaaguaauaugcacacauu

SEQ ID NO: 2354968 - RNA, 16 nt, Human
ugaaguaauaugcaca

SEQ ID NO: 2354969 - RNA, 13 nt, Human
agaggccaaugcc

SEQ ID NO: 2354970 - RNA, 13 nt, Human
agaggccagaggc

SEQ ID NO: 2354971 - RNA, 21 nt, Human
agaggccagccccacccagga

SEQ ID NO: 2354972 - RNA, 18 nt, Human
agaggccagccccaccca

SEQ ID NO: 2354973 - RNA, 17 nt, Human
agaggccagccccaccc

SEQ ID NO: 2354974 - RNA, 16 nt, Human
agaggccagccccacc

SEQ ID NO: 2354975 - RNA, 15 nt, Human
agaggccagccuggc

SEQ ID NO: 2354976 - RNA, 21 nt, Human
agaggcccucuggaguggcca

SEQ ID NO: 2354977 - RNA, 23 nt, Human
agaggccagccccacccaggagg

SEQ ID NO: 2354978 - RNA, 14 nt, Human
agaggccagccugg

SEQ ID NO: 2354979 - RNA, 23 nt, Human
agaggcccucuggaguggccacu

SEQ ID NO: 2354980 - RNA, 22 nt, Human
agaggcccucuggaguggccac

SEQ ID NO: 2354981 - RNA, 24 nt, Human
agaggcccucuggaguggccacua

SEQ ID NO: 2354982 - RNA, 13 nt, Human
agaggccugagga

SEQ ID NO: 2354983 - RNA, 20 nt, Human
agaggccugccuccagggcu

SEQ ID NO: 2354984 - RNA, 22 nt, Human
agaggccugaggaugagcugga

SEQ ID NO: 2354985 - RNA, 12 nt, Human
agaggccugccc

SEQ ID NO: 2354986 - RNA, 21 nt, Human
agaggccugccuccagggcug

SEQ ID NO: 2354987 - RNA, 22 nt, Human
agaggccugccuccagggcugg

SEQ ID NO: 2354988 - RNA, 13 nt, Human
agaggccugcccg

SEQ ID NO: 2354989 - RNA, 21 nt, Human
agaggcagccccauucugccu

SEQ ID NO: 2354990 - RNA, 22 nt, Human
agaggcagccccauucugccug

SEQ ID NO: 2354991 - RNA, 21 nt, Human
agaggcagggucucacucugu

SEQ ID NO: 2354992 - RNA, 23 nt, Human
agaggcagccccauucugccugc

SEQ ID NO: 2354993 - RNA, 15 nt, Human
agagcuggugucuga

SEQ ID NO: 2354994 - RNA, 11 nt, Human
agagcuggugu

SEQ ID NO: 2354995 - RNA, 22 nt, Human
agagcugguugggaagacaugg

SEQ ID NO: 2354996 - RNA, 16 nt, Human
agagcugguugggaag

SEQ ID NO: 2354997 - RNA, 17 nt, Human
agagcuggugucugauu

SEQ ID NO: 2354998 - RNA, 19 nt, Human
agagcuguauuaagccacu

SEQ ID NO: 2354999 - RNA, 17 nt, Human
agagcuguauuaagcca

SEQ ID NO: 2355000 - RNA, 16 nt, Human
agagcuguggagaggg

SEQ ID NO: 2355001 - RNA, 19 nt, Human
agagcuguucacagccaga

SEQ ID NO: 2355002 - RNA, 18 nt, Human
agagcuguucacagccag

SEQ ID NO: 2355003 - RNA, 22 nt, Human
agaggcugccucucccaucacu

SEQ ID NO: 2355004 - RNA, 16 nt, Human
agaggcugcagccagg

SEQ ID NO: 2355005 - RNA, 21 nt, Human
agaggcugcagaaggccaaga

SEQ ID NO: 2355006 - RNA, 22 nt, Human
agaggcugcagaaggccaagaa

SEQ ID NO: 2355007 - RNA, 21 nt, Human
agaggcugaggcuggcacagg

SEQ ID NO: 2355008 - RNA, 13 nt, Human
agaggcugcagaa

SEQ ID NO: 2355009 - RNA, 19 nt, Human
agaggcugaggcuggcaca

SEQ ID NO: 2355010 - RNA, 16 nt, Human
agaggcugaggcuggc

SEQ ID NO: 2355011 - RNA, 20 nt, Human
agagggagugacagaggcag

SEQ ID NO: 2355012 - RNA, 13 nt, Human
agagguucaaaga

SEQ ID NO: 2355013 - RNA, 16 nt, Human
agaggcuggaggcagg

SEQ ID NO: 2355014 - RNA, 15 nt, Human
agagggagguaagga

SEQ ID NO: 2355015 - RNA, 15 nt, Human
agagggagugacaga

SEQ ID NO: 2355016 - RNA, 23 nt, Human
agagggaugaggugcugggaggg

SEQ ID NO: 2355017 - RNA, 22 nt, Human
agagggaugaggugcugggagg

SEQ ID NO: 2355018 - RNA, 16 nt, Human
agagguuuuguuguuu

SEQ ID NO: 2355019 - RNA, 19 nt, Human
agagguuuuguuguuuuau

SEQ ID NO: 2355020 - RNA, 20 nt, Human
agagggaggucacuggaaag

SEQ ID NO: 2355021 - RNA, 22 nt, Human
agagggaggucacuggaaaggg

SEQ ID NO: 2355022 - RNA, 14 nt, Human
agagggagguguuu

SEQ ID NO: 2355023 - RNA, 23 nt, Human
agagggauaagguaccuuucaca

SEQ ID NO: 2355024 - RNA, 20 nt, Human
agagguucaaagauauuuug

SEQ ID NO: 2355025 - RNA, 19 nt, Human
agagguucaaagauauuuu

SEQ ID NO: 2355026 - RNA, 16 nt, Human
agagguucaaagauau

SEQ ID NO: 2355027 - RNA, 15 nt, Human
agaguaaaaacugaa

SEQ ID NO: 2355028 - RNA, 18 nt, Human
agaguaaaggaaaugauu

SEQ ID NO: 2355029 - RNA, 22 nt, Human
agagguuuuucuuaaauaauaa

SEQ ID NO: 2355030 - RNA, 12 nt, Human
agagguuuuucu

SEQ ID NO: 2355031 - RNA, 18 nt, Human
agaguaauccaagcaaau

SEQ ID NO: 2355032 - RNA, 21 nt, Human
ugaagauucuuucccaauuca

SEQ ID NO: 2355033 - RNA, 20 nt, Human
agaguaauccaagcaaaugu

SEQ ID NO: 2355034 - RNA, 23 nt, Human
agacuccuccuccaaaggccccc

SEQ ID NO: 2355035 - RNA, 15 nt, Human
agacuccugaggaca

SEQ ID NO: 2355036 - RNA, 20 nt, Human
agacuccugaggacagcugu

SEQ ID NO: 2355037 - RNA, 22 nt, Human
agacuccugaggacagcugucc

SEQ ID NO: 2355038 - RNA, 13 nt, Human
agacuccugcagg

SEQ ID NO: 2355039 - RNA, 21 nt, Human
agacucuaggacauaaauuag

SEQ ID NO: 2355040 - RNA, 19 nt, Human
agacucuacccauauuaca

SEQ ID NO: 2355041 - RNA, 13 nt, Human
agacucuaccaga

SEQ ID NO: 2355042 - RNA, 21 nt, Human
agacucuaccagacuguguau

SEQ ID NO: 2355043 - RNA, 14 nt, Human
agacuccuccucca

SEQ ID NO: 2355044 - RNA, 14 nt, Human
agacuccuaggcag

SEQ ID NO: 2355045 - RNA, 22 nt, Human
agacuccuaggcaggacaugcu

SEQ ID NO: 2355046 - RNA, 18 nt, Human
agacuccgucucaaggaa

SEQ ID NO: 2355047 - RNA, 11 nt, Human
agacuccuagg

SEQ ID NO: 2355048 - RNA, 23 nt, Human
agacucccauuccugaagaacca

SEQ ID NO: 2355049 - RNA, 19 nt, Human
agacucccauuccugaaga

SEQ ID NO: 2355050 - RNA, 17 nt, Human
agacucccauuccugaa

SEQ ID NO: 2355051 - RNA, 16 nt, Human
agacucccaagcugga

SEQ ID NO: 2355052 - RNA, 21 nt, Human
agacuccagcuggguuggaaa

SEQ ID NO: 2355053 - RNA, 12 nt, Human
ucuuucucuccu

SEQ ID NO: 2355054 - RNA, 19 nt, Human
agacucuggucuucuuugg

SEQ ID NO: 2355055 - RNA, 20 nt, Human
agacucugaaaucucagaau

SEQ ID NO: 2355056 - RNA, 14 nt, Human
agacucuggucuuc

SEQ ID NO: 2355057 - RNA, 16 nt, Human
agacucugaaaucuca

SEQ ID NO: 2355058 - RNA, 14 nt, Human
agacucucuuagga

SEQ ID NO: 2355059 - RNA, 21 nt, Human
agacuggcacaguuuucugag

SEQ ID NO: 2355060 - RNA, 20 nt, Human
agacuggcacaguuuucuga

SEQ ID NO: 2355061 - RNA, 23 nt, Human
agacuggcacaguuuucugagaa

SEQ ID NO: 2355062 - RNA, 23 nt, Human
agacugggaagauaggcucugca

SEQ ID NO: 2355063 - RNA, 22 nt, Human
agacugggaagauaggcucugc

SEQ ID NO: 2355064 - RNA, 21 nt, Human
agacugggaagauaggcucug

SEQ ID NO: 2355065 - RNA, 22 nt, Human
agacuggcuuuuauuaaugcac

SEQ ID NO: 2355066 - RNA, 23 nt, Human
agacuggcuuuuauuaaugcacu

SEQ ID NO: 2355067 - RNA, 20 nt, Human
agacuggcuggcugcaguga

SEQ ID NO: 2355068 - RNA, 14 nt, Human
agacuggcuggcug

SEQ ID NO: 2355069 - RNA, 11 nt, Human
agacuggcuuu

SEQ ID NO: 2355070 - RNA, 18 nt, Human
agacuggcuuuuauuaau

SEQ ID NO: 2355071 - RNA, 20 nt, Human
ucuuucccugcuuaaugaaa

SEQ ID NO: 2355072 - RNA, 23 nt, Human
agacaggagggcaagggccaugc

SEQ ID NO: 2355073 - RNA, 11 nt, Human
ucuuuaaugcu

SEQ ID NO: 2355074 - RNA, 16 nt, Human
ucuuuaaugcuuuuau

SEQ ID NO: 2355075 - RNA, 13 nt, Human
ucuuuaaugcuuu

SEQ ID NO: 2355076 - RNA, 18 nt, Human
ucuuuaaugucacaggca

SEQ ID NO: 2355077 - RNA, 19 nt, Human
ucuuuaaugucacaggcag

SEQ ID NO: 2355078 - RNA, 20 nt, Human
agacaggcaagcaccuccug

SEQ ID NO: 2355079 - RNA, 14 nt, Human
agacaggagaaaug

SEQ ID NO: 2355080 - RNA, 16 nt, Human
agacaggaccuaggau

SEQ ID NO: 2355081 - RNA, 18 nt, Human
agacaggaccugacuauu

SEQ ID NO: 2355082 - RNA, 22 nt, Human
agacaggcaagcaccuccugcc

SEQ ID NO: 2355083 - RNA, 14 nt, Human
agacaggagggcaa

SEQ ID NO: 2355084 - RNA, 19 nt, Human
agacaggagggcaagggcc

SEQ ID NO: 2355085 - RNA, 15 nt, Human
ucuuuaaugucacag

SEQ ID NO: 2355086 - RNA, 24 nt, Human
ucuuucuccuuagucuucucauag

SEQ ID NO: 2355087 - RNA, 15 nt, Human
ucuuucucuccuuuc

SEQ ID NO: 2355088 - RNA, 16 nt, Human
ucuuucucuacuuuga

SEQ ID NO: 2355089 - RNA, 21 nt, Human
ucuuucuccuuagucuucuca

SEQ ID NO: 2355090 - RNA, 18 nt, Human
ucuuucuccuuagucuuc

SEQ ID NO: 2355091 - RNA, 19 nt, Human
ucuuucuaguucagcugcc

SEQ ID NO: 2355092 - RNA, 15 nt, Human
ucuuucuauuccaaa

SEQ ID NO: 2355093 - RNA, 16 nt, Human
agacuccaccaagccu

SEQ ID NO: 2355094 - RNA, 12 nt, Human
agacuccaccaa

SEQ ID NO: 2355095 - RNA, 22 nt, Human
agacuccaaagaaauguaaggg

SEQ ID NO: 2355096 - RNA, 19 nt, Human
ucuuucuaaugugugaauc

SEQ ID NO: 2355097 - RNA, 20 nt, Human
ucuuuccucuuccccuugcc

SEQ ID NO: 2355098 - RNA, 22 nt, Human
ucuuuccucuuccccuugcccu

SEQ ID NO: 2355099 - RNA, 23 nt, Human
ucuuuccucuuccccuugcccuu

SEQ ID NO: 2355100 - RNA, 14 nt, Human
ucuuucuacaguau

SEQ ID NO: 2355101 - RNA, 16 nt, Human
ucuuucuacucugaac

SEQ ID NO: 2355102 - RNA, 19 nt, Human
ucuuucuacucugaacuaa

SEQ ID NO: 2355103 - RNA, 15 nt, Human
ucuuucuaguggucu

SEQ ID NO: 2355104 - RNA, 16 nt, Human
ucuuucuaguggucuu

SEQ ID NO: 2355105 - RNA, 17 nt, Human
ucuuucuaguggucuuu

SEQ ID NO: 2355106 - RNA, 20 nt, Human
ucuuucuaguggucuuugua

SEQ ID NO: 2355107 - RNA, 21 nt, Human
ucuuucuaguggucuuuguaa

SEQ ID NO: 2355108 - RNA, 22 nt, Human
ucuuucuaguggucuuuguaag

SEQ ID NO: 2355109 - RNA, 22 nt, Human
ucuuucuaguucagcugcccca

SEQ ID NO: 2355110 - RNA, 12 nt, Human
ucuuuccugagg

SEQ ID NO: 2355111 - RNA, 14 nt, Human
ucuuuccuccuucc

SEQ ID NO: 2355112 - RNA, 22 nt, Human
ucuuuccuagauggcagucacu

SEQ ID NO: 2355113 - RNA, 15 nt, Human
ucuuuccuccuucca

SEQ ID NO: 2355114 - RNA, 11 nt, Human
ucuuuccucuu

SEQ ID NO: 2355115 - RNA, 17 nt, Human
ucuuuccuaaggcugca

SEQ ID NO: 2355116 - RNA, 19 nt, Human
ucuuuccuagauggcaguc

SEQ ID NO: 2355117 - RNA, 23 nt, Human
ucuuuccuaaggcugcaagguuu

SEQ ID NO: 2355118 - RNA, 12 nt, Human
ucuuuccuccuu

SEQ ID NO: 2355119 - RNA, 14 nt, Human
ucuuuuuucacaaa

SEQ ID NO: 2355120 - RNA, 23 nt, Human
ucuuuuuucauggacacuuugaa

SEQ ID NO: 2355121 - RNA, 21 nt, Human
ucuuuuuucuaaaguaaaaac

SEQ ID NO: 2355122 - RNA, 22 nt, Human
ucuuuuuucuaaaguaaaaaca

SEQ ID NO: 2355123 - RNA, 16 nt, Human
ucuuugugcuuuggcu

SEQ ID NO: 2355124 - RNA, 23 nt, Human
ucuuuguggccaaggagcugcua

SEQ ID NO: 2355125 - RNA, 22 nt, Human
ucuuuguggccaaggagcugcu

SEQ ID NO: 2355126 - RNA, 14 nt, Human
ucuuuguggccaag

SEQ ID NO: 2355127 - RNA, 13 nt, Human
ucuuuguggccaa

SEQ ID NO: 2355128 - RNA, 14 nt, Human
ucuuuguggcuucc

SEQ ID NO: 2355129 - RNA, 20 nt, Human
ucuuugucuaaaacaauaaa

SEQ ID NO: 2355130 - RNA, 19 nt, Human
ucuuugucuaaaacaauaa

SEQ ID NO: 2355131 - RNA, 15 nt, Human
ucuuugucuaaaaca

SEQ ID NO: 2355132 - RNA, 23 nt, Human
ucuuuguaaugucaccaccuucc

SEQ ID NO: 2355133 - RNA, 13 nt, Human
ucuuugucuaaaa

SEQ ID NO: 2355134 - RNA, 20 nt, Human
agagacaccugcaccucccc

SEQ ID NO: 2355135 - RNA, 19 nt, Human
agagacaccugcaccuccc

SEQ ID NO: 2355136 - RNA, 18 nt, Human
agagacaccugcaccucc

SEQ ID NO: 2355137 - RNA, 16 nt, Human
agagacaccugcaccu

SEQ ID NO: 2355138 - RNA, 15 nt, Human
agagacaccugcacc

SEQ ID NO: 2355139 - RNA, 14 nt, Human
agagacaccugcac

SEQ ID NO: 2355140 - RNA, 13 nt, Human
agagacaccugca

SEQ ID NO: 2355141 - RNA, 16 nt, Human
agagacacacugaaga

SEQ ID NO: 2355142 - RNA, 15 nt, Human
agagacagaaagcag

SEQ ID NO: 2355143 - RNA, 14 nt, Human
agagacagaaagca

SEQ ID NO: 2355144 - RNA, 22 nt, Human
agagacaccugcaccucccccc

SEQ ID NO: 2355145 - RNA, 21 nt, Human
agagacaccugcaccuccccc

SEQ ID NO: 2355146 - RNA, 16 nt, Human
ucuuuguaaugaaaac

SEQ ID NO: 2355147 - RNA, 14 nt, Human
ucuuuguacagaca

SEQ ID NO: 2355148 - RNA, 15 nt, Human
ucuuuguacagacaa

SEQ ID NO: 2355149 - RNA, 20 nt, Human
ucuuuguacagacaacaaac

SEQ ID NO: 2355150 - RNA, 23 nt, Human
agacuggugagcagacugguggg

SEQ ID NO: 2355151 - RNA, 14 nt, Human
agacuguaaugaau

SEQ ID NO: 2355152 - RNA, 18 nt, Human
agacuggugagcagacug

SEQ ID NO: 2355153 - RNA, 18 nt, Human
agacuggggggcuugaaa

SEQ ID NO: 2355154 - RNA, 22 nt, Human
agacugguuuauccacccacaa

SEQ ID NO: 2355155 - RNA, 15 nt, Human
agacuuuggaaagac

SEQ ID NO: 2355156 - RNA, 17 nt, Human
agacuuuggaaagacuu

SEQ ID NO: 2355157 - RNA, 15 nt, Human
agacuuuggaaagag

SEQ ID NO: 2355158 - RNA, 20 nt, Human
agacugguuccauggccucu

SEQ ID NO: 2355159 - RNA, 14 nt, Human
agacugggcugagg

SEQ ID NO: 2355160 - RNA, 12 nt, Human
agacugggcuga

SEQ ID NO: 2355161 - RNA, 16 nt, Human
agacugggcugaggga

SEQ ID NO: 2355162 - RNA, 15 nt, Human
agacugggcugaggg

SEQ ID NO: 2355163 - RNA, 20 nt, Human
agacugggcugagggagccu

SEQ ID NO: 2355164 - RNA, 15 nt, Human
agacuuuuaugauac

SEQ ID NO: 2355165 - RNA, 15 nt, Human
agacuuuuccaaccc

SEQ ID NO: 2355166 - RNA, 12 nt, Human
agacuuuuauga

SEQ ID NO: 2355167 - RNA, 19 nt, Human
agacuuuggaaagaguagg

SEQ ID NO: 2355168 - RNA, 18 nt, Human
agacuuuuaaucagacaa

SEQ ID NO: 2355169 - RNA, 16 nt, Human
agacuguaaugaaucu

SEQ ID NO: 2355170 - RNA, 15 nt, Human
agagacacaagccuu

SEQ ID NO: 2355171 - RNA, 16 nt, Human
agagacacaagccuuc

SEQ ID NO: 2355172 - RNA, 19 nt, Human
agagacacaagccuucggc

SEQ ID NO: 2355173 - RNA, 18 nt, Human
ugaaaauuaacacugcuu

SEQ ID NO: 2355174 - RNA, 19 nt, Human
ugaaacugcuuguuuccua

SEQ ID NO: 2355175 - RNA, 18 nt, Human
ugaaacugcuuguuuccu

SEQ ID NO: 2355176 - RNA, 14 nt, Human
ugaaaauuaacaug

SEQ ID NO: 2355177 - RNA, 14 nt, Human
ugaaaauuaacacu

SEQ ID NO: 2355178 - RNA, 13 nt, Human
ugaaaauguuuuu

SEQ ID NO: 2355179 - RNA, 15 nt, Human
ugaaaauuaacacug

SEQ ID NO: 2355180 - RNA, 16 nt, Human
ugaaaauuaacacugc

SEQ ID NO: 2355181 - RNA, 13 nt, Human
ugaaaaugugaau

SEQ ID NO: 2355182 - RNA, 22 nt, Human
ugaaaaugugcuauacugcaua

SEQ ID NO: 2355183 - RNA, 21 nt, Human
ugaaaaugugcuauacugcau

SEQ ID NO: 2355184 - RNA, 20 nt, Human
ugaaaaugugcuauacugca

SEQ ID NO: 2355185 - RNA, 13 nt, Human
ugaaagaaaauaa

SEQ ID NO: 2355186 - RNA, 18 nt, Human
ugaaacuggauuaaacuu

SEQ ID NO: 2355187 - RNA, 17 nt, Human
ugaaacuggauuaaacu

SEQ ID NO: 2355188 - RNA, 23 nt, Human
ugaaaaugcaacaacauguauaa

SEQ ID NO: 2355189 - RNA, 20 nt, Human
ugaaaaugcaacaacaugua

SEQ ID NO: 2355190 - RNA, 21 nt, Human
ugaaaaugcaacaacauguau

SEQ ID NO: 2355191 - RNA, 18 nt, Human
ugaaaaugcaacaacaug

SEQ ID NO: 2355192 - RNA, 12 nt, Human
ugaaaaucaaau

SEQ ID NO: 2355193 - RNA, 19 nt, Human
ugaaaauguaagcuguuua

SEQ ID NO: 2355194 - RNA, 16 nt, Human
ugaaaaugucuugugu

SEQ ID NO: 2355195 - RNA, 19 nt, Human
ugaaaaugugcuauacugc

SEQ ID NO: 2355196 - RNA, 17 nt, Human
ugaaaaugugcuauacu

SEQ ID NO: 2355197 - RNA, 21 nt, Human
ugaaaauggguuggugcuucu

SEQ ID NO: 2355198 - RNA, 15 nt, Human
ugaaaaugguauuuu

SEQ ID NO: 2355199 - RNA, 16 nt, Human
ugaaaaugguauuuuc

SEQ ID NO: 2355200 - RNA, 21 nt, Human
ugaaaaugguauuuucccccu

SEQ ID NO: 2355201 - RNA, 18 nt, Human
ugaaaauguaagcuguuu

SEQ ID NO: 2355202 - RNA, 23 nt, Human
ugaaaauacaacuuaaauaauaa

SEQ ID NO: 2355203 - RNA, 13 nt, Human
ugaaaauaauugu

SEQ ID NO: 2355204 - RNA, 18 nt, Human
ugaaaauacuuaggaagg

SEQ ID NO: 2355205 - RNA, 18 nt, Human
ugaaaauagguauacagu

SEQ ID NO: 2355206 - RNA, 21 nt, Human
ugaaaauauuuuuuauauaua

SEQ ID NO: 2355207 - RNA, 23 nt, Human
ugaaaauauuuuuuauauauaca

SEQ ID NO: 2355208 - RNA, 22 nt, Human
ugaaaauauuuguaucacaaau

SEQ ID NO: 2355209 - RNA, 21 nt, Human
ugaaaauauuuguaucacaaa

SEQ ID NO: 2355210 - RNA, 23 nt, Human
ucuuuuuuuuuuuuuaaagacag

SEQ ID NO: 2355211 - RNA, 18 nt, Human
ugaaaaaaaaaaugcuga

SEQ ID NO: 2355212 - RNA, 21 nt, Human
ugaaaaaaaaaaugcugaaca

SEQ ID NO: 2355213 - RNA, 20 nt, Human
ugaaaaaaaaaaugcugaac

SEQ ID NO: 2355214 - RNA, 22 nt, Human
ugaaaaaaaaaaugcugaacau

SEQ ID NO: 2355215 - RNA, 20 nt, Human
ugaaaaauuuaagcauuguu

SEQ ID NO: 2355216 - RNA, 12 nt, Human
ugaaaacaagug

SEQ ID NO: 2355217 - RNA, 14 nt, Human
ucuuuuuuugugau

SEQ ID NO: 2355218 - RNA, 16 nt, Human
ucuuuuuuugugaugu

SEQ ID NO: 2355219 - RNA, 19 nt, Human
ucuuuuuuuuaaugugcug

SEQ ID NO: 2355220 - RNA, 20 nt, Human
ucuuuuuuuuaaugugcugu

SEQ ID NO: 2355221 - RNA, 22 nt, Human
ucuuuuuuuuaaugugcugugu

SEQ ID NO: 2355222 - RNA, 19 nt, Human
ucuuuuuuuuauuccacau

SEQ ID NO: 2355223 - RNA, 13 nt, Human
ugaaaacacauuu

SEQ ID NO: 2355224 - RNA, 12 nt, Human
ugaaaacacauu

SEQ ID NO: 2355225 - RNA, 14 nt, Human
ugaaaacacauuuu

SEQ ID NO: 2355226 - RNA, 18 nt, Human
ugaaaacaagugcuggca

SEQ ID NO: 2355227 - RNA, 21 nt, Human
ugaaaacaagugcuggcacca

SEQ ID NO: 2355228 - RNA, 13 nt, Human
ugaaaacaagugc

SEQ ID NO: 2355229 - RNA, 14 nt, Human
ugaaaacaagugcu

SEQ ID NO: 2355230 - RNA, 15 nt, Human
ugaaaacaagugcug

SEQ ID NO: 2355231 - RNA, 16 nt, Human
ugaaaacaagugcugg

SEQ ID NO: 2355232 - RNA, 19 nt, Human
ugaaaauacaacuuaaaua

SEQ ID NO: 2355233 - RNA, 12 nt, Human
ugaaaauacaac

SEQ ID NO: 2355234 - RNA, 17 nt, Human
ugaaaauauuuguauca

SEQ ID NO: 2355235 - RNA, 16 nt, Human
ugaaaauaagaauaga

SEQ ID NO: 2355236 - RNA, 21 nt, Human
ugaaaauaaaaagaucacuuu

SEQ ID NO: 2355237 - RNA, 20 nt, Human
ugaaaacacauuuuucuuag

SEQ ID NO: 2355238 - RNA, 20 nt, Human
ugaaaauaaaaagaucacuu

SEQ ID NO: 2355239 - RNA, 22 nt, Human
ugaaaaguuacuaccugucaag

SEQ ID NO: 2355240 - RNA, 19 nt, Human
ugaaaacacauuuuucuua

SEQ ID NO: 2355241 - RNA, 17 nt, Human
ugaaaacacauuuuucu

SEQ ID NO: 2355242 - RNA, 15 nt, Human
ugaaaacacauuuuu

SEQ ID NO: 2355243 - RNA, 16 nt, Human
ugaaagacuguacaaa

SEQ ID NO: 2355244 - RNA, 20 nt, Human
ugaaagaaaauaugcaucua

SEQ ID NO: 2355245 - RNA, 22 nt, Human
ugaaagaaacaguuaacuuuca

SEQ ID NO: 2355246 - RNA, 20 nt, Human
ugaaagaaacaguuaacuuu

SEQ ID NO: 2355247 - RNA, 14 nt, Human
ugaaagaaacaguu

SEQ ID NO: 2355248 - RNA, 18 nt, Human
ugaaacuggcacugaauu

SEQ ID NO: 2355249 - RNA, 22 nt, Human
ugaaacugcuuguuuccuagca

SEQ ID NO: 2355250 - RNA, 20 nt, Human
ugaaacugcuuguuuccuag

SEQ ID NO: 2355251 - RNA, 22 nt, Human
ugaaagaaaauaccaaggaaca

SEQ ID NO: 2355252 - RNA, 22 nt, Human
ugaaagacuguacaaaguagaa

SEQ ID NO: 2355253 - RNA, 17 nt, Human
ugaaagaggaaugaagu

SEQ ID NO: 2355254 - RNA, 19 nt, Human
ugaaagacuguacaaagua

SEQ ID NO: 2355255 - RNA, 18 nt, Human
ugaaagacuguacaaagu

SEQ ID NO: 2355256 - RNA, 13 nt, Human
ugaaagagaacca

SEQ ID NO: 2355257 - RNA, 18 nt, Human
agagaccaucccugaagg

SEQ ID NO: 2355258 - RNA, 18 nt, Human
ugaaagaggaaugaagua

SEQ ID NO: 2355259 - RNA, 19 nt, Human
agagaccaucccugaaggc

SEQ ID NO: 2355260 - RNA, 21 nt, Human
agagaccaucccugaaggccc

SEQ ID NO: 2355261 - RNA, 21 nt, Human
agagacccccggaacaagccu

SEQ ID NO: 2355262 - RNA, 21 nt, Human
agagacccaaggaggaaaaac

SEQ ID NO: 2355263 - RNA, 16 nt, Human
agagacccaaggagga

SEQ ID NO: 2355264 - RNA, 14 nt, Human
agagacccaaggag

SEQ ID NO: 2355265 - RNA, 13 nt, Human
agagacccaagga

SEQ ID NO: 2355266 - RNA, 12 nt, Human
agagacccaagg

SEQ ID NO: 2355267 - RNA, 18 nt, Human
ugaaagagaaccaguuuc

SEQ ID NO: 2355268 - RNA, 16 nt, Human
ugaaagagaaccaguu

SEQ ID NO: 2355269 - RNA, 17 nt, Human
agagacccuuguuugau

SEQ ID NO: 2355270 - RNA, 22 nt, Human
agagaccguccucaccccuguc

SEQ ID NO: 2355271 - RNA, 15 nt, Human
agagaccguccucac

SEQ ID NO: 2355272 - RNA, 19 nt, Human
agagacccucugccaccag

SEQ ID NO: 2355273 - RNA, 21 nt, Human
agagacccucugccaccagag

SEQ ID NO: 2355274 - RNA, 23 nt, Human
agagacccucugccaccagagac

SEQ ID NO: 2355275 - RNA, 22 nt, Human
agagaccaucccugaaggcccc

SEQ ID NO: 2355276 - RNA, 23 nt, Human
agagaccaucccugaaggccccg

SEQ ID NO: 2355277 - RNA, 23 nt, Human
agagaugccuccaccgcugccua

SEQ ID NO: 2355278 - RNA, 21 nt, Human
agagaugccuccaccgcugcc

SEQ ID NO: 2355279 - RNA, 17 nt, Human
agagaugccuccaccgc

SEQ ID NO: 2355280 - RNA, 16 nt, Human
agagaugccuccaccg

SEQ ID NO: 2355281 - RNA, 18 nt, Human
agagaugacugaguccuc

SEQ ID NO: 2355282 - RNA, 12 nt, Human
agagaugaauua

SEQ ID NO: 2355283 - RNA, 12 nt, Human
agagaugccucc

SEQ ID NO: 2355284 - RNA, 14 nt, Human
agagaugccuccac

SEQ ID NO: 2355285 - RNA, 17 nt, Human
agagaugacugaguccu

SEQ ID NO: 2355286 - RNA, 17 nt, Human
agagauauggcagcgaa

SEQ ID NO: 2355287 - RNA, 20 nt, Human
agagauaugcagaaggaagg

SEQ ID NO: 2355288 - RNA, 19 nt, Human
agagaugaagagugagagg

SEQ ID NO: 2355289 - RNA, 18 nt, Human
agagauccaaaagaagcc

SEQ ID NO: 2355290 - RNA, 17 nt, Human
agagaguggcuccuccc

SEQ ID NO: 2355291 - RNA, 11 nt, Human
agagagaaaau

SEQ ID NO: 2355292 - RNA, 19 nt, Human
agagagaaaacuuauuuga

SEQ ID NO: 2355293 - RNA, 21 nt, Human
agagagaaaacuuauuugagu

SEQ ID NO: 2355294 - RNA, 12 nt, Human
agagagaaaaua

SEQ ID NO: 2355295 - RNA, 15 nt, Human
agagaguugaaccua

SEQ ID NO: 2355296 - RNA, 15 nt, Human
agagaccuaccucag

SEQ ID NO: 2355297 - RNA, 23 nt, Human
agagaccguccucaccccugucc

SEQ ID NO: 2355298 - RNA, 16 nt, Human
agagaccuaccucagg

SEQ ID NO: 2355299 - RNA, 17 nt, Human
agagaccuaccucaggu

SEQ ID NO: 2355300 - RNA, 18 nt, Human
agagaccuaccucagguu

SEQ ID NO: 2355301 - RNA, 20 nt, Human
agagaccuaccucagguugc

SEQ ID NO: 2355302 - RNA, 13 nt, Human
agagaccucauca

SEQ ID NO: 2355303 - RNA, 12 nt, Human
agagacuccugc

SEQ ID NO: 2355304 - RNA, 13 nt, Human
agagacuccugca

SEQ ID NO: 2355305 - RNA, 14 nt, Human
agagacuccugcag

SEQ ID NO: 2355306 - RNA, 13 nt, Human
agagacugggaag

SEQ ID NO: 2355307 - RNA, 21 nt, Human
agagacuggagcaucugacuc

SEQ ID NO: 2355308 - RNA, 23 nt, Human
agagacugggaagauaggcucug

SEQ ID NO: 2355309 - RNA, 20 nt, Human
agagacuugggacauugccu

SEQ ID NO: 2355310 - RNA, 17 nt, Human
agagacuuuuaaucaga

SEQ ID NO: 2355311 - RNA, 16 nt, Human
agagacuuuuaaucag

SEQ ID NO: 2355312 - RNA, 19 nt, Human
agagacuuuuaaucagaca

SEQ ID NO: 2355313 - RNA, 13 nt, Human
agagagaaaaaca

SEQ ID NO: 2355314 - RNA, 14 nt, Human
agagagaaaaacaa

SEQ ID NO: 2355315 - RNA, 11 nt, Human
agagacuccug

SEQ ID NO: 2355316 - RNA, 21 nt, Human
agagacuccuugagagaccag

SEQ ID NO: 2355317 - RNA, 22 nt, Human
agagacuccuugagagaccagg

SEQ ID NO: 2355318 - RNA, 22 nt, Human
agagacucuggccuccacaguu

SEQ ID NO: 2355319 - RNA, 13 nt, Human
agagacuggagca

SEQ ID NO: 2355320 - RNA, 14 nt, Human
agagacuggagcau

SEQ ID NO: 2355321 - RNA, 17 nt, Human
agagacuggagcaucug

SEQ ID NO: 2355322 - RNA, 15 nt, Human
ugagauuacagagga

SEQ ID NO: 2355323 - RNA, 15 nt, Human
ugagauuauuuuaau

SEQ ID NO: 2355324 - RNA, 17 nt, Human
ugagauuagagggaggu

SEQ ID NO: 2355325 - RNA, 19 nt, Human
ugagauuacagaggaaguu

SEQ ID NO: 2355326 - RNA, 14 nt, Human
ugagauguguucac

SEQ ID NO: 2355327 - RNA, 13 nt, Human
ugagauuucaucu

SEQ ID NO: 2355328 - RNA, 18 nt, Human
ugagauugcaccacugca

SEQ ID NO: 2355329 - RNA, 24 nt, Human
ugagaugugaacacaucagcuugc

SEQ ID NO: 2355330 - RNA, 19 nt, Human
ugagaugugaacacaucag

SEQ ID NO: 2355331 - RNA, 18 nt, Human
ugagaugugaacacauca

SEQ ID NO: 2355332 - RNA, 21 nt, Human
ugagauggaacccuuuuggcc

SEQ ID NO: 2355333 - RNA, 13 nt, Human
ugagauggacaca

SEQ ID NO: 2355334 - RNA, 21 nt, Human
ugagaugcugguaauggccau

SEQ ID NO: 2355335 - RNA, 16 nt, Human
ugagauggacacacug

SEQ ID NO: 2355336 - RNA, 18 nt, Human
ugagauggagucucacuc

SEQ ID NO: 2355337 - RNA, 23 nt, Human
ugagauguagccccucuccugga

SEQ ID NO: 2355338 - RNA, 13 nt, Human
ugagaugugaaca

SEQ ID NO: 2355339 - RNA, 23 nt, Human
ugagaggacuuuucuuuguggcu

SEQ ID NO: 2355340 - RNA, 17 nt, Human
ugagaggaaaucaccga

SEQ ID NO: 2355341 - RNA, 20 nt, Human
ugagaggcaaugauuguuaa

SEQ ID NO: 2355342 - RNA, 22 nt, Human
ugagaggaugaauguaugugca

SEQ ID NO: 2355343 - RNA, 23 nt, Human
ugagaggaugaauguaugugcac

SEQ ID NO: 2355344 - RNA, 19 nt, Human
ugagagcugcucuggaaaa

SEQ ID NO: 2355345 - RNA, 15 nt, Human
ugagaggaugaaugu

SEQ ID NO: 2355346 - RNA, 13 nt, Human
ugagaugcuggag

SEQ ID NO: 2355347 - RNA, 15 nt, Human
ugagaugcuggagaa

SEQ ID NO: 2355348 - RNA, 16 nt, Human
ugagaugcuggagaag

SEQ ID NO: 2355349 - RNA, 17 nt, Human
ugagaugcuggagaaga

SEQ ID NO: 2355350 - RNA, 18 nt, Human
ugagaugcuggagaagag

SEQ ID NO: 2355351 - RNA, 19 nt, Human
ugagaugcuggagaagaga

SEQ ID NO: 2355352 - RNA, 20 nt, Human
ugagaugcuggagaagagag

SEQ ID NO: 2355353 - RNA, 23 nt, Human
ugagaugcuggagaagagaggag

SEQ ID NO: 2355354 - RNA, 16 nt, Human
ugagagccccagcuga

SEQ ID NO: 2355355 - RNA, 19 nt, Human
ugagagccccagcugacau

SEQ ID NO: 2355356 - RNA, 19 nt, Human
ugagagcccagagguaaca

SEQ ID NO: 2355357 - RNA, 20 nt, Human
ugagagcccagagguaacag

SEQ ID NO: 2355358 - RNA, 12 nt, Human
ugagagccccag

SEQ ID NO: 2355359 - RNA, 15 nt, Human
ugagagccccagcug

SEQ ID NO: 2355360 - RNA, 14 nt, Human
ugagagcugggugu

SEQ ID NO: 2355361 - RNA, 10 nt, Human
ugagaggaaa

SEQ ID NO: 2355362 - RNA, 17 nt, Human
ugagagcugugcaucag

SEQ ID NO: 2355363 - RNA, 23 nt, Human
ugagagcgugcuccagccuggcu

SEQ ID NO: 2355364 - RNA, 22 nt, Human
ugagagccccagcugacaugga

SEQ ID NO: 2355365 - RNA, 16 nt, Human
ugagagcugcucugga

SEQ ID NO: 2355366 - RNA, 11 nt, Human
ugagaggaaau

SEQ ID NO: 2355367 - RNA, 12 nt, Human
ugagaggaaauc

SEQ ID NO: 2355368 - RNA, 13 nt, Human
ugagaggaaauca

SEQ ID NO: 2355369 - RNA, 14 nt, Human
ugagaggaaaucac

SEQ ID NO: 2355370 - RNA, 16 nt, Human
ugagagagaugggagc

SEQ ID NO: 2355371 - RNA, 17 nt, Human
ugagagagaugggagcu

SEQ ID NO: 2355372 - RNA, 21 nt, Human
ugagagagaugggagcuccuc

SEQ ID NO: 2355373 - RNA, 20 nt, Human
ugagagacccaaggaggaaa

SEQ ID NO: 2355374 - RNA, 12 nt, Human
ugagagacuuuu

SEQ ID NO: 2355375 - RNA, 21 nt, Human
ugagagacccaaggaggaaaa

SEQ ID NO: 2355376 - RNA, 19 nt, Human
ugagagaauuguaucauuu

SEQ ID NO: 2355377 - RNA, 18 nt, Human
ugagagaauuguaucauu

SEQ ID NO: 2355378 - RNA, 23 nt, Human
ugagagaauggaaaacagacuca

SEQ ID NO: 2355379 - RNA, 24 nt, Human
ugagagaccaggcaaagcaaguga

SEQ ID NO: 2355380 - RNA, 14 nt, Human
ugagagaccaggca

SEQ ID NO: 2355381 - RNA, 21 nt, Human
ugagagacacacugaagaagc

SEQ ID NO: 2355382 - RNA, 22 nt, Human
ugagagacacacugaagaagca

SEQ ID NO: 2355383 - RNA, 15 nt, Human
ugagagcccagaggu

SEQ ID NO: 2355384 - RNA, 16 nt, Human
ugagagcccagaggua

SEQ ID NO: 2355385 - RNA, 22 nt, Human
ugagagagaugggagcuccucu

SEQ ID NO: 2355386 - RNA, 23 nt, Human
ugagagagaugggagcuccucuc

SEQ ID NO: 2355387 - RNA, 19 nt, Human
ugagagaauggaaaacaga

SEQ ID NO: 2355388 - RNA, 14 nt, Human
ugagagaauggaaa

SEQ ID NO: 2355389 - RNA, 15 nt, Human
ugagagaagggacac

SEQ ID NO: 2355390 - RNA, 18 nt, Human
ugagagaauaagucaugu

SEQ ID NO: 2355391 - RNA, 22 nt, Human
ugagagaaauauggaacuuaca

SEQ ID NO: 2355392 - RNA, 13 nt, Human
ugagagaaaauaa

SEQ ID NO: 2355393 - RNA, 20 nt, Human
ugagacuugcucucuggccu

SEQ ID NO: 2355394 - RNA, 14 nt, Human
ugagacuugcucuc

SEQ ID NO: 2355395 - RNA, 18 nt, Human
ugagacugggucucgcuu

SEQ ID NO: 2355396 - RNA, 21 nt, Human
ugagacuggauacugcccggg

SEQ ID NO: 2355397 - RNA, 12 nt, Human
ugagacuuccaa

SEQ ID NO: 2355398 - RNA, 23 nt, Human
ugagacugcgggaugguccuggg

SEQ ID NO: 2355399 - RNA, 22 nt, Human
ugagacugcgggaugguccugg

SEQ ID NO: 2355400 - RNA, 14 nt, Human
ugagacagaaucuc

SEQ ID NO: 2355401 - RNA, 16 nt, Human
ugagagacacacugaa

SEQ ID NO: 2355402 - RNA, 17 nt, Human
ugagagacacacugaag

SEQ ID NO: 2355403 - RNA, 19 nt, Human
ugagagacacacugaagaa

SEQ ID NO: 2355404 - RNA, 20 nt, Human
ugagagacacacugaagaag

SEQ ID NO: 2355405 - RNA, 20 nt, Human
ugagacucugucucaaaaaa

SEQ ID NO: 2355406 - RNA, 20 nt, Human
ugagacucugucucagucca

SEQ ID NO: 2355407 - RNA, 22 nt, Human
ugagacagcccgggcucugccu

SEQ ID NO: 2355408 - RNA, 12 nt, Human
ugagacagcucu

SEQ ID NO: 2355409 - RNA, 17 nt, Human
ugagacagcccgggcuc

SEQ ID NO: 2355410 - RNA, 18 nt, Human
ugagacagcccgggcucu

SEQ ID NO: 2355411 - RNA, 19 nt, Human
ugagacagcccgggcucug

SEQ ID NO: 2355412 - RNA, 20 nt, Human
ugagacagcccgggcucugc

SEQ ID NO: 2355413 - RNA, 11 nt, Human
agauuuuccuu

SEQ ID NO: 2355414 - RNA, 20 nt, Human
agauuuuaggaaaugaaugu

SEQ ID NO: 2355415 - RNA, 16 nt, Human
agauuuuccugaaaac

SEQ ID NO: 2355416 - RNA, 15 nt, Human
agauuuuccugaaaa

SEQ ID NO: 2355417 - RNA, 19 nt, Human
agauuuuaggaaaugaaug

SEQ ID NO: 2355418 - RNA, 14 nt, Human
agauuuuccugaaa

SEQ ID NO: 2355419 - RNA, 17 nt, Human
ugagaagccgugggugg

SEQ ID NO: 2355420 - RNA, 16 nt, Human
ugagaagccgugggug

SEQ ID NO: 2355421 - RNA, 20 nt, Human
agauuuuccuuuuuuauaca

SEQ ID NO: 2355422 - RNA, 13 nt, Human
agauuuuccuucc

SEQ ID NO: 2355423 - RNA, 19 nt, Human
agauuuuccuuuuuuauac

SEQ ID NO: 2355424 - RNA, 17 nt, Human
ugagaaggaauuugagu

SEQ ID NO: 2355425 - RNA, 12 nt, Human
ugagaaggagag

SEQ ID NO: 2355426 - RNA, 13 nt, Human
ugagaaggagaga

SEQ ID NO: 2355427 - RNA, 14 nt, Human
ugagaaggagagaa

SEQ ID NO: 2355428 - RNA, 19 nt, Human
ugagaagcuuuugaauaaa

SEQ ID NO: 2355429 - RNA, 20 nt, Human
ugagaagcuuugcccuccua

SEQ ID NO: 2355430 - RNA, 14 nt, Human
ugagaaggcagcca

SEQ ID NO: 2355431 - RNA, 15 nt, Human
ugagaaggagagaaa

SEQ ID NO: 2355432 - RNA, 16 nt, Human
ugagaaggagagaaag

SEQ ID NO: 2355433 - RNA, 22 nt, Human
ugagaaggagucagaaacuguu

SEQ ID NO: 2355434 - RNA, 13 nt, Human
ugagaaggcagcc

SEQ ID NO: 2355435 - RNA, 11 nt, Human
ugagacagagu

SEQ ID NO: 2355436 - RNA, 20 nt, Human
ugagacagaaucucgcucug

SEQ ID NO: 2355437 - RNA, 22 nt, Human
ugagacacggagcccagcccuc

SEQ ID NO: 2355438 - RNA, 13 nt, Human
ugagacagaaucu

SEQ ID NO: 2355439 - RNA, 21 nt, Human
ugagacagaguuuucacucuu

SEQ ID NO: 2355440 - RNA, 13 nt, Human
ugagacagcccgg

SEQ ID NO: 2355441 - RNA, 19 nt, Human
ugagaaucuuuauugagaa

SEQ ID NO: 2355442 - RNA, 20 nt, Human
ugagaaucuuuauugagaaa

SEQ ID NO: 2355443 - RNA, 21 nt, Human
ugagaaucuuuauugagaaag

SEQ ID NO: 2355444 - RNA, 22 nt, Human
ugagaaucuuuauugagaaaga

SEQ ID NO: 2355445 - RNA, 17 nt, Human
ugagacacggagcccag

SEQ ID NO: 2355446 - RNA, 21 nt, Human
ugagacacggagcccagcccu

SEQ ID NO: 2355447 - RNA, 15 nt, Human
ugagaauguaagaac

SEQ ID NO: 2355448 - RNA, 22 nt, Human
ugagaaucccaaauuugauuga

SEQ ID NO: 2355449 - RNA, 21 nt, Human
ugagaaucccaaauuugauug

SEQ ID NO: 2355450 - RNA, 20 nt, Human
ugagaaucccaaauuugauu

SEQ ID NO: 2355451 - RNA, 13 nt, Human
ugagaaucccaaa

SEQ ID NO: 2355452 - RNA, 21 nt, Human
ugagaaucuacccccagaucc

SEQ ID NO: 2355453 - RNA, 12 nt, Human
ugagaaucuacc

SEQ ID NO: 2355454 - RNA, 23 nt, Human
ugagaaucuauauuuaacaagau

SEQ ID NO: 2355455 - RNA, 18 nt, Human
ugagaaucuauauuuaac

SEQ ID NO: 2355456 - RNA, 14 nt, Human
agcaagucaggguu

SEQ ID NO: 2355457 - RNA, 13 nt, Human
agcaagucucuuu

SEQ ID NO: 2355458 - RNA, 16 nt, Human
agcaagugagacccug

SEQ ID NO: 2355459 - RNA, 15 nt, Human
agcaagugagagcug

SEQ ID NO: 2355460 - RNA, 16 nt, Human
agcaagugagagcugg

SEQ ID NO: 2355461 - RNA, 20 nt, Human
agcaaggguucccucaagag

SEQ ID NO: 2355462 - RNA, 23 nt, Human
agcaaggugcucacaccccauug

SEQ ID NO: 2355463 - RNA, 15 nt, Human
agcaagucagaauag

SEQ ID NO: 2355464 - RNA, 22 nt, Human
agcaagggugaugggaaagcau

SEQ ID NO: 2355465 - RNA, 20 nt, Human
agcaagggugaugggaaagc

SEQ ID NO: 2355466 - RNA, 20 nt, Human
agcaagcucccaagggaugg

SEQ ID NO: 2355467 - RNA, 14 nt, Human
agcaaggagauuua

SEQ ID NO: 2355468 - RNA, 19 nt, Human
agcaaggagauuuacaacu

SEQ ID NO: 2355469 - RNA, 17 nt, Human
agcaaggagauuuacaa

SEQ ID NO: 2355470 - RNA, 13 nt, Human
agcaaggcaccug

SEQ ID NO: 2355471 - RNA, 22 nt, Human
agcaaggaggcuggcuggggcc

SEQ ID NO: 2355472 - RNA, 16 nt, Human
agcaaggaggcuggcu

SEQ ID NO: 2355473 - RNA, 17 nt, Human
agcaaggaggcuggcug

SEQ ID NO: 2355474 - RNA, 16 nt, Human
agcaaggcaccugcag

SEQ ID NO: 2355475 - RNA, 16 nt, Human
agcaagggugauggga

SEQ ID NO: 2355476 - RNA, 14 nt, Human
agcaagauuucaga

SEQ ID NO: 2355477 - RNA, 20 nt, Human
agcaagcauuuauguuuauu

SEQ ID NO: 2355478 - RNA, 11 nt, Human
agcaagcuccc

SEQ ID NO: 2355479 - RNA, 15 nt, Human
agcaagcucccaagg

SEQ ID NO: 2355480 - RNA, 20 nt, Human
ugagccagauuucacucucc

SEQ ID NO: 2355481 - RNA, 21 nt, Human
ugagccagauuucacucuccu

SEQ ID NO: 2355482 - RNA, 23 nt, Human
ugagcauuguggcugucagcagg

SEQ ID NO: 2355483 - RNA, 22 nt, Human
ugagcauuguggcugucagcag

SEQ ID NO: 2355484 - RNA, 14 nt, Human
ugagccacugcacc

SEQ ID NO: 2355485 - RNA, 18 nt, Human
ugagccagauuucacucu

SEQ ID NO: 2355486 - RNA, 19 nt, Human
ugagccagauuucacucuc

SEQ ID NO: 2355487 - RNA, 16 nt, Human
ugagcauggagcuggc

SEQ ID NO: 2355488 - RNA, 18 nt, Human
ugagcauggagcuggccg

SEQ ID NO: 2355489 - RNA, 15 nt, Human
ugagcauggagcugg

SEQ ID NO: 2355490 - RNA, 14 nt, Human
ugagcauggagcug

SEQ ID NO: 2355491 - RNA, 20 nt, Human
ugagcaaagggaacagugag

SEQ ID NO: 2355492 - RNA, 18 nt, Human
ugagcaaacuaacuugac

SEQ ID NO: 2355493 - RNA, 22 nt, Human
ugagauuucaucugcucuccuu

SEQ ID NO: 2355494 - RNA, 14 nt, Human
ugagauuuugguau

SEQ ID NO: 2355495 - RNA, 14 nt, Human
ugagauuucaucug

SEQ ID NO: 2355496 - RNA, 18 nt, Human
ugagauuucaucugcucu

SEQ ID NO: 2355497 - RNA, 19 nt, Human
ugagauuucaucugcucuc

SEQ ID NO: 2355498 - RNA, 21 nt, Human
ugagauuucaucugcucuccu

SEQ ID NO: 2355499 - RNA, 12 nt, Human
ugagccacugca

SEQ ID NO: 2355500 - RNA, 13 nt, Human
ugagccacugcac

SEQ ID NO: 2355501 - RNA, 21 nt, Human
ugagcauuguggcugucagca

SEQ ID NO: 2355502 - RNA, 16 nt, Human
ugagcauuagauuucu

SEQ ID NO: 2355503 - RNA, 14 nt, Human
ugagcauuagauuu

SEQ ID NO: 2355504 - RNA, 22 nt, Human
agcaccuacaguguacagucuu

SEQ ID NO: 2355505 - RNA, 18 nt, Human
agcaccguucugugcaca

SEQ ID NO: 2355506 - RNA, 15 nt, Human
agcaccuacuuacau

SEQ ID NO: 2355507 - RNA, 17 nt, Human
agcaccuagccucgcuc

SEQ ID NO: 2355508 - RNA, 18 nt, Human
agcaccuaguccagugac

SEQ ID NO: 2355509 - RNA, 14 nt, Human
agcaccuacagugu

SEQ ID NO: 2355510 - RNA, 15 nt, Human
agcaccuacagugua

SEQ ID NO: 2355511 - RNA, 19 nt, Human
agcaccuacaguguacagu

SEQ ID NO: 2355512 - RNA, 21 nt, Human
agcaccuacaguguacagucu

SEQ ID NO: 2355513 - RNA, 13 nt, Human
agcaccuccugcc

SEQ ID NO: 2355514 - RNA, 14 nt, Human
agcaccuccugccu

SEQ ID NO: 2355515 - RNA, 16 nt, Human
agcaccuccugccucg

SEQ ID NO: 2355516 - RNA, 19 nt, Human
agcaccccaugccaaagcu

SEQ ID NO: 2355517 - RNA, 14 nt, Human
agcaccccucucug

SEQ ID NO: 2355518 - RNA, 15 nt, Human
agcaccccucucugc

SEQ ID NO: 2355519 - RNA, 16 nt, Human
agcaccccucucugca

SEQ ID NO: 2355520 - RNA, 19 nt, Human
agcaccccucucugcaucu

SEQ ID NO: 2355521 - RNA, 13 nt, Human
agcaccccugucu

SEQ ID NO: 2355522 - RNA, 15 nt, Human
agcaccccugucucu

SEQ ID NO: 2355523 - RNA, 12 nt, Human
agcaccccuucc

SEQ ID NO: 2355524 - RNA, 13 nt, Human
agcaccccuucca

SEQ ID NO: 2355525 - RNA, 14 nt, Human
agcaccccuuccau

SEQ ID NO: 2355526 - RNA, 15 nt, Human
agcacccgggcucag

SEQ ID NO: 2355527 - RNA, 17 nt, Human
agcacccgggcucaggg

SEQ ID NO: 2355528 - RNA, 17 nt, Human
agcaccguucugugcac

SEQ ID NO: 2355529 - RNA, 16 nt, Human
agcaccguucugugca

SEQ ID NO: 2355530 - RNA, 15 nt, Human
agcaccguucugugc

SEQ ID NO: 2355531 - RNA, 20 nt, Human
agcacccagcaacuccaacu

SEQ ID NO: 2355532 - RNA, 19 nt, Human
agcaccauccgccagggcc

SEQ ID NO: 2355533 - RNA, 20 nt, Human
agcaccauccgccagggccc

SEQ ID NO: 2355534 - RNA, 14 nt, Human
agcaccccaaggcu

SEQ ID NO: 2355535 - RNA, 16 nt, Human
agcaccaucucuccuc

SEQ ID NO: 2355536 - RNA, 23 nt, Human
agcacaugccucucucaggccaa

SEQ ID NO: 2355537 - RNA, 23 nt, Human
agcaauccauguuaguuuuuacu

SEQ ID NO: 2355538 - RNA, 22 nt, Human
agcaauccauguuaguuuuuac

SEQ ID NO: 2355539 - RNA, 19 nt, Human
agcaauccuagguaggguu

SEQ ID NO: 2355540 - RNA, 14 nt, Human
agcacagcuugacc

SEQ ID NO: 2355541 - RNA, 21 nt, Human
agcacagcuucauuuccugug

SEQ ID NO: 2355542 - RNA, 20 nt, Human
agcaauccauguuaguuuuu

SEQ ID NO: 2355543 - RNA, 17 nt, Human
agcaauccauguuaguu

SEQ ID NO: 2355544 - RNA, 15 nt, Human
agcaauauguaaaua

SEQ ID NO: 2355545 - RNA, 12 nt, Human
agcaauaugcau

SEQ ID NO: 2355546 - RNA, 15 nt, Human
agcaauaucaguuau

SEQ ID NO: 2355547 - RNA, 21 nt, Human
agcaauaucaguuauuuuuug

SEQ ID NO: 2355548 - RNA, 13 nt, Human
agcaagucugcag

SEQ ID NO: 2355549 - RNA, 14 nt, Human
agcaagucugcagg

SEQ ID NO: 2355550 - RNA, 15 nt, Human
agcaagucugcaggu

SEQ ID NO: 2355551 - RNA, 17 nt, Human
agcaagugagagcuggg

SEQ ID NO: 2355552 - RNA, 15 nt, Human
agcaauaaaugaaug

SEQ ID NO: 2355553 - RNA, 14 nt, Human
agcaauaaaugaau

SEQ ID NO: 2355554 - RNA, 13 nt, Human
agcaauaaaugaa

SEQ ID NO: 2355555 - RNA, 14 nt, Human
agcaagugaauuuu

SEQ ID NO: 2355556 - RNA, 19 nt, Human
agcaauaauggucccaucc

SEQ ID NO: 2355557 - RNA, 20 nt, Human
agcaauaauggucccaucca

SEQ ID NO: 2355558 - RNA, 21 nt, Human
agcaauaauggucccauccag

SEQ ID NO: 2355559 - RNA, 23 nt, Human
agcaauaauggucccauccaggc

SEQ ID NO: 2355560 - RNA, 15 nt, Human
agcacaggcagcugg

SEQ ID NO: 2355561 - RNA, 12 nt, Human
agcacaggcagc

SEQ ID NO: 2355562 - RNA, 13 nt, Human
agcacaggcagcu

SEQ ID NO: 2355563 - RNA, 18 nt, Human
agcacagcuugaccugag

SEQ ID NO: 2355564 - RNA, 20 nt, Human
agcacagcuugaccugaggc

SEQ ID NO: 2355565 - RNA, 18 nt, Human
agcacaugccucucucag

SEQ ID NO: 2355566 - RNA, 15 nt, Human
agcacaggugggcuu

SEQ ID NO: 2355567 - RNA, 16 nt, Human
agcacaugccucucuc

SEQ ID NO: 2355568 - RNA, 19 nt, Human
agcacaugccucucucagg

SEQ ID NO: 2355569 - RNA, 20 nt, Human
agcacaugccucucucaggc

SEQ ID NO: 2355570 - RNA, 21 nt, Human
agcacaugccucucucaggcc

SEQ ID NO: 2355571 - RNA, 22 nt, Human
agcacaugccucucucaggcca

SEQ ID NO: 2355572 - RNA, 20 nt, Human
ugacaccuuucauaaucuuu

SEQ ID NO: 2355573 - RNA, 23 nt, Human
ugacaccuuucauaaucuuugcu

SEQ ID NO: 2355574 - RNA, 20 nt, Human
ugacacugcggggcuuggcu

SEQ ID NO: 2355575 - RNA, 18 nt, Human
ugacaccuuugcaggcau

SEQ ID NO: 2355576 - RNA, 19 nt, Human
ugacaccuuugcaggcaug

SEQ ID NO: 2355577 - RNA, 19 nt, Human
ugacacgaauauugcugau

SEQ ID NO: 2355578 - RNA, 23 nt, Human
ugacacugcggggcuuggcugag

SEQ ID NO: 2355579 - RNA, 19 nt, Human
ugacacugguauuccugcc

SEQ ID NO: 2355580 - RNA, 15 nt, Human
ugacagaguucacua

SEQ ID NO: 2355581 - RNA, 15 nt, Human
ugacagaucaagcug

SEQ ID NO: 2355582 - RNA, 20 nt, Human
ugacacugguauuccugccu

SEQ ID NO: 2355583 - RNA, 21 nt, Human
ugacacugguauuccugccuc

SEQ ID NO: 2355584 - RNA, 16 nt, Human
ugacagaucaagcugu

SEQ ID NO: 2355585 - RNA, 17 nt, Human
ugacagaucaagcugug

SEQ ID NO: 2355586 - RNA, 18 nt, Human
ugacagaucaagcuguga

SEQ ID NO: 2355587 - RNA, 19 nt, Human
ugacagaucaagcugugag

SEQ ID NO: 2355588 - RNA, 19 nt, Human
ugacagauguugaaugccc

SEQ ID NO: 2355589 - RNA, 22 nt, Human
ugacagaugucagccgagccgg

SEQ ID NO: 2355590 - RNA, 21 nt, Human
ugacagaucaagcugugagac

SEQ ID NO: 2355591 - RNA, 19 nt, Human
ugacagaugucagccgagc

SEQ ID NO: 2355592 - RNA, 22 nt, Human
ugacagagugagacucugucuc

SEQ ID NO: 2355593 - RNA, 15 nt, Human
ugacacuuaaaaaug

SEQ ID NO: 2355594 - RNA, 13 nt, Human
ugaaugcggccca

SEQ ID NO: 2355595 - RNA, 14 nt, Human
ugaaugccguggau

SEQ ID NO: 2355596 - RNA, 19 nt, Human
ugaaugcccccagcuggcc

SEQ ID NO: 2355597 - RNA, 20 nt, Human
ugaaugcccccagcuggccc

SEQ ID NO: 2355598 - RNA, 11 nt, Human
ugaaugcuggg

SEQ ID NO: 2355599 - RNA, 17 nt, Human
ugaaugccucaauguga

SEQ ID NO: 2355600 - RNA, 12 nt, Human
ugaaugcuggga

SEQ ID NO: 2355601 - RNA, 13 nt, Human
ugaaugcugggac

SEQ ID NO: 2355602 - RNA, 13 nt, Human
ugaaucaauaaua

SEQ ID NO: 2355603 - RNA, 15 nt, Human
ugaaucaauaauaua

SEQ ID NO: 2355604 - RNA, 16 nt, Human
ugaaucaauaauauau

SEQ ID NO: 2355605 - RNA, 17 nt, Human
ugaaucaauaauauauu

SEQ ID NO: 2355606 - RNA, 19 nt, Human
ugaaucaauaauauauuuu

SEQ ID NO: 2355607 - RNA, 20 nt, Human
ugaaucaauaauauauuuuc

SEQ ID NO: 2355608 - RNA, 17 nt, Human
ugaaugcccccagcugg

SEQ ID NO: 2355609 - RNA, 18 nt, Human
ugaaugcccccagcuggc

SEQ ID NO: 2355610 - RNA, 16 nt, Human
ugacacgaauauugcu

SEQ ID NO: 2355611 - RNA, 21 nt, Human
ugacaccgggguggugggaac

SEQ ID NO: 2355612 - RNA, 15 nt, Human
ugacaccugcugaga

SEQ ID NO: 2355613 - RNA, 19 nt, Human
ugaaugcuuauagguggcc

SEQ ID NO: 2355614 - RNA, 19 nt, Human
ugaaugcugggacucagcc

SEQ ID NO: 2355615 - RNA, 14 nt, Human
ugaaugcugggacu

SEQ ID NO: 2355616 - RNA, 15 nt, Human
ugaaugcugggacuc

SEQ ID NO: 2355617 - RNA, 13 nt, Human
ugacauuaacagu

SEQ ID NO: 2355618 - RNA, 17 nt, Human
ugacagguaaauuaaga

SEQ ID NO: 2355619 - RNA, 22 nt, Human
ugacauuaacaguuuuccauga

SEQ ID NO: 2355620 - RNA, 19 nt, Human
ugacauuaacaguuuucca

SEQ ID NO: 2355621 - RNA, 17 nt, Human
ugacauuaacaguuuuc

SEQ ID NO: 2355622 - RNA, 21 nt, Human
ugacauuaacaguuuuccaug

SEQ ID NO: 2355623 - RNA, 12 nt, Human
ugacauucaccu

SEQ ID NO: 2355624 - RNA, 18 nt, Human
ugacauucaccugcccca

SEQ ID NO: 2355625 - RNA, 15 nt, Human
ugacauucaccugcc

SEQ ID NO: 2355626 - RNA, 17 nt, Human
ugacauucaugccuggc

SEQ ID NO: 2355627 - RNA, 22 nt, Human
ugacauucucaggaagccccca

SEQ ID NO: 2355628 - RNA, 15 nt, Human
ugacauucaaggcau

SEQ ID NO: 2355629 - RNA, 15 nt, Human
ugacauucaugccug

SEQ ID NO: 2355630 - RNA, 20 nt, Human
ugacauuccuaaacuaucuu

SEQ ID NO: 2355631 - RNA, 21 nt, Human
ugacauuccuaaacuaucuuu

SEQ ID NO: 2355632 - RNA, 21 nt, Human
ugacauuugggagacauguga

SEQ ID NO: 2355633 - RNA, 22 nt, Human
ugacauuugggagacaugugac

SEQ ID NO: 2355634 - RNA, 23 nt, Human
ugacauuugggagacaugugaca

SEQ ID NO: 2355635 - RNA, 24 nt, Human
ugacauuugggagacaugugacau

SEQ ID NO: 2355636 - RNA, 12 nt, Human
ugacauuucuuu

SEQ ID NO: 2355637 - RNA, 21 nt, Human
ugacauuuauuuuucucauga

SEQ ID NO: 2355638 - RNA, 22 nt, Human
ugacauuuauuuuucucaugaa

SEQ ID NO: 2355639 - RNA, 14 nt, Human
ugacauuucuuugu

SEQ ID NO: 2355640 - RNA, 13 nt, Human
ugacauuucuuug

SEQ ID NO: 2355641 - RNA, 21 nt, Human
ugacauuuggaguguuccccu

SEQ ID NO: 2355642 - RNA, 21 nt, Human
ugacauuuauuuuucauuuag

SEQ ID NO: 2355643 - RNA, 18 nt, Human
ugacauuuauuuuucauu

SEQ ID NO: 2355644 - RNA, 19 nt, Human
ugacauuuauauauugaau

SEQ ID NO: 2355645 - RNA, 20 nt, Human
ugacauuuauauauugaauu

SEQ ID NO: 2355646 - RNA, 12 nt, Human
ugacagccuccc

SEQ ID NO: 2355647 - RNA, 11 nt, Human
ugacagccucc

SEQ ID NO: 2355648 - RNA, 14 nt, Human
ugacagcuuugcug

SEQ ID NO: 2355649 - RNA, 13 nt, Human
ugacagcuuugcu

SEQ ID NO: 2355650 - RNA, 14 nt, Human
ugacagcagguggg

SEQ ID NO: 2355651 - RNA, 17 nt, Human
ugacaggcaaugcuggc

SEQ ID NO: 2355652 - RNA, 19 nt, Human
ugacaggcaaugcuggcug

SEQ ID NO: 2355653 - RNA, 21 nt, Human
ugacagggcacaccgggcacu

SEQ ID NO: 2355654 - RNA, 18 nt, Human
ugacagcuuugcugcuga

SEQ ID NO: 2355655 - RNA, 17 nt, Human
ugacagcuuugcugcug

SEQ ID NO: 2355656 - RNA, 16 nt, Human
ugacagcuuugcugcu

SEQ ID NO: 2355657 - RNA, 15 nt, Human
ugacagcuuugcugc

SEQ ID NO: 2355658 - RNA, 22 nt, Human
ugacagggcacaccgggcacuc

SEQ ID NO: 2355659 - RNA, 15 nt, Human
ugacagguuugggac

SEQ ID NO: 2355660 - RNA, 15 nt, Human
ugacagguaaacuau

SEQ ID NO: 2355661 - RNA, 20 nt, Human
ugacagcuuugcugcugaag

SEQ ID NO: 2355662 - RNA, 21 nt, Human
ugacagcuuugcugcugaagg

SEQ ID NO: 2355663 - RNA, 20 nt, Human
agaugcaaugacucaggaca

SEQ ID NO: 2355664 - RNA, 18 nt, Human
agaugcaaggaccaggac

SEQ ID NO: 2355665 - RNA, 17 nt, Human
agaugcaaggaccagga

SEQ ID NO: 2355666 - RNA, 20 nt, Human
agaugcaaggaccaggacuc

SEQ ID NO: 2355667 - RNA, 18 nt, Human
agaugcaaugugcuacug

SEQ ID NO: 2355668 - RNA, 13 nt, Human
agaugcaagauau

SEQ ID NO: 2355669 - RNA, 19 nt, Human
agaugcaaugugcuacuga

SEQ ID NO: 2355670 - RNA, 18 nt, Human
agaugcaccaccaagcca

SEQ ID NO: 2355671 - RNA, 20 nt, Human
agaugcaguucugaagaaga

SEQ ID NO: 2355672 - RNA, 19 nt, Human
agaugcuagaacucccuuu

SEQ ID NO: 2355673 - RNA, 20 nt, Human
agaugcaccaccaagccaag

SEQ ID NO: 2355674 - RNA, 22 nt, Human
agaugcauucuugguuggcugg

SEQ ID NO: 2355675 - RNA, 21 nt, Human
agaugcaguucugaagaagau

SEQ ID NO: 2355676 - RNA, 21 nt, Human
agaugcuggaugucugccaau

SEQ ID NO: 2355677 - RNA, 22 nt, Human
agauguagccccucuccuggaa

SEQ ID NO: 2355678 - RNA, 21 nt, Human
agauguagccccucuccugga

SEQ ID NO: 2355679 - RNA, 19 nt, Human
agaugcuggcccagggccc

SEQ ID NO: 2355680 - RNA, 18 nt, Human
agaugcuggcccagggcc

SEQ ID NO: 2355681 - RNA, 17 nt, Human
agaugcuggcccagggc

SEQ ID NO: 2355682 - RNA, 16 nt, Human
agaugcuggcccaggg

SEQ ID NO: 2355683 - RNA, 15 nt, Human
agaugcuggcccagg

SEQ ID NO: 2355684 - RNA, 14 nt, Human
agaugcuggcccag

SEQ ID NO: 2355685 - RNA, 16 nt, Human
agaugcugauguucag

SEQ ID NO: 2355686 - RNA, 21 nt, Human
agaugcuagaacucccuuuca

SEQ ID NO: 2355687 - RNA, 17 nt, Human
agaugcugauguucagu

SEQ ID NO: 2355688 - RNA, 18 nt, Human
agaugcugauguucagug

SEQ ID NO: 2355689 - RNA, 19 nt, Human
agaugcugauguucagugu

SEQ ID NO: 2355690 - RNA, 20 nt, Human
agaugcugauguucagugua

SEQ ID NO: 2355691 - RNA, 21 nt, Human
agaugcugauguucaguguaa

SEQ ID NO: 2355692 - RNA, 22 nt, Human
agaugcugauguucaguguaau

SEQ ID NO: 2355693 - RNA, 11 nt, Human
agaugcuggag

SEQ ID NO: 2355694 - RNA, 13 nt, Human
agaugcuggagaa

SEQ ID NO: 2355695 - RNA, 16 nt, Human
agaugcuggagaagag

SEQ ID NO: 2355696 - RNA, 17 nt, Human
agaugcuggagaagaga

SEQ ID NO: 2355697 - RNA, 18 nt, Human
agaugcuggagaagagag

SEQ ID NO: 2355698 - RNA, 19 nt, Human
agaugcuggagaagagagg

SEQ ID NO: 2355699 - RNA, 20 nt, Human
agaugcuggagaagagagga

SEQ ID NO: 2355700 - RNA, 21 nt, Human
agaugcuggagaagagaggag

SEQ ID NO: 2355701 - RNA, 22 nt, Human
agaugcuggagaagagaggaga

SEQ ID NO: 2355702 - RNA, 16 nt, Human
agaucguucucugccu

SEQ ID NO: 2355703 - RNA, 18 nt, Human
agauccugcggguggggc

SEQ ID NO: 2355704 - RNA, 22 nt, Human
agaucgugccguuacucuccaa

SEQ ID NO: 2355705 - RNA, 14 nt, Human
agauccuggaaauc

SEQ ID NO: 2355706 - RNA, 17 nt, Human
agauccugcgggugggg

SEQ ID NO: 2355707 - RNA, 12 nt, Human
agauccuccugc

SEQ ID NO: 2355708 - RNA, 13 nt, Human
agauccuggaaau

SEQ ID NO: 2355709 - RNA, 15 nt, Human
agaugcaaggaccag

SEQ ID NO: 2355710 - RNA, 14 nt, Human
agaucuccuggcaa

SEQ ID NO: 2355711 - RNA, 20 nt, Human
agaugcaaagaggcaagagg

SEQ ID NO: 2355712 - RNA, 18 nt, Human
agaucuccuggcaaaggc

SEQ ID NO: 2355713 - RNA, 18 nt, Human
agaucucuaacuucacca

SEQ ID NO: 2355714 - RNA, 19 nt, Human
agaucuaggugaggauuga

SEQ ID NO: 2355715 - RNA, 22 nt, Human
agaucuaaggaugucacagggc

SEQ ID NO: 2355716 - RNA, 16 nt, Human
agaucguuaguaucua

SEQ ID NO: 2355717 - RNA, 17 nt, Human
agaucguuaguaucuaa

SEQ ID NO: 2355718 - RNA, 20 nt, Human
agaucuaagccuuuccauaa

SEQ ID NO: 2355719 - RNA, 22 nt, Human
agaucccgccucuucuucuuca

SEQ ID NO: 2355720 - RNA, 13 nt, Human
agauccuaaaaca

SEQ ID NO: 2355721 - RNA, 22 nt, Human
agauccuaaaacaaaagcucau

SEQ ID NO: 2355722 - RNA, 19 nt, Human
agaucccgccucuucuucu

SEQ ID NO: 2355723 - RNA, 15 nt, Human
agaucccgccucuuc

SEQ ID NO: 2355724 - RNA, 15 nt, Human
agauccccucaggac

SEQ ID NO: 2355725 - RNA, 22 nt, Human
agauccuaccccaauuccuugu

SEQ ID NO: 2355726 - RNA, 16 nt, Human
agauccuaaaacaaaa

SEQ ID NO: 2355727 - RNA, 13 nt, Human
agaucccagcuca

SEQ ID NO: 2355728 - RNA, 11 nt, Human
agauccccuca

SEQ ID NO: 2355729 - RNA, 14 nt, Human
agaucccccagacu

SEQ ID NO: 2355730 - RNA, 18 nt, Human
agauccccaagccuggca

SEQ ID NO: 2355731 - RNA, 22 nt, Human
agaucccagaaggaccuccuga

SEQ ID NO: 2355732 - RNA, 20 nt, Human
ugaccaaguuauaaaucaau

SEQ ID NO: 2355733 - RNA, 16 nt, Human
ugaccaaguuauaaau

SEQ ID NO: 2355734 - RNA, 13 nt, Human
ugaccaaguuaua

SEQ ID NO: 2355735 - RNA, 21 nt, Human
ugaccaagcaggaagcucaga

SEQ ID NO: 2355736 - RNA, 19 nt, Human
ugaccaagcaggaagcuca

SEQ ID NO: 2355737 - RNA, 18 nt, Human
ugaccaagcaggaagcuc

SEQ ID NO: 2355738 - RNA, 17 nt, Human
ugaccaagcaggaagcu

SEQ ID NO: 2355739 - RNA, 16 nt, Human
ugaccaagcaggaagc

SEQ ID NO: 2355740 - RNA, 15 nt, Human
ugaccaagcaggaag

SEQ ID NO: 2355741 - RNA, 18 nt, Human
ugaccaagagagaaagaa

SEQ ID NO: 2355742 - RNA, 17 nt, Human
ugaccaagagagaaaga

SEQ ID NO: 2355743 - RNA, 16 nt, Human
ugaccaagagagaaag

SEQ ID NO: 2355744 - RNA, 14 nt, Human
ugaccaagcaggaa

SEQ ID NO: 2355745 - RNA, 15 nt, Human
ugaccaagagagaaa

SEQ ID NO: 2355746 - RNA, 20 nt, Human
ugaccaacuagacauucugu

SEQ ID NO: 2355747 - RNA, 21 nt, Human
ugaccaacuagacauucuguc

SEQ ID NO: 2355748 - RNA, 22 nt, Human
ugaccaacuagacauucugucg

SEQ ID NO: 2355749 - RNA, 15 nt, Human
ugaccaacuagacau

SEQ ID NO: 2355750 - RNA, 16 nt, Human
ugaccaacuagacauu

SEQ ID NO: 2355751 - RNA, 18 nt, Human
ugaccaacuagacauucu

SEQ ID NO: 2355752 - RNA, 23 nt, Human
ugaccaacauggagaaacccugu

SEQ ID NO: 2355753 - RNA, 14 nt, Human
agauuaccuccuga

SEQ ID NO: 2355754 - RNA, 16 nt, Human
agauuacuuagaggaa

SEQ ID NO: 2355755 - RNA, 16 nt, Human
agauuaagagccauau

SEQ ID NO: 2355756 - RNA, 16 nt, Human
ugacuuagcagaugcu

SEQ ID NO: 2355757 - RNA, 20 nt, Human
ugacuuacuguacaugaaaa

SEQ ID NO: 2355758 - RNA, 12 nt, Human
ugacuuacugua

SEQ ID NO: 2355759 - RNA, 16 nt, Human
agauucauauuuacuu

SEQ ID NO: 2355760 - RNA, 13 nt, Human
agauucauauuua

SEQ ID NO: 2355761 - RNA, 18 nt, Human
agauucagguauguugcc

SEQ ID NO: 2355762 - RNA, 20 nt, Human
agauucagguauguugccuu

SEQ ID NO: 2355763 - RNA, 21 nt, Human
agauuacccccucauuguuua

SEQ ID NO: 2355764 - RNA, 15 nt, Human
agauuagaagcugaa

SEQ ID NO: 2355765 - RNA, 14 nt, Human
agauuagagggagg

SEQ ID NO: 2355766 - RNA, 15 nt, Human
agauuagaucuuuua

SEQ ID NO: 2355767 - RNA, 14 nt, Human
agauuagcucugga

SEQ ID NO: 2355768 - RNA, 15 nt, Human
agauuagcucuggac

SEQ ID NO: 2355769 - RNA, 17 nt, Human
agauuagcucuggacca

SEQ ID NO: 2355770 - RNA, 16 nt, Human
agauuagaucuuuuaa

SEQ ID NO: 2355771 - RNA, 21 nt, Human
agauuagaaugaaaauuguau

SEQ ID NO: 2355772 - RNA, 18 nt, Human
agauuagagggagguguu

SEQ ID NO: 2355773 - RNA, 14 nt, Human
agauuauacagaau

SEQ ID NO: 2355774 - RNA, 17 nt, Human
agauuauacagaauugu

SEQ ID NO: 2355775 - RNA, 13 nt, Human
agauuauaacuug

SEQ ID NO: 2355776 - RNA, 14 nt, Human
agauuauaacuugu

SEQ ID NO: 2355777 - RNA, 18 nt, Human
agauuauaacuugucuaa

SEQ ID NO: 2355778 - RNA, 13 nt, Human
agauucccagaga

SEQ ID NO: 2355779 - RNA, 12 nt, Human
agauucccagag

SEQ ID NO: 2355780 - RNA, 13 nt, Human
agauucccagagc

SEQ ID NO: 2355781 - RNA, 19 nt, Human
agauucauauuuacuucuu

SEQ ID NO: 2355782 - RNA, 21 nt, Human
agauuccagagaguggcuccu

SEQ ID NO: 2355783 - RNA, 22 nt, Human
agauuccagagaguggcuccuc

SEQ ID NO: 2355784 - RNA, 19 nt, Human
agauuccagagaguggcuc

SEQ ID NO: 2355785 - RNA, 19 nt, Human
agauucagguauguugccu

SEQ ID NO: 2355786 - RNA, 13 nt, Human
agauuguguaaca

SEQ ID NO: 2355787 - RNA, 15 nt, Human
agauuguguaacaau

SEQ ID NO: 2355788 - RNA, 21 nt, Human
agauuguguaacaauuuuaau

SEQ ID NO: 2355789 - RNA, 15 nt, Human
agauuguuaaaauaa

SEQ ID NO: 2355790 - RNA, 14 nt, Human
agauuguuaaaaua

SEQ ID NO: 2355791 - RNA, 14 nt, Human
agauucccagagac

SEQ ID NO: 2355792 - RNA, 16 nt, Human
agauucccagagcaaa

SEQ ID NO: 2355793 - RNA, 15 nt, Human
agauuguuguuugcc

SEQ ID NO: 2355794 - RNA, 16 nt, Human
agauuguuguuugcca

SEQ ID NO: 2355795 - RNA, 22 nt, Human
agauuguuguuugccauacuuu

SEQ ID NO: 2355796 - RNA, 23 nt, Human
agauuguuguuugccauacuuug

SEQ ID NO: 2355797 - RNA, 23 nt, Human
agauuguuuuaucaugacauguu

SEQ ID NO: 2355798 - RNA, 22 nt, Human
agauuguuuuaucaugacaugu

SEQ ID NO: 2355799 - RNA, 19 nt, Human
agauuuuaaauucacaaua

SEQ ID NO: 2355800 - RNA, 13 nt, Human
agauuuuaaauuc

SEQ ID NO: 2355801 - RNA, 22 nt, Human
agauuuuaaauucacaauagaa

SEQ ID NO: 2355802 - RNA, 19 nt, Human
agauuuuaaucaaguugaa

SEQ ID NO: 2355803 - RNA, 14 nt, Human
agauuuuaauuuug

SEQ ID NO: 2355804 - RNA, 17 nt, Human
agauuuuaauuuugaau

SEQ ID NO: 2355805 - RNA, 21 nt, Human
agauuuuaauuuugaauaaau

SEQ ID NO: 2355806 - RNA, 23 nt, Human
agauuucaucugcucuccuuccu

SEQ ID NO: 2355807 - RNA, 13 nt, Human
agauuuguguuau

SEQ ID NO: 2355808 - RNA, 12 nt, Human
agauuuuaaaga

SEQ ID NO: 2355809 - RNA, 17 nt, Human
agauuuuaaaaagucuu

SEQ ID NO: 2355810 - RNA, 17 nt, Human
agauuucacucuccuug

SEQ ID NO: 2355811 - RNA, 19 nt, Human
agauuucacucuccuuggu

SEQ ID NO: 2355812 - RNA, 13 nt, Human
agauuucaucugc

SEQ ID NO: 2355813 - RNA, 15 nt, Human
agauuucaucugcuc

SEQ ID NO: 2355814 - RNA, 18 nt, Human
agauuucaucugcucucc

SEQ ID NO: 2355815 - RNA, 19 nt, Human
agauuucaucugcucuccu

SEQ ID NO: 2355816 - RNA, 20 nt, Human
agauuucaucugcucuccuu

SEQ ID NO: 2355817 - RNA, 21 nt, Human
agauuucaucugcucuccuuc

SEQ ID NO: 2355818 - RNA, 16 nt, Human
ugaccuugcaacuuca

SEQ ID NO: 2355819 - RNA, 15 nt, Human
ugaccuuuaagagaa

SEQ ID NO: 2355820 - RNA, 12 nt, Human
ugaccugucacc

SEQ ID NO: 2355821 - RNA, 15 nt, Human
ugaccugucaugccc

SEQ ID NO: 2355822 - RNA, 16 nt, Human
ugaccugucaugcccc

SEQ ID NO: 2355823 - RNA, 19 nt, Human
ugaccugucaugccccccu

SEQ ID NO: 2355824 - RNA, 22 nt, Human
ugaccuggauaacuuagguggc

SEQ ID NO: 2355825 - RNA, 21 nt, Human
ugaccugccucccuucaugca

SEQ ID NO: 2355826 - RNA, 23 nt, Human
ugaccugccucccuucaugcaug

SEQ ID NO: 2355827 - RNA, 19 nt, Human
ugaccugccucccuucaug

SEQ ID NO: 2355828 - RNA, 17 nt, Human
ugaccugccucccuuca

SEQ ID NO: 2355829 - RNA, 21 nt, Human
ugaccugcuggguaaacugug

SEQ ID NO: 2355830 - RNA, 19 nt, Human
ugaccugccaggcacacug

SEQ ID NO: 2355831 - RNA, 16 nt, Human
ugaccugccaggcaca

SEQ ID NO: 2355832 - RNA, 19 nt, Human
ugaccugccccgcccagcu

SEQ ID NO: 2355833 - RNA, 13 nt, Human
ugaccugccccgc

SEQ ID NO: 2355834 - RNA, 20 nt, Human
ugaccugccccgcccagcug

SEQ ID NO: 2355835 - RNA, 16 nt, Human
ugaccugccucccuuc

SEQ ID NO: 2355836 - RNA, 17 nt, Human
agaugugauaaggauca

SEQ ID NO: 2355837 - RNA, 22 nt, Human
agaugugaacacaucagcuugc

SEQ ID NO: 2355838 - RNA, 15 nt, Human
agaugucuuuaggca

SEQ ID NO: 2355839 - RNA, 23 nt, Human
agaugucuuuaggcagcagcuuu

SEQ ID NO: 2355840 - RNA, 13 nt, Human
agaugucuuuagg

SEQ ID NO: 2355841 - RNA, 17 nt, Human
agaugugaacacaucag

SEQ ID NO: 2355842 - RNA, 22 nt, Human
agauguauguacuucaugcugu

SEQ ID NO: 2355843 - RNA, 19 nt, Human
agaugucuucugccuguua

SEQ ID NO: 2355844 - RNA, 20 nt, Human
ugacuauugaaguugcagau

SEQ ID NO: 2355845 - RNA, 22 nt, Human
ugacuaucaaacugaagccaga

SEQ ID NO: 2355846 - RNA, 16 nt, Human
ugacuaucaaacugaa

SEQ ID NO: 2355847 - RNA, 14 nt, Human
ugacuauauagaga

SEQ ID NO: 2355848 - RNA, 16 nt, Human
ugacuauauagagaug

SEQ ID NO: 2355849 - RNA, 17 nt, Human
ugacuauauagagaugu

SEQ ID NO: 2355850 - RNA, 18 nt, Human
ugacuauauagagauguu

SEQ ID NO: 2355851 - RNA, 19 nt, Human
ugacuauauagagauguuu

SEQ ID NO: 2355852 - RNA, 21 nt, Human
ugacuauauagagauguuuuu

SEQ ID NO: 2355853 - RNA, 12 nt, Human
ugaccuuucaau

SEQ ID NO: 2355854 - RNA, 21 nt, Human
ugaccuuguaccucucuuuga

SEQ ID NO: 2355855 - RNA, 13 nt, Human
ugaccuuucaaua

SEQ ID NO: 2355856 - RNA, 19 nt, Human
ugacuauuuuucagaaucu

SEQ ID NO: 2355857 - RNA, 14 nt, Human
ugacucgguuucuc

SEQ ID NO: 2355858 - RNA, 15 nt, Human
ugacucgguuucucc

SEQ ID NO: 2355859 - RNA, 16 nt, Human
ugacucgguuucucca

SEQ ID NO: 2355860 - RNA, 21 nt, Human
ugacucguauaugucucaggu

SEQ ID NO: 2355861 - RNA, 18 nt, Human
ugacucgguuucuccaaa

SEQ ID NO: 2355862 - RNA, 18 nt, Human
ugacucggggguggggaa

SEQ ID NO: 2355863 - RNA, 15 nt, Human
ugacucgucugacug

SEQ ID NO: 2355864 - RNA, 13 nt, Human
ugacucucaaauc

SEQ ID NO: 2355865 - RNA, 16 nt, Human
ugacucgucugacugu

SEQ ID NO: 2355866 - RNA, 20 nt, Human
ugacucgucugacugugugu

SEQ ID NO: 2355867 - RNA, 15 nt, Human
ugacucgugcugcau

SEQ ID NO: 2355868 - RNA, 15 nt, Human
ugacucucugugacc

SEQ ID NO: 2355869 - RNA, 13 nt, Human
ugacucucuguga

SEQ ID NO: 2355870 - RNA, 14 nt, Human
ugacucucaaaucu

SEQ ID NO: 2355871 - RNA, 11 nt, Human
ugacucugaaa

SEQ ID NO: 2355872 - RNA, 14 nt, Human
ugacucugaaaucu

SEQ ID NO: 2355873 - RNA, 15 nt, Human
ugacucugaaaucug

SEQ ID NO: 2355874 - RNA, 21 nt, Human
ugacuguuuucucuugagagg

SEQ ID NO: 2355875 - RNA, 17 nt, Human
ugacuguuuuuguagug

SEQ ID NO: 2355876 - RNA, 16 nt, Human
ugacuuaacugcauuu

SEQ ID NO: 2355877 - RNA, 18 nt, Human
ugacuguuuuuacccaua

SEQ ID NO: 2355878 - RNA, 16 nt, Human
ugacuguuuuuaccca

SEQ ID NO: 2355879 - RNA, 17 nt, Human
ugacuguuuuuacccau

SEQ ID NO: 2355880 - RNA, 16 nt, Human
ugacucugaaaucuga

SEQ ID NO: 2355881 - RNA, 15 nt, Human
ugacuguuuuuaccc

SEQ ID NO: 2355882 - RNA, 13 nt, Human
ucuauagacucua

SEQ ID NO: 2355883 - RNA, 17 nt, Human
ucuauagaacugaauga

SEQ ID NO: 2355884 - RNA, 20 nt, Human
ucuauaccugucuccuuucu

SEQ ID NO: 2355885 - RNA, 16 nt, Human
ucuauagacucuagga

SEQ ID NO: 2355886 - RNA, 17 nt, Human
ucuauagcaccagggcu

SEQ ID NO: 2355887 - RNA, 23 nt, Human
ucuaugggacucaaugcacugac

SEQ ID NO: 2355888 - RNA, 16 nt, Human
ucuauguauauacauu

SEQ ID NO: 2355889 - RNA, 19 nt, Human
ucuauguaaaugcaucugu

SEQ ID NO: 2355890 - RNA, 17 nt, Human
ucuaugugcuuguaaaa

SEQ ID NO: 2355891 - RNA, 22 nt, Human
ucuauguuuacaaauggacaua

SEQ ID NO: 2355892 - RNA, 13 nt, Human
ucuauucucucca

SEQ ID NO: 2355893 - RNA, 16 nt, Human
ucuauucuccagcuga

SEQ ID NO: 2355894 - RNA, 16 nt, Human
ucuauugauguacagu

SEQ ID NO: 2355895 - RNA, 13 nt, Human
ucuauugaaaaau

SEQ ID NO: 2355896 - RNA, 23 nt, Human
ucuauugcaguuauagaaaaucu

SEQ ID NO: 2355897 - RNA, 22 nt, Human
ucuauugacuucaaugauagua

SEQ ID NO: 2355898 - RNA, 20 nt, Human
ucuauugauguacagucugu

SEQ ID NO: 2355899 - RNA, 12 nt, Human
ucuauucagcuu

SEQ ID NO: 2355900 - RNA, 19 nt, Human
ucuauuauacuguauuaag

SEQ ID NO: 2355901 - RNA, 22 nt, Human
ucuauuauacuguauuaagagu

SEQ ID NO: 2355902 - RNA, 16 nt, Human
ucuauucagacaagca

SEQ ID NO: 2355903 - RNA, 14 nt, Human
ucuauuauacugua

SEQ ID NO: 2355904 - RNA, 15 nt, Human
ucuauuauacuguau

SEQ ID NO: 2355905 - RNA, 16 nt, Human
ucuauuaagauuucca

SEQ ID NO: 2355906 - RNA, 17 nt, Human
ucuauuaagauuuccaa

SEQ ID NO: 2355907 - RNA, 18 nt, Human
ucuauuaagauuuccaag

SEQ ID NO: 2355908 - RNA, 19 nt, Human
ucuauguauauacauuuau

SEQ ID NO: 2355909 - RNA, 18 nt, Human
ucuauuuauauguacaug

SEQ ID NO: 2355910 - RNA, 13 nt, Human
ucuauuuagcaug

SEQ ID NO: 2355911 - RNA, 13 nt, Human
ucuauuuauaugu

SEQ ID NO: 2355912 - RNA, 15 nt, Human
ucuauuuauuuacug

SEQ ID NO: 2355913 - RNA, 22 nt, Human
ucuauuuauuuacugagcuucu

SEQ ID NO: 2355914 - RNA, 15 nt, Human
ucuauuuauguuugc

SEQ ID NO: 2355915 - RNA, 13 nt, Human
ucuauuuauguuu

SEQ ID NO: 2355916 - RNA, 15 nt, Human
ucuauuuaaguaaaa

SEQ ID NO: 2355917 - RNA, 17 nt, Human
ucuauugcuggcaaaga

SEQ ID NO: 2355918 - RNA, 12 nt, Human
ucuauuuaauau

SEQ ID NO: 2355919 - RNA, 13 nt, Human
ucuauuuaauauu

SEQ ID NO: 2355920 - RNA, 22 nt, Human
ucuauugcuggcaaagacagaa

SEQ ID NO: 2355921 - RNA, 15 nt, Human
ucuauuuuggauugu

SEQ ID NO: 2355922 - RNA, 16 nt, Human
ucuauuuucauuuucu

SEQ ID NO: 2355923 - RNA, 16 nt, Human
ucuauuuggaauuuau

SEQ ID NO: 2355924 - RNA, 12 nt, Human
ucuauuuggaau

SEQ ID NO: 2355925 - RNA, 13 nt, Human
ucuauuuggaauu

SEQ ID NO: 2355926 - RNA, 19 nt, Human
ucucaccccaucccacacc

SEQ ID NO: 2355927 - RNA, 17 nt, Human
ucucaccccaucccaca

SEQ ID NO: 2355928 - RNA, 21 nt, Human
ucucaccccaucccacacccu

SEQ ID NO: 2355929 - RNA, 16 nt, Human
ucucaccgcagucguc

SEQ ID NO: 2355930 - RNA, 15 nt, Human
ucucaccccauccca

SEQ ID NO: 2355931 - RNA, 18 nt, Human
ucuauuuuggauuguaua

SEQ ID NO: 2355932 - RNA, 17 nt, Human
ucuauuuuguaaacuca

SEQ ID NO: 2355933 - RNA, 24 nt, Human
ucuauuuuguaacuuucucuauga

SEQ ID NO: 2355934 - RNA, 17 nt, Human
ucucacuauguugccca

SEQ ID NO: 2355935 - RNA, 19 nt, Human
ucucacuauguugcccagg

SEQ ID NO: 2355936 - RNA, 16 nt, Human
ucucacuauguugccc

SEQ ID NO: 2355937 - RNA, 12 nt, Human
acuuccccuccu

SEQ ID NO: 2355938 - RNA, 16 nt, Human
acuuccccuccuaccc

SEQ ID NO: 2355939 - RNA, 16 nt, Human
acuucaucccucuggg

SEQ ID NO: 2355940 - RNA, 17 nt, Human
acuucauagauuuccuu

SEQ ID NO: 2355941 - RNA, 18 nt, Human
acuucauauaugaggacu

SEQ ID NO: 2355942 - RNA, 22 nt, Human
acuucauauugcugagagaaau

SEQ ID NO: 2355943 - RNA, 14 nt, Human
acuucauauugcug

SEQ ID NO: 2355944 - RNA, 24 nt, Human
acuucauauugcugagagaaauau

SEQ ID NO: 2355945 - RNA, 19 nt, Human
acuuccccuuccuaauucc

SEQ ID NO: 2355946 - RNA, 13 nt, Human
acuuccccuuccu

SEQ ID NO: 2355947 - RNA, 20 nt, Human
acuucccgucccauauccug

SEQ ID NO: 2355948 - RNA, 17 nt, Human
acuuccccuccuacccc

SEQ ID NO: 2355949 - RNA, 21 nt, Human
acuuccccuccuaccccuccc

SEQ ID NO: 2355950 - RNA, 22 nt, Human
acuucccgucccauauccugcc

SEQ ID NO: 2355951 - RNA, 23 nt, Human
acuucccgucccauauccugccu

SEQ ID NO: 2355952 - RNA, 17 nt, Human
acuucccucaucucucc

SEQ ID NO: 2355953 - RNA, 14 nt, Human
acuucccucuguuu

SEQ ID NO: 2355954 - RNA, 17 nt, Human
ucuagacaacccugcaa

SEQ ID NO: 2355955 - RNA, 14 nt, Human
ucuagacacugcca

SEQ ID NO: 2355956 - RNA, 24 nt, Human
ucuagacucaagguucccagagau

SEQ ID NO: 2355957 - RNA, 13 nt, Human
ucuagacaacccu

SEQ ID NO: 2355958 - RNA, 19 nt, Human
ucuagaauuuuaagugcuu

SEQ ID NO: 2355959 - RNA, 14 nt, Human
acuucccugggcaa

SEQ ID NO: 2355960 - RNA, 20 nt, Human
acuucccucuguuucucuuu

SEQ ID NO: 2355961 - RNA, 13 nt, Human
acuucccugggca

SEQ ID NO: 2355962 - RNA, 22 nt, Human
acuucccugacacugcggggcu

SEQ ID NO: 2355963 - RNA, 20 nt, Human
ucuagagauaguacauaaag

SEQ ID NO: 2355964 - RNA, 16 nt, Human
ucuagagauaguacau

SEQ ID NO: 2355965 - RNA, 23 nt, Human
ucuagagagggaggcaagcccug

SEQ ID NO: 2355966 - RNA, 15 nt, Human
ucuagagcagggauu

SEQ ID NO: 2355967 - RNA, 13 nt, Human
ucuagagagggag

SEQ ID NO: 2355968 - RNA, 16 nt, Human
ucuagagaagaggcug

SEQ ID NO: 2355969 - RNA, 13 nt, Human
ucuagacuuucug

SEQ ID NO: 2355970 - RNA, 14 nt, Human
ucuagacuuucugu

SEQ ID NO: 2355971 - RNA, 15 nt, Human
ucuagacuuucuguu

SEQ ID NO: 2355972 - RNA, 13 nt, Human
ucuagagaagagg

SEQ ID NO: 2355973 - RNA, 20 nt, Human
ucuagagccgugaugccucc

SEQ ID NO: 2355974 - RNA, 17 nt, Human
ucuagagcuugaugcca

SEQ ID NO: 2355975 - RNA, 16 nt, Human
ucuagaggcuuccuuc

SEQ ID NO: 2355976 - RNA, 21 nt, Human
ucuagaggcuuccuucauuuc

SEQ ID NO: 2355977 - RNA, 13 nt, Human
ucuagauacugua

SEQ ID NO: 2355978 - RNA, 18 nt, Human
ucuagcauggcugccaau

SEQ ID NO: 2355979 - RNA, 15 nt, Human
ucuauaacaugcauu

SEQ ID NO: 2355980 - RNA, 16 nt, Human
ucuauaaauuguccgu

SEQ ID NO: 2355981 - RNA, 22 nt, Human
ucuauaaggccauaaaacaggu

SEQ ID NO: 2355982 - RNA, 16 nt, Human
ucuauaaggccauaaa

SEQ ID NO: 2355983 - RNA, 14 nt, Human
ucuauaaggccaua

SEQ ID NO: 2355984 - RNA, 13 nt, Human
ucuauaaggccau

SEQ ID NO: 2355985 - RNA, 20 nt, Human
ucuauaaagaagaacuugca

SEQ ID NO: 2355986 - RNA, 13 nt, Human
ucuauaaauaacc

SEQ ID NO: 2355987 - RNA, 18 nt, Human
ucuaguugcuuguaaaau

SEQ ID NO: 2355988 - RNA, 22 nt, Human
ucuaguuuaauuaaucuguaau

SEQ ID NO: 2355989 - RNA, 23 nt, Human
ucuaguuguuugauucagacagc

SEQ ID NO: 2355990 - RNA, 21 nt, Human
ucuaguuugauuaaauucuug

SEQ ID NO: 2355991 - RNA, 22 nt, Human
ucuaguuugauuaaauucuugc

SEQ ID NO: 2355992 - RNA, 14 nt, Human
ucuaguuucuugug

SEQ ID NO: 2355993 - RNA, 13 nt, Human
ucuaguuucccac

SEQ ID NO: 2355994 - RNA, 14 nt, Human
ucuaguuucccaca

SEQ ID NO: 2355995 - RNA, 22 nt, Human
ucuaguuguuugauucagacag

SEQ ID NO: 2355996 - RNA, 13 nt, Human
ucuaguucuuugu

SEQ ID NO: 2355997 - RNA, 12 nt, Human
ucuaggaagacu

SEQ ID NO: 2355998 - RNA, 13 nt, Human
ucuagccagagga

SEQ ID NO: 2355999 - RNA, 16 nt, Human
ucuaggaaauauuuau

SEQ ID NO: 2356000 - RNA, 16 nt, Human
ucuagccaaaugguuu

SEQ ID NO: 2356001 - RNA, 15 nt, Human
ucuaggaagaauuuu

SEQ ID NO: 2356002 - RNA, 23 nt, Human
ucuagccacuuuggucccgugca

SEQ ID NO: 2356003 - RNA, 20 nt, Human
ucuaggaagaauuuuaaaaa

SEQ ID NO: 2356004 - RNA, 22 nt, Human
ucuaggaagaauuuuaaaaaug

SEQ ID NO: 2356005 - RNA, 23 nt, Human
ucuaggaagaauuuuaaaaauga

SEQ ID NO: 2356006 - RNA, 17 nt, Human
ucuaggaaauauuuauu

SEQ ID NO: 2356007 - RNA, 18 nt, Human
acuguucccaccugcugg

SEQ ID NO: 2356008 - RNA, 16 nt, Human
acuguucccccugugc

SEQ ID NO: 2356009 - RNA, 15 nt, Human
acuguucccccugug

SEQ ID NO: 2356010 - RNA, 21 nt, Human
acuguuauuuauaaucacuuu

SEQ ID NO: 2356011 - RNA, 13 nt, Human
acuguucaagagc

SEQ ID NO: 2356012 - RNA, 15 nt, Human
acuguucaagagcac

SEQ ID NO: 2356013 - RNA, 16 nt, Human
acuguucaagagcaca

SEQ ID NO: 2356014 - RNA, 16 nt, Human
acuguucucugcccuc

SEQ ID NO: 2356015 - RNA, 17 nt, Human
acuguucucugcccucc

SEQ ID NO: 2356016 - RNA, 19 nt, Human
acuguucucugcccuccaa

SEQ ID NO: 2356017 - RNA, 18 nt, Human
acuguucccccugugcag

SEQ ID NO: 2356018 - RNA, 14 nt, Human
acuguuccagccug

SEQ ID NO: 2356019 - RNA, 15 nt, Human
acuguucccucugcu

SEQ ID NO: 2356020 - RNA, 18 nt, Human
acuguucucugcccucca

SEQ ID NO: 2356021 - RNA, 16 nt, Human
acuguucccucugcuc

SEQ ID NO: 2356022 - RNA, 18 nt, Human
acuguucccucugcuccu

SEQ ID NO: 2356023 - RNA, 13 nt, Human
acuguucuugaau

SEQ ID NO: 2356024 - RNA, 16 nt, Human
ucuacccagggccugc

SEQ ID NO: 2356025 - RNA, 13 nt, Human
ucuacccagggcc

SEQ ID NO: 2356026 - RNA, 21 nt, Human
ucuacccuggcacuauaaugu

SEQ ID NO: 2356027 - RNA, 20 nt, Human
acuguuauuuauaaucacuu

SEQ ID NO: 2356028 - RNA, 17 nt, Human
acuguuauuuauaauca

SEQ ID NO: 2356029 - RNA, 15 nt, Human
acuguuauuuauaau

SEQ ID NO: 2356030 - RNA, 14 nt, Human
acuguuauuuauaa

SEQ ID NO: 2356031 - RNA, 15 nt, Human
ucuaccucaggcagc

SEQ ID NO: 2356032 - RNA, 14 nt, Human
ucuacccuggcacu

SEQ ID NO: 2356033 - RNA, 19 nt, Human
ucuacccuggcacuauaau

SEQ ID NO: 2356034 - RNA, 20 nt, Human
ucuacccagcgagcccuggu

SEQ ID NO: 2356035 - RNA, 14 nt, Human
ucuacccaggugcu

SEQ ID NO: 2356036 - RNA, 23 nt, Human
uccugggagaaccucaggcuucc

SEQ ID NO: 2356037 - RNA, 13 nt, Human
uccugggaugugg

SEQ ID NO: 2356038 - RNA, 17 nt, Human
uccugggauguggcugc

SEQ ID NO: 2356039 - RNA, 18 nt, Human
uccugggauguggcugca

SEQ ID NO: 2356040 - RNA, 22 nt, Human
uccugggauguggcugcagcag

SEQ ID NO: 2356041 - RNA, 11 nt, Human
uccugggcaca

SEQ ID NO: 2356042 - RNA, 18 nt, Human
uccugggagugagcuggu

SEQ ID NO: 2356043 - RNA, 14 nt, Human
ucuaagguucucau

SEQ ID NO: 2356044 - RNA, 18 nt, Human
ucuaagguucucauagga

SEQ ID NO: 2356045 - RNA, 20 nt, Human
ucuaaguaaaaccacagcag

SEQ ID NO: 2356046 - RNA, 19 nt, Human
ucuaaguaaaaccacagca

SEQ ID NO: 2356047 - RNA, 15 nt, Human
ucuaaguaaaaccac

SEQ ID NO: 2356048 - RNA, 14 nt, Human
ucuaaguaaaacca

SEQ ID NO: 2356049 - RNA, 21 nt, Human
ucuacagaggccaugggccuc

SEQ ID NO: 2356050 - RNA, 14 nt, Human
ucuaauaccucugu

SEQ ID NO: 2356051 - RNA, 16 nt, Human
ucuaauaccucugugu

SEQ ID NO: 2356052 - RNA, 17 nt, Human
ucuaauaccucugugug

SEQ ID NO: 2356053 - RNA, 19 nt, Human
ucuacccagcgagcccugg

SEQ ID NO: 2356054 - RNA, 23 nt, Human
ucuacagcuaaucagcauucuca

SEQ ID NO: 2356055 - RNA, 19 nt, Human
ucuaauagaacucaguuuu

SEQ ID NO: 2356056 - RNA, 20 nt, Human
ucuaauaccucugugugcuc

SEQ ID NO: 2356057 - RNA, 20 nt, Human
ucuacagcuaaucagcauuc

SEQ ID NO: 2356058 - RNA, 17 nt, Human
acuuaugauuucaugug

SEQ ID NO: 2356059 - RNA, 16 nt, Human
acuuaugauuucaugu

SEQ ID NO: 2356060 - RNA, 13 nt, Human
acuuaugauuuca

SEQ ID NO: 2356061 - RNA, 23 nt, Human
acuuagggcaccagggguuucuc

SEQ ID NO: 2356062 - RNA, 23 nt, Human
acuuaugaccucuuccuuuagga

SEQ ID NO: 2356063 - RNA, 16 nt, Human
acuuagggcaccaggg

SEQ ID NO: 2356064 - RNA, 17 nt, Human
acuuaguauauuuucuu

SEQ ID NO: 2356065 - RNA, 15 nt, Human
acuuagguguggggg

SEQ ID NO: 2356066 - RNA, 20 nt, Human
acuuauuacugcuaaguauu

SEQ ID NO: 2356067 - RNA, 16 nt, Human
acuuauucucaagaag

SEQ ID NO: 2356068 - RNA, 14 nt, Human
acuuauuacugcua

SEQ ID NO: 2356069 - RNA, 16 nt, Human
acuuauuacugcuaag

SEQ ID NO: 2356070 - RNA, 19 nt, Human
acuuauuacugcuaaguau

SEQ ID NO: 2356071 - RNA, 22 nt, Human
acuuauuaaucuguaugaagau

SEQ ID NO: 2356072 - RNA, 22 nt, Human
acuucaggguucuccucucccc

SEQ ID NO: 2356073 - RNA, 21 nt, Human
acuucaggguucuccucuccc

SEQ ID NO: 2356074 - RNA, 23 nt, Human
acuucaggguucuccucuccccu

SEQ ID NO: 2356075 - RNA, 16 nt, Human
acuucaggggcugccc

SEQ ID NO: 2356076 - RNA, 17 nt, Human
acuucaggggcugcccg

SEQ ID NO: 2356077 - RNA, 19 nt, Human
acuucaggggcugcccgcu

SEQ ID NO: 2356078 - RNA, 22 nt, Human
acuucaggggcugcccgcuccc

SEQ ID NO: 2356079 - RNA, 23 nt, Human
acuucaguauguugucaaagaga

SEQ ID NO: 2356080 - RNA, 17 nt, Human
acuucaguauguuguca

SEQ ID NO: 2356081 - RNA, 19 nt, Human
acuucaguauguugucaaa

SEQ ID NO: 2356082 - RNA, 21 nt, Human
acuucaguauguugucaaaga

SEQ ID NO: 2356083 - RNA, 17 nt, Human
acuuacacuuuaugcac

SEQ ID NO: 2356084 - RNA, 22 nt, Human
acuuaauuucuuuauguaaucu

SEQ ID NO: 2356085 - RNA, 21 nt, Human
acuuaauuucuuuauguaauc

SEQ ID NO: 2356086 - RNA, 16 nt, Human
acuuacuguacaugaa

SEQ ID NO: 2356087 - RNA, 21 nt, Human
acuuacuguacaugaaaacac

SEQ ID NO: 2356088 - RNA, 21 nt, Human
acuuagcuugaaggaucuguu

SEQ ID NO: 2356089 - RNA, 22 nt, Human
acuuacuuacccucaccuguca

SEQ ID NO: 2356090 - RNA, 14 nt, Human
acuuagcugggaga

SEQ ID NO: 2356091 - RNA, 13 nt, Human
acuuacuugcuua

SEQ ID NO: 2356092 - RNA, 14 nt, Human
acuuacuugcuuau

SEQ ID NO: 2356093 - RNA, 16 nt, Human
acuuagcuaucagaag

SEQ ID NO: 2356094 - RNA, 22 nt, Human
acuuacuguacaugaaaacaca

SEQ ID NO: 2356095 - RNA, 12 nt, Human
acuuacaugauu

SEQ ID NO: 2356096 - RNA, 24 nt, Human
acuuacuguuguccuaugggaguc

SEQ ID NO: 2356097 - RNA, 13 nt, Human
acuuacuguuucu

SEQ ID NO: 2356098 - RNA, 16 nt, Human
acuuacuguuucuguc

SEQ ID NO: 2356099 - RNA, 20 nt, Human
acuuacuguuucugucagga

SEQ ID NO: 2356100 - RNA, 21 nt, Human
acuuacuguuucugucaggag

SEQ ID NO: 2356101 - RNA, 16 nt, Human
acuuacuuacccucac

SEQ ID NO: 2356102 - RNA, 13 nt, Human
acuuaagagaaua

SEQ ID NO: 2356103 - RNA, 14 nt, Human
acuuaagagaauau

SEQ ID NO: 2356104 - RNA, 15 nt, Human
acuuaagagaauauu

SEQ ID NO: 2356105 - RNA, 13 nt, Human
acuuaagcacacu

SEQ ID NO: 2356106 - RNA, 19 nt, Human
acuuaaucuaaauggaacc

SEQ ID NO: 2356107 - RNA, 17 nt, Human
acuuaaucuaaauggaa

SEQ ID NO: 2356108 - RNA, 16 nt, Human
acuuacacuuuaugca

SEQ ID NO: 2356109 - RNA, 14 nt, Human
acuuaauugcuaca

SEQ ID NO: 2356110 - RNA, 22 nt, Human
acuuaaucuaaauggaaccacu

SEQ ID NO: 2356111 - RNA, 18 nt, Human
acuuaagagaauauuuua

SEQ ID NO: 2356112 - RNA, 19 nt, Human
acuuaagagaauauuuuaa

SEQ ID NO: 2356113 - RNA, 13 nt, Human
acuuaaugaauga

SEQ ID NO: 2356114 - RNA, 14 nt, Human
acuguugccagaga

SEQ ID NO: 2356115 - RNA, 13 nt, Human
acuuaaaugaaag

SEQ ID NO: 2356116 - RNA, 18 nt, Human
acuguugccagagaugga

SEQ ID NO: 2356117 - RNA, 19 nt, Human
acuuaaauggaaaaaauga

SEQ ID NO: 2356118 - RNA, 20 nt, Human
acuuaaauaaugugaaacug

SEQ ID NO: 2356119 - RNA, 13 nt, Human
acuguugaaaauu

SEQ ID NO: 2356120 - RNA, 14 nt, Human
acuguugaaaauua

SEQ ID NO: 2356121 - RNA, 21 nt, Human
acuguugaaaauuauuuuaaa

SEQ ID NO: 2356122 - RNA, 23 nt, Human
acuguugaaaauuauuuuaaaca

SEQ ID NO: 2356123 - RNA, 15 nt, Human
acuuaacggcuccag

SEQ ID NO: 2356124 - RNA, 23 nt, Human
acuuaacuauucaggagaguaga

SEQ ID NO: 2356125 - RNA, 17 nt, Human
acuuaacggcuccagga

SEQ ID NO: 2356126 - RNA, 19 nt, Human
acuuaacggcuccaggauu

SEQ ID NO: 2356127 - RNA, 17 nt, Human
acuuaaauuuuaauuua

SEQ ID NO: 2356128 - RNA, 14 nt, Human
acuuaacagaugca

SEQ ID NO: 2356129 - RNA, 20 nt, Human
acuuaacaagcucccaggcc

SEQ ID NO: 2356130 - RNA, 15 nt, Human
acuuaacaagcuccc

SEQ ID NO: 2356131 - RNA, 21 nt, Human
acuuaacagaugcaaugugcu

SEQ ID NO: 2356132 - RNA, 14 nt, Human
acuuaacauauuua

SEQ ID NO: 2356133 - RNA, 11 nt, Human
acuuuguucac

SEQ ID NO: 2356134 - RNA, 21 nt, Human
acuuuuuaaaaucuuuucuau

SEQ ID NO: 2356135 - RNA, 18 nt, Human
acuuuuuaaauguaaaga

SEQ ID NO: 2356136 - RNA, 11 nt, Human
acuuuuuacaa

SEQ ID NO: 2356137 - RNA, 19 nt, Human
acuuuuuaacuauuaagag

SEQ ID NO: 2356138 - RNA, 18 nt, Human
acuuuuuaauucaccaaa

SEQ ID NO: 2356139 - RNA, 23 nt, Human
acuuuuguucuugguuuguaaau

SEQ ID NO: 2356140 - RNA, 15 nt, Human
acuuuuguucuuggu

SEQ ID NO: 2356141 - RNA, 21 nt, Human
acuuuuuauauuuuauacauu

SEQ ID NO: 2356142 - RNA, 12 nt, Human
agaaaaaagaag

SEQ ID NO: 2356143 - RNA, 18 nt, Human
agaaaaaagagaaaagaa

SEQ ID NO: 2356144 - RNA, 17 nt, Human
agaaaaaagagaaaaga

SEQ ID NO: 2356145 - RNA, 14 nt, Human
agaaaaaaguugua

SEQ ID NO: 2356146 - RNA, 12 nt, Human
agaaaaaaguug

SEQ ID NO: 2356147 - RNA, 10 nt, Human
agaaaaaagu

SEQ ID NO: 2356148 - RNA, 17 nt, Human
acuuuuuauauuuuaua

SEQ ID NO: 2356149 - RNA, 18 nt, Human
ucuccuuagucuucucau

SEQ ID NO: 2356150 - RNA, 22 nt, Human
agaaaaaauacauuuuauauua

SEQ ID NO: 2356151 - RNA, 17 nt, Human
ucuccuuagucuucuca

SEQ ID NO: 2356152 - RNA, 19 nt, Human
ucuccuuguggccugggcc

SEQ ID NO: 2356153 - RNA, 16 nt, Human
ucuccuucaccuuugu

SEQ ID NO: 2356154 - RNA, 21 nt, Human
ucuccuuguguuacuaaguuu

SEQ ID NO: 2356155 - RNA, 13 nt, Human
ucuccuuguguua

SEQ ID NO: 2356156 - RNA, 17 nt, Human
agaaaaaauauuuuccc

SEQ ID NO: 2356157 - RNA, 11 nt, Human
agaaaaaauac

SEQ ID NO: 2356158 - RNA, 18 nt, Human
agaaaaaauaacacacau

SEQ ID NO: 2356159 - RNA, 18 nt, Human
agaaaaaauacauuuuau

SEQ ID NO: 2356160 - RNA, 16 nt, Human
agaaaaaauacauuuu

SEQ ID NO: 2356161 - RNA, 14 nt, Human
agaaaaaauacauu

SEQ ID NO: 2356162 - RNA, 14 nt, Human
ucuccuucaccuuu

SEQ ID NO: 2356163 - RNA, 15 nt, Human
ucuccuucaccuuug

SEQ ID NO: 2356164 - RNA, 15 nt, Human
acuuuggaauacauu

SEQ ID NO: 2356165 - RNA, 13 nt, Human
acuuugaccucug

SEQ ID NO: 2356166 - RNA, 12 nt, Human
acuuugaccucu

SEQ ID NO: 2356167 - RNA, 18 nt, Human
acuuuggaauacauuucu

SEQ ID NO: 2356168 - RNA, 23 nt, Human
acuuuggaguccccucaccuccu

SEQ ID NO: 2356169 - RNA, 18 nt, Human
acuuuggaguccccucac

SEQ ID NO: 2356170 - RNA, 22 nt, Human
acuuuggaguccccucaccucc

SEQ ID NO: 2356171 - RNA, 13 nt, Human
acuuuuguucuug

SEQ ID NO: 2356172 - RNA, 12 nt, Human
acuuuuguucuu

SEQ ID NO: 2356173 - RNA, 21 nt, Human
acuuuguuaguuucuccaagc

SEQ ID NO: 2356174 - RNA, 14 nt, Human
acuuuguucuggcu

SEQ ID NO: 2356175 - RNA, 18 nt, Human
acuuuguaccccccaacc

SEQ ID NO: 2356176 - RNA, 22 nt, Human
acuuuguaccccccaaccccug

SEQ ID NO: 2356177 - RNA, 20 nt, Human
acuuuguuaguuucuccaag

SEQ ID NO: 2356178 - RNA, 16 nt, Human
ucuccucauguucugc

SEQ ID NO: 2356179 - RNA, 15 nt, Human
ucuccucaucucuaa

SEQ ID NO: 2356180 - RNA, 14 nt, Human
ucuccucaucucua

SEQ ID NO: 2356181 - RNA, 20 nt, Human
ucuccucagccuccucaucu

SEQ ID NO: 2356182 - RNA, 22 nt, Human
ucuccucagccuccucaucugg

SEQ ID NO: 2356183 - RNA, 13 nt, Human
ucuccucagccuc

SEQ ID NO: 2356184 - RNA, 14 nt, Human
ucuccucagccucc

SEQ ID NO: 2356185 - RNA, 23 nt, Human
ucuccucacucccuucuaccugc

SEQ ID NO: 2356186 - RNA, 17 nt, Human
ucuccgaccagacaccu

SEQ ID NO: 2356187 - RNA, 23 nt, Human
ucuccgaccagacaccuugacag

SEQ ID NO: 2356188 - RNA, 15 nt, Human
ucucccuuucccuuc

SEQ ID NO: 2356189 - RNA, 15 nt, Human
ucuccccagguccag

SEQ ID NO: 2356190 - RNA, 19 nt, Human
ucuccccagcccagagaca

SEQ ID NO: 2356191 - RNA, 18 nt, Human
ucuccccagcccagagac

SEQ ID NO: 2356192 - RNA, 12 nt, Human
ucuccccagagu

SEQ ID NO: 2356193 - RNA, 20 nt, Human
ucuccccaggguucaguccu

SEQ ID NO: 2356194 - RNA, 17 nt, Human
ucuccccagcccagaga

SEQ ID NO: 2356195 - RNA, 16 nt, Human
ucuccccagcccagag

SEQ ID NO: 2356196 - RNA, 15 nt, Human
ucuccccagcccaga

SEQ ID NO: 2356197 - RNA, 14 nt, Human
ucuccccagcccag

SEQ ID NO: 2356198 - RNA, 22 nt, Human
ucuccacacacagcugggcugu

SEQ ID NO: 2356199 - RNA, 23 nt, Human
ucuccaagugccagaggugggca

SEQ ID NO: 2356200 - RNA, 16 nt, Human
ucuccaauaucagugc

SEQ ID NO: 2356201 - RNA, 17 nt, Human
ucuccaagucucagugg

SEQ ID NO: 2356202 - RNA, 14 nt, Human
ucuccaagugccag

SEQ ID NO: 2356203 - RNA, 20 nt, Human
ucuccaagugccagaggugg

SEQ ID NO: 2356204 - RNA, 21 nt, Human
ucuccaagugccagagguggg

SEQ ID NO: 2356205 - RNA, 14 nt, Human
ucuccaaggaccag

SEQ ID NO: 2356206 - RNA, 16 nt, Human
ucuccaaggaccaggu

SEQ ID NO: 2356207 - RNA, 16 nt, Human
ucuccaagggcuucug

SEQ ID NO: 2356208 - RNA, 20 nt, Human
ucuccaagggcuucugcacc

SEQ ID NO: 2356209 - RNA, 21 nt, Human
ucuccaagggcuucugcaccc

SEQ ID NO: 2356210 - RNA, 22 nt, Human
ucuccaagggcuucugcacccu

SEQ ID NO: 2356211 - RNA, 23 nt, Human
ucuccaagggcuucugcacccuc

SEQ ID NO: 2356212 - RNA, 18 nt, Human
ucuccaagcaggacaugg

SEQ ID NO: 2356213 - RNA, 19 nt, Human
ucuccaagcaggacaugga

SEQ ID NO: 2356214 - RNA, 18 nt, Human
ucuccaccaggaaccucu

SEQ ID NO: 2356215 - RNA, 16 nt, Human
ucuccaccaggaaccu

SEQ ID NO: 2356216 - RNA, 18 nt, Human
ucuccaauaucagugcuc

SEQ ID NO: 2356217 - RNA, 19 nt, Human
ucuccacagcaaccccagg

SEQ ID NO: 2356218 - RNA, 14 nt, Human
ucuccacagcaacc

SEQ ID NO: 2356219 - RNA, 12 nt, Human
ucuccacccugc

SEQ ID NO: 2356220 - RNA, 23 nt, Human
ucuccccagcaagugagagcugg

SEQ ID NO: 2356221 - RNA, 19 nt, Human
ucuccacccccagcugcuu

SEQ ID NO: 2356222 - RNA, 14 nt, Human
ucuccacccuccca

SEQ ID NO: 2356223 - RNA, 23 nt, Human
ucuccacccucccagaccugccu

SEQ ID NO: 2356224 - RNA, 22 nt, Human
ucuccccacacuaaccuggguu

SEQ ID NO: 2356225 - RNA, 19 nt, Human
acuuucuguugccacaacc

SEQ ID NO: 2356226 - RNA, 19 nt, Human
acuuucuguaaacucaaaa

SEQ ID NO: 2356227 - RNA, 13 nt, Human
acuuucugccugg

SEQ ID NO: 2356228 - RNA, 14 nt, Human
acuuucugccugga

SEQ ID NO: 2356229 - RNA, 14 nt, Human
acuuucuguaaacu

SEQ ID NO: 2356230 - RNA, 18 nt, Human
acuuucuguaaacucaaa

SEQ ID NO: 2356231 - RNA, 12 nt, Human
acuuuaccuuuu

SEQ ID NO: 2356232 - RNA, 15 nt, Human
acuuuacaugacaca

SEQ ID NO: 2356233 - RNA, 17 nt, Human
acuuuacaugacacagc

SEQ ID NO: 2356234 - RNA, 18 nt, Human
acuuuacaugacacagcu

SEQ ID NO: 2356235 - RNA, 20 nt, Human
acuuuacaugacacagcuuu

SEQ ID NO: 2356236 - RNA, 15 nt, Human
acuuuaccaccccca

SEQ ID NO: 2356237 - RNA, 16 nt, Human
acuuuaccacccccac

SEQ ID NO: 2356238 - RNA, 17 nt, Human
acuuuacccaaaaacua

SEQ ID NO: 2356239 - RNA, 14 nt, Human
acuuucugaaauaa

SEQ ID NO: 2356240 - RNA, 20 nt, Human
acuuucugaaauaacauggc

SEQ ID NO: 2356241 - RNA, 18 nt, Human
ucuccuccauacucagga

SEQ ID NO: 2356242 - RNA, 17 nt, Human
ucuccuccauacucagg

SEQ ID NO: 2356243 - RNA, 18 nt, Human
ucuccucaucucuaacag

SEQ ID NO: 2356244 - RNA, 19 nt, Human
ucuccuccaagacacugug

SEQ ID NO: 2356245 - RNA, 23 nt, Human
ucuccuccaagacacuguggacu

SEQ ID NO: 2356246 - RNA, 14 nt, Human
ucuccuccaccgcc

SEQ ID NO: 2356247 - RNA, 15 nt, Human
ucuccuccagaguca

SEQ ID NO: 2356248 - RNA, 15 nt, Human
ucuccucugcugcug

SEQ ID NO: 2356249 - RNA, 16 nt, Human
ucuccucugcugcugg

SEQ ID NO: 2356250 - RNA, 17 nt, Human
ucuccucugcugcuggc

SEQ ID NO: 2356251 - RNA, 18 nt, Human
ucuccucugcugcuggcu

SEQ ID NO: 2356252 - RNA, 16 nt, Human
ucuccuccaugggaga

SEQ ID NO: 2356253 - RNA, 20 nt, Human
acuuuaauuaccaaccuguu

SEQ ID NO: 2356254 - RNA, 22 nt, Human
acuuuaauuaccaaccuguuac

SEQ ID NO: 2356255 - RNA, 20 nt, Human
ucuccuccaccgccauggcu

SEQ ID NO: 2356256 - RNA, 19 nt, Human
acuuuaauucucaugugau

SEQ ID NO: 2356257 - RNA, 23 nt, Human
acuuuaauucucaugugauccuu

SEQ ID NO: 2356258 - RNA, 19 nt, Human
acuuuacaauguucauccc

SEQ ID NO: 2356259 - RNA, 20 nt, Human
acuuuacaauguucauccca

SEQ ID NO: 2356260 - RNA, 21 nt, Human
ucucaggccaccugcccccuu

SEQ ID NO: 2356261 - RNA, 16 nt, Human
ucucaggccaucauca

SEQ ID NO: 2356262 - RNA, 20 nt, Human
ucucaugccucagccuccug

SEQ ID NO: 2356263 - RNA, 21 nt, Human
ucucaggccagcugcuugggc

SEQ ID NO: 2356264 - RNA, 17 nt, Human
ucucaggccagcugcuu

SEQ ID NO: 2356265 - RNA, 18 nt, Human
ucucaggccagcugcuug

SEQ ID NO: 2356266 - RNA, 20 nt, Human
ucucauggagaagcagaaau

SEQ ID NO: 2356267 - RNA, 21 nt, Human
ucucaugccucagccuccuga

SEQ ID NO: 2356268 - RNA, 22 nt, Human
ucucauggagaagcagaaauac

SEQ ID NO: 2356269 - RNA, 15 nt, Human
ucucauggagaaguu

SEQ ID NO: 2356270 - RNA, 16 nt, Human
ucucauggagaaguua

SEQ ID NO: 2356271 - RNA, 18 nt, Human
ucucauguaucaucugga

SEQ ID NO: 2356272 - RNA, 14 nt, Human
ucucaugugauccu

SEQ ID NO: 2356273 - RNA, 15 nt, Human
ucucaugugauccuu

SEQ ID NO: 2356274 - RNA, 20 nt, Human
ucucauuggacccuuccaug

SEQ ID NO: 2356275 - RNA, 19 nt, Human
ucucauguuuucaacugcc

SEQ ID NO: 2356276 - RNA, 18 nt, Human
ucucauguuuuccauugu

SEQ ID NO: 2356277 - RNA, 18 nt, Human
ucucauguuuucaacugc

SEQ ID NO: 2356278 - RNA, 23 nt, Human
ucucaugugauccuuuuauguua

SEQ ID NO: 2356279 - RNA, 17 nt, Human
ucucauguuuucaacug

SEQ ID NO: 2356280 - RNA, 21 nt, Human
ucucaugugugcucuucuucu

SEQ ID NO: 2356281 - RNA, 16 nt, Human
ucucaugugauccuuu

SEQ ID NO: 2356282 - RNA, 17 nt, Human
ucucaugugauccuuuu

SEQ ID NO: 2356283 - RNA, 18 nt, Human
ucucaugugauccuuuua

SEQ ID NO: 2356284 - RNA, 19 nt, Human
ucucaugugauccuuuuau

SEQ ID NO: 2356285 - RNA, 16 nt, Human
ucucauuugucacaca

SEQ ID NO: 2356286 - RNA, 13 nt, Human
ucuccaaaauaaa

SEQ ID NO: 2356287 - RNA, 15 nt, Human
ucuccaagcaggaca

SEQ ID NO: 2356288 - RNA, 16 nt, Human
ucuccaagcaggacau

SEQ ID NO: 2356289 - RNA, 14 nt, Human
ucucauuugucaca

SEQ ID NO: 2356290 - RNA, 19 nt, Human
ucucauuugccaauaauaa

SEQ ID NO: 2356291 - RNA, 19 nt, Human
ucucauuucaccccucccu

SEQ ID NO: 2356292 - RNA, 22 nt, Human
ucucauuucaccccucccuuuc

SEQ ID NO: 2356293 - RNA, 16 nt, Human
ucucauuucaccccuc

SEQ ID NO: 2356294 - RNA, 17 nt, Human
ucucauuucaccccucc

SEQ ID NO: 2356295 - RNA, 16 nt, Human
ucucauuuaauccucu

SEQ ID NO: 2356296 - RNA, 18 nt, Human
ucucauuuagaacuugca

SEQ ID NO: 2356297 - RNA, 15 nt, Human
ucucauuuccaagca

SEQ ID NO: 2356298 - RNA, 15 nt, Human
ucucaggagcauggg

SEQ ID NO: 2356299 - RNA, 20 nt, Human
ucucaggagcacaggcagcu

SEQ ID NO: 2356300 - RNA, 23 nt, Human
ucucaggagcacaggcagcugga

SEQ ID NO: 2356301 - RNA, 15 nt, Human
ucucaggagcacagg

SEQ ID NO: 2356302 - RNA, 16 nt, Human
ucucaggagcacaggc

SEQ ID NO: 2356303 - RNA, 18 nt, Human
ucucaggagcacaggcag

SEQ ID NO: 2356304 - RNA, 19 nt, Human
ucucaggagcacaggcagc

SEQ ID NO: 2356305 - RNA, 16 nt, Human
ucucaggaccuaggga

SEQ ID NO: 2356306 - RNA, 14 nt, Human
ucucaggagcacag

SEQ ID NO: 2356307 - RNA, 21 nt, Human
ucucaggaccuagggauguuc

SEQ ID NO: 2356308 - RNA, 23 nt, Human
ucucaggaccaaagcuuucaugu

SEQ ID NO: 2356309 - RNA, 20 nt, Human
ucucaggaucaagaaagugu

SEQ ID NO: 2356310 - RNA, 22 nt, Human
ucucaggauccccucucuuccu

SEQ ID NO: 2356311 - RNA, 10 nt, Human
ucucaggcca

SEQ ID NO: 2356312 - RNA, 19 nt, Human
ucucaggccaccugccccc

SEQ ID NO: 2356313 - RNA, 18 nt, Human
ucucaggccaccugcccc

SEQ ID NO: 2356314 - RNA, 13 nt, Human
ucucaggccaccu

SEQ ID NO: 2356315 - RNA, 21 nt, Human
ucucaggcaugccugugugac

SEQ ID NO: 2356316 - RNA, 20 nt, Human
ucucaggcaugccuguguga

SEQ ID NO: 2356317 - RNA, 18 nt, Human
ucucaggcaugccugugu

SEQ ID NO: 2356318 - RNA, 20 nt, Human
ucucaggcaugaacauguac

SEQ ID NO: 2356319 - RNA, 12 nt, Human
ucucaggccaaa

SEQ ID NO: 2356320 - RNA, 12 nt, Human
ucucaggccagc

SEQ ID NO: 2356321 - RNA, 13 nt, Human
ucucaggccagcu

SEQ ID NO: 2356322 - RNA, 11 nt, Human
ucucagccucc

SEQ ID NO: 2356323 - RNA, 23 nt, Human
ucucaggaaaucaaauaugcaaa

SEQ ID NO: 2356324 - RNA, 21 nt, Human
ucucaggaaaucaaauaugca

SEQ ID NO: 2356325 - RNA, 14 nt, Human
ucucaggaaaucaa

SEQ ID NO: 2356326 - RNA, 21 nt, Human
ucucagcaaugauuacucuuu

SEQ ID NO: 2356327 - RNA, 21 nt, Human
ucucagccgcuucugacugcu

SEQ ID NO: 2356328 - RNA, 15 nt, Human
ucucagccaacgagu

SEQ ID NO: 2356329 - RNA, 16 nt, Human
acuugucuuuuucugg

SEQ ID NO: 2356330 - RNA, 18 nt, Human
ucucagcagcgaccaccc

SEQ ID NO: 2356331 - RNA, 23 nt, Human
ucucagcagcgaccaccccugcc

SEQ ID NO: 2356332 - RNA, 18 nt, Human
acuugcuguuuuguucug

SEQ ID NO: 2356333 - RNA, 23 nt, Human
acuugcugccugaagaacaguaa

SEQ ID NO: 2356334 - RNA, 17 nt, Human
acuugcugccugaagaa

SEQ ID NO: 2356335 - RNA, 22 nt, Human
acuugcugcaguaugaaaauaa

SEQ ID NO: 2356336 - RNA, 16 nt, Human
acuugcuuauuugaca

SEQ ID NO: 2356337 - RNA, 14 nt, Human
acuugcuuuuaaaa

SEQ ID NO: 2356338 - RNA, 13 nt, Human
acuugucaaagaa

SEQ ID NO: 2356339 - RNA, 22 nt, Human
acuugcuuuaugccuucuuauu

SEQ ID NO: 2356340 - RNA, 15 nt, Human
acuugucaauaaaau

SEQ ID NO: 2356341 - RNA, 18 nt, Human
acuuguauuauguguguu

SEQ ID NO: 2356342 - RNA, 19 nt, Human
acuuguauuauguguguuu

SEQ ID NO: 2356343 - RNA, 17 nt, Human
acuugucuuuuucugga

SEQ ID NO: 2356344 - RNA, 14 nt, Human
acuugucaaagaag

SEQ ID NO: 2356345 - RNA, 15 nt, Human
acuugucaaagaagg

SEQ ID NO: 2356346 - RNA, 18 nt, Human
acuugucaaagaagguuu

SEQ ID NO: 2356347 - RNA, 21 nt, Human
acuugucuuuggacccugagg

SEQ ID NO: 2356348 - RNA, 20 nt, Human
acuugucuuuggacccugag

SEQ ID NO: 2356349 - RNA, 18 nt, Human
acuugucuuuggacccug

SEQ ID NO: 2356350 - RNA, 15 nt, Human
acuugucuuuuucug

SEQ ID NO: 2356351 - RNA, 16 nt, Human
acuugucaaagaaggu

SEQ ID NO: 2356352 - RNA, 15 nt, Human
acuuguggacuaaaa

SEQ ID NO: 2356353 - RNA, 18 nt, Human
acuuguggacuaaaagau

SEQ ID NO: 2356354 - RNA, 19 nt, Human
acuuguggacuaaaagaua

SEQ ID NO: 2356355 - RNA, 20 nt, Human
acuuguggacuaaaagauau

SEQ ID NO: 2356356 - RNA, 19 nt, Human
acuuguggacacagcucuu

SEQ ID NO: 2356357 - RNA, 22 nt, Human
acuuguggacacagcucuucuc

SEQ ID NO: 2356358 - RNA, 23 nt, Human
acuugcagcugauguuggaagag

SEQ ID NO: 2356359 - RNA, 21 nt, Human
acuugcugcaguaugaaaaua

SEQ ID NO: 2356360 - RNA, 20 nt, Human
acuugcagcugauguuggaa

SEQ ID NO: 2356361 - RNA, 20 nt, Human
acuugcucuugaugccuggc

SEQ ID NO: 2356362 - RNA, 17 nt, Human
acuugcucuugaugccu

SEQ ID NO: 2356363 - RNA, 18 nt, Human
acuugcucuugaugccug

SEQ ID NO: 2356364 - RNA, 23 nt, Human
acuugcagacucuacagaggcca

SEQ ID NO: 2356365 - RNA, 16 nt, Human
acuugcucuugaugcc

SEQ ID NO: 2356366 - RNA, 19 nt, Human
acuugcagacucuacagag

SEQ ID NO: 2356367 - RNA, 22 nt, Human
acuugcagacucuacagaggcc

SEQ ID NO: 2356368 - RNA, 20 nt, Human
ucucacuauguugcccaggc

SEQ ID NO: 2356369 - RNA, 21 nt, Human
ucucacuauguugcccaggca

SEQ ID NO: 2356370 - RNA, 22 nt, Human
ucucacuauguugcccaggcag

SEQ ID NO: 2356371 - RNA, 23 nt, Human
ucucacuauguugcccaggcagg

SEQ ID NO: 2356372 - RNA, 16 nt, Human
acuugaugugccauuu

SEQ ID NO: 2356373 - RNA, 20 nt, Human
acuugaugugccauuuuaaa

SEQ ID NO: 2356374 - RNA, 19 nt, Human
acuugcacgcccaugugug

SEQ ID NO: 2356375 - RNA, 13 nt, Human
acuugcaccucug

SEQ ID NO: 2356376 - RNA, 21 nt, Human
acuugcaaccgucuguuaugc

SEQ ID NO: 2356377 - RNA, 23 nt, Human
acuugcaaaaagggucaguaugg

SEQ ID NO: 2356378 - RNA, 17 nt, Human
acuugcaaaaaggguca

SEQ ID NO: 2356379 - RNA, 18 nt, Human
acuugaugugccauuuua

SEQ ID NO: 2356380 - RNA, 19 nt, Human
acuugaugugccauuuuaa

SEQ ID NO: 2356381 - RNA, 11 nt, Human
agaauuauuua

SEQ ID NO: 2356382 - RNA, 20 nt, Human
agaauucaaacuggggccuc

SEQ ID NO: 2356383 - RNA, 13 nt, Human
agaauuccaagga

SEQ ID NO: 2356384 - RNA, 16 nt, Human
ucugggagaggauuuu

SEQ ID NO: 2356385 - RNA, 14 nt, Human
agaauuccaaggag

SEQ ID NO: 2356386 - RNA, 20 nt, Human
agaauuccaaggaguuccau

SEQ ID NO: 2356387 - RNA, 23 nt, Human
ucugggaggaauggacagacaga

SEQ ID NO: 2356388 - RNA, 19 nt, Human
ucugggaggaauggacaga

SEQ ID NO: 2356389 - RNA, 16 nt, Human
ucugggaguccccuuu

SEQ ID NO: 2356390 - RNA, 18 nt, Human
ucugggauaaguaaguuu

SEQ ID NO: 2356391 - RNA, 19 nt, Human
ucugggauucuacuuuaag

SEQ ID NO: 2356392 - RNA, 21 nt, Human
ucugggagggcagcagggcua

SEQ ID NO: 2356393 - RNA, 19 nt, Human
ucugggagggcagcagggc

SEQ ID NO: 2356394 - RNA, 13 nt, Human
ucugggagggcag

SEQ ID NO: 2356395 - RNA, 19 nt, Human
ucugggccaaguuccucua

SEQ ID NO: 2356396 - RNA, 16 nt, Human
ucugggccaaguuccu

SEQ ID NO: 2356397 - RNA, 12 nt, Human
ucugggccaagu

SEQ ID NO: 2356398 - RNA, 18 nt, Human
ucugggcaucuguucugg

SEQ ID NO: 2356399 - RNA, 19 nt, Human
ucugggcaucuguucuggu

SEQ ID NO: 2356400 - RNA, 19 nt, Human
ucugggcaggaccucagag

SEQ ID NO: 2356401 - RNA, 14 nt, Human
ucugggcaggacuc

SEQ ID NO: 2356402 - RNA, 20 nt, Human
ucugggcaggacucagcucc

SEQ ID NO: 2356403 - RNA, 21 nt, Human
ucugggcaggacucagcuccc

SEQ ID NO: 2356404 - RNA, 18 nt, Human
ucugggcaggaccucaga

SEQ ID NO: 2356405 - RNA, 14 nt, Human
ucugggcaggaccu

SEQ ID NO: 2356406 - RNA, 15 nt, Human
ucugggauucuacuu

SEQ ID NO: 2356407 - RNA, 21 nt, Human
ucugggcacugguaaucccaa

SEQ ID NO: 2356408 - RNA, 13 nt, Human
agaauuauauagg

SEQ ID NO: 2356409 - RNA, 22 nt, Human
agaauuauauagguugugcaaa

SEQ ID NO: 2356410 - RNA, 23 nt, Human
agaauuaacacaugauccugcaa

SEQ ID NO: 2356411 - RNA, 17 nt, Human
agaauuaaaaaugaaau

SEQ ID NO: 2356412 - RNA, 15 nt, Human
agaauuaacacauga

SEQ ID NO: 2356413 - RNA, 13 nt, Human
agaaugucaguau

SEQ ID NO: 2356414 - RNA, 13 nt, Human
agaauguauugua

SEQ ID NO: 2356415 - RNA, 14 nt, Human
agaauguauuguac

SEQ ID NO: 2356416 - RNA, 15 nt, Human
agaauguauuguacc

SEQ ID NO: 2356417 - RNA, 16 nt, Human
agaauguauuguaccu

SEQ ID NO: 2356418 - RNA, 17 nt, Human
agaauguauuguaccuu

SEQ ID NO: 2356419 - RNA, 21 nt, Human
agaauguauuguaccuuuuaa

SEQ ID NO: 2356420 - RNA, 22 nt, Human
agaauguauuguaccuuuuaac

SEQ ID NO: 2356421 - RNA, 23 nt, Human
agaauguauuguaccuuuuaaca

SEQ ID NO: 2356422 - RNA, 14 nt, Human
agaauguagccauu

SEQ ID NO: 2356423 - RNA, 12 nt, Human
agaauguauugu

SEQ ID NO: 2356424 - RNA, 15 nt, Human
agaauguaagaacua

SEQ ID NO: 2356425 - RNA, 16 nt, Human
agaauguaagaacuac

SEQ ID NO: 2356426 - RNA, 22 nt, Human
agaaucagucuauccacagaga

SEQ ID NO: 2356427 - RNA, 14 nt, Human
agaaucauacuuag

SEQ ID NO: 2356428 - RNA, 16 nt, Human
agaaucagugcaaaga

SEQ ID NO: 2356429 - RNA, 17 nt, Human
agaaucauaugauucug

SEQ ID NO: 2356430 - RNA, 20 nt, Human
agaaucauaugauucugcuu

SEQ ID NO: 2356431 - RNA, 21 nt, Human
agaaucauaugauucugcuuu

SEQ ID NO: 2356432 - RNA, 21 nt, Human
agaaucaugugaacccgggac

SEQ ID NO: 2356433 - RNA, 18 nt, Human
agaaucaugugaacccgg

SEQ ID NO: 2356434 - RNA, 22 nt, Human
agaaucauaugauucugcuuuu

SEQ ID NO: 2356435 - RNA, 21 nt, Human
agaauccaaacuuggauuuuu

SEQ ID NO: 2356436 - RNA, 18 nt, Human
agaauccaagugaacacu

SEQ ID NO: 2356437 - RNA, 16 nt, Human
agaauccaaacuugga

SEQ ID NO: 2356438 - RNA, 14 nt, Human
agaauccaaacuug

SEQ ID NO: 2356439 - RNA, 12 nt, Human
agaauccaaacu

SEQ ID NO: 2356440 - RNA, 14 nt, Human
agaauauuuuaagu

SEQ ID NO: 2356441 - RNA, 16 nt, Human
agaauauuuauuaccu

SEQ ID NO: 2356442 - RNA, 19 nt, Human
agaauauuuauuaccucug

SEQ ID NO: 2356443 - RNA, 13 nt, Human
agaaucagccuag

SEQ ID NO: 2356444 - RNA, 19 nt, Human
agaaucagucuauccacag

SEQ ID NO: 2356445 - RNA, 21 nt, Human
agaaucagucuauccacagag

SEQ ID NO: 2356446 - RNA, 22 nt, Human
agaauauuuauuaccucugaua

SEQ ID NO: 2356447 - RNA, 19 nt, Human
agaauauuuuaaguauugc

SEQ ID NO: 2356448 - RNA, 17 nt, Human
agaaucagaucauuuca

SEQ ID NO: 2356449 - RNA, 23 nt, Human
agaauauuagcuuuacuguuugu

SEQ ID NO: 2356450 - RNA, 12 nt, Human
agaauauucagg

SEQ ID NO: 2356451 - RNA, 13 nt, Human
agaauauucagga

SEQ ID NO: 2356452 - RNA, 15 nt, Human
agaauauucaggacu

SEQ ID NO: 2356453 - RNA, 11 nt, Human
agaauauuuau

SEQ ID NO: 2356454 - RNA, 15 nt, Human
agaauggggugcaug

SEQ ID NO: 2356455 - RNA, 19 nt, Human
agaaugggcaguuacaugc

SEQ ID NO: 2356456 - RNA, 18 nt, Human
agaauggggaucacagag

SEQ ID NO: 2356457 - RNA, 17 nt, Human
agaaugggcaguuacau

SEQ ID NO: 2356458 - RNA, 16 nt, Human
agaaugggcaguuaca

SEQ ID NO: 2356459 - RNA, 18 nt, Human
agaaucccuggcaaaggg

SEQ ID NO: 2356460 - RNA, 19 nt, Human
agaaucccaaauuugauug

SEQ ID NO: 2356461 - RNA, 22 nt, Human
agaauccacccauccuaccaau

SEQ ID NO: 2356462 - RNA, 18 nt, Human
agaaucccacuuucuaua

SEQ ID NO: 2356463 - RNA, 18 nt, Human
agaaucccaaauuugauu

SEQ ID NO: 2356464 - RNA, 17 nt, Human
agaaucccaaauuugau

SEQ ID NO: 2356465 - RNA, 15 nt, Human
agaaucccaaauuug

SEQ ID NO: 2356466 - RNA, 23 nt, Human
agaaugguugccuuaaagaaagu

SEQ ID NO: 2356467 - RNA, 21 nt, Human
agaaugguugccuuaaagaaa

SEQ ID NO: 2356468 - RNA, 21 nt, Human
agaauaagucauguuccuuca

SEQ ID NO: 2356469 - RNA, 21 nt, Human
agaauaaguuauugcaguuua

SEQ ID NO: 2356470 - RNA, 19 nt, Human
agaauaaguuauugcaguu

SEQ ID NO: 2356471 - RNA, 20 nt, Human
agaauaaguuauugcaguuu

SEQ ID NO: 2356472 - RNA, 14 nt, Human
agaauaauaagagg

SEQ ID NO: 2356473 - RNA, 23 nt, Human
agaauaauaugcugccaaauuuu

SEQ ID NO: 2356474 - RNA, 22 nt, Human
agaauaauaugcugccaaauuu

SEQ ID NO: 2356475 - RNA, 19 nt, Human
agaauacuguuaaaggaaa

SEQ ID NO: 2356476 - RNA, 12 nt, Human
agaauaaguuau

SEQ ID NO: 2356477 - RNA, 15 nt, Human
agaauaagucauguu

SEQ ID NO: 2356478 - RNA, 18 nt, Human
agaauaagucauguuccu

SEQ ID NO: 2356479 - RNA, 16 nt, Human
agaauaagagaaagaa

SEQ ID NO: 2356480 - RNA, 21 nt, Human
agaauaagagaaagaaaauga

SEQ ID NO: 2356481 - RNA, 22 nt, Human
agaauaagagagucauaaaccu

SEQ ID NO: 2356482 - RNA, 13 nt, Human
agaauaaguuauu

SEQ ID NO: 2356483 - RNA, 14 nt, Human
agaauaaguuauug

SEQ ID NO: 2356484 - RNA, 16 nt, Human
agaauaaguuauugca

SEQ ID NO: 2356485 - RNA, 17 nt, Human
agaauaaguuauugcag

SEQ ID NO: 2356486 - RNA, 12 nt, Human
agaauaaaauuu

SEQ ID NO: 2356487 - RNA, 14 nt, Human
agaauaaaauuuuu

SEQ ID NO: 2356488 - RNA, 17 nt, Human
agaauaaaauuuuuaau

SEQ ID NO: 2356489 - RNA, 12 nt, Human
agaauaaaauug

SEQ ID NO: 2356490 - RNA, 13 nt, Human
agaauaaaauugu

SEQ ID NO: 2356491 - RNA, 14 nt, Human
agaauaaaauugua

SEQ ID NO: 2356492 - RNA, 14 nt, Human
agaauaagagaaag

SEQ ID NO: 2356493 - RNA, 16 nt, Human
agaauacuuuucucuu

SEQ ID NO: 2356494 - RNA, 22 nt, Human
agaauagaaauaaaggauguga

SEQ ID NO: 2356495 - RNA, 20 nt, Human
agaauacuguuaaaggaaaa

SEQ ID NO: 2356496 - RNA, 14 nt, Human
agaauacuuuucuc

SEQ ID NO: 2356497 - RNA, 16 nt, Human
agaauagaugcugacu

SEQ ID NO: 2356498 - RNA, 17 nt, Human
agaauagccacauuugg

SEQ ID NO: 2356499 - RNA, 17 nt, Human
agaauauccaugaccua

SEQ ID NO: 2356500 - RNA, 11 nt, Human
agaauaucugg

SEQ ID NO: 2356501 - RNA, 19 nt, Human
agaauauccuacuucucca

SEQ ID NO: 2356502 - RNA, 21 nt, Human
agaauauuagcuuuacuguuu

SEQ ID NO: 2356503 - RNA, 20 nt, Human
agaauauuagcuuuacuguu

SEQ ID NO: 2356504 - RNA, 19 nt, Human
agaauauuagcuuuacugu

SEQ ID NO: 2356505 - RNA, 19 nt, Human
agaaguuaagcaacaucua

SEQ ID NO: 2356506 - RNA, 14 nt, Human
agaaguuacugaau

SEQ ID NO: 2356507 - RNA, 15 nt, Human
agaaguuacugaaug

SEQ ID NO: 2356508 - RNA, 23 nt, Human
agaaguuauuuucuacagugguu

SEQ ID NO: 2356509 - RNA, 12 nt, Human
agaagugugauu

SEQ ID NO: 2356510 - RNA, 14 nt, Human
agaagugugauugg

SEQ ID NO: 2356511 - RNA, 22 nt, Human
agaagugugauugggaauaaau

SEQ ID NO: 2356512 - RNA, 15 nt, Human
agaaguuaagcaaca

SEQ ID NO: 2356513 - RNA, 23 nt, Human
agaagugugauugggaauaaaua

SEQ ID NO: 2356514 - RNA, 23 nt, Human
agaagugggccaggacaggcccg

SEQ ID NO: 2356515 - RNA, 19 nt, Human
agaagugggccaggacagg

SEQ ID NO: 2356516 - RNA, 18 nt, Human
agaagugggccaggacag

SEQ ID NO: 2356517 - RNA, 17 nt, Human
agaagugggccaggaca

SEQ ID NO: 2356518 - RNA, 20 nt, Human
agaaguggggacagagcaga

SEQ ID NO: 2356519 - RNA, 21 nt, Human
agaaguuucugccgcagcccu

SEQ ID NO: 2356520 - RNA, 22 nt, Human
agaaguuucugccgcagcccug

SEQ ID NO: 2356521 - RNA, 23 nt, Human
agaaguuucugccgcagcccugc

SEQ ID NO: 2356522 - RNA, 20 nt, Human
agaaguuuuuguacuguaaa

SEQ ID NO: 2356523 - RNA, 21 nt, Human
agaaguuuuuguacuguaaag

SEQ ID NO: 2356524 - RNA, 22 nt, Human
agaaguuuuuguacuguaaaga

SEQ ID NO: 2356525 - RNA, 13 nt, Human
agaauaaaauguu

SEQ ID NO: 2356526 - RNA, 14 nt, Human
agaauaaaauguug

SEQ ID NO: 2356527 - RNA, 16 nt, Human
agaauaaaauguugaa

SEQ ID NO: 2356528 - RNA, 20 nt, Human
agaauaaaauguugaaaagu

SEQ ID NO: 2356529 - RNA, 13 nt, Human
agaaggcagccac

SEQ ID NO: 2356530 - RNA, 22 nt, Human
agaaggcaaguuucuagcuaga

SEQ ID NO: 2356531 - RNA, 13 nt, Human
agaaggccaagaa

SEQ ID NO: 2356532 - RNA, 22 nt, Human
agaaggcauaucagucucugag

SEQ ID NO: 2356533 - RNA, 15 nt, Human
agaaggcaaaaaugu

SEQ ID NO: 2356534 - RNA, 14 nt, Human
agaaggcaaaugac

SEQ ID NO: 2356535 - RNA, 20 nt, Human
agaaggcaaaugacuuugga

SEQ ID NO: 2356536 - RNA, 15 nt, Human
agaaggcaaaugacu

SEQ ID NO: 2356537 - RNA, 15 nt, Human
agaaggcagggaaag

SEQ ID NO: 2356538 - RNA, 14 nt, Human
agaaggccacaugu

SEQ ID NO: 2356539 - RNA, 11 nt, Human
agaaggcucuu

SEQ ID NO: 2356540 - RNA, 12 nt, Human
agaaggcucuuc

SEQ ID NO: 2356541 - RNA, 13 nt, Human
agaaggccaagag

SEQ ID NO: 2356542 - RNA, 17 nt, Human
agaaggccaagaggcug

SEQ ID NO: 2356543 - RNA, 18 nt, Human
agaaggcucuucugacua

SEQ ID NO: 2356544 - RNA, 23 nt, Human
agaaguggaccaggacaggacca

SEQ ID NO: 2356545 - RNA, 18 nt, Human
ucugcuuuccucuuccug

SEQ ID NO: 2356546 - RNA, 13 nt, Human
ucugcuuuccucu

SEQ ID NO: 2356547 - RNA, 12 nt, Human
ucugcuuuccuc

SEQ ID NO: 2356548 - RNA, 15 nt, Human
ucugcuuuauguugc

SEQ ID NO: 2356549 - RNA, 13 nt, Human
ucugcuuuccaca

SEQ ID NO: 2356550 - RNA, 15 nt, Human
ucugcucagcagcua

SEQ ID NO: 2356551 - RNA, 19 nt, Human
ucugcuuguuauuagagau

SEQ ID NO: 2356552 - RNA, 14 nt, Human
ucugcuuguguuaa

SEQ ID NO: 2356553 - RNA, 22 nt, Human
agacacacacacgcacgcacac

SEQ ID NO: 2356554 - RNA, 23 nt, Human
agacacacacacgcacgcacaca

SEQ ID NO: 2356555 - RNA, 16 nt, Human
agacacagggacuuga

SEQ ID NO: 2356556 - RNA, 19 nt, Human
agacacagggacuugaagu

SEQ ID NO: 2356557 - RNA, 20 nt, Human
agacacagggacuugaaguu

SEQ ID NO: 2356558 - RNA, 22 nt, Human
agacacagggacuugaaguugu

SEQ ID NO: 2356559 - RNA, 16 nt, Human
agacacaggcccggcu

SEQ ID NO: 2356560 - RNA, 12 nt, Human
agacacaggccc

SEQ ID NO: 2356561 - RNA, 13 nt, Human
agacacaggcccg

SEQ ID NO: 2356562 - RNA, 12 nt, Human
agacacacacac

SEQ ID NO: 2356563 - RNA, 22 nt, Human
agaauuuuaagugcuuuguaau

SEQ ID NO: 2356564 - RNA, 21 nt, Human
agaauuuuaagugcuuuguaa

SEQ ID NO: 2356565 - RNA, 13 nt, Human
agacacacacaca

SEQ ID NO: 2356566 - RNA, 14 nt, Human
agacacacacacgc

SEQ ID NO: 2356567 - RNA, 15 nt, Human
agacacacacacgca

SEQ ID NO: 2356568 - RNA, 12 nt, Human
agacacacauga

SEQ ID NO: 2356569 - RNA, 15 nt, Human
agacacacaugaagu

SEQ ID NO: 2356570 - RNA, 12 nt, Human
agacacagacug

SEQ ID NO: 2356571 - RNA, 16 nt, Human
agacacacacacgcac

SEQ ID NO: 2356572 - RNA, 18 nt, Human
agacacacacacgcacgc

SEQ ID NO: 2356573 - RNA, 20 nt, Human
agacacacacacgcacgcac

SEQ ID NO: 2356574 - RNA, 21 nt, Human
agacacacacacgcacgcaca

SEQ ID NO: 2356575 - RNA, 18 nt, Human
agaauuuuaaauuauaac

SEQ ID NO: 2356576 - RNA, 15 nt, Human
agaauuuuaaauuau

SEQ ID NO: 2356577 - RNA, 13 nt, Human
agaauuuuaaauu

SEQ ID NO: 2356578 - RNA, 21 nt, Human
agaauuuuaaaaaugaauccu

SEQ ID NO: 2356579 - RNA, 16 nt, Human
agaauuuuaagugcuu

SEQ ID NO: 2356580 - RNA, 12 nt, Human
agaauuuuaaaa

SEQ ID NO: 2356581 - RNA, 14 nt, Human
agaauuuuaaaaau

SEQ ID NO: 2356582 - RNA, 16 nt, Human
agaauuuuaaaaauga

SEQ ID NO: 2356583 - RNA, 17 nt, Human
agaauuuuaaaaaugaa

SEQ ID NO: 2356584 - RNA, 18 nt, Human
agaauuuuaaaaaugaau

SEQ ID NO: 2356585 - RNA, 19 nt, Human
agaauuuuaaaaaugaauc

SEQ ID NO: 2356586 - RNA, 20 nt, Human
agaauuuuaaaaaugaaucc

SEQ ID NO: 2356587 - RNA, 22 nt, Human
agaauugaucauuuucccccca

SEQ ID NO: 2356588 - RNA, 21 nt, Human
agaauugaucauuuucccccc

SEQ ID NO: 2356589 - RNA, 20 nt, Human
agaauugauauacacggaug

SEQ ID NO: 2356590 - RNA, 19 nt, Human
agaauugaacccaggaggu

SEQ ID NO: 2356591 - RNA, 18 nt, Human
agaauugaacccaggagg

SEQ ID NO: 2356592 - RNA, 22 nt, Human
agaauugaacccaggaggugga

SEQ ID NO: 2356593 - RNA, 16 nt, Human
agacacauaugagggg

SEQ ID NO: 2356594 - RNA, 14 nt, Human
agacacauaugagg

SEQ ID NO: 2356595 - RNA, 16 nt, Human
agacacauguccaaga

SEQ ID NO: 2356596 - RNA, 20 nt, Human
agacacauguccaagaagcc

SEQ ID NO: 2356597 - RNA, 19 nt, Human
agacacugaccauccacuc

SEQ ID NO: 2356598 - RNA, 20 nt, Human
agacaccugcaccucccccc

SEQ ID NO: 2356599 - RNA, 18 nt, Human
agacaccuugacagggca

SEQ ID NO: 2356600 - RNA, 21 nt, Human
agacaccugcaccucccccca

SEQ ID NO: 2356601 - RNA, 17 nt, Human
agacaccugcaccuccc

SEQ ID NO: 2356602 - RNA, 16 nt, Human
agacaccugcaccucc

SEQ ID NO: 2356603 - RNA, 14 nt, Human
agacaccugcaccu

SEQ ID NO: 2356604 - RNA, 17 nt, Human
agacaccuugacagggc

SEQ ID NO: 2356605 - RNA, 16 nt, Human
agacaggaccagggau

SEQ ID NO: 2356606 - RNA, 19 nt, Human
agacagagaccuccugccu

SEQ ID NO: 2356607 - RNA, 15 nt, Human
agacagagaggacug

SEQ ID NO: 2356608 - RNA, 20 nt, Human
agacagagaggacuguaggg

SEQ ID NO: 2356609 - RNA, 22 nt, Human
agacacuguuuacaagaaaaaa

SEQ ID NO: 2356610 - RNA, 20 nt, Human
agacacuguuuacaagaaaa

SEQ ID NO: 2356611 - RNA, 19 nt, Human
agacacuguuuacaagaaa

SEQ ID NO: 2356612 - RNA, 18 nt, Human
agacacuguuuacaagaa

SEQ ID NO: 2356613 - RNA, 18 nt, Human
agacacugguuuacacuu

SEQ ID NO: 2356614 - RNA, 20 nt, Human
agacacugguuuacacuuua

SEQ ID NO: 2356615 - RNA, 13 nt, Human
agacacuugccuu

SEQ ID NO: 2356616 - RNA, 16 nt, Human
agacagagaccuccug

SEQ ID NO: 2356617 - RNA, 21 nt, Human
agacagagaccuccugccucc

SEQ ID NO: 2356618 - RNA, 20 nt, Human
agacacuucuaaaugaagug

SEQ ID NO: 2356619 - RNA, 20 nt, Human
agacacugccacacaggguc

SEQ ID NO: 2356620 - RNA, 13 nt, Human
agacacuggcccc

SEQ ID NO: 2356621 - RNA, 15 nt, Human
agacacuggccccuc

SEQ ID NO: 2356622 - RNA, 16 nt, Human
agacacuggccccuca

SEQ ID NO: 2356623 - RNA, 18 nt, Human
agacacuggcugccagcu

SEQ ID NO: 2356624 - RNA, 20 nt, Human
agacacuggcugccagcuau

SEQ ID NO: 2356625 - RNA, 14 nt, Human
ucuguugucauugc

SEQ ID NO: 2356626 - RNA, 18 nt, Human
ucuguugucauugcuguu

SEQ ID NO: 2356627 - RNA, 15 nt, Human
ucuguuguccucccc

SEQ ID NO: 2356628 - RNA, 17 nt, Human
ucuguuguccuccccuu

SEQ ID NO: 2356629 - RNA, 19 nt, Human
ucuguuguccuccccuugg

SEQ ID NO: 2356630 - RNA, 18 nt, Human
ucuguuggcaggcuggcc

SEQ ID NO: 2356631 - RNA, 20 nt, Human
ucuguuggcaggcuggccag

SEQ ID NO: 2356632 - RNA, 17 nt, Human
ucuguuuaaaguagauu

SEQ ID NO: 2356633 - RNA, 21 nt, Human
ucuguuguccuccccuugggc

SEQ ID NO: 2356634 - RNA, 15 nt, Human
ucuguuuaauacuca

SEQ ID NO: 2356635 - RNA, 17 nt, Human
ucuguuuaauacucauc

SEQ ID NO: 2356636 - RNA, 14 nt, Human
ucuguuuacagugu

SEQ ID NO: 2356637 - RNA, 17 nt, Human
agaauugaacccaggag

SEQ ID NO: 2356638 - RNA, 16 nt, Human
agaauugaacccagga

SEQ ID NO: 2356639 - RNA, 13 nt, Human
agaauucuuucaa

SEQ ID NO: 2356640 - RNA, 17 nt, Human
agaauucuucaggugga

SEQ ID NO: 2356641 - RNA, 14 nt, Human
agaauucuuucaag

SEQ ID NO: 2356642 - RNA, 23 nt, Human
agaauucuuacauguuuucuuug

SEQ ID NO: 2356643 - RNA, 20 nt, Human
agaauucuuacauguuuucu

SEQ ID NO: 2356644 - RNA, 19 nt, Human
agaauucuuacauguuuuc

SEQ ID NO: 2356645 - RNA, 17 nt, Human
agaauucuuacauguuu

SEQ ID NO: 2356646 - RNA, 16 nt, Human
agaauucuuacauguu

SEQ ID NO: 2356647 - RNA, 23 nt, Human
ucuguuuaauacucauccuugua

SEQ ID NO: 2356648 - RNA, 20 nt, Human
ucuguuuacaucaguuuuaa

SEQ ID NO: 2356649 - RNA, 13 nt, Human
ucuguuuagauaa

SEQ ID NO: 2356650 - RNA, 16 nt, Human
ucuguugcccaggcug

SEQ ID NO: 2356651 - RNA, 18 nt, Human
ucuguugccacaacccug

SEQ ID NO: 2356652 - RNA, 15 nt, Human
ucuguugccaggcua

SEQ ID NO: 2356653 - RNA, 15 nt, Human
ucuguuggcaggcug

SEQ ID NO: 2356654 - RNA, 15 nt, Human
ucuguugcugccuca

SEQ ID NO: 2356655 - RNA, 12 nt, Human
ucuguuggccag

SEQ ID NO: 2356656 - RNA, 17 nt, Human
ucuguuggccaguguga

SEQ ID NO: 2356657 - RNA, 12 nt, Human
ucuguugaaguu

SEQ ID NO: 2356658 - RNA, 12 nt, Human
ucuguugcaaac

SEQ ID NO: 2356659 - RNA, 16 nt, Human
ucuguugcaagugcaa

SEQ ID NO: 2356660 - RNA, 22 nt, Human
ucuguucuuuccaaaguacacu

SEQ ID NO: 2356661 - RNA, 13 nt, Human
ucuguucuuucca

SEQ ID NO: 2356662 - RNA, 20 nt, Human
ucugugagcaucacaguuuu

SEQ ID NO: 2356663 - RNA, 20 nt, Human
ucugugaaaugcuggcauuu

SEQ ID NO: 2356664 - RNA, 17 nt, Human
ucugugaaaugcuggca

SEQ ID NO: 2356665 - RNA, 17 nt, Human
ucugugaacgauuuaga

SEQ ID NO: 2356666 - RNA, 21 nt, Human
ucugugaacgauuuagaaaga

SEQ ID NO: 2356667 - RNA, 14 nt, Human
ucugugagaugcua

SEQ ID NO: 2356668 - RNA, 22 nt, Human
ucugugagaugcuagaacuccc

SEQ ID NO: 2356669 - RNA, 17 nt, Human
ucugugagaugcuagaa

SEQ ID NO: 2356670 - RNA, 23 nt, Human
ucugugagaugcuagaacucccu

SEQ ID NO: 2356671 - RNA, 17 nt, Human
ucugugagacucgagaa

SEQ ID NO: 2356672 - RNA, 21 nt, Human
ucugugagacucgagaacuuu

SEQ ID NO: 2356673 - RNA, 17 nt, Human
ucugugagauucauuca

SEQ ID NO: 2356674 - RNA, 19 nt, Human
ucugugagauucauucaug

SEQ ID NO: 2356675 - RNA, 23 nt, Human
ucuguauuuuauuuagacaagag

SEQ ID NO: 2356676 - RNA, 20 nt, Human
ucugggcccggccauguccu

SEQ ID NO: 2356677 - RNA, 18 nt, Human
ucugggccaagucaaaga

SEQ ID NO: 2356678 - RNA, 18 nt, Human
ucugggcccccuccuccc

SEQ ID NO: 2356679 - RNA, 23 nt, Human
ucugggccaaguuccucuagugc

SEQ ID NO: 2356680 - RNA, 21 nt, Human
ucugggccauucuccacagca

SEQ ID NO: 2356681 - RNA, 15 nt, Human
ucugggccagaauuu

SEQ ID NO: 2356682 - RNA, 14 nt, Human
ucugggccagaauu

SEQ ID NO: 2356683 - RNA, 19 nt, Human
ucugucagaugggaagaca

SEQ ID NO: 2356684 - RNA, 18 nt, Human
ucugucagaugggaagac

SEQ ID NO: 2356685 - RNA, 17 nt, Human
ucugucacugcaggcac

SEQ ID NO: 2356686 - RNA, 16 nt, Human
ucugugaaaguacauu

SEQ ID NO: 2356687 - RNA, 22 nt, Human
ucugugaaaggaaagagggagg

SEQ ID NO: 2356688 - RNA, 13 nt, Human
ucugucacuuaau

SEQ ID NO: 2356689 - RNA, 14 nt, Human
ucugucaaugaaaa

SEQ ID NO: 2356690 - RNA, 15 nt, Human
ucugucacaccagcc

SEQ ID NO: 2356691 - RNA, 19 nt, Human
ucugucaccaauugguuaa

SEQ ID NO: 2356692 - RNA, 16 nt, Human
ucugucacccaggcug

SEQ ID NO: 2356693 - RNA, 17 nt, Human
ucugucacccaggcugg

SEQ ID NO: 2356694 - RNA, 13 nt, Human
ucugucaagaaga

SEQ ID NO: 2356695 - RNA, 23 nt, Human
ucugcuccacccuuggccugucu

SEQ ID NO: 2356696 - RNA, 21 nt, Human
ucugcuccacccuuggccugu

SEQ ID NO: 2356697 - RNA, 20 nt, Human
ucugcuccacccuuggccug

SEQ ID NO: 2356698 - RNA, 13 nt, Human
ucugcuucagccu

SEQ ID NO: 2356699 - RNA, 14 nt, Human
ucugcuucagccuc

SEQ ID NO: 2356700 - RNA, 15 nt, Human
ucugcuucagccucc

SEQ ID NO: 2356701 - RNA, 18 nt, Human
ucugcuugcucuuguccu

SEQ ID NO: 2356702 - RNA, 13 nt, Human
ucugcuucagugg

SEQ ID NO: 2356703 - RNA, 14 nt, Human
ucugcuucagugga

SEQ ID NO: 2356704 - RNA, 20 nt, Human
ucugcgugucaccugugcuu

SEQ ID NO: 2356705 - RNA, 19 nt, Human
ucugcgugucaccugugcu

SEQ ID NO: 2356706 - RNA, 15 nt, Human
ucugcgugucaccug

SEQ ID NO: 2356707 - RNA, 21 nt, Human
ucugcuaacuuggagccccag

SEQ ID NO: 2356708 - RNA, 17 nt, Human
ucugcucacauaucugu

SEQ ID NO: 2356709 - RNA, 19 nt, Human
ucugcucacauaucuguca

SEQ ID NO: 2356710 - RNA, 20 nt, Human
ucugcucacauaucugucau

SEQ ID NO: 2356711 - RNA, 19 nt, Human
ucugcuccacccuuggccu

SEQ ID NO: 2356712 - RNA, 18 nt, Human
ucugcuccacccuuggcc

SEQ ID NO: 2356713 - RNA, 17 nt, Human
ucugcuccacccuuggc

SEQ ID NO: 2356714 - RNA, 16 nt, Human
ucugcuccacccuugg

SEQ ID NO: 2356715 - RNA, 15 nt, Human
ucugcuccacccuug

SEQ ID NO: 2356716 - RNA, 14 nt, Human
ucugcuccacccuu

SEQ ID NO: 2356717 - RNA, 12 nt, Human
ucugcuccaccc

SEQ ID NO: 2356718 - RNA, 20 nt, Human
ucugcuccaccacauccucc

SEQ ID NO: 2356719 - RNA, 14 nt, Human
ucugcuccaccaca

SEQ ID NO: 2356720 - RNA, 12 nt, Human
ucugcuccacca

SEQ ID NO: 2356721 - RNA, 10 nt, Human
ucugcuccac

SEQ ID NO: 2356722 - RNA, 23 nt, Human
ucugcucaucauucucugucuca

SEQ ID NO: 2356723 - RNA, 14 nt, Human
ucugcucagcagcu

SEQ ID NO: 2356724 - RNA, 13 nt, Human
ucugcucagcagc

SEQ ID NO: 2356725 - RNA, 22 nt, Human
ucugcucagacagaaccccuac

SEQ ID NO: 2356726 - RNA, 17 nt, Human
ucugcgucaugcuugug

SEQ ID NO: 2356727 - RNA, 16 nt, Human
ucugcgucaugcuugu

SEQ ID NO: 2356728 - RNA, 22 nt, Human
ucugcgugguuccuuucucagc

SEQ ID NO: 2356729 - RNA, 15 nt, Human
ucugcgucuguguug

SEQ ID NO: 2356730 - RNA, 16 nt, Human
ucugcgugacaauaaa

SEQ ID NO: 2356731 - RNA, 12 nt, Human
ucugccuguccc

SEQ ID NO: 2356732 - RNA, 21 nt, Human
ucugccuggaguguaugacug

SEQ ID NO: 2356733 - RNA, 23 nt, Human
ucugccuggagacuuagggcacc

SEQ ID NO: 2356734 - RNA, 12 nt, Human
ucugccugcccc

SEQ ID NO: 2356735 - RNA, 14 nt, Human
ucugccugccccgc

SEQ ID NO: 2356736 - RNA, 12 nt, Human
ucugccuggagu

SEQ ID NO: 2356737 - RNA, 13 nt, Human
ucugccuggagug

SEQ ID NO: 2356738 - RNA, 21 nt, Human
ucugccugcccaggccccugc

SEQ ID NO: 2356739 - RNA, 22 nt, Human
ucugccugcccaggccccugcc

SEQ ID NO: 2356740 - RNA, 18 nt, Human
ucugccgcaauacaggaa

SEQ ID NO: 2356741 - RNA, 22 nt, Human
ucugccgcagcccugcagaggg

SEQ ID NO: 2356742 - RNA, 18 nt, Human
ucugcccugcccuagcuc

SEQ ID NO: 2356743 - RNA, 21 nt, Human
agaagccaagggaaaggggug

SEQ ID NO: 2356744 - RNA, 10 nt, Human
ucugcccugc

SEQ ID NO: 2356745 - RNA, 12 nt, Human
ucugcccugcgg

SEQ ID NO: 2356746 - RNA, 11 nt, Human
ucugcccugcg

SEQ ID NO: 2356747 - RNA, 14 nt, Human
ucugccgcagcccu

SEQ ID NO: 2356748 - RNA, 15 nt, Human
ucugccgcagcccug

SEQ ID NO: 2356749 - RNA, 18 nt, Human
ucugcccacucccugcaa

SEQ ID NO: 2356750 - RNA, 21 nt, Human
ucugcccacucccugcaaccu

SEQ ID NO: 2356751 - RNA, 18 nt, Human
ucugcccuccaagaccuu

SEQ ID NO: 2356752 - RNA, 19 nt, Human
ucugcccuccaagaccuuc

SEQ ID NO: 2356753 - RNA, 23 nt, Human
agaaauuccuugauucacaauga

SEQ ID NO: 2356754 - RNA, 23 nt, Human
agaaauuccuguagcaucuucug

SEQ ID NO: 2356755 - RNA, 16 nt, Human
agaaauuccuguagca

SEQ ID NO: 2356756 - RNA, 19 nt, Human
agaaauuccuguagcaucu

SEQ ID NO: 2356757 - RNA, 20 nt, Human
agaaauuccuguagcaucuu

SEQ ID NO: 2356758 - RNA, 17 nt, Human
agaaauugcauuuccug

SEQ ID NO: 2356759 - RNA, 20 nt, Human
agaaauugcauuuccugaca

SEQ ID NO: 2356760 - RNA, 22 nt, Human
agaacugccuuuggcagaguuc

SEQ ID NO: 2356761 - RNA, 23 nt, Human
agaacugcuuucuuucguuuguu

SEQ ID NO: 2356762 - RNA, 20 nt, Human
agaacuggacucaggaugcc

SEQ ID NO: 2356763 - RNA, 17 nt, Human
agaacuggacucaggau

SEQ ID NO: 2356764 - RNA, 16 nt, Human
agaacuggacucagga

SEQ ID NO: 2356765 - RNA, 15 nt, Human
agaacuggacucagg

SEQ ID NO: 2356766 - RNA, 19 nt, Human
agaacuguaugucagacau

SEQ ID NO: 2356767 - RNA, 22 nt, Human
agaacuggacucaggaugccca

SEQ ID NO: 2356768 - RNA, 20 nt, Human
agaacuguguuucaaguuca

SEQ ID NO: 2356769 - RNA, 21 nt, Human
agaacuguguuucaaguucaa

SEQ ID NO: 2356770 - RNA, 19 nt, Human
agaacuguguuucaaguuc

SEQ ID NO: 2356771 - RNA, 13 nt, Human
agaagaacaucca

SEQ ID NO: 2356772 - RNA, 13 nt, Human
agaagaacugaaa

SEQ ID NO: 2356773 - RNA, 19 nt, Human
agaagaacuauaugugaau

SEQ ID NO: 2356774 - RNA, 20 nt, Human
agaagaauacaaacauauuu

SEQ ID NO: 2356775 - RNA, 14 nt, Human
agaagaaguguguc

SEQ ID NO: 2356776 - RNA, 14 nt, Human
agaagaacugaaau

SEQ ID NO: 2356777 - RNA, 23 nt, Human
agaagaauuuucagaccccagcg

SEQ ID NO: 2356778 - RNA, 22 nt, Human
agaagaauuuucagaccccagc

SEQ ID NO: 2356779 - RNA, 19 nt, Human
agaagaauugaacccagga

SEQ ID NO: 2356780 - RNA, 13 nt, Human
agaagacaaaauu

SEQ ID NO: 2356781 - RNA, 18 nt, Human
agaagaugguaccaccag

SEQ ID NO: 2356782 - RNA, 18 nt, Human
agaagaauauucaggacu

SEQ ID NO: 2356783 - RNA, 19 nt, Human
agaagaauauucaggacuu

SEQ ID NO: 2356784 - RNA, 14 nt, Human
agaagaauauucag

SEQ ID NO: 2356785 - RNA, 15 nt, Human
agaagaauauucagg

SEQ ID NO: 2356786 - RNA, 16 nt, Human
agaagaauauucagga

SEQ ID NO: 2356787 - RNA, 20 nt, Human
agaagaauugaacccaggag

SEQ ID NO: 2356788 - RNA, 17 nt, Human
agaagaauugaacccag

SEQ ID NO: 2356789 - RNA, 19 nt, Human
agaagauuugaugcuggag

SEQ ID NO: 2356790 - RNA, 22 nt, Human
agaagauguuuaacuuaaucaa

SEQ ID NO: 2356791 - RNA, 22 nt, Human
agaagauuugaugcuggagagg

SEQ ID NO: 2356792 - RNA, 19 nt, Human
agaagauggcacuuauaac

SEQ ID NO: 2356793 - RNA, 14 nt, Human
agaagauguuuaac

SEQ ID NO: 2356794 - RNA, 18 nt, Human
agaagauuuugaaauuuu

SEQ ID NO: 2356795 - RNA, 17 nt, Human
agaagcaacagaaaaaa

SEQ ID NO: 2356796 - RNA, 23 nt, Human
agaagauuugaugcuggagaggu

SEQ ID NO: 2356797 - RNA, 15 nt, Human
agaagcauuccuucu

SEQ ID NO: 2356798 - RNA, 17 nt, Human
agaagcauuccuucuuu

SEQ ID NO: 2356799 - RNA, 19 nt, Human
agaagcauuccuucuuuga

SEQ ID NO: 2356800 - RNA, 20 nt, Human
agaagcauuccuucuuugau

SEQ ID NO: 2356801 - RNA, 22 nt, Human
agaagcauuccuucuuugauaa

SEQ ID NO: 2356802 - RNA, 23 nt, Human
agaagcauuccuucuuugauaau

SEQ ID NO: 2356803 - RNA, 17 nt, Human
agaagccaaaagauugg

SEQ ID NO: 2356804 - RNA, 24 nt, Human
agaagcauuccuucuuugauaaug

SEQ ID NO: 2356805 - RNA, 16 nt, Human
agaagccacaggccug

SEQ ID NO: 2356806 - RNA, 22 nt, Human
agaagccaagggaaaggggugc

SEQ ID NO: 2356807 - RNA, 15 nt, Human
agaagccaagggaaa

SEQ ID NO: 2356808 - RNA, 16 nt, Human
agaagccaagggaaag

SEQ ID NO: 2356809 - RNA, 18 nt, Human
agaagccaagggaaaggg

SEQ ID NO: 2356810 - RNA, 19 nt, Human
agaagccaagggaaagggg

SEQ ID NO: 2356811 - RNA, 21 nt, Human
agaagcccaauauuauaauuu

SEQ ID NO: 2356812 - RNA, 17 nt, Human
agaagccacaggccuga

SEQ ID NO: 2356813 - RNA, 11 nt, Human
agaagcccaga

SEQ ID NO: 2356814 - RNA, 13 nt, Human
agaagcccagaau

SEQ ID NO: 2356815 - RNA, 12 nt, Human
agaagcccagaa

SEQ ID NO: 2356816 - RNA, 12 nt, Human
agaagcccagga

SEQ ID NO: 2356817 - RNA, 16 nt, Human
agaagcccaggaaagg

SEQ ID NO: 2356818 - RNA, 18 nt, Human
agaagcccaggaaaggcu

SEQ ID NO: 2356819 - RNA, 20 nt, Human
agaagcccaggaaaggcucc

SEQ ID NO: 2356820 - RNA, 21 nt, Human
agaagcccaggaaaggcucca

SEQ ID NO: 2356821 - RNA, 22 nt, Human
agaagcccaggaaaggcuccag

SEQ ID NO: 2356822 - RNA, 16 nt, Human
ucugcccacucccugc

SEQ ID NO: 2356823 - RNA, 17 nt, Human
ucugcccacucccugca

SEQ ID NO: 2356824 - RNA, 19 nt, Human
ucugcagggggugugucug

SEQ ID NO: 2356825 - RNA, 13 nt, Human
ucugcaggucccu

SEQ ID NO: 2356826 - RNA, 11 nt, Human
ucugcaggucc

SEQ ID NO: 2356827 - RNA, 12 nt, Human
ucugcagguccc

SEQ ID NO: 2356828 - RNA, 13 nt, Human
ucugcaggcaggg

SEQ ID NO: 2356829 - RNA, 17 nt, Human
agaaaugguuguauuag

SEQ ID NO: 2356830 - RNA, 18 nt, Human
agaaaugguuguauuaga

SEQ ID NO: 2356831 - RNA, 19 nt, Human
agaaaugguuguauuagau

SEQ ID NO: 2356832 - RNA, 20 nt, Human
agaaaugguuguauuagaug

SEQ ID NO: 2356833 - RNA, 21 nt, Human
agaaaugguuguauuagaugu

SEQ ID NO: 2356834 - RNA, 22 nt, Human
agaaaugguuguauuagauguu

SEQ ID NO: 2356835 - RNA, 23 nt, Human
agaaaugguuguauuagauguuc

SEQ ID NO: 2356836 - RNA, 15 nt, Human
agaaauguacagcaa

SEQ ID NO: 2356837 - RNA, 14 nt, Human
agaaauguacagca

SEQ ID NO: 2356838 - RNA, 14 nt, Human
ucugcaggcagggc

SEQ ID NO: 2356839 - RNA, 16 nt, Human
ucugcaggcagacacg

SEQ ID NO: 2356840 - RNA, 17 nt, Human
ucugcagcaauaaagca

SEQ ID NO: 2356841 - RNA, 15 nt, Human
ucugcagauaaacag

SEQ ID NO: 2356842 - RNA, 18 nt, Human
ucugcagauaaacaguag

SEQ ID NO: 2356843 - RNA, 21 nt, Human
ucugaugcaagcaagaaacac

SEQ ID NO: 2356844 - RNA, 17 nt, Human
ucugcacuccccugcug

SEQ ID NO: 2356845 - RNA, 16 nt, Human
ucugcacuccccugcu

SEQ ID NO: 2356846 - RNA, 14 nt, Human
ucugcacuccccug

SEQ ID NO: 2356847 - RNA, 15 nt, Human
ucugcacuccccugc

SEQ ID NO: 2356848 - RNA, 18 nt, Human
ucugagugaaccuguaua

SEQ ID NO: 2356849 - RNA, 21 nt, Human
ucugaucauccacugugccau

SEQ ID NO: 2356850 - RNA, 13 nt, Human
ucugagugaaccu

SEQ ID NO: 2356851 - RNA, 17 nt, Human
ucugaucauccacugug

SEQ ID NO: 2356852 - RNA, 15 nt, Human
ucugaucuccauggc

SEQ ID NO: 2356853 - RNA, 21 nt, Human
ucugaucuccauggcuuccuc

SEQ ID NO: 2356854 - RNA, 21 nt, Human
ucugaucgugacgcugaauaa

SEQ ID NO: 2356855 - RNA, 22 nt, Human
ucugaucgugacgcugaauaaa

SEQ ID NO: 2356856 - RNA, 21 nt, Human
ucugaucccucuacagagcuu

SEQ ID NO: 2356857 - RNA, 20 nt, Human
ucugaucgugacgcugaaua

SEQ ID NO: 2356858 - RNA, 16 nt, Human
ucugaugaugugccug

SEQ ID NO: 2356859 - RNA, 16 nt, Human
ucugaugcaagcaaga

SEQ ID NO: 2356860 - RNA, 22 nt, Human
ucugaucugugcuuuccagcuc

SEQ ID NO: 2356861 - RNA, 23 nt, Human
ucugaucugugcuuuccagcuca

SEQ ID NO: 2356862 - RNA, 14 nt, Human
ucugaucugugcuu

SEQ ID NO: 2356863 - RNA, 15 nt, Human
ucugaucugugcuuu

SEQ ID NO: 2356864 - RNA, 18 nt, Human
ucugaucugugcuuucca

SEQ ID NO: 2356865 - RNA, 21 nt, Human
ucugaucugugcuuuccagcu

SEQ ID NO: 2356866 - RNA, 18 nt, Human
ucugaguaucuccucgca

SEQ ID NO: 2356867 - RNA, 23 nt, Human
ucugaguaucuccucgcaagcug

SEQ ID NO: 2356868 - RNA, 20 nt, Human
ucugagugaaccuguauaag

SEQ ID NO: 2356869 - RNA, 14 nt, Human
ucugagucccagga

SEQ ID NO: 2356870 - RNA, 23 nt, Human
ucugagucccaggagcugcccag

SEQ ID NO: 2356871 - RNA, 24 nt, Human
ucugagucccaggagcugcccaga

SEQ ID NO: 2356872 - RNA, 21 nt, Human
ucugagacucgcgacaaugca

SEQ ID NO: 2356873 - RNA, 21 nt, Human
ucugaggugccugucccaccc

SEQ ID NO: 2356874 - RNA, 20 nt, Human
ucugagaagguccuuaauga

SEQ ID NO: 2356875 - RNA, 18 nt, Human
ucugagaagguccuuaau

SEQ ID NO: 2356876 - RNA, 17 nt, Human
ucugagaagguccuuaa

SEQ ID NO: 2356877 - RNA, 12 nt, Human
ucugagaaucuu

SEQ ID NO: 2356878 - RNA, 15 nt, Human
ucugagaaucuuuau

SEQ ID NO: 2356879 - RNA, 19 nt, Human
ucugagaaucuuuauugag

SEQ ID NO: 2356880 - RNA, 22 nt, Human
ucugagaaucuuuauugagaaa

SEQ ID NO: 2356881 - RNA, 23 nt, Human
ucugagaaucuuuauugagaaag

SEQ ID NO: 2356882 - RNA, 19 nt, Human
ucugagacaaagcaaugga

SEQ ID NO: 2356883 - RNA, 18 nt, Human
ucugagaauuccaaggag

SEQ ID NO: 2356884 - RNA, 20 nt, Human
ucugagaauuccaaggaguu

SEQ ID NO: 2356885 - RNA, 12 nt, Human
ucugacugugug

SEQ ID NO: 2356886 - RNA, 14 nt, Human
ucugacugugugug

SEQ ID NO: 2356887 - RNA, 16 nt, Human
ucugacugaugcuuuc

SEQ ID NO: 2356888 - RNA, 14 nt, Human
ucugacucugagcu

SEQ ID NO: 2356889 - RNA, 12 nt, Human
ucugacucucaa

SEQ ID NO: 2356890 - RNA, 15 nt, Human
ucugacucucaaauc

SEQ ID NO: 2356891 - RNA, 16 nt, Human
ucugaaggacacuucc

SEQ ID NO: 2356892 - RNA, 19 nt, Human
ucugaaggacacuuccugc

SEQ ID NO: 2356893 - RNA, 20 nt, Human
ucugaaggacacuuccugcc

SEQ ID NO: 2356894 - RNA, 22 nt, Human
ucugaaggacauugcggacagc

SEQ ID NO: 2356895 - RNA, 12 nt, Human
ucugaauguucu

SEQ ID NO: 2356896 - RNA, 21 nt, Human
ucugaaggacacuuccugccu

SEQ ID NO: 2356897 - RNA, 22 nt, Human
ucugaauguucugacauuaaca

SEQ ID NO: 2356898 - RNA, 19 nt, Human
ucugaauguucugacauua

SEQ ID NO: 2356899 - RNA, 17 nt, Human
ucugaauguucugacau

SEQ ID NO: 2356900 - RNA, 16 nt, Human
ucugaauguucugaca

SEQ ID NO: 2356901 - RNA, 14 nt, Human
ucugaauguucuga

SEQ ID NO: 2356902 - RNA, 13 nt, Human
ucugaauguucug

SEQ ID NO: 2356903 - RNA, 13 nt, Human
ucugaauggucca

SEQ ID NO: 2356904 - RNA, 10 nt, Human
ucugaauuau

SEQ ID NO: 2356905 - RNA, 18 nt, Human
agaaaugcauccauuccu

SEQ ID NO: 2356906 - RNA, 18 nt, Human
agaaaugcauauuguauu

SEQ ID NO: 2356907 - RNA, 22 nt, Human
agaaaugcauccauuccucagg

SEQ ID NO: 2356908 - RNA, 12 nt, Human
agaaaugcagaa

SEQ ID NO: 2356909 - RNA, 15 nt, Human
agaaaugcauauugu

SEQ ID NO: 2356910 - RNA, 16 nt, Human
agaaaugcauauugua

SEQ ID NO: 2356911 - RNA, 13 nt, Human
ucugaagccucac

SEQ ID NO: 2356912 - RNA, 16 nt, Human
ucugaagccucuggga

SEQ ID NO: 2356913 - RNA, 21 nt, Human
ucugaaggacauugcggacag

SEQ ID NO: 2356914 - RNA, 21 nt, Human
ucugaagcugacgaacuucca

SEQ ID NO: 2356915 - RNA, 20 nt, Human
ucugaagcugacgaacuucc

SEQ ID NO: 2356916 - RNA, 23 nt, Human
ucugaauguucugacauuaacag

SEQ ID NO: 2356917 - RNA, 18 nt, Human
ucugaauuaguccuugcu

SEQ ID NO: 2356918 - RNA, 19 nt, Human
ucugaauuaguccuugcuu

SEQ ID NO: 2356919 - RNA, 15 nt, Human
ucugaauuauuuucu

SEQ ID NO: 2356920 - RNA, 13 nt, Human
ucugacacacagc

SEQ ID NO: 2356921 - RNA, 14 nt, Human
ucugacacacagcu

SEQ ID NO: 2356922 - RNA, 15 nt, Human
ucugacacacagcuc

SEQ ID NO: 2356923 - RNA, 15 nt, Human
ucugacucagggcuc

SEQ ID NO: 2356924 - RNA, 14 nt, Human
ucugacucagggcu

SEQ ID NO: 2356925 - RNA, 13 nt, Human
ucugacucagggc

SEQ ID NO: 2356926 - RNA, 16 nt, Human
ucugacucacaagaag

SEQ ID NO: 2356927 - RNA, 23 nt, Human
ucugacuccaguggggcaagauu

SEQ ID NO: 2356928 - RNA, 13 nt, Human
ucugacuccagug

SEQ ID NO: 2356929 - RNA, 14 nt, Human
ucugacuccagugg

SEQ ID NO: 2356930 - RNA, 19 nt, Human
ucugacucauauccccuau

SEQ ID NO: 2356931 - RNA, 20 nt, Human
ucugacucagggcuccuggg

SEQ ID NO: 2356932 - RNA, 16 nt, Human
ucugacucgguuucuc

SEQ ID NO: 2356933 - RNA, 18 nt, Human
ucugacucgguuucucca

SEQ ID NO: 2356934 - RNA, 19 nt, Human
ucugacucgguuucuccaa

SEQ ID NO: 2356935 - RNA, 20 nt, Human
ucugacucgguuucuccaaa

SEQ ID NO: 2356936 - RNA, 20 nt, Human
ucuccuuuguacuuugugcu

SEQ ID NO: 2356937 - RNA, 22 nt, Human
ucuccuuugcugaggccuccag

SEQ ID NO: 2356938 - RNA, 14 nt, Human
ucuccuuuguauau

SEQ ID NO: 2356939 - RNA, 19 nt, Human
ucuccuuuguacuuugugc

SEQ ID NO: 2356940 - RNA, 17 nt, Human
ucuccuuugcaggcuca

SEQ ID NO: 2356941 - RNA, 23 nt, Human
ucuccuuugcacugagggccaca

SEQ ID NO: 2356942 - RNA, 14 nt, Human
agaaagcauuugaa

SEQ ID NO: 2356943 - RNA, 17 nt, Human
ucuccuuuuccucucuc

SEQ ID NO: 2356944 - RNA, 22 nt, Human
ucuccuuuguauauuauuucua

SEQ ID NO: 2356945 - RNA, 21 nt, Human
agaaagccaaaucaaaauaug

SEQ ID NO: 2356946 - RNA, 15 nt, Human
agaaagccaggcagg

SEQ ID NO: 2356947 - RNA, 22 nt, Human
agaaagcauuugaaugcauuuu

SEQ ID NO: 2356948 - RNA, 20 nt, Human
agaaagcauuugaaugcauu

SEQ ID NO: 2356949 - RNA, 21 nt, Human
agaaagcauuugaaugcauuu

SEQ ID NO: 2356950 - RNA, 15 nt, Human
agaaagcauuugaau

SEQ ID NO: 2356951 - RNA, 16 nt, Human
agaaagcauuugaaug

SEQ ID NO: 2356952 - RNA, 17 nt, Human
agaaagcauuugaaugc

SEQ ID NO: 2356953 - RNA, 18 nt, Human
agaaagcauuugaaugca

SEQ ID NO: 2356954 - RNA, 19 nt, Human
ucuccuuagucuucucaua

SEQ ID NO: 2356955 - RNA, 20 nt, Human
ucuccuuguggccugggccu

SEQ ID NO: 2356956 - RNA, 13 nt, Human
ucuccuuguucug

SEQ ID NO: 2356957 - RNA, 16 nt, Human
ucuccuuguucugaua

SEQ ID NO: 2356958 - RNA, 14 nt, Human
ucuccuuguucuga

SEQ ID NO: 2356959 - RNA, 16 nt, Human
ucuccuuucacaaccu

SEQ ID NO: 2356960 - RNA, 18 nt, Human
ucuccuuguucugauaau

SEQ ID NO: 2356961 - RNA, 15 nt, Human
ucuccuuucuuucua

SEQ ID NO: 2356962 - RNA, 14 nt, Human
ucuccuuucaggga

SEQ ID NO: 2356963 - RNA, 23 nt, Human
ucuccuuucaccccagggccuga

SEQ ID NO: 2356964 - RNA, 20 nt, Human
ucuccuuucuuuuucuucuu

SEQ ID NO: 2356965 - RNA, 17 nt, Human
ucuccuuugauaaaaua

SEQ ID NO: 2356966 - RNA, 23 nt, Human
ucuccuuugauaaaauaaaugag

SEQ ID NO: 2356967 - RNA, 16 nt, Human
ucuccuuugcacugag

SEQ ID NO: 2356968 - RNA, 17 nt, Human
ucuccuuugcacugagg

SEQ ID NO: 2356969 - RNA, 19 nt, Human
ucuccuuugcacugagggc

SEQ ID NO: 2356970 - RNA, 21 nt, Human
ucuccuuugcacugagggcca

SEQ ID NO: 2356971 - RNA, 22 nt, Human
ucuccuuugcacugagggccac

SEQ ID NO: 2356972 - RNA, 17 nt, Human
agaaaugagaucaggcu

SEQ ID NO: 2356973 - RNA, 19 nt, Human
agaaaugagaucaggcucu

SEQ ID NO: 2356974 - RNA, 20 nt, Human
agaaaugagaucaggcucug

SEQ ID NO: 2356975 - RNA, 23 nt, Human
agaaaugaccaauauuauacuaa

SEQ ID NO: 2356976 - RNA, 19 nt, Human
agaaaugaauaauuuccca

SEQ ID NO: 2356977 - RNA, 12 nt, Human
agaaaugaauaa

SEQ ID NO: 2356978 - RNA, 15 nt, Human
agaaauaugugguuu

SEQ ID NO: 2356979 - RNA, 14 nt, Human
agaaauaugugguu

SEQ ID NO: 2356980 - RNA, 22 nt, Human
agaaagcccuuaggaagaauuu

SEQ ID NO: 2356981 - RNA, 20 nt, Human
agaaagcccuuaggaagaau

SEQ ID NO: 2356982 - RNA, 21 nt, Human
agaaagccucagagaauugcu

SEQ ID NO: 2356983 - RNA, 15 nt, Human
agaaagccucagaga

SEQ ID NO: 2356984 - RNA, 22 nt, Human
agaaauauggaacuuacauugu

SEQ ID NO: 2356985 - RNA, 17 nt, Human
agaaauauggacacuua

SEQ ID NO: 2356986 - RNA, 20 nt, Human
agaaauauggaacuuacauu

SEQ ID NO: 2356987 - RNA, 17 nt, Human
agaaauauggaacuuac

SEQ ID NO: 2356988 - RNA, 14 nt, Human
agaaauauggacac

SEQ ID NO: 2356989 - RNA, 16 nt, Human
agaaauauggaacuua

SEQ ID NO: 2356990 - RNA, 22 nt, Human
agaaauaugauuuuauuugaca

SEQ ID NO: 2356991 - RNA, 21 nt, Human
agaaauaugcacaauagcagu

SEQ ID NO: 2356992 - RNA, 13 nt, Human
agaaauaugauuu

SEQ ID NO: 2356993 - RNA, 15 nt, Human
agaaauaugauuuua

SEQ ID NO: 2356994 - RNA, 16 nt, Human
agaaauaugauuuuau

SEQ ID NO: 2356995 - RNA, 22 nt, Human
uccucagguggccaugccucag

SEQ ID NO: 2356996 - RNA, 18 nt, Human
uccucagguggccaugcc

SEQ ID NO: 2356997 - RNA, 22 nt, Human
uccucagguggccagccuggau

SEQ ID NO: 2356998 - RNA, 15 nt, Human
uccucauauggccca

SEQ ID NO: 2356999 - RNA, 22 nt, Human
uccucauaguaugguggcuggg

SEQ ID NO: 2357000 - RNA, 13 nt, Human
uccucccaggcgc

SEQ ID NO: 2357001 - RNA, 21 nt, Human
uccucauauggcccaguguca

SEQ ID NO: 2357002 - RNA, 16 nt, Human
uccucauccagggcuc

SEQ ID NO: 2357003 - RNA, 14 nt, Human
uccucauccacccc

SEQ ID NO: 2357004 - RNA, 15 nt, Human
uccucauccacccca

SEQ ID NO: 2357005 - RNA, 17 nt, Human
uccucauccaccccauc

SEQ ID NO: 2357006 - RNA, 18 nt, Human
uccucauccaccccaucc

SEQ ID NO: 2357007 - RNA, 19 nt, Human
uccucccaggcgccccuuc

SEQ ID NO: 2357008 - RNA, 21 nt, Human
uccucccaggcgccccuuccc

SEQ ID NO: 2357009 - RNA, 13 nt, Human
uccucccaucccc

SEQ ID NO: 2357010 - RNA, 15 nt, Human
uccucccauccccug

SEQ ID NO: 2357011 - RNA, 18 nt, Human
uccucccauccccuggac

SEQ ID NO: 2357012 - RNA, 15 nt, Human
uccucccucagugcc

SEQ ID NO: 2357013 - RNA, 19 nt, Human
uccucccgggcccucccuu

SEQ ID NO: 2357014 - RNA, 21 nt, Human
uccucccgggcccucccuugg

SEQ ID NO: 2357015 - RNA, 15 nt, Human
uccucccgggcccuc

SEQ ID NO: 2357016 - RNA, 16 nt, Human
uccucccgggcccucc

SEQ ID NO: 2357017 - RNA, 17 nt, Human
uccucccgggcccuccc

SEQ ID NO: 2357018 - RNA, 14 nt, Human
uccucccgggcccu

SEQ ID NO: 2357019 - RNA, 16 nt, Human
uccuccccaaaucaau

SEQ ID NO: 2357020 - RNA, 13 nt, Human
uccuccccuuggg

SEQ ID NO: 2357021 - RNA, 14 nt, Human
uccuccccuugggc

SEQ ID NO: 2357022 - RNA, 23 nt, Human
uccucccauccccuggacuggga

SEQ ID NO: 2357023 - RNA, 19 nt, Human
uccucccauccccuggacu

SEQ ID NO: 2357024 - RNA, 21 nt, Human
uccucccauguuaugcccagc

SEQ ID NO: 2357025 - RNA, 13 nt, Human
uccucagguggcc

SEQ ID NO: 2357026 - RNA, 16 nt, Human
uccucagguggccaug

SEQ ID NO: 2357027 - RNA, 24 nt, Human
uccucagggacagagacaccugca

SEQ ID NO: 2357028 - RNA, 23 nt, Human
uccucauacccacccccacccaa

SEQ ID NO: 2357029 - RNA, 22 nt, Human
uccucagggacagagacaccug

SEQ ID NO: 2357030 - RNA, 18 nt, Human
uccucagggacagagaca

SEQ ID NO: 2357031 - RNA, 16 nt, Human
uccucagggacagaga

SEQ ID NO: 2357032 - RNA, 19 nt, Human
uccucaggcugcuggagga

SEQ ID NO: 2357033 - RNA, 13 nt, Human
uccucaggcugcu

SEQ ID NO: 2357034 - RNA, 21 nt, Human
uccucagccuugccagagauc

SEQ ID NO: 2357035 - RNA, 23 nt, Human
uccucaccucuggacuggcuaga

SEQ ID NO: 2357036 - RNA, 22 nt, Human
uccucaccucuggacuggcuag

SEQ ID NO: 2357037 - RNA, 21 nt, Human
uccucaccucuggacuggcua

SEQ ID NO: 2357038 - RNA, 20 nt, Human
uccucaccucuggacuggcu

SEQ ID NO: 2357039 - RNA, 16 nt, Human
uccucaccucuggacu

SEQ ID NO: 2357040 - RNA, 15 nt, Human
uccucaccucuggac

SEQ ID NO: 2357041 - RNA, 13 nt, Human
uccucaccucugg

SEQ ID NO: 2357042 - RNA, 12 nt, Human
uccucaccucug

SEQ ID NO: 2357043 - RNA, 14 nt, Human
uccucacucccagu

SEQ ID NO: 2357044 - RNA, 13 nt, Human
uccucacucccag

SEQ ID NO: 2357045 - RNA, 12 nt, Human
uccucacuccca

SEQ ID NO: 2357046 - RNA, 15 nt, Human
uccucaccuuuuccc

SEQ ID NO: 2357047 - RNA, 19 nt, Human
uccucaccuuuucccgggg

SEQ ID NO: 2357048 - RNA, 17 nt, Human
uccucacucccagucca

SEQ ID NO: 2357049 - RNA, 22 nt, Human
uccucaccuuuucccggggagg

SEQ ID NO: 2357050 - RNA, 12 nt, Human
uccucacucccu

SEQ ID NO: 2357051 - RNA, 18 nt, Human
uccucagccuugccagag

SEQ ID NO: 2357052 - RNA, 14 nt, Human
uccucacucccuuc

SEQ ID NO: 2357053 - RNA, 20 nt, Human
uccucagccuugccagagau

SEQ ID NO: 2357054 - RNA, 15 nt, Human
uccucaccucaugcc

SEQ ID NO: 2357055 - RNA, 16 nt, Human
uccucaccucaugccc

SEQ ID NO: 2357056 - RNA, 21 nt, Human
uccucaccucaugcccacccc

SEQ ID NO: 2357057 - RNA, 16 nt, Human
acucuugcucuuucua

SEQ ID NO: 2357058 - RNA, 16 nt, Human
acucuugguuucuuca

SEQ ID NO: 2357059 - RNA, 20 nt, Human
uccucaccccuguccucacu

SEQ ID NO: 2357060 - RNA, 21 nt, Human
uccucaccccuguccucacug

SEQ ID NO: 2357061 - RNA, 23 nt, Human
acucuuggagccugcagagcugc

SEQ ID NO: 2357062 - RNA, 22 nt, Human
acucuuggagccugcagagcug

SEQ ID NO: 2357063 - RNA, 14 nt, Human
acucuuggagccug

SEQ ID NO: 2357064 - RNA, 13 nt, Human
acucuugcucuuu

SEQ ID NO: 2357065 - RNA, 14 nt, Human
acucuugcucuuuc

SEQ ID NO: 2357066 - RNA, 16 nt, Human
acucuuggagccugca

SEQ ID NO: 2357067 - RNA, 15 nt, Human
acucuuggagccugc

SEQ ID NO: 2357068 - RNA, 15 nt, Human
acucuuaguuacuca

SEQ ID NO: 2357069 - RNA, 16 nt, Human
acucuugauuauccau

SEQ ID NO: 2357070 - RNA, 15 nt, Human
acucuugaccucagg

SEQ ID NO: 2357071 - RNA, 16 nt, Human
acucuugaccucaggu

SEQ ID NO: 2357072 - RNA, 19 nt, Human
acucuuaggaagagaaacc

SEQ ID NO: 2357073 - RNA, 20 nt, Human
acucuuaggaagagaaacca

SEQ ID NO: 2357074 - RNA, 14 nt, Human
acucuugaccucag

SEQ ID NO: 2357075 - RNA, 21 nt, Human
acucuugaaaaaugcauguug

SEQ ID NO: 2357076 - RNA, 17 nt, Human
acucuuaggaagagaaa

SEQ ID NO: 2357077 - RNA, 19 nt, Human
acucuuagauggauucucc

SEQ ID NO: 2357078 - RNA, 14 nt, Human
acucuuagaaauga

SEQ ID NO: 2357079 - RNA, 14 nt, Human
acucuuaaucaaau

SEQ ID NO: 2357080 - RNA, 22 nt, Human
acucuuaaguuucucagcuccc

SEQ ID NO: 2357081 - RNA, 14 nt, Human
acucuuaagccauc

SEQ ID NO: 2357082 - RNA, 22 nt, Human
acucuuaagccaucuugguaaa

SEQ ID NO: 2357083 - RNA, 14 nt, Human
acucuuaaguuucu

SEQ ID NO: 2357084 - RNA, 16 nt, Human
acucuuaaguuucuca

SEQ ID NO: 2357085 - RNA, 17 nt, Human
acucuuaaguuucucag

SEQ ID NO: 2357086 - RNA, 18 nt, Human
acucuuaaguuucucagc

SEQ ID NO: 2357087 - RNA, 19 nt, Human
acucuuaaguuucucagcu

SEQ ID NO: 2357088 - RNA, 21 nt, Human
acucuuaaguuucucagcucc

SEQ ID NO: 2357089 - RNA, 13 nt, Human
acucuuaagccau

SEQ ID NO: 2357090 - RNA, 21 nt, Human
acucuuaagaagacugcauua

SEQ ID NO: 2357091 - RNA, 18 nt, Human
acucucugaaccccuccc

SEQ ID NO: 2357092 - RNA, 21 nt, Human
acucucuccacccuauaugua

SEQ ID NO: 2357093 - RNA, 20 nt, Human
acucucuccacccuauaugu

SEQ ID NO: 2357094 - RNA, 13 nt, Human
acucucuccaccc

SEQ ID NO: 2357095 - RNA, 15 nt, Human
acucuccuggacugc

SEQ ID NO: 2357096 - RNA, 17 nt, Human
acucuccuugcuaccca

SEQ ID NO: 2357097 - RNA, 16 nt, Human
acucuccuuggugucg

SEQ ID NO: 2357098 - RNA, 23 nt, Human
acucuccuuggugucgggcauga

SEQ ID NO: 2357099 - RNA, 21 nt, Human
acucucugaaccccucccucc

SEQ ID NO: 2357100 - RNA, 19 nt, Human
acucucugaaccccucccu

SEQ ID NO: 2357101 - RNA, 23 nt, Human
acucugaggcucuuucugggcca

SEQ ID NO: 2357102 - RNA, 21 nt, Human
acucugaggcucuuucugggc

SEQ ID NO: 2357103 - RNA, 11 nt, Human
acucugagacu

SEQ ID NO: 2357104 - RNA, 22 nt, Human
acucugagacucgcgacaaugc

SEQ ID NO: 2357105 - RNA, 16 nt, Human
acucugccuccucuuc

SEQ ID NO: 2357106 - RNA, 14 nt, Human
acucuggcaaagcu

SEQ ID NO: 2357107 - RNA, 16 nt, Human
acucuggcaaagcuuu

SEQ ID NO: 2357108 - RNA, 15 nt, Human
acucuggcaaagcuu

SEQ ID NO: 2357109 - RNA, 23 nt, Human
acucuggcaaagcuuuuagaaau

SEQ ID NO: 2357110 - RNA, 17 nt, Human
acucuggcaaagcuuuu

SEQ ID NO: 2357111 - RNA, 13 nt, Human
acucuggcagcuc

SEQ ID NO: 2357112 - RNA, 15 nt, Human
acucuggcagcucag

SEQ ID NO: 2357113 - RNA, 16 nt, Human
acucugccagccacau

SEQ ID NO: 2357114 - RNA, 13 nt, Human
acucugccagcca

SEQ ID NO: 2357115 - RNA, 12 nt, Human
acucugccuccu

SEQ ID NO: 2357116 - RNA, 19 nt, Human
acucugcccccugcuggcu

SEQ ID NO: 2357117 - RNA, 21 nt, Human
acucugcccccugcuggcucu

SEQ ID NO: 2357118 - RNA, 12 nt, Human
acucugcccccu

SEQ ID NO: 2357119 - RNA, 13 nt, Human
acucugcccccug

SEQ ID NO: 2357120 - RNA, 15 nt, Human
acucugcccccugcu

SEQ ID NO: 2357121 - RNA, 17 nt, Human
acucugcccccugcugg

SEQ ID NO: 2357122 - RNA, 18 nt, Human
acucugcccccugcuggc

SEQ ID NO: 2357123 - RNA, 18 nt, Human
acucuccuggaaauauua

SEQ ID NO: 2357124 - RNA, 15 nt, Human
acucuccuugguguc

SEQ ID NO: 2357125 - RNA, 16 nt, Human
acucuccucugcugcu

SEQ ID NO: 2357126 - RNA, 16 nt, Human
acucuccucugccuca

SEQ ID NO: 2357127 - RNA, 12 nt, Human
acucuccucugc

SEQ ID NO: 2357128 - RNA, 15 nt, Human
acucuccucaucucu

SEQ ID NO: 2357129 - RNA, 14 nt, Human
acucuccucaucuc

SEQ ID NO: 2357130 - RNA, 19 nt, Human
acucuccucggcccccucc

SEQ ID NO: 2357131 - RNA, 20 nt, Human
acucuccucggcccccucca

SEQ ID NO: 2357132 - RNA, 22 nt, Human
acucuccucggcccccuccauc

SEQ ID NO: 2357133 - RNA, 14 nt, Human
acucuccucugccu

SEQ ID NO: 2357134 - RNA, 13 nt, Human
acucuccucugcu

SEQ ID NO: 2357135 - RNA, 14 nt, Human
acucuccucugcug

SEQ ID NO: 2357136 - RNA, 12 nt, Human
acucuccuagag

SEQ ID NO: 2357137 - RNA, 22 nt, Human
acucucccccacccccuccccg

SEQ ID NO: 2357138 - RNA, 23 nt, Human
acucuccuagagacagaagcagg

SEQ ID NO: 2357139 - RNA, 13 nt, Human
acucuccuagaga

SEQ ID NO: 2357140 - RNA, 21 nt, Human
acucuccuagagacagaagca

SEQ ID NO: 2357141 - RNA, 21 nt, Human
acuccuuccugccaccugcug

SEQ ID NO: 2357142 - RNA, 17 nt, Human
acuccuugagagaccag

SEQ ID NO: 2357143 - RNA, 18 nt, Human
acuccuugagagaccagg

SEQ ID NO: 2357144 - RNA, 20 nt, Human
acucucccccacccccuccc

SEQ ID NO: 2357145 - RNA, 21 nt, Human
acuccuugagagaccaggcaa

SEQ ID NO: 2357146 - RNA, 23 nt, Human
acuccuugagagaccaggcaaag

SEQ ID NO: 2357147 - RNA, 14 nt, Human
acucuccuccagag

SEQ ID NO: 2357148 - RNA, 17 nt, Human
acucuccuccagaguca

SEQ ID NO: 2357149 - RNA, 21 nt, Human
acuccuggggccucuuggguc

SEQ ID NO: 2357150 - RNA, 14 nt, Human
acuccuggguugag

SEQ ID NO: 2357151 - RNA, 16 nt, Human
acuccuggggccucuu

SEQ ID NO: 2357152 - RNA, 21 nt, Human
acuccugggcucaagcagucu

SEQ ID NO: 2357153 - RNA, 19 nt, Human
uccuaggcaggacaugcug

SEQ ID NO: 2357154 - RNA, 20 nt, Human
acuccuuccugccaccugcu

SEQ ID NO: 2357155 - RNA, 13 nt, Human
acuccuuccugcc

SEQ ID NO: 2357156 - RNA, 16 nt, Human
acuccuggguugagcu

SEQ ID NO: 2357157 - RNA, 17 nt, Human
acuccuggguugagcug

SEQ ID NO: 2357158 - RNA, 23 nt, Human
acuccuugaaaacacuguucucu

SEQ ID NO: 2357159 - RNA, 24 nt, Human
acuccuugaaaacacuguucucug

SEQ ID NO: 2357160 - RNA, 14 nt, Human
acucacagaccugg

SEQ ID NO: 2357161 - RNA, 18 nt, Human
acucacagaccuggagcc

SEQ ID NO: 2357162 - RNA, 19 nt, Human
acucacagaccuggagccc

SEQ ID NO: 2357163 - RNA, 22 nt, Human
acucacagaccuggagccccug

SEQ ID NO: 2357164 - RNA, 23 nt, Human
acucacagaccuggagccccugg

SEQ ID NO: 2357165 - RNA, 22 nt, Human
acucacacaggacccccuuccc

SEQ ID NO: 2357166 - RNA, 13 nt, Human
acucaccccagcc

SEQ ID NO: 2357167 - RNA, 13 nt, Human
acuccagaccccu

SEQ ID NO: 2357168 - RNA, 15 nt, Human
acuccagaccccugg

SEQ ID NO: 2357169 - RNA, 16 nt, Human
acucaccccagcccca

SEQ ID NO: 2357170 - RNA, 14 nt, Human
acucaccccagccc

SEQ ID NO: 2357171 - RNA, 15 nt, Human
acucaccccagcccc

SEQ ID NO: 2357172 - RNA, 20 nt, Human
acuccagugauguucuucaa

SEQ ID NO: 2357173 - RNA, 19 nt, Human
acuccagugagacagcucu

SEQ ID NO: 2357174 - RNA, 18 nt, Human
acuccagaccccuggcuu

SEQ ID NO: 2357175 - RNA, 19 nt, Human
acuccagaccccuggcuuu

SEQ ID NO: 2357176 - RNA, 21 nt, Human
acuccagaccccuggcuuuuc

SEQ ID NO: 2357177 - RNA, 17 nt, Human
acuccagacucucugug

SEQ ID NO: 2357178 - RNA, 19 nt, Human
acuccaucucaaaaaauaa

SEQ ID NO: 2357179 - RNA, 14 nt, Human
acuccaucagcuua

SEQ ID NO: 2357180 - RNA, 20 nt, Human
acuccaguuaaaaaaaauuu

SEQ ID NO: 2357181 - RNA, 18 nt, Human
acuccaguuaaaaaaaau

SEQ ID NO: 2357182 - RNA, 21 nt, Human
acuccagugccaacaauccua

SEQ ID NO: 2357183 - RNA, 14 nt, Human
acuccagugccagc

SEQ ID NO: 2357184 - RNA, 15 nt, Human
acuccagugccagca

SEQ ID NO: 2357185 - RNA, 19 nt, Human
acuccagugccagcaauga

SEQ ID NO: 2357186 - RNA, 10 nt, Human
acuccagugg

SEQ ID NO: 2357187 - RNA, 22 nt, Human
acuccaguggggcaagauuuuc

SEQ ID NO: 2357188 - RNA, 16 nt, Human
acuccaguggugaaga

SEQ ID NO: 2357189 - RNA, 18 nt, Human
acuccaguggugaagaaa

SEQ ID NO: 2357190 - RNA, 19 nt, Human
acuccaucaguuagagcug

SEQ ID NO: 2357191 - RNA, 14 nt, Human
acuccaugagaagc

SEQ ID NO: 2357192 - RNA, 18 nt, Human
acuccuaugaucucaggu

SEQ ID NO: 2357193 - RNA, 21 nt, Human
acuccucaaaagcaaaugaga

SEQ ID NO: 2357194 - RNA, 20 nt, Human
acuccucaaaagcaaaugag

SEQ ID NO: 2357195 - RNA, 19 nt, Human
acuccucaggguugagguc

SEQ ID NO: 2357196 - RNA, 16 nt, Human
acuccucaggguugag

SEQ ID NO: 2357197 - RNA, 12 nt, Human
acuccucccagg

SEQ ID NO: 2357198 - RNA, 12 nt, Human
acuccugcaggc

SEQ ID NO: 2357199 - RNA, 14 nt, Human
acuccugcaggcag

SEQ ID NO: 2357200 - RNA, 17 nt, Human
acuccugccaaggagga

SEQ ID NO: 2357201 - RNA, 22 nt, Human
acuccugcaggcagccaggcca

SEQ ID NO: 2357202 - RNA, 15 nt, Human
acuccugcaggcagc

SEQ ID NO: 2357203 - RNA, 16 nt, Human
acuccugcaggcagcc

SEQ ID NO: 2357204 - RNA, 11 nt, Human
acuccuggccu

SEQ ID NO: 2357205 - RNA, 21 nt, Human
acuccugccccuguucucuuc

SEQ ID NO: 2357206 - RNA, 14 nt, Human
acuccugcccuguu

SEQ ID NO: 2357207 - RNA, 22 nt, Human
acuccugcccuguuguguauag

SEQ ID NO: 2357208 - RNA, 16 nt, Human
ucccugguggcagcuc

SEQ ID NO: 2357209 - RNA, 17 nt, Human
ucccugguggcagcuca

SEQ ID NO: 2357210 - RNA, 18 nt, Human
ucccugguggcagcucac

SEQ ID NO: 2357211 - RNA, 19 nt, Human
ucccugguggcagcucacc

SEQ ID NO: 2357212 - RNA, 20 nt, Human
ucccugguggcagcucaccu

SEQ ID NO: 2357213 - RNA, 21 nt, Human
ucccugguggcagcucaccuc

SEQ ID NO: 2357214 - RNA, 12 nt, Human
acuccuggaaau

SEQ ID NO: 2357215 - RNA, 16 nt, Human
acuccuggaagcugug

SEQ ID NO: 2357216 - RNA, 13 nt, Human
acuccuggaagcu

SEQ ID NO: 2357217 - RNA, 23 nt, Human
ucccugguggcagcucaccucuc

SEQ ID NO: 2357218 - RNA, 22 nt, Human
ucccugguggcagcucaccucu

SEQ ID NO: 2357219 - RNA, 19 nt, Human
ucccuuggauuguccccga

SEQ ID NO: 2357220 - RNA, 20 nt, Human
ucccuuggauuguccccgac

SEQ ID NO: 2357221 - RNA, 14 nt, Human
ucccuuggccucag

SEQ ID NO: 2357222 - RNA, 13 nt, Human
ucccuuggccuca

SEQ ID NO: 2357223 - RNA, 12 nt, Human
ucccuuggccuc

SEQ ID NO: 2357224 - RNA, 16 nt, Human
ucccuuggccucagaa

SEQ ID NO: 2357225 - RNA, 12 nt, Human
ucccuugggcuc

SEQ ID NO: 2357226 - RNA, 14 nt, Human
ucccuugggcuccc

SEQ ID NO: 2357227 - RNA, 16 nt, Human
ucccuuugacgccauc

SEQ ID NO: 2357228 - RNA, 18 nt, Human
ucccuuugacgccauccc

SEQ ID NO: 2357229 - RNA, 13 nt, Human
ucccuuuuuuuaa

SEQ ID NO: 2357230 - RNA, 23 nt, Human
ucccuuuuuuggcugcugaaggc

SEQ ID NO: 2357231 - RNA, 20 nt, Human
ucccuuuuuuggcugcugaa

SEQ ID NO: 2357232 - RNA, 22 nt, Human
ucccuuuuuuggcugcugaagg

SEQ ID NO: 2357233 - RNA, 21 nt, Human
ucccuuugacgccaucccagc

SEQ ID NO: 2357234 - RNA, 17 nt, Human
ucccuuggguucugaua

SEQ ID NO: 2357235 - RNA, 19 nt, Human
ucccuuugacgccauccca

SEQ ID NO: 2357236 - RNA, 17 nt, Human
ucccuuuuuuggcugcu

SEQ ID NO: 2357237 - RNA, 19 nt, Human
ucccuuuuuuggcugcuga

SEQ ID NO: 2357238 - RNA, 17 nt, Human
uccggugugccugcagc

SEQ ID NO: 2357239 - RNA, 15 nt, Human
uccggugugccugca

SEQ ID NO: 2357240 - RNA, 12 nt, Human
uccggugugccu

SEQ ID NO: 2357241 - RNA, 15 nt, Human
ucccuuugaaaugaa

SEQ ID NO: 2357242 - RNA, 18 nt, Human
uccggucgugucucuggu

SEQ ID NO: 2357243 - RNA, 19 nt, Human
uccggugugccugcagccc

SEQ ID NO: 2357244 - RNA, 18 nt, Human
uccggugugccugcagcc

SEQ ID NO: 2357245 - RNA, 18 nt, Human
uccgguguuuaagacauu

SEQ ID NO: 2357246 - RNA, 16 nt, Human
ucccuuuuuuuaagua

SEQ ID NO: 2357247 - RNA, 21 nt, Human
ucccuuuuuuuaaguaaggaa

SEQ ID NO: 2357248 - RNA, 13 nt, Human
uccuacucugugu

SEQ ID NO: 2357249 - RNA, 14 nt, Human
uccuacucuguguc

SEQ ID NO: 2357250 - RNA, 13 nt, Human
uccguauuucaga

SEQ ID NO: 2357251 - RNA, 21 nt, Human
uccguagccagcugcucccca

SEQ ID NO: 2357252 - RNA, 22 nt, Human
uccguaacccaacucuccugga

SEQ ID NO: 2357253 - RNA, 16 nt, Human
uccguaacccaacucu

SEQ ID NO: 2357254 - RNA, 15 nt, Human
uccuacucuguguca

SEQ ID NO: 2357255 - RNA, 14 nt, Human
uccguaguucccug

SEQ ID NO: 2357256 - RNA, 20 nt, Human
uccguagccagcugcucccc

SEQ ID NO: 2357257 - RNA, 15 nt, Human
uccguaguucccuga

SEQ ID NO: 2357258 - RNA, 14 nt, Human
uccuagcugcacag

SEQ ID NO: 2357259 - RNA, 16 nt, Human
uccuagcugcacaggg

SEQ ID NO: 2357260 - RNA, 17 nt, Human
uccuagcugcacagggc

SEQ ID NO: 2357261 - RNA, 20 nt, Human
uccuagcugcacagggcagc

SEQ ID NO: 2357262 - RNA, 18 nt, Human
uccuaggaguauccucau

SEQ ID NO: 2357263 - RNA, 22 nt, Human
uccuagcuugggaggcuucccc

SEQ ID NO: 2357264 - RNA, 14 nt, Human
uccuaggaaaauac

SEQ ID NO: 2357265 - RNA, 21 nt, Human
uccuagcuugggaggcuuccc

SEQ ID NO: 2357266 - RNA, 13 nt, Human
uccuaggcauuug

SEQ ID NO: 2357267 - RNA, 12 nt, Human
acuccuggccuc

SEQ ID NO: 2357268 - RNA, 13 nt, Human
acuccuggccuca

SEQ ID NO: 2357269 - RNA, 14 nt, Human
acuccuggccucaa

SEQ ID NO: 2357270 - RNA, 21 nt, Human
acugaccugucaugccccccu

SEQ ID NO: 2357271 - RNA, 13 nt, Human
acugaacuucagg

SEQ ID NO: 2357272 - RNA, 22 nt, Human
acugaccugucaugccccccuc

SEQ ID NO: 2357273 - RNA, 21 nt, Human
acugaacuuugcugagccugu

SEQ ID NO: 2357274 - RNA, 12 nt, Human
acugaagaagca

SEQ ID NO: 2357275 - RNA, 13 nt, Human
acugacucuuaag

SEQ ID NO: 2357276 - RNA, 14 nt, Human
acugacucuuaaga

SEQ ID NO: 2357277 - RNA, 15 nt, Human
acugacucuuaagaa

SEQ ID NO: 2357278 - RNA, 16 nt, Human
acugacucuuaagaag

SEQ ID NO: 2357279 - RNA, 14 nt, Human
acugacuccuuaga

SEQ ID NO: 2357280 - RNA, 20 nt, Human
acugacucuuaagaagacug

SEQ ID NO: 2357281 - RNA, 17 nt, Human
acugacucuuaagaaga

SEQ ID NO: 2357282 - RNA, 18 nt, Human
acugacucuuaagaagac

SEQ ID NO: 2357283 - RNA, 22 nt, Human
acugacuucuaaguaaaaccac

SEQ ID NO: 2357284 - RNA, 16 nt, Human
acugacuucuaaguaa

SEQ ID NO: 2357285 - RNA, 15 nt, Human
acugacuucuaagua

SEQ ID NO: 2357286 - RNA, 13 nt, Human
acugacuucuaag

SEQ ID NO: 2357287 - RNA, 20 nt, Human
acugagauccuuccuuuuga

SEQ ID NO: 2357288 - RNA, 19 nt, Human
acugagauaccagcgagga

SEQ ID NO: 2357289 - RNA, 18 nt, Human
acugagauaccagcgagg

SEQ ID NO: 2357290 - RNA, 17 nt, Human
acugagaugugaacaca

SEQ ID NO: 2357291 - RNA, 17 nt, Human
acugagauuuugguauu

SEQ ID NO: 2357292 - RNA, 22 nt, Human
acugagaugugaacacaucagc

SEQ ID NO: 2357293 - RNA, 15 nt, Human
acugagaccaaagaa

SEQ ID NO: 2357294 - RNA, 18 nt, Human
acugagagugaacaaauu

SEQ ID NO: 2357295 - RNA, 22 nt, Human
acugagacagcccgggcucugc

SEQ ID NO: 2357296 - RNA, 23 nt, Human
acugagacagcccgggcucugcc

SEQ ID NO: 2357297 - RNA, 19 nt, Human
acugagaauguaagaacua

SEQ ID NO: 2357298 - RNA, 20 nt, Human
acugagaauguaagaacuac

SEQ ID NO: 2357299 - RNA, 15 nt, Human
acugagacagcccgg

SEQ ID NO: 2357300 - RNA, 18 nt, Human
acugagacagcccgggcu

SEQ ID NO: 2357301 - RNA, 21 nt, Human
acugagacagcccgggcucug

SEQ ID NO: 2357302 - RNA, 14 nt, Human
acugacuuuauccu

SEQ ID NO: 2357303 - RNA, 15 nt, Human
acugacuuuauccuc

SEQ ID NO: 2357304 - RNA, 12 nt, Human
acugagaaauuu

SEQ ID NO: 2357305 - RNA, 17 nt, Human
acugagaaauuuauaaa

SEQ ID NO: 2357306 - RNA, 21 nt, Human
acugagaaauuuauaaacuuu

SEQ ID NO: 2357307 - RNA, 18 nt, Human
acucuuuuuguuuuuugu

SEQ ID NO: 2357308 - RNA, 20 nt, Human
acucuuuuuucauggacacu

SEQ ID NO: 2357309 - RNA, 16 nt, Human
acucuuuuuguaccug

SEQ ID NO: 2357310 - RNA, 20 nt, Human
acucuuuuuguaccugguga

SEQ ID NO: 2357311 - RNA, 21 nt, Human
acucuuuugcuuuauuccaga

SEQ ID NO: 2357312 - RNA, 14 nt, Human
acucuuuuuagggc

SEQ ID NO: 2357313 - RNA, 19 nt, Human
acucuuuuuagggccaggc

SEQ ID NO: 2357314 - RNA, 20 nt, Human
acucuuuuuagggccaggca

SEQ ID NO: 2357315 - RNA, 17 nt, Human
acucuuuuugggcuccu

SEQ ID NO: 2357316 - RNA, 18 nt, Human
acucuuuuugggcuccuu

SEQ ID NO: 2357317 - RNA, 13 nt, Human
acucuuuuuguac

SEQ ID NO: 2357318 - RNA, 19 nt, Human
acugaacauguacacuggu

SEQ ID NO: 2357319 - RNA, 13 nt, Human
acugaacauucca

SEQ ID NO: 2357320 - RNA, 16 nt, Human
acugaacauuccagag

SEQ ID NO: 2357321 - RNA, 18 nt, Human
acugaaccggcuuuacca

SEQ ID NO: 2357322 - RNA, 20 nt, Human
acugaacucugacaacagac

SEQ ID NO: 2357323 - RNA, 18 nt, Human
acugaacucacuuuccuc

SEQ ID NO: 2357324 - RNA, 19 nt, Human
acugaaccggcuuuaccaa

SEQ ID NO: 2357325 - RNA, 19 nt, Human
acugaacuuugcugagccu

SEQ ID NO: 2357326 - RNA, 16 nt, Human
acugaacuuugcugag

SEQ ID NO: 2357327 - RNA, 21 nt, Human
acugaacuucaggauaauaaa

SEQ ID NO: 2357328 - RNA, 18 nt, Human
acucuuguggauguuuua

SEQ ID NO: 2357329 - RNA, 16 nt, Human
uccugaccacccuccc

SEQ ID NO: 2357330 - RNA, 14 nt, Human
uccugaccacccuc

SEQ ID NO: 2357331 - RNA, 15 nt, Human
uccugaccacccucc

SEQ ID NO: 2357332 - RNA, 15 nt, Human
acucuuguuuccuua

SEQ ID NO: 2357333 - RNA, 13 nt, Human
uccugacacuuua

SEQ ID NO: 2357334 - RNA, 13 nt, Human
uccugaccacccu

SEQ ID NO: 2357335 - RNA, 14 nt, Human
acucuuuguaagag

SEQ ID NO: 2357336 - RNA, 13 nt, Human
acucuuuguaaga

SEQ ID NO: 2357337 - RNA, 20 nt, Human
acucuuuugcuuuauuccag

SEQ ID NO: 2357338 - RNA, 14 nt, Human
acucuuuugcuuua

SEQ ID NO: 2357339 - RNA, 12 nt, Human
acucuuuugcuu

SEQ ID NO: 2357340 - RNA, 14 nt, Human
acucuuugguggcu

SEQ ID NO: 2357341 - RNA, 19 nt, Human
acucuuucuauuguuucuu

SEQ ID NO: 2357342 - RNA, 13 nt, Human
acucuuucaaaac

SEQ ID NO: 2357343 - RNA, 11 nt, Human
acucuuucaaa

SEQ ID NO: 2357344 - RNA, 12 nt, Human
uccucuuuccau

SEQ ID NO: 2357345 - RNA, 11 nt, Human
uccucuuucca

SEQ ID NO: 2357346 - RNA, 14 nt, Human
uccucccucccucu

SEQ ID NO: 2357347 - RNA, 11 nt, Human
uccucccuccc

SEQ ID NO: 2357348 - RNA, 19 nt, Human
uccucuuuccaucuacccu

SEQ ID NO: 2357349 - RNA, 22 nt, Human
uccucccgggcccucccuugga

SEQ ID NO: 2357350 - RNA, 19 nt, Human
uccucuuuggucuacacug

SEQ ID NO: 2357351 - RNA, 21 nt, Human
uccucuuuggucuacacugug

SEQ ID NO: 2357352 - RNA, 21 nt, Human
uccugaaagaaacaguuaacu

SEQ ID NO: 2357353 - RNA, 18 nt, Human
uccugaaagaaacaguua

SEQ ID NO: 2357354 - RNA, 16 nt, Human
uccugaaagacaauau

SEQ ID NO: 2357355 - RNA, 19 nt, Human
uccugaaacuuacacacaa

SEQ ID NO: 2357356 - RNA, 23 nt, Human
uccucuuugcuuugcuuucugcu

SEQ ID NO: 2357357 - RNA, 20 nt, Human
uccucuuugcuuugcuuucu

SEQ ID NO: 2357358 - RNA, 17 nt, Human
uccugaaacaacuugga

SEQ ID NO: 2357359 - RNA, 22 nt, Human
uccucuuuggucuacacugugc

SEQ ID NO: 2357360 - RNA, 16 nt, Human
uccucuuugcuuugcu

SEQ ID NO: 2357361 - RNA, 15 nt, Human
uccucuuugcuuugc

SEQ ID NO: 2357362 - RNA, 14 nt, Human
uccucuuugcaugg

SEQ ID NO: 2357363 - RNA, 17 nt, Human
uccucuuugcauggaau

SEQ ID NO: 2357364 - RNA, 22 nt, Human
uccugaauccaaacuaauccau

SEQ ID NO: 2357365 - RNA, 14 nt, Human
uccugaaauuucag

SEQ ID NO: 2357366 - RNA, 15 nt, Human
uccugaaauuucaga

SEQ ID NO: 2357367 - RNA, 19 nt, Human
uccugaaugaaauaucaga

SEQ ID NO: 2357368 - RNA, 14 nt, Human
uccugaaugaaaua

SEQ ID NO: 2357369 - RNA, 15 nt, Human
uccugaauucuauuu

SEQ ID NO: 2357370 - RNA, 21 nt, Human
uccugaauuuauuauuguucu

SEQ ID NO: 2357371 - RNA, 22 nt, Human
uccugaauuuauuauuguucuu

SEQ ID NO: 2357372 - RNA, 21 nt, Human
uccugaauuuuauuuuuuggg

SEQ ID NO: 2357373 - RNA, 14 nt, Human
uccugcugcugugu

SEQ ID NO: 2357374 - RNA, 15 nt, Human
uccugcugcuguguu

SEQ ID NO: 2357375 - RNA, 12 nt, Human
uccugcgggcuu

SEQ ID NO: 2357376 - RNA, 23 nt, Human
uccugcggagugaagaggggcag

SEQ ID NO: 2357377 - RNA, 21 nt, Human
uccugcggagugaagaggggc

SEQ ID NO: 2357378 - RNA, 22 nt, Human
uccugcggagugaagaggggca

SEQ ID NO: 2357379 - RNA, 21 nt, Human
uccugcugcaguugccaguca

SEQ ID NO: 2357380 - RNA, 20 nt, Human
uccugcgggcuuuuccccgg

SEQ ID NO: 2357381 - RNA, 14 nt, Human
uccugccuguggcg

SEQ ID NO: 2357382 - RNA, 17 nt, Human
uccugccuuagagccag

SEQ ID NO: 2357383 - RNA, 18 nt, Human
uccugccuuagagccagg

SEQ ID NO: 2357384 - RNA, 22 nt, Human
uccugccuuccuccugggcccu

SEQ ID NO: 2357385 - RNA, 19 nt, Human
uccugccuuccuccugggc

SEQ ID NO: 2357386 - RNA, 16 nt, Human
uccugccuuccuccug

SEQ ID NO: 2357387 - RNA, 14 nt, Human
uccugccuuccucc

SEQ ID NO: 2357388 - RNA, 19 nt, Human
uccugcggagugaagaggg

SEQ ID NO: 2357389 - RNA, 22 nt, Human
uccugccuucuucuuuuugcug

SEQ ID NO: 2357390 - RNA, 23 nt, Human
uccugccuuccuccugggcccuc

SEQ ID NO: 2357391 - RNA, 13 nt, Human
uccugccuucugu

SEQ ID NO: 2357392 - RNA, 14 nt, Human
uccugccuucuguc

SEQ ID NO: 2357393 - RNA, 17 nt, Human
uccugccuucuguccug

SEQ ID NO: 2357394 - RNA, 22 nt, Human
uccugccuucuguccugguguc

SEQ ID NO: 2357395 - RNA, 23 nt, Human
uccugccuucuguccugguguca

SEQ ID NO: 2357396 - RNA, 16 nt, Human
uccugccuucuucuuu

SEQ ID NO: 2357397 - RNA, 13 nt, Human
uccugccuggcca

SEQ ID NO: 2357398 - RNA, 12 nt, Human
uccugccuggcc

SEQ ID NO: 2357399 - RNA, 14 nt, Human
uccugccugccccu

SEQ ID NO: 2357400 - RNA, 14 nt, Human
uccugcagccugga

SEQ ID NO: 2357401 - RNA, 17 nt, Human
uccugcagccuggaggc

SEQ ID NO: 2357402 - RNA, 20 nt, Human
uccugccugucuccuuugca

SEQ ID NO: 2357403 - RNA, 16 nt, Human
uccugccuggccaggc

SEQ ID NO: 2357404 - RNA, 14 nt, Human
uccugccuggccag

SEQ ID NO: 2357405 - RNA, 20 nt, Human
uccugccugccccucucccg

SEQ ID NO: 2357406 - RNA, 18 nt, Human
uccugccugucugaagcc

SEQ ID NO: 2357407 - RNA, 12 nt, Human
uccugccugugg

SEQ ID NO: 2357408 - RNA, 13 nt, Human
uccugccuguggc

SEQ ID NO: 2357409 - RNA, 12 nt, Human
uccugcaggcag

SEQ ID NO: 2357410 - RNA, 13 nt, Human
uccugcaggcagc

SEQ ID NO: 2357411 - RNA, 14 nt, Human
uccugcaggcagcc

SEQ ID NO: 2357412 - RNA, 16 nt, Human
uccuggcuccugaggg

SEQ ID NO: 2357413 - RNA, 13 nt, Human
uccuggcuccuga

SEQ ID NO: 2357414 - RNA, 23 nt, Human
uccuggcucuugauaccccccuc

SEQ ID NO: 2357415 - RNA, 19 nt, Human
uccuggacacucagaccug

SEQ ID NO: 2357416 - RNA, 16 nt, Human
uccugggaaauauucc

SEQ ID NO: 2357417 - RNA, 14 nt, Human
uccugggaaauauu

SEQ ID NO: 2357418 - RNA, 18 nt, Human
uccugggagaaccucagg

SEQ ID NO: 2357419 - RNA, 17 nt, Human
uccugggagaaccucag

SEQ ID NO: 2357420 - RNA, 21 nt, Human
uccugggaaauauucccuaga

SEQ ID NO: 2357421 - RNA, 20 nt, Human
uccugggaaauauucccuag

SEQ ID NO: 2357422 - RNA, 20 nt, Human
uccugggagaaccucaggcu

SEQ ID NO: 2357423 - RNA, 19 nt, Human
uccugggagaaccucaggc

SEQ ID NO: 2357424 - RNA, 12 nt, Human
uccugggaguga

SEQ ID NO: 2357425 - RNA, 14 nt, Human
uccugggagugagc

SEQ ID NO: 2357426 - RNA, 17 nt, Human
uccugggagugagcugg

SEQ ID NO: 2357427 - RNA, 19 nt, Human
uccuggaaaggcucagucu

SEQ ID NO: 2357428 - RNA, 16 nt, Human
uccuggaaaggcucag

SEQ ID NO: 2357429 - RNA, 22 nt, Human
uccuggaaaggcucagucucag

SEQ ID NO: 2357430 - RNA, 14 nt, Human
uccuggaagccagc

SEQ ID NO: 2357431 - RNA, 14 nt, Human
uccuggaagcugug

SEQ ID NO: 2357432 - RNA, 14 nt, Human
uccuggaaaccaca

SEQ ID NO: 2357433 - RNA, 22 nt, Human
uccuggaagcgcgagggccuca

SEQ ID NO: 2357434 - RNA, 20 nt, Human
uccuggaagccagcuuuccc

SEQ ID NO: 2357435 - RNA, 18 nt, Human
uccuggaagccagcuuuc

SEQ ID NO: 2357436 - RNA, 21 nt, Human
uccuggaagcuguguccuugc

SEQ ID NO: 2357437 - RNA, 17 nt, Human
uccuggacacucagacc

SEQ ID NO: 2357438 - RNA, 23 nt, Human
uccuggaagugcuaauuuugaaa

SEQ ID NO: 2357439 - RNA, 18 nt, Human
uccugcuuugggaagccg

SEQ ID NO: 2357440 - RNA, 15 nt, Human
uccuggaaauauuaa

SEQ ID NO: 2357441 - RNA, 16 nt, Human
uccuggaaaucagggu

SEQ ID NO: 2357442 - RNA, 22 nt, Human
uccuggaaauugacgaggggug

SEQ ID NO: 2357443 - RNA, 15 nt, Human
acugcacccccuccu

SEQ ID NO: 2357444 - RNA, 16 nt, Human
acugcacccccuccug

SEQ ID NO: 2357445 - RNA, 17 nt, Human
acugcacccccuccugc

SEQ ID NO: 2357446 - RNA, 18 nt, Human
acugcacccccuccugcu

SEQ ID NO: 2357447 - RNA, 14 nt, Human
acugcaccgggcca

SEQ ID NO: 2357448 - RNA, 16 nt, Human
acugcaccgggccaca

SEQ ID NO: 2357449 - RNA, 20 nt, Human
acugcacuauagccuaggug

SEQ ID NO: 2357450 - RNA, 17 nt, Human
acugcaagagccuuggu

SEQ ID NO: 2357451 - RNA, 16 nt, Human
acugcaagagccuugg

SEQ ID NO: 2357452 - RNA, 15 nt, Human
acugcaagagccuug

SEQ ID NO: 2357453 - RNA, 16 nt, Human
acugcaagaaaaugau

SEQ ID NO: 2357454 - RNA, 18 nt, Human
acugcaagagccuuggug

SEQ ID NO: 2357455 - RNA, 22 nt, Human
acugcacagugcaucucagccc

SEQ ID NO: 2357456 - RNA, 23 nt, Human
acugcacagugcaucucagccca

SEQ ID NO: 2357457 - RNA, 16 nt, Human
acugcaacuucugccu

SEQ ID NO: 2357458 - RNA, 20 nt, Human
acugcaacuuguaaaugugg

SEQ ID NO: 2357459 - RNA, 14 nt, Human
acugcaacuucugc

SEQ ID NO: 2357460 - RNA, 23 nt, Human
acugcaaccuucgccaccugggu

SEQ ID NO: 2357461 - RNA, 23 nt, Human
acugauaguuacuguugugaccu

SEQ ID NO: 2357462 - RNA, 16 nt, Human
acugauauauuuuaca

SEQ ID NO: 2357463 - RNA, 22 nt, Human
acugauauaucaugagugaaua

SEQ ID NO: 2357464 - RNA, 18 nt, Human
acugauaguuacuguugu

SEQ ID NO: 2357465 - RNA, 20 nt, Human
acugauaguuacuguuguga

SEQ ID NO: 2357466 - RNA, 14 nt, Human
acugagccuuguaa

SEQ ID NO: 2357467 - RNA, 21 nt, Human
acugagccccgcagaccuccc

SEQ ID NO: 2357468 - RNA, 23 nt, Human
acugagccccgcagaccucccca

SEQ ID NO: 2357469 - RNA, 16 nt, Human
acugauaguguccaaa

SEQ ID NO: 2357470 - RNA, 17 nt, Human
acugauaguguccaaau

SEQ ID NO: 2357471 - RNA, 15 nt, Human
acugauaguuacugu

SEQ ID NO: 2357472 - RNA, 17 nt, Human
acugauaguuacuguug

SEQ ID NO: 2357473 - RNA, 20 nt, Human
acugagccagucccaggggc

SEQ ID NO: 2357474 - RNA, 13 nt, Human
acugagccccccc

SEQ ID NO: 2357475 - RNA, 15 nt, Human
acugagcccccccaa

SEQ ID NO: 2357476 - RNA, 22 nt, Human
acugagcccccccaacacugug

SEQ ID NO: 2357477 - RNA, 14 nt, Human
acugagccccgcag

SEQ ID NO: 2357478 - RNA, 18 nt, Human
acugagccccgcagaccu

SEQ ID NO: 2357479 - RNA, 20 nt, Human
acugagccccgcagaccucc

SEQ ID NO: 2357480 - RNA, 12 nt, Human
acugagcagacu

SEQ ID NO: 2357481 - RNA, 13 nt, Human
acugagcagacug

SEQ ID NO: 2357482 - RNA, 23 nt, Human
acugagcagacuggugagcagac

SEQ ID NO: 2357483 - RNA, 14 nt, Human
acugagcagacugg

SEQ ID NO: 2357484 - RNA, 14 nt, Human
acugagcagagucu

SEQ ID NO: 2357485 - RNA, 21 nt, Human
acugauaaagaugagugagca

SEQ ID NO: 2357486 - RNA, 13 nt, Human
acugauaaagaug

SEQ ID NO: 2357487 - RNA, 20 nt, Human
acugcacuccagccugggug

SEQ ID NO: 2357488 - RNA, 19 nt, Human
acugcacuccagccugggu

SEQ ID NO: 2357489 - RNA, 21 nt, Human
acugcacuccagccugggcga

SEQ ID NO: 2357490 - RNA, 20 nt, Human
acugcacuccagccugggcg

SEQ ID NO: 2357491 - RNA, 20 nt, Human
acugcacuccagccugggca

SEQ ID NO: 2357492 - RNA, 19 nt, Human
acugcacuccagccugggc

SEQ ID NO: 2357493 - RNA, 18 nt, Human
acugcacuccagccuggg

SEQ ID NO: 2357494 - RNA, 17 nt, Human
acugcacuccagccugg

SEQ ID NO: 2357495 - RNA, 15 nt, Human
acugcacuccagccu

SEQ ID NO: 2357496 - RNA, 19 nt, Human
acugcacccccuccugcug

SEQ ID NO: 2357497 - RNA, 20 nt, Human
acugcacccccuccugcugc

SEQ ID NO: 2357498 - RNA, 21 nt, Human
acugcacccccuccugcugca

SEQ ID NO: 2357499 - RNA, 22 nt, Human
acugcacccccuccugcugcag

SEQ ID NO: 2357500 - RNA, 14 nt, Human
acugcacuccagcc

SEQ ID NO: 2357501 - RNA, 21 nt, Human
acugcacuauagccuagguga

SEQ ID NO: 2357502 - RNA, 15 nt, Human
uccugaucagagccg

SEQ ID NO: 2357503 - RNA, 19 nt, Human
uccugaugcuucuucagag

SEQ ID NO: 2357504 - RNA, 20 nt, Human
uccugaugcuucuucagaga

SEQ ID NO: 2357505 - RNA, 21 nt, Human
uccugaugcuucuucagagac

SEQ ID NO: 2357506 - RNA, 14 nt, Human
uccugaucagagcc

SEQ ID NO: 2357507 - RNA, 22 nt, Human
uccugcaaugaagucucugaag

SEQ ID NO: 2357508 - RNA, 21 nt, Human
uccugcacacgcuccuuccuc

SEQ ID NO: 2357509 - RNA, 14 nt, Human
uccugcacacgcuc

SEQ ID NO: 2357510 - RNA, 21 nt, Human
uccugcaaugaagucucugaa

SEQ ID NO: 2357511 - RNA, 20 nt, Human
uccugcacaguuuucuggcu

SEQ ID NO: 2357512 - RNA, 21 nt, Human
uccugcacaguuuucuggcug

SEQ ID NO: 2357513 - RNA, 22 nt, Human
uccugcacacgcuccuuccucu

SEQ ID NO: 2357514 - RNA, 22 nt, Human
uccaggaugcuaacaucuaaaa

SEQ ID NO: 2357515 - RNA, 15 nt, Human
uccaggauccagaag

SEQ ID NO: 2357516 - RNA, 19 nt, Human
uccaggaugcuaacaucua

SEQ ID NO: 2357517 - RNA, 18 nt, Human
uccaggagccugugccuc

SEQ ID NO: 2357518 - RNA, 22 nt, Human
uccaggccugugaggugcagag

SEQ ID NO: 2357519 - RNA, 19 nt, Human
uccaggauugaagagcauu

SEQ ID NO: 2357520 - RNA, 10 nt, Human
uccaggcucc

SEQ ID NO: 2357521 - RNA, 12 nt, Human
uccaggcuccuu

SEQ ID NO: 2357522 - RNA, 22 nt, Human
uccaggcuccuuuagcgcccag

SEQ ID NO: 2357523 - RNA, 20 nt, Human
uccaggcugggagagccuuc

SEQ ID NO: 2357524 - RNA, 21 nt, Human
uccaggcugggagagccuucc

SEQ ID NO: 2357525 - RNA, 19 nt, Human
uccaggcgaugugcaagug

SEQ ID NO: 2357526 - RNA, 11 nt, Human
uccaggcuggu

SEQ ID NO: 2357527 - RNA, 13 nt, Human
uccaggcugguuc

SEQ ID NO: 2357528 - RNA, 23 nt, Human
uccaggcugggagagccuuccag

SEQ ID NO: 2357529 - RNA, 14 nt, Human
acgaacccaccugc

SEQ ID NO: 2357530 - RNA, 16 nt, Human
acgaaauguuauuuuu

SEQ ID NO: 2357531 - RNA, 23 nt, Human
acgaaauguuauuuuuuaauuau

SEQ ID NO: 2357532 - RNA, 12 nt, Human
acgaaauguuau

SEQ ID NO: 2357533 - RNA, 13 nt, Human
acgaaauguuauu

SEQ ID NO: 2357534 - RNA, 15 nt, Human
acgaauauugcugau

SEQ ID NO: 2357535 - RNA, 18 nt, Human
acgaauauugcugauggu

SEQ ID NO: 2357536 - RNA, 11 nt, Human
uccagccuggg

SEQ ID NO: 2357537 - RNA, 15 nt, Human
uccaggagccugugc

SEQ ID NO: 2357538 - RNA, 23 nt, Human
uccaggagccuggcuccguccag

SEQ ID NO: 2357539 - RNA, 14 nt, Human
uccaggagccuggc

SEQ ID NO: 2357540 - RNA, 13 nt, Human
uccaggagccugg

SEQ ID NO: 2357541 - RNA, 19 nt, Human
uccagccugccuggcaggc

SEQ ID NO: 2357542 - RNA, 16 nt, Human
uccagccugccuggca

SEQ ID NO: 2357543 - RNA, 12 nt, Human
uccagccuggac

SEQ ID NO: 2357544 - RNA, 13 nt, Human
uccagccuggacc

SEQ ID NO: 2357545 - RNA, 14 nt, Human
uccagccuggaccc

SEQ ID NO: 2357546 - RNA, 17 nt, Human
uccagccuggaccccca

SEQ ID NO: 2357547 - RNA, 18 nt, Human
uccagccuggacccccag

SEQ ID NO: 2357548 - RNA, 19 nt, Human
uccagccuggacccccagc

SEQ ID NO: 2357549 - RNA, 20 nt, Human
uccagccuggacccccagcu

SEQ ID NO: 2357550 - RNA, 21 nt, Human
uccagccuggacccccagcuu

SEQ ID NO: 2357551 - RNA, 22 nt, Human
uccagccuggacccccagcuuu

SEQ ID NO: 2357552 - RNA, 14 nt, Human
uccagccuggagau

SEQ ID NO: 2357553 - RNA, 12 nt, Human
uccagccuggcu

SEQ ID NO: 2357554 - RNA, 13 nt, Human
uccagccuggcuc

SEQ ID NO: 2357555 - RNA, 23 nt, Human
uccagccgccauugccaccagga

SEQ ID NO: 2357556 - RNA, 22 nt, Human
uccagccgccauugccaccagg

SEQ ID NO: 2357557 - RNA, 21 nt, Human
uccagcccuggcugaaggacu

SEQ ID NO: 2357558 - RNA, 20 nt, Human
uccagccggcauggcuggga

SEQ ID NO: 2357559 - RNA, 12 nt, Human
uccagccuagag

SEQ ID NO: 2357560 - RNA, 21 nt, Human
uccagccgccauugccaccag

SEQ ID NO: 2357561 - RNA, 20 nt, Human
uccagccgccauugccacca

SEQ ID NO: 2357562 - RNA, 19 nt, Human
uccagccgccauugccacc

SEQ ID NO: 2357563 - RNA, 18 nt, Human
uccagccgccauugccac

SEQ ID NO: 2357564 - RNA, 20 nt, Human
uccagccugcugccugcuuu

SEQ ID NO: 2357565 - RNA, 13 nt, Human
uccagccugccac

SEQ ID NO: 2357566 - RNA, 15 nt, Human
uccagccucuccccu

SEQ ID NO: 2357567 - RNA, 16 nt, Human
uccagccgccauugcc

SEQ ID NO: 2357568 - RNA, 19 nt, Human
uccagcccuggcugaagga

SEQ ID NO: 2357569 - RNA, 20 nt, Human
uccagcccuggcugaaggac

SEQ ID NO: 2357570 - RNA, 21 nt, Human
uccagacccccagcaacccuc

SEQ ID NO: 2357571 - RNA, 16 nt, Human
uccagacccccagcaa

SEQ ID NO: 2357572 - RNA, 15 nt, Human
uccagcccuggcuga

SEQ ID NO: 2357573 - RNA, 17 nt, Human
uccagcccuggcugaag

SEQ ID NO: 2357574 - RNA, 22 nt, Human
uccagcccugaguuccuagcca

SEQ ID NO: 2357575 - RNA, 20 nt, Human
uccagcccugaguuccuagc

SEQ ID NO: 2357576 - RNA, 15 nt, Human
uccagacccccagca

SEQ ID NO: 2357577 - RNA, 14 nt, Human
uccagacccccagc

SEQ ID NO: 2357578 - RNA, 22 nt, Human
uccagacccccaccccuucccc

SEQ ID NO: 2357579 - RNA, 21 nt, Human
uccagacccccaccccuuccc

SEQ ID NO: 2357580 - RNA, 20 nt, Human
uccagacccccaccccuucc

SEQ ID NO: 2357581 - RNA, 17 nt, Human
uccagacccccaccccu

SEQ ID NO: 2357582 - RNA, 16 nt, Human
uccagacccccacccc

SEQ ID NO: 2357583 - RNA, 14 nt, Human
uccagacccccacc

SEQ ID NO: 2357584 - RNA, 13 nt, Human
uccagaccccugg

SEQ ID NO: 2357585 - RNA, 13 nt, Human
uccagacacuuuu

SEQ ID NO: 2357586 - RNA, 13 nt, Human
uccagacagccug

SEQ ID NO: 2357587 - RNA, 14 nt, Human
uccagacagccugu

SEQ ID NO: 2357588 - RNA, 13 nt, Human
uccagacccccac

SEQ ID NO: 2357589 - RNA, 18 nt, Human
uccagacagccuguaucu

SEQ ID NO: 2357590 - RNA, 12 nt, Human
uccagaccccca

SEQ ID NO: 2357591 - RNA, 15 nt, Human
uccagacagccugua

SEQ ID NO: 2357592 - RNA, 16 nt, Human
uccagacagccuguau

SEQ ID NO: 2357593 - RNA, 14 nt, Human
uccagaauuuccca

SEQ ID NO: 2357594 - RNA, 15 nt, Human
uccagaauuucccaa

SEQ ID NO: 2357595 - RNA, 15 nt, Human
accuuucuccuuugu

SEQ ID NO: 2357596 - RNA, 16 nt, Human
accuuucuccuuugua

SEQ ID NO: 2357597 - RNA, 18 nt, Human
accuugaacuccugggcu

SEQ ID NO: 2357598 - RNA, 20 nt, Human
accuugaacuggguacuugu

SEQ ID NO: 2357599 - RNA, 21 nt, Human
accuugaacacugggggaggg

SEQ ID NO: 2357600 - RNA, 18 nt, Human
accuugaacacuggggga

SEQ ID NO: 2357601 - RNA, 20 nt, Human
accuugaaaauaagaauaga

SEQ ID NO: 2357602 - RNA, 14 nt, Human
ucauuccuguauuc

SEQ ID NO: 2357603 - RNA, 19 nt, Human
accuugaaaacuuuaugcu

SEQ ID NO: 2357604 - RNA, 17 nt, Human
ucauuccuaacacagca

SEQ ID NO: 2357605 - RNA, 14 nt, Human
ucauuccccaggug

SEQ ID NO: 2357606 - RNA, 12 nt, Human
ucauuccccagg

SEQ ID NO: 2357607 - RNA, 23 nt, Human
ucauuccccagguggcugaccca

SEQ ID NO: 2357608 - RNA, 15 nt, Human
ucauguuuuaacaaa

SEQ ID NO: 2357609 - RNA, 14 nt, Human
ucauguuuuaacaa

SEQ ID NO: 2357610 - RNA, 19 nt, Human
ucauuccauucuggaagug

SEQ ID NO: 2357611 - RNA, 19 nt, Human
ucauuccugccugucuccu

SEQ ID NO: 2357612 - RNA, 17 nt, Human
ucauuccugccugucuc

SEQ ID NO: 2357613 - RNA, 13 nt, Human
ucauuccugccug

SEQ ID NO: 2357614 - RNA, 22 nt, Human
ucauuccugaaagaaacaguua

SEQ ID NO: 2357615 - RNA, 21 nt, Human
ucauuccugaaagaaacaguu

SEQ ID NO: 2357616 - RNA, 20 nt, Human
ucauuccugaaagaaacagu

SEQ ID NO: 2357617 - RNA, 16 nt, Human
ucauuccugaaagaaa

SEQ ID NO: 2357618 - RNA, 18 nt, Human
ucauuccuaacacagcau

SEQ ID NO: 2357619 - RNA, 14 nt, Human
ucauuccugaaaga

SEQ ID NO: 2357620 - RNA, 23 nt, Human
accuuucuccuuuguacuuugug

SEQ ID NO: 2357621 - RNA, 19 nt, Human
accuuucuccuuuguacuu

SEQ ID NO: 2357622 - RNA, 20 nt, Human
accuuucuccuuuguacuuu

SEQ ID NO: 2357623 - RNA, 17 nt, Human
accuuuguccccaccgc

SEQ ID NO: 2357624 - RNA, 17 nt, Human
accuuugacaaagguaa

SEQ ID NO: 2357625 - RNA, 18 nt, Human
accuuugacaaagguaaa

SEQ ID NO: 2357626 - RNA, 14 nt, Human
accuuuuaacucac

SEQ ID NO: 2357627 - RNA, 21 nt, Human
accuuuuaacaccugaugugu

SEQ ID NO: 2357628 - RNA, 20 nt, Human
accuuuuaacaccugaugug

SEQ ID NO: 2357629 - RNA, 12 nt, Human
accuuuuaacac

SEQ ID NO: 2357630 - RNA, 22 nt, Human
accuuuguuugcaucugaaaau

SEQ ID NO: 2357631 - RNA, 18 nt, Human
accuuuguccccaccgca

SEQ ID NO: 2357632 - RNA, 18 nt, Human
accuuuggagcaaagcug

SEQ ID NO: 2357633 - RNA, 14 nt, Human
accuuugcaggcau

SEQ ID NO: 2357634 - RNA, 23 nt, Human
accuuugugggguuuuuggagaa

SEQ ID NO: 2357635 - RNA, 16 nt, Human
accuuuuauugacaca

SEQ ID NO: 2357636 - RNA, 17 nt, Human
accuuuugaggagcccc

SEQ ID NO: 2357637 - RNA, 21 nt, Human
accuuuugaggagccccagcu

SEQ ID NO: 2357638 - RNA, 20 nt, Human
accuuuuggucuggagggaa

SEQ ID NO: 2357639 - RNA, 15 nt, Human
accuuuuauccacuu

SEQ ID NO: 2357640 - RNA, 15 nt, Human
accuuuuauguagua

SEQ ID NO: 2357641 - RNA, 21 nt, Human
accuuuuaauuaaugaaauau

SEQ ID NO: 2357642 - RNA, 14 nt, Human
accuuuuauuacau

SEQ ID NO: 2357643 - RNA, 20 nt, Human
accuuuuauguaguaauuga

SEQ ID NO: 2357644 - RNA, 20 nt, Human
accuuuuauugacacagaaa

SEQ ID NO: 2357645 - RNA, 15 nt, Human
accuuuuuccuuccu

SEQ ID NO: 2357646 - RNA, 15 nt, Human
accuuuuuuaagauu

SEQ ID NO: 2357647 - RNA, 16 nt, Human
accuuuuuuaagauuu

SEQ ID NO: 2357648 - RNA, 14 nt, Human
uccacuccuuccug

SEQ ID NO: 2357649 - RNA, 13 nt, Human
uccacuccuuccu

SEQ ID NO: 2357650 - RNA, 20 nt, Human
accuuuuuuaagauuuuucu

SEQ ID NO: 2357651 - RNA, 22 nt, Human
accuuuuuuaagauuuuucuca

SEQ ID NO: 2357652 - RNA, 14 nt, Human
accuuuuuccuucc

SEQ ID NO: 2357653 - RNA, 19 nt, Human
accuuuuuauuugcaugug

SEQ ID NO: 2357654 - RNA, 14 nt, Human
accuuuuuaucucc

SEQ ID NO: 2357655 - RNA, 19 nt, Human
accuuuugaaguaguuugu

SEQ ID NO: 2357656 - RNA, 13 nt, Human
accuuuuuuauac

SEQ ID NO: 2357657 - RNA, 18 nt, Human
uccacucuacccucccac

SEQ ID NO: 2357658 - RNA, 17 nt, Human
uccacucuacccuccca

SEQ ID NO: 2357659 - RNA, 21 nt, Human
uccacucuacccucccacccc

SEQ ID NO: 2357660 - RNA, 20 nt, Human
uccacucuacccucccaccc

SEQ ID NO: 2357661 - RNA, 23 nt, Human
uccacucuacccucccacccccu

SEQ ID NO: 2357662 - RNA, 12 nt, Human
uccacucucccc

SEQ ID NO: 2357663 - RNA, 22 nt, Human
uccacugguucuucuuggucuc

SEQ ID NO: 2357664 - RNA, 13 nt, Human
uccacucuccccc

SEQ ID NO: 2357665 - RNA, 14 nt, Human
uccacucuccccca

SEQ ID NO: 2357666 - RNA, 16 nt, Human
uccacucucccccacc

SEQ ID NO: 2357667 - RNA, 18 nt, Human
uccacucucccccacccc

SEQ ID NO: 2357668 - RNA, 22 nt, Human
uccacugucacuguuucucugc

SEQ ID NO: 2357669 - RNA, 19 nt, Human
uccacugucacuguuucuc

SEQ ID NO: 2357670 - RNA, 18 nt, Human
uccagaaugcuguacauc

SEQ ID NO: 2357671 - RNA, 17 nt, Human
uccagaaugcuguacau

SEQ ID NO: 2357672 - RNA, 16 nt, Human
uccagaauugaccuuu

SEQ ID NO: 2357673 - RNA, 21 nt, Human
uccagaaugcuguacaucuau

SEQ ID NO: 2357674 - RNA, 18 nt, Human
uccagaauggucuuucua

SEQ ID NO: 2357675 - RNA, 21 nt, Human
uccacugugccaugugccagg

SEQ ID NO: 2357676 - RNA, 21 nt, Human
uccacuccuuccugccaccug

SEQ ID NO: 2357677 - RNA, 12 nt, Human
uccacugucacc

SEQ ID NO: 2357678 - RNA, 17 nt, Human
uccacugucacccucca

SEQ ID NO: 2357679 - RNA, 19 nt, Human
uccacugucacccuccacc

SEQ ID NO: 2357680 - RNA, 15 nt, Human
acgccucccacuggg

SEQ ID NO: 2357681 - RNA, 14 nt, Human
acgccucccacugg

SEQ ID NO: 2357682 - RNA, 18 nt, Human
acgccuaugaucccagca

SEQ ID NO: 2357683 - RNA, 17 nt, Human
acgccuaugaucccagc

SEQ ID NO: 2357684 - RNA, 16 nt, Human
acgccuaugaucccag

SEQ ID NO: 2357685 - RNA, 16 nt, Human
acgaacccaccugcug

SEQ ID NO: 2357686 - RNA, 15 nt, Human
acgaacccaccugcu

SEQ ID NO: 2357687 - RNA, 21 nt, Human
acgaauauugcugauggugca

SEQ ID NO: 2357688 - RNA, 21 nt, Human
acgccugcaaacgcugccugc

SEQ ID NO: 2357689 - RNA, 20 nt, Human
acgccugcaaacgcugccug

SEQ ID NO: 2357690 - RNA, 19 nt, Human
acgccugcaaacgcugccu

SEQ ID NO: 2357691 - RNA, 18 nt, Human
acgccugcaaacgcugcc

SEQ ID NO: 2357692 - RNA, 17 nt, Human
acgccugcaaacgcugc

SEQ ID NO: 2357693 - RNA, 14 nt, Human
acgccugcaaacgc

SEQ ID NO: 2357694 - RNA, 21 nt, Human
acgccugaggaacccuuacag

SEQ ID NO: 2357695 - RNA, 13 nt, Human
acgccugaggaac

SEQ ID NO: 2357696 - RNA, 18 nt, Human
acgccuuguucuuggcca

SEQ ID NO: 2357697 - RNA, 14 nt, Human
acgccuuguucuug

SEQ ID NO: 2357698 - RNA, 19 nt, Human
acgccuguaaucccagcag

SEQ ID NO: 2357699 - RNA, 23 nt, Human
acgcgaaaguaucaccagggugc

SEQ ID NO: 2357700 - RNA, 16 nt, Human
acgccuguaguccuag

SEQ ID NO: 2357701 - RNA, 21 nt, Human
acgccuguaaucccagcacuu

SEQ ID NO: 2357702 - RNA, 19 nt, Human
acgccuguaaucccagcac

SEQ ID NO: 2357703 - RNA, 18 nt, Human
acgccuguaaucccagca

SEQ ID NO: 2357704 - RNA, 20 nt, Human
acgccuguaaucccagcacu

SEQ ID NO: 2357705 - RNA, 17 nt, Human
acgccuguaaucccagc

SEQ ID NO: 2357706 - RNA, 16 nt, Human
acgccuguaaucccag

SEQ ID NO: 2357707 - RNA, 18 nt, Human
acgccugggggugccagg

SEQ ID NO: 2357708 - RNA, 15 nt, Human
acgccugccuccccu

SEQ ID NO: 2357709 - RNA, 23 nt, Human
acgccugcaaacgcugccugccc

SEQ ID NO: 2357710 - RNA, 22 nt, Human
acgccugcaaacgcugccugcc

SEQ ID NO: 2357711 - RNA, 19 nt, Human
acgccugcccuccccagag

SEQ ID NO: 2357712 - RNA, 21 nt, Human
acgccugcccuccccagagca

SEQ ID NO: 2357713 - RNA, 22 nt, Human
acgccugcccuccccagagcac

SEQ ID NO: 2357714 - RNA, 12 nt, Human
acgccugccucc

SEQ ID NO: 2357715 - RNA, 12 nt, Human
acgcggccgaga

SEQ ID NO: 2357716 - RNA, 12 nt, Human
acgcgucuccug

SEQ ID NO: 2357717 - RNA, 13 nt, Human
acgcgucuuccug

SEQ ID NO: 2357718 - RNA, 22 nt, Human
acgcgaaaguaucaccagggug

SEQ ID NO: 2357719 - RNA, 21 nt, Human
acgcuacccgggaagggggcu

SEQ ID NO: 2357720 - RNA, 15 nt, Human
acgcgucuuccugag

SEQ ID NO: 2357721 - RNA, 22 nt, Human
acgcucuccuuucuuucuaacu

SEQ ID NO: 2357722 - RNA, 13 nt, Human
acgcuggaccuug

SEQ ID NO: 2357723 - RNA, 14 nt, Human
acgcucucuggccu

SEQ ID NO: 2357724 - RNA, 11 nt, Human
acgcucucugg

SEQ ID NO: 2357725 - RNA, 22 nt, Human
acgcuccccgccuguucccccg

SEQ ID NO: 2357726 - RNA, 14 nt, Human
acgcuccuuccucu

SEQ ID NO: 2357727 - RNA, 22 nt, Human
acgcuccucccucugaggcugu

SEQ ID NO: 2357728 - RNA, 23 nt, Human
acgcuccucccucugaggcugua

SEQ ID NO: 2357729 - RNA, 15 nt, Human
acgcuccuuccucug

SEQ ID NO: 2357730 - RNA, 15 nt, Human
acgcgucuccuguuu

SEQ ID NO: 2357731 - RNA, 14 nt, Human
acgcuccccgccug

SEQ ID NO: 2357732 - RNA, 17 nt, Human
acgcuccccgccuguuc

SEQ ID NO: 2357733 - RNA, 18 nt, Human
acgcuccccgccuguucc

SEQ ID NO: 2357734 - RNA, 19 nt, Human
acgcuccccgccuguuccc

SEQ ID NO: 2357735 - RNA, 20 nt, Human
acgcuccccgccuguucccc

SEQ ID NO: 2357736 - RNA, 20 nt, Human
acggauccauguagcaggac

SEQ ID NO: 2357737 - RNA, 13 nt, Human
acggagucucgcu

SEQ ID NO: 2357738 - RNA, 17 nt, Human
acggaucagaaauacag

SEQ ID NO: 2357739 - RNA, 16 nt, Human
acggaucagaaauaca

SEQ ID NO: 2357740 - RNA, 23 nt, Human
acggagucccaccuuggcugcag

SEQ ID NO: 2357741 - RNA, 17 nt, Human
acgcuggagugcaguga

SEQ ID NO: 2357742 - RNA, 20 nt, Human
acgcuggaccuugaacuggg

SEQ ID NO: 2357743 - RNA, 23 nt, Human
acgcuggaccuugaacuggguac

SEQ ID NO: 2357744 - RNA, 15 nt, Human
acgcuggagugcagu

SEQ ID NO: 2357745 - RNA, 16 nt, Human
acgcuggagugcagug

SEQ ID NO: 2357746 - RNA, 18 nt, Human
acggccacaucaaagagg

SEQ ID NO: 2357747 - RNA, 13 nt, Human
acggccacaucaa

SEQ ID NO: 2357748 - RNA, 19 nt, Human
acggcucgauuucuccagg

SEQ ID NO: 2357749 - RNA, 18 nt, Human
acggcucgauuucuccag

SEQ ID NO: 2357750 - RNA, 15 nt, Human
acggccacuggccau

SEQ ID NO: 2357751 - RNA, 17 nt, Human
acggcucuagguggggc

SEQ ID NO: 2357752 - RNA, 18 nt, Human
acggcucuagguggggcg

SEQ ID NO: 2357753 - RNA, 19 nt, Human
acggcucuagguggggcgg

SEQ ID NO: 2357754 - RNA, 11 nt, Human
acggcugggca

SEQ ID NO: 2357755 - RNA, 22 nt, Human
acggcugggcacacgccuccca

SEQ ID NO: 2357756 - RNA, 23 nt, Human
acggcuuagacuucgacucagga

SEQ ID NO: 2357757 - RNA, 18 nt, Human
acggcuuuuacuuaaacc

SEQ ID NO: 2357758 - RNA, 14 nt, Human
uccaguaucuugaa

SEQ ID NO: 2357759 - RNA, 15 nt, Human
uccaguaucuugaag

SEQ ID NO: 2357760 - RNA, 15 nt, Human
uccaguaaucuaaua

SEQ ID NO: 2357761 - RNA, 19 nt, Human
uccaguaaucuaauauggc

SEQ ID NO: 2357762 - RNA, 13 nt, Human
acgggaccgggcc

SEQ ID NO: 2357763 - RNA, 15 nt, Human
acgggaccgggccgc

SEQ ID NO: 2357764 - RNA, 15 nt, Human
acgggacugacgcaa

SEQ ID NO: 2357765 - RNA, 17 nt, Human
acgggaaguuuagagag

SEQ ID NO: 2357766 - RNA, 16 nt, Human
acggcucacugcagcc

SEQ ID NO: 2357767 - RNA, 17 nt, Human
acggcucacugcagccu

SEQ ID NO: 2357768 - RNA, 18 nt, Human
acggcucacugcagccuc

SEQ ID NO: 2357769 - RNA, 12 nt, Human
acggccaggcca

SEQ ID NO: 2357770 - RNA, 22 nt, Human
acggcaggcucacugccaggcc

SEQ ID NO: 2357771 - RNA, 16 nt, Human
acggccaacaaagcug

SEQ ID NO: 2357772 - RNA, 21 nt, Human
acggauccauguagcaggacu

SEQ ID NO: 2357773 - RNA, 15 nt, Human
acggaucugagaauc

SEQ ID NO: 2357774 - RNA, 17 nt, Human
acggaucugagaaucuu

SEQ ID NO: 2357775 - RNA, 16 nt, Human
acggaugauuggauua

SEQ ID NO: 2357776 - RNA, 15 nt, Human
acggcaggcucacug

SEQ ID NO: 2357777 - RNA, 17 nt, Human
acggcaggcucacugcc

SEQ ID NO: 2357778 - RNA, 18 nt, Human
acggcaggcucacugcca

SEQ ID NO: 2357779 - RNA, 20 nt, Human
acggcaggcucacugccagg

SEQ ID NO: 2357780 - RNA, 18 nt, Human
uccagugcaacacugaag

SEQ ID NO: 2357781 - RNA, 14 nt, Human
uccagugcaauugu

SEQ ID NO: 2357782 - RNA, 18 nt, Human
uccagugagcuuaucaug

SEQ ID NO: 2357783 - RNA, 19 nt, Human
uccagugccaacaauccua

SEQ ID NO: 2357784 - RNA, 18 nt, Human
uccagugccaacaauccu

SEQ ID NO: 2357785 - RNA, 14 nt, Human
uccagugccagcaa

SEQ ID NO: 2357786 - RNA, 17 nt, Human
uccagugccagcaauga

SEQ ID NO: 2357787 - RNA, 20 nt, Human
uccagugcccauuccucacc

SEQ ID NO: 2357788 - RNA, 19 nt, Human
uccaguggggcaagauuuu

SEQ ID NO: 2357789 - RNA, 22 nt, Human
uccagugaggcucugcccuugg

SEQ ID NO: 2357790 - RNA, 23 nt, Human
uccagugaggcucugcccuuggu

SEQ ID NO: 2357791 - RNA, 14 nt, Human
uccagucugcugcc

SEQ ID NO: 2357792 - RNA, 13 nt, Human
uccagucugcugc

SEQ ID NO: 2357793 - RNA, 19 nt, Human
uccagucuccaccaggaac

SEQ ID NO: 2357794 - RNA, 16 nt, Human
uccagugaggcucugc

SEQ ID NO: 2357795 - RNA, 15 nt, Human
uccagugaggcucug

SEQ ID NO: 2357796 - RNA, 18 nt, Human
uccagugagacagcucug

SEQ ID NO: 2357797 - RNA, 22 nt, Human
uccagucuaaaaauaucugucu

SEQ ID NO: 2357798 - RNA, 16 nt, Human
uccagucuccaccagg

SEQ ID NO: 2357799 - RNA, 15 nt, Human
uccagucuccaccag

SEQ ID NO: 2357800 - RNA, 17 nt, Human
uccaguccaaucucaug

SEQ ID NO: 2357801 - RNA, 16 nt, Human
uccaguccaaggaaac

SEQ ID NO: 2357802 - RNA, 23 nt, Human
uccaguccaaggaaaccacagcu

SEQ ID NO: 2357803 - RNA, 23 nt, Human
uccaguagcuugggacaaaucaa

SEQ ID NO: 2357804 - RNA, 17 nt, Human
uccaguaccuuugucac

SEQ ID NO: 2357805 - RNA, 16 nt, Human
uccaguaggauccagu

SEQ ID NO: 2357806 - RNA, 13 nt, Human
uccaguauucuug

SEQ ID NO: 2357807 - RNA, 19 nt, Human
uccaguauucuugucaaaa

SEQ ID NO: 2357808 - RNA, 13 nt, Human
uccagucaacaaa

SEQ ID NO: 2357809 - RNA, 22 nt, Human
uccagucaacaaacuauuucuu

SEQ ID NO: 2357810 - RNA, 13 nt, Human
uccagucaggaug

SEQ ID NO: 2357811 - RNA, 20 nt, Human
uccagucaggccuaucuaaa

SEQ ID NO: 2357812 - RNA, 16 nt, Human
uccaguaucuugaaga

SEQ ID NO: 2357813 - RNA, 18 nt, Human
uccaguaucuugaagacu

SEQ ID NO: 2357814 - RNA, 13 nt, Human
acguuuguaugug

SEQ ID NO: 2357815 - RNA, 16 nt, Human
acuaaacuuucacacc

SEQ ID NO: 2357816 - RNA, 15 nt, Human
acuaaacuuucacac

SEQ ID NO: 2357817 - RNA, 18 nt, Human
acguuggagaagcccgug

SEQ ID NO: 2357818 - RNA, 22 nt, Human
acguuucuaaaggcuaccuuug

SEQ ID NO: 2357819 - RNA, 21 nt, Human
acuaaagagagaauguagaua

SEQ ID NO: 2357820 - RNA, 16 nt, Human
acuaaagagagaaugu

SEQ ID NO: 2357821 - RNA, 14 nt, Human
acuaaagagagaau

SEQ ID NO: 2357822 - RNA, 12 nt, Human
acuaaagagaga

SEQ ID NO: 2357823 - RNA, 15 nt, Human
acuaaagaaagauua

SEQ ID NO: 2357824 - RNA, 17 nt, Human
acuaaagaaagauuacu

SEQ ID NO: 2357825 - RNA, 13 nt, Human
acuaaacuuuacc

SEQ ID NO: 2357826 - RNA, 21 nt, Human
acuaaagaaaauaucugaaau

SEQ ID NO: 2357827 - RNA, 17 nt, Human
acuaaagcaguagaaau

SEQ ID NO: 2357828 - RNA, 13 nt, Human
acuaacagauaag

SEQ ID NO: 2357829 - RNA, 22 nt, Human
acuaacacuauuuuaugcaaau

SEQ ID NO: 2357830 - RNA, 16 nt, Human
acuaacagauaagcaa

SEQ ID NO: 2357831 - RNA, 17 nt, Human
acuaauuugauguuuac

SEQ ID NO: 2357832 - RNA, 19 nt, Human
acuacacauucaauaagca

SEQ ID NO: 2357833 - RNA, 15 nt, Human
acuacacauucaaua

SEQ ID NO: 2357834 - RNA, 23 nt, Human
acuacacaucccuaaugugugcc

SEQ ID NO: 2357835 - RNA, 18 nt, Human
acuacaaaauuugaaauu

SEQ ID NO: 2357836 - RNA, 16 nt, Human
acuacaaaauuugaaa

SEQ ID NO: 2357837 - RNA, 18 nt, Human
acuacaaacaaaauuucu

SEQ ID NO: 2357838 - RNA, 14 nt, Human
acuacaaaauuuga

SEQ ID NO: 2357839 - RNA, 13 nt, Human
acuacaaaauuug

SEQ ID NO: 2357840 - RNA, 21 nt, Human
acuacaaaaaaguuguuaacu

SEQ ID NO: 2357841 - RNA, 12 nt, Human
acuaacacuauu

SEQ ID NO: 2357842 - RNA, 15 nt, Human
acuaacacuauuuua

SEQ ID NO: 2357843 - RNA, 18 nt, Human
acuaaauuguaaacuccu

SEQ ID NO: 2357844 - RNA, 15 nt, Human
acuaauuuuaaaaug

SEQ ID NO: 2357845 - RNA, 17 nt, Human
ucccacuuggaggccuu

SEQ ID NO: 2357846 - RNA, 21 nt, Human
ucccacuuggcaucagcuggc

SEQ ID NO: 2357847 - RNA, 23 nt, Human
ucccacuuggcaucagcuggcgu

SEQ ID NO: 2357848 - RNA, 12 nt, Human
ucccacuuguca

SEQ ID NO: 2357849 - RNA, 13 nt, Human
ucccacuuggcca

SEQ ID NO: 2357850 - RNA, 14 nt, Human
ucccacuuggccaa

SEQ ID NO: 2357851 - RNA, 20 nt, Human
acuacacuccagccugagca

SEQ ID NO: 2357852 - RNA, 19 nt, Human
acuacacuccagccugagc

SEQ ID NO: 2357853 - RNA, 18 nt, Human
acuacacuccagccugag

SEQ ID NO: 2357854 - RNA, 17 nt, Human
acuacacuccagccuga

SEQ ID NO: 2357855 - RNA, 15 nt, Human
acuacacuccagccu

SEQ ID NO: 2357856 - RNA, 23 nt, Human
acuacaccauguuugagcucaga

SEQ ID NO: 2357857 - RNA, 14 nt, Human
acuacaccuggcug

SEQ ID NO: 2357858 - RNA, 13 nt, Human
acuacaccuggcu

SEQ ID NO: 2357859 - RNA, 16 nt, Human
ucccagagacaggaaa

SEQ ID NO: 2357860 - RNA, 22 nt, Human
ucccagaccugccucuuccccc

SEQ ID NO: 2357861 - RNA, 23 nt, Human
ucccagaaucaaagcaaugcauu

SEQ ID NO: 2357862 - RNA, 22 nt, Human
ucccagaaucaaagcaaugcau

SEQ ID NO: 2357863 - RNA, 18 nt, Human
ucccagacacccacccuc

SEQ ID NO: 2357864 - RNA, 18 nt, Human
ucccagagacaggaaaau

SEQ ID NO: 2357865 - RNA, 17 nt, Human
ucccagagacaggaaaa

SEQ ID NO: 2357866 - RNA, 20 nt, Human
ucccagagacaggaaaaucc

SEQ ID NO: 2357867 - RNA, 16 nt, Human
ucccagagcaaaauaa

SEQ ID NO: 2357868 - RNA, 20 nt, Human
ucccagaaggaccuccugag

SEQ ID NO: 2357869 - RNA, 12 nt, Human
ucccagaaucaa

SEQ ID NO: 2357870 - RNA, 18 nt, Human
ucccagaaucaaagcaau

SEQ ID NO: 2357871 - RNA, 19 nt, Human
ucccagaaucaaagcaaug

SEQ ID NO: 2357872 - RNA, 18 nt, Human
ucccagaaggaccuccug

SEQ ID NO: 2357873 - RNA, 20 nt, Human
ucccagaacacacuccauca

SEQ ID NO: 2357874 - RNA, 19 nt, Human
ucccagaacacacuccauc

SEQ ID NO: 2357875 - RNA, 17 nt, Human
ucccagaacacacucca

SEQ ID NO: 2357876 - RNA, 12 nt, Human
ucccagaaauua

SEQ ID NO: 2357877 - RNA, 23 nt, Human
ucccacuuggccaagcagggagg

SEQ ID NO: 2357878 - RNA, 16 nt, Human
ucccagauacuugggg

SEQ ID NO: 2357879 - RNA, 17 nt, Human
ucccagaggcugcccca

SEQ ID NO: 2357880 - RNA, 16 nt, Human
ucccagaggcugcccc

SEQ ID NO: 2357881 - RNA, 21 nt, Human
ucccagaggguuuccaugggg

SEQ ID NO: 2357882 - RNA, 18 nt, Human
ucccagagcaggaggccc

SEQ ID NO: 2357883 - RNA, 21 nt, Human
ucccagagcaggaggccccug

SEQ ID NO: 2357884 - RNA, 17 nt, Human
ucccagagcaggaggcc

SEQ ID NO: 2357885 - RNA, 15 nt, Human
ucccagagugcuggg

SEQ ID NO: 2357886 - RNA, 16 nt, Human
ucccagauaaugugaa

SEQ ID NO: 2357887 - RNA, 17 nt, Human
ucccagaucggaucugu

SEQ ID NO: 2357888 - RNA, 18 nt, Human
ucccagauacuugggggg

SEQ ID NO: 2357889 - RNA, 22 nt, Human
ucccagauuggcucacacugag

SEQ ID NO: 2357890 - RNA, 18 nt, Human
ucccagauuggcucacac

SEQ ID NO: 2357891 - RNA, 19 nt, Human
ucccagauuggcucacacu

SEQ ID NO: 2357892 - RNA, 20 nt, Human
ucccagauuggcucacacug

SEQ ID NO: 2357893 - RNA, 21 nt, Human
ucccagauuggcucacacuga

SEQ ID NO: 2357894 - RNA, 17 nt, Human
acguaaagcuagaaaug

SEQ ID NO: 2357895 - RNA, 18 nt, Human
acguaaagcuagaaauga

SEQ ID NO: 2357896 - RNA, 19 nt, Human
acggugggcauuugugagg

SEQ ID NO: 2357897 - RNA, 18 nt, Human
acggugggcauuugugag

SEQ ID NO: 2357898 - RNA, 20 nt, Human
acggugggccuugcugggga

SEQ ID NO: 2357899 - RNA, 15 nt, Human
acggugcuccaggca

SEQ ID NO: 2357900 - RNA, 18 nt, Human
acggugcuccaggcaggc

SEQ ID NO: 2357901 - RNA, 22 nt, Human
acggugcuccaggcaggcuaag

SEQ ID NO: 2357902 - RNA, 14 nt, Human
acggugcccaagcc

SEQ ID NO: 2357903 - RNA, 20 nt, Human
acggucuguucuugaagcag

SEQ ID NO: 2357904 - RNA, 15 nt, Human
acggugcccaagcca

SEQ ID NO: 2357905 - RNA, 17 nt, Human
acggugcagucugggug

SEQ ID NO: 2357906 - RNA, 21 nt, Human
acggugccuuuuuucacggaa

SEQ ID NO: 2357907 - RNA, 18 nt, Human
acguaaccacggaaaaga

SEQ ID NO: 2357908 - RNA, 17 nt, Human
acggugggccuugcugg

SEQ ID NO: 2357909 - RNA, 18 nt, Human
acguaaugaaacuuggau

SEQ ID NO: 2357910 - RNA, 17 nt, Human
acgucaagucuccuucc

SEQ ID NO: 2357911 - RNA, 17 nt, Human
acgucaaacaugaagug

SEQ ID NO: 2357912 - RNA, 16 nt, Human
acgucaaacaugaagu

SEQ ID NO: 2357913 - RNA, 14 nt, Human
acgucaaacaugaa

SEQ ID NO: 2357914 - RNA, 16 nt, Human
uccagugucucggagg

SEQ ID NO: 2357915 - RNA, 19 nt, Human
uccaguuaaaaaaaauuuu

SEQ ID NO: 2357916 - RNA, 19 nt, Human
uccauccugaggcuccacu

SEQ ID NO: 2357917 - RNA, 16 nt, Human
uccagugucucacagc

SEQ ID NO: 2357918 - RNA, 18 nt, Human
acggucuguucuugaagc

SEQ ID NO: 2357919 - RNA, 15 nt, Human
uccauccugaggcuc

SEQ ID NO: 2357920 - RNA, 12 nt, Human
uccauccugagg

SEQ ID NO: 2357921 - RNA, 20 nt, Human
uccaguguccuuagaacauu

SEQ ID NO: 2357922 - RNA, 15 nt, Human
uccagugucucacag

SEQ ID NO: 2357923 - RNA, 21 nt, Human
uccaguguccuuagaacauuu

SEQ ID NO: 2357924 - RNA, 18 nt, Human
uccaguguccuuagaaca

SEQ ID NO: 2357925 - RNA, 17 nt, Human
uccaguguccuuagaac

SEQ ID NO: 2357926 - RNA, 20 nt, Human
uccaguggggcaagauuuuc

SEQ ID NO: 2357927 - RNA, 20 nt, Human
uccagugguccauggaaugc

SEQ ID NO: 2357928 - RNA, 22 nt, Human
uccagugguccauggaaugcuu

SEQ ID NO: 2357929 - RNA, 12 nt, Human
uccaguggugaa

SEQ ID NO: 2357930 - RNA, 19 nt, Human
uccaguggugaagaaaacu

SEQ ID NO: 2357931 - RNA, 15 nt, Human
uccagugguugcugu

SEQ ID NO: 2357932 - RNA, 19 nt, Human
uccagugguugcuguugau

SEQ ID NO: 2357933 - RNA, 16 nt, Human
uccagugguuugagac

SEQ ID NO: 2357934 - RNA, 23 nt, Human
uccagugguuugagacacugguu

SEQ ID NO: 2357935 - RNA, 13 nt, Human
acguucaccccuc

SEQ ID NO: 2357936 - RNA, 19 nt, Human
acguuggagaagcccgugu

SEQ ID NO: 2357937 - RNA, 18 nt, Human
acguuagaccacaaauag

SEQ ID NO: 2357938 - RNA, 16 nt, Human
acguuaugguguuucu

SEQ ID NO: 2357939 - RNA, 17 nt, Human
acguuaugguguuucuc

SEQ ID NO: 2357940 - RNA, 13 nt, Human
acguugugcauuu

SEQ ID NO: 2357941 - RNA, 15 nt, Human
acguuaccaggcagg

SEQ ID NO: 2357942 - RNA, 21 nt, Human
acguuaagggaaggaacucug

SEQ ID NO: 2357943 - RNA, 16 nt, Human
acguuagucgugagcu

SEQ ID NO: 2357944 - RNA, 12 nt, Human
acguuacauuuu

SEQ ID NO: 2357945 - RNA, 17 nt, Human
acguuagaccacaaaua

SEQ ID NO: 2357946 - RNA, 21 nt, Human
acguuagucgugagcucuugu

SEQ ID NO: 2357947 - RNA, 22 nt, Human
acguuagucgugagcucuugug

SEQ ID NO: 2357948 - RNA, 15 nt, Human
acguugugcauuugg

SEQ ID NO: 2357949 - RNA, 14 nt, Human
acguugugcauuug

SEQ ID NO: 2357950 - RNA, 16 nt, Human
acguuucuaaaggcua

SEQ ID NO: 2357951 - RNA, 15 nt, Human
acguuucuaaaggcu

SEQ ID NO: 2357952 - RNA, 12 nt, Human
acgucccuccac

SEQ ID NO: 2357953 - RNA, 22 nt, Human
acgucccuccacguucaccccu

SEQ ID NO: 2357954 - RNA, 17 nt, Human
acguggcugcuucaagg

SEQ ID NO: 2357955 - RNA, 18 nt, Human
acguggcugcuucaagga

SEQ ID NO: 2357956 - RNA, 17 nt, Human
acgucaucuaguuuuaa

SEQ ID NO: 2357957 - RNA, 13 nt, Human
acgucccccuggg

SEQ ID NO: 2357958 - RNA, 23 nt, Human
acguccaccaugggguccuacca

SEQ ID NO: 2357959 - RNA, 18 nt, Human
acguccagaauuuuucau

SEQ ID NO: 2357960 - RNA, 21 nt, Human
acgucacuggaccacugggca

SEQ ID NO: 2357961 - RNA, 16 nt, Human
acguccugccaccugg

SEQ ID NO: 2357962 - RNA, 15 nt, Human
acguccugccaccug

SEQ ID NO: 2357963 - RNA, 23 nt, Human
acgugugugacucagaugucucu

SEQ ID NO: 2357964 - RNA, 16 nt, Human
acguguuugugcugug

SEQ ID NO: 2357965 - RNA, 22 nt, Human
acguguuuuauuccuguauguu

SEQ ID NO: 2357966 - RNA, 11 nt, Human
acguguugccu

SEQ ID NO: 2357967 - RNA, 19 nt, Human
acguggcugcuucaaggau

SEQ ID NO: 2357968 - RNA, 21 nt, Human
acguggcugcuucaaggaucc

SEQ ID NO: 2357969 - RNA, 16 nt, Human
ucccagcuacaccuuu

SEQ ID NO: 2357970 - RNA, 16 nt, Human
ucccagcuaccucaac

SEQ ID NO: 2357971 - RNA, 14 nt, Human
ucccagcuacucag

SEQ ID NO: 2357972 - RNA, 22 nt, Human
ucccagcuacucaagaggcuga

SEQ ID NO: 2357973 - RNA, 13 nt, Human
ucccagcuacuca

SEQ ID NO: 2357974 - RNA, 21 nt, Human
ucccagccuuggcaucuagag

SEQ ID NO: 2357975 - RNA, 23 nt, Human
ucccagcuacucagaagccugag

SEQ ID NO: 2357976 - RNA, 21 nt, Human
ucccagcuacucagaagccug

SEQ ID NO: 2357977 - RNA, 19 nt, Human
ucccagcuacucagaagcc

SEQ ID NO: 2357978 - RNA, 16 nt, Human
ucccagcuacucagaa

SEQ ID NO: 2357979 - RNA, 22 nt, Human
ucccagcccuuugggaggcuga

SEQ ID NO: 2357980 - RNA, 15 nt, Human
ucccagcccuaugga

SEQ ID NO: 2357981 - RNA, 16 nt, Human
ucccagcccuauggau

SEQ ID NO: 2357982 - RNA, 17 nt, Human
ucccagcccuauggaug

SEQ ID NO: 2357983 - RNA, 13 nt, Human
ucccagccuuggc

SEQ ID NO: 2357984 - RNA, 14 nt, Human
ucccagccuuggca

SEQ ID NO: 2357985 - RNA, 10 nt, Human
ucccagccug

SEQ ID NO: 2357986 - RNA, 18 nt, Human
ucccagcccuauggaugu

SEQ ID NO: 2357987 - RNA, 19 nt, Human
ucccagcuacuugggaggc

SEQ ID NO: 2357988 - RNA, 17 nt, Human
ucccagcuacuugggaa

SEQ ID NO: 2357989 - RNA, 17 nt, Human
ucccagcuacuugggag

SEQ ID NO: 2357990 - RNA, 18 nt, Human
ucccagcuacuugggagg

SEQ ID NO: 2357991 - RNA, 16 nt, Human
ucccagcuacucggga

SEQ ID NO: 2357992 - RNA, 16 nt, Human
ucccagcuacucagga

SEQ ID NO: 2357993 - RNA, 15 nt, Human
ucccagcuacucagg

SEQ ID NO: 2357994 - RNA, 17 nt, Human
ucccagcuacucaggag

SEQ ID NO: 2357995 - RNA, 16 nt, Human
ucccagcuacuuggga

SEQ ID NO: 2357996 - RNA, 20 nt, Human
ucccagcucuagacaacccu

SEQ ID NO: 2357997 - RNA, 21 nt, Human
ucccagcucuagacaacccug

SEQ ID NO: 2357998 - RNA, 21 nt, Human
ucccauugucccucugcccca

SEQ ID NO: 2357999 - RNA, 19 nt, Human
ucccauugucccucugccc

SEQ ID NO: 2358000 - RNA, 18 nt, Human
ucccauugucccucugcc

SEQ ID NO: 2358001 - RNA, 17 nt, Human
ucccauugucccucugc

SEQ ID NO: 2358002 - RNA, 17 nt, Human
ucccagcucacgucaca

SEQ ID NO: 2358003 - RNA, 16 nt, Human
ucccagcucacgucac

SEQ ID NO: 2358004 - RNA, 22 nt, Human
ucccauuuugcaaaauuuccag

SEQ ID NO: 2358005 - RNA, 21 nt, Human
ucccauuuugcaaaauuucca

SEQ ID NO: 2358006 - RNA, 13 nt, Human
ucccauuuugcaa

SEQ ID NO: 2358007 - RNA, 12 nt, Human
uccccacccuga

SEQ ID NO: 2358008 - RNA, 24 nt, Human
ucccauuucuaaaggccucuuccu

SEQ ID NO: 2358009 - RNA, 21 nt, Human
ucccauuucuaaaggccucuu

SEQ ID NO: 2358010 - RNA, 14 nt, Human
ucccauuucuacuc

SEQ ID NO: 2358011 - RNA, 15 nt, Human
ucccauuucucacug

SEQ ID NO: 2358012 - RNA, 16 nt, Human
ucccauuucucacuga

SEQ ID NO: 2358013 - RNA, 18 nt, Human
ucccauuucucacugaga

SEQ ID NO: 2358014 - RNA, 16 nt, Human
ucccauuguggcuccu

SEQ ID NO: 2358015 - RNA, 13 nt, Human
ucccauuucagcu

SEQ ID NO: 2358016 - RNA, 23 nt, Human
uccccacccugaaagcccugagc

SEQ ID NO: 2358017 - RNA, 15 nt, Human
uccccaccgcagaca

SEQ ID NO: 2358018 - RNA, 16 nt, Human
uccccaccgcagacag

SEQ ID NO: 2358019 - RNA, 18 nt, Human
uccccaggaggccagccu

SEQ ID NO: 2358020 - RNA, 23 nt, Human
acuacugacauguggggccaggu

SEQ ID NO: 2358021 - RNA, 18 nt, Human
acuacugacauguggggc

SEQ ID NO: 2358022 - RNA, 13 nt, Human
acuacucugugcc

SEQ ID NO: 2358023 - RNA, 16 nt, Human
ucccccagccccaucc

SEQ ID NO: 2358024 - RNA, 13 nt, Human
ucccccagcccca

SEQ ID NO: 2358025 - RNA, 15 nt, Human
ucccccagccccauc

SEQ ID NO: 2358026 - RNA, 19 nt, Human
acuagacucccaagcugga

SEQ ID NO: 2358027 - RNA, 18 nt, Human
acuacuguguuccuggca

SEQ ID NO: 2358028 - RNA, 16 nt, Human
acuacuguguuccugg

SEQ ID NO: 2358029 - RNA, 21 nt, Human
acuacuguguuccuggcaaua

SEQ ID NO: 2358030 - RNA, 15 nt, Human
acuagacauucuguc

SEQ ID NO: 2358031 - RNA, 16 nt, Human
acuagacauucugucg

SEQ ID NO: 2358032 - RNA, 20 nt, Human
acuagacauucugucgccuu

SEQ ID NO: 2358033 - RNA, 21 nt, Human
acuacuguggaaaaauauuua

SEQ ID NO: 2358034 - RNA, 20 nt, Human
acuacuguggaaaaauauuu

SEQ ID NO: 2358035 - RNA, 19 nt, Human
acuacuguggaaaaauauu

SEQ ID NO: 2358036 - RNA, 18 nt, Human
acuacuguggaaaaauau

SEQ ID NO: 2358037 - RNA, 15 nt, Human
acuacuguguuccug

SEQ ID NO: 2358038 - RNA, 22 nt, Human
acuacuguggaaaaauauuuaa

SEQ ID NO: 2358039 - RNA, 13 nt, Human
acuacuguguucc

SEQ ID NO: 2358040 - RNA, 20 nt, Human
acuacugcuaccacaacuau

SEQ ID NO: 2358041 - RNA, 18 nt, Human
acuacugggcaaagagug

SEQ ID NO: 2358042 - RNA, 19 nt, Human
ucccauuuuggaaguuuuc

SEQ ID NO: 2358043 - RNA, 18 nt, Human
ucccauuuuggaaguuuu

SEQ ID NO: 2358044 - RNA, 23 nt, Human
uccccaggggagagggucuggag

SEQ ID NO: 2358045 - RNA, 14 nt, Human
uccccaggggagag

SEQ ID NO: 2358046 - RNA, 18 nt, Human
uccccaggggaaaaugaa

SEQ ID NO: 2358047 - RNA, 19 nt, Human
uccccaggggaaaaugaag

SEQ ID NO: 2358048 - RNA, 10 nt, Human
uccccagggg

SEQ ID NO: 2358049 - RNA, 20 nt, Human
uccccaggaggccagccuug

SEQ ID NO: 2358050 - RNA, 21 nt, Human
uccccaggaggccagccuuga

SEQ ID NO: 2358051 - RNA, 23 nt, Human
uccccaggggucccagccacccc

SEQ ID NO: 2358052 - RNA, 22 nt, Human
uccccaggggucccagccaccc

SEQ ID NO: 2358053 - RNA, 15 nt, Human
uccccagguccagcu

SEQ ID NO: 2358054 - RNA, 16 nt, Human
uccccagguccagcuc

SEQ ID NO: 2358055 - RNA, 20 nt, Human
uccccaggggucccagccac

SEQ ID NO: 2358056 - RNA, 18 nt, Human
uccccaggggucccagcc

SEQ ID NO: 2358057 - RNA, 17 nt, Human
uccccaggggucccagc

SEQ ID NO: 2358058 - RNA, 15 nt, Human
uccccaggggaguug

SEQ ID NO: 2358059 - RNA, 20 nt, Human
uccccagguggcugacccag

SEQ ID NO: 2358060 - RNA, 19 nt, Human
uccccagguggcugaccca

SEQ ID NO: 2358061 - RNA, 18 nt, Human
uccccagguggcugaccc

SEQ ID NO: 2358062 - RNA, 15 nt, Human
uccccagguggcuga

SEQ ID NO: 2358063 - RNA, 17 nt, Human
uccccagguccagcucu

SEQ ID NO: 2358064 - RNA, 23 nt, Human
uccccagguccagcucuggaggg

SEQ ID NO: 2358065 - RNA, 11 nt, Human
ucccccagccc

SEQ ID NO: 2358066 - RNA, 19 nt, Human
acuagagggaccucuccca

SEQ ID NO: 2358067 - RNA, 18 nt, Human
acuagagggaccucuccc

SEQ ID NO: 2358068 - RNA, 21 nt, Human
acuagagcagcccuggaguca

SEQ ID NO: 2358069 - RNA, 15 nt, Human
acuagaggcagggag

SEQ ID NO: 2358070 - RNA, 14 nt, Human
acuagaggcaggga

SEQ ID NO: 2358071 - RNA, 17 nt, Human
acuagagaucugguuuu

SEQ ID NO: 2358072 - RNA, 16 nt, Human
acuagagcagcccugg

SEQ ID NO: 2358073 - RNA, 23 nt, Human
acuagagaucugguuuugcuauu

SEQ ID NO: 2358074 - RNA, 19 nt, Human
acuagagcagcccuggagu

SEQ ID NO: 2358075 - RNA, 20 nt, Human
acuauagccuaggugacaga

SEQ ID NO: 2358076 - RNA, 22 nt, Human
acuauagccuaggugacagagu

SEQ ID NO: 2358077 - RNA, 16 nt, Human
acuagaggcagggagg

SEQ ID NO: 2358078 - RNA, 18 nt, Human
acuauagccuaggugaca

SEQ ID NO: 2358079 - RNA, 17 nt, Human
acuauauuguuugcuaa

SEQ ID NO: 2358080 - RNA, 22 nt, Human
acuauauuugggccugcuccag

SEQ ID NO: 2358081 - RNA, 23 nt, Human
acuauauuugggccugcuccaga

SEQ ID NO: 2358082 - RNA, 21 nt, Human
acuauaguccagcuuuguucu

SEQ ID NO: 2358083 - RNA, 22 nt, Human
acuauauuguuugcuaagcauu

SEQ ID NO: 2358084 - RNA, 19 nt, Human
acuaucaaacugaagccag

SEQ ID NO: 2358085 - RNA, 14 nt, Human
acuaucaaacugaa

SEQ ID NO: 2358086 - RNA, 16 nt, Human
acuaucuacucuccuc

SEQ ID NO: 2358087 - RNA, 15 nt, Human
acuaucuacucuccu

SEQ ID NO: 2358088 - RNA, 15 nt, Human
acuaucucauuucca

SEQ ID NO: 2358089 - RNA, 21 nt, Human
acuaucuaaauguugaaagau

SEQ ID NO: 2358090 - RNA, 16 nt, Human
acuaucuaaauguuga

SEQ ID NO: 2358091 - RNA, 17 nt, Human
acuaucuacucuccuca

SEQ ID NO: 2358092 - RNA, 12 nt, Human
acuaucugggug

SEQ ID NO: 2358093 - RNA, 14 nt, Human
acuaucugucuggu

SEQ ID NO: 2358094 - RNA, 16 nt, Human
acuaugccugugucuu

SEQ ID NO: 2358095 - RNA, 17 nt, Human
acuaucugucugguggc

SEQ ID NO: 2358096 - RNA, 19 nt, Human
acuaucuacucuccucauc

SEQ ID NO: 2358097 - RNA, 20 nt, Human
acuaucugaaccauuaaagu

SEQ ID NO: 2358098 - RNA, 12 nt, Human
acuaucugcuuu

SEQ ID NO: 2358099 - RNA, 13 nt, Human
acuaucugcuuuu

SEQ ID NO: 2358100 - RNA, 16 nt, Human
acuaucucauuuccaa

SEQ ID NO: 2358101 - RNA, 17 nt, Human
acuaucucauuuccaag

SEQ ID NO: 2358102 - RNA, 22 nt, Human
acucaagugucucaguccaccu

SEQ ID NO: 2358103 - RNA, 23 nt, Human
acucaagugucucaguccaccug

SEQ ID NO: 2358104 - RNA, 16 nt, Human
acucaauggauuugau

SEQ ID NO: 2358105 - RNA, 15 nt, Human
acucaauugauaaac

SEQ ID NO: 2358106 - RNA, 21 nt, Human
acucaauguuacuaucugcuu

SEQ ID NO: 2358107 - RNA, 21 nt, Human
acucacaaccugaaccuagga

SEQ ID NO: 2358108 - RNA, 14 nt, Human
acucaauuucuccc

SEQ ID NO: 2358109 - RNA, 16 nt, Human
acucaauuucucccca

SEQ ID NO: 2358110 - RNA, 17 nt, Human
acucaauuucuccccag

SEQ ID NO: 2358111 - RNA, 14 nt, Human
acucacaagaagac

SEQ ID NO: 2358112 - RNA, 16 nt, Human
acucacaagaagacca

SEQ ID NO: 2358113 - RNA, 18 nt, Human
acucacaagaagaccaga

SEQ ID NO: 2358114 - RNA, 21 nt, Human
acucacaagaagaccagacug

SEQ ID NO: 2358115 - RNA, 14 nt, Human
acucacacagccag

SEQ ID NO: 2358116 - RNA, 15 nt, Human
acucacacagccagg

SEQ ID NO: 2358117 - RNA, 22 nt, Human
acucacacagccaggugccuug

SEQ ID NO: 2358118 - RNA, 14 nt, Human
acucacacaggacc

SEQ ID NO: 2358119 - RNA, 20 nt, Human
acucaagguucccagagaug

SEQ ID NO: 2358120 - RNA, 19 nt, Human
acucaagguucccagagau

SEQ ID NO: 2358121 - RNA, 16 nt, Human
acucaaugcacugaca

SEQ ID NO: 2358122 - RNA, 11 nt, Human
acucaagccaa

SEQ ID NO: 2358123 - RNA, 16 nt, Human
acucaagccaagcagc

SEQ ID NO: 2358124 - RNA, 14 nt, Human
acucaagccaagca

SEQ ID NO: 2358125 - RNA, 14 nt, Human
acucaagcccgcgg

SEQ ID NO: 2358126 - RNA, 19 nt, Human
acucaagccaagcagccaa

SEQ ID NO: 2358127 - RNA, 17 nt, Human
acucaagccaagcagcc

SEQ ID NO: 2358128 - RNA, 22 nt, Human
acucaagccaagcagccaagcu

SEQ ID NO: 2358129 - RNA, 17 nt, Human
acucaaggacuuugcag

SEQ ID NO: 2358130 - RNA, 18 nt, Human
acucaagaggcugaggca

SEQ ID NO: 2358131 - RNA, 17 nt, Human
acucaagaggcugaggc

SEQ ID NO: 2358132 - RNA, 15 nt, Human
acucaagaggcugag

SEQ ID NO: 2358133 - RNA, 14 nt, Human
acucaagaggcuga

SEQ ID NO: 2358134 - RNA, 16 nt, Human
acuaugguauuugagu

SEQ ID NO: 2358135 - RNA, 15 nt, Human
acuaugguauuugag

SEQ ID NO: 2358136 - RNA, 15 nt, Human
acuauguugcccagg

SEQ ID NO: 2358137 - RNA, 16 nt, Human
acuauguugcccaggc

SEQ ID NO: 2358138 - RNA, 14 nt, Human
acuauguugcccag

SEQ ID NO: 2358139 - RNA, 22 nt, Human
acuauggcccuggccuagcaua

SEQ ID NO: 2358140 - RNA, 19 nt, Human
acuaugccugugucuucuc

SEQ ID NO: 2358141 - RNA, 18 nt, Human
acuaugccugugucuucu

SEQ ID NO: 2358142 - RNA, 14 nt, Human
acuaugcguuuuua

SEQ ID NO: 2358143 - RNA, 18 nt, Human
acuaugcguuuuuauaaa

SEQ ID NO: 2358144 - RNA, 23 nt, Human
ucaugaacauguuccugaauucu

SEQ ID NO: 2358145 - RNA, 11 nt, Human
ucaugaaccuc

SEQ ID NO: 2358146 - RNA, 22 nt, Human
ucaugaaccucaagcugcaucu

SEQ ID NO: 2358147 - RNA, 15 nt, Human
ucaugaacuucgcau

SEQ ID NO: 2358148 - RNA, 18 nt, Human
ucaugaacuucgcaucaa

SEQ ID NO: 2358149 - RNA, 14 nt, Human
ucaugaaauaugca

SEQ ID NO: 2358150 - RNA, 15 nt, Human
ucaugaaauaugcau

SEQ ID NO: 2358151 - RNA, 12 nt, Human
ucaugaagccca

SEQ ID NO: 2358152 - RNA, 22 nt, Human
ucaugauucacccccaaacagu

SEQ ID NO: 2358153 - RNA, 19 nt, Human
ucaugaagauauuuuucca

SEQ ID NO: 2358154 - RNA, 21 nt, Human
ucaugaacuucgcaucaaaag

SEQ ID NO: 2358155 - RNA, 22 nt, Human
ucaugaacuucgcaucaaaaga

SEQ ID NO: 2358156 - RNA, 17 nt, Human
ucaugauuucauuucaa

SEQ ID NO: 2358157 - RNA, 23 nt, Human
ucaugauuucauuucaacuguuu

SEQ ID NO: 2358158 - RNA, 14 nt, Human
ucaugauuuugaaa

SEQ ID NO: 2358159 - RNA, 11 nt, Human
ucaugauuuuu

SEQ ID NO: 2358160 - RNA, 21 nt, Human
ucaugauuuugaaaucaugaa

SEQ ID NO: 2358161 - RNA, 14 nt, Human
ucaugcaaacuuua

SEQ ID NO: 2358162 - RNA, 18 nt, Human
ucaucgcguccuccuacc

SEQ ID NO: 2358163 - RNA, 17 nt, Human
ucaucgcguccuccuac

SEQ ID NO: 2358164 - RNA, 19 nt, Human
ucaucgggaauacuaggga

SEQ ID NO: 2358165 - RNA, 13 nt, Human
ucaucuaggauuu

SEQ ID NO: 2358166 - RNA, 21 nt, Human
ucaucgaaucuacuaauucca

SEQ ID NO: 2358167 - RNA, 14 nt, Human
ucaucgaaucuacu

SEQ ID NO: 2358168 - RNA, 18 nt, Human
ucaucccacgcacuccau

SEQ ID NO: 2358169 - RNA, 13 nt, Human
ucaucccagcugc

SEQ ID NO: 2358170 - RNA, 16 nt, Human
ucauccuuuccagcau

SEQ ID NO: 2358171 - RNA, 17 nt, Human
ucauccuuuccagcaug

SEQ ID NO: 2358172 - RNA, 21 nt, Human
accuccugcccaggagagcca

SEQ ID NO: 2358173 - RNA, 11 nt, Human
accuccugccu

SEQ ID NO: 2358174 - RNA, 20 nt, Human
accuccugcccaggagagcc

SEQ ID NO: 2358175 - RNA, 19 nt, Human
accuccugcccaggagagc

SEQ ID NO: 2358176 - RNA, 14 nt, Human
ucauccaucaucau

SEQ ID NO: 2358177 - RNA, 12 nt, Human
ucauccaucauc

SEQ ID NO: 2358178 - RNA, 11 nt, Human
ucauccaucau

SEQ ID NO: 2358179 - RNA, 14 nt, Human
ucauccagggcucu

SEQ ID NO: 2358180 - RNA, 21 nt, Human
ucauccagggcucugaccagu

SEQ ID NO: 2358181 - RNA, 13 nt, Human
ucauccauccagg

SEQ ID NO: 2358182 - RNA, 16 nt, Human
ucauccaucaucaugu

SEQ ID NO: 2358183 - RNA, 15 nt, Human
ucauccaucaucaug

SEQ ID NO: 2358184 - RNA, 16 nt, Human
ucaucccaacugucuu

SEQ ID NO: 2358185 - RNA, 19 nt, Human
ucauccauucuauuguuaa

SEQ ID NO: 2358186 - RNA, 17 nt, Human
ucauccaucaucaugug

SEQ ID NO: 2358187 - RNA, 14 nt, Human
ucauccauucuauu

SEQ ID NO: 2358188 - RNA, 15 nt, Human
ucauguuucuuaaau

SEQ ID NO: 2358189 - RNA, 11 nt, Human
ucauguuucuu

SEQ ID NO: 2358190 - RNA, 17 nt, Human
ucauguuuacagaggac

SEQ ID NO: 2358191 - RNA, 19 nt, Human
ucauguguaugggcaaaaa

SEQ ID NO: 2358192 - RNA, 16 nt, Human
ucauguuucuuaaaug

SEQ ID NO: 2358193 - RNA, 15 nt, Human
ucauguuugcucucc

SEQ ID NO: 2358194 - RNA, 14 nt, Human
ucauguuugcuuca

SEQ ID NO: 2358195 - RNA, 13 nt, Human
ucauguuuuaaca

SEQ ID NO: 2358196 - RNA, 20 nt, Human
ucauguuugcuucauaaaug

SEQ ID NO: 2358197 - RNA, 21 nt, Human
ucauguuuuaaagcuugcuca

SEQ ID NO: 2358198 - RNA, 15 nt, Human
ucauguuugcuucau

SEQ ID NO: 2358199 - RNA, 17 nt, Human
ucauguuugcuucauaa

SEQ ID NO: 2358200 - RNA, 21 nt, Human
ucauguuugcuucauaaauga

SEQ ID NO: 2358201 - RNA, 18 nt, Human
ucauguggaauauaaaga

SEQ ID NO: 2358202 - RNA, 22 nt, Human
ucaugcaucuccaccugcuccc

SEQ ID NO: 2358203 - RNA, 15 nt, Human
ucaugugauccuuuu

SEQ ID NO: 2358204 - RNA, 19 nt, Human
ucauguggaauauaaagau

SEQ ID NO: 2358205 - RNA, 13 nt, Human
ucauguggcugga

SEQ ID NO: 2358206 - RNA, 20 nt, Human
ucaugugauccuuuuauguu

SEQ ID NO: 2358207 - RNA, 18 nt, Human
ucauguguaaucaauaaa

SEQ ID NO: 2358208 - RNA, 16 nt, Human
ucauguggcuggaaga

SEQ ID NO: 2358209 - RNA, 21 nt, Human
ucauguggcuggaagauccug

SEQ ID NO: 2358210 - RNA, 20 nt, Human
ucauguguacaaaaguuuca

SEQ ID NO: 2358211 - RNA, 19 nt, Human
ucauguguaaucaauaaac

SEQ ID NO: 2358212 - RNA, 21 nt, Human
ucauguguaaucaauaaacga

SEQ ID NO: 2358213 - RNA, 22 nt, Human
ucauguguaaucaauaaacgau

SEQ ID NO: 2358214 - RNA, 23 nt, Human
ucauguguaaucaauaaacgauu

SEQ ID NO: 2358215 - RNA, 16 nt, Human
ucaugcaaugacaucu

SEQ ID NO: 2358216 - RNA, 15 nt, Human
ucaugcaaugacauc

SEQ ID NO: 2358217 - RNA, 13 nt, Human
ucaugcaaugaca

SEQ ID NO: 2358218 - RNA, 20 nt, Human
ucaugcaaaugcuguauucu

SEQ ID NO: 2358219 - RNA, 17 nt, Human
ucaugcaaaggcuggga

SEQ ID NO: 2358220 - RNA, 23 nt, Human
ucaugcaaacuuuauuuuguguu

SEQ ID NO: 2358221 - RNA, 14 nt, Human
ucaugcauaaauau

SEQ ID NO: 2358222 - RNA, 15 nt, Human
ucaugcauaaauaug

SEQ ID NO: 2358223 - RNA, 19 nt, Human
ucaugcauaaauaugcagu

SEQ ID NO: 2358224 - RNA, 13 nt, Human
ucaugcagccgug

SEQ ID NO: 2358225 - RNA, 14 nt, Human
ucaugcagccguga

SEQ ID NO: 2358226 - RNA, 23 nt, Human
ucaugcagccgugaucaagggaa

SEQ ID NO: 2358227 - RNA, 16 nt, Human
ucaugcaucuccaccu

SEQ ID NO: 2358228 - RNA, 20 nt, Human
ucaugcauaaauaugcagug

SEQ ID NO: 2358229 - RNA, 20 nt, Human
ucaugcaucuccaccugcuc

SEQ ID NO: 2358230 - RNA, 17 nt, Human
ucaugugaccacucugu

SEQ ID NO: 2358231 - RNA, 17 nt, Human
ucaugugaaaucauuca

SEQ ID NO: 2358232 - RNA, 16 nt, Human
ucaugugaaaucauuc

SEQ ID NO: 2358233 - RNA, 12 nt, Human
accuauuuccau

SEQ ID NO: 2358234 - RNA, 14 nt, Human
accuauuugacaua

SEQ ID NO: 2358235 - RNA, 20 nt, Human
accuauuuugaaaaauuccu

SEQ ID NO: 2358236 - RNA, 16 nt, Human
accucaaaaugucuaa

SEQ ID NO: 2358237 - RNA, 19 nt, Human
accucacccgaggcugccc

SEQ ID NO: 2358238 - RNA, 21 nt, Human
accuauuuugaaaaauuccua

SEQ ID NO: 2358239 - RNA, 12 nt, Human
accucacccugc

SEQ ID NO: 2358240 - RNA, 14 nt, Human
accucacccugcua

SEQ ID NO: 2358241 - RNA, 15 nt, Human
accucaccuagaaau

SEQ ID NO: 2358242 - RNA, 14 nt, Human
accucaccuagaaa

SEQ ID NO: 2358243 - RNA, 18 nt, Human
accucacgcaccucccau

SEQ ID NO: 2358244 - RNA, 17 nt, Human
accucacgcaccuccca

SEQ ID NO: 2358245 - RNA, 16 nt, Human
accucacgcaccuccc

SEQ ID NO: 2358246 - RNA, 15 nt, Human
accucacgcaccucc

SEQ ID NO: 2358247 - RNA, 22 nt, Human
accucacgcaccucccauccua

SEQ ID NO: 2358248 - RNA, 19 nt, Human
accucacgcaccucccauc

SEQ ID NO: 2358249 - RNA, 20 nt, Human
accucacuauucaaguauua

SEQ ID NO: 2358250 - RNA, 15 nt, Human
accuaggggcgccgc

SEQ ID NO: 2358251 - RNA, 24 nt, Human
accuagggaggaccuuaucugugc

SEQ ID NO: 2358252 - RNA, 17 nt, Human
accuagggaggaccuua

SEQ ID NO: 2358253 - RNA, 15 nt, Human
accuagggaggaccu

SEQ ID NO: 2358254 - RNA, 18 nt, Human
accuaggccacuccucca

SEQ ID NO: 2358255 - RNA, 17 nt, Human
accuaggccacuccucc

SEQ ID NO: 2358256 - RNA, 16 nt, Human
accuagggugauauua

SEQ ID NO: 2358257 - RNA, 20 nt, Human
accuagggauguucuggccc

SEQ ID NO: 2358258 - RNA, 19 nt, Human
accuaugucauuucauuuc

SEQ ID NO: 2358259 - RNA, 22 nt, Human
accuaugucauuucauuuccua

SEQ ID NO: 2358260 - RNA, 17 nt, Human
accuauguccuaaggac

SEQ ID NO: 2358261 - RNA, 19 nt, Human
accuauguccuaaggacac

SEQ ID NO: 2358262 - RNA, 22 nt, Human
accuauguccuaaggacacacu

SEQ ID NO: 2358263 - RNA, 23 nt, Human
accuauguccuaaggacacacua

SEQ ID NO: 2358264 - RNA, 16 nt, Human
accuauuccuccuggg

SEQ ID NO: 2358265 - RNA, 18 nt, Human
accuaccuucauuucagg

SEQ ID NO: 2358266 - RNA, 20 nt, Human
accuaccucagguugcuggu

SEQ ID NO: 2358267 - RNA, 17 nt, Human
accgcagacaggaccag

SEQ ID NO: 2358268 - RNA, 12 nt, Human
accgcagacagg

SEQ ID NO: 2358269 - RNA, 16 nt, Human
accgcagacaggacca

SEQ ID NO: 2358270 - RNA, 17 nt, Human
accuaggauaucuucuc

SEQ ID NO: 2358271 - RNA, 14 nt, Human
accuagaagggcua

SEQ ID NO: 2358272 - RNA, 20 nt, Human
accuagagacuucacccggg

SEQ ID NO: 2358273 - RNA, 22 nt, Human
accuagaaauugacacaagugg

SEQ ID NO: 2358274 - RNA, 21 nt, Human
accuacuuugacuuuuugcau

SEQ ID NO: 2358275 - RNA, 20 nt, Human
accuacuuugacuuuuugca

SEQ ID NO: 2358276 - RNA, 10 nt, Human
accuccaucu

SEQ ID NO: 2358277 - RNA, 20 nt, Human
accucccacaaaggagagcu

SEQ ID NO: 2358278 - RNA, 15 nt, Human
accucccauccuaau

SEQ ID NO: 2358279 - RNA, 22 nt, Human
accucccagcccuauggaugug

SEQ ID NO: 2358280 - RNA, 11 nt, Human
accuccccacg

SEQ ID NO: 2358281 - RNA, 14 nt, Human
accuccccacgccc

SEQ ID NO: 2358282 - RNA, 19 nt, Human
accuccccacgcccucccc

SEQ ID NO: 2358283 - RNA, 20 nt, Human
accuccccacgcccuccccu

SEQ ID NO: 2358284 - RNA, 21 nt, Human
accuccccacgcccuccccuc

SEQ ID NO: 2358285 - RNA, 22 nt, Human
accuccccacgcccuccccucc

SEQ ID NO: 2358286 - RNA, 13 nt, Human
accucccagcccu

SEQ ID NO: 2358287 - RNA, 14 nt, Human
accucccagcccua

SEQ ID NO: 2358288 - RNA, 15 nt, Human
accucccagcccuau

SEQ ID NO: 2358289 - RNA, 19 nt, Human
accucccagcccuauggau

SEQ ID NO: 2358290 - RNA, 20 nt, Human
accucccagcccuauggaug

SEQ ID NO: 2358291 - RNA, 21 nt, Human
accucccagcccuauggaugu

SEQ ID NO: 2358292 - RNA, 21 nt, Human
accuccagaaacggccauuca

SEQ ID NO: 2358293 - RNA, 14 nt, Human
accuccacauccuc

SEQ ID NO: 2358294 - RNA, 18 nt, Human
accuccacaguucagugg

SEQ ID NO: 2358295 - RNA, 19 nt, Human
accuccacaguucaguggc

SEQ ID NO: 2358296 - RNA, 16 nt, Human
accuccacauccucca

SEQ ID NO: 2358297 - RNA, 20 nt, Human
accuccacaguucaguggca

SEQ ID NO: 2358298 - RNA, 15 nt, Human
accuccacagcuucc

SEQ ID NO: 2358299 - RNA, 16 nt, Human
accucacucuugccaa

SEQ ID NO: 2358300 - RNA, 18 nt, Human
accucacucuugccaacc

SEQ ID NO: 2358301 - RNA, 14 nt, Human
accucacuccuguu

SEQ ID NO: 2358302 - RNA, 13 nt, Human
accucacuccugu

SEQ ID NO: 2358303 - RNA, 15 nt, Human
accucacucuugcca

SEQ ID NO: 2358304 - RNA, 18 nt, Human
accuccugcccaggagag

SEQ ID NO: 2358305 - RNA, 17 nt, Human
accuccugcccaggaga

SEQ ID NO: 2358306 - RNA, 16 nt, Human
accuccugcccaggag

SEQ ID NO: 2358307 - RNA, 15 nt, Human
accuccugcccagga

SEQ ID NO: 2358308 - RNA, 14 nt, Human
accuccugcccagg

SEQ ID NO: 2358309 - RNA, 13 nt, Human
accuccugcccag

SEQ ID NO: 2358310 - RNA, 12 nt, Human
accuccugccca

SEQ ID NO: 2358311 - RNA, 13 nt, Human
accuccugagaaa

SEQ ID NO: 2358312 - RNA, 16 nt, Human
accuccucuucugacg

SEQ ID NO: 2358313 - RNA, 12 nt, Human
accuccucugug

SEQ ID NO: 2358314 - RNA, 11 nt, Human
accuccucugu

SEQ ID NO: 2358315 - RNA, 18 nt, Human
accuccucugugaagcau

SEQ ID NO: 2358316 - RNA, 14 nt, Human
accuccucugugaa

SEQ ID NO: 2358317 - RNA, 13 nt, Human
accuccucuguga

SEQ ID NO: 2358318 - RNA, 20 nt, Human
accuccccuauccacccagc

SEQ ID NO: 2358319 - RNA, 19 nt, Human
accuccccuauccacccag

SEQ ID NO: 2358320 - RNA, 18 nt, Human
accuccccuauccaccca

SEQ ID NO: 2358321 - RNA, 17 nt, Human
accuccccuauccaccc

SEQ ID NO: 2358322 - RNA, 14 nt, Human
accuccccuaucca

SEQ ID NO: 2358323 - RNA, 15 nt, Human
accuccccagccccu

SEQ ID NO: 2358324 - RNA, 21 nt, Human
accucccccucccccuucucc

SEQ ID NO: 2358325 - RNA, 15 nt, Human
accucccccugcccc

SEQ ID NO: 2358326 - RNA, 15 nt, Human
accuccccagcauuc

SEQ ID NO: 2358327 - RNA, 21 nt, Human
accuccccagcauuccagccc

SEQ ID NO: 2358328 - RNA, 23 nt, Human
accuccccagcauuccagccccu

SEQ ID NO: 2358329 - RNA, 12 nt, Human
accuccccagcc

SEQ ID NO: 2358330 - RNA, 13 nt, Human
accuccccagccc

SEQ ID NO: 2358331 - RNA, 22 nt, Human
accuccccuccuugccuccugu

SEQ ID NO: 2358332 - RNA, 21 nt, Human
accuccccuccuugccuccug

SEQ ID NO: 2358333 - RNA, 20 nt, Human
accuccccuccuugccuccu

SEQ ID NO: 2358334 - RNA, 19 nt, Human
accuccccuccuugccucc

SEQ ID NO: 2358335 - RNA, 17 nt, Human
accuccccuccuugccu

SEQ ID NO: 2358336 - RNA, 13 nt, Human
accuccccuccuu

SEQ ID NO: 2358337 - RNA, 23 nt, Human
accuccccuauccacccagccca

SEQ ID NO: 2358338 - RNA, 21 nt, Human
accuccccuauccacccagcc

SEQ ID NO: 2358339 - RNA, 15 nt, Human
accuccccugaggcu

SEQ ID NO: 2358340 - RNA, 14 nt, Human
ucauauugaauaua

SEQ ID NO: 2358341 - RNA, 22 nt, Human
ucauauguaccauguacaugaa

SEQ ID NO: 2358342 - RNA, 21 nt, Human
ucauauguaccauguacauga

SEQ ID NO: 2358343 - RNA, 18 nt, Human
ucauauggcccaguguca

SEQ ID NO: 2358344 - RNA, 17 nt, Human
ucauauggcccaguguc

SEQ ID NO: 2358345 - RNA, 15 nt, Human
ucauaugauucugcu

SEQ ID NO: 2358346 - RNA, 19 nt, Human
ucauaugauucugcuuuua

SEQ ID NO: 2358347 - RNA, 11 nt, Human
ucauaugaaaa

SEQ ID NO: 2358348 - RNA, 20 nt, Human
ucauaugacauucaugccug

SEQ ID NO: 2358349 - RNA, 12 nt, Human
ucauaugaaaaa

SEQ ID NO: 2358350 - RNA, 21 nt, Human
ucauaugaaaaaaaugcauuu

SEQ ID NO: 2358351 - RNA, 18 nt, Human
ucauauccccuauuuaac

SEQ ID NO: 2358352 - RNA, 23 nt, Human
ucauauuuacuucuuauacauuu

SEQ ID NO: 2358353 - RNA, 15 nt, Human
ucauauuuacuucuu

SEQ ID NO: 2358354 - RNA, 19 nt, Human
ucauauuuaaagacaggga

SEQ ID NO: 2358355 - RNA, 14 nt, Human
ucauauuguuuccu

SEQ ID NO: 2358356 - RNA, 12 nt, Human
ucauauuuaaag

SEQ ID NO: 2358357 - RNA, 14 nt, Human
ucauauugugccaa

SEQ ID NO: 2358358 - RNA, 15 nt, Human
ucauauugugccaau

SEQ ID NO: 2358359 - RNA, 20 nt, Human
ucauauugugccaauaugua

SEQ ID NO: 2358360 - RNA, 22 nt, Human
ucauauugugccaauauguauu

SEQ ID NO: 2358361 - RNA, 21 nt, Human
ucauauugugauucugccuuu

SEQ ID NO: 2358362 - RNA, 19 nt, Human
ucauauugaauguuuccaa

SEQ ID NO: 2358363 - RNA, 22 nt, Human
ucauauuucuuaucaccacagu

SEQ ID NO: 2358364 - RNA, 15 nt, Human
ucauauuuucuuuca

SEQ ID NO: 2358365 - RNA, 18 nt, Human
accgagcgcuuucuggaa

SEQ ID NO: 2358366 - RNA, 20 nt, Human
accgagcgcuuucuggaaaa

SEQ ID NO: 2358367 - RNA, 18 nt, Human
accgaggcuggagcuggc

SEQ ID NO: 2358368 - RNA, 17 nt, Human
accgaggcuggagcugg

SEQ ID NO: 2358369 - RNA, 17 nt, Human
accgaggcgcgggggcc

SEQ ID NO: 2358370 - RNA, 15 nt, Human
accgaggacaugaaa

SEQ ID NO: 2358371 - RNA, 16 nt, Human
accgaggcgcgggggc

SEQ ID NO: 2358372 - RNA, 16 nt, Human
accgagucucuucucc

SEQ ID NO: 2358373 - RNA, 19 nt, Human
accgaggggcucaggaaaa

SEQ ID NO: 2358374 - RNA, 17 nt, Human
accgaggggcucaggaa

SEQ ID NO: 2358375 - RNA, 17 nt, Human
accgagucucuucucca

SEQ ID NO: 2358376 - RNA, 20 nt, Human
accgcagaagccuccccagc

SEQ ID NO: 2358377 - RNA, 23 nt, Human
accgcagaagccuccccagcuca

SEQ ID NO: 2358378 - RNA, 14 nt, Human
ucauaacggaucag

SEQ ID NO: 2358379 - RNA, 16 nt, Human
ucauaaauuuaugguu

SEQ ID NO: 2358380 - RNA, 16 nt, Human
ucauaacggaucagaa

SEQ ID NO: 2358381 - RNA, 18 nt, Human
ucauaacggaucagaaau

SEQ ID NO: 2358382 - RNA, 19 nt, Human
ucauaacggaucagaaaua

SEQ ID NO: 2358383 - RNA, 21 nt, Human
ucauaacggaucagaaauaca

SEQ ID NO: 2358384 - RNA, 12 nt, Human
ucauaaaauaaa

SEQ ID NO: 2358385 - RNA, 20 nt, Human
ucauaaaaagcaaaacaaaa

SEQ ID NO: 2358386 - RNA, 22 nt, Human
ucaguuuuuuuuuauacacugu

SEQ ID NO: 2358387 - RNA, 14 nt, Human
ucauaaccuagccu

SEQ ID NO: 2358388 - RNA, 15 nt, Human
ucauaguaugguggc

SEQ ID NO: 2358389 - RNA, 22 nt, Human
ucauaacggaucagaaauacag

SEQ ID NO: 2358390 - RNA, 23 nt, Human
ucauaacggaucagaaauacaga

SEQ ID NO: 2358391 - RNA, 18 nt, Human
ucauaguaugguggcugg

SEQ ID NO: 2358392 - RNA, 19 nt, Human
ucauaguaugguggcuggg

SEQ ID NO: 2358393 - RNA, 21 nt, Human
ucauaguaugguggcuggguu

SEQ ID NO: 2358394 - RNA, 21 nt, Human
ucauaguuauuguuucugguc

SEQ ID NO: 2358395 - RNA, 16 nt, Human
ucauaguuauuguuuc

SEQ ID NO: 2358396 - RNA, 17 nt, Human
ucauaguuauuguuucu

SEQ ID NO: 2358397 - RNA, 13 nt, Human
ucauaguuuaauu

SEQ ID NO: 2358398 - RNA, 16 nt, Human
ucauauaaaagcuaug

SEQ ID NO: 2358399 - RNA, 20 nt, Human
ucauauaaaagcuaugguga

SEQ ID NO: 2358400 - RNA, 20 nt, Human
ucauauaaacuuuuuaaaga

SEQ ID NO: 2358401 - RNA, 22 nt, Human
ucauauauggggggccaacacc

SEQ ID NO: 2358402 - RNA, 18 nt, Human
ucauauauggggggccaa

SEQ ID NO: 2358403 - RNA, 14 nt, Human
ucauauauaucuau

SEQ ID NO: 2358404 - RNA, 17 nt, Human
ucauauaccagcaauau

SEQ ID NO: 2358405 - RNA, 14 nt, Human
ucauauacgugaaa

SEQ ID NO: 2358406 - RNA, 16 nt, Human
ucauauaccagcaaua

SEQ ID NO: 2358407 - RNA, 16 nt, Human
ucauauaauaaaugua

SEQ ID NO: 2358408 - RNA, 18 nt, Human
ucauauaagauucauauu

SEQ ID NO: 2358409 - RNA, 15 nt, Human
ucauauaauaaaugu

SEQ ID NO: 2358410 - RNA, 12 nt, Human
ucaguggagcca

SEQ ID NO: 2358411 - RNA, 23 nt, Human
ucaguggacuuuccacccccucc

SEQ ID NO: 2358412 - RNA, 21 nt, Human
ucaguggacuuuccacccccu

SEQ ID NO: 2358413 - RNA, 19 nt, Human
ucaguggacuuuccacccc

SEQ ID NO: 2358414 - RNA, 21 nt, Human
ucaguggaagaagcagaugag

SEQ ID NO: 2358415 - RNA, 16 nt, Human
ucaguggaagaagcag

SEQ ID NO: 2358416 - RNA, 23 nt, Human
ucagugccgccgccucgcccacc

SEQ ID NO: 2358417 - RNA, 11 nt, Human
ucaguggcagc

SEQ ID NO: 2358418 - RNA, 15 nt, Human
ucagugcuucgcaga

SEQ ID NO: 2358419 - RNA, 20 nt, Human
ucagugccgccgccucgccc

SEQ ID NO: 2358420 - RNA, 21 nt, Human
ucagugccgccgccucgccca

SEQ ID NO: 2358421 - RNA, 18 nt, Human
ucagugccuuauggaaca

SEQ ID NO: 2358422 - RNA, 16 nt, Human
ucagugccuuauggaa

SEQ ID NO: 2358423 - RNA, 19 nt, Human
ucagugggaacgugacugc

SEQ ID NO: 2358424 - RNA, 15 nt, Human
ucagugggaacguga

SEQ ID NO: 2358425 - RNA, 17 nt, Human
ucaguggcuucaucugu

SEQ ID NO: 2358426 - RNA, 20 nt, Human
ucaguggcuucaucugucaa

SEQ ID NO: 2358427 - RNA, 20 nt, Human
ucaguggcauggcuccaguc

SEQ ID NO: 2358428 - RNA, 19 nt, Human
ucaguggcauggcuccagu

SEQ ID NO: 2358429 - RNA, 17 nt, Human
ucaguggcgagaaauaa

SEQ ID NO: 2358430 - RNA, 13 nt, Human
ucagugggagaaa

SEQ ID NO: 2358431 - RNA, 12 nt, Human
ucagugggagaa

SEQ ID NO: 2358432 - RNA, 23 nt, Human
ucagugggaacgugacugcccca

SEQ ID NO: 2358433 - RNA, 22 nt, Human
ucagugggaacgugacugcccc

SEQ ID NO: 2358434 - RNA, 16 nt, Human
ucaguggggaggggcu

SEQ ID NO: 2358435 - RNA, 12 nt, Human
ucaguggcagcu

SEQ ID NO: 2358436 - RNA, 14 nt, Human
ucaguggcagggcu

SEQ ID NO: 2358437 - RNA, 15 nt, Human
ucaguggcagggcuc

SEQ ID NO: 2358438 - RNA, 16 nt, Human
ucaguggcagggcuca

SEQ ID NO: 2358439 - RNA, 19 nt, Human
ucaguggcagggcucagga

SEQ ID NO: 2358440 - RNA, 16 nt, Human
ucaguuuucaggagug

SEQ ID NO: 2358441 - RNA, 13 nt, Human
ucaguuuucauuu

SEQ ID NO: 2358442 - RNA, 12 nt, Human
ucaguuuucauu

SEQ ID NO: 2358443 - RNA, 15 nt, Human
ucaguuuuuuuuuau

SEQ ID NO: 2358444 - RNA, 22 nt, Human
ucauaaaaagccugcaauuuca

SEQ ID NO: 2358445 - RNA, 17 nt, Human
ucaguuuuugugaaaag

SEQ ID NO: 2358446 - RNA, 13 nt, Human
ucaguuuuaacua

SEQ ID NO: 2358447 - RNA, 16 nt, Human
ucagugggagaaaaca

SEQ ID NO: 2358448 - RNA, 14 nt, Human
ucaguggggcaguc

SEQ ID NO: 2358449 - RNA, 14 nt, Human
ucaguuuuaucuuu

SEQ ID NO: 2358450 - RNA, 14 nt, Human
ucagugggagaaaa

SEQ ID NO: 2358451 - RNA, 19 nt, Human
ucaguuuuaucauuuucaa

SEQ ID NO: 2358452 - RNA, 16 nt, Human
ucaguuuuaucauuuu

SEQ ID NO: 2358453 - RNA, 17 nt, Human
ucaguuuuaucauuuuc

SEQ ID NO: 2358454 - RNA, 15 nt, Human
ucaguuuuugugaaa

SEQ ID NO: 2358455 - RNA, 22 nt, Human
ucagugcccaccaacaucccau

SEQ ID NO: 2358456 - RNA, 13 nt, Human
ucagugcccacca

SEQ ID NO: 2358457 - RNA, 16 nt, Human
ucagugcccaacuguu

SEQ ID NO: 2358458 - RNA, 9 nt, Human
ucagugccc

SEQ ID NO: 2358459 - RNA, 22 nt, Human
ucagugccaauaaaauuuagga

SEQ ID NO: 2358460 - RNA, 14 nt, Human
ucagugccgccgcc

SEQ ID NO: 2358461 - RNA, 16 nt, Human
ucagugccgccgccuc

SEQ ID NO: 2358462 - RNA, 20 nt, Human
ucagugcccuccaggauaga

SEQ ID NO: 2358463 - RNA, 9 nt, Human
ucagugccu

SEQ ID NO: 2358464 - RNA, 10 nt, Human
ucagugccuu

SEQ ID NO: 2358465 - RNA, 11 nt, Human
ucagugccuua

SEQ ID NO: 2358466 - RNA, 12 nt, Human
ucagugccuuau

SEQ ID NO: 2358467 - RNA, 14 nt, Human
ucagugccuuaugg

SEQ ID NO: 2358468 - RNA, 15 nt, Human
ucagugccuuaugga

SEQ ID NO: 2358469 - RNA, 16 nt, Human
ucaguauaauuuuuua

SEQ ID NO: 2358470 - RNA, 20 nt, Human
ucaguauaauucuguacuga

SEQ ID NO: 2358471 - RNA, 13 nt, Human
ucaguaucaggcc

SEQ ID NO: 2358472 - RNA, 18 nt, Human
ucaguaucuguaucucuc

SEQ ID NO: 2358473 - RNA, 20 nt, Human
ucaguaucuguaucucucuc

SEQ ID NO: 2358474 - RNA, 15 nt, Human
ucaguauaaacaaag

SEQ ID NO: 2358475 - RNA, 17 nt, Human
ucaguauaaacaaaguu

SEQ ID NO: 2358476 - RNA, 16 nt, Human
ucaguauaauucugua

SEQ ID NO: 2358477 - RNA, 17 nt, Human
accgaaaacguggcugc

SEQ ID NO: 2358478 - RNA, 19 nt, Human
accgaaaacguggcugcuu

SEQ ID NO: 2358479 - RNA, 12 nt, Human
ucagugccacua

SEQ ID NO: 2358480 - RNA, 16 nt, Human
ucagugccaaaaacaa

SEQ ID NO: 2358481 - RNA, 12 nt, Human
ucaguaugugga

SEQ ID NO: 2358482 - RNA, 24 nt, Human
ucaguaucuguaucucucucucuu

SEQ ID NO: 2358483 - RNA, 16 nt, Human
ucaguauguggaagug

SEQ ID NO: 2358484 - RNA, 14 nt, Human
ucaguauguggaag

SEQ ID NO: 2358485 - RNA, 19 nt, Human
accccauagugaccggcug

SEQ ID NO: 2358486 - RNA, 17 nt, Human
accccauccaguucaug

SEQ ID NO: 2358487 - RNA, 19 nt, Human
accccaguucugcuccucu

SEQ ID NO: 2358488 - RNA, 20 nt, Human
accccaguucugcuccucuc

SEQ ID NO: 2358489 - RNA, 21 nt, Human
accccaguucugcuccucucc

SEQ ID NO: 2358490 - RNA, 22 nt, Human
accccaguucugcuccucucca

SEQ ID NO: 2358491 - RNA, 23 nt, Human
accccaguucugcuccucuccag

SEQ ID NO: 2358492 - RNA, 15 nt, Human
accccaucccacacc

SEQ ID NO: 2358493 - RNA, 17 nt, Human
accccaucccuccccag

SEQ ID NO: 2358494 - RNA, 21 nt, Human
accccauagugaccggcugcu

SEQ ID NO: 2358495 - RNA, 13 nt, Human
accccaucugccc

SEQ ID NO: 2358496 - RNA, 18 nt, Human
accccaucucuacaaaaa

SEQ ID NO: 2358497 - RNA, 16 nt, Human
acccccucgcuuggac

SEQ ID NO: 2358498 - RNA, 19 nt, Human
acccccuccuucagacacc

SEQ ID NO: 2358499 - RNA, 18 nt, Human
acccccucgggucuccuc

SEQ ID NO: 2358500 - RNA, 21 nt, Human
acccccucgggucuccucacu

SEQ ID NO: 2358501 - RNA, 17 nt, Human
acccccuccuucagaca

SEQ ID NO: 2358502 - RNA, 16 nt, Human
acccccuccuucagac

SEQ ID NO: 2358503 - RNA, 15 nt, Human
acccccuccuucaga

SEQ ID NO: 2358504 - RNA, 12 nt, Human
acccccuccuuc

SEQ ID NO: 2358505 - RNA, 22 nt, Human
acccccucccuggccuguucug

SEQ ID NO: 2358506 - RNA, 20 nt, Human
acccccucccuggccuguuc

SEQ ID NO: 2358507 - RNA, 13 nt, Human
acccccuccucuc

SEQ ID NO: 2358508 - RNA, 14 nt, Human
acccccuccucucu

SEQ ID NO: 2358509 - RNA, 17 nt, Human
acccccucccuggccug

SEQ ID NO: 2358510 - RNA, 16 nt, Human
acccccucccuggccu

SEQ ID NO: 2358511 - RNA, 14 nt, Human
accccaucugccca

SEQ ID NO: 2358512 - RNA, 11 nt, Human
acccccuccuu

SEQ ID NO: 2358513 - RNA, 15 nt, Human
acccccuccugcugc

SEQ ID NO: 2358514 - RNA, 16 nt, Human
acccccuccugcugca

SEQ ID NO: 2358515 - RNA, 15 nt, Human
acccccuccucucug

SEQ ID NO: 2358516 - RNA, 16 nt, Human
acccccuccucucugc

SEQ ID NO: 2358517 - RNA, 13 nt, Human
acccccuccugcu

SEQ ID NO: 2358518 - RNA, 14 nt, Human
acccccuccugcug

SEQ ID NO: 2358519 - RNA, 18 nt, Human
accccucuggccaggaug

SEQ ID NO: 2358520 - RNA, 19 nt, Human
accccugaggaagaugggg

SEQ ID NO: 2358521 - RNA, 15 nt, Human
accccugaucugaca

SEQ ID NO: 2358522 - RNA, 15 nt, Human
accccugagcuugca

SEQ ID NO: 2358523 - RNA, 11 nt, Human
accccugcccc

SEQ ID NO: 2358524 - RNA, 10 nt, Human
accccugccc

SEQ ID NO: 2358525 - RNA, 22 nt, Human
accccuccuuccuugaccagca

SEQ ID NO: 2358526 - RNA, 21 nt, Human
accccuccuuccuugaccagc

SEQ ID NO: 2358527 - RNA, 14 nt, Human
acccccucuagaaa

SEQ ID NO: 2358528 - RNA, 20 nt, Human
accccuccuuccuugaccag

SEQ ID NO: 2358529 - RNA, 23 nt, Human
accccuccuuccuugaccagcag

SEQ ID NO: 2358530 - RNA, 13 nt, Human
accccucucugca

SEQ ID NO: 2358531 - RNA, 15 nt, Human
accccucuggccagg

SEQ ID NO: 2358532 - RNA, 14 nt, Human
accccucuggccag

SEQ ID NO: 2358533 - RNA, 13 nt, Human
accccucuggcca

SEQ ID NO: 2358534 - RNA, 16 nt, Human
accccugcccuugucc

SEQ ID NO: 2358535 - RNA, 15 nt, Human
accccugcccuggga

SEQ ID NO: 2358536 - RNA, 12 nt, Human
accccugccucc

SEQ ID NO: 2358537 - RNA, 13 nt, Human
accccugccucca

SEQ ID NO: 2358538 - RNA, 14 nt, Human
accccugccuccac

SEQ ID NO: 2358539 - RNA, 15 nt, Human
accccugccuccacc

SEQ ID NO: 2358540 - RNA, 16 nt, Human
accccugccuccaccc

SEQ ID NO: 2358541 - RNA, 17 nt, Human
accccugccuccacccu

SEQ ID NO: 2358542 - RNA, 14 nt, Human
accccugcccuggg

SEQ ID NO: 2358543 - RNA, 13 nt, Human
accccugcccugg

SEQ ID NO: 2358544 - RNA, 12 nt, Human
accccugcccug

SEQ ID NO: 2358545 - RNA, 20 nt, Human
accccugcccccagccccgg

SEQ ID NO: 2358546 - RNA, 12 nt, Human
accccugccccc

SEQ ID NO: 2358547 - RNA, 13 nt, Human
accccugccccca

SEQ ID NO: 2358548 - RNA, 19 nt, Human
accccugcccccacuuccu

SEQ ID NO: 2358549 - RNA, 17 nt, Human
accccugcccccagccc

SEQ ID NO: 2358550 - RNA, 22 nt, Human
accccugccuccacccucugag

SEQ ID NO: 2358551 - RNA, 23 nt, Human
accccugccuccacccucugagc

SEQ ID NO: 2358552 - RNA, 14 nt, Human
accccugcuucuga

SEQ ID NO: 2358553 - RNA, 18 nt, Human
accccugccuccacccuc

SEQ ID NO: 2358554 - RNA, 19 nt, Human
accccugccuccacccucu

SEQ ID NO: 2358555 - RNA, 20 nt, Human
accccugccuccacccucug

SEQ ID NO: 2358556 - RNA, 21 nt, Human
accccugccuccacccucuga

SEQ ID NO: 2358557 - RNA, 18 nt, Human
ucagcuccacuuucagug

SEQ ID NO: 2358558 - RNA, 12 nt, Human
ucagcucaugga

SEQ ID NO: 2358559 - RNA, 20 nt, Human
ucagcuacuaaugauguuuu

SEQ ID NO: 2358560 - RNA, 14 nt, Human
ucagcuacugauuu

SEQ ID NO: 2358561 - RNA, 15 nt, Human
ucagcuacuaaugau

SEQ ID NO: 2358562 - RNA, 12 nt, Human
ucagcuccagcu

SEQ ID NO: 2358563 - RNA, 18 nt, Human
ucagcuaaagcccaaccu

SEQ ID NO: 2358564 - RNA, 14 nt, Human
ucagcguugcaugu

SEQ ID NO: 2358565 - RNA, 18 nt, Human
ucagcgugcuuagccucc

SEQ ID NO: 2358566 - RNA, 16 nt, Human
ucagcgugcuuagccu

SEQ ID NO: 2358567 - RNA, 13 nt, Human
ucagcguugcaug

SEQ ID NO: 2358568 - RNA, 19 nt, Human
ucagcggggacagcuccuu

SEQ ID NO: 2358569 - RNA, 20 nt, Human
ucagcggggacagcuccuuc

SEQ ID NO: 2358570 - RNA, 21 nt, Human
ucagcggggacagcuccuucu

SEQ ID NO: 2358571 - RNA, 23 nt, Human
ucagcggggacagcuccuucugu

SEQ ID NO: 2358572 - RNA, 19 nt, Human
ucagccuggugggccuccu

SEQ ID NO: 2358573 - RNA, 18 nt, Human
ucagccuggugggccucc

SEQ ID NO: 2358574 - RNA, 17 nt, Human
ucagccuggugggccuc

SEQ ID NO: 2358575 - RNA, 17 nt, Human
accccugggggcucuca

SEQ ID NO: 2358576 - RNA, 16 nt, Human
accccugggggcucuc

SEQ ID NO: 2358577 - RNA, 17 nt, Human
accccuggcuuuucacu

SEQ ID NO: 2358578 - RNA, 15 nt, Human
accccugggggcucu

SEQ ID NO: 2358579 - RNA, 16 nt, Human
accccuggugguucac

SEQ ID NO: 2358580 - RNA, 18 nt, Human
accccuggcuuuucacug

SEQ ID NO: 2358581 - RNA, 19 nt, Human
accccuggcuuuucacugc

SEQ ID NO: 2358582 - RNA, 20 nt, Human
accccuggcuuuucacugcu

SEQ ID NO: 2358583 - RNA, 21 nt, Human
accccuggcuuuucacugcug

SEQ ID NO: 2358584 - RNA, 16 nt, Human
ucagccugugcugccc

SEQ ID NO: 2358585 - RNA, 12 nt, Human
ucagccugugcu

SEQ ID NO: 2358586 - RNA, 16 nt, Human
ucagccugucucuucc

SEQ ID NO: 2358587 - RNA, 17 nt, Human
ucagccugucucuucca

SEQ ID NO: 2358588 - RNA, 18 nt, Human
ucagccugucucuuccau

SEQ ID NO: 2358589 - RNA, 22 nt, Human
ucagccuucccccucccagggc

SEQ ID NO: 2358590 - RNA, 21 nt, Human
ucagccuucccccucccaggg

SEQ ID NO: 2358591 - RNA, 17 nt, Human
ucagccugugcugcccg

SEQ ID NO: 2358592 - RNA, 23 nt, Human
ucagccuuccccuugcccagggc

SEQ ID NO: 2358593 - RNA, 22 nt, Human
ucagccuuccccuugcccaggg

SEQ ID NO: 2358594 - RNA, 21 nt, Human
ucagccuuccccuugcccagg

SEQ ID NO: 2358595 - RNA, 24 nt, Human
ucagccuucccccucccagggcca

SEQ ID NO: 2358596 - RNA, 18 nt, Human
ucagcggggacagcuccu

SEQ ID NO: 2358597 - RNA, 18 nt, Human
ucagccaauuauguuaaa

SEQ ID NO: 2358598 - RNA, 21 nt, Human
ucagcaaaaagcaaaaucauu

SEQ ID NO: 2358599 - RNA, 23 nt, Human
ucagccaccauccuauugcaaag

SEQ ID NO: 2358600 - RNA, 12 nt, Human
ucagccagcacu

SEQ ID NO: 2358601 - RNA, 23 nt, Human
ucagccagcacuuguccagcuga

SEQ ID NO: 2358602 - RNA, 14 nt, Human
ucagccagcacuug

SEQ ID NO: 2358603 - RNA, 15 nt, Human
ucagcaaaagaugcu

SEQ ID NO: 2358604 - RNA, 13 nt, Human
ucagccaauuaug

SEQ ID NO: 2358605 - RNA, 15 nt, Human
ucagccaauuauguu

SEQ ID NO: 2358606 - RNA, 17 nt, Human
ucagccaauuauguuaa

SEQ ID NO: 2358607 - RNA, 13 nt, Human
ucagcaaaaagca

SEQ ID NO: 2358608 - RNA, 14 nt, Human
ucagcaaaaagcaa

SEQ ID NO: 2358609 - RNA, 15 nt, Human
ucagcaaaaagcaaa

SEQ ID NO: 2358610 - RNA, 16 nt, Human
ucagcaaaaagcaaaa

SEQ ID NO: 2358611 - RNA, 20 nt, Human
ucagcaaaaagcaaaaucau

SEQ ID NO: 2358612 - RNA, 22 nt, Human
ucagauuugccuuauuggcagc

SEQ ID NO: 2358613 - RNA, 17 nt, Human
ucagauuugccuuauug

SEQ ID NO: 2358614 - RNA, 19 nt, Human
accauaaccccggaagcca

SEQ ID NO: 2358615 - RNA, 20 nt, Human
accaguugggagcacuggag

SEQ ID NO: 2358616 - RNA, 21 nt, Human
accaguugggagcacuggagu

SEQ ID NO: 2358617 - RNA, 19 nt, Human
accaguuuaaccugaugca

SEQ ID NO: 2358618 - RNA, 20 nt, Human
accaguuuaaccugaugcag

SEQ ID NO: 2358619 - RNA, 21 nt, Human
accaguuuaaccugaugcagu

SEQ ID NO: 2358620 - RNA, 15 nt, Human
accauaaaaagcuga

SEQ ID NO: 2358621 - RNA, 21 nt, Human
accagugugguuuguguuuga

SEQ ID NO: 2358622 - RNA, 20 nt, Human
accaguguccccuccacugu

SEQ ID NO: 2358623 - RNA, 22 nt, Human
accaguguuagggaagggccug

SEQ ID NO: 2358624 - RNA, 18 nt, Human
accaguugggagcacugg

SEQ ID NO: 2358625 - RNA, 19 nt, Human
accaguugggagcacugga

SEQ ID NO: 2358626 - RNA, 18 nt, Human
accaguguuguggauuua

SEQ ID NO: 2358627 - RNA, 21 nt, Human
ucagauuugaacucuucaauc

SEQ ID NO: 2358628 - RNA, 15 nt, Human
accauaccuuccuuc

SEQ ID NO: 2358629 - RNA, 16 nt, Human
accauaccuuccuucc

SEQ ID NO: 2358630 - RNA, 17 nt, Human
accauaccuuccuuccc

SEQ ID NO: 2358631 - RNA, 12 nt, Human
ucagauuugaac

SEQ ID NO: 2358632 - RNA, 13 nt, Human
accauaauguuac

SEQ ID NO: 2358633 - RNA, 22 nt, Human
accauaagguuucguuucugua

SEQ ID NO: 2358634 - RNA, 15 nt, Human
accauaauguuacau

SEQ ID NO: 2358635 - RNA, 18 nt, Human
accauaauguuacauuau

SEQ ID NO: 2358636 - RNA, 12 nt, Human
ucagccaggagc

SEQ ID NO: 2358637 - RNA, 13 nt, Human
ucagccaggagcu

SEQ ID NO: 2358638 - RNA, 14 nt, Human
ucagccagagaagc

SEQ ID NO: 2358639 - RNA, 15 nt, Human
ucagccagccccauc

SEQ ID NO: 2358640 - RNA, 17 nt, Human
ucagccagccccaucag

SEQ ID NO: 2358641 - RNA, 13 nt, Human
ucagcccucccug

SEQ ID NO: 2358642 - RNA, 14 nt, Human
ucagcccucccugc

SEQ ID NO: 2358643 - RNA, 15 nt, Human
ucagcccucccugcc

SEQ ID NO: 2358644 - RNA, 16 nt, Human
ucagcccucccugccc

SEQ ID NO: 2358645 - RNA, 19 nt, Human
acccaggagccccgaggcc

SEQ ID NO: 2358646 - RNA, 23 nt, Human
acccaggagccccgaggccuucu

SEQ ID NO: 2358647 - RNA, 21 nt, Human
acccaggagguggagguugca

SEQ ID NO: 2358648 - RNA, 20 nt, Human
acccaggagguggagguugc

SEQ ID NO: 2358649 - RNA, 14 nt, Human
acccaggaggugga

SEQ ID NO: 2358650 - RNA, 11 nt, Human
acccaggaggu

SEQ ID NO: 2358651 - RNA, 19 nt, Human
acccaggagggagggggcu

SEQ ID NO: 2358652 - RNA, 22 nt, Human
accccacccccuucagugccca

SEQ ID NO: 2358653 - RNA, 21 nt, Human
accccacccuaguuucccuga

SEQ ID NO: 2358654 - RNA, 12 nt, Human
accccacccuca

SEQ ID NO: 2358655 - RNA, 13 nt, Human
accccacccucag

SEQ ID NO: 2358656 - RNA, 14 nt, Human
accccacccucagc

SEQ ID NO: 2358657 - RNA, 15 nt, Human
accccacccucagca

SEQ ID NO: 2358658 - RNA, 21 nt, Human
accccacccucagcaccccuu

SEQ ID NO: 2358659 - RNA, 13 nt, Human
accccacccuccc

SEQ ID NO: 2358660 - RNA, 21 nt, Human
accccacccccuucagugccc

SEQ ID NO: 2358661 - RNA, 12 nt, Human
accccacccccu

SEQ ID NO: 2358662 - RNA, 15 nt, Human
accccacccccaccc

SEQ ID NO: 2358663 - RNA, 21 nt, Human
accccacacuuguuccagcuc

SEQ ID NO: 2358664 - RNA, 22 nt, Human
accccaccacgauguggcccug

SEQ ID NO: 2358665 - RNA, 11 nt, Human
accccacccaa

SEQ ID NO: 2358666 - RNA, 11 nt, Human
accccacacuu

SEQ ID NO: 2358667 - RNA, 22 nt, Human
accccacaccaggccguccucc

SEQ ID NO: 2358668 - RNA, 18 nt, Human
accccacacgcuccuccc

SEQ ID NO: 2358669 - RNA, 23 nt, Human
acccaggagguggagguugcagu

SEQ ID NO: 2358670 - RNA, 16 nt, Human
accccacaccaggccg

SEQ ID NO: 2358671 - RNA, 17 nt, Human
accccacaccaggccgu

SEQ ID NO: 2358672 - RNA, 20 nt, Human
accccacaccaggccguccu

SEQ ID NO: 2358673 - RNA, 17 nt, Human
accccacacacgccaga

SEQ ID NO: 2358674 - RNA, 13 nt, Human
accccagagugug

SEQ ID NO: 2358675 - RNA, 13 nt, Human
accccagccccaa

SEQ ID NO: 2358676 - RNA, 13 nt, Human
accccagcauccu

SEQ ID NO: 2358677 - RNA, 15 nt, Human
accccacccucccug

SEQ ID NO: 2358678 - RNA, 12 nt, Human
accccagccuaa

SEQ ID NO: 2358679 - RNA, 23 nt, Human
accccagccgcucggaggcccca

SEQ ID NO: 2358680 - RNA, 22 nt, Human
accccagccccaaaacucuccu

SEQ ID NO: 2358681 - RNA, 17 nt, Human
acccuuuuucuccagcu

SEQ ID NO: 2358682 - RNA, 14 nt, Human
acccuuuugucugc

SEQ ID NO: 2358683 - RNA, 15 nt, Human
accgaaaacguggcu

SEQ ID NO: 2358684 - RNA, 13 nt, Human
acccuugaaaaga

SEQ ID NO: 2358685 - RNA, 16 nt, Human
acccuugcccacccca

SEQ ID NO: 2358686 - RNA, 17 nt, Human
acccuugcccaccccac

SEQ ID NO: 2358687 - RNA, 14 nt, Human
acccuuuccuuccu

SEQ ID NO: 2358688 - RNA, 20 nt, Human
acccuuuagccaaacccuug

SEQ ID NO: 2358689 - RNA, 19 nt, Human
acccuuuccuuccuucccu

SEQ ID NO: 2358690 - RNA, 18 nt, Human
acccuuuccuuccuuccc

SEQ ID NO: 2358691 - RNA, 17 nt, Human
acccuuuccuuccuucc

SEQ ID NO: 2358692 - RNA, 15 nt, Human
acccuuuccuuccuu

SEQ ID NO: 2358693 - RNA, 22 nt, Human
acccuuuccuuccuucccuggc

SEQ ID NO: 2358694 - RNA, 21 nt, Human
acccuuuccuuccuucccugg

SEQ ID NO: 2358695 - RNA, 23 nt, Human
acccuuuccuuccuucccuggcu

SEQ ID NO: 2358696 - RNA, 16 nt, Human
acccuugaaaagacau

SEQ ID NO: 2358697 - RNA, 11 nt, Human
acccuugacac

SEQ ID NO: 2358698 - RNA, 16 nt, Human
acccuucuuuccucuu

SEQ ID NO: 2358699 - RNA, 18 nt, Human
acccuucuuuccucuucc

SEQ ID NO: 2358700 - RNA, 20 nt, Human
acccuucuuuccucuucccc

SEQ ID NO: 2358701 - RNA, 17 nt, Human
acccuugccgucuaccu

SEQ ID NO: 2358702 - RNA, 20 nt, Human
acccuuguggucccacccca

SEQ ID NO: 2358703 - RNA, 23 nt, Human
acccuuguggucccaccccacac

SEQ ID NO: 2358704 - RNA, 23 nt, Human
acccuucuccucuuguaaauaaa

SEQ ID NO: 2358705 - RNA, 12 nt, Human
acccuucuuuuc

SEQ ID NO: 2358706 - RNA, 14 nt, Human
acccuucuuuccuc

SEQ ID NO: 2358707 - RNA, 15 nt, Human
acccuucuuuccucu

SEQ ID NO: 2358708 - RNA, 17 nt, Human
acccugcccugugggcc

SEQ ID NO: 2358709 - RNA, 22 nt, Human
acccugcccugugggcccccaa

SEQ ID NO: 2358710 - RNA, 15 nt, Human
acccugaggcccaga

SEQ ID NO: 2358711 - RNA, 16 nt, Human
acccugaggcccagag

SEQ ID NO: 2358712 - RNA, 17 nt, Human
acccugaggcccagagg

SEQ ID NO: 2358713 - RNA, 15 nt, Human
acccugcccuguggg

SEQ ID NO: 2358714 - RNA, 21 nt, Human
acccugaauuuggccugcacu

SEQ ID NO: 2358715 - RNA, 18 nt, Human
acccugaaggggccauga

SEQ ID NO: 2358716 - RNA, 21 nt, Human
acccugaaugguuccaugccu

SEQ ID NO: 2358717 - RNA, 22 nt, Human
acccugaaugguuccaugccug

SEQ ID NO: 2358718 - RNA, 14 nt, Human
acccugaggcccag

SEQ ID NO: 2358719 - RNA, 14 nt, Human
acccucugccacca

SEQ ID NO: 2358720 - RNA, 17 nt, Human
acccucugccaccagag

SEQ ID NO: 2358721 - RNA, 13 nt, Human
acccucugagcuu

SEQ ID NO: 2358722 - RNA, 18 nt, Human
acccucugagcuuugcau

SEQ ID NO: 2358723 - RNA, 21 nt, Human
acccucugagcuuugcauguu

SEQ ID NO: 2358724 - RNA, 13 nt, Human
acccucugccacc

SEQ ID NO: 2358725 - RNA, 17 nt, Human
acccugaaggggccaug

SEQ ID NO: 2358726 - RNA, 12 nt, Human
acccugaagggg

SEQ ID NO: 2358727 - RNA, 22 nt, Human
acccucugaaugguccaggguu

SEQ ID NO: 2358728 - RNA, 21 nt, Human
acccucugaaugguccagggu

SEQ ID NO: 2358729 - RNA, 15 nt, Human
acccucucccaggac

SEQ ID NO: 2358730 - RNA, 14 nt, Human
acccucucccagga

SEQ ID NO: 2358731 - RNA, 19 nt, Human
acccucugaaugguccagg

SEQ ID NO: 2358732 - RNA, 16 nt, Human
acccucuccaccccau

SEQ ID NO: 2358733 - RNA, 15 nt, Human
acccucuccacccca

SEQ ID NO: 2358734 - RNA, 14 nt, Human
acccucuccacccc

SEQ ID NO: 2358735 - RNA, 19 nt, Human
acccucucaggugaccaaa

SEQ ID NO: 2358736 - RNA, 15 nt, Human
acccucucagcucca

SEQ ID NO: 2358737 - RNA, 16 nt, Human
acccucucagcuccag

SEQ ID NO: 2358738 - RNA, 18 nt, Human
acccugaaagcccugagc

SEQ ID NO: 2358739 - RNA, 16 nt, Human
acccugaaagcccuga

SEQ ID NO: 2358740 - RNA, 14 nt, Human
acccucguggccuu

SEQ ID NO: 2358741 - RNA, 20 nt, Human
acccucguggccuuccccag

SEQ ID NO: 2358742 - RNA, 22 nt, Human
acccucgggcccaccuggccac

SEQ ID NO: 2358743 - RNA, 18 nt, Human
acccucgggcccaccugg

SEQ ID NO: 2358744 - RNA, 19 nt, Human
acccucgggcccaccuggc

SEQ ID NO: 2358745 - RNA, 20 nt, Human
acccucgggcccaccuggcc

SEQ ID NO: 2358746 - RNA, 21 nt, Human
acccucgggcccaccuggcca

SEQ ID NO: 2358747 - RNA, 13 nt, Human
acccucgggccca

SEQ ID NO: 2358748 - RNA, 14 nt, Human
acccucgggcccac

SEQ ID NO: 2358749 - RNA, 15 nt, Human
acccucgggcccacc

SEQ ID NO: 2358750 - RNA, 16 nt, Human
acccucgggcccaccu

SEQ ID NO: 2358751 - RNA, 17 nt, Human
acccucgggcccaccug

SEQ ID NO: 2358752 - RNA, 19 nt, Human
acccucgaggcggaucuuu

SEQ ID NO: 2358753 - RNA, 18 nt, Human
acccucgaggcggaucuu

SEQ ID NO: 2358754 - RNA, 21 nt, Human
acccgggaggcggagcuugca

SEQ ID NO: 2358755 - RNA, 12 nt, Human
acccgggcucag

SEQ ID NO: 2358756 - RNA, 13 nt, Human
acccgggcucagg

SEQ ID NO: 2358757 - RNA, 23 nt, Human
acccgggcucagggaccacagca

SEQ ID NO: 2358758 - RNA, 15 nt, Human
acccguacaacgugu

SEQ ID NO: 2358759 - RNA, 14 nt, Human
acccguccagaccu

SEQ ID NO: 2358760 - RNA, 12 nt, Human
ucagggggccag

SEQ ID NO: 2358761 - RNA, 13 nt, Human
ucagggggccagg

SEQ ID NO: 2358762 - RNA, 21 nt, Human
ucaggggcugcccgcucccag

SEQ ID NO: 2358763 - RNA, 22 nt, Human
ucaggggcugcccgcucccagu

SEQ ID NO: 2358764 - RNA, 18 nt, Human
ucaggggcuguuugagga

SEQ ID NO: 2358765 - RNA, 19 nt, Human
ucagggucccugguggcag

SEQ ID NO: 2358766 - RNA, 15 nt, Human
ucaggguucuccucu

SEQ ID NO: 2358767 - RNA, 18 nt, Human
ucagggucucugcugccg

SEQ ID NO: 2358768 - RNA, 16 nt, Human
ucagggugaugccagg

SEQ ID NO: 2358769 - RNA, 14 nt, Human
ucaggggcuguuug

SEQ ID NO: 2358770 - RNA, 12 nt, Human
ucagggucucug

SEQ ID NO: 2358771 - RNA, 16 nt, Human
ucagggucucugcugc

SEQ ID NO: 2358772 - RNA, 17 nt, Human
ucagggucucugcugcc

SEQ ID NO: 2358773 - RNA, 16 nt, Human
ucaggguuggccccug

SEQ ID NO: 2358774 - RNA, 20 nt, Human
ucaggggagucccgucagga

SEQ ID NO: 2358775 - RNA, 16 nt, Human
ucaggggagucccguc

SEQ ID NO: 2358776 - RNA, 12 nt, Human
ucaggggccaga

SEQ ID NO: 2358777 - RNA, 14 nt, Human
ucaggggccagagg

SEQ ID NO: 2358778 - RNA, 18 nt, Human
ucaggggacucagcccug

SEQ ID NO: 2358779 - RNA, 15 nt, Human
ucaggggccagagga

SEQ ID NO: 2358780 - RNA, 16 nt, Human
ucaggggccagaggaa

SEQ ID NO: 2358781 - RNA, 13 nt, Human
ucaggggcugccc

SEQ ID NO: 2358782 - RNA, 14 nt, Human
ucaggggcugcccg

SEQ ID NO: 2358783 - RNA, 16 nt, Human
ucaggggcugcccgcu

SEQ ID NO: 2358784 - RNA, 20 nt, Human
ucaggggcugcccgcuccca

SEQ ID NO: 2358785 - RNA, 16 nt, Human
ucaggggacucagccc

SEQ ID NO: 2358786 - RNA, 22 nt, Human
ucagggcugacacguccacccc

SEQ ID NO: 2358787 - RNA, 18 nt, Human
ucagcuuuuugucuuuuc

SEQ ID NO: 2358788 - RNA, 14 nt, Human
ucagggcuccuggg

SEQ ID NO: 2358789 - RNA, 12 nt, Human
ucagggcugaca

SEQ ID NO: 2358790 - RNA, 23 nt, Human
ucaggccaggcccucugcccacu

SEQ ID NO: 2358791 - RNA, 22 nt, Human
ucagcuuugccuuccacgcugu

SEQ ID NO: 2358792 - RNA, 16 nt, Human
ucagcuuuugcuucau

SEQ ID NO: 2358793 - RNA, 16 nt, Human
ucagcuuugccuucca

SEQ ID NO: 2358794 - RNA, 15 nt, Human
ucagcuuugccuucc

SEQ ID NO: 2358795 - RNA, 20 nt, Human
ucaggccaggcccucugccc

SEQ ID NO: 2358796 - RNA, 15 nt, Human
ucagcuacugauuuu

SEQ ID NO: 2358797 - RNA, 23 nt, Human
ucagcuccagacguaggggaggg

SEQ ID NO: 2358798 - RNA, 16 nt, Human
ucagcuugugcacaau

SEQ ID NO: 2358799 - RNA, 21 nt, Human
ucaggccaggcccucugccca

SEQ ID NO: 2358800 - RNA, 22 nt, Human
ucaggccaggcccucugcccac

SEQ ID NO: 2358801 - RNA, 14 nt, Human
ucagcuccagcuca

SEQ ID NO: 2358802 - RNA, 15 nt, Human
ucagcuccagcucac

SEQ ID NO: 2358803 - RNA, 21 nt, Human
ucagcuuguaaauagcucagg

SEQ ID NO: 2358804 - RNA, 22 nt, Human
ucagcuuguaaauagcucaggu

SEQ ID NO: 2358805 - RNA, 21 nt, Human
ucaggguucuccucuccccuc

SEQ ID NO: 2358806 - RNA, 15 nt, Human
acccggaggggccug

SEQ ID NO: 2358807 - RNA, 23 nt, Human
ucagguaacaggcagauacagga

SEQ ID NO: 2358808 - RNA, 21 nt, Human
ucagguaacaggcagauacag

SEQ ID NO: 2358809 - RNA, 22 nt, Human
ucagguaacaggcagauacagg

SEQ ID NO: 2358810 - RNA, 14 nt, Human
acccggccccugcu

SEQ ID NO: 2358811 - RNA, 18 nt, Human
acccggaggggccuggca

SEQ ID NO: 2358812 - RNA, 21 nt, Human
acccggaggggccuggcagcc

SEQ ID NO: 2358813 - RNA, 15 nt, Human
acccggccccugcug

SEQ ID NO: 2358814 - RNA, 16 nt, Human
acccggccccugcugg

SEQ ID NO: 2358815 - RNA, 21 nt, Human
acccggcgguccccuccgcca

SEQ ID NO: 2358816 - RNA, 22 nt, Human
acccggcaggcuagaaccuggc

SEQ ID NO: 2358817 - RNA, 22 nt, Human
acccggccccugcugguucagg

SEQ ID NO: 2358818 - RNA, 17 nt, Human
acccggccccugcuggu

SEQ ID NO: 2358819 - RNA, 20 nt, Human
acccggccccugcugguuca

SEQ ID NO: 2358820 - RNA, 17 nt, Human
acccgggaggcagaggu

SEQ ID NO: 2358821 - RNA, 14 nt, Human
acccggcugcagag

SEQ ID NO: 2358822 - RNA, 12 nt, Human
acccgggaaggg

SEQ ID NO: 2358823 - RNA, 13 nt, Human
acccgggaagggg

SEQ ID NO: 2358824 - RNA, 21 nt, Human
acaugguaaacgcugucccua

SEQ ID NO: 2358825 - RNA, 22 nt, Human
acaugguagccaguugaauuua

SEQ ID NO: 2358826 - RNA, 21 nt, Human
acauggugaaaccucaucucu

SEQ ID NO: 2358827 - RNA, 15 nt, Human
acauguaauuaagua

SEQ ID NO: 2358828 - RNA, 22 nt, Human
acaugggguuuucaauuuugca

SEQ ID NO: 2358829 - RNA, 18 nt, Human
acaugggguuuucaauuu

SEQ ID NO: 2358830 - RNA, 16 nt, Human
acaugggguuuucaau

SEQ ID NO: 2358831 - RNA, 21 nt, Human
acaugggguuggcugggccca

SEQ ID NO: 2358832 - RNA, 20 nt, Human
acaugggguuggcugggccc

SEQ ID NO: 2358833 - RNA, 17 nt, Human
acaugggguuggcuggg

SEQ ID NO: 2358834 - RNA, 18 nt, Human
acauggggcugggcagcu

SEQ ID NO: 2358835 - RNA, 16 nt, Human
acauggggaggaagga

SEQ ID NO: 2358836 - RNA, 23 nt, Human
acaugggagccgggucugccucu

SEQ ID NO: 2358837 - RNA, 22 nt, Human
acauguaauuaaguacuaugua

SEQ ID NO: 2358838 - RNA, 21 nt, Human
acauguaauuaaguacuaugu

SEQ ID NO: 2358839 - RNA, 19 nt, Human
acauguaauuaaguacuau

SEQ ID NO: 2358840 - RNA, 17 nt, Human
acauguaauuaaguacu

SEQ ID NO: 2358841 - RNA, 19 nt, Human
acauggcuuaguuuucaua

SEQ ID NO: 2358842 - RNA, 14 nt, Human
acauggcuuaguuu

SEQ ID NO: 2358843 - RNA, 13 nt, Human
acauggcuuccuc

SEQ ID NO: 2358844 - RNA, 16 nt, Human
acauggcuuccuccug

SEQ ID NO: 2358845 - RNA, 13 nt, Human
acaugcuuuguga

SEQ ID NO: 2358846 - RNA, 17 nt, Human
acauggaacucauuccu

SEQ ID NO: 2358847 - RNA, 11 nt, Human
acaugggacau

SEQ ID NO: 2358848 - RNA, 14 nt, Human
acaugggacauuug

SEQ ID NO: 2358849 - RNA, 20 nt, Human
acauggcuugccacagcucu

SEQ ID NO: 2358850 - RNA, 20 nt, Human
acaugggagccgggucugcc

SEQ ID NO: 2358851 - RNA, 21 nt, Human
acaugggacauuugcucaugg

SEQ ID NO: 2358852 - RNA, 15 nt, Human
acaugggacauuugc

SEQ ID NO: 2358853 - RNA, 20 nt, Human
acaugggacauuugcucaug

SEQ ID NO: 2358854 - RNA, 14 nt, Human
acaguccagccugg

SEQ ID NO: 2358855 - RNA, 14 nt, Human
acagucauuuaaaa

SEQ ID NO: 2358856 - RNA, 15 nt, Human
acaguccagccugga

SEQ ID NO: 2358857 - RNA, 13 nt, Human
acagucauuuaaa

SEQ ID NO: 2358858 - RNA, 20 nt, Human
acagucagauuuccagucuc

SEQ ID NO: 2358859 - RNA, 21 nt, Human
acaugaaguguguuuccuuca

SEQ ID NO: 2358860 - RNA, 19 nt, Human
acaugaaguguguuuccuu

SEQ ID NO: 2358861 - RNA, 18 nt, Human
acaguccagccuggagau

SEQ ID NO: 2358862 - RNA, 16 nt, Human
acaguccagccuggag

SEQ ID NO: 2358863 - RNA, 17 nt, Human
acagucccuaaagaaaa

SEQ ID NO: 2358864 - RNA, 20 nt, Human
acaugaauauuuaguguuca

SEQ ID NO: 2358865 - RNA, 15 nt, Human
acaugaaugcacacu

SEQ ID NO: 2358866 - RNA, 18 nt, Human
acaugaauugcauuuuac

SEQ ID NO: 2358867 - RNA, 13 nt, Human
acaugaauaugau

SEQ ID NO: 2358868 - RNA, 20 nt, Human
acaugaaucccacccacaug

SEQ ID NO: 2358869 - RNA, 21 nt, Human
acaugaaucccacccacaugu

SEQ ID NO: 2358870 - RNA, 23 nt, Human
acaugaaucccacccacauguga

SEQ ID NO: 2358871 - RNA, 20 nt, Human
acaugagguacugagaguga

SEQ ID NO: 2358872 - RNA, 16 nt, Human
acaugagguacugaga

SEQ ID NO: 2358873 - RNA, 21 nt, Human
acaugcuacacacugcauguu

SEQ ID NO: 2358874 - RNA, 15 nt, Human
acaugcuacacacug

SEQ ID NO: 2358875 - RNA, 23 nt, Human
acaugagguacugagagugaaca

SEQ ID NO: 2358876 - RNA, 23 nt, Human
acaugcgguagccagcacacagg

SEQ ID NO: 2358877 - RNA, 22 nt, Human
acaugcgguagccagcacacag

SEQ ID NO: 2358878 - RNA, 20 nt, Human
acaugcgguagccagcacac

SEQ ID NO: 2358879 - RNA, 13 nt, Human
acaugagucaaga

SEQ ID NO: 2358880 - RNA, 13 nt, Human
acaugagucccag

SEQ ID NO: 2358881 - RNA, 18 nt, Human
acaugcgguagccagcac

SEQ ID NO: 2358882 - RNA, 17 nt, Human
ucaaccaaugccaaaaa

SEQ ID NO: 2358883 - RNA, 15 nt, Human
ucaaccaauguagaa

SEQ ID NO: 2358884 - RNA, 17 nt, Human
ucaacauuuacauguau

SEQ ID NO: 2358885 - RNA, 14 nt, Human
ucaacauuucucaa

SEQ ID NO: 2358886 - RNA, 16 nt, Human
ucaacaagggagagac

SEQ ID NO: 2358887 - RNA, 16 nt, Human
ucaacauuuacaugua

SEQ ID NO: 2358888 - RNA, 14 nt, Human
ucaacaaccaggga

SEQ ID NO: 2358889 - RNA, 14 nt, Human
ucaacaaagcacag

SEQ ID NO: 2358890 - RNA, 15 nt, Human
ucaacaaagcacagu

SEQ ID NO: 2358891 - RNA, 18 nt, Human
ucaacaaagcacaguguu

SEQ ID NO: 2358892 - RNA, 23 nt, Human
ucaacaaagcacaguguuaaaug

SEQ ID NO: 2358893 - RNA, 14 nt, Human
ucaacauuuacaug

SEQ ID NO: 2358894 - RNA, 12 nt, Human
ucaaauuucaca

SEQ ID NO: 2358895 - RNA, 13 nt, Human
ucaaauuucuaaa

SEQ ID NO: 2358896 - RNA, 18 nt, Human
ucaacaaaaauugucccu

SEQ ID NO: 2358897 - RNA, 14 nt, Human
ucaacaaacuauuu

SEQ ID NO: 2358898 - RNA, 15 nt, Human
ucaacaaaaauuguc

SEQ ID NO: 2358899 - RNA, 18 nt, Human
ucaacaaacuauuucuua

SEQ ID NO: 2358900 - RNA, 17 nt, Human
ucaacaagggagagacc

SEQ ID NO: 2358901 - RNA, 15 nt, Human
ucaaccauuccccau

SEQ ID NO: 2358902 - RNA, 15 nt, Human
ucaacccaggagcau

SEQ ID NO: 2358903 - RNA, 16 nt, Human
ucaaccaucgcuuuau

SEQ ID NO: 2358904 - RNA, 18 nt, Human
ucaaccauuccccauggg

SEQ ID NO: 2358905 - RNA, 14 nt, Human
ucaaccagcagaug

SEQ ID NO: 2358906 - RNA, 23 nt, Human
ucaaccacuguaaaaugaaauua

SEQ ID NO: 2358907 - RNA, 17 nt, Human
ucaaccaccuuucagau

SEQ ID NO: 2358908 - RNA, 18 nt, Human
ucaacccccauuucuauu

SEQ ID NO: 2358909 - RNA, 19 nt, Human
ucaacugccaaaaugcucu

SEQ ID NO: 2358910 - RNA, 14 nt, Human
ucaacugccuacuc

SEQ ID NO: 2358911 - RNA, 18 nt, Human
ucaacugggcugaacacu

SEQ ID NO: 2358912 - RNA, 20 nt, Human
ucaacugccuacuccaaaau

SEQ ID NO: 2358913 - RNA, 18 nt, Human
ucaacugccuacuccaaa

SEQ ID NO: 2358914 - RNA, 20 nt, Human
ucaaccccaccacuucuuuu

SEQ ID NO: 2358915 - RNA, 23 nt, Human
ucaacccaggagcauccaccucc

SEQ ID NO: 2358916 - RNA, 20 nt, Human
ucaacugcaucaagauguga

SEQ ID NO: 2358917 - RNA, 20 nt, Human
acauguacuguucucuucuu

SEQ ID NO: 2358918 - RNA, 17 nt, Human
acauguaggaaguagga

SEQ ID NO: 2358919 - RNA, 16 nt, Human
acauguauuuguuugc

SEQ ID NO: 2358920 - RNA, 15 nt, Human
acauguagguguuug

SEQ ID NO: 2358921 - RNA, 23 nt, Human
acauguagguguuuguucaucug

SEQ ID NO: 2358922 - RNA, 18 nt, Human
acauguauuuguuugcau

SEQ ID NO: 2358923 - RNA, 17 nt, Human
acauguauuuguuugca

SEQ ID NO: 2358924 - RNA, 19 nt, Human
acauguauuuguuugcaua

SEQ ID NO: 2358925 - RNA, 20 nt, Human
acauguaguaguacuugaaa

SEQ ID NO: 2358926 - RNA, 23 nt, Human
acauguaauuaaguacuauguau

SEQ ID NO: 2358927 - RNA, 18 nt, Human
acauguaauauaaagaug

SEQ ID NO: 2358928 - RNA, 11 nt, Human
acauguacaga

SEQ ID NO: 2358929 - RNA, 13 nt, Human
acauguacagaga

SEQ ID NO: 2358930 - RNA, 13 nt, Human
acauggugccuga

SEQ ID NO: 2358931 - RNA, 16 nt, Human
acauggugccugagag

SEQ ID NO: 2358932 - RNA, 18 nt, Human
acauggugccugagaggc

SEQ ID NO: 2358933 - RNA, 19 nt, Human
acauuccuaaacuaucuuu

SEQ ID NO: 2358934 - RNA, 23 nt, Human
acauuccgacaaccgaugcucca

SEQ ID NO: 2358935 - RNA, 13 nt, Human
acauuccauccuu

SEQ ID NO: 2358936 - RNA, 20 nt, Human
acauuccuaaacuaucuuuu

SEQ ID NO: 2358937 - RNA, 17 nt, Human
acauucccaucugucac

SEQ ID NO: 2358938 - RNA, 15 nt, Human
acauguccaagaagc

SEQ ID NO: 2358939 - RNA, 21 nt, Human
acaugucaguaccuucaaacu

SEQ ID NO: 2358940 - RNA, 19 nt, Human
acaugucaguaccuucaaa

SEQ ID NO: 2358941 - RNA, 18 nt, Human
acaugucaguaccuucaa

SEQ ID NO: 2358942 - RNA, 23 nt, Human
acaugucaccguggaccuuccug

SEQ ID NO: 2358943 - RNA, 15 nt, Human
acauucggcucccug

SEQ ID NO: 2358944 - RNA, 17 nt, Human
acauuccuugccugcac

SEQ ID NO: 2358945 - RNA, 20 nt, Human
acauucggcucccuggagcc

SEQ ID NO: 2358946 - RNA, 17 nt, Human
acauucggcucccugga

SEQ ID NO: 2358947 - RNA, 18 nt, Human
acauuccuugccugcaca

SEQ ID NO: 2358948 - RNA, 14 nt, Human
acauuccugaugcu

SEQ ID NO: 2358949 - RNA, 20 nt, Human
acauucugacaucuuaguau

SEQ ID NO: 2358950 - RNA, 16 nt, Human
acauucugauuuggaa

SEQ ID NO: 2358951 - RNA, 18 nt, Human
ucaaauugugugaaaggu

SEQ ID NO: 2358952 - RNA, 15 nt, Human
ucaaauugugugaaa

SEQ ID NO: 2358953 - RNA, 14 nt, Human
ucaauauccuuugc

SEQ ID NO: 2358954 - RNA, 16 nt, Human
ucaauauccuuugccu

SEQ ID NO: 2358955 - RNA, 18 nt, Human
ucaauauccaaaccaaau

SEQ ID NO: 2358956 - RNA, 12 nt, Human
ucaagucuuccc

SEQ ID NO: 2358957 - RNA, 14 nt, Human
ucaauagucaagaa

SEQ ID NO: 2358958 - RNA, 17 nt, Human
ucaauagucaagaaaaa

SEQ ID NO: 2358959 - RNA, 14 nt, Human
ucaauauuccugaa

SEQ ID NO: 2358960 - RNA, 22 nt, Human
ucaauauuccugaaugaaauau

SEQ ID NO: 2358961 - RNA, 21 nt, Human
ucaauauuccugaaugaaaua

SEQ ID NO: 2358962 - RNA, 18 nt, Human
ucaauauuccugaaugaa

SEQ ID NO: 2358963 - RNA, 17 nt, Human
ucaauauuccugaauga

SEQ ID NO: 2358964 - RNA, 22 nt, Human
ucaauaucuuuuuuuuaauaaa

SEQ ID NO: 2358965 - RNA, 13 nt, Human
ucaauaugcuuac

SEQ ID NO: 2358966 - RNA, 14 nt, Human
ucaauauuaaauac

SEQ ID NO: 2358967 - RNA, 15 nt, Human
ucaauauuaaauaca

SEQ ID NO: 2358968 - RNA, 16 nt, Human
ucaauauuaaauacag

SEQ ID NO: 2358969 - RNA, 17 nt, Human
ucaauauuaaauacaga

SEQ ID NO: 2358970 - RNA, 19 nt, Human
ucaauauuaaauacagaca

SEQ ID NO: 2358971 - RNA, 21 nt, Human
ucaauauuaaauacagacacu

SEQ ID NO: 2358972 - RNA, 22 nt, Human
ucaauauuaaauacagacacua

SEQ ID NO: 2358973 - RNA, 19 nt, Human
ucaacuugcauccaacucc

SEQ ID NO: 2358974 - RNA, 22 nt, Human
ucaacuuucuuuugauuagugu

SEQ ID NO: 2358975 - RNA, 15 nt, Human
ucaacuuuuccuuug

SEQ ID NO: 2358976 - RNA, 19 nt, Human
ucaacuucuggcuccucaa

SEQ ID NO: 2358977 - RNA, 16 nt, Human
ucaacuucuggcuccu

SEQ ID NO: 2358978 - RNA, 18 nt, Human
ucaacuucuggcuccuca

SEQ ID NO: 2358979 - RNA, 12 nt, Human
ucaacugggcug

SEQ ID NO: 2358980 - RNA, 20 nt, Human
ucaacugccaaaaugcucua

SEQ ID NO: 2358981 - RNA, 19 nt, Human
ucaagucucugcuggccca

SEQ ID NO: 2358982 - RNA, 17 nt, Human
ucaagucucugcuggcc

SEQ ID NO: 2358983 - RNA, 16 nt, Human
ucaagucucugcuggc

SEQ ID NO: 2358984 - RNA, 14 nt, Human
ucaagucucugcug

SEQ ID NO: 2358985 - RNA, 18 nt, Human
ucaaguccuuaccucuuc

SEQ ID NO: 2358986 - RNA, 22 nt, Human
ucaaguccuuaccucuuccgga

SEQ ID NO: 2358987 - RNA, 22 nt, Human
ucaaguccucuuuucugagagg

SEQ ID NO: 2358988 - RNA, 17 nt, Human
ucaagaaaacaacuuca

SEQ ID NO: 2358989 - RNA, 21 nt, Human
ucaacuuuuccuuugaauccu

SEQ ID NO: 2358990 - RNA, 18 nt, Human
ucaagaaaaauuauugua

SEQ ID NO: 2358991 - RNA, 21 nt, Human
ucaagaaaaauuauuguauaa

SEQ ID NO: 2358992 - RNA, 10 nt, Human
ucaauauuua

SEQ ID NO: 2358993 - RNA, 15 nt, Human
ucaauauugucauuc

SEQ ID NO: 2358994 - RNA, 17 nt, Human
ucaauauugucauuccu

SEQ ID NO: 2358995 - RNA, 11 nt, Human
ucaauauuuau

SEQ ID NO: 2358996 - RNA, 18 nt, Human
ucaauauugucauuccug

SEQ ID NO: 2358997 - RNA, 13 nt, Human
ucaauauuuaaac

SEQ ID NO: 2358998 - RNA, 15 nt, Human
ucaauauuucagaua

SEQ ID NO: 2358999 - RNA, 20 nt, Human
ucaauauuuauuauuuucac

SEQ ID NO: 2359000 - RNA, 12 nt, Human
ucaauauuuauu

SEQ ID NO: 2359001 - RNA, 13 nt, Human
ucaauauuuauua

SEQ ID NO: 2359002 - RNA, 19 nt, Human
ucaauauuucagauaauca

SEQ ID NO: 2359003 - RNA, 15 nt, Human
ucaaucucucuuaga

SEQ ID NO: 2359004 - RNA, 15 nt, Human
ucaauccuuguucag

SEQ ID NO: 2359005 - RNA, 17 nt, Human
ucaauauuuaaacaugg

SEQ ID NO: 2359006 - RNA, 20 nt, Human
ucaaucucccgcugcugcug

SEQ ID NO: 2359007 - RNA, 18 nt, Human
ucaaucucccgcugcugc

SEQ ID NO: 2359008 - RNA, 13 nt, Human
ucaaucuguaaac

SEQ ID NO: 2359009 - RNA, 16 nt, Human
ucaaucuguaaacugu

SEQ ID NO: 2359010 - RNA, 14 nt, Human
ucaaucuguaaacu

SEQ ID NO: 2359011 - RNA, 16 nt, Human
ucaaucuguuuuucau

SEQ ID NO: 2359012 - RNA, 17 nt, Human
ucaaucuguaaacugug

SEQ ID NO: 2359013 - RNA, 20 nt, Human
acauugaaguaaugaauuuu

SEQ ID NO: 2359014 - RNA, 19 nt, Human
acauugaaguaaugaauuu

SEQ ID NO: 2359015 - RNA, 18 nt, Human
acauugaaguaaugaauu

SEQ ID NO: 2359016 - RNA, 15 nt, Human
acauugaaguaauga

SEQ ID NO: 2359017 - RNA, 12 nt, Human
acauugaaagag

SEQ ID NO: 2359018 - RNA, 19 nt, Human
acauucuuccaaaaagauu

SEQ ID NO: 2359019 - RNA, 23 nt, Human
acauucuuauaaauaugaagcuc

SEQ ID NO: 2359020 - RNA, 18 nt, Human
acauucuuauaaauauga

SEQ ID NO: 2359021 - RNA, 22 nt, Human
acauucuuauaaauaugaagcu

SEQ ID NO: 2359022 - RNA, 10 nt, Human
ucaaugaucu

SEQ ID NO: 2359023 - RNA, 11 nt, Human
ucaaugaucua

SEQ ID NO: 2359024 - RNA, 17 nt, Human
acauucuuauaaauaug

SEQ ID NO: 2359025 - RNA, 15 nt, Human
ucaaugacagagccu

SEQ ID NO: 2359026 - RNA, 23 nt, Human
ucaaugaaugaaugaauggcuaa

SEQ ID NO: 2359027 - RNA, 17 nt, Human
ucaaugacagagccuuc

SEQ ID NO: 2359028 - RNA, 18 nt, Human
ucaaugacagagccuucu

SEQ ID NO: 2359029 - RNA, 20 nt, Human
acauuuucacacaauacaau

SEQ ID NO: 2359030 - RNA, 15 nt, Human
acauuuucacacaau

SEQ ID NO: 2359031 - RNA, 13 nt, Human
acauuuucacaca

SEQ ID NO: 2359032 - RNA, 14 nt, Human
acauuguugagcua

SEQ ID NO: 2359033 - RNA, 19 nt, Human
acauuuuccuuuucaaaua

SEQ ID NO: 2359034 - RNA, 12 nt, Human
acauuuuccuuu

SEQ ID NO: 2359035 - RNA, 12 nt, Human
acauuuucauuu

SEQ ID NO: 2359036 - RNA, 17 nt, Human
acauuuuggugagaaau

SEQ ID NO: 2359037 - RNA, 14 nt, Human
acauuuugccaaaa

SEQ ID NO: 2359038 - RNA, 20 nt, Human
acauuuuguaacaaagaacu

SEQ ID NO: 2359039 - RNA, 20 nt, Human
acauuuuauuuuauuaugca

SEQ ID NO: 2359040 - RNA, 19 nt, Human
acauuuuauuuuauuaugc

SEQ ID NO: 2359041 - RNA, 14 nt, Human
acauuuuauuuuau

SEQ ID NO: 2359042 - RNA, 18 nt, Human
acauuuuauuuuauuaug

SEQ ID NO: 2359043 - RNA, 12 nt, Human
acauugucugcg

SEQ ID NO: 2359044 - RNA, 17 nt, Human
acauuguggcacauucu

SEQ ID NO: 2359045 - RNA, 20 nt, Human
acauuguucaauuagaauag

SEQ ID NO: 2359046 - RNA, 16 nt, Human
acauuguucaauuaga

SEQ ID NO: 2359047 - RNA, 22 nt, Human
acauugucucuaaauugugggu

SEQ ID NO: 2359048 - RNA, 17 nt, Human
acauuguugagcuauug

SEQ ID NO: 2359049 - RNA, 14 nt, Human
acauugucaauaaa

SEQ ID NO: 2359050 - RNA, 14 nt, Human
acauugucagcaaa

SEQ ID NO: 2359051 - RNA, 13 nt, Human
acauugucaauaa

SEQ ID NO: 2359052 - RNA, 12 nt, Human
acauugucaaua

SEQ ID NO: 2359053 - RNA, 22 nt, Human
acauugccuuuucuagcccgaa

SEQ ID NO: 2359054 - RNA, 18 nt, Human
acauugucagcaaauuaa

SEQ ID NO: 2359055 - RNA, 15 nt, Human
acauugucauuuaua

SEQ ID NO: 2359056 - RNA, 19 nt, Human
acauugucauuuauauaga

SEQ ID NO: 2359057 - RNA, 17 nt, Human
acauugucauuuauaua

SEQ ID NO: 2359058 - RNA, 19 nt, Human
acauugcauauaacuuaua

SEQ ID NO: 2359059 - RNA, 14 nt, Human
acauugaauuagaa

SEQ ID NO: 2359060 - RNA, 18 nt, Human
acauugaauuagaaacau

SEQ ID NO: 2359061 - RNA, 22 nt, Human
acauugaauuagaaacauaaau

SEQ ID NO: 2359062 - RNA, 15 nt, Human
accaaaagaacaaga

SEQ ID NO: 2359063 - RNA, 17 nt, Human
accaaaacugugcagag

SEQ ID NO: 2359064 - RNA, 12 nt, Human
accaaaacaugu

SEQ ID NO: 2359065 - RNA, 12 nt, Human
accaaaacugug

SEQ ID NO: 2359066 - RNA, 18 nt, Human
accaaaacugugcagagu

SEQ ID NO: 2359067 - RNA, 14 nt, Human
accaaaauccccuu

SEQ ID NO: 2359068 - RNA, 18 nt, Human
accaaaauaagaaaagau

SEQ ID NO: 2359069 - RNA, 17 nt, Human
accaaaauaagaaaaga

SEQ ID NO: 2359070 - RNA, 16 nt, Human
accaaaauaagaaaag

SEQ ID NO: 2359071 - RNA, 15 nt, Human
accaaaauaagaaaa

SEQ ID NO: 2359072 - RNA, 13 nt, Human
accaaaauaagaa

SEQ ID NO: 2359073 - RNA, 16 nt, Human
accaaaauuauuucag

SEQ ID NO: 2359074 - RNA, 23 nt, Human
accaaaccgccagcgaacuugac

SEQ ID NO: 2359075 - RNA, 14 nt, Human
accaaaccuagccc

SEQ ID NO: 2359076 - RNA, 16 nt, Human
accaaaauccccuucu

SEQ ID NO: 2359077 - RNA, 17 nt, Human
accaaaauccccuucuc

SEQ ID NO: 2359078 - RNA, 17 nt, Human
accaaaauuauuucaga

SEQ ID NO: 2359079 - RNA, 12 nt, Human
accaaagaagaa

SEQ ID NO: 2359080 - RNA, 13 nt, Human
accaaagaagaaa

SEQ ID NO: 2359081 - RNA, 18 nt, Human
accaaagagacuggagca

SEQ ID NO: 2359082 - RNA, 17 nt, Human
accaaagagacuggagc

SEQ ID NO: 2359083 - RNA, 22 nt, Human
accaaagauauauacacaggau

SEQ ID NO: 2359084 - RNA, 23 nt, Human
accaaagauauauacacaggauc

SEQ ID NO: 2359085 - RNA, 21 nt, Human
accaaagagacuggagcaucu

SEQ ID NO: 2359086 - RNA, 22 nt, Human
accaaagagacuggagcaucug

SEQ ID NO: 2359087 - RNA, 15 nt, Human
accaaagagggcuuc

SEQ ID NO: 2359088 - RNA, 18 nt, Human
accaaagagggcuuccuc

SEQ ID NO: 2359089 - RNA, 18 nt, Human
acauuuuggugagaaaug

SEQ ID NO: 2359090 - RNA, 12 nt, Human
acauuuuuacaa

SEQ ID NO: 2359091 - RNA, 19 nt, Human
acauuuuuaagugcugcau

SEQ ID NO: 2359092 - RNA, 23 nt, Human
acauuuuuaagugcugcauuuaa

SEQ ID NO: 2359093 - RNA, 22 nt, Human
acauuuuuaagugcugcauuua

SEQ ID NO: 2359094 - RNA, 21 nt, Human
acauuuuuaagugcugcauuu

SEQ ID NO: 2359095 - RNA, 21 nt, Human
acauuuuuuaaaugcaccugg

SEQ ID NO: 2359096 - RNA, 23 nt, Human
accaaaaaucucaauauuucaga

SEQ ID NO: 2359097 - RNA, 17 nt, Human
acauuuuuuaaaugcac

SEQ ID NO: 2359098 - RNA, 16 nt, Human
acauuuuuuaaaugca

SEQ ID NO: 2359099 - RNA, 14 nt, Human
acauuuuuuaaaug

SEQ ID NO: 2359100 - RNA, 16 nt, Human
ucacugucuuuccuag

SEQ ID NO: 2359101 - RNA, 15 nt, Human
ucacugucuuuccua

SEQ ID NO: 2359102 - RNA, 17 nt, Human
ucacugucuuuccuaga

SEQ ID NO: 2359103 - RNA, 13 nt, Human
ucacugcaggcac

SEQ ID NO: 2359104 - RNA, 22 nt, Human
ucacugcagccuccuucuccug

SEQ ID NO: 2359105 - RNA, 21 nt, Human
ucacugcaggcacucaaugca

SEQ ID NO: 2359106 - RNA, 15 nt, Human
ucacugcagccucaa

SEQ ID NO: 2359107 - RNA, 23 nt, Human
ucacuauggugccaauggaaccu

SEQ ID NO: 2359108 - RNA, 13 nt, Human
ucacugcagccuc

SEQ ID NO: 2359109 - RNA, 23 nt, Human
ucacuguugcccaggcuggcgug

SEQ ID NO: 2359110 - RNA, 15 nt, Human
ucacuguucccucug

SEQ ID NO: 2359111 - RNA, 17 nt, Human
ucacuguucccucugcu

SEQ ID NO: 2359112 - RNA, 16 nt, Human
ucacuguggugucugu

SEQ ID NO: 2359113 - RNA, 18 nt, Human
ucacugugggaaggccag

SEQ ID NO: 2359114 - RNA, 17 nt, Human
ucacugugguccuaugc

SEQ ID NO: 2359115 - RNA, 21 nt, Human
ucacugugggaaggccagcug

SEQ ID NO: 2359116 - RNA, 14 nt, Human
ucacuauggugcca

SEQ ID NO: 2359117 - RNA, 22 nt, Human
ucacuaugaaucuauuauacug

SEQ ID NO: 2359118 - RNA, 19 nt, Human
ucacuauggugccaaugga

SEQ ID NO: 2359119 - RNA, 16 nt, Human
ucacugagacagcccg

SEQ ID NO: 2359120 - RNA, 17 nt, Human
ucacuauaaaugguguu

SEQ ID NO: 2359121 - RNA, 20 nt, Human
ucacuacccuauucucucuu

SEQ ID NO: 2359122 - RNA, 19 nt, Human
ucacuaucccggcugcccu

SEQ ID NO: 2359123 - RNA, 13 nt, Human
ucacuauaaaugg

SEQ ID NO: 2359124 - RNA, 23 nt, Human
ucacuauaggucauacaauccau

SEQ ID NO: 2359125 - RNA, 21 nt, Human
ucacuauauaggcaucacauu

SEQ ID NO: 2359126 - RNA, 21 nt, Human
ucacuaugaaucuauuauacu

SEQ ID NO: 2359127 - RNA, 20 nt, Human
ucacuaucccggcugcccuu

SEQ ID NO: 2359128 - RNA, 14 nt, Human
ucacugcagccuca

SEQ ID NO: 2359129 - RNA, 22 nt, Human
ucacugagacagcccgggcucu

SEQ ID NO: 2359130 - RNA, 17 nt, Human
ucacugagacagcccgg

SEQ ID NO: 2359131 - RNA, 21 nt, Human
ucacugagacagcccgggcuc

SEQ ID NO: 2359132 - RNA, 15 nt, Human
accaguccccccacc

SEQ ID NO: 2359133 - RNA, 14 nt, Human
accagucugacugu

SEQ ID NO: 2359134 - RNA, 20 nt, Human
accaguaucgcucauagauc

SEQ ID NO: 2359135 - RNA, 14 nt, Human
accagucugacccu

SEQ ID NO: 2359136 - RNA, 17 nt, Human
accaguccccccacccu

SEQ ID NO: 2359137 - RNA, 14 nt, Human
accagugaaccaaa

SEQ ID NO: 2359138 - RNA, 16 nt, Human
accagugaaccaaaga

SEQ ID NO: 2359139 - RNA, 17 nt, Human
accagugaaccaaagag

SEQ ID NO: 2359140 - RNA, 13 nt, Human
accaguguccccu

SEQ ID NO: 2359141 - RNA, 18 nt, Human
accagugaaccaaagaga

SEQ ID NO: 2359142 - RNA, 18 nt, Human
accaguguccccuccacu

SEQ ID NO: 2359143 - RNA, 17 nt, Human
accaguguuguggauuu

SEQ ID NO: 2359144 - RNA, 15 nt, Human
accaguguuguggau

SEQ ID NO: 2359145 - RNA, 12 nt, Human
ucacuugagacc

SEQ ID NO: 2359146 - RNA, 14 nt, Human
ucacuugagacaaa

SEQ ID NO: 2359147 - RNA, 13 nt, Human
ucacuugaaugug

SEQ ID NO: 2359148 - RNA, 21 nt, Human
ucacuugaauccuagggccug

SEQ ID NO: 2359149 - RNA, 18 nt, Human
ucacuguuucucugcugu

SEQ ID NO: 2359150 - RNA, 23 nt, Human
ucacuugaacccgggaggcagag

SEQ ID NO: 2359151 - RNA, 17 nt, Human
ucacuguuucucugcug

SEQ ID NO: 2359152 - RNA, 14 nt, Human
ucacuguuucucug

SEQ ID NO: 2359153 - RNA, 16 nt, Human
ucacuguucccucugc

SEQ ID NO: 2359154 - RNA, 22 nt, Human
ucacuugaggucaggaguuccu

SEQ ID NO: 2359155 - RNA, 18 nt, Human
ucacuugaugugccauuu

SEQ ID NO: 2359156 - RNA, 19 nt, Human
ucacuugaugugccauuuu

SEQ ID NO: 2359157 - RNA, 10 nt, Human
ucacuugagu

SEQ ID NO: 2359158 - RNA, 15 nt, Human
accagcugccucuuc

SEQ ID NO: 2359159 - RNA, 16 nt, Human
accagcugccucuucu

SEQ ID NO: 2359160 - RNA, 16 nt, Human
accagcugcgcuugcu

SEQ ID NO: 2359161 - RNA, 14 nt, Human
accagcugccucuu

SEQ ID NO: 2359162 - RNA, 14 nt, Human
accagcuccucccu

SEQ ID NO: 2359163 - RNA, 23 nt, Human
accagcucaggacagaugccaca

SEQ ID NO: 2359164 - RNA, 13 nt, Human
accagcuccuccc

SEQ ID NO: 2359165 - RNA, 16 nt, Human
accagcuuagauuuua

SEQ ID NO: 2359166 - RNA, 22 nt, Human
accagcuguucugucccuugga

SEQ ID NO: 2359167 - RNA, 17 nt, Human
accagcuguaacacagc

SEQ ID NO: 2359168 - RNA, 21 nt, Human
accagcuggggcguggggagg

SEQ ID NO: 2359169 - RNA, 23 nt, Human
accagcuggggcguggggagggc

SEQ ID NO: 2359170 - RNA, 18 nt, Human
accagcugcgcuugcuuu

SEQ ID NO: 2359171 - RNA, 19 nt, Human
accagcugcgcuugcuuuu

SEQ ID NO: 2359172 - RNA, 20 nt, Human
accagcugcgcuugcuuuuc

SEQ ID NO: 2359173 - RNA, 10 nt, Human
accagcuggg

SEQ ID NO: 2359174 - RNA, 11 nt, Human
accagcugggg

SEQ ID NO: 2359175 - RNA, 20 nt, Human
accagcuggggcguggggag

SEQ ID NO: 2359176 - RNA, 15 nt, Human
accaggacaggacca

SEQ ID NO: 2359177 - RNA, 14 nt, Human
accaggacaggacc

SEQ ID NO: 2359178 - RNA, 17 nt, Human
accaggacaggaccaga

SEQ ID NO: 2359179 - RNA, 19 nt, Human
accaggacuauagcccagg

SEQ ID NO: 2359180 - RNA, 20 nt, Human
accaggacuauagcccaggu

SEQ ID NO: 2359181 - RNA, 21 nt, Human
accaggacuauagcccagguc

SEQ ID NO: 2359182 - RNA, 20 nt, Human
accaggaauguuaaagucag

SEQ ID NO: 2359183 - RNA, 17 nt, Human
accaggaaccucuucag

SEQ ID NO: 2359184 - RNA, 16 nt, Human
accagcuucuccaggc

SEQ ID NO: 2359185 - RNA, 18 nt, Human
accagcuucuccaggcuc

SEQ ID NO: 2359186 - RNA, 20 nt, Human
accagcuucuccaggcucuu

SEQ ID NO: 2359187 - RNA, 23 nt, Human
accagcuguucugucccuuggag

SEQ ID NO: 2359188 - RNA, 15 nt, Human
accagcuucuccagg

SEQ ID NO: 2359189 - RNA, 20 nt, Human
accacuagaacucuccaucu

SEQ ID NO: 2359190 - RNA, 13 nt, Human
accacuagaacuc

SEQ ID NO: 2359191 - RNA, 17 nt, Human
accacuaggacucugag

SEQ ID NO: 2359192 - RNA, 17 nt, Human
accacuacauucuguua

SEQ ID NO: 2359193 - RNA, 15 nt, Human
accacuacauucugu

SEQ ID NO: 2359194 - RNA, 13 nt, Human
accaccagaagcc

SEQ ID NO: 2359195 - RNA, 23 nt, Human
accaccacuggccaccaggcugg

SEQ ID NO: 2359196 - RNA, 24 nt, Human
accaccacuggccaccaggcuggc

SEQ ID NO: 2359197 - RNA, 16 nt, Human
accacuacauucuguu

SEQ ID NO: 2359198 - RNA, 15 nt, Human
accacuaugaagcua

SEQ ID NO: 2359199 - RNA, 17 nt, Human
accagcgcccgcugggc

SEQ ID NO: 2359200 - RNA, 18 nt, Human
accagcgcccgcugggcu

SEQ ID NO: 2359201 - RNA, 19 nt, Human
accagcgcccgcugggcug

SEQ ID NO: 2359202 - RNA, 20 nt, Human
accagcgcccgcugggcuga

SEQ ID NO: 2359203 - RNA, 22 nt, Human
accagcgugugacuacuccccc

SEQ ID NO: 2359204 - RNA, 16 nt, Human
accagcucaggacaga

SEQ ID NO: 2359205 - RNA, 15 nt, Human
accagcucaggacag

SEQ ID NO: 2359206 - RNA, 14 nt, Human
accagcucaggaca

SEQ ID NO: 2359207 - RNA, 13 nt, Human
accagcucaggac

SEQ ID NO: 2359208 - RNA, 22 nt, Human
accagcuaagaaaagauuuuaa

SEQ ID NO: 2359209 - RNA, 23 nt, Human
accagcuaagaaaagauuuuaau

SEQ ID NO: 2359210 - RNA, 23 nt, Human
accagcgcccgcugggcugagcc

SEQ ID NO: 2359211 - RNA, 19 nt, Human
ucacuacccuauucucucu

SEQ ID NO: 2359212 - RNA, 23 nt, Human
ucacuaggcccccacuugccucu

SEQ ID NO: 2359213 - RNA, 16 nt, Human
ucacuaggcuucuggu

SEQ ID NO: 2359214 - RNA, 22 nt, Human
ucacuaccauuguaacuuggau

SEQ ID NO: 2359215 - RNA, 13 nt, Human
ucacuaaacuuua

SEQ ID NO: 2359216 - RNA, 19 nt, Human
ucacuaauacuaauucauu

SEQ ID NO: 2359217 - RNA, 19 nt, Human
ucacguaaagcuagaaaug

SEQ ID NO: 2359218 - RNA, 20 nt, Human
ucacguaaagcuagaaauga

SEQ ID NO: 2359219 - RNA, 13 nt, Human
ucacgucacacuu

SEQ ID NO: 2359220 - RNA, 17 nt, Human
ucaccugucaggccuga

SEQ ID NO: 2359221 - RNA, 17 nt, Human
ucacgugcagcucaagg

SEQ ID NO: 2359222 - RNA, 17 nt, Human
ucacgugugugacucag

SEQ ID NO: 2359223 - RNA, 16 nt, Human
ucacgugugugacuca

SEQ ID NO: 2359224 - RNA, 22 nt, Human
ucacguuucauguaauccucaa

SEQ ID NO: 2359225 - RNA, 12 nt, Human
ucacguguguga

SEQ ID NO: 2359226 - RNA, 21 nt, Human
ucacguggaggagcagugcag

SEQ ID NO: 2359227 - RNA, 16 nt, Human
ucacguggaggagcag

SEQ ID NO: 2359228 - RNA, 18 nt, Human
ucacguaaagcuagaaau

SEQ ID NO: 2359229 - RNA, 14 nt, Human
ucaccugugcuucg

SEQ ID NO: 2359230 - RNA, 17 nt, Human
ucaccuguacucuuccg

SEQ ID NO: 2359231 - RNA, 18 nt, Human
ucaccuguacucuuccga

SEQ ID NO: 2359232 - RNA, 19 nt, Human
ucaccuggggugugggagg

SEQ ID NO: 2359233 - RNA, 22 nt, Human
ucaccuggggcugcuggccuga

SEQ ID NO: 2359234 - RNA, 16 nt, Human
ucaccuggggcugcug

SEQ ID NO: 2359235 - RNA, 17 nt, Human
ucaccuggggcugcugg

SEQ ID NO: 2359236 - RNA, 18 nt, Human
ucaccuggggcugcuggc

SEQ ID NO: 2359237 - RNA, 20 nt, Human
ucaccuggggcugcuggccu

SEQ ID NO: 2359238 - RNA, 19 nt, Human
ucaccuguaaaccugaguc

SEQ ID NO: 2359239 - RNA, 15 nt, Human
ucaccuguacucuuc

SEQ ID NO: 2359240 - RNA, 16 nt, Human
ucaccuguacucuucc

SEQ ID NO: 2359241 - RNA, 17 nt, Human
ucaccuguaaaccugag

SEQ ID NO: 2359242 - RNA, 16 nt, Human
ucaccuguaaaccuga

SEQ ID NO: 2359243 - RNA, 20 nt, Human
ucaccugggcaccuggggag

SEQ ID NO: 2359244 - RNA, 23 nt, Human
ucaccucaugcccacccccugcc

SEQ ID NO: 2359245 - RNA, 16 nt, Human
accaggacucccuccu

SEQ ID NO: 2359246 - RNA, 15 nt, Human
accaggacucccucc

SEQ ID NO: 2359247 - RNA, 14 nt, Human
accaggacucccuc

SEQ ID NO: 2359248 - RNA, 14 nt, Human
ucaccucauggaau

SEQ ID NO: 2359249 - RNA, 12 nt, Human
ucaccucaugga

SEQ ID NO: 2359250 - RNA, 13 nt, Human
ucaccucauggaa

SEQ ID NO: 2359251 - RNA, 14 nt, Human
ucacaaaauuuuau

SEQ ID NO: 2359252 - RNA, 17 nt, Human
ucacaaaaccuggcaca

SEQ ID NO: 2359253 - RNA, 21 nt, Human
ucacaaaaccuggcacaaugg

SEQ ID NO: 2359254 - RNA, 22 nt, Human
ucacaaaauuuuauuccuauau

SEQ ID NO: 2359255 - RNA, 17 nt, Human
ucacaaacuuuuauacu

SEQ ID NO: 2359256 - RNA, 15 nt, Human
ucacaaacuuuuaua

SEQ ID NO: 2359257 - RNA, 17 nt, Human
ucacaaaggaugcccaa

SEQ ID NO: 2359258 - RNA, 15 nt, Human
ucacaaagcccaagg

SEQ ID NO: 2359259 - RNA, 12 nt, Human
ucacaaagccca

SEQ ID NO: 2359260 - RNA, 21 nt, Human
ucacaaacuuuuauacucuuu

SEQ ID NO: 2359261 - RNA, 13 nt, Human
ucaauuuccaaga

SEQ ID NO: 2359262 - RNA, 18 nt, Human
ucaauuuccaagagcuga

SEQ ID NO: 2359263 - RNA, 20 nt, Human
ucaauuuccaagagcugagg

SEQ ID NO: 2359264 - RNA, 18 nt, Human
ucaauuucccugacuccu

SEQ ID NO: 2359265 - RNA, 21 nt, Human
ucaauuucccugacuccucua

SEQ ID NO: 2359266 - RNA, 20 nt, Human
ucaauuuauucaagaaaagu

SEQ ID NO: 2359267 - RNA, 20 nt, Human
ucaauuuguaauugcuuaca

SEQ ID NO: 2359268 - RNA, 23 nt, Human
ucaauuucuguguugccaagcuc

SEQ ID NO: 2359269 - RNA, 15 nt, Human
ucaauuucuguguug

SEQ ID NO: 2359270 - RNA, 14 nt, Human
ucaauuucucccca

SEQ ID NO: 2359271 - RNA, 15 nt, Human
ucaauuucuccccag

SEQ ID NO: 2359272 - RNA, 14 nt, Human
accaaagccaccag

SEQ ID NO: 2359273 - RNA, 20 nt, Human
accaaagcaccuuagcuggc

SEQ ID NO: 2359274 - RNA, 16 nt, Human
accaaagcgaauuuua

SEQ ID NO: 2359275 - RNA, 21 nt, Human
accaaaguccuuuuuuuccau

SEQ ID NO: 2359276 - RNA, 20 nt, Human
accaaaggugaaggaauaua

SEQ ID NO: 2359277 - RNA, 21 nt, Human
accaaaggugaaggaauauau

SEQ ID NO: 2359278 - RNA, 15 nt, Human
accaaaguauuuuuu

SEQ ID NO: 2359279 - RNA, 18 nt, Human
accaaaguauuuuuuuau

SEQ ID NO: 2359280 - RNA, 13 nt, Human
accaaaggccagg

SEQ ID NO: 2359281 - RNA, 17 nt, Human
accaaaggugaaggaau

SEQ ID NO: 2359282 - RNA, 18 nt, Human
accaaaggugaaggaaua

SEQ ID NO: 2359283 - RNA, 19 nt, Human
accaaaggugaaggaauau

SEQ ID NO: 2359284 - RNA, 16 nt, Human
ucaauucuugccaaau

SEQ ID NO: 2359285 - RNA, 18 nt, Human
ucaauuguaaauugaauc

SEQ ID NO: 2359286 - RNA, 14 nt, Human
ucaauuguaaauug

SEQ ID NO: 2359287 - RNA, 15 nt, Human
ucaauugaaugguca

SEQ ID NO: 2359288 - RNA, 13 nt, Human
ucaauuguaaauu

SEQ ID NO: 2359289 - RNA, 22 nt, Human
ucaauugcaucucccagauaau

SEQ ID NO: 2359290 - RNA, 18 nt, Human
ucaauugcaucucccaga

SEQ ID NO: 2359291 - RNA, 17 nt, Human
ucaauugcaucucccag

SEQ ID NO: 2359292 - RNA, 16 nt, Human
ucaauugcaucuccca

SEQ ID NO: 2359293 - RNA, 16 nt, Human
ucacaaccugaaccua

SEQ ID NO: 2359294 - RNA, 19 nt, Human
ucacaaccugaaccuagga

SEQ ID NO: 2359295 - RNA, 14 nt, Human
ucacaaccuucugu

SEQ ID NO: 2359296 - RNA, 14 nt, Human
ucacaaccugaacc

SEQ ID NO: 2359297 - RNA, 16 nt, Human
ucacaaagcccaaggg

SEQ ID NO: 2359298 - RNA, 21 nt, Human
ucacacugcaagagccuuggu

SEQ ID NO: 2359299 - RNA, 18 nt, Human
ucacacugcaagagccuu

SEQ ID NO: 2359300 - RNA, 14 nt, Human
ucacaagaagacca

SEQ ID NO: 2359301 - RNA, 20 nt, Human
ucacaacgugcauugugcuu

SEQ ID NO: 2359302 - RNA, 21 nt, Human
ucacaacgugcauugugcuuc

SEQ ID NO: 2359303 - RNA, 16 nt, Human
ucacaacgugcauugu

SEQ ID NO: 2359304 - RNA, 17 nt, Human
ucacaacgugcauugug

SEQ ID NO: 2359305 - RNA, 18 nt, Human
ucacaacgugcauugugc

SEQ ID NO: 2359306 - RNA, 19 nt, Human
ucacaacgugcauugugcu

SEQ ID NO: 2359307 - RNA, 20 nt, Human
ucacacugcaagagccuugg

SEQ ID NO: 2359308 - RNA, 11 nt, Human
ucacacuggga

SEQ ID NO: 2359309 - RNA, 16 nt, Human
ucacacuucugugaga

SEQ ID NO: 2359310 - RNA, 19 nt, Human
ucacacuuccaccagccug

SEQ ID NO: 2359311 - RNA, 18 nt, Human
ucacacuuccaccagccu

SEQ ID NO: 2359312 - RNA, 20 nt, Human
ucacagaugggugcuuggag

SEQ ID NO: 2359313 - RNA, 13 nt, Human
ucacagccucuga

SEQ ID NO: 2359314 - RNA, 11 nt, Human
ucacagccucu

SEQ ID NO: 2359315 - RNA, 12 nt, Human
ucacagccucug

SEQ ID NO: 2359316 - RNA, 16 nt, Human
ucacagccucugaccc

SEQ ID NO: 2359317 - RNA, 17 nt, Human
ucacagccucugacccc

SEQ ID NO: 2359318 - RNA, 18 nt, Human
ucacagccucugaccccu

SEQ ID NO: 2359319 - RNA, 19 nt, Human
ucacagccucugaccccuc

SEQ ID NO: 2359320 - RNA, 20 nt, Human
ucacagccucugaccccucc

SEQ ID NO: 2359321 - RNA, 21 nt, Human
ucacagccucugaccccuccu

SEQ ID NO: 2359322 - RNA, 16 nt, Human
ucacaguucucuccuu

SEQ ID NO: 2359323 - RNA, 20 nt, Human
ucacaguucucuccuucuuc

SEQ ID NO: 2359324 - RNA, 17 nt, Human
ucacagcacagagaaga

SEQ ID NO: 2359325 - RNA, 16 nt, Human
ucacagaaaugagauc

SEQ ID NO: 2359326 - RNA, 20 nt, Human
ucacacuuccaccagccugc

SEQ ID NO: 2359327 - RNA, 12 nt, Human
ucacagaaauga

SEQ ID NO: 2359328 - RNA, 18 nt, Human
ucacagcacagagaagac

SEQ ID NO: 2359329 - RNA, 15 nt, Human
ucacagcagcuucua

SEQ ID NO: 2359330 - RNA, 14 nt, Human
ucacagccuccucu

SEQ ID NO: 2359331 - RNA, 15 nt, Human
ucacagccuccucug

SEQ ID NO: 2359332 - RNA, 17 nt, Human
ucacagccuccucuguc

SEQ ID NO: 2359333 - RNA, 19 nt, Human
ucacagccuccucugucug

SEQ ID NO: 2359334 - RNA, 20 nt, Human
ucacagccuccucugucugc

SEQ ID NO: 2359335 - RNA, 22 nt, Human
ucacagccuccucugucugccc

SEQ ID NO: 2359336 - RNA, 23 nt, Human
ucacagaugugugauucacagug

SEQ ID NO: 2359337 - RNA, 23 nt, Human
ucacagcaagucacuggccagug

SEQ ID NO: 2359338 - RNA, 23 nt, Human
ucacacuucugugagacccccac

SEQ ID NO: 2359339 - RNA, 22 nt, Human
ucacacuucugugagaccccca

SEQ ID NO: 2359340 - RNA, 21 nt, Human
ucacagaugugugauucacag

SEQ ID NO: 2359341 - RNA, 21 nt, Human
ucaccauguuggccaggcugg

SEQ ID NO: 2359342 - RNA, 22 nt, Human
ucaccauguuggccaggcuggu

SEQ ID NO: 2359343 - RNA, 23 nt, Human
ucaccauuuggcaaugccaucau

SEQ ID NO: 2359344 - RNA, 19 nt, Human
ucacccaagcaaggccaaa

SEQ ID NO: 2359345 - RNA, 19 nt, Human
ucacccaagagauuguugu

SEQ ID NO: 2359346 - RNA, 22 nt, Human
ucaccauuugauuauguagcaa

SEQ ID NO: 2359347 - RNA, 17 nt, Human
ucaccauuugauuaugu

SEQ ID NO: 2359348 - RNA, 13 nt, Human
ucacccccaaggg

SEQ ID NO: 2359349 - RNA, 13 nt, Human
ucacccccagcuu

SEQ ID NO: 2359350 - RNA, 19 nt, Human
ucacccccaaggggcaguc

SEQ ID NO: 2359351 - RNA, 18 nt, Human
ucaccccccacacucacu

SEQ ID NO: 2359352 - RNA, 18 nt, Human
ucacccccagcuuugcua

SEQ ID NO: 2359353 - RNA, 13 nt, Human
ucacccccucggg

SEQ ID NO: 2359354 - RNA, 18 nt, Human
ucaccccccacucaccag

SEQ ID NO: 2359355 - RNA, 14 nt, Human
ucacccccucgggu

SEQ ID NO: 2359356 - RNA, 19 nt, Human
ucacccccucgggucuccu

SEQ ID NO: 2359357 - RNA, 13 nt, Human
ucaccccccacuc

SEQ ID NO: 2359358 - RNA, 14 nt, Human
ucaccccccacuca

SEQ ID NO: 2359359 - RNA, 19 nt, Human
ucaccccaucccacacccu

SEQ ID NO: 2359360 - RNA, 17 nt, Human
ucacccagacagcuccc

SEQ ID NO: 2359361 - RNA, 16 nt, Human
ucacccagacagcucc

SEQ ID NO: 2359362 - RNA, 14 nt, Human
ucacccacagggcu

SEQ ID NO: 2359363 - RNA, 12 nt, Human
ucacccacaggg

SEQ ID NO: 2359364 - RNA, 11 nt, Human
ucacccacagg

SEQ ID NO: 2359365 - RNA, 22 nt, Human
ucacccacagggcuaagagcua

SEQ ID NO: 2359366 - RNA, 15 nt, Human
ucacccacagggcua

SEQ ID NO: 2359367 - RNA, 15 nt, Human
ucaccauguuggcca

SEQ ID NO: 2359368 - RNA, 23 nt, Human
ucaccaucucaggccaccugccc

SEQ ID NO: 2359369 - RNA, 21 nt, Human
ucaccaucucaggccaccugc

SEQ ID NO: 2359370 - RNA, 14 nt, Human
ucaccaucugugca

SEQ ID NO: 2359371 - RNA, 15 nt, Human
ucaccaucuuggcca

SEQ ID NO: 2359372 - RNA, 17 nt, Human
ucaccaucucaggccac

SEQ ID NO: 2359373 - RNA, 15 nt, Human
ucacauagauguccc

SEQ ID NO: 2359374 - RNA, 16 nt, Human
ucacauacccuccccc

SEQ ID NO: 2359375 - RNA, 18 nt, Human
ucacauagagaucauccu

SEQ ID NO: 2359376 - RNA, 18 nt, Human
ucacauacaauuauuuuu

SEQ ID NO: 2359377 - RNA, 14 nt, Human
ucacauacccuccc

SEQ ID NO: 2359378 - RNA, 15 nt, Human
ucacauacccucccc

SEQ ID NO: 2359379 - RNA, 17 nt, Human
ucacauagaugucccuu

SEQ ID NO: 2359380 - RNA, 16 nt, Human
ucacauagaugucccu

SEQ ID NO: 2359381 - RNA, 17 nt, Human
ucacauaagcucagaau

SEQ ID NO: 2359382 - RNA, 19 nt, Human
ucacauaagcucagaaucc

SEQ ID NO: 2359383 - RNA, 20 nt, Human
ucacauaagcucagaaucca

SEQ ID NO: 2359384 - RNA, 18 nt, Human
ucacauaaaauagauuuu

SEQ ID NO: 2359385 - RNA, 17 nt, Human
ucacauaaaaccucauu

SEQ ID NO: 2359386 - RNA, 23 nt, Human
ucacaguuuugguugcuuuaaua

SEQ ID NO: 2359387 - RNA, 21 nt, Human
ucacaguuuugguugcuuuaa

SEQ ID NO: 2359388 - RNA, 22 nt, Human
ucacaguuggcuggaugaaauu

SEQ ID NO: 2359389 - RNA, 23 nt, Human
ucacagaaaugagaucaggcucu

SEQ ID NO: 2359390 - RNA, 22 nt, Human
ucacagccucugaccccuccuc

SEQ ID NO: 2359391 - RNA, 13 nt, Human
ucacagcggaggu

SEQ ID NO: 2359392 - RNA, 20 nt, Human
ucacaguucuuugggccaga

SEQ ID NO: 2359393 - RNA, 19 nt, Human
ucacaguucuuugggccag

SEQ ID NO: 2359394 - RNA, 22 nt, Human
ucacaguucuuugggccagaca

SEQ ID NO: 2359395 - RNA, 13 nt, Human
ucacaguugacaa

SEQ ID NO: 2359396 - RNA, 17 nt, Human
ucacaguuggccuucag

SEQ ID NO: 2359397 - RNA, 20 nt, Human
ucacaguuuugguugcuuua

SEQ ID NO: 2359398 - RNA, 15 nt, Human
accaccacacccagc

SEQ ID NO: 2359399 - RNA, 20 nt, Human
accaccacacccagcccacu

SEQ ID NO: 2359400 - RNA, 14 nt, Human
accaccacuggcca

SEQ ID NO: 2359401 - RNA, 15 nt, Human
accaccacuggccac

SEQ ID NO: 2359402 - RNA, 16 nt, Human
accaccacuggccacc

SEQ ID NO: 2359403 - RNA, 20 nt, Human
accaccacuggccaccaggc

SEQ ID NO: 2359404 - RNA, 21 nt, Human
accaccacuggccaccaggcu

SEQ ID NO: 2359405 - RNA, 22 nt, Human
accaccacuggccaccaggcug

SEQ ID NO: 2359406 - RNA, 16 nt, Human
accaccaagccaaggg

SEQ ID NO: 2359407 - RNA, 18 nt, Human
accacaugugcacaugca

SEQ ID NO: 2359408 - RNA, 22 nt, Human
accacagguucaugccaccaug

SEQ ID NO: 2359409 - RNA, 22 nt, Human
accacaugccaagcacugugcu

SEQ ID NO: 2359410 - RNA, 19 nt, Human
accacauuuuauauuuauu

SEQ ID NO: 2359411 - RNA, 18 nt, Human
accacaugcggagaacaa

SEQ ID NO: 2359412 - RNA, 24 nt, Human
accacauuggagauguuuaguaau

SEQ ID NO: 2359413 - RNA, 17 nt, Human
accacaucuugcucugc

SEQ ID NO: 2359414 - RNA, 17 nt, Human
accacaggguucaaaau

SEQ ID NO: 2359415 - RNA, 23 nt, Human
accacaggguucaaaaugucugu

SEQ ID NO: 2359416 - RNA, 22 nt, Human
accacaggguucaaaaugucug

SEQ ID NO: 2359417 - RNA, 18 nt, Human
accacaucuugcucugcu

SEQ ID NO: 2359418 - RNA, 19 nt, Human
accacaucuugcucugcug

SEQ ID NO: 2359419 - RNA, 13 nt, Human
accacagcccugu

SEQ ID NO: 2359420 - RNA, 20 nt, Human
accacagccagcaccuggca

SEQ ID NO: 2359421 - RNA, 18 nt, Human
ucacccccuucuccaucc

SEQ ID NO: 2359422 - RNA, 19 nt, Human
accacagccagcaccuggc

SEQ ID NO: 2359423 - RNA, 22 nt, Human
ucacccccuucuccauccacau

SEQ ID NO: 2359424 - RNA, 16 nt, Human
ucacccccuucuccau

SEQ ID NO: 2359425 - RNA, 13 nt, Human
ucacccccuucuc

SEQ ID NO: 2359426 - RNA, 17 nt, Human
accacagcccugucagu

SEQ ID NO: 2359427 - RNA, 16 nt, Human
accacagcccugucag

SEQ ID NO: 2359428 - RNA, 15 nt, Human
accacagcccuguca

SEQ ID NO: 2359429 - RNA, 14 nt, Human
accacagcccuguc

SEQ ID NO: 2359430 - RNA, 12 nt, Human
accacagcugcu

SEQ ID NO: 2359431 - RNA, 13 nt, Human
accacagcugcug

SEQ ID NO: 2359432 - RNA, 14 nt, Human
accacagcugcugg

SEQ ID NO: 2359433 - RNA, 15 nt, Human
accacagcugcugga

SEQ ID NO: 2359434 - RNA, 16 nt, Human
accacagcugcuggag

SEQ ID NO: 2359435 - RNA, 21 nt, Human
accacaggcccuuuccucagg

SEQ ID NO: 2359436 - RNA, 22 nt, Human
accacaggcccuuuccucaggc

SEQ ID NO: 2359437 - RNA, 13 nt, Human
aauauuuugucua

SEQ ID NO: 2359438 - RNA, 14 nt, Human
aauauuuugucuaa

SEQ ID NO: 2359439 - RNA, 15 nt, Human
aauauuuugucuaaa

SEQ ID NO: 2359440 - RNA, 20 nt, Human
aauauuuugcuaguuuuuga

SEQ ID NO: 2359441 - RNA, 12 nt, Human
aauauuugcuga

SEQ ID NO: 2359442 - RNA, 20 nt, Human
aauauuugaaucuugucuca

SEQ ID NO: 2359443 - RNA, 14 nt, Human
aauauuuguacaua

SEQ ID NO: 2359444 - RNA, 12 nt, Human
aauauuuguaca

SEQ ID NO: 2359445 - RNA, 14 nt, Human
aauauuuuuagaua

SEQ ID NO: 2359446 - RNA, 17 nt, Human
aauauuuuuaauauaua

SEQ ID NO: 2359447 - RNA, 16 nt, Human
aauauuuugucuaaaa

SEQ ID NO: 2359448 - RNA, 19 nt, Human
aauauuuugucuaaaaugc

SEQ ID NO: 2359449 - RNA, 20 nt, Human
aauauuuugucuaaaaugcc

SEQ ID NO: 2359450 - RNA, 21 nt, Human
aauauuuugucuaaaaugccu

SEQ ID NO: 2359451 - RNA, 13 nt, Human
aauauuuuucuua

SEQ ID NO: 2359452 - RNA, 23 nt, Human
aauauuuuugaaaggcauguucc

SEQ ID NO: 2359453 - RNA, 17 nt, Human
aauauuuuuuauauaua

SEQ ID NO: 2359454 - RNA, 22 nt, Human
aauauuuuuauagauuugaccu

SEQ ID NO: 2359455 - RNA, 16 nt, Human
aaucaggguuaguauu

SEQ ID NO: 2359456 - RNA, 21 nt, Human
aaucaggguuaguauugucca

SEQ ID NO: 2359457 - RNA, 21 nt, Human
uaagauggauucucagauauu

SEQ ID NO: 2359458 - RNA, 14 nt, Human
uaagauuccagaga

SEQ ID NO: 2359459 - RNA, 21 nt, Human
uaagauuccagagaguggcuc

SEQ ID NO: 2359460 - RNA, 22 nt, Human
uaagauggauucucagauauuu

SEQ ID NO: 2359461 - RNA, 18 nt, Human
uaagaugggcagcuaguu

SEQ ID NO: 2359462 - RNA, 20 nt, Human
uaagauggauucucagauau

SEQ ID NO: 2359463 - RNA, 18 nt, Human
uaagauggauucucagau

SEQ ID NO: 2359464 - RNA, 17 nt, Human
uaagauggauucucaga

SEQ ID NO: 2359465 - RNA, 15 nt, Human
uaagauggauucuca

SEQ ID NO: 2359466 - RNA, 23 nt, Human
uaagaugcuaccuugugacccag

SEQ ID NO: 2359467 - RNA, 24 nt, Human
uaagaugcucuaucuugcucugua

SEQ ID NO: 2359468 - RNA, 11 nt, Human
uaagaugcugg

SEQ ID NO: 2359469 - RNA, 12 nt, Human
uaagaugcuggg

SEQ ID NO: 2359470 - RNA, 13 nt, Human
uaagaugcugggu

SEQ ID NO: 2359471 - RNA, 17 nt, Human
uaagauggaagcuucca

SEQ ID NO: 2359472 - RNA, 18 nt, Human
uaagauggaagcuuccag

SEQ ID NO: 2359473 - RNA, 19 nt, Human
uaagauggaagcuuccagu

SEQ ID NO: 2359474 - RNA, 17 nt, Human
uaagaugcuaccuugug

SEQ ID NO: 2359475 - RNA, 16 nt, Human
uaagaugacauugcua

SEQ ID NO: 2359476 - RNA, 17 nt, Human
uaagaugacauugcuaa

SEQ ID NO: 2359477 - RNA, 18 nt, Human
aauauuuuuucuuuucua

SEQ ID NO: 2359478 - RNA, 19 nt, Human
aauauuuuuuauauauaca

SEQ ID NO: 2359479 - RNA, 21 nt, Human
aauauuuuuuauauauacagu

SEQ ID NO: 2359480 - RNA, 22 nt, Human
aaucaggguuaguauuguccag

SEQ ID NO: 2359481 - RNA, 15 nt, Human
uaagauuuuucucaa

SEQ ID NO: 2359482 - RNA, 19 nt, Human
uaagauuuagagaugaauu

SEQ ID NO: 2359483 - RNA, 23 nt, Human
uaagcaaagggagcacuggguug

SEQ ID NO: 2359484 - RNA, 16 nt, Human
uaagauuuuucucaaa

SEQ ID NO: 2359485 - RNA, 18 nt, Human
uaagauuuuucucaaagu

SEQ ID NO: 2359486 - RNA, 20 nt, Human
uaagauuuuucucaaaguuu

SEQ ID NO: 2359487 - RNA, 21 nt, Human
uaagauuuuucucaaaguuuu

SEQ ID NO: 2359488 - RNA, 23 nt, Human
uaagcaacaucuagcaaauguua

SEQ ID NO: 2359489 - RNA, 18 nt, Human
uaagcacacuugacauca

SEQ ID NO: 2359490 - RNA, 13 nt, Human
uaagcuguaaaaa

SEQ ID NO: 2359491 - RNA, 12 nt, Human
uaagcuguaaaa

SEQ ID NO: 2359492 - RNA, 17 nt, Human
uaagcagaggaggggcc

SEQ ID NO: 2359493 - RNA, 16 nt, Human
uaagcugcucuauugu

SEQ ID NO: 2359494 - RNA, 13 nt, Human
uaagcagaggagg

SEQ ID NO: 2359495 - RNA, 16 nt, Human
uaagcagaggaggggc

SEQ ID NO: 2359496 - RNA, 15 nt, Human
uaagcagaggagggg

SEQ ID NO: 2359497 - RNA, 22 nt, Human
uaagcagauggaaugcuguguu

SEQ ID NO: 2359498 - RNA, 14 nt, Human
uaagcugaaaauau

SEQ ID NO: 2359499 - RNA, 11 nt, Human
uaagcuguuuc

SEQ ID NO: 2359500 - RNA, 16 nt, Human
uaagcuguuuccauag

SEQ ID NO: 2359501 - RNA, 15 nt, Human
uaagcuguaaaaaga

SEQ ID NO: 2359502 - RNA, 13 nt, Human
uaagcuguuuauu

SEQ ID NO: 2359503 - RNA, 21 nt, Human
uaagcuguuuauuuuauauua

SEQ ID NO: 2359504 - RNA, 22 nt, Human
uaagcuguuacugucuucagua

SEQ ID NO: 2359505 - RNA, 18 nt, Human
uaagcaagagagauguuu

SEQ ID NO: 2359506 - RNA, 13 nt, Human
uaagcaagagaga

SEQ ID NO: 2359507 - RNA, 13 nt, Human
uaagcacuacaua

SEQ ID NO: 2359508 - RNA, 16 nt, Human
uaagcacuacauaaac

SEQ ID NO: 2359509 - RNA, 17 nt, Human
uaagcacuacauaaacu

SEQ ID NO: 2359510 - RNA, 22 nt, Human
uaagcacuacauaaacugacuu

SEQ ID NO: 2359511 - RNA, 13 nt, Human
uaagcacugugcu

SEQ ID NO: 2359512 - RNA, 14 nt, Human
uaagcacugugcua

SEQ ID NO: 2359513 - RNA, 17 nt, Human
uaagcacugugcuaaua

SEQ ID NO: 2359514 - RNA, 16 nt, Human
uaagcacugugcuaau

SEQ ID NO: 2359515 - RNA, 20 nt, Human
uaagcagaccacugauaaaa

SEQ ID NO: 2359516 - RNA, 17 nt, Human
uaagcagaccacugaua

SEQ ID NO: 2359517 - RNA, 19 nt, Human
aauauuuaaacagcagugu

SEQ ID NO: 2359518 - RNA, 13 nt, Human
aauauuuaaacau

SEQ ID NO: 2359519 - RNA, 12 nt, Human
aauauuuaagac

SEQ ID NO: 2359520 - RNA, 22 nt, Human
aauauuuaaacaugguuacaau

SEQ ID NO: 2359521 - RNA, 23 nt, Human
aauauugugaagaaaaauaaagu

SEQ ID NO: 2359522 - RNA, 17 nt, Human
aauauuguguugugaau

SEQ ID NO: 2359523 - RNA, 16 nt, Human
aauauugucauuccug

SEQ ID NO: 2359524 - RNA, 13 nt, Human
aauauuguccauu

SEQ ID NO: 2359525 - RNA, 23 nt, Human
aauauuguacaguuuuuauugcu

SEQ ID NO: 2359526 - RNA, 15 nt, Human
aauauuguacaguuu

SEQ ID NO: 2359527 - RNA, 17 nt, Human
aauauuguacaguuuuu

SEQ ID NO: 2359528 - RNA, 14 nt, Human
aauauugacuuugu

SEQ ID NO: 2359529 - RNA, 17 nt, Human
aauauugacuuguauau

SEQ ID NO: 2359530 - RNA, 14 nt, Human
aauauugacuugua

SEQ ID NO: 2359531 - RNA, 15 nt, Human
aauauugaacuuuuu

SEQ ID NO: 2359532 - RNA, 15 nt, Human
aauauugacuuuguc

SEQ ID NO: 2359533 - RNA, 16 nt, Human
aauauugacuuugucu

SEQ ID NO: 2359534 - RNA, 19 nt, Human
aauauugagaaagaaacua

SEQ ID NO: 2359535 - RNA, 16 nt, Human
aauauugagaaagaaa

SEQ ID NO: 2359536 - RNA, 14 nt, Human
aauauuguacaguu

SEQ ID NO: 2359537 - RNA, 20 nt, Human
aauauugagaaagaaacuaa

SEQ ID NO: 2359538 - RNA, 15 nt, Human
aauauuuacauauga

SEQ ID NO: 2359539 - RNA, 14 nt, Human
aauauuuagcaaau

SEQ ID NO: 2359540 - RNA, 17 nt, Human
aauauuuauaaaacuuc

SEQ ID NO: 2359541 - RNA, 16 nt, Human
aauauuuauaaaacuu

SEQ ID NO: 2359542 - RNA, 13 nt, Human
aauauuuauaaaa

SEQ ID NO: 2359543 - RNA, 20 nt, Human
aauauuuagcaaauaauuuc

SEQ ID NO: 2359544 - RNA, 18 nt, Human
aauauuuauuuuaauaau

SEQ ID NO: 2359545 - RNA, 17 nt, Human
aauauuuaagauaguuu

SEQ ID NO: 2359546 - RNA, 15 nt, Human
aauauuuaaacaugg

SEQ ID NO: 2359547 - RNA, 12 nt, Human
aauauuuagugu

SEQ ID NO: 2359548 - RNA, 14 nt, Human
aauauuugaaugua

SEQ ID NO: 2359549 - RNA, 16 nt, Human
aauauuugaaucuugu

SEQ ID NO: 2359550 - RNA, 16 nt, Human
aauauuucaagacauu

SEQ ID NO: 2359551 - RNA, 14 nt, Human
aauauuucaagaca

SEQ ID NO: 2359552 - RNA, 15 nt, Human
aauauuucaagacau

SEQ ID NO: 2359553 - RNA, 23 nt, Human
aauauuugaauguaugcuucaua

SEQ ID NO: 2359554 - RNA, 21 nt, Human
aauauuugaauguaugcuuca

SEQ ID NO: 2359555 - RNA, 19 nt, Human
aauauuuauaaaacuucuc

SEQ ID NO: 2359556 - RNA, 14 nt, Human
aauauuucagauaa

SEQ ID NO: 2359557 - RNA, 19 nt, Human
aauauuuauuuuaauaaug

SEQ ID NO: 2359558 - RNA, 23 nt, Human
aauauucuauuuucauuuucugc

SEQ ID NO: 2359559 - RNA, 15 nt, Human
aauauuccugaauga

SEQ ID NO: 2359560 - RNA, 16 nt, Human
aauauucuauaugaau

SEQ ID NO: 2359561 - RNA, 20 nt, Human
aauauucuauaugaauuuaa

SEQ ID NO: 2359562 - RNA, 15 nt, Human
aauauuccugcauuu

SEQ ID NO: 2359563 - RNA, 12 nt, Human
aauauuccagag

SEQ ID NO: 2359564 - RNA, 18 nt, Human
aauauucauaguuuaauu

SEQ ID NO: 2359565 - RNA, 12 nt, Human
aauauuccugaa

SEQ ID NO: 2359566 - RNA, 20 nt, Human
aauauuccccuaucucuaga

SEQ ID NO: 2359567 - RNA, 17 nt, Human
aauauucccuagaaacu

SEQ ID NO: 2359568 - RNA, 13 nt, Human
aauauucccaagc

SEQ ID NO: 2359569 - RNA, 15 nt, Human
aauauucccuagaaa

SEQ ID NO: 2359570 - RNA, 20 nt, Human
aauaugcaucuaauaaaaaa

SEQ ID NO: 2359571 - RNA, 16 nt, Human
aauaugccucuccuuu

SEQ ID NO: 2359572 - RNA, 19 nt, Human
aauaugccucuccuuugua

SEQ ID NO: 2359573 - RNA, 22 nt, Human
aauaugcagugauauggcagaa

SEQ ID NO: 2359574 - RNA, 15 nt, Human
aauaugcaguucugc

SEQ ID NO: 2359575 - RNA, 17 nt, Human
aauaugccuuuuugaag

SEQ ID NO: 2359576 - RNA, 21 nt, Human
aauaugccucuccuuuguaua

SEQ ID NO: 2359577 - RNA, 23 nt, Human
aauaugccucuccuuuguauauu

SEQ ID NO: 2359578 - RNA, 21 nt, Human
aauaugccccauucaacaucu

SEQ ID NO: 2359579 - RNA, 24 nt, Human
aauaugccccauucaacaucuagu

SEQ ID NO: 2359580 - RNA, 19 nt, Human
uaagagaauauuuuaagua

SEQ ID NO: 2359581 - RNA, 13 nt, Human
uaagagacaguca

SEQ ID NO: 2359582 - RNA, 22 nt, Human
aauaugcacacauuuuuuaaau

SEQ ID NO: 2359583 - RNA, 17 nt, Human
aauaugcacacauuuuu

SEQ ID NO: 2359584 - RNA, 16 nt, Human
aauaugcacacauuuu

SEQ ID NO: 2359585 - RNA, 20 nt, Human
uaagacuuugggauaggaaa

SEQ ID NO: 2359586 - RNA, 19 nt, Human
uaagacaugauuuccuuga

SEQ ID NO: 2359587 - RNA, 17 nt, Human
uaagacaugauuuccuu

SEQ ID NO: 2359588 - RNA, 22 nt, Human
uaagacauaacguuuuuccuuu

SEQ ID NO: 2359589 - RNA, 15 nt, Human
uaagagaaaugagcu

SEQ ID NO: 2359590 - RNA, 15 nt, Human
uaagacuuugggaua

SEQ ID NO: 2359591 - RNA, 13 nt, Human
uaagagaaagaaa

SEQ ID NO: 2359592 - RNA, 18 nt, Human
uaagagaaagaaaaugaa

SEQ ID NO: 2359593 - RNA, 19 nt, Human
aauauauuuguguauuuaa

SEQ ID NO: 2359594 - RNA, 21 nt, Human
aauauauuuguguauuuaaca

SEQ ID NO: 2359595 - RNA, 18 nt, Human
aauauauuuuaagacgaa

SEQ ID NO: 2359596 - RNA, 20 nt, Human
aauaucacuugucaauaaaa

SEQ ID NO: 2359597 - RNA, 13 nt, Human
aauaucagacuuu

SEQ ID NO: 2359598 - RNA, 20 nt, Human
aauaucagcaagucucuuua

SEQ ID NO: 2359599 - RNA, 24 nt, Human
aauauauuuguguauuuaacaggg

SEQ ID NO: 2359600 - RNA, 15 nt, Human
aauaucagacuagug

SEQ ID NO: 2359601 - RNA, 22 nt, Human
aauaucacuugucaauaaaauc

SEQ ID NO: 2359602 - RNA, 21 nt, Human
uaacaguuuuccaugaaaacg

SEQ ID NO: 2359603 - RNA, 19 nt, Human
uaacaguuuuccaugaaaa

SEQ ID NO: 2359604 - RNA, 17 nt, Human
uaacaguuuuccaugaa

SEQ ID NO: 2359605 - RNA, 16 nt, Human
uaacaguuuuccauga

SEQ ID NO: 2359606 - RNA, 15 nt, Human
uaacaguuuuccaug

SEQ ID NO: 2359607 - RNA, 14 nt, Human
uaacaguuuuccau

SEQ ID NO: 2359608 - RNA, 13 nt, Human
uaacaguuuucca

SEQ ID NO: 2359609 - RNA, 14 nt, Human
uaacaguucauguu

SEQ ID NO: 2359610 - RNA, 18 nt, Human
uaacaguucauguuugcu

SEQ ID NO: 2359611 - RNA, 22 nt, Human
aauaucaguuacucagcccugg

SEQ ID NO: 2359612 - RNA, 19 nt, Human
aauaucaguuacucagccc

SEQ ID NO: 2359613 - RNA, 19 nt, Human
aauaucaguagaaacucua

SEQ ID NO: 2359614 - RNA, 21 nt, Human
aauaucaguuacucagcccug

SEQ ID NO: 2359615 - RNA, 16 nt, Human
aauaucaucaguauug

SEQ ID NO: 2359616 - RNA, 21 nt, Human
uaacagugcauauuccuuucu

SEQ ID NO: 2359617 - RNA, 18 nt, Human
uaacauggacaugaucuu

SEQ ID NO: 2359618 - RNA, 17 nt, Human
uaacauguaauuaagua

SEQ ID NO: 2359619 - RNA, 23 nt, Human
uaacauggacaugaucuucuuua

SEQ ID NO: 2359620 - RNA, 23 nt, Human
uaacauccuuucuauugaaaaau

SEQ ID NO: 2359621 - RNA, 14 nt, Human
uaacauauuuacua

SEQ ID NO: 2359622 - RNA, 22 nt, Human
uaacauauuuacuaagccacaa

SEQ ID NO: 2359623 - RNA, 23 nt, Human
uaacauauuuacuaagccacaag

SEQ ID NO: 2359624 - RNA, 13 nt, Human
uaacaucugagaa

SEQ ID NO: 2359625 - RNA, 14 nt, Human
uaacaucuaaaaau

SEQ ID NO: 2359626 - RNA, 20 nt, Human
uaacaucuaaaaauagacuu

SEQ ID NO: 2359627 - RNA, 13 nt, Human
uaacauauuuacu

SEQ ID NO: 2359628 - RNA, 14 nt, Human
uaacauauaauguu

SEQ ID NO: 2359629 - RNA, 23 nt, Human
uaacauauaauguuguuauuuaa

SEQ ID NO: 2359630 - RNA, 20 nt, Human
uaacaguuuuccaugaaaac

SEQ ID NO: 2359631 - RNA, 16 nt, Human
aauaguugagccagca

SEQ ID NO: 2359632 - RNA, 18 nt, Human
aauaguugagccagcaga

SEQ ID NO: 2359633 - RNA, 19 nt, Human
aauaguugagccagcagac

SEQ ID NO: 2359634 - RNA, 20 nt, Human
aauaguugagccagcagaca

SEQ ID NO: 2359635 - RNA, 21 nt, Human
aauaguugagccagcagacau

SEQ ID NO: 2359636 - RNA, 13 nt, Human
aauaguuggcuag

SEQ ID NO: 2359637 - RNA, 13 nt, Human
aauaguguguucu

SEQ ID NO: 2359638 - RNA, 22 nt, Human
aauaguguggaaauuaagaaga

SEQ ID NO: 2359639 - RNA, 20 nt, Human
aauaguguggaaauuaagaa

SEQ ID NO: 2359640 - RNA, 19 nt, Human
aauaguguggaaauuaaga

SEQ ID NO: 2359641 - RNA, 17 nt, Human
aauaguguguucugauu

SEQ ID NO: 2359642 - RNA, 15 nt, Human
aauaguguguucuga

SEQ ID NO: 2359643 - RNA, 14 nt, Human
aauaguguguucug

SEQ ID NO: 2359644 - RNA, 13 nt, Human
aauauauuugugu

SEQ ID NO: 2359645 - RNA, 14 nt, Human
aauauauuugugua

SEQ ID NO: 2359646 - RNA, 19 nt, Human
aauaguuuacauguaguag

SEQ ID NO: 2359647 - RNA, 15 nt, Human
aauauauuucagaua

SEQ ID NO: 2359648 - RNA, 14 nt, Human
aauaguuguugauu

SEQ ID NO: 2359649 - RNA, 22 nt, Human
aauaguugagccagcagacauu

SEQ ID NO: 2359650 - RNA, 23 nt, Human
aauaguugagccagcagacauug

SEQ ID NO: 2359651 - RNA, 14 nt, Human
aauaguugagcccc

SEQ ID NO: 2359652 - RNA, 14 nt, Human
aauauauuuuaaga

SEQ ID NO: 2359653 - RNA, 15 nt, Human
aauauauuuuaagac

SEQ ID NO: 2359654 - RNA, 23 nt, Human
uaaaauuuauugcuugauacuuu

SEQ ID NO: 2359655 - RNA, 17 nt, Human
uaaaauuuaaguaucuu

SEQ ID NO: 2359656 - RNA, 13 nt, Human
uaaaauuucaaca

SEQ ID NO: 2359657 - RNA, 16 nt, Human
uaaaauuugcccuccc

SEQ ID NO: 2359658 - RNA, 21 nt, Human
uaaaauuugcccucccauccc

SEQ ID NO: 2359659 - RNA, 16 nt, Human
aauagucaaauugugu

SEQ ID NO: 2359660 - RNA, 20 nt, Human
aauaguauuugagaguucua

SEQ ID NO: 2359661 - RNA, 22 nt, Human
aauaguauuugagaguucuaaa

SEQ ID NO: 2359662 - RNA, 12 nt, Human
aauaguguggaa

SEQ ID NO: 2359663 - RNA, 22 nt, Human
aauaguggugugauuuggggau

SEQ ID NO: 2359664 - RNA, 16 nt, Human
aauaguggugugauuu

SEQ ID NO: 2359665 - RNA, 23 nt, Human
aauaguauuugagaguucuaaau

SEQ ID NO: 2359666 - RNA, 18 nt, Human
uaacauggugugcuucuu

SEQ ID NO: 2359667 - RNA, 21 nt, Human
uaaccuuaccagauuuuuaca

SEQ ID NO: 2359668 - RNA, 20 nt, Human
uaacgauaaaagacagugaa

SEQ ID NO: 2359669 - RNA, 23 nt, Human
uaacgacuucagggcagggcucu

SEQ ID NO: 2359670 - RNA, 14 nt, Human
uaacgacuucaggg

SEQ ID NO: 2359671 - RNA, 17 nt, Human
uaacgaccacagggucu

SEQ ID NO: 2359672 - RNA, 15 nt, Human
uaacuagaauuuauu

SEQ ID NO: 2359673 - RNA, 17 nt, Human
uaacuagaauuuauuca

SEQ ID NO: 2359674 - RNA, 18 nt, Human
uaacuagaauuuauucaa

SEQ ID NO: 2359675 - RNA, 18 nt, Human
uaacuuaaaaaaaugaca

SEQ ID NO: 2359676 - RNA, 17 nt, Human
uaacuuaaaaauguaaa

SEQ ID NO: 2359677 - RNA, 19 nt, Human
uaacuuaaaaauguaaaua

SEQ ID NO: 2359678 - RNA, 21 nt, Human
uaacuguuauuuauaaucacu

SEQ ID NO: 2359679 - RNA, 18 nt, Human
uaacuagagcagcccugg

SEQ ID NO: 2359680 - RNA, 21 nt, Human
uaacuagagcagcccuggagu

SEQ ID NO: 2359681 - RNA, 16 nt, Human
uaacuuaaaauauuuu

SEQ ID NO: 2359682 - RNA, 23 nt, Human
uaacuuaaaaauguaaauauucu

SEQ ID NO: 2359683 - RNA, 20 nt, Human
uaacuuaaaaauguaaauau

SEQ ID NO: 2359684 - RNA, 21 nt, Human
uaacuuaaaaauguaaauauu

SEQ ID NO: 2359685 - RNA, 22 nt, Human
uaacuuaaaagaacauguauau

SEQ ID NO: 2359686 - RNA, 16 nt, Human
uaacuuaauaguauuu

SEQ ID NO: 2359687 - RNA, 14 nt, Human
uaacuuaaucaauu

SEQ ID NO: 2359688 - RNA, 13 nt, Human
uaacuucacauau

SEQ ID NO: 2359689 - RNA, 21 nt, Human
uaacuucacauauugauuucc

SEQ ID NO: 2359690 - RNA, 17 nt, Human
uaacuuccaauuuacau

SEQ ID NO: 2359691 - RNA, 14 nt, Human
uaacuucaccauau

SEQ ID NO: 2359692 - RNA, 22 nt, Human
uaacuugagaguagaugguuug

SEQ ID NO: 2359693 - RNA, 22 nt, Human
uaacuugaggguaauaaacuua

SEQ ID NO: 2359694 - RNA, 15 nt, Human
uaacuugaguuuuau

SEQ ID NO: 2359695 - RNA, 21 nt, Human
uaacuugaguuuuauuuauuu

SEQ ID NO: 2359696 - RNA, 15 nt, Human
uaacuugcaccucug

SEQ ID NO: 2359697 - RNA, 15 nt, Human
uaacuuaaucaauua

SEQ ID NO: 2359698 - RNA, 23 nt, Human
uaacuucuuauggaauugauuug

SEQ ID NO: 2359699 - RNA, 23 nt, Human
uaacuuucagaagagaugggcuu

SEQ ID NO: 2359700 - RNA, 13 nt, Human
uaacuuucagaag

SEQ ID NO: 2359701 - RNA, 18 nt, Human
uaacuuuauguguaaaua

SEQ ID NO: 2359702 - RNA, 23 nt, Human
uaacuuucauuaaagcauuuacu

SEQ ID NO: 2359703 - RNA, 19 nt, Human
uaacuuucauuaaagcauu

SEQ ID NO: 2359704 - RNA, 15 nt, Human
uaacuuucucuauga

SEQ ID NO: 2359705 - RNA, 16 nt, Human
uaacuuucugaaauaa

SEQ ID NO: 2359706 - RNA, 21 nt, Human
uaacuuuaucacauuauuugc

SEQ ID NO: 2359707 - RNA, 14 nt, Human
uaacuuuaugugua

SEQ ID NO: 2359708 - RNA, 15 nt, Human
uaacuuuauguguaa

SEQ ID NO: 2359709 - RNA, 16 nt, Human
uaacuuuauguguaaa

SEQ ID NO: 2359710 - RNA, 17 nt, Human
uaacuuuaucacauuau

SEQ ID NO: 2359711 - RNA, 15 nt, Human
uaacuuuaucacauu

SEQ ID NO: 2359712 - RNA, 16 nt, Human
uaacuuggagccccag

SEQ ID NO: 2359713 - RNA, 19 nt, Human
uaacuuggauguagccaug

SEQ ID NO: 2359714 - RNA, 20 nt, Human
uaagacauacuccuuccauc

SEQ ID NO: 2359715 - RNA, 16 nt, Human
uaagacaugauuuccu

SEQ ID NO: 2359716 - RNA, 16 nt, Human
uaagacauaacguuuu

SEQ ID NO: 2359717 - RNA, 17 nt, Human
uaagacauaacguuuuu

SEQ ID NO: 2359718 - RNA, 20 nt, Human
uaagacauaacguuuuuccu

SEQ ID NO: 2359719 - RNA, 21 nt, Human
uaagacauaacguuuuuccuu

SEQ ID NO: 2359720 - RNA, 19 nt, Human
uaagacagucccaucaaaa

SEQ ID NO: 2359721 - RNA, 12 nt, Human
uaagacauaacg

SEQ ID NO: 2359722 - RNA, 14 nt, Human
uaagacacuuuuug

SEQ ID NO: 2359723 - RNA, 13 nt, Human
uaagacaaauaug

SEQ ID NO: 2359724 - RNA, 14 nt, Human
uaagaauauuugaa

SEQ ID NO: 2359725 - RNA, 20 nt, Human
uaagacacugaaaaaucuaa

SEQ ID NO: 2359726 - RNA, 23 nt, Human
uaagacacugaaaaaucuaagug

SEQ ID NO: 2359727 - RNA, 15 nt, Human
uaagaauaaaauguu

SEQ ID NO: 2359728 - RNA, 12 nt, Human
uaacuuugcuug

SEQ ID NO: 2359729 - RNA, 22 nt, Human
uaacuuugcuugcaguagauuu

SEQ ID NO: 2359730 - RNA, 24 nt, Human
uaacuuugcuugcaguagauuuuc

SEQ ID NO: 2359731 - RNA, 18 nt, Human
uaagaagugaaaaucuac

SEQ ID NO: 2359732 - RNA, 21 nt, Human
uaagaauaaaauguugaaaag

SEQ ID NO: 2359733 - RNA, 13 nt, Human
uaagaauauuuga

SEQ ID NO: 2359734 - RNA, 16 nt, Human
uaagaauaaaauguug

SEQ ID NO: 2359735 - RNA, 17 nt, Human
uaagaauaaaauguuga

SEQ ID NO: 2359736 - RNA, 19 nt, Human
uaagaauaaaauguugaaa

SEQ ID NO: 2359737 - RNA, 20 nt, Human
uaagaauaaaauguugaaaa

SEQ ID NO: 2359738 - RNA, 14 nt, Human
aaucauaugauucu

SEQ ID NO: 2359739 - RNA, 15 nt, Human
aaucauaugauucug

SEQ ID NO: 2359740 - RNA, 18 nt, Human
aaucaucugugugaaaau

SEQ ID NO: 2359741 - RNA, 16 nt, Human
aaucaugaaauaugca

SEQ ID NO: 2359742 - RNA, 17 nt, Human
aaucaugaaauaugcau

SEQ ID NO: 2359743 - RNA, 20 nt, Human
aaucaugaagauauuuuucc

SEQ ID NO: 2359744 - RNA, 12 nt, Human
aaucaugaauua

SEQ ID NO: 2359745 - RNA, 15 nt, Human
aaucaugaauuaguu

SEQ ID NO: 2359746 - RNA, 22 nt, Human
aaucauaguacucuuuguagca

SEQ ID NO: 2359747 - RNA, 18 nt, Human
aaucauauaauaaaugua

SEQ ID NO: 2359748 - RNA, 21 nt, Human
aaucauauaauaaauguacau

SEQ ID NO: 2359749 - RNA, 19 nt, Human
aaucauaguacucuuugua

SEQ ID NO: 2359750 - RNA, 15 nt, Human
uaauaaacuguguuu

SEQ ID NO: 2359751 - RNA, 14 nt, Human
uaauaaacuguguu

SEQ ID NO: 2359752 - RNA, 23 nt, Human
aaucauaagauauuuuucaugau

SEQ ID NO: 2359753 - RNA, 17 nt, Human
uaauaaacuuagaauaa

SEQ ID NO: 2359754 - RNA, 13 nt, Human
uaaguuguuugca

SEQ ID NO: 2359755 - RNA, 15 nt, Human
uaaguuguuugcaug

SEQ ID NO: 2359756 - RNA, 19 nt, Human
uaaguuuaccuauguaaca

SEQ ID NO: 2359757 - RNA, 20 nt, Human
uaaguucuggaugcauuucu

SEQ ID NO: 2359758 - RNA, 23 nt, Human
uaaguucuggaugcauuucucug

SEQ ID NO: 2359759 - RNA, 14 nt, Human
uaaguuccacugag

SEQ ID NO: 2359760 - RNA, 15 nt, Human
uaaguuccacugagc

SEQ ID NO: 2359761 - RNA, 17 nt, Human
uaaguuccacugagcuc

SEQ ID NO: 2359762 - RNA, 19 nt, Human
uaaguuccacugagcucca

SEQ ID NO: 2359763 - RNA, 17 nt, Human
uaaguugaauggccugc

SEQ ID NO: 2359764 - RNA, 22 nt, Human
uaauaaacauccuucaagaacu

SEQ ID NO: 2359765 - RNA, 17 nt, Human
uaaguuuaugucuaaag

SEQ ID NO: 2359766 - RNA, 13 nt, Human
uaauaaacauucu

SEQ ID NO: 2359767 - RNA, 12 nt, Human
uaauaaacacuc

SEQ ID NO: 2359768 - RNA, 18 nt, Human
uaauaaacacucuugaaa

SEQ ID NO: 2359769 - RNA, 17 nt, Human
uaagcuuugccagcugc

SEQ ID NO: 2359770 - RNA, 18 nt, Human
uaagcuuauuuaauuaaa

SEQ ID NO: 2359771 - RNA, 17 nt, Human
uaaggaaaaaaagacaa

SEQ ID NO: 2359772 - RNA, 18 nt, Human
uaagcuuugccagcugcu

SEQ ID NO: 2359773 - RNA, 19 nt, Human
uaagcuuugccagcugcug

SEQ ID NO: 2359774 - RNA, 21 nt, Human
uaagcuuugccagcugcugcu

SEQ ID NO: 2359775 - RNA, 22 nt, Human
uaagcuuugccagcugcugcug

SEQ ID NO: 2359776 - RNA, 14 nt, Human
uaagcuuauuuaau

SEQ ID NO: 2359777 - RNA, 16 nt, Human
uaagcuuaugucagac

SEQ ID NO: 2359778 - RNA, 16 nt, Human
uaagcuuguauuccuu

SEQ ID NO: 2359779 - RNA, 13 nt, Human
uaaguaaaugcua

SEQ ID NO: 2359780 - RNA, 12 nt, Human
uaaguaagaaaa

SEQ ID NO: 2359781 - RNA, 13 nt, Human
uaaguaagaaaau

SEQ ID NO: 2359782 - RNA, 14 nt, Human
uaaguaagaaaaua

SEQ ID NO: 2359783 - RNA, 15 nt, Human
uaaguaagaaaauau

SEQ ID NO: 2359784 - RNA, 19 nt, Human
uaaguaagaaaauauuuug

SEQ ID NO: 2359785 - RNA, 19 nt, Human
uaaguaaugauaacuggaa

SEQ ID NO: 2359786 - RNA, 19 nt, Human
uaaguauucuuauuuaaug

SEQ ID NO: 2359787 - RNA, 17 nt, Human
uaaguauuaugucucuu

SEQ ID NO: 2359788 - RNA, 22 nt, Human
uaaguucauauuccauauuuau

SEQ ID NO: 2359789 - RNA, 21 nt, Human
uaaguauuaugucucuucuga

SEQ ID NO: 2359790 - RNA, 20 nt, Human
uaaguauucuuauuuaauga

SEQ ID NO: 2359791 - RNA, 19 nt, Human
uaaguacuauguaucaaug

SEQ ID NO: 2359792 - RNA, 19 nt, Human
uaaguaagcaacagcauaa

SEQ ID NO: 2359793 - RNA, 20 nt, Human
uaaguaagaaaauauuuugu

SEQ ID NO: 2359794 - RNA, 17 nt, Human
uaaguacuauguaucaa

SEQ ID NO: 2359795 - RNA, 16 nt, Human
uaaguacuauguauca

SEQ ID NO: 2359796 - RNA, 13 nt, Human
uaaguacuaugua

SEQ ID NO: 2359797 - RNA, 21 nt, Human
aauccuggggaacauagaacu

SEQ ID NO: 2359798 - RNA, 14 nt, Human
aauccuggggaaca

SEQ ID NO: 2359799 - RNA, 15 nt, Human
aauccuaaaagaagc

SEQ ID NO: 2359800 - RNA, 20 nt, Human
aauccgaaccuccucuguga

SEQ ID NO: 2359801 - RNA, 19 nt, Human
aauccuggcccucuguguu

SEQ ID NO: 2359802 - RNA, 15 nt, Human
aauccuguccucagc

SEQ ID NO: 2359803 - RNA, 18 nt, Human
aauccuguccucagcuuc

SEQ ID NO: 2359804 - RNA, 21 nt, Human
aauccuguccucagcuucuua

SEQ ID NO: 2359805 - RNA, 13 nt, Human
aauccuuuacugu

SEQ ID NO: 2359806 - RNA, 12 nt, Human
aauccugucuuu

SEQ ID NO: 2359807 - RNA, 20 nt, Human
aauccuuuuucuuuauaaac

SEQ ID NO: 2359808 - RNA, 19 nt, Human
aaucgaggaaccagagcca

SEQ ID NO: 2359809 - RNA, 17 nt, Human
aaucgaggaaccagagc

SEQ ID NO: 2359810 - RNA, 15 nt, Human
aaucgaccugccucg

SEQ ID NO: 2359811 - RNA, 13 nt, Human
aaucgauggggga

SEQ ID NO: 2359812 - RNA, 14 nt, Human
aaucgauuggcuuu

SEQ ID NO: 2359813 - RNA, 22 nt, Human
aaucuaagcagcauuucugaag

SEQ ID NO: 2359814 - RNA, 15 nt, Human
aaucuaagugauaua

SEQ ID NO: 2359815 - RNA, 17 nt, Human
aaucuaagugauauaaa

SEQ ID NO: 2359816 - RNA, 13 nt, Human
aaucgauuggcuu

SEQ ID NO: 2359817 - RNA, 18 nt, Human
aaucgaggaaccagagcc

SEQ ID NO: 2359818 - RNA, 16 nt, Human
aaucaugaaauuacuu

SEQ ID NO: 2359819 - RNA, 22 nt, Human
aaucaugaauguguaacacagu

SEQ ID NO: 2359820 - RNA, 15 nt, Human
aaucauuagguguga

SEQ ID NO: 2359821 - RNA, 23 nt, Human
aaucauuaggugugacugaauuu

SEQ ID NO: 2359822 - RNA, 17 nt, Human
aaucauuaggugugacu

SEQ ID NO: 2359823 - RNA, 17 nt, Human
aaucccuguuuaauauu

SEQ ID NO: 2359824 - RNA, 23 nt, Human
aaucccuguuuaauauuuaaaca

SEQ ID NO: 2359825 - RNA, 19 nt, Human
aaucccuuuauuacccccu

SEQ ID NO: 2359826 - RNA, 23 nt, Human
aaucccuuuauuacccccuccuu

SEQ ID NO: 2359827 - RNA, 12 nt, Human
aauccgaaccuc

SEQ ID NO: 2359828 - RNA, 21 nt, Human
aauccgaccacuaauugccaa

SEQ ID NO: 2359829 - RNA, 19 nt, Human
aauccgaaccuccucugug

SEQ ID NO: 2359830 - RNA, 13 nt, Human
aauccgaaccucc

SEQ ID NO: 2359831 - RNA, 12 nt, Human
aauccgcccauc

SEQ ID NO: 2359832 - RNA, 16 nt, Human
aaucuaauauuaaaaa

SEQ ID NO: 2359833 - RNA, 17 nt, Human
aaucuaauauuaaaaau

SEQ ID NO: 2359834 - RNA, 19 nt, Human
aaucuaauauuaaaaauau

SEQ ID NO: 2359835 - RNA, 20 nt, Human
aaucuaauauuaaaaauaug

SEQ ID NO: 2359836 - RNA, 19 nt, Human
aaucuacacuccagugaga

SEQ ID NO: 2359837 - RNA, 15 nt, Human
aaucuggagaccagg

SEQ ID NO: 2359838 - RNA, 14 nt, Human
aaucuggagugagg

SEQ ID NO: 2359839 - RNA, 15 nt, Human
aaucuacccaaagga

SEQ ID NO: 2359840 - RNA, 16 nt, Human
aaucuacccaaaggau

SEQ ID NO: 2359841 - RNA, 17 nt, Human
aaucuacccaaaggaua

SEQ ID NO: 2359842 - RNA, 15 nt, Human
aaucuaccuucugua

SEQ ID NO: 2359843 - RNA, 16 nt, Human
aaucuaccuucuguag

SEQ ID NO: 2359844 - RNA, 17 nt, Human
aaucuaccuucuguagu

SEQ ID NO: 2359845 - RNA, 22 nt, Human
aaucuaccuucuguaguuuuau

SEQ ID NO: 2359846 - RNA, 16 nt, Human
aaucugggaagggaag

SEQ ID NO: 2359847 - RNA, 19 nt, Human
aaucuggagagcuagaacc

SEQ ID NO: 2359848 - RNA, 17 nt, Human
aaucugggccagaauuu

SEQ ID NO: 2359849 - RNA, 16 nt, Human
aaucugggccagaauu

SEQ ID NO: 2359850 - RNA, 19 nt, Human
aaucuuaggggagagcuuu

SEQ ID NO: 2359851 - RNA, 23 nt, Human
aaucuuacagcuggguggcacug

SEQ ID NO: 2359852 - RNA, 14 nt, Human
aaucuuacagcugg

SEQ ID NO: 2359853 - RNA, 18 nt, Human
aaucuuacagcugggugg

SEQ ID NO: 2359854 - RNA, 19 nt, Human
aaucuuauaauuuaaaaua

SEQ ID NO: 2359855 - RNA, 18 nt, Human
aaucuguguacaaagaaa

SEQ ID NO: 2359856 - RNA, 19 nt, Human
aaucuguguacaaagaaau

SEQ ID NO: 2359857 - RNA, 13 nt, Human
aaucuguguacaa

SEQ ID NO: 2359858 - RNA, 12 nt, Human
aaucugugauga

SEQ ID NO: 2359859 - RNA, 17 nt, Human
aaucuguguacaaagaa

SEQ ID NO: 2359860 - RNA, 20 nt, Human
aaucuguguacaaagaaaua

SEQ ID NO: 2359861 - RNA, 17 nt, Human
aaucuguuugaucccug

SEQ ID NO: 2359862 - RNA, 13 nt, Human
uaaugucuucauu

SEQ ID NO: 2359863 - RNA, 17 nt, Human
uaaugucuucauuucau

SEQ ID NO: 2359864 - RNA, 11 nt, Human
uaaugucucug

SEQ ID NO: 2359865 - RNA, 19 nt, Human
uaaugucucugugagacuc

SEQ ID NO: 2359866 - RNA, 22 nt, Human
uaaugucaccaccuucccagcu

SEQ ID NO: 2359867 - RNA, 21 nt, Human
uaaugucaccaccuucccagc

SEQ ID NO: 2359868 - RNA, 15 nt, Human
uaaugucaccaccuu

SEQ ID NO: 2359869 - RNA, 18 nt, Human
uaaugucacaggcagguc

SEQ ID NO: 2359870 - RNA, 14 nt, Human
uaauguagccaugg

SEQ ID NO: 2359871 - RNA, 13 nt, Human
uaauguacugcau

SEQ ID NO: 2359872 - RNA, 16 nt, Human
uaauguagccauggga

SEQ ID NO: 2359873 - RNA, 15 nt, Human
uaauguacaucuggc

SEQ ID NO: 2359874 - RNA, 15 nt, Human
uaaugaauggacuca

SEQ ID NO: 2359875 - RNA, 15 nt, Human
uaaugaaugcauaaa

SEQ ID NO: 2359876 - RNA, 13 nt, Human
uaauguuacugau

SEQ ID NO: 2359877 - RNA, 12 nt, Human
uaauguuacuga

SEQ ID NO: 2359878 - RNA, 14 nt, Human
uaauguuacugauc

SEQ ID NO: 2359879 - RNA, 21 nt, Human
aaucuuuagagaaguauacau

SEQ ID NO: 2359880 - RNA, 22 nt, Human
aaucuuuagagaaguauacaua

SEQ ID NO: 2359881 - RNA, 14 nt, Human
aaucuuuauugaga

SEQ ID NO: 2359882 - RNA, 15 nt, Human
aaucuuuaauuuuac

SEQ ID NO: 2359883 - RNA, 16 nt, Human
aaucuuuaauuuuaca

SEQ ID NO: 2359884 - RNA, 11 nt, Human
uaauguuacug

SEQ ID NO: 2359885 - RNA, 15 nt, Human
uaauguuaauucagc

SEQ ID NO: 2359886 - RNA, 20 nt, Human
uaauguuaaauuuguaaguu

SEQ ID NO: 2359887 - RNA, 22 nt, Human
uaauguuaaauuuguaaguuuc

SEQ ID NO: 2359888 - RNA, 13 nt, Human
uaauguuaaauuu

SEQ ID NO: 2359889 - RNA, 16 nt, Human
uaauguuaaauuugua

SEQ ID NO: 2359890 - RNA, 17 nt, Human
uaauguuaaauuuguaa

SEQ ID NO: 2359891 - RNA, 18 nt, Human
uaauguuaaauuuguaag

SEQ ID NO: 2359892 - RNA, 16 nt, Human
uaaugugguuauuucu

SEQ ID NO: 2359893 - RNA, 19 nt, Human
uaaugucuucauuucauug

SEQ ID NO: 2359894 - RNA, 21 nt, Human
uaaugucuucauuucauugua

SEQ ID NO: 2359895 - RNA, 19 nt, Human
uaauguguauuacaaauau

SEQ ID NO: 2359896 - RNA, 17 nt, Human
aaugaauuuuuaugaua

SEQ ID NO: 2359897 - RNA, 13 nt, Human
aaugaauuuuguu

SEQ ID NO: 2359898 - RNA, 20 nt, Human
aaugaaugugugugguuuuu

SEQ ID NO: 2359899 - RNA, 13 nt, Human
aaugacaacagaa

SEQ ID NO: 2359900 - RNA, 14 nt, Human
aaugacaacagaag

SEQ ID NO: 2359901 - RNA, 15 nt, Human
aaugacaacagaagc

SEQ ID NO: 2359902 - RNA, 22 nt, Human
aaugaaugucagugugacugau

SEQ ID NO: 2359903 - RNA, 23 nt, Human
aaugaauguuuacacucuuugua

SEQ ID NO: 2359904 - RNA, 13 nt, Human
aaugaaugugugu

SEQ ID NO: 2359905 - RNA, 16 nt, Human
aaugaauguguguggu

SEQ ID NO: 2359906 - RNA, 17 nt, Human
aaugaauuaaauaaacc

SEQ ID NO: 2359907 - RNA, 19 nt, Human
aaugaauggacucaaacug

SEQ ID NO: 2359908 - RNA, 13 nt, Human
aaugaaugucagu

SEQ ID NO: 2359909 - RNA, 17 nt, Human
aaugaaugcauaaaaug

SEQ ID NO: 2359910 - RNA, 20 nt, Human
aaugaaacccccacacacac

SEQ ID NO: 2359911 - RNA, 22 nt, Human
aaugaauggcuaagcaaaaugu

SEQ ID NO: 2359912 - RNA, 13 nt, Human
aaucuuucugcag

SEQ ID NO: 2359913 - RNA, 15 nt, Human
aaucuuuauugagaa

SEQ ID NO: 2359914 - RNA, 18 nt, Human
aaucuuuauugagaaaga

SEQ ID NO: 2359915 - RNA, 15 nt, Human
aaugaaaaugucuug

SEQ ID NO: 2359916 - RNA, 20 nt, Human
aaugaaaauuguauguuaag

SEQ ID NO: 2359917 - RNA, 16 nt, Human
aaugaaaaugucuugu

SEQ ID NO: 2359918 - RNA, 16 nt, Human
aaugaaacaccuucuc

SEQ ID NO: 2359919 - RNA, 17 nt, Human
aaugaaacauuuuguca

SEQ ID NO: 2359920 - RNA, 19 nt, Human
aaugaaacacucaguuguu

SEQ ID NO: 2359921 - RNA, 14 nt, Human
aaugaaacccccac

SEQ ID NO: 2359922 - RNA, 17 nt, Human
aaugaaacaccuucucu

SEQ ID NO: 2359923 - RNA, 20 nt, Human
aaugaaacaccuucucugga

SEQ ID NO: 2359924 - RNA, 17 nt, Human
aaugaaagacuguacaa

SEQ ID NO: 2359925 - RNA, 16 nt, Human
aaugaaagacuguaca

SEQ ID NO: 2359926 - RNA, 17 nt, Human
aaugaaaccugugucuc

SEQ ID NO: 2359927 - RNA, 14 nt, Human
aaugaaacuuggau

SEQ ID NO: 2359928 - RNA, 19 nt, Human
aaugaaacccccacacaca

SEQ ID NO: 2359929 - RNA, 18 nt, Human
aaugaaacccccacacac

SEQ ID NO: 2359930 - RNA, 15 nt, Human
uaauauuuuuaauua

SEQ ID NO: 2359931 - RNA, 18 nt, Human
uaaucacgcuuuccugaa

SEQ ID NO: 2359932 - RNA, 14 nt, Human
uaauauuuuuaauu

SEQ ID NO: 2359933 - RNA, 13 nt, Human
uaauauuuugcac

SEQ ID NO: 2359934 - RNA, 17 nt, Human
uaaucacuuuuuuccac

SEQ ID NO: 2359935 - RNA, 16 nt, Human
uaaucacuuuuuucca

SEQ ID NO: 2359936 - RNA, 16 nt, Human
uaaucccagcacuuug

SEQ ID NO: 2359937 - RNA, 23 nt, Human
uaauccaggcagauccaggacua

SEQ ID NO: 2359938 - RNA, 22 nt, Human
uaauccaggcagauccaggacu

SEQ ID NO: 2359939 - RNA, 19 nt, Human
uaaucccagcuacuuggga

SEQ ID NO: 2359940 - RNA, 19 nt, Human
uaaucccagcacuuuggga

SEQ ID NO: 2359941 - RNA, 21 nt, Human
uaaucccagcaugcugagauu

SEQ ID NO: 2359942 - RNA, 21 nt, Human
uaaucagcaagaauuugaucg

SEQ ID NO: 2359943 - RNA, 20 nt, Human
uaaucagcaagaauuugauc

SEQ ID NO: 2359944 - RNA, 18 nt, Human
uaaucacuuuuuuccaca

SEQ ID NO: 2359945 - RNA, 19 nt, Human
uaaucacuuuuuuccacau

SEQ ID NO: 2359946 - RNA, 11 nt, Human
uaaucagccuc

SEQ ID NO: 2359947 - RNA, 17 nt, Human
uaauccaggcagaucca

SEQ ID NO: 2359948 - RNA, 19 nt, Human
uaauccaggcagauccagg

SEQ ID NO: 2359949 - RNA, 18 nt, Human
uaauccaggcagauccag

SEQ ID NO: 2359950 - RNA, 17 nt, Human
uaaugaaugaaacauuu

SEQ ID NO: 2359951 - RNA, 18 nt, Human
uaaugaaucuaagcagca

SEQ ID NO: 2359952 - RNA, 15 nt, Human
uaaugaaaaugucag

SEQ ID NO: 2359953 - RNA, 14 nt, Human
uaaugaaaauguca

SEQ ID NO: 2359954 - RNA, 13 nt, Human
uaaugaaaauguc

SEQ ID NO: 2359955 - RNA, 21 nt, Human
uaaugaaguuugaauguuaaa

SEQ ID NO: 2359956 - RNA, 22 nt, Human
uaaugaaguuugaauguuaaau

SEQ ID NO: 2359957 - RNA, 20 nt, Human
uaaugaaguuugaauguuaa

SEQ ID NO: 2359958 - RNA, 19 nt, Human
uaaugaaguuugaauguua

SEQ ID NO: 2359959 - RNA, 12 nt, Human
uaaucuuugggu

SEQ ID NO: 2359960 - RNA, 18 nt, Human
uaaucuuucuuuaccuga

SEQ ID NO: 2359961 - RNA, 21 nt, Human
uaaucuuucuuuaccugagac

SEQ ID NO: 2359962 - RNA, 20 nt, Human
uaaucccagcuacucaggag

SEQ ID NO: 2359963 - RNA, 20 nt, Human
uaaucccagcuacuugggaa

SEQ ID NO: 2359964 - RNA, 17 nt, Human
uaauccccaguaaaauu

SEQ ID NO: 2359965 - RNA, 18 nt, Human
uaauccccaguaaaauug

SEQ ID NO: 2359966 - RNA, 20 nt, Human
uaauccccaguaaaauugcc

SEQ ID NO: 2359967 - RNA, 22 nt, Human
uaaucuuuggguaacuucaaaa

SEQ ID NO: 2359968 - RNA, 15 nt, Human
uaaucuuuucacaaa

SEQ ID NO: 2359969 - RNA, 16 nt, Human
uaaucuuuucacaaau

SEQ ID NO: 2359970 - RNA, 23 nt, Human
uaaucuuucuuuaccugagacca

SEQ ID NO: 2359971 - RNA, 19 nt, Human
uaaucuuuucacaaauaaa

SEQ ID NO: 2359972 - RNA, 17 nt, Human
uaaucuuuucacaaaua

SEQ ID NO: 2359973 - RNA, 18 nt, Human
uaaucuuuucacaaauaa

SEQ ID NO: 2359974 - RNA, 15 nt, Human
aaucuuauauuccau

SEQ ID NO: 2359975 - RNA, 21 nt, Human
aaucuuaucauggucucaguc

SEQ ID NO: 2359976 - RNA, 15 nt, Human
aaucuuaucaugguc

SEQ ID NO: 2359977 - RNA, 14 nt, Human
uaauacaccacuac

SEQ ID NO: 2359978 - RNA, 16 nt, Human
uaauacaccacuacau

SEQ ID NO: 2359979 - RNA, 16 nt, Human
uaauagacaauuuauu

SEQ ID NO: 2359980 - RNA, 14 nt, Human
uaauagacaauuua

SEQ ID NO: 2359981 - RNA, 19 nt, Human
uaauacaccacuacauucu

SEQ ID NO: 2359982 - RNA, 18 nt, Human
uaauacaccacuacauuc

SEQ ID NO: 2359983 - RNA, 12 nt, Human
uaauagagcaaa

SEQ ID NO: 2359984 - RNA, 21 nt, Human
uaauagagcaaaauugaugug

SEQ ID NO: 2359985 - RNA, 22 nt, Human
uaauagacaauuuauuauggca

SEQ ID NO: 2359986 - RNA, 18 nt, Human
uaauagacaauuuauuau

SEQ ID NO: 2359987 - RNA, 19 nt, Human
uaauagcggguuacuuuca

SEQ ID NO: 2359988 - RNA, 22 nt, Human
uaauagcggguuacuuucacau

SEQ ID NO: 2359989 - RNA, 14 nt, Human
uaauauuugcugac

SEQ ID NO: 2359990 - RNA, 18 nt, Human
uaauauuuauugcuuuau

SEQ ID NO: 2359991 - RNA, 20 nt, Human
uaauauuuauugcuuuauaa

SEQ ID NO: 2359992 - RNA, 14 nt, Human
uaauauuuauugcu

SEQ ID NO: 2359993 - RNA, 15 nt, Human
uaauauuuauugcuu

SEQ ID NO: 2359994 - RNA, 16 nt, Human
uaauauuuauugcuuu

SEQ ID NO: 2359995 - RNA, 17 nt, Human
uaauauuuauugcuuua

SEQ ID NO: 2359996 - RNA, 23 nt, Human
uaauauuuaugucuauuuaagcc

SEQ ID NO: 2359997 - RNA, 16 nt, Human
uaauauuuauauauuu

SEQ ID NO: 2359998 - RNA, 21 nt, Human
uaauauuuaugucuauuuaag

SEQ ID NO: 2359999 - RNA, 17 nt, Human
aauggcacagcccaaag

SEQ ID NO: 2360000 - RNA, 20 nt, Human
aauggcacagcccaaagaag

SEQ ID NO: 2360001 - RNA, 12 nt, Human
aauggcagccuu

SEQ ID NO: 2360002 - RNA, 19 nt, Human
aauggcacagcccaaagaa

SEQ ID NO: 2360003 - RNA, 16 nt, Human
aauggcagccuuggca

SEQ ID NO: 2360004 - RNA, 14 nt, Human
aauggacucaaacu

SEQ ID NO: 2360005 - RNA, 13 nt, Human
aauggaaaggaga

SEQ ID NO: 2360006 - RNA, 17 nt, Human
aauggacuggaagggga

SEQ ID NO: 2360007 - RNA, 23 nt, Human
aauggacuggaaggggaagggac

SEQ ID NO: 2360008 - RNA, 23 nt, Human
aauggauuggauuauuuaauaac

SEQ ID NO: 2360009 - RNA, 22 nt, Human
aauggauuggauuauuuaauaa

SEQ ID NO: 2360010 - RNA, 21 nt, Human
aauggauuugaugcuguuuga

SEQ ID NO: 2360011 - RNA, 21 nt, Human
aauggcaaggcagcccugucu

SEQ ID NO: 2360012 - RNA, 23 nt, Human
aauggcaaggcagcccugucuga

SEQ ID NO: 2360013 - RNA, 23 nt, Human
aauggcacaaucucggcucacug

SEQ ID NO: 2360014 - RNA, 12 nt, Human
aauggcucagau

SEQ ID NO: 2360015 - RNA, 15 nt, Human
aauggcucagaugcc

SEQ ID NO: 2360016 - RNA, 21 nt, Human
aauggcucacuauggugccaa

SEQ ID NO: 2360017 - RNA, 17 nt, Human
aauguaacagucugauc

SEQ ID NO: 2360018 - RNA, 22 nt, Human
aauggccugccuugaagccacu

SEQ ID NO: 2360019 - RNA, 17 nt, Human
aauggccuccucccuua

SEQ ID NO: 2360020 - RNA, 18 nt, Human
aauggcgcagugccucug

SEQ ID NO: 2360021 - RNA, 19 nt, Human
aauggcgcagugccucugg

SEQ ID NO: 2360022 - RNA, 19 nt, Human
aauggcgugaacccgggag

SEQ ID NO: 2360023 - RNA, 20 nt, Human
aauggcgucuggaaguccaa

SEQ ID NO: 2360024 - RNA, 16 nt, Human
aauggcuaauucccag

SEQ ID NO: 2360025 - RNA, 20 nt, Human
aauggcgcagugccucuggu

SEQ ID NO: 2360026 - RNA, 18 nt, Human
aauggcgugaucucggcu

SEQ ID NO: 2360027 - RNA, 20 nt, Human
aauggccugccuugaagcca

SEQ ID NO: 2360028 - RNA, 14 nt, Human
aauggccugccuug

SEQ ID NO: 2360029 - RNA, 20 nt, Human
aauggccucauguggcugga

SEQ ID NO: 2360030 - RNA, 22 nt, Human
aauggccucauguggcuggaag

SEQ ID NO: 2360031 - RNA, 17 nt, Human
aauggccauuugcuuuu

SEQ ID NO: 2360032 - RNA, 16 nt, Human
aauggccggcuggaaa

SEQ ID NO: 2360033 - RNA, 15 nt, Human
aauggccucaugugg

SEQ ID NO: 2360034 - RNA, 15 nt, Human
uacacuaaaagguga

SEQ ID NO: 2360035 - RNA, 23 nt, Human
uacacauuuuauuuuauuaugca

SEQ ID NO: 2360036 - RNA, 14 nt, Human
uacacuaagagaga

SEQ ID NO: 2360037 - RNA, 18 nt, Human
uacacuaagagagaauga

SEQ ID NO: 2360038 - RNA, 15 nt, Human
aauguaacuuuugua

SEQ ID NO: 2360039 - RNA, 22 nt, Human
aauguaacuuuuguaagacaaa

SEQ ID NO: 2360040 - RNA, 16 nt, Human
aauguaacuuuuguaa

SEQ ID NO: 2360041 - RNA, 19 nt, Human
uacacauuuuauuuuauua

SEQ ID NO: 2360042 - RNA, 22 nt, Human
uacacauuuuauuuuauuaugc

SEQ ID NO: 2360043 - RNA, 21 nt, Human
uacacauuuuauuuuauuaug

SEQ ID NO: 2360044 - RNA, 11 nt, Human
uacagacacua

SEQ ID NO: 2360045 - RNA, 13 nt, Human
uacagacacuaag

SEQ ID NO: 2360046 - RNA, 14 nt, Human
uacagacacuaagu

SEQ ID NO: 2360047 - RNA, 19 nt, Human
uacagacacuaaguuauag

SEQ ID NO: 2360048 - RNA, 23 nt, Human
uacagaccgaacuguuguauaaa

SEQ ID NO: 2360049 - RNA, 21 nt, Human
uacagaccgaacuguuguaua

SEQ ID NO: 2360050 - RNA, 20 nt, Human
uacagaccgaacuguuguau

SEQ ID NO: 2360051 - RNA, 19 nt, Human
uacagaccgaacuguugua

SEQ ID NO: 2360052 - RNA, 22 nt, Human
uacagacaacaaaccuguuucu

SEQ ID NO: 2360053 - RNA, 13 nt, Human
uacacguguccug

SEQ ID NO: 2360054 - RNA, 17 nt, Human
uacacguguccuguagu

SEQ ID NO: 2360055 - RNA, 19 nt, Human
uacagacaaagcguggugg

SEQ ID NO: 2360056 - RNA, 13 nt, Human
uacagacguaugc

SEQ ID NO: 2360057 - RNA, 16 nt, Human
uacagagugauagccu

SEQ ID NO: 2360058 - RNA, 18 nt, Human
uacagacacuaaguuaua

SEQ ID NO: 2360059 - RNA, 20 nt, Human
uacagaggucucugccggcu

SEQ ID NO: 2360060 - RNA, 23 nt, Human
uacagaggucucugccggcucuu

SEQ ID NO: 2360061 - RNA, 19 nt, Human
uacagauagucaaaccaua

SEQ ID NO: 2360062 - RNA, 20 nt, Human
uacagauccccaagccuggc

SEQ ID NO: 2360063 - RNA, 21 nt, Human
aaugccauggacagaagaagg

SEQ ID NO: 2360064 - RNA, 16 nt, Human
aaugccauuaucccug

SEQ ID NO: 2360065 - RNA, 22 nt, Human
aaugccauccucaaacacugca

SEQ ID NO: 2360066 - RNA, 15 nt, Human
aaugccaucaucucc

SEQ ID NO: 2360067 - RNA, 17 nt, Human
aaugccauccucaaaca

SEQ ID NO: 2360068 - RNA, 21 nt, Human
aaugccauccucaaacacugc

SEQ ID NO: 2360069 - RNA, 21 nt, Human
aaugccaguaacgcgucuucc

SEQ ID NO: 2360070 - RNA, 22 nt, Human
aaugccagagacggaagccuuu

SEQ ID NO: 2360071 - RNA, 23 nt, Human
aaugccaguaacgcgucuuccug

SEQ ID NO: 2360072 - RNA, 22 nt, Human
aaugcagcgaaccaauauuugu

SEQ ID NO: 2360073 - RNA, 22 nt, Human
aaugcagggauugcugccacuu

SEQ ID NO: 2360074 - RNA, 23 nt, Human
aaugcagggauugcugccacuuu

SEQ ID NO: 2360075 - RNA, 12 nt, Human
aaugcagccaga

SEQ ID NO: 2360076 - RNA, 14 nt, Human
aaugcagcgugaag

SEQ ID NO: 2360077 - RNA, 22 nt, Human
aaugccacugccuucgcuucuu

SEQ ID NO: 2360078 - RNA, 22 nt, Human
aaugcacuuuguucuggcucuu

SEQ ID NO: 2360079 - RNA, 22 nt, Human
uacaaugugaacuuuauuaaau

SEQ ID NO: 2360080 - RNA, 22 nt, Human
aaugcagcagggaugcccugga

SEQ ID NO: 2360081 - RNA, 20 nt, Human
aaugcagcagggaugcccug

SEQ ID NO: 2360082 - RNA, 21 nt, Human
uacaaugcugugcccuaaagu

SEQ ID NO: 2360083 - RNA, 18 nt, Human
aaugaccuuucaauagga

SEQ ID NO: 2360084 - RNA, 16 nt, Human
aaugaccuuucaauag

SEQ ID NO: 2360085 - RNA, 17 nt, Human
aaugaccuuucaauagg

SEQ ID NO: 2360086 - RNA, 21 nt, Human
aaugcacuuuguucuggcucu

SEQ ID NO: 2360087 - RNA, 21 nt, Human
uacaaugugaacuuuauuaaa

SEQ ID NO: 2360088 - RNA, 20 nt, Human
uacaaugugaacuuuauuaa

SEQ ID NO: 2360089 - RNA, 17 nt, Human
uacaaugugaacuuuau

SEQ ID NO: 2360090 - RNA, 16 nt, Human
uacaaugugaacuuua

SEQ ID NO: 2360091 - RNA, 15 nt, Human
uacaaugugaacuuu

SEQ ID NO: 2360092 - RNA, 14 nt, Human
uacaaugugaacuu

SEQ ID NO: 2360093 - RNA, 22 nt, Human
uacaauguauuuauuuaaaaga

SEQ ID NO: 2360094 - RNA, 16 nt, Human
aaugacaacagaagcu

SEQ ID NO: 2360095 - RNA, 14 nt, Human
uacaauguauuuau

SEQ ID NO: 2360096 - RNA, 17 nt, Human
uacaauguauuuauuua

SEQ ID NO: 2360097 - RNA, 18 nt, Human
uacaauguauuuauuuaa

SEQ ID NO: 2360098 - RNA, 19 nt, Human
uacaauguauuuauuuaaa

SEQ ID NO: 2360099 - RNA, 20 nt, Human
uacaauguauuuauuuaaaa

SEQ ID NO: 2360100 - RNA, 16 nt, Human
aauggaaacugaaugc

SEQ ID NO: 2360101 - RNA, 23 nt, Human
aaugcuuccuagaaguuacugaa

SEQ ID NO: 2360102 - RNA, 16 nt, Human
aaugcuucaucccuuu

SEQ ID NO: 2360103 - RNA, 20 nt, Human
aauggaaaugggcagagcag

SEQ ID NO: 2360104 - RNA, 21 nt, Human
aauggaaaugggcagagcaga

SEQ ID NO: 2360105 - RNA, 21 nt, Human
aaugcuuccugacaaucaacu

SEQ ID NO: 2360106 - RNA, 17 nt, Human
aauggaaacugaaugcu

SEQ ID NO: 2360107 - RNA, 15 nt, Human
aauggaaaggagagg

SEQ ID NO: 2360108 - RNA, 21 nt, Human
aauggacguguuaugacucca

SEQ ID NO: 2360109 - RNA, 14 nt, Human
aauggaaccacucu

SEQ ID NO: 2360110 - RNA, 23 nt, Human
aauggacguguuaugacuccaga

SEQ ID NO: 2360111 - RNA, 20 nt, Human
aauggacuaacuugucuuug

SEQ ID NO: 2360112 - RNA, 18 nt, Human
aaugcugguuuuucaguu

SEQ ID NO: 2360113 - RNA, 16 nt, Human
aaugcuguugccucau

SEQ ID NO: 2360114 - RNA, 23 nt, Human
aaugcuguacaucuauuuuggau

SEQ ID NO: 2360115 - RNA, 13 nt, Human
aaugcuguguuaa

SEQ ID NO: 2360116 - RNA, 20 nt, Human
aaugcuuaucaucuaaagau

SEQ ID NO: 2360117 - RNA, 22 nt, Human
aaugcuguauuagucacagaga

SEQ ID NO: 2360118 - RNA, 16 nt, Human
aaugcuguauuuuaaa

SEQ ID NO: 2360119 - RNA, 13 nt, Human
aaugcccagcccc

SEQ ID NO: 2360120 - RNA, 17 nt, Human
aaugcuguacaucuauu

SEQ ID NO: 2360121 - RNA, 15 nt, Human
aaugcuguacaucua

SEQ ID NO: 2360122 - RNA, 13 nt, Human
aaugcuguacauc

SEQ ID NO: 2360123 - RNA, 12 nt, Human
aaugcuguacau

SEQ ID NO: 2360124 - RNA, 11 nt, Human
aaugcccagcc

SEQ ID NO: 2360125 - RNA, 12 nt, Human
aaugcccagccc

SEQ ID NO: 2360126 - RNA, 17 nt, Human
aaugugccuaguucuuu

SEQ ID NO: 2360127 - RNA, 19 nt, Human
aaugugcuacugauuguuu

SEQ ID NO: 2360128 - RNA, 13 nt, Human
aaugugcccccag

SEQ ID NO: 2360129 - RNA, 23 nt, Human
aaugugcauucuuuuaaaagaca

SEQ ID NO: 2360130 - RNA, 24 nt, Human
aaugugcauucuuuuaaaagacaa

SEQ ID NO: 2360131 - RNA, 11 nt, Human
aaugugugugu

SEQ ID NO: 2360132 - RNA, 18 nt, Human
aaugugcuauacugcaua

SEQ ID NO: 2360133 - RNA, 16 nt, Human
aaugugauuuuucuga

SEQ ID NO: 2360134 - RNA, 22 nt, Human
aaugugauucuaaugucuucau

SEQ ID NO: 2360135 - RNA, 19 nt, Human
aaugugcagguuuguuaca

SEQ ID NO: 2360136 - RNA, 20 nt, Human
aaugugcagguuuguuacau

SEQ ID NO: 2360137 - RNA, 22 nt, Human
aaugugcagguuuguuacauag

SEQ ID NO: 2360138 - RNA, 20 nt, Human
aaugugauuuacgcucauug

SEQ ID NO: 2360139 - RNA, 14 nt, Human
aaugugauucuaau

SEQ ID NO: 2360140 - RNA, 19 nt, Human
aaugugauucuaaugucuu

SEQ ID NO: 2360141 - RNA, 21 nt, Human
aaugugauuccuuugaagagg

SEQ ID NO: 2360142 - RNA, 22 nt, Human
aaugugauuccuuugaagagga

SEQ ID NO: 2360143 - RNA, 19 nt, Human
aaugugaaaagaaaaauga

SEQ ID NO: 2360144 - RNA, 14 nt, Human
aaugugaaacugga

SEQ ID NO: 2360145 - RNA, 16 nt, Human
aauguauuauucugca

SEQ ID NO: 2360146 - RNA, 14 nt, Human
aauguauuauucug

SEQ ID NO: 2360147 - RNA, 22 nt, Human
aaugugaaaaugguccaggaga

SEQ ID NO: 2360148 - RNA, 15 nt, Human
aaugugaaacuggau

SEQ ID NO: 2360149 - RNA, 17 nt, Human
aauguauuauucugcag

SEQ ID NO: 2360150 - RNA, 14 nt, Human
aauguaucaggaaa

SEQ ID NO: 2360151 - RNA, 13 nt, Human
aauguaucaggaa

SEQ ID NO: 2360152 - RNA, 21 nt, Human
aauguauauguuuugugggaa

SEQ ID NO: 2360153 - RNA, 20 nt, Human
aauguauguguaaguauucu

SEQ ID NO: 2360154 - RNA, 19 nt, Human
aauguauguguaaguauuc

SEQ ID NO: 2360155 - RNA, 14 nt, Human
aauguauaugcacu

SEQ ID NO: 2360156 - RNA, 13 nt, Human
aauguauaugcac

SEQ ID NO: 2360157 - RNA, 17 nt, Human
uacauauguaaaauaaa

SEQ ID NO: 2360158 - RNA, 16 nt, Human
uacaucacuugagaca

SEQ ID NO: 2360159 - RNA, 23 nt, Human
uacauccaaagcagacagcucca

SEQ ID NO: 2360160 - RNA, 16 nt, Human
uacaucccauguaaca

SEQ ID NO: 2360161 - RNA, 17 nt, Human
uacaucccauguaacag

SEQ ID NO: 2360162 - RNA, 20 nt, Human
uacauccaaagcagacagcu

SEQ ID NO: 2360163 - RNA, 19 nt, Human
uacauccaaagcagacagc

SEQ ID NO: 2360164 - RNA, 22 nt, Human
uacaucccauguaacagaaagg

SEQ ID NO: 2360165 - RNA, 18 nt, Human
uacaucccauguaacaga

SEQ ID NO: 2360166 - RNA, 19 nt, Human
uacaucccauguaacagaa

SEQ ID NO: 2360167 - RNA, 20 nt, Human
uacaucccauguaacagaaa

SEQ ID NO: 2360168 - RNA, 21 nt, Human
uacaucccauguaacagaaag

SEQ ID NO: 2360169 - RNA, 20 nt, Human
uacaucccuuaccugggaaa

SEQ ID NO: 2360170 - RNA, 22 nt, Human
uacauauaagugauugcugguu

SEQ ID NO: 2360171 - RNA, 22 nt, Human
uacauaucuuuauuaaucacua

SEQ ID NO: 2360172 - RNA, 16 nt, Human
uacauaucuuuauuaa

SEQ ID NO: 2360173 - RNA, 12 nt, Human
uacauaucuuua

SEQ ID NO: 2360174 - RNA, 18 nt, Human
uacauaucaccucauggc

SEQ ID NO: 2360175 - RNA, 20 nt, Human
uacauaucaccucauggccu

SEQ ID NO: 2360176 - RNA, 20 nt, Human
uacauauguaaaauaaaauu

SEQ ID NO: 2360177 - RNA, 16 nt, Human
uacauauguaaaauaa

SEQ ID NO: 2360178 - RNA, 15 nt, Human
uacauauguaaaaua

SEQ ID NO: 2360179 - RNA, 13 nt, Human
uacauaugaaauu

SEQ ID NO: 2360180 - RNA, 16 nt, Human
uacauaugagugugga

SEQ ID NO: 2360181 - RNA, 22 nt, Human
uacauaugaguguggaagccgg

SEQ ID NO: 2360182 - RNA, 22 nt, Human
uacagaugaauguauuuauuug

SEQ ID NO: 2360183 - RNA, 18 nt, Human
uacagaugaauguauuua

SEQ ID NO: 2360184 - RNA, 16 nt, Human
uacaggugugagucac

SEQ ID NO: 2360185 - RNA, 13 nt, Human
uacagguuacaac

SEQ ID NO: 2360186 - RNA, 15 nt, Human
uacagguuacaacag

SEQ ID NO: 2360187 - RNA, 17 nt, Human
uacagguuacaacagau

SEQ ID NO: 2360188 - RNA, 18 nt, Human
uacagguuacaacagauu

SEQ ID NO: 2360189 - RNA, 21 nt, Human
uacagguuacaacagauuugu

SEQ ID NO: 2360190 - RNA, 23 nt, Human
uacagguuacaacagauuuguga

SEQ ID NO: 2360191 - RNA, 13 nt, Human
uacaguaaauaaa

SEQ ID NO: 2360192 - RNA, 15 nt, Human
uacaguaaauaaauu

SEQ ID NO: 2360193 - RNA, 24 nt, Human
uacauaaugcgugcauaccacuuu

SEQ ID NO: 2360194 - RNA, 22 nt, Human
uacauaauuuuuuauucaaguu

SEQ ID NO: 2360195 - RNA, 19 nt, Human
uacauaauuuuuuauucaa

SEQ ID NO: 2360196 - RNA, 13 nt, Human
uacaguaacuuua

SEQ ID NO: 2360197 - RNA, 23 nt, Human
uacauaaugcgugcauaccacuu

SEQ ID NO: 2360198 - RNA, 21 nt, Human
uacauaaugcgugcauaccac

SEQ ID NO: 2360199 - RNA, 16 nt, Human
uacaguaaauaaauug

SEQ ID NO: 2360200 - RNA, 17 nt, Human
uacaguaaauaaauugu

SEQ ID NO: 2360201 - RNA, 18 nt, Human
uacaguaaauaaauuguu

SEQ ID NO: 2360202 - RNA, 21 nt, Human
uacaguaaauaaauuguuuga

SEQ ID NO: 2360203 - RNA, 22 nt, Human
aauguuaaauuuguaaguuuca

SEQ ID NO: 2360204 - RNA, 18 nt, Human
aauguuaaggaaacucuu

SEQ ID NO: 2360205 - RNA, 22 nt, Human
aauguuaaggaaacucuuaucu

SEQ ID NO: 2360206 - RNA, 23 nt, Human
aauguuaauucagcacugauuuc

SEQ ID NO: 2360207 - RNA, 13 nt, Human
aauguuaagcaga

SEQ ID NO: 2360208 - RNA, 18 nt, Human
aauguuaaauaaauugua

SEQ ID NO: 2360209 - RNA, 20 nt, Human
aauguuaaauaaauuguaua

SEQ ID NO: 2360210 - RNA, 21 nt, Human
aauguuaaauaaauuguauau

SEQ ID NO: 2360211 - RNA, 22 nt, Human
aauguuaaauaaauuguauauu

SEQ ID NO: 2360212 - RNA, 23 nt, Human
aauguuaaauaaauuguauauuc

SEQ ID NO: 2360213 - RNA, 12 nt, Human
aauguuaaauuu

SEQ ID NO: 2360214 - RNA, 13 nt, Human
aauguuaaauuug

SEQ ID NO: 2360215 - RNA, 16 nt, Human
aauguuaaauuuguaa

SEQ ID NO: 2360216 - RNA, 17 nt, Human
aauguuaaauuuguaag

SEQ ID NO: 2360217 - RNA, 18 nt, Human
aauguuaaauuuguaagu

SEQ ID NO: 2360218 - RNA, 21 nt, Human
aauguuaaauuuguaaguuuc

SEQ ID NO: 2360219 - RNA, 15 nt, Human
aauguuaaagucagu

SEQ ID NO: 2360220 - RNA, 14 nt, Human
aauguuaaagucag

SEQ ID NO: 2360221 - RNA, 13 nt, Human
aauguuaaauaaa

SEQ ID NO: 2360222 - RNA, 15 nt, Human
aauguuaaauaaauu

SEQ ID NO: 2360223 - RNA, 13 nt, Human
aauguguuucugu

SEQ ID NO: 2360224 - RNA, 15 nt, Human
aauguuaaaauguau

SEQ ID NO: 2360225 - RNA, 16 nt, Human
aauguuaaaauguauu

SEQ ID NO: 2360226 - RNA, 16 nt, Human
aauuaaccuggugcug

SEQ ID NO: 2360227 - RNA, 15 nt, Human
aauuaaccuggugcu

SEQ ID NO: 2360228 - RNA, 14 nt, Human
aauuaaccuggugc

SEQ ID NO: 2360229 - RNA, 13 nt, Human
aauuaaccuggug

SEQ ID NO: 2360230 - RNA, 18 nt, Human
aauuaaccuggugcugga

SEQ ID NO: 2360231 - RNA, 11 nt, Human
aauuaacuuuu

SEQ ID NO: 2360232 - RNA, 20 nt, Human
aauuaacauugggaaaucuu

SEQ ID NO: 2360233 - RNA, 17 nt, Human
aauuaaccaaaaaaguu

SEQ ID NO: 2360234 - RNA, 12 nt, Human
aauuaaccuggu

SEQ ID NO: 2360235 - RNA, 19 nt, Human
aauguugaaaagucaaacu

SEQ ID NO: 2360236 - RNA, 20 nt, Human
aauguucugacauuaacagu

SEQ ID NO: 2360237 - RNA, 19 nt, Human
aauguucugacauuaacag

SEQ ID NO: 2360238 - RNA, 17 nt, Human
aauguucugacauuaac

SEQ ID NO: 2360239 - RNA, 15 nt, Human
aauguucugacauua

SEQ ID NO: 2360240 - RNA, 14 nt, Human
aauguucugacauu

SEQ ID NO: 2360241 - RNA, 12 nt, Human
aauguucugaca

SEQ ID NO: 2360242 - RNA, 21 nt, Human
aauguucugaauaauuucuua

SEQ ID NO: 2360243 - RNA, 21 nt, Human
aauguucucucuucuccaccu

SEQ ID NO: 2360244 - RNA, 12 nt, Human
aauguugaaaag

SEQ ID NO: 2360245 - RNA, 13 nt, Human
aauguugaaaagu

SEQ ID NO: 2360246 - RNA, 16 nt, Human
aauguugaaaagucaa

SEQ ID NO: 2360247 - RNA, 13 nt, Human
uacaugugggagc

SEQ ID NO: 2360248 - RNA, 16 nt, Human
uacauguggcccaaca

SEQ ID NO: 2360249 - RNA, 16 nt, Human
uacauguguagccugu

SEQ ID NO: 2360250 - RNA, 14 nt, Human
uacaugugguuuau

SEQ ID NO: 2360251 - RNA, 19 nt, Human
uacauguguagccugugca

SEQ ID NO: 2360252 - RNA, 18 nt, Human
uacauguguagccugugc

SEQ ID NO: 2360253 - RNA, 20 nt, Human
uacaugugccgaaugugcag

SEQ ID NO: 2360254 - RNA, 19 nt, Human
uacauguauugcacauugu

SEQ ID NO: 2360255 - RNA, 20 nt, Human
uacauguauugcacauugua

SEQ ID NO: 2360256 - RNA, 21 nt, Human
uacauguauugcacauuguaa

SEQ ID NO: 2360257 - RNA, 22 nt, Human
uacauguauugcacauuguaaa

SEQ ID NO: 2360258 - RNA, 17 nt, Human
uacaugugccgaaugug

SEQ ID NO: 2360259 - RNA, 19 nt, Human
uacaugugccgaaugugca

SEQ ID NO: 2360260 - RNA, 13 nt, Human
uacauguauuugu

SEQ ID NO: 2360261 - RNA, 17 nt, Human
uacauugaauuagaaac

SEQ ID NO: 2360262 - RNA, 17 nt, Human
uacauuguaaauaguau

SEQ ID NO: 2360263 - RNA, 18 nt, Human
uaccaccagucugacugu

SEQ ID NO: 2360264 - RNA, 13 nt, Human
uacauucuguuaa

SEQ ID NO: 2360265 - RNA, 19 nt, Human
aauuaauaucccuacaugu

SEQ ID NO: 2360266 - RNA, 14 nt, Human
aauuaauagcuuuu

SEQ ID NO: 2360267 - RNA, 22 nt, Human
aauuaaucugggccagaauuuc

SEQ ID NO: 2360268 - RNA, 21 nt, Human
aauuaauaucccuacauguau

SEQ ID NO: 2360269 - RNA, 13 nt, Human
aauuaauagcuuu

SEQ ID NO: 2360270 - RNA, 16 nt, Human
aauuaaucaugaaugu

SEQ ID NO: 2360271 - RNA, 13 nt, Human
aauuaaugacaga

SEQ ID NO: 2360272 - RNA, 19 nt, Human
aauuaaugaaauaucugua

SEQ ID NO: 2360273 - RNA, 16 nt, Human
aauuaaugaaauaucu

SEQ ID NO: 2360274 - RNA, 17 nt, Human
aauuaaugaaauaucug

SEQ ID NO: 2360275 - RNA, 18 nt, Human
aauuaauuggcagcagau

SEQ ID NO: 2360276 - RNA, 13 nt, Human
aauuaauuggcag

SEQ ID NO: 2360277 - RNA, 17 nt, Human
aauuaauuggcagcaga

SEQ ID NO: 2360278 - RNA, 12 nt, Human
aauuaagaagaa

SEQ ID NO: 2360279 - RNA, 20 nt, Human
aauuaagaaaggauaaaguu

SEQ ID NO: 2360280 - RNA, 11 nt, Human
aauuaacuuga

SEQ ID NO: 2360281 - RNA, 15 nt, Human
aauuaacuugaguuu

SEQ ID NO: 2360282 - RNA, 17 nt, Human
aauuaacuugaguuuua

SEQ ID NO: 2360283 - RNA, 21 nt, Human
aauuaagaaaggauaaaguug

SEQ ID NO: 2360284 - RNA, 16 nt, Human
aauuaagaagaaacua

SEQ ID NO: 2360285 - RNA, 13 nt, Human
aauuaagaaggca

SEQ ID NO: 2360286 - RNA, 16 nt, Human
aauuaagaaggcaaaa

SEQ ID NO: 2360287 - RNA, 14 nt, Human
aauuaagaaggcaa

SEQ ID NO: 2360288 - RNA, 23 nt, Human
aauuaagaaggcaaaaauguaaa

SEQ ID NO: 2360289 - RNA, 19 nt, Human
aauuaagaaggcaaaaaug

SEQ ID NO: 2360290 - RNA, 17 nt, Human
aauuagguuuuguacaa

SEQ ID NO: 2360291 - RNA, 16 nt, Human
aauuagguuuuguaca

SEQ ID NO: 2360292 - RNA, 17 nt, Human
aauuaguaacauguguu

SEQ ID NO: 2360293 - RNA, 18 nt, Human
aauuaguauuuauuuaau

SEQ ID NO: 2360294 - RNA, 17 nt, Human
aauuaguauuuauuuaa

SEQ ID NO: 2360295 - RNA, 20 nt, Human
aauuagggguugcuaagaag

SEQ ID NO: 2360296 - RNA, 17 nt, Human
aauuagggguugcuaag

SEQ ID NO: 2360297 - RNA, 18 nt, Human
aauuauuauuuguguuuu

SEQ ID NO: 2360298 - RNA, 15 nt, Human
aauuauuauuugugu

SEQ ID NO: 2360299 - RNA, 16 nt, Human
aauuauuauuuguguu

SEQ ID NO: 2360300 - RNA, 16 nt, Human
aauuauuauuuggccc

SEQ ID NO: 2360301 - RNA, 22 nt, Human
aauuauuauuuauauauguauu

SEQ ID NO: 2360302 - RNA, 12 nt, Human
aauuauuauuug

SEQ ID NO: 2360303 - RNA, 20 nt, Human
aauuagugcuaagugugaac

SEQ ID NO: 2360304 - RNA, 21 nt, Human
aauuagugcuaagugugaacu

SEQ ID NO: 2360305 - RNA, 14 nt, Human
aauuagugcuaagu

SEQ ID NO: 2360306 - RNA, 18 nt, Human
aauuagugcuaaguguga

SEQ ID NO: 2360307 - RNA, 16 nt, Human
aauucaaaaaguguuu

SEQ ID NO: 2360308 - RNA, 20 nt, Human
aauucaaacuggggccucca

SEQ ID NO: 2360309 - RNA, 14 nt, Human
aauucaaagcucua

SEQ ID NO: 2360310 - RNA, 18 nt, Human
aauucaaagcucuauuaa

SEQ ID NO: 2360311 - RNA, 15 nt, Human
aauucaaaaaguguu

SEQ ID NO: 2360312 - RNA, 14 nt, Human
aauucaaaaagugu

SEQ ID NO: 2360313 - RNA, 17 nt, Human
aauuauuuuuacaguuc

SEQ ID NO: 2360314 - RNA, 20 nt, Human
aauuauuuugguacuuuuau

SEQ ID NO: 2360315 - RNA, 11 nt, Human
aauuauuuugg

SEQ ID NO: 2360316 - RNA, 18 nt, Human
aauuauuuuggauuuugu

SEQ ID NO: 2360317 - RNA, 19 nt, Human
aauuauuuugguacuuuua

SEQ ID NO: 2360318 - RNA, 15 nt, Human
aauucaacucagacu

SEQ ID NO: 2360319 - RNA, 18 nt, Human
aauucaacccuuugcccc

SEQ ID NO: 2360320 - RNA, 21 nt, Human
aauucaaccacuguaaaauga

SEQ ID NO: 2360321 - RNA, 14 nt, Human
aauucaacccuuug

SEQ ID NO: 2360322 - RNA, 14 nt, Human
aauucacaaacuuu

SEQ ID NO: 2360323 - RNA, 19 nt, Human
aauucacaaacuuuuauac

SEQ ID NO: 2360324 - RNA, 22 nt, Human
aauucacaucuaaccucaucuu

SEQ ID NO: 2360325 - RNA, 21 nt, Human
aauucacaucuaaccucaucu

SEQ ID NO: 2360326 - RNA, 13 nt, Human
aauucacucccac

SEQ ID NO: 2360327 - RNA, 21 nt, Human
aauucacccccuuuccuggac

SEQ ID NO: 2360328 - RNA, 17 nt, Human
aauucaccaaaguauuu

SEQ ID NO: 2360329 - RNA, 14 nt, Human
aauucaccaaagua

SEQ ID NO: 2360330 - RNA, 23 nt, Human
aauucacucccacacccaagaag

SEQ ID NO: 2360331 - RNA, 18 nt, Human
aauuccaagugauugaaa

SEQ ID NO: 2360332 - RNA, 16 nt, Human
aauucccauuuugcaa

SEQ ID NO: 2360333 - RNA, 22 nt, Human
aauucccauuuugcaaaauuuc

SEQ ID NO: 2360334 - RNA, 21 nt, Human
aauucccauuuugcaaaauuu

SEQ ID NO: 2360335 - RNA, 19 nt, Human
aauucccauuuugcaaaau

SEQ ID NO: 2360336 - RNA, 17 nt, Human
aauucccauuuugcaaa

SEQ ID NO: 2360337 - RNA, 16 nt, Human
aauuccaugaaucgcu

SEQ ID NO: 2360338 - RNA, 18 nt, Human
aauuccaugaaucgcuuc

SEQ ID NO: 2360339 - RNA, 10 nt, Human
aauuccauga

SEQ ID NO: 2360340 - RNA, 11 nt, Human
aauuccaugaa

SEQ ID NO: 2360341 - RNA, 14 nt, Human
aauuccccacccug

SEQ ID NO: 2360342 - RNA, 12 nt, Human
aauuccccagau

SEQ ID NO: 2360343 - RNA, 21 nt, Human
aauuccacuggacuugagcuu

SEQ ID NO: 2360344 - RNA, 14 nt, Human
aauuccacugucaa

SEQ ID NO: 2360345 - RNA, 22 nt, Human
aauuccacugucaagaaagagc

SEQ ID NO: 2360346 - RNA, 16 nt, Human
aauuccaauaugauga

SEQ ID NO: 2360347 - RNA, 22 nt, Human
aauuccacuuauaggaauugac

SEQ ID NO: 2360348 - RNA, 14 nt, Human
aauuccacuggacu

SEQ ID NO: 2360349 - RNA, 13 nt, Human
aauuccacuggac

SEQ ID NO: 2360350 - RNA, 12 nt, Human
aauuccaaggag

SEQ ID NO: 2360351 - RNA, 23 nt, Human
aauuccaaggaguuccaugaaga

SEQ ID NO: 2360352 - RNA, 14 nt, Human
aauuccaaaggaau

SEQ ID NO: 2360353 - RNA, 15 nt, Human
aauucauuuuuuuca

SEQ ID NO: 2360354 - RNA, 15 nt, Human
uaccuguauucccag

SEQ ID NO: 2360355 - RNA, 13 nt, Human
uaccugugaaaua

SEQ ID NO: 2360356 - RNA, 18 nt, Human
aauuaauuuuuuuauugu

SEQ ID NO: 2360357 - RNA, 21 nt, Human
aauuaauuuuuuuauuguuua

SEQ ID NO: 2360358 - RNA, 22 nt, Human
aauuaauuuuuuuauuguuuaa

SEQ ID NO: 2360359 - RNA, 23 nt, Human
aauuaauuuuuuuauuguuuaaa

SEQ ID NO: 2360360 - RNA, 23 nt, Human
aauuacaauugucauuuauaaaa

SEQ ID NO: 2360361 - RNA, 11 nt, Human
aauuacaggaa

SEQ ID NO: 2360362 - RNA, 17 nt, Human
aauuacuacaaaauuug

SEQ ID NO: 2360363 - RNA, 15 nt, Human
aauuacuacaaaauu

SEQ ID NO: 2360364 - RNA, 14 nt, Human
aauuacaauuguca

SEQ ID NO: 2360365 - RNA, 14 nt, Human
aauuacacccaaag

SEQ ID NO: 2360366 - RNA, 21 nt, Human
aauuaccuugagccaguaauu

SEQ ID NO: 2360367 - RNA, 21 nt, Human
aauuaccuuagauuagcucug

SEQ ID NO: 2360368 - RNA, 23 nt, Human
aauuaccuuagauuagcucugga

SEQ ID NO: 2360369 - RNA, 16 nt, Human
aauuagcugugugaaa

SEQ ID NO: 2360370 - RNA, 22 nt, Human
aauuaggaaguguaacagcuga

SEQ ID NO: 2360371 - RNA, 20 nt, Human
aauuaggaauaaauaaaaau

SEQ ID NO: 2360372 - RNA, 21 nt, Human
aauuaggaaguguaacagcug

SEQ ID NO: 2360373 - RNA, 17 nt, Human
aauuaggaagugauuau

SEQ ID NO: 2360374 - RNA, 16 nt, Human
aauuacuacaaaauuu

SEQ ID NO: 2360375 - RNA, 13 nt, Human
aauuacucaggaa

SEQ ID NO: 2360376 - RNA, 19 nt, Human
aauuacucaggaagaacac

SEQ ID NO: 2360377 - RNA, 14 nt, Human
aauuacugguccaa

SEQ ID NO: 2360378 - RNA, 15 nt, Human
aauuagccaagugug

SEQ ID NO: 2360379 - RNA, 14 nt, Human
aauuagccgggcgu

SEQ ID NO: 2360380 - RNA, 12 nt, Human
aauuagcaauug

SEQ ID NO: 2360381 - RNA, 14 nt, Human
uaccacucaggcca

SEQ ID NO: 2360382 - RNA, 13 nt, Human
uaccacuccugcc

SEQ ID NO: 2360383 - RNA, 10 nt, Human
uaccaccucc

SEQ ID NO: 2360384 - RNA, 19 nt, Human
uaccaccccuuccuguccc

SEQ ID NO: 2360385 - RNA, 19 nt, Human
uacauuggcugguaacagu

SEQ ID NO: 2360386 - RNA, 15 nt, Human
uaccacccaaugcug

SEQ ID NO: 2360387 - RNA, 14 nt, Human
uaccacccccacac

SEQ ID NO: 2360388 - RNA, 15 nt, Human
uaccacccccacacc

SEQ ID NO: 2360389 - RNA, 14 nt, Human
uaccaccccuuccu

SEQ ID NO: 2360390 - RNA, 15 nt, Human
uaccaccccuuccug

SEQ ID NO: 2360391 - RNA, 16 nt, Human
uaccaccccuuccugu

SEQ ID NO: 2360392 - RNA, 17 nt, Human
uaccaccccuuccuguc

SEQ ID NO: 2360393 - RNA, 18 nt, Human
uaccaccccuuccugucc

SEQ ID NO: 2360394 - RNA, 23 nt, Human
uaccugccaggaagccagcaggc

SEQ ID NO: 2360395 - RNA, 16 nt, Human
uaccugcccugacaug

SEQ ID NO: 2360396 - RNA, 18 nt, Human
uaccugccaggaagccag

SEQ ID NO: 2360397 - RNA, 20 nt, Human
uaccugccaggaagccagca

SEQ ID NO: 2360398 - RNA, 21 nt, Human
uaccuggguccuuuucagaag

SEQ ID NO: 2360399 - RNA, 17 nt, Human
uaccuggaggaggagca

SEQ ID NO: 2360400 - RNA, 14 nt, Human
uaccugggaagggg

SEQ ID NO: 2360401 - RNA, 20 nt, Human
uaccugggcauacuaauaaa

SEQ ID NO: 2360402 - RNA, 14 nt, Human
uaccugcucuccaa

SEQ ID NO: 2360403 - RNA, 23 nt, Human
uaccugcucuccaagucucagug

SEQ ID NO: 2360404 - RNA, 10 nt, Human
uaccuguccc

SEQ ID NO: 2360405 - RNA, 18 nt, Human
uaccugggugauuacaua

SEQ ID NO: 2360406 - RNA, 13 nt, Human
uaccugucccccu

SEQ ID NO: 2360407 - RNA, 14 nt, Human
uaccugucccccug

SEQ ID NO: 2360408 - RNA, 16 nt, Human
uaccugucccccugac

SEQ ID NO: 2360409 - RNA, 17 nt, Human
uaccugucccccugaca

SEQ ID NO: 2360410 - RNA, 13 nt, Human
uacguuuguaugu

SEQ ID NO: 2360411 - RNA, 14 nt, Human
uacguuuguaugug

SEQ ID NO: 2360412 - RNA, 20 nt, Human
uacguuuguauguguguaga

SEQ ID NO: 2360413 - RNA, 13 nt, Human
uacuacuccugua

SEQ ID NO: 2360414 - RNA, 17 nt, Human
uacuacuccuguaggaa

SEQ ID NO: 2360415 - RNA, 13 nt, Human
uacguuuuuguaa

SEQ ID NO: 2360416 - RNA, 16 nt, Human
uacuaaaaagaaggaa

SEQ ID NO: 2360417 - RNA, 23 nt, Human
uacuaaaaagaaggaaaaugauc

SEQ ID NO: 2360418 - RNA, 17 nt, Human
uacuaaaaagaaggaaa

SEQ ID NO: 2360419 - RNA, 16 nt, Human
uacuacuccuguaauu

SEQ ID NO: 2360420 - RNA, 20 nt, Human
uacuaucaugucaaacguga

SEQ ID NO: 2360421 - RNA, 14 nt, Human
uacuauauuuaugg

SEQ ID NO: 2360422 - RNA, 19 nt, Human
uacuauauaugugaugauc

SEQ ID NO: 2360423 - RNA, 22 nt, Human
uacuacuguggaaaaauauuua

SEQ ID NO: 2360424 - RNA, 20 nt, Human
uacuacuuuugcaugaaaau

SEQ ID NO: 2360425 - RNA, 12 nt, Human
uacuagaacaca

SEQ ID NO: 2360426 - RNA, 18 nt, Human
uacuagaacacagaaagc

SEQ ID NO: 2360427 - RNA, 14 nt, Human
uacuagaagaugaa

SEQ ID NO: 2360428 - RNA, 20 nt, Human
uacuacuguggaaaaauauu

SEQ ID NO: 2360429 - RNA, 16 nt, Human
uacuacugaaucucua

SEQ ID NO: 2360430 - RNA, 17 nt, Human
uacuacugaaucucuaa

SEQ ID NO: 2360431 - RNA, 13 nt, Human
uacuauguaucaa

SEQ ID NO: 2360432 - RNA, 12 nt, Human
uacuauguauca

SEQ ID NO: 2360433 - RNA, 17 nt, Human
uacuagaagaugaauac

SEQ ID NO: 2360434 - RNA, 17 nt, Human
uacuaucuacucuccuc

SEQ ID NO: 2360435 - RNA, 15 nt, Human
uacuaucuacucucc

SEQ ID NO: 2360436 - RNA, 23 nt, Human
uacuauggcccuggccuagcaua

SEQ ID NO: 2360437 - RNA, 23 nt, Human
uacucuccuggaaauauuaagaa

SEQ ID NO: 2360438 - RNA, 22 nt, Human
uacucuccuggaaauauuaaga

SEQ ID NO: 2360439 - RNA, 16 nt, Human
uacucuccucaucucu

SEQ ID NO: 2360440 - RNA, 14 nt, Human
uacucuccucaucu

SEQ ID NO: 2360441 - RNA, 14 nt, Human
uacuaugccugugu

SEQ ID NO: 2360442 - RNA, 13 nt, Human
uacuaugccugug

SEQ ID NO: 2360443 - RNA, 14 nt, Human
uacuauguaucaau

SEQ ID NO: 2360444 - RNA, 22 nt, Human
aauucccuaucuuuuaguuuua

SEQ ID NO: 2360445 - RNA, 10 nt, Human
aauucccuau

SEQ ID NO: 2360446 - RNA, 16 nt, Human
aauucccucucucuga

SEQ ID NO: 2360447 - RNA, 23 nt, Human
aauucccuaucuuuuaguuuuag

SEQ ID NO: 2360448 - RNA, 17 nt, Human
aauucccucucucugac

SEQ ID NO: 2360449 - RNA, 21 nt, Human
aauucccucucucugacucuc

SEQ ID NO: 2360450 - RNA, 23 nt, Human
aauucccucucucugacucucaa

SEQ ID NO: 2360451 - RNA, 19 nt, Human
aauucccuggccuuucaua

SEQ ID NO: 2360452 - RNA, 13 nt, Human
aauucccugcugu

SEQ ID NO: 2360453 - RNA, 14 nt, Human
aauucccugcuguc

SEQ ID NO: 2360454 - RNA, 22 nt, Human
aauuccuauacgcagcgugcuu

SEQ ID NO: 2360455 - RNA, 20 nt, Human
aauucccuggccuuucauau

SEQ ID NO: 2360456 - RNA, 13 nt, Human
aauuccucuggga

SEQ ID NO: 2360457 - RNA, 14 nt, Human
aauuccucugggaa

SEQ ID NO: 2360458 - RNA, 12 nt, Human
aauuccuauugu

SEQ ID NO: 2360459 - RNA, 15 nt, Human
aauuccuauugugau

SEQ ID NO: 2360460 - RNA, 16 nt, Human
aauuccuauugugauu

SEQ ID NO: 2360461 - RNA, 18 nt, Human
aauuccuauugugauuug

SEQ ID NO: 2360462 - RNA, 19 nt, Human
aauuccuauugugauuuga

SEQ ID NO: 2360463 - RNA, 20 nt, Human
aauuccuauugugauuugac

SEQ ID NO: 2360464 - RNA, 22 nt, Human
aauuccuauugugauuugacug

SEQ ID NO: 2360465 - RNA, 22 nt, Human
uacgccaggggaaaaucagccu

SEQ ID NO: 2360466 - RNA, 16 nt, Human
uacgauggcacccagu

SEQ ID NO: 2360467 - RNA, 18 nt, Human
uacgggaggguaaggcug

SEQ ID NO: 2360468 - RNA, 17 nt, Human
uacgccugcauguaaac

SEQ ID NO: 2360469 - RNA, 22 nt, Human
uacgcagcgugcuuuaaaaaau

SEQ ID NO: 2360470 - RNA, 21 nt, Human
aauuccucucacuaaacuuua

SEQ ID NO: 2360471 - RNA, 23 nt, Human
uacgcacuacaugugguuuauag

SEQ ID NO: 2360472 - RNA, 17 nt, Human
uacgcccaacccuuccc

SEQ ID NO: 2360473 - RNA, 19 nt, Human
uacgcccaacccuucccca

SEQ ID NO: 2360474 - RNA, 16 nt, Human
uacgccugccuccccu

SEQ ID NO: 2360475 - RNA, 13 nt, Human
uacgcuaguuauc

SEQ ID NO: 2360476 - RNA, 12 nt, Human
uacguacacauu

SEQ ID NO: 2360477 - RNA, 16 nt, Human
uacguugugcauuugg

SEQ ID NO: 2360478 - RNA, 15 nt, Human
uacguugugcauuug

SEQ ID NO: 2360479 - RNA, 14 nt, Human
uacguacacauuuu

SEQ ID NO: 2360480 - RNA, 13 nt, Human
uacguacacauuu

SEQ ID NO: 2360481 - RNA, 19 nt, Human
uacucugaagggcaucaug

SEQ ID NO: 2360482 - RNA, 22 nt, Human
uacucugaagggcaucaugcau

SEQ ID NO: 2360483 - RNA, 12 nt, Human
uacucugaaggg

SEQ ID NO: 2360484 - RNA, 19 nt, Human
uacucuccucggcccccuc

SEQ ID NO: 2360485 - RNA, 20 nt, Human
uacucuccucggcccccucc

SEQ ID NO: 2360486 - RNA, 17 nt, Human
uacucugguucuuuguu

SEQ ID NO: 2360487 - RNA, 15 nt, Human
uacucugucagaugg

SEQ ID NO: 2360488 - RNA, 15 nt, Human
uacucugguucuuug

SEQ ID NO: 2360489 - RNA, 14 nt, Human
uacuggagaagucu

SEQ ID NO: 2360490 - RNA, 16 nt, Human
uacuggagaaaaugga

SEQ ID NO: 2360491 - RNA, 17 nt, Human
uacuggaaguuuugcau

SEQ ID NO: 2360492 - RNA, 12 nt, Human
uacucuguguca

SEQ ID NO: 2360493 - RNA, 23 nt, Human
uacuggaaguuuugcauuuaugg

SEQ ID NO: 2360494 - RNA, 18 nt, Human
uacuggaaguuuugcauu

SEQ ID NO: 2360495 - RNA, 22 nt, Human
uacuggcaaaaggaucuuugug

SEQ ID NO: 2360496 - RNA, 18 nt, Human
uacuggcaaaaggaucuu

SEQ ID NO: 2360497 - RNA, 14 nt, Human
uacuggccucgccu

SEQ ID NO: 2360498 - RNA, 19 nt, Human
uacuggccucgccuggccu

SEQ ID NO: 2360499 - RNA, 21 nt, Human
uacuggccucgccuggccuga

SEQ ID NO: 2360500 - RNA, 18 nt, Human
uacuguaaggcaaucaug

SEQ ID NO: 2360501 - RNA, 14 nt, Human
uacuguaagaaaau

SEQ ID NO: 2360502 - RNA, 19 nt, Human
uacuguaaggcaaucaugg

SEQ ID NO: 2360503 - RNA, 18 nt, Human
uacuguaauuugugauac

SEQ ID NO: 2360504 - RNA, 20 nt, Human
uacuguaauuugugauacaa

SEQ ID NO: 2360505 - RNA, 19 nt, Human
uacuguaauuugugauaca

SEQ ID NO: 2360506 - RNA, 14 nt, Human
aauugacuuauuua

SEQ ID NO: 2360507 - RNA, 14 nt, Human
aauugacugucacu

SEQ ID NO: 2360508 - RNA, 22 nt, Human
aauugacccacaagaaaugaaa

SEQ ID NO: 2360509 - RNA, 15 nt, Human
uacuguaguuuuucu

SEQ ID NO: 2360510 - RNA, 13 nt, Human
uacuguaguuuuu

SEQ ID NO: 2360511 - RNA, 14 nt, Human
uacuguacuuaaua

SEQ ID NO: 2360512 - RNA, 12 nt, Human
uacuguaguuuu

SEQ ID NO: 2360513 - RNA, 21 nt, Human
aauugacccacaagaaaugaa

SEQ ID NO: 2360514 - RNA, 23 nt, Human
uacuguaauuugugauacaaugc

SEQ ID NO: 2360515 - RNA, 21 nt, Human
uacuguacaugaaaacacauu

SEQ ID NO: 2360516 - RNA, 14 nt, Human
uacuggcuggugau

SEQ ID NO: 2360517 - RNA, 18 nt, Human
uacuguacaugaaaacac

SEQ ID NO: 2360518 - RNA, 22 nt, Human
uacuguacaugaaaacacauuu

SEQ ID NO: 2360519 - RNA, 19 nt, Human
aauugaggucugcucggcc

SEQ ID NO: 2360520 - RNA, 14 nt, Human
aauugaggucugcu

SEQ ID NO: 2360521 - RNA, 15 nt, Human
aauugacucaaaucu

SEQ ID NO: 2360522 - RNA, 17 nt, Human
aauugaguuuucagugg

SEQ ID NO: 2360523 - RNA, 19 nt, Human
aauugaugggauuugguca

SEQ ID NO: 2360524 - RNA, 21 nt, Human
aauugaucauagguauuucaa

SEQ ID NO: 2360525 - RNA, 22 nt, Human
aauugaucauagguauuucaaa

SEQ ID NO: 2360526 - RNA, 13 nt, Human
aauugauguguuu

SEQ ID NO: 2360527 - RNA, 12 nt, Human
aauugcauuucc

SEQ ID NO: 2360528 - RNA, 14 nt, Human
aauugauguguuua

SEQ ID NO: 2360529 - RNA, 14 nt, Human
aauugccaaagcug

SEQ ID NO: 2360530 - RNA, 22 nt, Human
aauugaucauuuuccccccacu

SEQ ID NO: 2360531 - RNA, 12 nt, Human
aauugccauauu

SEQ ID NO: 2360532 - RNA, 13 nt, Human
aauugccauauug

SEQ ID NO: 2360533 - RNA, 15 nt, Human
aauugccauauugca

SEQ ID NO: 2360534 - RNA, 15 nt, Human
aauugccugacgaac

SEQ ID NO: 2360535 - RNA, 19 nt, Human
aauugccugcagagagaag

SEQ ID NO: 2360536 - RNA, 23 nt, Human
aauugccugacgaacuccuugau

SEQ ID NO: 2360537 - RNA, 16 nt, Human
aauugccauauugcac

SEQ ID NO: 2360538 - RNA, 17 nt, Human
aauugccauauugcaca

SEQ ID NO: 2360539 - RNA, 19 nt, Human
aauugccauauugcacaug

SEQ ID NO: 2360540 - RNA, 23 nt, Human
aauugccauauugcacaugucuu

SEQ ID NO: 2360541 - RNA, 14 nt, Human
uaugccucuccuuu

SEQ ID NO: 2360542 - RNA, 21 nt, Human
uaugccggaugugcuuuucuc

SEQ ID NO: 2360543 - RNA, 23 nt, Human
uaugccggaugugcuuuucucca

SEQ ID NO: 2360544 - RNA, 20 nt, Human
uaugccgaaugcccucaggg

SEQ ID NO: 2360545 - RNA, 15 nt, Human
uaugccggaugugcu

SEQ ID NO: 2360546 - RNA, 16 nt, Human
uaugccggaugugcuu

SEQ ID NO: 2360547 - RNA, 16 nt, Human
uaugccucuguauuua

SEQ ID NO: 2360548 - RNA, 20 nt, Human
uaugccucuccuuuguauau

SEQ ID NO: 2360549 - RNA, 21 nt, Human
uaugccucuccuuuguauauu

SEQ ID NO: 2360550 - RNA, 15 nt, Human
uaugccucuccuuug

SEQ ID NO: 2360551 - RNA, 17 nt, Human
uaugccucuccuuugua

SEQ ID NO: 2360552 - RNA, 18 nt, Human
uaugccucuccuuuguau

SEQ ID NO: 2360553 - RNA, 19 nt, Human
uaugccucuccuuuguaua

SEQ ID NO: 2360554 - RNA, 22 nt, Human
uaugcauuuaaauacagucuuc

SEQ ID NO: 2360555 - RNA, 21 nt, Human
uaugcauuuaaauacagucuu

SEQ ID NO: 2360556 - RNA, 14 nt, Human
uaugccaaagauca

SEQ ID NO: 2360557 - RNA, 19 nt, Human
uaugccccauucaacaucu

SEQ ID NO: 2360558 - RNA, 13 nt, Human
uaugcuaaucagg

SEQ ID NO: 2360559 - RNA, 16 nt, Human
uaugccuuuaaaucug

SEQ ID NO: 2360560 - RNA, 19 nt, Human
uaugccuucuuauugcuuu

SEQ ID NO: 2360561 - RNA, 20 nt, Human
uaugccuuuaaaucugugau

SEQ ID NO: 2360562 - RNA, 22 nt, Human
uaugccuuuaaaucugugauga

SEQ ID NO: 2360563 - RNA, 12 nt, Human
uaugccuguacu

SEQ ID NO: 2360564 - RNA, 10 nt, Human
uaugccugug

SEQ ID NO: 2360565 - RNA, 22 nt, Human
uaugccuguacucgcuugugca

SEQ ID NO: 2360566 - RNA, 14 nt, Human
uaugccuucuuauu

SEQ ID NO: 2360567 - RNA, 17 nt, Human
uaugccugggcagaagg

SEQ ID NO: 2360568 - RNA, 18 nt, Human
uaugaacggugagcauug

SEQ ID NO: 2360569 - RNA, 17 nt, Human
uaugaacauauuguuga

SEQ ID NO: 2360570 - RNA, 19 nt, Human
uaugaacauauuguugaaa

SEQ ID NO: 2360571 - RNA, 16 nt, Human
uaugauuaaguaauga

SEQ ID NO: 2360572 - RNA, 20 nt, Human
uaugauuaaguaaugauaac

SEQ ID NO: 2360573 - RNA, 24 nt, Human
uaugcauuugaaaauuuugauguu

SEQ ID NO: 2360574 - RNA, 23 nt, Human
uaugcauuugaaaauuuugaugu

SEQ ID NO: 2360575 - RNA, 11 nt, Human
uaugcauuuga

SEQ ID NO: 2360576 - RNA, 21 nt, Human
uaugauuaaguaaugauaacu

SEQ ID NO: 2360577 - RNA, 15 nt, Human
uaugcuuacugauau

SEQ ID NO: 2360578 - RNA, 15 nt, Human
uaugcuuauacacuu

SEQ ID NO: 2360579 - RNA, 16 nt, Human
uaugcuacuacaaaaa

SEQ ID NO: 2360580 - RNA, 16 nt, Human
uaugcugccaaauuuu

SEQ ID NO: 2360581 - RNA, 22 nt, Human
uaugcugccaaauuuuggccaa

SEQ ID NO: 2360582 - RNA, 20 nt, Human
uaugcugccaaauuuuggcc

SEQ ID NO: 2360583 - RNA, 17 nt, Human
uauggcuuuugugcauu

SEQ ID NO: 2360584 - RNA, 21 nt, Human
uaugcuuacugauauauuuua

SEQ ID NO: 2360585 - RNA, 16 nt, Human
uaugcuuacugauaua

SEQ ID NO: 2360586 - RNA, 17 nt, Human
uaugcuuaguaaugcua

SEQ ID NO: 2360587 - RNA, 21 nt, Human
uauggcuuuugugcauuaucu

SEQ ID NO: 2360588 - RNA, 18 nt, Human
uauggcuuuugugcauua

SEQ ID NO: 2360589 - RNA, 19 nt, Human
uauggggggccaacaccag

SEQ ID NO: 2360590 - RNA, 22 nt, Human
uaugggggccuggauucauuuc

SEQ ID NO: 2360591 - RNA, 20 nt, Human
uauggggcugaacggggaga

SEQ ID NO: 2360592 - RNA, 20 nt, Human
uauggggauagaugugugga

SEQ ID NO: 2360593 - RNA, 23 nt, Human
uauggcuuuugugcauuaucuag

SEQ ID NO: 2360594 - RNA, 23 nt, Human
uauggggggccaacaccagggau

SEQ ID NO: 2360595 - RNA, 22 nt, Human
uauggguguguguuugugugag

SEQ ID NO: 2360596 - RNA, 12 nt, Human
acagccuggcac

SEQ ID NO: 2360597 - RNA, 19 nt, Human
acagcggcuggacuuggag

SEQ ID NO: 2360598 - RNA, 21 nt, Human
acagccucugaccccuccuca

SEQ ID NO: 2360599 - RNA, 22 nt, Human
acagccucugaccccuccucac

SEQ ID NO: 2360600 - RNA, 23 nt, Human
acagccucugaccccuccucacu

SEQ ID NO: 2360601 - RNA, 13 nt, Human
acagccucugacu

SEQ ID NO: 2360602 - RNA, 20 nt, Human
acagccucugaccccuccuc

SEQ ID NO: 2360603 - RNA, 16 nt, Human
acagccucuuagaugc

SEQ ID NO: 2360604 - RNA, 18 nt, Human
acagaugccacacaagga

SEQ ID NO: 2360605 - RNA, 17 nt, Human
acagaugcaaugugcua

SEQ ID NO: 2360606 - RNA, 16 nt, Human
acagaugcaaugugcu

SEQ ID NO: 2360607 - RNA, 17 nt, Human
acagaugaauguauuua

SEQ ID NO: 2360608 - RNA, 14 nt, Human
acagaugaauguau

SEQ ID NO: 2360609 - RNA, 19 nt, Human
acagaugaaacacaaacaa

SEQ ID NO: 2360610 - RNA, 20 nt, Human
acagaugaaacacaaacaau

SEQ ID NO: 2360611 - RNA, 22 nt, Human
acagaucuggaaccucagccug

SEQ ID NO: 2360612 - RNA, 21 nt, Human
acagaucuggaaccucagccu

SEQ ID NO: 2360613 - RNA, 20 nt, Human
acagaucuggaaccucagcc

SEQ ID NO: 2360614 - RNA, 16 nt, Human
acagaucuggaaccuc

SEQ ID NO: 2360615 - RNA, 14 nt, Human
acagaucuggaacc

SEQ ID NO: 2360616 - RNA, 20 nt, Human
acagaugcaaugugcuacug

SEQ ID NO: 2360617 - RNA, 15 nt, Human
acagauuugagcuca

SEQ ID NO: 2360618 - RNA, 14 nt, Human
acagauuugagcuc

SEQ ID NO: 2360619 - RNA, 17 nt, Human
acagcaaggagauuuac

SEQ ID NO: 2360620 - RNA, 14 nt, Human
acagagacaccugc

SEQ ID NO: 2360621 - RNA, 14 nt, Human
acagagcccacgcc

SEQ ID NO: 2360622 - RNA, 15 nt, Human
acagagcccacgccc

SEQ ID NO: 2360623 - RNA, 18 nt, Human
acagagcccacgccccca

SEQ ID NO: 2360624 - RNA, 19 nt, Human
acagagcccacgcccccac

SEQ ID NO: 2360625 - RNA, 23 nt, Human
acagaucgaaccguuuugaagcu

SEQ ID NO: 2360626 - RNA, 18 nt, Human
acagauccccaagccugg

SEQ ID NO: 2360627 - RNA, 17 nt, Human
acagaucuccuggcaaa

SEQ ID NO: 2360628 - RNA, 12 nt, Human
acagaucuggaa

SEQ ID NO: 2360629 - RNA, 22 nt, Human
acagaucucugcuuuggaaauc

SEQ ID NO: 2360630 - RNA, 21 nt, Human
acagauaguaucuagcaauca

SEQ ID NO: 2360631 - RNA, 23 nt, Human
acagauagucaaaccauaaacuu

SEQ ID NO: 2360632 - RNA, 13 nt, Human
acagauaguugug

SEQ ID NO: 2360633 - RNA, 14 nt, Human
acagaucaagcugu

SEQ ID NO: 2360634 - RNA, 17 nt, Human
acagauauaaauggcug

SEQ ID NO: 2360635 - RNA, 17 nt, Human
acagauccccaagccug

SEQ ID NO: 2360636 - RNA, 14 nt, Human
acagauauaaaugg

SEQ ID NO: 2360637 - RNA, 15 nt, Human
acagaucaagcugug

SEQ ID NO: 2360638 - RNA, 16 nt, Human
acagaucaagcuguga

SEQ ID NO: 2360639 - RNA, 18 nt, Human
acagaucaagcugugaga

SEQ ID NO: 2360640 - RNA, 18 nt, Human
acagccgcuccugucugc

SEQ ID NO: 2360641 - RNA, 14 nt, Human
acagccgcuccugu

SEQ ID NO: 2360642 - RNA, 23 nt, Human
acagccgcagccucccucugacc

SEQ ID NO: 2360643 - RNA, 20 nt, Human
acagcccgggcucugccucc

SEQ ID NO: 2360644 - RNA, 23 nt, Human
acagcaaggaggcuggcuggggc

SEQ ID NO: 2360645 - RNA, 16 nt, Human
acagcaaggcaccugc

SEQ ID NO: 2360646 - RNA, 18 nt, Human
acagcaaggcaccugcag

SEQ ID NO: 2360647 - RNA, 22 nt, Human
acagccgcagccucccucugac

SEQ ID NO: 2360648 - RNA, 18 nt, Human
acagcccgggcucugccu

SEQ ID NO: 2360649 - RNA, 19 nt, Human
acagcccgggcucugccuc

SEQ ID NO: 2360650 - RNA, 16 nt, Human
acagcaaggagauuua

SEQ ID NO: 2360651 - RNA, 16 nt, Human
acagcaaggaggcugg

SEQ ID NO: 2360652 - RNA, 17 nt, Human
acagcaaggaggcuggc

SEQ ID NO: 2360653 - RNA, 21 nt, Human
acagcaaggagauuuacaacu

SEQ ID NO: 2360654 - RNA, 17 nt, Human
acagcccgggcucugcc

SEQ ID NO: 2360655 - RNA, 18 nt, Human
acagcaagggugauggga

SEQ ID NO: 2360656 - RNA, 18 nt, Human
acagcaaggaggcuggcu

SEQ ID NO: 2360657 - RNA, 19 nt, Human
acagcaaggaggcuggcug

SEQ ID NO: 2360658 - RNA, 20 nt, Human
acagcaaggaggcuggcugg

SEQ ID NO: 2360659 - RNA, 21 nt, Human
acagcaaggaggcuggcuggg

SEQ ID NO: 2360660 - RNA, 17 nt, Human
acagccucacagaagaa

SEQ ID NO: 2360661 - RNA, 20 nt, Human
acagccgucagccaaaugua

SEQ ID NO: 2360662 - RNA, 18 nt, Human
acagccucacuugaaugu

SEQ ID NO: 2360663 - RNA, 14 nt, Human
acagccucacagaa

SEQ ID NO: 2360664 - RNA, 19 nt, Human
uaucuuugauucuccuuca

SEQ ID NO: 2360665 - RNA, 22 nt, Human
uaucuuugauucuccuucagcc

SEQ ID NO: 2360666 - RNA, 11 nt, Human
uaucuuugcca

SEQ ID NO: 2360667 - RNA, 16 nt, Human
uaucuuugccacccuc

SEQ ID NO: 2360668 - RNA, 14 nt, Human
uaucuuugccaccc

SEQ ID NO: 2360669 - RNA, 24 nt, Human
acagccgcuccugucugccagcca

SEQ ID NO: 2360670 - RNA, 23 nt, Human
acagccgcuccugucugccagcc

SEQ ID NO: 2360671 - RNA, 20 nt, Human
acagccgcuccugucugcca

SEQ ID NO: 2360672 - RNA, 19 nt, Human
acagccgcuccugucugcc

SEQ ID NO: 2360673 - RNA, 17 nt, Human
acagccgucagccaaau

SEQ ID NO: 2360674 - RNA, 19 nt, Human
acagccgucagccaaaugu

SEQ ID NO: 2360675 - RNA, 18 nt, Human
acagccguuuguucccca

SEQ ID NO: 2360676 - RNA, 23 nt, Human
uaucuuuucuauuguuuauucuu

SEQ ID NO: 2360677 - RNA, 22 nt, Human
uaucuuugccacccucaugcug

SEQ ID NO: 2360678 - RNA, 22 nt, Human
uaucuuuuugcuuacaguuuua

SEQ ID NO: 2360679 - RNA, 19 nt, Human
uaucuuuugaccuguggug

SEQ ID NO: 2360680 - RNA, 13 nt, Human
uaucuuuugaccu

SEQ ID NO: 2360681 - RNA, 14 nt, Human
uaugaacauauugu

SEQ ID NO: 2360682 - RNA, 20 nt, Human
uaugaaauuuaauauagcua

SEQ ID NO: 2360683 - RNA, 15 nt, Human
uaucuuuuuucaaaa

SEQ ID NO: 2360684 - RNA, 22 nt, Human
uaugaaauuuaauauagcuauu

SEQ ID NO: 2360685 - RNA, 21 nt, Human
uaucuuuuuuuuauuccacau

SEQ ID NO: 2360686 - RNA, 15 nt, Human
uaucuccaagaccag

SEQ ID NO: 2360687 - RNA, 11 nt, Human
uaucucaucuc

SEQ ID NO: 2360688 - RNA, 18 nt, Human
uaucucagucaugcauaa

SEQ ID NO: 2360689 - RNA, 23 nt, Human
uaucuccaggauugaagagcauu

SEQ ID NO: 2360690 - RNA, 13 nt, Human
uaucucccccagc

SEQ ID NO: 2360691 - RNA, 14 nt, Human
uaucucccccagcc

SEQ ID NO: 2360692 - RNA, 22 nt, Human
uaucucagucaugcauaaauau

SEQ ID NO: 2360693 - RNA, 17 nt, Human
uaucucaaaacugcacu

SEQ ID NO: 2360694 - RNA, 13 nt, Human
uaucuaucuuaua

SEQ ID NO: 2360695 - RNA, 14 nt, Human
uaucuauauuuuug

SEQ ID NO: 2360696 - RNA, 16 nt, Human
acagagaaggcaggaa

SEQ ID NO: 2360697 - RNA, 14 nt, Human
acagagaaggcagg

SEQ ID NO: 2360698 - RNA, 15 nt, Human
acagagaaggcagga

SEQ ID NO: 2360699 - RNA, 11 nt, Human
acagagaaagu

SEQ ID NO: 2360700 - RNA, 18 nt, Human
acagagaaaguacuucuc

SEQ ID NO: 2360701 - RNA, 17 nt, Human
acagagaaagagagaga

SEQ ID NO: 2360702 - RNA, 19 nt, Human
acagagaaagaggaagcuu

SEQ ID NO: 2360703 - RNA, 14 nt, Human
acagagaaccugga

SEQ ID NO: 2360704 - RNA, 18 nt, Human
acagagaacuaacacuau

SEQ ID NO: 2360705 - RNA, 16 nt, Human
acagagaagacaaaau

SEQ ID NO: 2360706 - RNA, 19 nt, Human
acagagaacuaacacuauu

SEQ ID NO: 2360707 - RNA, 16 nt, Human
uauccggacuccugcc

SEQ ID NO: 2360708 - RNA, 14 nt, Human
uaucccuuccuuuu

SEQ ID NO: 2360709 - RNA, 11 nt, Human
uauccaggacu

SEQ ID NO: 2360710 - RNA, 20 nt, Human
uauccacccagcccauucuc

SEQ ID NO: 2360711 - RNA, 19 nt, Human
uauccacccagcccauucu

SEQ ID NO: 2360712 - RNA, 18 nt, Human
uauccacuuugcacagcu

SEQ ID NO: 2360713 - RNA, 15 nt, Human
uauccacuuugcaca

SEQ ID NO: 2360714 - RNA, 11 nt, Human
uauccagucua

SEQ ID NO: 2360715 - RNA, 17 nt, Human
uauccauauugagucaa

SEQ ID NO: 2360716 - RNA, 18 nt, Human
uauccagguaauccaaga

SEQ ID NO: 2360717 - RNA, 21 nt, Human
uauccagguaauccaagauau

SEQ ID NO: 2360718 - RNA, 16 nt, Human
uaucauuuaauaauau

SEQ ID NO: 2360719 - RNA, 23 nt, Human
uaucaagccaguacgugcuaaca

SEQ ID NO: 2360720 - RNA, 15 nt, Human
uaucaagcagccaag

SEQ ID NO: 2360721 - RNA, 21 nt, Human
uaucaacacuguuacuuucgu

SEQ ID NO: 2360722 - RNA, 21 nt, Human
uauauuuauaacucaucauaa

SEQ ID NO: 2360723 - RNA, 12 nt, Human
uaucaagaaagu

SEQ ID NO: 2360724 - RNA, 21 nt, Human
uaucauuuucugcauuuaacc

SEQ ID NO: 2360725 - RNA, 14 nt, Human
uaucauuuucugca

SEQ ID NO: 2360726 - RNA, 17 nt, Human
uaucauuuuagaagacu

SEQ ID NO: 2360727 - RNA, 20 nt, Human
uaucauuuauuuuuuacauu

SEQ ID NO: 2360728 - RNA, 22 nt, Human
uaucauuuaauaauauacuugu

SEQ ID NO: 2360729 - RNA, 18 nt, Human
uaucauuuaauaauauac

SEQ ID NO: 2360730 - RNA, 19 nt, Human
uaucauuuaauaauauacu

SEQ ID NO: 2360731 - RNA, 20 nt, Human
uaucauuuaauaauauacuu

SEQ ID NO: 2360732 - RNA, 21 nt, Human
uaucauuuaauaauauacuug

SEQ ID NO: 2360733 - RNA, 19 nt, Human
uauccaaaccaaauaaaaa

SEQ ID NO: 2360734 - RNA, 13 nt, Human
uauccaaaagcuu

SEQ ID NO: 2360735 - RNA, 15 nt, Human
uaucauuuuuguaca

SEQ ID NO: 2360736 - RNA, 17 nt, Human
uaucauuuuuguacagu

SEQ ID NO: 2360737 - RNA, 21 nt, Human
uaucauuuuuguacaguuugc

SEQ ID NO: 2360738 - RNA, 22 nt, Human
uaucauuuuuguacaguuugcu

SEQ ID NO: 2360739 - RNA, 16 nt, Human
uauauuuaguuauagu

SEQ ID NO: 2360740 - RNA, 18 nt, Human
uauauuuaguuauaguuu

SEQ ID NO: 2360741 - RNA, 21 nt, Human
uauauuuagauuguuaaaaua

SEQ ID NO: 2360742 - RNA, 16 nt, Human
uauauuuauaacucau

SEQ ID NO: 2360743 - RNA, 15 nt, Human
uauauuuauaacuca

SEQ ID NO: 2360744 - RNA, 14 nt, Human
uauauuuauaacuc

SEQ ID NO: 2360745 - RNA, 12 nt, Human
uauauuuauaac

SEQ ID NO: 2360746 - RNA, 16 nt, Human
uauauuuaguaucuuu

SEQ ID NO: 2360747 - RNA, 19 nt, Human
uauauugucagauauuuuu

SEQ ID NO: 2360748 - RNA, 19 nt, Human
uauauuguguuuguguauu

SEQ ID NO: 2360749 - RNA, 15 nt, Human
uauauuguuugcuaa

SEQ ID NO: 2360750 - RNA, 19 nt, Human
uauauuguaagaaauacug

SEQ ID NO: 2360751 - RNA, 15 nt, Human
uauauuguaagaaau

SEQ ID NO: 2360752 - RNA, 12 nt, Human
uauauuguaaga

SEQ ID NO: 2360753 - RNA, 22 nt, Human
uauauuguaagaaauacuguac

SEQ ID NO: 2360754 - RNA, 20 nt, Human
uauauuguaagaaauacugu

SEQ ID NO: 2360755 - RNA, 18 nt, Human
uauauuguguuuguguau

SEQ ID NO: 2360756 - RNA, 20 nt, Human
uauauuaucaugcaaaugcu

SEQ ID NO: 2360757 - RNA, 14 nt, Human
uauauuaucaugca

SEQ ID NO: 2360758 - RNA, 23 nt, Human
uauauuagcauuuaguccaaugu

SEQ ID NO: 2360759 - RNA, 16 nt, Human
uauauuagcauuuagu

SEQ ID NO: 2360760 - RNA, 22 nt, Human
uauauuacuagcauaugaguuu

SEQ ID NO: 2360761 - RNA, 22 nt, Human
acagaccacaucuuuaucuguu

SEQ ID NO: 2360762 - RNA, 13 nt, Human
acagacccugccc

SEQ ID NO: 2360763 - RNA, 14 nt, Human
acagacccugcccu

SEQ ID NO: 2360764 - RNA, 11 nt, Human
acagacauugu

SEQ ID NO: 2360765 - RNA, 12 nt, Human
acagacauuguu

SEQ ID NO: 2360766 - RNA, 16 nt, Human
acagacauuguuuugc

SEQ ID NO: 2360767 - RNA, 20 nt, Human
acagaccacaucuuuaucug

SEQ ID NO: 2360768 - RNA, 21 nt, Human
acagaccacaucuuuaucugu

SEQ ID NO: 2360769 - RNA, 15 nt, Human
acagacccugcccug

SEQ ID NO: 2360770 - RNA, 17 nt, Human
acagaaauuagccgggc

SEQ ID NO: 2360771 - RNA, 17 nt, Human
acagaaauguacagcaa

SEQ ID NO: 2360772 - RNA, 16 nt, Human
acagaaauguacagca

SEQ ID NO: 2360773 - RNA, 14 nt, Human
acagaaauguacag

SEQ ID NO: 2360774 - RNA, 20 nt, Human
acagaaaauggaagacagcu

SEQ ID NO: 2360775 - RNA, 21 nt, Human
acagaaaauauacuguaaaga

SEQ ID NO: 2360776 - RNA, 20 nt, Human
acagaaaauauacuguaaag

SEQ ID NO: 2360777 - RNA, 19 nt, Human
acagaaaauauacuguaaa

SEQ ID NO: 2360778 - RNA, 18 nt, Human
acagaaaauauacuguaa

SEQ ID NO: 2360779 - RNA, 17 nt, Human
acagaaaauucuucucc

SEQ ID NO: 2360780 - RNA, 19 nt, Human
uauaauuuuuuagagagcu

SEQ ID NO: 2360781 - RNA, 19 nt, Human
uauaauuuuuaaaguauau

SEQ ID NO: 2360782 - RNA, 16 nt, Human
uauaaguuugaaggaa

SEQ ID NO: 2360783 - RNA, 20 nt, Human
uauaauuuuuuuauuacuga

SEQ ID NO: 2360784 - RNA, 18 nt, Human
uauaauuuuuuucaauau

SEQ ID NO: 2360785 - RNA, 15 nt, Human
uauaauuuuuuaaag

SEQ ID NO: 2360786 - RNA, 21 nt, Human
uauaauuuuuuucaauauuua

SEQ ID NO: 2360787 - RNA, 12 nt, Human
uauacaacagug

SEQ ID NO: 2360788 - RNA, 17 nt, Human
acagaaaauauacugua

SEQ ID NO: 2360789 - RNA, 13 nt, Human
uauacaacagugc

SEQ ID NO: 2360790 - RNA, 16 nt, Human
acagaaaauauacugu

SEQ ID NO: 2360791 - RNA, 17 nt, Human
uauacaaauuagaaaau

SEQ ID NO: 2360792 - RNA, 18 nt, Human
uauacaaauuagaaaaug

SEQ ID NO: 2360793 - RNA, 16 nt, Human
uauacaaauuagaaaa

SEQ ID NO: 2360794 - RNA, 14 nt, Human
uauacaaauuagaa

SEQ ID NO: 2360795 - RNA, 13 nt, Human
uauacaaauuaga

SEQ ID NO: 2360796 - RNA, 17 nt, Human
uauaaguguguguuuuu

SEQ ID NO: 2360797 - RNA, 23 nt, Human
uauaaguguguguuuuucauaaa

SEQ ID NO: 2360798 - RNA, 18 nt, Human
uauaaguguacauaugug

SEQ ID NO: 2360799 - RNA, 15 nt, Human
uauaaguguacauau

SEQ ID NO: 2360800 - RNA, 12 nt, Human
uauaaguuucuu

SEQ ID NO: 2360801 - RNA, 13 nt, Human
uauaaguuugaag

SEQ ID NO: 2360802 - RNA, 12 nt, Human
uauaauaaaagg

SEQ ID NO: 2360803 - RNA, 14 nt, Human
uaugugaacauuua

SEQ ID NO: 2360804 - RNA, 12 nt, Human
uaugugaaugau

SEQ ID NO: 2360805 - RNA, 21 nt, Human
uaugugaauccucuucuuuau

SEQ ID NO: 2360806 - RNA, 22 nt, Human
uaugugaauauggacucaguuu

SEQ ID NO: 2360807 - RNA, 19 nt, Human
uaugugacaauuuuguaca

SEQ ID NO: 2360808 - RNA, 22 nt, Human
uaugugaaugaucucucugaau

SEQ ID NO: 2360809 - RNA, 17 nt, Human
uaugugaaacauguuuc

SEQ ID NO: 2360810 - RNA, 13 nt, Human
uaugugagugugu

SEQ ID NO: 2360811 - RNA, 23 nt, Human
uaugugccagauuuaugcauauu

SEQ ID NO: 2360812 - RNA, 20 nt, Human
uauguggaguucaucuugaa

SEQ ID NO: 2360813 - RNA, 16 nt, Human
uauguggaaguguggg

SEQ ID NO: 2360814 - RNA, 12 nt, Human
uauguggaagug

SEQ ID NO: 2360815 - RNA, 15 nt, Human
acaggcauguucucu

SEQ ID NO: 2360816 - RNA, 18 nt, Human
acaggcauguucucugag

SEQ ID NO: 2360817 - RNA, 19 nt, Human
acaggcauguucucugagg

SEQ ID NO: 2360818 - RNA, 20 nt, Human
acaggcauguucucugagga

SEQ ID NO: 2360819 - RNA, 22 nt, Human
acaggcauguucucugaggaca

SEQ ID NO: 2360820 - RNA, 14 nt, Human
uaugugaaacaugu

SEQ ID NO: 2360821 - RNA, 14 nt, Human
uaugucuuggacac

SEQ ID NO: 2360822 - RNA, 17 nt, Human
uaugucuuggacacugu

SEQ ID NO: 2360823 - RNA, 19 nt, Human
uaugucuuggacacuguac

SEQ ID NO: 2360824 - RNA, 21 nt, Human
uaugucuuggacacuguacaa

SEQ ID NO: 2360825 - RNA, 16 nt, Human
uauuaaaacucauuuu

SEQ ID NO: 2360826 - RNA, 12 nt, Human
uauuaaaaauau

SEQ ID NO: 2360827 - RNA, 13 nt, Human
uauuaaaaauaua

SEQ ID NO: 2360828 - RNA, 14 nt, Human
uauuaaaaauauaa

SEQ ID NO: 2360829 - RNA, 15 nt, Human
uauuaaaaauauaaa

SEQ ID NO: 2360830 - RNA, 18 nt, Human
uauuaaaaauauaaaacu

SEQ ID NO: 2360831 - RNA, 19 nt, Human
uauuaaaaauauaaaacug

SEQ ID NO: 2360832 - RNA, 21 nt, Human
uauuaaaaauauaaaacugcg

SEQ ID NO: 2360833 - RNA, 14 nt, Human
uauguuuuugugua

SEQ ID NO: 2360834 - RNA, 18 nt, Human
uauguuuuuguguauuug

SEQ ID NO: 2360835 - RNA, 16 nt, Human
uauguuuuuguucaaa

SEQ ID NO: 2360836 - RNA, 16 nt, Human
uauguuuuugaaggca

SEQ ID NO: 2360837 - RNA, 14 nt, Human
uauguuuuugaagg

SEQ ID NO: 2360838 - RNA, 15 nt, Human
uauguuuuuuuucug

SEQ ID NO: 2360839 - RNA, 22 nt, Human
uauguuuuuuuucugcuggaaa

SEQ ID NO: 2360840 - RNA, 14 nt, Human
uauuaaaaaaaaca

SEQ ID NO: 2360841 - RNA, 23 nt, Human
uauuaaaaaaaacaaaaagaaca

SEQ ID NO: 2360842 - RNA, 13 nt, Human
uauuaaaaaacaa

SEQ ID NO: 2360843 - RNA, 23 nt, Human
uauguuuuuuagaucaaauacuu

SEQ ID NO: 2360844 - RNA, 17 nt, Human
uauguuuuuuagaucaa

SEQ ID NO: 2360845 - RNA, 19 nt, Human
uauguuuuuuagaucaaau

SEQ ID NO: 2360846 - RNA, 17 nt, Human
uauguuuuuuaaaauau

SEQ ID NO: 2360847 - RNA, 15 nt, Human
uauguuuuuguucaa

SEQ ID NO: 2360848 - RNA, 17 nt, Human
uaugugggcagauuuuc

SEQ ID NO: 2360849 - RNA, 23 nt, Human
uaugugggcagauuuucagcaaa

SEQ ID NO: 2360850 - RNA, 14 nt, Human
uauguguaaauaca

SEQ ID NO: 2360851 - RNA, 15 nt, Human
uaugugugaggagcu

SEQ ID NO: 2360852 - RNA, 13 nt, Human
uauguguauguac

SEQ ID NO: 2360853 - RNA, 12 nt, Human
uauguguaugua

SEQ ID NO: 2360854 - RNA, 21 nt, Human
uaugugugaggagcugcuggc

SEQ ID NO: 2360855 - RNA, 16 nt, Human
uaugugugaggagcug

SEQ ID NO: 2360856 - RNA, 14 nt, Human
uauguguguagaca

SEQ ID NO: 2360857 - RNA, 21 nt, Human
uauguuuucaggcuagaugua

SEQ ID NO: 2360858 - RNA, 20 nt, Human
uauguuuugguaucuguucu

SEQ ID NO: 2360859 - RNA, 14 nt, Human
uauguuuugguauc

SEQ ID NO: 2360860 - RNA, 18 nt, Human
uauguuuugguaucuguu

SEQ ID NO: 2360861 - RNA, 22 nt, Human
uauguuuugacauuuuuaguuu

SEQ ID NO: 2360862 - RNA, 12 nt, Human
uauguuuuggua

SEQ ID NO: 2360863 - RNA, 17 nt, Human
acaggacagugcuucag

SEQ ID NO: 2360864 - RNA, 16 nt, Human
acaggacacagucaga

SEQ ID NO: 2360865 - RNA, 15 nt, Human
acaggacacagucag

SEQ ID NO: 2360866 - RNA, 14 nt, Human
acaggacacaguca

SEQ ID NO: 2360867 - RNA, 19 nt, Human
acaggaaucaagagcugcc

SEQ ID NO: 2360868 - RNA, 22 nt, Human
acaggacagugcuucagccuga

SEQ ID NO: 2360869 - RNA, 20 nt, Human
acaggacagugcuucagccu

SEQ ID NO: 2360870 - RNA, 22 nt, Human
acaggacaugcgguagccagca

SEQ ID NO: 2360871 - RNA, 23 nt, Human
acaggaccagggauuuccaugau

SEQ ID NO: 2360872 - RNA, 14 nt, Human
acaggacucugccu

SEQ ID NO: 2360873 - RNA, 18 nt, Human
acaggagggcaagggcca

SEQ ID NO: 2360874 - RNA, 14 nt, Human
acaggaccagauuu

SEQ ID NO: 2360875 - RNA, 17 nt, Human
acaggacccccuucccc

SEQ ID NO: 2360876 - RNA, 14 nt, Human
acaggacccccuuc

SEQ ID NO: 2360877 - RNA, 14 nt, Human
acaggcauguucuc

SEQ ID NO: 2360878 - RNA, 19 nt, Human
acaggauaaagauaucaau

SEQ ID NO: 2360879 - RNA, 19 nt, Human
acaggcaguuacuucugag

SEQ ID NO: 2360880 - RNA, 14 nt, Human
acaggcagguccag

SEQ ID NO: 2360881 - RNA, 16 nt, Human
acaggcagguccaggg

SEQ ID NO: 2360882 - RNA, 16 nt, Human
acaggagugagcacua

SEQ ID NO: 2360883 - RNA, 14 nt, Human
acaggaucagucug

SEQ ID NO: 2360884 - RNA, 13 nt, Human
acaggcaggucca

SEQ ID NO: 2360885 - RNA, 15 nt, Human
acagcuuugcugcug

SEQ ID NO: 2360886 - RNA, 15 nt, Human
acagcuuugugacug

SEQ ID NO: 2360887 - RNA, 21 nt, Human
acagcuuugcugcugaaggcu

SEQ ID NO: 2360888 - RNA, 19 nt, Human
acagcuuugugacuguaua

SEQ ID NO: 2360889 - RNA, 20 nt, Human
acagcuuugugacuguauau

SEQ ID NO: 2360890 - RNA, 21 nt, Human
acagcuuugugacuguauaua

SEQ ID NO: 2360891 - RNA, 23 nt, Human
acagcuuugugacuguauauaaa

SEQ ID NO: 2360892 - RNA, 20 nt, Human
acagcuuucaugauuagcaa

SEQ ID NO: 2360893 - RNA, 12 nt, Human
acagcuuugcug

SEQ ID NO: 2360894 - RNA, 11 nt, Human
acagcuuugcu

SEQ ID NO: 2360895 - RNA, 17 nt, Human
acagcuuuaucaccaga

SEQ ID NO: 2360896 - RNA, 15 nt, Human
acagcuuguauuuug

SEQ ID NO: 2360897 - RNA, 18 nt, Human
acagcuaacacacagcuc

SEQ ID NO: 2360898 - RNA, 19 nt, Human
acagcuaacacacagcucc

SEQ ID NO: 2360899 - RNA, 16 nt, Human
acagcggggccccagg

SEQ ID NO: 2360900 - RNA, 15 nt, Human
acagccugcaaguca

SEQ ID NO: 2360901 - RNA, 22 nt, Human
acagcggcuggacuuggaggua

SEQ ID NO: 2360902 - RNA, 11 nt, Human
acagccuggca

SEQ ID NO: 2360903 - RNA, 21 nt, Human
acagcggcuggacuuggaggu

SEQ ID NO: 2360904 - RNA, 16 nt, Human
acagcguuuaagacug

SEQ ID NO: 2360905 - RNA, 17 nt, Human
acagcguuuaagacugu

SEQ ID NO: 2360906 - RNA, 19 nt, Human
acagcuaacaauugugaag

SEQ ID NO: 2360907 - RNA, 15 nt, Human
acagcuaacacacag

SEQ ID NO: 2360908 - RNA, 13 nt, Human
acagcuaacaugg

SEQ ID NO: 2360909 - RNA, 17 nt, Human
acaggaagucuucaggg

SEQ ID NO: 2360910 - RNA, 20 nt, Human
acaggaagguggugcuuaca

SEQ ID NO: 2360911 - RNA, 15 nt, Human
acaggaagugaagaa

SEQ ID NO: 2360912 - RNA, 20 nt, Human
acaggaagcaccccaugcca

SEQ ID NO: 2360913 - RNA, 15 nt, Human
acaggaagcacccca

SEQ ID NO: 2360914 - RNA, 17 nt, Human
acaggaaguagaggagg

SEQ ID NO: 2360915 - RNA, 10 nt, Human
acaggaagau

SEQ ID NO: 2360916 - RNA, 17 nt, Human
acaggaagaucuuaaau

SEQ ID NO: 2360917 - RNA, 18 nt, Human
acaggaagaucuuaaauu

SEQ ID NO: 2360918 - RNA, 22 nt, Human
acaggaagaucuuaaauuuugu

SEQ ID NO: 2360919 - RNA, 13 nt, Human
acaggaaguacug

SEQ ID NO: 2360920 - RNA, 15 nt, Human
acaggaaaagcugcu

SEQ ID NO: 2360921 - RNA, 16 nt, Human
acaggaaaagcugcug

SEQ ID NO: 2360922 - RNA, 17 nt, Human
acaggaaaagcugcuga

SEQ ID NO: 2360923 - RNA, 16 nt, Human
uauucaauauccuuug

SEQ ID NO: 2360924 - RNA, 21 nt, Human
uauucaauaaaguauuuaauu

SEQ ID NO: 2360925 - RNA, 19 nt, Human
uauucaauaaaguauuuaa

SEQ ID NO: 2360926 - RNA, 20 nt, Human
uauucaauaaaguauuuaau

SEQ ID NO: 2360927 - RNA, 15 nt, Human
uauucaauaaaguau

SEQ ID NO: 2360928 - RNA, 17 nt, Human
uauucaauaaaguauuu

SEQ ID NO: 2360929 - RNA, 14 nt, Human
uauucaauaaagua

SEQ ID NO: 2360930 - RNA, 14 nt, Human
uauucaauuccucu

SEQ ID NO: 2360931 - RNA, 15 nt, Human
uauucaauuccucug

SEQ ID NO: 2360932 - RNA, 16 nt, Human
uauucaauuccucugg

SEQ ID NO: 2360933 - RNA, 17 nt, Human
uauucaauuccucuggg

SEQ ID NO: 2360934 - RNA, 18 nt, Human
uauucaauuccucuggga

SEQ ID NO: 2360935 - RNA, 21 nt, Human
uauucagcuucauuuguguca

SEQ ID NO: 2360936 - RNA, 17 nt, Human
uauucagcuucauuugu

SEQ ID NO: 2360937 - RNA, 19 nt, Human
uauucagcuucauuugugu

SEQ ID NO: 2360938 - RNA, 14 nt, Human
uauucagcuucauu

SEQ ID NO: 2360939 - RNA, 16 nt, Human
uauucagcuucauuug

SEQ ID NO: 2360940 - RNA, 21 nt, Human
uauucagcucauggacuucug

SEQ ID NO: 2360941 - RNA, 22 nt, Human
uauucagugcuguggccugggc

SEQ ID NO: 2360942 - RNA, 18 nt, Human
uauucagugcuguggccu

SEQ ID NO: 2360943 - RNA, 15 nt, Human
uauucagugcugugg

SEQ ID NO: 2360944 - RNA, 20 nt, Human
uauucaguaauaacucuacc

SEQ ID NO: 2360945 - RNA, 14 nt, Human
uauucaguaaaaaa

SEQ ID NO: 2360946 - RNA, 17 nt, Human
uauucaggaaaagccuc

SEQ ID NO: 2360947 - RNA, 19 nt, Human
uauucagcuuuaguagaua

SEQ ID NO: 2360948 - RNA, 16 nt, Human
uauucaggaagcucag

SEQ ID NO: 2360949 - RNA, 14 nt, Human
uauucaggaagcuc

SEQ ID NO: 2360950 - RNA, 14 nt, Human
uauucaguucccag

SEQ ID NO: 2360951 - RNA, 17 nt, Human
uauucaguucccagaau

SEQ ID NO: 2360952 - RNA, 21 nt, Human
uauucaguucccagaaucaaa

SEQ ID NO: 2360953 - RNA, 21 nt, Human
uauucagugcuguggccuggg

SEQ ID NO: 2360954 - RNA, 15 nt, Human
uauucagugucacug

SEQ ID NO: 2360955 - RNA, 22 nt, Human
acaggcgugagccaccgugccu

SEQ ID NO: 2360956 - RNA, 14 nt, Human
acaggcgaggccug

SEQ ID NO: 2360957 - RNA, 20 nt, Human
uauucauaagccaauuuuuc

SEQ ID NO: 2360958 - RNA, 23 nt, Human
uauucauaagccaauuuuucugc

SEQ ID NO: 2360959 - RNA, 14 nt, Human
acaggcucaauauu

SEQ ID NO: 2360960 - RNA, 18 nt, Human
acaggcuacucuccucgg

SEQ ID NO: 2360961 - RNA, 12 nt, Human
acaggcuccugc

SEQ ID NO: 2360962 - RNA, 16 nt, Human
uauuagcuuuacuguu

SEQ ID NO: 2360963 - RNA, 16 nt, Human
uauuagggagaaaauu

SEQ ID NO: 2360964 - RNA, 15 nt, Human
uauuagggagaaaau

SEQ ID NO: 2360965 - RNA, 21 nt, Human
uauuagggagaaaauucaauu

SEQ ID NO: 2360966 - RNA, 17 nt, Human
uauuagggguaauauau

SEQ ID NO: 2360967 - RNA, 18 nt, Human
uauuagggguaauauauu

SEQ ID NO: 2360968 - RNA, 14 nt, Human
uauuaguaccauag

SEQ ID NO: 2360969 - RNA, 21 nt, Human
uauuaguacugcucuuguuuc

SEQ ID NO: 2360970 - RNA, 14 nt, Human
uauuagcuuuacug

SEQ ID NO: 2360971 - RNA, 16 nt, Human
uauuagucuuggggca

SEQ ID NO: 2360972 - RNA, 19 nt, Human
uauuagugaccucagcuuu

SEQ ID NO: 2360973 - RNA, 15 nt, Human
uauucaaacagucuc

SEQ ID NO: 2360974 - RNA, 21 nt, Human
uauuagucuuggggcaggaug

SEQ ID NO: 2360975 - RNA, 21 nt, Human
uauuagugaccucagcuuuga

SEQ ID NO: 2360976 - RNA, 23 nt, Human
uauucaaacagucucaggaaauc

SEQ ID NO: 2360977 - RNA, 14 nt, Human
uauuacuucugcua

SEQ ID NO: 2360978 - RNA, 23 nt, Human
uauuacuuauuuuugacaguguu

SEQ ID NO: 2360979 - RNA, 21 nt, Human
uauuacuguuugucuucuccc

SEQ ID NO: 2360980 - RNA, 13 nt, Human
uauuacuucugcu

SEQ ID NO: 2360981 - RNA, 18 nt, Human
uauuacugucugguuuua

SEQ ID NO: 2360982 - RNA, 23 nt, Human
uauuacugucugguuuuaacaau

SEQ ID NO: 2360983 - RNA, 22 nt, Human
uauuacuaugacugcuccccag

SEQ ID NO: 2360984 - RNA, 13 nt, Human
uauuaaaaucuua

SEQ ID NO: 2360985 - RNA, 17 nt, Human
uauuaaaaugauuguaa

SEQ ID NO: 2360986 - RNA, 18 nt, Human
uauuaaaaugauuguaaa

SEQ ID NO: 2360987 - RNA, 19 nt, Human
uauuaaaaugauuguaaaa

SEQ ID NO: 2360988 - RNA, 10 nt, Human
uauuaaaauc

SEQ ID NO: 2360989 - RNA, 20 nt, Human
uauuaaaauaagcacugugc

SEQ ID NO: 2360990 - RNA, 22 nt, Human
uauuaaaauauggcuauaaaua

SEQ ID NO: 2360991 - RNA, 20 nt, Human
uauuaaaaugauuguaaaau

SEQ ID NO: 2360992 - RNA, 22 nt, Human
uauuaaaaugauuguaaaauag

SEQ ID NO: 2360993 - RNA, 22 nt, Human
uauuacuaaggaguaaucugug

SEQ ID NO: 2360994 - RNA, 21 nt, Human
uauuacuagaagaugaauaca

SEQ ID NO: 2360995 - RNA, 14 nt, Human
uauuacuguaagaa

SEQ ID NO: 2360996 - RNA, 22 nt, Human
acagggacugaaaaccucuccu

SEQ ID NO: 2360997 - RNA, 13 nt, Human
acagggacuugaa

SEQ ID NO: 2360998 - RNA, 16 nt, Human
acagggacuugaaguu

SEQ ID NO: 2360999 - RNA, 12 nt, Human
acagggacccac

SEQ ID NO: 2361000 - RNA, 22 nt, Human
acagggaaugccugagugccug

SEQ ID NO: 2361001 - RNA, 16 nt, Human
acagggagcugggaca

SEQ ID NO: 2361002 - RNA, 19 nt, Human
acagggagccuccugccca

SEQ ID NO: 2361003 - RNA, 17 nt, Human
acagggagccuccugcc

SEQ ID NO: 2361004 - RNA, 18 nt, Human
acagggagccuccugccc

SEQ ID NO: 2361005 - RNA, 13 nt, Human
acagggagccucc

SEQ ID NO: 2361006 - RNA, 14 nt, Human
acagggagccuccu

SEQ ID NO: 2361007 - RNA, 15 nt, Human
acagggagccuccug

SEQ ID NO: 2361008 - RNA, 16 nt, Human
acagggagccuccugc

SEQ ID NO: 2361009 - RNA, 21 nt, Human
acagggaggacgcucucuggc

SEQ ID NO: 2361010 - RNA, 20 nt, Human
acagggaggacgcucucugg

SEQ ID NO: 2361011 - RNA, 15 nt, Human
acagggaagagcaga

SEQ ID NO: 2361012 - RNA, 23 nt, Human
acagggaacccugcuugcacuuu

SEQ ID NO: 2361013 - RNA, 22 nt, Human
acagggaacccugcuugcacuu

SEQ ID NO: 2361014 - RNA, 23 nt, Human
acagggaagcuacagguuacaac

SEQ ID NO: 2361015 - RNA, 18 nt, Human
acagggaagcuacagguu

SEQ ID NO: 2361016 - RNA, 19 nt, Human
acagggaagcuacagguua

SEQ ID NO: 2361017 - RNA, 13 nt, Human
acagggaagcuac

SEQ ID NO: 2361018 - RNA, 14 nt, Human
acagggaagcuaca

SEQ ID NO: 2361019 - RNA, 15 nt, Human
acagggaagcuacag

SEQ ID NO: 2361020 - RNA, 16 nt, Human
acagggaagcuacagg

SEQ ID NO: 2361021 - RNA, 12 nt, Human
acaggcugggcu

SEQ ID NO: 2361022 - RNA, 22 nt, Human
acaggcugggcuucaguggcag

SEQ ID NO: 2361023 - RNA, 23 nt, Human
acaggcugggcuucaguggcagc

SEQ ID NO: 2361024 - RNA, 13 nt, Human
acaggcucuuagc

SEQ ID NO: 2361025 - RNA, 15 nt, Human
acaggcucuuagcag

SEQ ID NO: 2361026 - RNA, 19 nt, Human
acaggcucuuagcagcuuc

SEQ ID NO: 2361027 - RNA, 20 nt, Human
acaggcucuuagcagcuucc

SEQ ID NO: 2361028 - RNA, 22 nt, Human
acaggcuccugccaccacgccc

SEQ ID NO: 2361029 - RNA, 21 nt, Human
acaggcuccugccaccacgcc

SEQ ID NO: 2361030 - RNA, 15 nt, Human
acaggcuccugccac

SEQ ID NO: 2361031 - RNA, 13 nt, Human
acaggcuccugcc

SEQ ID NO: 2361032 - RNA, 10 nt, Human
acagggaggg

SEQ ID NO: 2361033 - RNA, 12 nt, Human
acagggagggga

SEQ ID NO: 2361034 - RNA, 13 nt, Human
acagggaugagca

SEQ ID NO: 2361035 - RNA, 14 nt, Human
acagggaugagcau

SEQ ID NO: 2361036 - RNA, 12 nt, Human
acagggcacacc

SEQ ID NO: 2361037 - RNA, 20 nt, Human
acagggcacaccgggcacuc

SEQ ID NO: 2361038 - RNA, 16 nt, Human
acaguaacuuuaugug

SEQ ID NO: 2361039 - RNA, 18 nt, Human
acaguaacuuuaugugua

SEQ ID NO: 2361040 - RNA, 21 nt, Human
acagggaugagcauggagcug

SEQ ID NO: 2361041 - RNA, 23 nt, Human
acagggaugagcauggagcuggc

SEQ ID NO: 2361042 - RNA, 18 nt, Human
acaguacaggcagcacag

SEQ ID NO: 2361043 - RNA, 16 nt, Human
acaguacaggcagcac

SEQ ID NO: 2361044 - RNA, 14 nt, Human
acaguacaggcagc

SEQ ID NO: 2361045 - RNA, 13 nt, Human
acaguacaggcag

SEQ ID NO: 2361046 - RNA, 20 nt, Human
acaguacaggcagcacagag

SEQ ID NO: 2361047 - RNA, 13 nt, Human
acaguaggagccc

SEQ ID NO: 2361048 - RNA, 12 nt, Human
acaguacaggca

SEQ ID NO: 2361049 - RNA, 19 nt, Human
acaguaacuuuauguguaa

SEQ ID NO: 2361050 - RNA, 21 nt, Human
acaguaacuuuauguguaaau

SEQ ID NO: 2361051 - RNA, 14 nt, Human
acaguaagcugcuc

SEQ ID NO: 2361052 - RNA, 14 nt, Human
acaguaaguuccua

SEQ ID NO: 2361053 - RNA, 16 nt, Human
acaguaaguuccuacu

SEQ ID NO: 2361054 - RNA, 20 nt, Human
acaguaaguuccuacuaggc

SEQ ID NO: 2361055 - RNA, 22 nt, Human
acagucaaggaguggcuuacua

SEQ ID NO: 2361056 - RNA, 23 nt, Human
acaguaguaccaaaugcuuuaaa

SEQ ID NO: 2361057 - RNA, 18 nt, Human
acagucaaggaguggcuu

SEQ ID NO: 2361058 - RNA, 21 nt, Human
acagucagauuuccagucucc

SEQ ID NO: 2361059 - RNA, 15 nt, Human
acagucagauuucca

SEQ ID NO: 2361060 - RNA, 17 nt, Human
acagucaccucauggaa

SEQ ID NO: 2361061 - RNA, 18 nt, Human
acagucaccucauggaau

SEQ ID NO: 2361062 - RNA, 23 nt, Human
acaguagucuugaugaccaaagu

SEQ ID NO: 2361063 - RNA, 14 nt, Human
acaguagucuugau

SEQ ID NO: 2361064 - RNA, 21 nt, Human
acaguaguaccaaaugcuuua

SEQ ID NO: 2361065 - RNA, 22 nt, Human
acaguaggagcccagcucugaa

SEQ ID NO: 2361066 - RNA, 14 nt, Human
acaguaggagccca

SEQ ID NO: 2361067 - RNA, 16 nt, Human
acagucaccucaugga

SEQ ID NO: 2361068 - RNA, 15 nt, Human
uaguuacuauaugcc

SEQ ID NO: 2361069 - RNA, 14 nt, Human
uaguucauccaauc

SEQ ID NO: 2361070 - RNA, 14 nt, Human
uaguuacucauuca

SEQ ID NO: 2361071 - RNA, 20 nt, Human
uaguucauccaauccucacu

SEQ ID NO: 2361072 - RNA, 18 nt, Human
uaguucauccaauccuca

SEQ ID NO: 2361073 - RNA, 20 nt, Human
uaguuccaccaucaagccac

SEQ ID NO: 2361074 - RNA, 14 nt, Human
uauaaaaaaaauag

SEQ ID NO: 2361075 - RNA, 23 nt, Human
uauaaaaaaaauaguugagccag

SEQ ID NO: 2361076 - RNA, 20 nt, Human
uauaaaaaccccaaacuguu

SEQ ID NO: 2361077 - RNA, 19 nt, Human
uauaaaaagaaaagauaaa

SEQ ID NO: 2361078 - RNA, 18 nt, Human
uauaaaaagcuuccauga

SEQ ID NO: 2361079 - RNA, 21 nt, Human
uauaaaaagaaaagauaaaga

SEQ ID NO: 2361080 - RNA, 23 nt, Human
uauaaaaagaaaagauaaagaug

SEQ ID NO: 2361081 - RNA, 19 nt, Human
uauaaaaaauggugccuga

SEQ ID NO: 2361082 - RNA, 13 nt, Human
uauaaaaaauggu

SEQ ID NO: 2361083 - RNA, 17 nt, Human
uauaaaaaauggugccu

SEQ ID NO: 2361084 - RNA, 11 nt, Human
uauaaaaacaa

SEQ ID NO: 2361085 - RNA, 17 nt, Human
acacauagcauguaaug

SEQ ID NO: 2361086 - RNA, 14 nt, Human
acacauauaaacau

SEQ ID NO: 2361087 - RNA, 22 nt, Human
acacauauaaacaucacacaca

SEQ ID NO: 2361088 - RNA, 17 nt, Human
acacauaugagggggaa

SEQ ID NO: 2361089 - RNA, 16 nt, Human
acacauaugucauaua

SEQ ID NO: 2361090 - RNA, 13 nt, Human
acacauaugaggg

SEQ ID NO: 2361091 - RNA, 15 nt, Human
acacauacccucuuc

SEQ ID NO: 2361092 - RNA, 19 nt, Human
uauaaaauaaauauauaua

SEQ ID NO: 2361093 - RNA, 21 nt, Human
uauaaaauaaauauauauaaa

SEQ ID NO: 2361094 - RNA, 20 nt, Human
uauaaaaggcaaauguguac

SEQ ID NO: 2361095 - RNA, 13 nt, Human
uauaaaagugauu

SEQ ID NO: 2361096 - RNA, 22 nt, Human
uauaaaagugauuguuggcaca

SEQ ID NO: 2361097 - RNA, 13 nt, Human
uauaaaauaaaua

SEQ ID NO: 2361098 - RNA, 14 nt, Human
uauaaaauaaauau

SEQ ID NO: 2361099 - RNA, 15 nt, Human
uauaaaauaaauaua

SEQ ID NO: 2361100 - RNA, 16 nt, Human
uauaaaauaaauauau

SEQ ID NO: 2361101 - RNA, 17 nt, Human
uauaaaauaaauauaua

SEQ ID NO: 2361102 - RNA, 19 nt, Human
uauaaaagccuguuuaaga

SEQ ID NO: 2361103 - RNA, 19 nt, Human
uauaaaaggcaaaugugua

SEQ ID NO: 2361104 - RNA, 18 nt, Human
uauaaaagcuauggugag

SEQ ID NO: 2361105 - RNA, 22 nt, Human
uauaaaagggacugagaaauuu

SEQ ID NO: 2361106 - RNA, 19 nt, Human
uauaaaaauaaaaaacacu

SEQ ID NO: 2361107 - RNA, 20 nt, Human
uauaaaagccuguuuaagag

SEQ ID NO: 2361108 - RNA, 23 nt, Human
acaccauguuugagcucagaccc

SEQ ID NO: 2361109 - RNA, 14 nt, Human
acaccaucuuuugu

SEQ ID NO: 2361110 - RNA, 18 nt, Human
acacaucacccuuaccau

SEQ ID NO: 2361111 - RNA, 16 nt, Human
acacccucucccagga

SEQ ID NO: 2361112 - RNA, 13 nt, Human
acacccucuccca

SEQ ID NO: 2361113 - RNA, 12 nt, Human
acacccucuccc

SEQ ID NO: 2361114 - RNA, 19 nt, Human
acacccucccccgccacuc

SEQ ID NO: 2361115 - RNA, 22 nt, Human
acacccucgaagcgcgccacuc

SEQ ID NO: 2361116 - RNA, 14 nt, Human
acacccucccccgc

SEQ ID NO: 2361117 - RNA, 16 nt, Human
acacccucccccgcca

SEQ ID NO: 2361118 - RNA, 13 nt, Human
acacccucacacu

SEQ ID NO: 2361119 - RNA, 13 nt, Human
acacccucccccg

SEQ ID NO: 2361120 - RNA, 16 nt, Human
acacccucacacuggg

SEQ ID NO: 2361121 - RNA, 17 nt, Human
acacccgacuccucaaa

SEQ ID NO: 2361122 - RNA, 19 nt, Human
acaccccuuauccaggacu

SEQ ID NO: 2361123 - RNA, 20 nt, Human
acaccccuuauccaggacuc

SEQ ID NO: 2361124 - RNA, 18 nt, Human
acacccucaaccucuucu

SEQ ID NO: 2361125 - RNA, 17 nt, Human
acacccucaaccucuuc

SEQ ID NO: 2361126 - RNA, 18 nt, Human
acaccccuuauccaggac

SEQ ID NO: 2361127 - RNA, 19 nt, Human
acacccaaagagguauuua

SEQ ID NO: 2361128 - RNA, 20 nt, Human
acacccaaagagguauuuau

SEQ ID NO: 2361129 - RNA, 20 nt, Human
acacauuuuauuuuauuaug

SEQ ID NO: 2361130 - RNA, 19 nt, Human
acacauuuuauuuuauuau

SEQ ID NO: 2361131 - RNA, 14 nt, Human
acacauuuuauuuu

SEQ ID NO: 2361132 - RNA, 13 nt, Human
acacauuuuauuu

SEQ ID NO: 2361133 - RNA, 21 nt, Human
acacaugagcaucaggccagg

SEQ ID NO: 2361134 - RNA, 18 nt, Human
acacaugauccugcaauu

SEQ ID NO: 2361135 - RNA, 15 nt, Human
acacaugaaguccaa

SEQ ID NO: 2361136 - RNA, 15 nt, Human
acacaucagcuugcc

SEQ ID NO: 2361137 - RNA, 14 nt, Human
acaccuuucuccuu

SEQ ID NO: 2361138 - RNA, 17 nt, Human
acaccuuucuccuuugu

SEQ ID NO: 2361139 - RNA, 22 nt, Human
acaccuuggacauccuccuccc

SEQ ID NO: 2361140 - RNA, 13 nt, Human
acaccuucucugg

SEQ ID NO: 2361141 - RNA, 22 nt, Human
acaccuuucuccuuuguacuuu

SEQ ID NO: 2361142 - RNA, 16 nt, Human
acaccuuugcaggcau

SEQ ID NO: 2361143 - RNA, 17 nt, Human
acaccuuuuaacucacc

SEQ ID NO: 2361144 - RNA, 15 nt, Human
acaccuuuuaacuca

SEQ ID NO: 2361145 - RNA, 18 nt, Human
acaccuuugcaggcaugc

SEQ ID NO: 2361146 - RNA, 22 nt, Human
acaccuuugcaggcaugcaugu

SEQ ID NO: 2361147 - RNA, 20 nt, Human
acacuaaccacgcuggaccu

SEQ ID NO: 2361148 - RNA, 21 nt, Human
acaccuuuuauugacacagaa

SEQ ID NO: 2361149 - RNA, 23 nt, Human
acaccuuuuauugacacagaaaa

SEQ ID NO: 2361150 - RNA, 15 nt, Human
acaccuuauauuuac

SEQ ID NO: 2361151 - RNA, 14 nt, Human
acaccuuccagcuc

SEQ ID NO: 2361152 - RNA, 16 nt, Human
acaccuuccagcuccu

SEQ ID NO: 2361153 - RNA, 21 nt, Human
acaccuguagucccagcuacu

SEQ ID NO: 2361154 - RNA, 20 nt, Human
acaccuuccagcuccuguaa

SEQ ID NO: 2361155 - RNA, 23 nt, Human
acaccuuggacauccuccuccca

SEQ ID NO: 2361156 - RNA, 19 nt, Human
acaccuggcugagguuccu

SEQ ID NO: 2361157 - RNA, 20 nt, Human
acaccuguagcacuuacugg

SEQ ID NO: 2361158 - RNA, 23 nt, Human
acaccuggcugagguuccucugc

SEQ ID NO: 2361159 - RNA, 17 nt, Human
acaccugggcuuaagaa

SEQ ID NO: 2361160 - RNA, 19 nt, Human
acaccuguagucccagcua

SEQ ID NO: 2361161 - RNA, 17 nt, Human
acaccuguagucccagc

SEQ ID NO: 2361162 - RNA, 16 nt, Human
acaccuguagucccag

SEQ ID NO: 2361163 - RNA, 21 nt, Human
acaccuuagccugcccuccuu

SEQ ID NO: 2361164 - RNA, 21 nt, Human
acaccucugcacaagcugcac

SEQ ID NO: 2361165 - RNA, 19 nt, Human
acaccucugcacaagcugc

SEQ ID NO: 2361166 - RNA, 14 nt, Human
acaccugacucuga

SEQ ID NO: 2361167 - RNA, 16 nt, Human
acaccugacucugaaa

SEQ ID NO: 2361168 - RNA, 18 nt, Human
acaccugacucugaaauc

SEQ ID NO: 2361169 - RNA, 21 nt, Human
acaccugacucugaaaucuga

SEQ ID NO: 2361170 - RNA, 17 nt, Human
acaccugagccagccug

SEQ ID NO: 2361171 - RNA, 12 nt, Human
acaccugaugug

SEQ ID NO: 2361172 - RNA, 14 nt, Human
acaccugaugugua

SEQ ID NO: 2361173 - RNA, 12 nt, Human
acaccucugcca

SEQ ID NO: 2361174 - RNA, 13 nt, Human
acaccucugccag

SEQ ID NO: 2361175 - RNA, 14 nt, Human
acaccucugccaga

SEQ ID NO: 2361176 - RNA, 16 nt, Human
acaccgggcacucaga

SEQ ID NO: 2361177 - RNA, 14 nt, Human
acaccgggccugga

SEQ ID NO: 2361178 - RNA, 15 nt, Human
acaccgagggcgacc

SEQ ID NO: 2361179 - RNA, 22 nt, Human
acaccgccacauggcuuccucc

SEQ ID NO: 2361180 - RNA, 17 nt, Human
acacccucucccaggac

SEQ ID NO: 2361181 - RNA, 12 nt, Human
acacccugcccu

SEQ ID NO: 2361182 - RNA, 17 nt, Human
acacccugcccucaugc

SEQ ID NO: 2361183 - RNA, 19 nt, Human
acacccugugauggggccc

SEQ ID NO: 2361184 - RNA, 18 nt, Human
acacccuuggacuugagg

SEQ ID NO: 2361185 - RNA, 16 nt, Human
acacccuuggacuuga

SEQ ID NO: 2361186 - RNA, 20 nt, Human
acacccuucacauacccucc

SEQ ID NO: 2361187 - RNA, 18 nt, Human
acacuaguuuugugccag

SEQ ID NO: 2361188 - RNA, 19 nt, Human
acacuaguuuugugccagc

SEQ ID NO: 2361189 - RNA, 23 nt, Human
acacuaguuuugugccagccgug

SEQ ID NO: 2361190 - RNA, 13 nt, Human
acacuauaucugu

SEQ ID NO: 2361191 - RNA, 14 nt, Human
acacuauaucugua

SEQ ID NO: 2361192 - RNA, 15 nt, Human
acacuauaucuguau

SEQ ID NO: 2361193 - RNA, 17 nt, Human
acacuauaucuguauau

SEQ ID NO: 2361194 - RNA, 14 nt, Human
acacuaagagagaa

SEQ ID NO: 2361195 - RNA, 15 nt, Human
acacuaaccuggguu

SEQ ID NO: 2361196 - RNA, 18 nt, Human
acacgaacuuuagcugca

SEQ ID NO: 2361197 - RNA, 14 nt, Human
acacuaaccugacc

SEQ ID NO: 2361198 - RNA, 13 nt, Human
acacuaagagaga

SEQ ID NO: 2361199 - RNA, 17 nt, Human
acacuaugguauuugag

SEQ ID NO: 2361200 - RNA, 21 nt, Human
acacuauaucuguauauaaaa

SEQ ID NO: 2361201 - RNA, 18 nt, Human
acacuaugguauuugagu

SEQ ID NO: 2361202 - RNA, 19 nt, Human
acacuaugguauuugagug

SEQ ID NO: 2361203 - RNA, 13 nt, Human
acacuauuuuaug

SEQ ID NO: 2361204 - RNA, 14 nt, Human
acacuauuuuaugc

SEQ ID NO: 2361205 - RNA, 15 nt, Human
acacuauuuuaugca

SEQ ID NO: 2361206 - RNA, 22 nt, Human
acacuaugguauuugaguguuu

SEQ ID NO: 2361207 - RNA, 18 nt, Human
acacuauaucuguauaua

SEQ ID NO: 2361208 - RNA, 18 nt, Human
acacuauuaccaugagaa

SEQ ID NO: 2361209 - RNA, 15 nt, Human
acacucaaaagcugg

SEQ ID NO: 2361210 - RNA, 19 nt, Human
acacucaaaucaagaaacu

SEQ ID NO: 2361211 - RNA, 15 nt, Human
acacucaagaagcag

SEQ ID NO: 2361212 - RNA, 16 nt, Human
acacucaagaagcagg

SEQ ID NO: 2361213 - RNA, 20 nt, Human
acacucacauuuauucugcu

SEQ ID NO: 2361214 - RNA, 22 nt, Human
acacucacauuuauucugcuca

SEQ ID NO: 2361215 - RNA, 17 nt, Human
uauaacuuauauuguaa

SEQ ID NO: 2361216 - RNA, 18 nt, Human
uauaacuuaaaauauuuu

SEQ ID NO: 2361217 - RNA, 17 nt, Human
acacucaagaagcaggc

SEQ ID NO: 2361218 - RNA, 24 nt, Human
uauaacuuauauuguaagaaauac

SEQ ID NO: 2361219 - RNA, 22 nt, Human
uauaacuuauauuguaagaaau

SEQ ID NO: 2361220 - RNA, 21 nt, Human
uauaacuuauauuguaagaaa

SEQ ID NO: 2361221 - RNA, 19 nt, Human
uauaacuuauauuguaaga

SEQ ID NO: 2361222 - RNA, 13 nt, Human
uauaacuugucua

SEQ ID NO: 2361223 - RNA, 19 nt, Human
uauaacuugucuaaauaag

SEQ ID NO: 2361224 - RNA, 15 nt, Human
uauaacuucuuaaaa

SEQ ID NO: 2361225 - RNA, 16 nt, Human
uauaacuucuuaaaag

SEQ ID NO: 2361226 - RNA, 15 nt, Human
uauaaguguguguuu

SEQ ID NO: 2361227 - RNA, 12 nt, Human
acaaugugaacu

SEQ ID NO: 2361228 - RNA, 19 nt, Human
acaaugugaaaagaaaaau

SEQ ID NO: 2361229 - RNA, 17 nt, Human
acaaugugaaaagaaaa

SEQ ID NO: 2361230 - RNA, 19 nt, Human
acaauggaaacugaaugcu

SEQ ID NO: 2361231 - RNA, 14 nt, Human
acaauggaaacuga

SEQ ID NO: 2361232 - RNA, 16 nt, Human
acaauggaaacugaau

SEQ ID NO: 2361233 - RNA, 20 nt, Human
acaauguauuuauuuaaaag

SEQ ID NO: 2361234 - RNA, 21 nt, Human
acaauguauuuauuuaaaaga

SEQ ID NO: 2361235 - RNA, 23 nt, Human
acaauguauuuauuuaaaagauu

SEQ ID NO: 2361236 - RNA, 17 nt, Human
acaaugugaacuuuauu

SEQ ID NO: 2361237 - RNA, 14 nt, Human
acacaauaugaaua

SEQ ID NO: 2361238 - RNA, 22 nt, Human
acacacaaaauguacccaguau

SEQ ID NO: 2361239 - RNA, 14 nt, Human
acacacaacaauua

SEQ ID NO: 2361240 - RNA, 13 nt, Human
acacacacacaca

SEQ ID NO: 2361241 - RNA, 12 nt, Human
acacacacacac

SEQ ID NO: 2361242 - RNA, 14 nt, Human
acacacacacacac

SEQ ID NO: 2361243 - RNA, 16 nt, Human
acacacacacacacag

SEQ ID NO: 2361244 - RNA, 14 nt, Human
acacacacauacac

SEQ ID NO: 2361245 - RNA, 22 nt, Human
uagggaggaccuuaucugugcg

SEQ ID NO: 2361246 - RNA, 23 nt, Human
uagggaggaccagggcagggcca

SEQ ID NO: 2361247 - RNA, 12 nt, Human
uagggagaguca

SEQ ID NO: 2361248 - RNA, 17 nt, Human
uagggagagucauauuu

SEQ ID NO: 2361249 - RNA, 21 nt, Human
acaaugcugugcccuaaagug

SEQ ID NO: 2361250 - RNA, 22 nt, Human
acaaugcuguauuuuaaaagaa

SEQ ID NO: 2361251 - RNA, 19 nt, Human
acaauggauaggcacagga

SEQ ID NO: 2361252 - RNA, 24 nt, Human
acaaugcugugcccuaaaguguau

SEQ ID NO: 2361253 - RNA, 23 nt, Human
acaaugcugugcccuaaagugua

SEQ ID NO: 2361254 - RNA, 22 nt, Human
acaaugcugugcccuaaagugu

SEQ ID NO: 2361255 - RNA, 17 nt, Human
acacacagcucuguccu

SEQ ID NO: 2361256 - RNA, 13 nt, Human
acacacagcucug

SEQ ID NO: 2361257 - RNA, 14 nt, Human
acacacagcucugu

SEQ ID NO: 2361258 - RNA, 15 nt, Human
acacacacacacaca

SEQ ID NO: 2361259 - RNA, 12 nt, Human
acacacacaugc

SEQ ID NO: 2361260 - RNA, 11 nt, Human
acacacacaug

SEQ ID NO: 2361261 - RNA, 15 nt, Human
acacacacaugcaua

SEQ ID NO: 2361262 - RNA, 14 nt, Human
acacacacaugcau

SEQ ID NO: 2361263 - RNA, 13 nt, Human
acacacacaugca

SEQ ID NO: 2361264 - RNA, 17 nt, Human
acacacaccacacauac

SEQ ID NO: 2361265 - RNA, 14 nt, Human
acacacacgcacgc

SEQ ID NO: 2361266 - RNA, 19 nt, Human
acacacacgcacgcacaca

SEQ ID NO: 2361267 - RNA, 21 nt, Human
acacacacgcacgcacacaca

SEQ ID NO: 2361268 - RNA, 16 nt, Human
acacacacaugcauac

SEQ ID NO: 2361269 - RNA, 12 nt, Human
acacacacgcac

SEQ ID NO: 2361270 - RNA, 22 nt, Human
acacacacgcgugcacacacca

SEQ ID NO: 2361271 - RNA, 14 nt, Human
acacaccagagccc

SEQ ID NO: 2361272 - RNA, 15 nt, Human
acacaccagagccca

SEQ ID NO: 2361273 - RNA, 20 nt, Human
acacaccagagcccaccuug

SEQ ID NO: 2361274 - RNA, 21 nt, Human
acacacgcgugcacacaccag

SEQ ID NO: 2361275 - RNA, 21 nt, Human
acacacgcaggaacucccagc

SEQ ID NO: 2361276 - RNA, 19 nt, Human
acacacgugcaauuuguuu

SEQ ID NO: 2361277 - RNA, 15 nt, Human
acacacucaaaucaa

SEQ ID NO: 2361278 - RNA, 21 nt, Human
acacacugcauguuugugauu

SEQ ID NO: 2361279 - RNA, 13 nt, Human
acacacugaugcu

SEQ ID NO: 2361280 - RNA, 22 nt, Human
acacacgugcaauuuguuugug

SEQ ID NO: 2361281 - RNA, 13 nt, Human
acacacuaaucga

SEQ ID NO: 2361282 - RNA, 21 nt, Human
acacaguguuuuuguaaagug

SEQ ID NO: 2361283 - RNA, 20 nt, Human
acacagugggugguggaucu

SEQ ID NO: 2361284 - RNA, 18 nt, Human
acacaguuacacuugugc

SEQ ID NO: 2361285 - RNA, 13 nt, Human
acacagugagucg

SEQ ID NO: 2361286 - RNA, 20 nt, Human
acacacuguguccuggugcu

SEQ ID NO: 2361287 - RNA, 16 nt, Human
acacagugccuucaau

SEQ ID NO: 2361288 - RNA, 19 nt, Human
acacagugccuucaauaaa

SEQ ID NO: 2361289 - RNA, 20 nt, Human
acacagugccuucaauaaau

SEQ ID NO: 2361290 - RNA, 19 nt, Human
acacaguauuacuucugcu

SEQ ID NO: 2361291 - RNA, 22 nt, Human
acacaguauuacuucugcuaca

SEQ ID NO: 2361292 - RNA, 18 nt, Human
acacaguauuacuucugc

SEQ ID NO: 2361293 - RNA, 23 nt, Human
acacacuuuugguuaagucuguu

SEQ ID NO: 2361294 - RNA, 16 nt, Human
acacaguauuacuucu

SEQ ID NO: 2361295 - RNA, 17 nt, Human
acacacugaugcuuaga

SEQ ID NO: 2361296 - RNA, 15 nt, Human
acacacugaugcuua

SEQ ID NO: 2361297 - RNA, 11 nt, Human
acacacugugc

SEQ ID NO: 2361298 - RNA, 16 nt, Human
acacacugugcuuucu

SEQ ID NO: 2361299 - RNA, 17 nt, Human
acacacugugcuuucua

SEQ ID NO: 2361300 - RNA, 19 nt, Human
acacacugugcuuucuauu

SEQ ID NO: 2361301 - RNA, 21 nt, Human
acacacugugcuuucuauugu

SEQ ID NO: 2361302 - RNA, 22 nt, Human
acacacugugcuuucuauugua

SEQ ID NO: 2361303 - RNA, 23 nt, Human
acacacugugcuuucuauuguac

SEQ ID NO: 2361304 - RNA, 16 nt, Human
acacacuguguccugg

SEQ ID NO: 2361305 - RNA, 21 nt, Human
uaguacauaaaggugguaugu

SEQ ID NO: 2361306 - RNA, 19 nt, Human
uaguaccaaaugcuuuaaa

SEQ ID NO: 2361307 - RNA, 16 nt, Human
uaguaccaaucauuuu

SEQ ID NO: 2361308 - RNA, 16 nt, Human
uaguaccauuuauaca

SEQ ID NO: 2361309 - RNA, 20 nt, Human
uaguaccaaaugcuuuaaaa

SEQ ID NO: 2361310 - RNA, 23 nt, Human
uaguaccaaucauuuuaauuauu

SEQ ID NO: 2361311 - RNA, 12 nt, Human
uaguacauaaag

SEQ ID NO: 2361312 - RNA, 23 nt, Human
uaguacagguaaggugagggaau

SEQ ID NO: 2361313 - RNA, 16 nt, Human
uaguaccaaaugcuuu

SEQ ID NO: 2361314 - RNA, 19 nt, Human
uaguaacuucuuauggaau

SEQ ID NO: 2361315 - RNA, 18 nt, Human
uaguaacuucuuauggaa

SEQ ID NO: 2361316 - RNA, 22 nt, Human
acacaguugcugucauaagaau

SEQ ID NO: 2361317 - RNA, 15 nt, Human
acacaguugcuguca

SEQ ID NO: 2361318 - RNA, 13 nt, Human
acacauaauuaaa

SEQ ID NO: 2361319 - RNA, 15 nt, Human
acacauaauuaaagu

SEQ ID NO: 2361320 - RNA, 16 nt, Human
acacauaauuaaagug

SEQ ID NO: 2361321 - RNA, 17 nt, Human
acacauaauuaaagugu

SEQ ID NO: 2361322 - RNA, 18 nt, Human
acacauaauuaaaguguc

SEQ ID NO: 2361323 - RNA, 19 nt, Human
acacauaauuaaagugucc

SEQ ID NO: 2361324 - RNA, 20 nt, Human
acacauaauuaaagugucca

SEQ ID NO: 2361325 - RNA, 21 nt, Human
acacauaauuaaaguguccau

SEQ ID NO: 2361326 - RNA, 13 nt, Human
uaguaaagaaauu

SEQ ID NO: 2361327 - RNA, 14 nt, Human
uaguaaagaaauga

SEQ ID NO: 2361328 - RNA, 13 nt, Human
uaguaaagaaaug

SEQ ID NO: 2361329 - RNA, 12 nt, Human
uaguaaagaaau

SEQ ID NO: 2361330 - RNA, 22 nt, Human
uaguaaaauucuacuguaugga

SEQ ID NO: 2361331 - RNA, 21 nt, Human
uagugaaucacguaaagcuag

SEQ ID NO: 2361332 - RNA, 21 nt, Human
uagugaaggcuucucucugug

SEQ ID NO: 2361333 - RNA, 23 nt, Human
uaguguuggagaagaacugaaau

SEQ ID NO: 2361334 - RNA, 20 nt, Human
uaguguuuggguauauucau

SEQ ID NO: 2361335 - RNA, 18 nt, Human
uagugacccggaggccac

SEQ ID NO: 2361336 - RNA, 17 nt, Human
uagugacccggaggcca

SEQ ID NO: 2361337 - RNA, 15 nt, Human
uaguguuucugugca

SEQ ID NO: 2361338 - RNA, 16 nt, Human
uaguguuucugugcau

SEQ ID NO: 2361339 - RNA, 17 nt, Human
uaguguuucugugcaug

SEQ ID NO: 2361340 - RNA, 12 nt, Human
uaguuaaauuuc

SEQ ID NO: 2361341 - RNA, 15 nt, Human
uaguuaaauuucugg

SEQ ID NO: 2361342 - RNA, 23 nt, Human
uaguuaauauugugaagaaaaau

SEQ ID NO: 2361343 - RNA, 23 nt, Human
uaguuaagacaugauuuccuuga

SEQ ID NO: 2361344 - RNA, 21 nt, Human
uaguuaagacaugauuuccuu

SEQ ID NO: 2361345 - RNA, 19 nt, Human
uaguuaagacaugauuucc

SEQ ID NO: 2361346 - RNA, 14 nt, Human
uaguuaagacauga

SEQ ID NO: 2361347 - RNA, 19 nt, Human
uaguuaaauuucuggaccu

SEQ ID NO: 2361348 - RNA, 13 nt, Human
uaguuaauucugu

SEQ ID NO: 2361349 - RNA, 14 nt, Human
uaguuacagcugug

SEQ ID NO: 2361350 - RNA, 21 nt, Human
uagucccagcuacucagaagc

SEQ ID NO: 2361351 - RNA, 14 nt, Human
uagucccagcuacu

SEQ ID NO: 2361352 - RNA, 20 nt, Human
uagucccagcuacucaggag

SEQ ID NO: 2361353 - RNA, 18 nt, Human
uagucccucaugcaaauc

SEQ ID NO: 2361354 - RNA, 15 nt, Human
uagucccuuccccuc

SEQ ID NO: 2361355 - RNA, 14 nt, Human
uagucccuuccccu

SEQ ID NO: 2361356 - RNA, 15 nt, Human
uagucccagcuacuc

SEQ ID NO: 2361357 - RNA, 12 nt, Human
uagucccuucca

SEQ ID NO: 2361358 - RNA, 17 nt, Human
uagucccuuccacaccc

SEQ ID NO: 2361359 - RNA, 15 nt, Human
uaguaccugaaaagu

SEQ ID NO: 2361360 - RNA, 19 nt, Human
uaguaccauuuauacaaau

SEQ ID NO: 2361361 - RNA, 18 nt, Human
uaguaccauuuauacaaa

SEQ ID NO: 2361362 - RNA, 18 nt, Human
uaguaccugaaaaguaac

SEQ ID NO: 2361363 - RNA, 20 nt, Human
uaguaccauuuauacaaauu

SEQ ID NO: 2361364 - RNA, 16 nt, Human
uaguaccugaaaagua

SEQ ID NO: 2361365 - RNA, 14 nt, Human
uaguacuaacuccu

SEQ ID NO: 2361366 - RNA, 22 nt, Human
uaguccagcuuuguucuucuua

SEQ ID NO: 2361367 - RNA, 23 nt, Human
uaguccagcuuuguucuucuuaa

SEQ ID NO: 2361368 - RNA, 23 nt, Human
uagucccuuccccucccuggcuc

SEQ ID NO: 2361369 - RNA, 22 nt, Human
uagucccuuccccucccuggcu

SEQ ID NO: 2361370 - RNA, 20 nt, Human
uagucccuuccccucccugg

SEQ ID NO: 2361371 - RNA, 16 nt, Human
uagucccuuccccucc

SEQ ID NO: 2361372 - RNA, 24 nt, Human
uagugaaaccccaucucuacugaa

SEQ ID NO: 2361373 - RNA, 23 nt, Human
uaguccgugcugacagcugcucc

SEQ ID NO: 2361374 - RNA, 14 nt, Human
uaguccuauucuau

SEQ ID NO: 2361375 - RNA, 22 nt, Human
uaguccgugcugacagcugcuc

SEQ ID NO: 2361376 - RNA, 21 nt, Human
uaguccgugcugacagcugcu

SEQ ID NO: 2361377 - RNA, 18 nt, Human
uaguccuagaggaccuga

SEQ ID NO: 2361378 - RNA, 23 nt, Human
uagugaaaugaauauuuaaauaa

SEQ ID NO: 2361379 - RNA, 19 nt, Human
uagugaaggcuucucucug

SEQ ID NO: 2361380 - RNA, 22 nt, Human
uagugaaacucguuaauuugua

SEQ ID NO: 2361381 - RNA, 20 nt, Human
aauuguugacaguucugaag

SEQ ID NO: 2361382 - RNA, 24 nt, Human
acaaagauguuugucagauaugau

SEQ ID NO: 2361383 - RNA, 15 nt, Human
acaaagcacaguguu

SEQ ID NO: 2361384 - RNA, 14 nt, Human
acaaagcacagugu

SEQ ID NO: 2361385 - RNA, 23 nt, Human
acaaagauguuugucagauauga

SEQ ID NO: 2361386 - RNA, 22 nt, Human
acaaagauguuugucagauaug

SEQ ID NO: 2361387 - RNA, 21 nt, Human
acaaagauguuugucagauau

SEQ ID NO: 2361388 - RNA, 12 nt, Human
acaaagcagcca

SEQ ID NO: 2361389 - RNA, 19 nt, Human
acaaagcacaguuugaaca

SEQ ID NO: 2361390 - RNA, 16 nt, Human
acaaagcacaguguua

SEQ ID NO: 2361391 - RNA, 16 nt, Human
acaaagcacaguuuga

SEQ ID NO: 2361392 - RNA, 17 nt, Human
acaaagcacaguuugaa

SEQ ID NO: 2361393 - RNA, 18 nt, Human
acaaagcacaguuugaac

SEQ ID NO: 2361394 - RNA, 13 nt, Human
acaaagcagccac

SEQ ID NO: 2361395 - RNA, 22 nt, Human
acaaaggaugcccaaagaugca

SEQ ID NO: 2361396 - RNA, 15 nt, Human
acaaaggguuuuaau

SEQ ID NO: 2361397 - RNA, 11 nt, Human
acaaaggcaag

SEQ ID NO: 2361398 - RNA, 15 nt, Human
aauuguuaagauaug

SEQ ID NO: 2361399 - RNA, 20 nt, Human
aauuguguuuauaauuuuaa

SEQ ID NO: 2361400 - RNA, 21 nt, Human
aauuguguuuauaauuuuaaa

SEQ ID NO: 2361401 - RNA, 13 nt, Human
aauuguugacagu

SEQ ID NO: 2361402 - RNA, 18 nt, Human
aauuguugacaguucuga

SEQ ID NO: 2361403 - RNA, 16 nt, Human
aauuguuacaaauugu

SEQ ID NO: 2361404 - RNA, 18 nt, Human
acaaaaggauaaugaaua

SEQ ID NO: 2361405 - RNA, 22 nt, Human
acaaaagcaugugagacugguu

SEQ ID NO: 2361406 - RNA, 11 nt, Human
acaaaagcaug

SEQ ID NO: 2361407 - RNA, 23 nt, Human
uagauaucgacuuguuuuugcac

SEQ ID NO: 2361408 - RNA, 19 nt, Human
uagauauccacuugagaca

SEQ ID NO: 2361409 - RNA, 19 nt, Human
uagauauaugcucugcaug

SEQ ID NO: 2361410 - RNA, 21 nt, Human
uagaugagauuguuuuaucau

SEQ ID NO: 2361411 - RNA, 14 nt, Human
uagauauuauucau

SEQ ID NO: 2361412 - RNA, 19 nt, Human
uagaggcagggaggggacu

SEQ ID NO: 2361413 - RNA, 23 nt, Human
uagagauguuuuuaaaaguuuca

SEQ ID NO: 2361414 - RNA, 20 nt, Human
uagagcaccuaguccaguga

SEQ ID NO: 2361415 - RNA, 18 nt, Human
uagaggccagccccaccc

SEQ ID NO: 2361416 - RNA, 20 nt, Human
uagaggaucccucucuggau

SEQ ID NO: 2361417 - RNA, 22 nt, Human
uagaggagaaacuggaacucuc

SEQ ID NO: 2361418 - RNA, 15 nt, Human
uagauauaugcucug

SEQ ID NO: 2361419 - RNA, 16 nt, Human
uagaggccagccuggc

SEQ ID NO: 2361420 - RNA, 20 nt, Human
uagaggccagccccacccag

SEQ ID NO: 2361421 - RNA, 15 nt, Human
uagaggccagccugg

SEQ ID NO: 2361422 - RNA, 17 nt, Human
uagagaugacugagucc

SEQ ID NO: 2361423 - RNA, 19 nt, Human
uagagaucugguuuugcua

SEQ ID NO: 2361424 - RNA, 20 nt, Human
uagagaucugguuuugcuau

SEQ ID NO: 2361425 - RNA, 20 nt, Human
uagagaucauccuuuccagc

SEQ ID NO: 2361426 - RNA, 23 nt, Human
uagagaucauccuuuccagcaug

SEQ ID NO: 2361427 - RNA, 17 nt, Human
uagagaucugguuuugc

SEQ ID NO: 2361428 - RNA, 18 nt, Human
uagagaucugguuuugcu

SEQ ID NO: 2361429 - RNA, 17 nt, Human
uagagauaguacauaaa

SEQ ID NO: 2361430 - RNA, 17 nt, Human
acaaaggguuuuaaugu

SEQ ID NO: 2361431 - RNA, 18 nt, Human
acaaaggguuuuaaugua

SEQ ID NO: 2361432 - RNA, 20 nt, Human
uagagauaugcagaaggaag

SEQ ID NO: 2361433 - RNA, 19 nt, Human
uagagauaugcagaaggaa

SEQ ID NO: 2361434 - RNA, 19 nt, Human
uagagaucauccuuuccag

SEQ ID NO: 2361435 - RNA, 12 nt, Human
uagagauguuuu

SEQ ID NO: 2361436 - RNA, 19 nt, Human
uagagauggaggaggaggc

SEQ ID NO: 2361437 - RNA, 14 nt, Human
uagagauggaggag

SEQ ID NO: 2361438 - RNA, 21 nt, Human
uagagaucugguuuugcuauu

SEQ ID NO: 2361439 - RNA, 19 nt, Human
uagagauuaccuccugaga

SEQ ID NO: 2361440 - RNA, 18 nt, Human
uagagauuaccuccugag

SEQ ID NO: 2361441 - RNA, 17 nt, Human
uagagauuaccuccuga

SEQ ID NO: 2361442 - RNA, 19 nt, Human
uagagauguuuuuaaaagu

SEQ ID NO: 2361443 - RNA, 20 nt, Human
uagagauguuuuuaaaaguu

SEQ ID NO: 2361444 - RNA, 17 nt, Human
uagagcacacuguagca

SEQ ID NO: 2361445 - RNA, 16 nt, Human
uagagcacacuguagc

SEQ ID NO: 2361446 - RNA, 22 nt, Human
uagagcaaaauugauguguuua

SEQ ID NO: 2361447 - RNA, 19 nt, Human
uagaggagaaacuggaacu

SEQ ID NO: 2361448 - RNA, 21 nt, Human
uagagauuaccuccugagaaa

SEQ ID NO: 2361449 - RNA, 14 nt, Human
uagagcaaaauuga

SEQ ID NO: 2361450 - RNA, 21 nt, Human
uagagcaaaauugauguguuu

SEQ ID NO: 2361451 - RNA, 19 nt, Human
uagccagcacacagggcag

SEQ ID NO: 2361452 - RNA, 18 nt, Human
uagccagcacacagggca

SEQ ID NO: 2361453 - RNA, 19 nt, Human
acaaauuuacagagacaga

SEQ ID NO: 2361454 - RNA, 16 nt, Human
uagccagacacucugc

SEQ ID NO: 2361455 - RNA, 23 nt, Human
uagccacuuaccuucaauaaagu

SEQ ID NO: 2361456 - RNA, 21 nt, Human
uagccacuuuggucccgugca

SEQ ID NO: 2361457 - RNA, 14 nt, Human
uagccagacacucu

SEQ ID NO: 2361458 - RNA, 15 nt, Human
uagccagacacucug

SEQ ID NO: 2361459 - RNA, 18 nt, Human
acaaauuuacagagacag

SEQ ID NO: 2361460 - RNA, 22 nt, Human
uagccacuuaccuucaauaaag

SEQ ID NO: 2361461 - RNA, 18 nt, Human
uagccacuuaccuucaau

SEQ ID NO: 2361462 - RNA, 16 nt, Human
uagccacauuuggaau

SEQ ID NO: 2361463 - RNA, 19 nt, Human
uagccacaucccuuugaaa

SEQ ID NO: 2361464 - RNA, 20 nt, Human
uagccacaaaauugggaaag

SEQ ID NO: 2361465 - RNA, 14 nt, Human
uagccaauguggga

SEQ ID NO: 2361466 - RNA, 18 nt, Human
uagccaauauuuuucuua

SEQ ID NO: 2361467 - RNA, 11 nt, Human
uagccagagga

SEQ ID NO: 2361468 - RNA, 15 nt, Human
uagccagaggagaga

SEQ ID NO: 2361469 - RNA, 17 nt, Human
acaacaaaaagcuuccc

SEQ ID NO: 2361470 - RNA, 13 nt, Human
acaacagaaguca

SEQ ID NO: 2361471 - RNA, 11 nt, Human
acaacagaagu

SEQ ID NO: 2361472 - RNA, 13 nt, Human
acaacagaagcuu

SEQ ID NO: 2361473 - RNA, 19 nt, Human
acaacagaagcuucagaag

SEQ ID NO: 2361474 - RNA, 23 nt, Human
acaacacucauugaccugaggcc

SEQ ID NO: 2361475 - RNA, 21 nt, Human
acaacacucauugaccugagg

SEQ ID NO: 2361476 - RNA, 13 nt, Human
acaacagauuugu

SEQ ID NO: 2361477 - RNA, 14 nt, Human
acaacagauuugug

SEQ ID NO: 2361478 - RNA, 19 nt, Human
acaagaccacguuucuaaa

SEQ ID NO: 2361479 - RNA, 19 nt, Human
acaagacccuugugguccc

SEQ ID NO: 2361480 - RNA, 20 nt, Human
acaagacccaaaaggcagaa

SEQ ID NO: 2361481 - RNA, 13 nt, Human
uagcauguauugu

SEQ ID NO: 2361482 - RNA, 15 nt, Human
uagcauguauugugu

SEQ ID NO: 2361483 - RNA, 18 nt, Human
uagcauguauugugucuu

SEQ ID NO: 2361484 - RNA, 19 nt, Human
uagcauguauugugucuuu

SEQ ID NO: 2361485 - RNA, 16 nt, Human
uagcauuuugcuaaau

SEQ ID NO: 2361486 - RNA, 23 nt, Human
uagcauguauugugucuuuugca

SEQ ID NO: 2361487 - RNA, 22 nt, Human
uagcauuuugcuaaaugugaau

SEQ ID NO: 2361488 - RNA, 14 nt, Human
uagcauuuuugauu

SEQ ID NO: 2361489 - RNA, 20 nt, Human
uagcauuuuugauuuaugca

SEQ ID NO: 2361490 - RNA, 14 nt, Human
uagccaaggccaaa

SEQ ID NO: 2361491 - RNA, 23 nt, Human
uagccaaggugggcugagcccug

SEQ ID NO: 2361492 - RNA, 21 nt, Human
uagccaaggugggcugagccc

SEQ ID NO: 2361493 - RNA, 20 nt, Human
uagccaaggugggcugagcc

SEQ ID NO: 2361494 - RNA, 21 nt, Human
uagccaaggccaaaggaagca

SEQ ID NO: 2361495 - RNA, 23 nt, Human
uagaugcugacuguacuccuccc

SEQ ID NO: 2361496 - RNA, 14 nt, Human
uagaugcugacugu

SEQ ID NO: 2361497 - RNA, 15 nt, Human
uagaugcuggcccag

SEQ ID NO: 2361498 - RNA, 14 nt, Human
uagaugcuggccca

SEQ ID NO: 2361499 - RNA, 13 nt, Human
uagaugcuggccc

SEQ ID NO: 2361500 - RNA, 15 nt, Human
uagaugcaguucuga

SEQ ID NO: 2361501 - RNA, 19 nt, Human
uagaugcaagauauuuaua

SEQ ID NO: 2361502 - RNA, 12 nt, Human
uagcauguaaug

SEQ ID NO: 2361503 - RNA, 13 nt, Human
uagaugggaauga

SEQ ID NO: 2361504 - RNA, 15 nt, Human
uagaugggaaugaag

SEQ ID NO: 2361505 - RNA, 19 nt, Human
uagcauggcugccaauggg

SEQ ID NO: 2361506 - RNA, 22 nt, Human
uagaugcuggcccagggcccag

SEQ ID NO: 2361507 - RNA, 21 nt, Human
uagaugcuggcccagggccca

SEQ ID NO: 2361508 - RNA, 18 nt, Human
uagaugcuggcccagggc

SEQ ID NO: 2361509 - RNA, 16 nt, Human
uagaugcuggcccagg

SEQ ID NO: 2361510 - RNA, 14 nt, Human
uagauggauucucc

SEQ ID NO: 2361511 - RNA, 20 nt, Human
uagaugcugaugauuuguuu

SEQ ID NO: 2361512 - RNA, 14 nt, Human
uagauggcuccucu

SEQ ID NO: 2361513 - RNA, 21 nt, Human
acaauaaguuaacuauuuuau

SEQ ID NO: 2361514 - RNA, 21 nt, Human
acaauaacuacuguguuccug

SEQ ID NO: 2361515 - RNA, 20 nt, Human
acaauaacuacuguguuccu

SEQ ID NO: 2361516 - RNA, 19 nt, Human
acaauaacuacuguguucc

SEQ ID NO: 2361517 - RNA, 18 nt, Human
acaauaacuacuguguuc

SEQ ID NO: 2361518 - RNA, 22 nt, Human
acaauaacuacuguguuccugg

SEQ ID NO: 2361519 - RNA, 14 nt, Human
acaauaaaugugca

SEQ ID NO: 2361520 - RNA, 17 nt, Human
acaauaacuacuguguu

SEQ ID NO: 2361521 - RNA, 16 nt, Human
acaauaacuacugugu

SEQ ID NO: 2361522 - RNA, 15 nt, Human
acaauaaaugugcuu

SEQ ID NO: 2361523 - RNA, 22 nt, Human
acaauaaaauuuuuuuucaugu

SEQ ID NO: 2361524 - RNA, 14 nt, Human
acaauaaagagauu

SEQ ID NO: 2361525 - RNA, 23 nt, Human
acaauaaagaucgcccccaccuc

SEQ ID NO: 2361526 - RNA, 14 nt, Human
acaauaaauaaucu

SEQ ID NO: 2361527 - RNA, 13 nt, Human
acaauaauuucag

SEQ ID NO: 2361528 - RNA, 12 nt, Human
acaauaauuuca

SEQ ID NO: 2361529 - RNA, 14 nt, Human
acaauaauuuucua

SEQ ID NO: 2361530 - RNA, 23 nt, Human
acaauacaucccuuaccugggaa

SEQ ID NO: 2361531 - RNA, 16 nt, Human
acaauacaugcugcua

SEQ ID NO: 2361532 - RNA, 13 nt, Human
acaauacccccag

SEQ ID NO: 2361533 - RNA, 15 nt, Human
acaaucaguccccuc

SEQ ID NO: 2361534 - RNA, 16 nt, Human
acaaucaguccccucc

SEQ ID NO: 2361535 - RNA, 17 nt, Human
acaaucaguccccuccc

SEQ ID NO: 2361536 - RNA, 18 nt, Human
acaaucaguccccuccca

SEQ ID NO: 2361537 - RNA, 19 nt, Human
acaaucaguccccucccau

SEQ ID NO: 2361538 - RNA, 20 nt, Human
acaaucaguccccucccauc

SEQ ID NO: 2361539 - RNA, 22 nt, Human
acaaucaguccccucccaucug

SEQ ID NO: 2361540 - RNA, 15 nt, Human
acaacagauuuguga

SEQ ID NO: 2361541 - RNA, 21 nt, Human
acaagacuucaguauguuguc

SEQ ID NO: 2361542 - RNA, 16 nt, Human
acaagacuucaguaug

SEQ ID NO: 2361543 - RNA, 17 nt, Human
acaagacuucaguaugu

SEQ ID NO: 2361544 - RNA, 18 nt, Human
acaagaccacguuucuaa

SEQ ID NO: 2361545 - RNA, 19 nt, Human
acaagaccccgucucaaaa

SEQ ID NO: 2361546 - RNA, 14 nt, Human
acaagacuucagua

SEQ ID NO: 2361547 - RNA, 13 nt, Human
acaagacugcaca

SEQ ID NO: 2361548 - RNA, 14 nt, Human
acaagacugcacau

SEQ ID NO: 2361549 - RNA, 12 nt, Human
acaauaaagaga

SEQ ID NO: 2361550 - RNA, 23 nt, Human
acaauaaaauuuuuuuucauguu

SEQ ID NO: 2361551 - RNA, 21 nt, Human
acaaggauagaugcuggccca

SEQ ID NO: 2361552 - RNA, 18 nt, Human
acaaggauagaugcuggc

SEQ ID NO: 2361553 - RNA, 17 nt, Human
acaaggauagaugcugg

SEQ ID NO: 2361554 - RNA, 16 nt, Human
acaaggauagaugcug

SEQ ID NO: 2361555 - RNA, 15 nt, Human
acaaggacuuccugu

SEQ ID NO: 2361556 - RNA, 19 nt, Human
acaaggacuaggguccugg

SEQ ID NO: 2361557 - RNA, 18 nt, Human
acaaggacuaggguccug

SEQ ID NO: 2361558 - RNA, 21 nt, Human
acaaggacagccccuccucca

SEQ ID NO: 2361559 - RNA, 22 nt, Human
acaaggacagccccuccuccau

SEQ ID NO: 2361560 - RNA, 16 nt, Human
acaaugacauuuauau

SEQ ID NO: 2361561 - RNA, 18 nt, Human
acaaugacuuacuguaca

SEQ ID NO: 2361562 - RNA, 17 nt, Human
acaaugacuuacuguac

SEQ ID NO: 2361563 - RNA, 17 nt, Human
acaaucgauggccuugc

SEQ ID NO: 2361564 - RNA, 23 nt, Human
acaauccuagugcuuuccuuuuu

SEQ ID NO: 2361565 - RNA, 16 nt, Human
acaaucgauggccuug

SEQ ID NO: 2361566 - RNA, 22 nt, Human
acaauccuagugcuuuccuuuu

SEQ ID NO: 2361567 - RNA, 17 nt, Human
acaauccuagugcuuuc

SEQ ID NO: 2361568 - RNA, 16 nt, Human
acaauccuagugcuuu

SEQ ID NO: 2361569 - RNA, 15 nt, Human
acaauccuagugcuu

SEQ ID NO: 2361570 - RNA, 12 nt, Human
acaaugacuuac

SEQ ID NO: 2361571 - RNA, 18 nt, Human
acaaucaugaaauaugca

SEQ ID NO: 2361572 - RNA, 19 nt, Human
acaaucaugaaauaugcau

SEQ ID NO: 2361573 - RNA, 13 nt, Human
acaaucauugcug

SEQ ID NO: 2361574 - RNA, 14 nt, Human
acaaucauugcuga

SEQ ID NO: 2361575 - RNA, 18 nt, Human
acaaucauugcugaaaau

SEQ ID NO: 2361576 - RNA, 21 nt, Human
acaaucauugcugaaaauggu

SEQ ID NO: 2361577 - RNA, 22 nt, Human
acaaucauugcugaaaauggua

SEQ ID NO: 2361578 - RNA, 18 nt, Human
acaaucauuugcuuuuug

SEQ ID NO: 2361579 - RNA, 12 nt, Human
uagcuaauguaa

SEQ ID NO: 2361580 - RNA, 19 nt, Human
uagcuaauguaauaacugu

SEQ ID NO: 2361581 - RNA, 20 nt, Human
uagcuacaggaagcacccca

SEQ ID NO: 2361582 - RNA, 15 nt, Human
uagcuacaggaagca

SEQ ID NO: 2361583 - RNA, 22 nt, Human
uagcuauauccauguacuguag

SEQ ID NO: 2361584 - RNA, 15 nt, Human
uagcuauaucuauau

SEQ ID NO: 2361585 - RNA, 21 nt, Human
uagcuauauccauguacugua

SEQ ID NO: 2361586 - RNA, 20 nt, Human
uagcuauauccauguacugu

SEQ ID NO: 2361587 - RNA, 19 nt, Human
uagcuauauccauguacug

SEQ ID NO: 2361588 - RNA, 18 nt, Human
uagcuauauccauguacu

SEQ ID NO: 2361589 - RNA, 17 nt, Human
uagcuauauccauguac

SEQ ID NO: 2361590 - RNA, 16 nt, Human
uagcuauauccaugua

SEQ ID NO: 2361591 - RNA, 15 nt, Human
uagcuagaggaacca

SEQ ID NO: 2361592 - RNA, 14 nt, Human
uagcuagaggaacc

SEQ ID NO: 2361593 - RNA, 13 nt, Human
uagcuagaggaac

SEQ ID NO: 2361594 - RNA, 15 nt, Human
uagcuauauccaugu

SEQ ID NO: 2361595 - RNA, 14 nt, Human
uagcuauauccaug

SEQ ID NO: 2361596 - RNA, 16 nt, Human
uagcugugaccucucc

SEQ ID NO: 2361597 - RNA, 17 nt, Human
uagcuauaucuauauau

SEQ ID NO: 2361598 - RNA, 14 nt, Human
uagcuaucagaaga

SEQ ID NO: 2361599 - RNA, 15 nt, Human
uagcuaucagaagac

SEQ ID NO: 2361600 - RNA, 16 nt, Human
uagcuaucagaagacc

SEQ ID NO: 2361601 - RNA, 10 nt, Human
uagcuguggg

SEQ ID NO: 2361602 - RNA, 21 nt, Human
uagggaauggcacagcccaaa

SEQ ID NO: 2361603 - RNA, 21 nt, Human
uagggaagggugguggagcca

SEQ ID NO: 2361604 - RNA, 22 nt, Human
uagggacaauacagaacccauu

SEQ ID NO: 2361605 - RNA, 20 nt, Human
uagggaagggugguggagcc

SEQ ID NO: 2361606 - RNA, 14 nt, Human
uagggaaguaacag

SEQ ID NO: 2361607 - RNA, 14 nt, Human
uagggaagggccug

SEQ ID NO: 2361608 - RNA, 21 nt, Human
uagggaaggauacaaaagcau

SEQ ID NO: 2361609 - RNA, 12 nt, Human
uaggcauuuccu

SEQ ID NO: 2361610 - RNA, 16 nt, Human
uaggcaggacaugcug

SEQ ID NO: 2361611 - RNA, 14 nt, Human
uagggacuuaaaaa

SEQ ID NO: 2361612 - RNA, 16 nt, Human
uagggagaaauguugu

SEQ ID NO: 2361613 - RNA, 13 nt, Human
uagggacuuaaaa

SEQ ID NO: 2361614 - RNA, 17 nt, Human
uagggaccccuccuccc

SEQ ID NO: 2361615 - RNA, 20 nt, Human
uagggacucaauuucucccc

SEQ ID NO: 2361616 - RNA, 15 nt, Human
uagggaccccuccuc

SEQ ID NO: 2361617 - RNA, 16 nt, Human
uagggaccccuccucc

SEQ ID NO: 2361618 - RNA, 14 nt, Human
uagggaccccuccu

SEQ ID NO: 2361619 - RNA, 15 nt, Human
uagggagagaagaua

SEQ ID NO: 2361620 - RNA, 14 nt, Human
uagggagagaagau

SEQ ID NO: 2361621 - RNA, 11 nt, Human
uaggcagacac

SEQ ID NO: 2361622 - RNA, 12 nt, Human
uaggcagacaca

SEQ ID NO: 2361623 - RNA, 14 nt, Human
uaggcagacacagg

SEQ ID NO: 2361624 - RNA, 15 nt, Human
uaggcagacacaggg

SEQ ID NO: 2361625 - RNA, 21 nt, Human
uaggagggaguuaucuaaaag

SEQ ID NO: 2361626 - RNA, 18 nt, Human
uaggagggaguuaucuaa

SEQ ID NO: 2361627 - RNA, 18 nt, Human
uaggcaaccuuuauuuuu

SEQ ID NO: 2361628 - RNA, 16 nt, Human
uaggagggaguuaucu

SEQ ID NO: 2361629 - RNA, 14 nt, Human
uaggagggagacac

SEQ ID NO: 2361630 - RNA, 13 nt, Human
uaggaggaugggc

SEQ ID NO: 2361631 - RNA, 20 nt, Human
uaggcauuugcugaauacag

SEQ ID NO: 2361632 - RNA, 16 nt, Human
uaggcauuugcugaau

SEQ ID NO: 2361633 - RNA, 13 nt, Human
uaggcagcagcuu

SEQ ID NO: 2361634 - RNA, 20 nt, Human
uaggcagauugaaaaggaca

SEQ ID NO: 2361635 - RNA, 13 nt, Human
uaggcagagccuu

SEQ ID NO: 2361636 - RNA, 16 nt, Human
uaggcagagccuuugg

SEQ ID NO: 2361637 - RNA, 17 nt, Human
uaggcagacuggguuuc

SEQ ID NO: 2361638 - RNA, 22 nt, Human
uaggcagacacagggacuugaa

SEQ ID NO: 2361639 - RNA, 12 nt, Human
uaggcagagccu

SEQ ID NO: 2361640 - RNA, 14 nt, Human
uaggcauuguggga

SEQ ID NO: 2361641 - RNA, 13 nt, Human
uaggacuguagaa

SEQ ID NO: 2361642 - RNA, 14 nt, Human
uaggacuguagaaa

SEQ ID NO: 2361643 - RNA, 18 nt, Human
uaggacucugaggcucuu

SEQ ID NO: 2361644 - RNA, 17 nt, Human
uaggagaaccaaaucug

SEQ ID NO: 2361645 - RNA, 12 nt, Human
uaggagaagcca

SEQ ID NO: 2361646 - RNA, 20 nt, Human
uaggagaaccaaaucuggaa

SEQ ID NO: 2361647 - RNA, 21 nt, Human
uaggagaccaaggcgggagca

SEQ ID NO: 2361648 - RNA, 14 nt, Human
uaggagaccaaggc

SEQ ID NO: 2361649 - RNA, 14 nt, Human
uaggagagaccgag

SEQ ID NO: 2361650 - RNA, 22 nt, Human
uaggagaauugcuugaaccugg

SEQ ID NO: 2361651 - RNA, 16 nt, Human
uaggagaagccaggaa

SEQ ID NO: 2361652 - RNA, 15 nt, Human
uaggagaagccagga

SEQ ID NO: 2361653 - RNA, 22 nt, Human
uaggagauaccagguugaaaga

SEQ ID NO: 2361654 - RNA, 16 nt, Human
uaggagauaccagguu

SEQ ID NO: 2361655 - RNA, 22 nt, Human
uaggagaggaugagagcccaga

SEQ ID NO: 2361656 - RNA, 14 nt, Human
uaggagaggaugag

SEQ ID NO: 2361657 - RNA, 18 nt, Human
uaggagaggaugagagcc

SEQ ID NO: 2361658 - RNA, 14 nt, Human
uaggagcagagcuc

SEQ ID NO: 2361659 - RNA, 11 nt, Human
uaggagccugc

SEQ ID NO: 2361660 - RNA, 18 nt, Human
uaggagcugggaggaaaa

SEQ ID NO: 2361661 - RNA, 20 nt, Human
uaggaggaccagagcuacug

SEQ ID NO: 2361662 - RNA, 14 nt, Human
uaggagcugggagg

SEQ ID NO: 2361663 - RNA, 23 nt, Human
uaggagcugccuuggcucagaca

SEQ ID NO: 2361664 - RNA, 18 nt, Human
uaggagcugccuuggcuc

SEQ ID NO: 2361665 - RNA, 15 nt, Human
uaggagccugcuggu

SEQ ID NO: 2361666 - RNA, 23 nt, Human
uaggagccugcuggucacagccu

SEQ ID NO: 2361667 - RNA, 16 nt, Human
uaggacucugaggcuc

SEQ ID NO: 2361668 - RNA, 15 nt, Human
uaggacucugaggcu

SEQ ID NO: 2361669 - RNA, 14 nt, Human
uaggacucugaggc

SEQ ID NO: 2361670 - RNA, 19 nt, Human
uaggacucaaaguuucaga

SEQ ID NO: 2361671 - RNA, 16 nt, Human
uaggacgccacccagc

SEQ ID NO: 2361672 - RNA, 19 nt, Human
uaggaccuuuccaccacag

SEQ ID NO: 2361673 - RNA, 21 nt, Human
uaggaccuuuccaccacagcc

SEQ ID NO: 2361674 - RNA, 22 nt, Human
uaggaccuuuccaccacagcca

SEQ ID NO: 2361675 - RNA, 16 nt, Human
uaggaaaugaaugugu

SEQ ID NO: 2361676 - RNA, 15 nt, Human
uaggacgccacccag

SEQ ID NO: 2361677 - RNA, 20 nt, Human
uaggaaauaaaaccuuucaa

SEQ ID NO: 2361678 - RNA, 14 nt, Human
uaggaaaugaaugu

SEQ ID NO: 2361679 - RNA, 16 nt, Human
uaggaaauccagggug

SEQ ID NO: 2361680 - RNA, 19 nt, Human
uaggaaauauuuauuuuaa

SEQ ID NO: 2361681 - RNA, 18 nt, Human
uagcuguggugagguggg

SEQ ID NO: 2361682 - RNA, 14 nt, Human
uagcuguggugagg

SEQ ID NO: 2361683 - RNA, 14 nt, Human
uagcugugugaaau

SEQ ID NO: 2361684 - RNA, 13 nt, Human
uagcugugggggu

SEQ ID NO: 2361685 - RNA, 14 nt, Human
uagcugugggggug

SEQ ID NO: 2361686 - RNA, 16 nt, Human
uagcuguugagcuguu

SEQ ID NO: 2361687 - RNA, 17 nt, Human
uagcuguugagcuguuu

SEQ ID NO: 2361688 - RNA, 13 nt, Human
uagcuguugagcu

SEQ ID NO: 2361689 - RNA, 17 nt, Human
uagcuguuauuucuauu

SEQ ID NO: 2361690 - RNA, 20 nt, Human
uagcuguuauuucuauuuuu

SEQ ID NO: 2361691 - RNA, 19 nt, Human
uaggaaauaaaaccuuuca

SEQ ID NO: 2361692 - RNA, 18 nt, Human
uaggaaauauuuauuuua

SEQ ID NO: 2361693 - RNA, 14 nt, Human
gugaugaacuuucu

SEQ ID NO: 2361694 - RNA, 15 nt, Human
gugaugaacuuucuc

SEQ ID NO: 2361695 - RNA, 23 nt, Human
gugaugguuccccuguucacucu

SEQ ID NO: 2361696 - RNA, 22 nt, Human
gugaucuuggcuuacugcagcc

SEQ ID NO: 2361697 - RNA, 15 nt, Human
gugaucugaacagaa

SEQ ID NO: 2361698 - RNA, 13 nt, Human
gugaucuccauau

SEQ ID NO: 2361699 - RNA, 12 nt, Human
gugaucuccaua

SEQ ID NO: 2361700 - RNA, 19 nt, Human
gugauccuuuuauguuauu

SEQ ID NO: 2361701 - RNA, 14 nt, Human
gugaucucauuuaa

SEQ ID NO: 2361702 - RNA, 15 nt, Human
gugaucucagaucag

SEQ ID NO: 2361703 - RNA, 14 nt, Human
gugaucucagauca

SEQ ID NO: 2361704 - RNA, 22 nt, Human
aacuugagcuuuaaaaaucauu

SEQ ID NO: 2361705 - RNA, 14 nt, Human
gugauccuuuuaug

SEQ ID NO: 2361706 - RNA, 22 nt, Human
gugaugguuccccuguucacuc

SEQ ID NO: 2361707 - RNA, 15 nt, Human
gugaugugaagccaa

SEQ ID NO: 2361708 - RNA, 14 nt, Human
gugaugucaucugu

SEQ ID NO: 2361709 - RNA, 14 nt, Human
gugauguuuguccu

SEQ ID NO: 2361710 - RNA, 10 nt, Human
gugauguguc

SEQ ID NO: 2361711 - RNA, 15 nt, Human
gugaugugaguugca

SEQ ID NO: 2361712 - RNA, 14 nt, Human
gugcaagugugugc

SEQ ID NO: 2361713 - RNA, 19 nt, Human
gugauuauuuguuauuugu

SEQ ID NO: 2361714 - RNA, 22 nt, Human
gugauucaauucaacacucccu

SEQ ID NO: 2361715 - RNA, 23 nt, Human
gugauucaaucuguaaacugugu

SEQ ID NO: 2361716 - RNA, 21 nt, Human
gugauucaaucuguaaacugu

SEQ ID NO: 2361717 - RNA, 16 nt, Human
gugauuauuucacuuu

SEQ ID NO: 2361718 - RNA, 22 nt, Human
gugauuagagggaggagaauga

SEQ ID NO: 2361719 - RNA, 16 nt, Human
gugauucaaucuguaa

SEQ ID NO: 2361720 - RNA, 14 nt, Human
gugauucaaucugu

SEQ ID NO: 2361721 - RNA, 22 nt, Human
gugcaagugugugcacaugugu

SEQ ID NO: 2361722 - RNA, 15 nt, Human
gugcaagugugugca

SEQ ID NO: 2361723 - RNA, 20 nt, Human
gugcaagugugugcaugugu

SEQ ID NO: 2361724 - RNA, 21 nt, Human
gugcaauaaaucugacccagu

SEQ ID NO: 2361725 - RNA, 19 nt, Human
gugcaauaaaucugaccca

SEQ ID NO: 2361726 - RNA, 23 nt, Human
gugcaauaaaucugacccagugc

SEQ ID NO: 2361727 - RNA, 22 nt, Human
gugcaauaaaucugacccagug

SEQ ID NO: 2361728 - RNA, 17 nt, Human
gugauuacauaaucugu

SEQ ID NO: 2361729 - RNA, 19 nt, Human
gugauuagaggcagaucug

SEQ ID NO: 2361730 - RNA, 19 nt, Human
gugauuaaacgugcagacu

SEQ ID NO: 2361731 - RNA, 22 nt, Human
gugauguuuaacaggaagaucu

SEQ ID NO: 2361732 - RNA, 14 nt, Human
gugauuaaacgugc

SEQ ID NO: 2361733 - RNA, 15 nt, Human
gugauuaaacgugca

SEQ ID NO: 2361734 - RNA, 18 nt, Human
gugauuaaacgugcagac

SEQ ID NO: 2361735 - RNA, 17 nt, Human
gugauuaccagggacug

SEQ ID NO: 2361736 - RNA, 16 nt, Human
gugauuaccagggacu

SEQ ID NO: 2361737 - RNA, 11 nt, Human
gugauuaccag

SEQ ID NO: 2361738 - RNA, 21 nt, Human
gugcacaugcacgugugugca

SEQ ID NO: 2361739 - RNA, 23 nt, Human
gugcacaagcuccaagcucccag

SEQ ID NO: 2361740 - RNA, 15 nt, Human
gugcacccacucugc

SEQ ID NO: 2361741 - RNA, 23 nt, Human
gugcaccaucccuuuuugaagug

SEQ ID NO: 2361742 - RNA, 19 nt, Human
gugcacccaugggcucuga

SEQ ID NO: 2361743 - RNA, 23 nt, Human
gugcacccaugggcucugacaga

SEQ ID NO: 2361744 - RNA, 16 nt, Human
gugcaccaucccuuuu

SEQ ID NO: 2361745 - RNA, 20 nt, Human
gugcacaaauauuuauuuuc

SEQ ID NO: 2361746 - RNA, 18 nt, Human
gugcaaugaccuuucaau

SEQ ID NO: 2361747 - RNA, 13 nt, Human
gugcacaagcucc

SEQ ID NO: 2361748 - RNA, 16 nt, Human
gugcacaagcuccaag

SEQ ID NO: 2361749 - RNA, 21 nt, Human
gugcacaagcuccaagcuccc

SEQ ID NO: 2361750 - RNA, 21 nt, Human
gugcaccuguacucaggaggc

SEQ ID NO: 2361751 - RNA, 18 nt, Human
gugcaccuguacucagga

SEQ ID NO: 2361752 - RNA, 20 nt, Human
gugcaccuuaccaacuuucu

SEQ ID NO: 2361753 - RNA, 21 nt, Human
gugcaccuuaccaacuuucug

SEQ ID NO: 2361754 - RNA, 19 nt, Human
gugcauucuuuuaaaagac

SEQ ID NO: 2361755 - RNA, 22 nt, Human
gugcauucuuuuaaaagacaag

SEQ ID NO: 2361756 - RNA, 23 nt, Human
gugcauucuuuuaaaagacaaga

SEQ ID NO: 2361757 - RNA, 20 nt, Human
gugcauuggaagaccccacc

SEQ ID NO: 2361758 - RNA, 21 nt, Human
gugcauuggaagaccccaccc

SEQ ID NO: 2361759 - RNA, 19 nt, Human
gugcauuugaggucuguuc

SEQ ID NO: 2361760 - RNA, 17 nt, Human
gugcauuugaggucugu

SEQ ID NO: 2361761 - RNA, 16 nt, Human
gugcauuuuugugaaa

SEQ ID NO: 2361762 - RNA, 17 nt, Human
gugcauuuucccagaua

SEQ ID NO: 2361763 - RNA, 22 nt, Human
gugccaaacaaaaagguucuca

SEQ ID NO: 2361764 - RNA, 23 nt, Human
gugccaaaaacaacaacaaaaug

SEQ ID NO: 2361765 - RNA, 21 nt, Human
gugcauuuggugguuucagaa

SEQ ID NO: 2361766 - RNA, 11 nt, Human
gugcauugugc

SEQ ID NO: 2361767 - RNA, 13 nt, Human
gugcauugugcuu

SEQ ID NO: 2361768 - RNA, 17 nt, Human
gugcauuuaugagcucu

SEQ ID NO: 2361769 - RNA, 19 nt, Human
aacuugagggcccagagca

SEQ ID NO: 2361770 - RNA, 24 nt, Human
aacuucuuuguaaucguuaugugu

SEQ ID NO: 2361771 - RNA, 22 nt, Human
aacuucagagggaaaguaaaua

SEQ ID NO: 2361772 - RNA, 15 nt, Human
aacuucagacacaaa

SEQ ID NO: 2361773 - RNA, 13 nt, Human
aacuucagacaua

SEQ ID NO: 2361774 - RNA, 18 nt, Human
aacuucagcgguuuauau

SEQ ID NO: 2361775 - RNA, 22 nt, Human
aacuuccuuggacucauuuuaa

SEQ ID NO: 2361776 - RNA, 20 nt, Human
aacuucgaaagcaucauuau

SEQ ID NO: 2361777 - RNA, 11 nt, Human
aacuucagcag

SEQ ID NO: 2361778 - RNA, 21 nt, Human
aacuucagcgguuuauauaag

SEQ ID NO: 2361779 - RNA, 23 nt, Human
aacuuccuuggacucauuuuaaa

SEQ ID NO: 2361780 - RNA, 14 nt, Human
aacuucuaauauau

SEQ ID NO: 2361781 - RNA, 16 nt, Human
aacuucuaauauauuu

SEQ ID NO: 2361782 - RNA, 18 nt, Human
aacuucagcaguaccuau

SEQ ID NO: 2361783 - RNA, 17 nt, Human
aacuucgcaucaaaaga

SEQ ID NO: 2361784 - RNA, 19 nt, Human
aacuucgcaucaaaagaca

SEQ ID NO: 2361785 - RNA, 23 nt, Human
aacuucgcaucaaaagacaauuc

SEQ ID NO: 2361786 - RNA, 20 nt, Human
aacuguggccguuaucugga

SEQ ID NO: 2361787 - RNA, 11 nt, Human
aacuguggccg

SEQ ID NO: 2361788 - RNA, 23 nt, Human
aacuguguacauaacugaaaaug

SEQ ID NO: 2361789 - RNA, 21 nt, Human
aacuguguacauaacugaaaa

SEQ ID NO: 2361790 - RNA, 20 nt, Human
aacuguguacauaacugaaa

SEQ ID NO: 2361791 - RNA, 22 nt, Human
aacugugcagagucuagaaguu

SEQ ID NO: 2361792 - RNA, 19 nt, Human
aacugugaaguuuacauug

SEQ ID NO: 2361793 - RNA, 17 nt, Human
aacugugaaguuuacau

SEQ ID NO: 2361794 - RNA, 19 nt, Human
aacugucucucaugaaccu

SEQ ID NO: 2361795 - RNA, 18 nt, Human
aacuguguggacugugau

SEQ ID NO: 2361796 - RNA, 17 nt, Human
aacuguguucauuagaa

SEQ ID NO: 2361797 - RNA, 14 nt, Human
aacuucacauauug

SEQ ID NO: 2361798 - RNA, 22 nt, Human
aacuucaccauauuaccacaga

SEQ ID NO: 2361799 - RNA, 22 nt, Human
aacuucacauauugauuuccgu

SEQ ID NO: 2361800 - RNA, 14 nt, Human
aacugcauuagaaa

SEQ ID NO: 2361801 - RNA, 19 nt, Human
aacugccaguuuuguuucc

SEQ ID NO: 2361802 - RNA, 14 nt, Human
aacugccaguuuug

SEQ ID NO: 2361803 - RNA, 17 nt, Human
aacugcccccucugccc

SEQ ID NO: 2361804 - RNA, 16 nt, Human
aacugcccccucugcc

SEQ ID NO: 2361805 - RNA, 21 nt, Human
aacugcccccucugcccugcg

SEQ ID NO: 2361806 - RNA, 20 nt, Human
aacugcccccucugcccugc

SEQ ID NO: 2361807 - RNA, 19 nt, Human
aacugcccccucugcccug

SEQ ID NO: 2361808 - RNA, 18 nt, Human
aacugcccccucugcccu

SEQ ID NO: 2361809 - RNA, 14 nt, Human
aacuguccagagag

SEQ ID NO: 2361810 - RNA, 14 nt, Human
aacugucuauuucu

SEQ ID NO: 2361811 - RNA, 16 nt, Human
aacugucuauuucugc

SEQ ID NO: 2361812 - RNA, 23 nt, Human
aacugucucgaugcaaugaacac

SEQ ID NO: 2361813 - RNA, 17 nt, Human
aacugucuauuucugcu

SEQ ID NO: 2361814 - RNA, 19 nt, Human
aacugucuauuucugcuga

SEQ ID NO: 2361815 - RNA, 16 nt, Human
aacuguccagagagca

SEQ ID NO: 2361816 - RNA, 16 nt, Human
aacugcccccaacuuu

SEQ ID NO: 2361817 - RNA, 16 nt, Human
aacugccuacuccaaa

SEQ ID NO: 2361818 - RNA, 21 nt, Human
gugcuacacccuuuuccagcu

SEQ ID NO: 2361819 - RNA, 23 nt, Human
aagaauaaucacgcuuuccugaa

SEQ ID NO: 2361820 - RNA, 16 nt, Human
gugcuaccuggguccu

SEQ ID NO: 2361821 - RNA, 19 nt, Human
gugcuaccuggguccuuuu

SEQ ID NO: 2361822 - RNA, 20 nt, Human
gugcuacguacaugugaggc

SEQ ID NO: 2361823 - RNA, 16 nt, Human
gugcuacugauuguuu

SEQ ID NO: 2361824 - RNA, 16 nt, Human
aagaauacaaacauau

SEQ ID NO: 2361825 - RNA, 22 nt, Human
gugcuacaaaaacacagcaagg

SEQ ID NO: 2361826 - RNA, 17 nt, Human
gugcuaggaacacuccu

SEQ ID NO: 2361827 - RNA, 21 nt, Human
gugcuauacugcauacuuuuu

SEQ ID NO: 2361828 - RNA, 16 nt, Human
gugcuauaggcuggag

SEQ ID NO: 2361829 - RNA, 18 nt, Human
gugcuauaggcuggagaa

SEQ ID NO: 2361830 - RNA, 19 nt, Human
gugcuauaggcuggagaag

SEQ ID NO: 2361831 - RNA, 15 nt, Human
gugcuaucuccccca

SEQ ID NO: 2361832 - RNA, 18 nt, Human
gugcuaucucccccagcc

SEQ ID NO: 2361833 - RNA, 14 nt, Human
aagaagagacagga

SEQ ID NO: 2361834 - RNA, 22 nt, Human
aagaagagagaagacccuucuc

SEQ ID NO: 2361835 - RNA, 10 nt, Human
aagaagagac

SEQ ID NO: 2361836 - RNA, 11 nt, Human
aagaagagaca

SEQ ID NO: 2361837 - RNA, 13 nt, Human
aagaagacuuuuu

SEQ ID NO: 2361838 - RNA, 22 nt, Human
aagaagaucacgcuccccgccu

SEQ ID NO: 2361839 - RNA, 19 nt, Human
aagaagauccuaaaacaaa

SEQ ID NO: 2361840 - RNA, 22 nt, Human
aagaagaggagaaaaaaacuuc

SEQ ID NO: 2361841 - RNA, 13 nt, Human
aagaagagggaga

SEQ ID NO: 2361842 - RNA, 17 nt, Human
aagaagaucacgcuccc

SEQ ID NO: 2361843 - RNA, 21 nt, Human
aagaagaucacgcuccccgcc

SEQ ID NO: 2361844 - RNA, 21 nt, Human
aagaauaauaugcugccaaau

SEQ ID NO: 2361845 - RNA, 23 nt, Human
aagaauaaaauguugaaaaguca

SEQ ID NO: 2361846 - RNA, 20 nt, Human
aagaauaaaauguugaaaag

SEQ ID NO: 2361847 - RNA, 21 nt, Human
aagaauaaaauguugaaaagu

SEQ ID NO: 2361848 - RNA, 22 nt, Human
aagaauaaucacgcuuuccuga

SEQ ID NO: 2361849 - RNA, 16 nt, Human
aagaauaaucacgcuu

SEQ ID NO: 2361850 - RNA, 15 nt, Human
aagaauaaaauguug

SEQ ID NO: 2361851 - RNA, 18 nt, Human
aagaauaaaauguugaaa

SEQ ID NO: 2361852 - RNA, 14 nt, Human
aagaagauguuuaa

SEQ ID NO: 2361853 - RNA, 17 nt, Human
aagaaguuuaaggaaua

SEQ ID NO: 2361854 - RNA, 14 nt, Human
aagaaguuuaagga

SEQ ID NO: 2361855 - RNA, 16 nt, Human
gugcucugaucaucca

SEQ ID NO: 2361856 - RNA, 15 nt, Human
gugcucuccaagccc

SEQ ID NO: 2361857 - RNA, 22 nt, Human
gugcucgcuguugcugaauagg

SEQ ID NO: 2361858 - RNA, 21 nt, Human
gugcucgagacacagugaagc

SEQ ID NO: 2361859 - RNA, 13 nt, Human
gugcucuggacag

SEQ ID NO: 2361860 - RNA, 14 nt, Human
gugcucuggacagg

SEQ ID NO: 2361861 - RNA, 12 nt, Human
gugcugcccugc

SEQ ID NO: 2361862 - RNA, 13 nt, Human
gugcugcccugcc

SEQ ID NO: 2361863 - RNA, 14 nt, Human
gugcugcccugccc

SEQ ID NO: 2361864 - RNA, 15 nt, Human
gugcugcccugccca

SEQ ID NO: 2361865 - RNA, 13 nt, Human
gugcucagggcug

SEQ ID NO: 2361866 - RNA, 13 nt, Human
gugcucagggcua

SEQ ID NO: 2361867 - RNA, 21 nt, Human
gugcuauaggcuggagaagcu

SEQ ID NO: 2361868 - RNA, 13 nt, Human
gugcucaguugua

SEQ ID NO: 2361869 - RNA, 17 nt, Human
gugcucaguuguagaau

SEQ ID NO: 2361870 - RNA, 19 nt, Human
gugcucaguuguagaaugu

SEQ ID NO: 2361871 - RNA, 19 nt, Human
gugcucaggagcccuggga

SEQ ID NO: 2361872 - RNA, 18 nt, Human
gugcucaggagcccuggg

SEQ ID NO: 2361873 - RNA, 19 nt, Human
gugcuaucucccccagccc

SEQ ID NO: 2361874 - RNA, 16 nt, Human
gugcucaggagcccug

SEQ ID NO: 2361875 - RNA, 18 nt, Human
gugcucccuaccaccucc

SEQ ID NO: 2361876 - RNA, 13 nt, Human
gugcuccgugccu

SEQ ID NO: 2361877 - RNA, 16 nt, Human
gugcuccgugccucca

SEQ ID NO: 2361878 - RNA, 17 nt, Human
gugcuccgugccuccac

SEQ ID NO: 2361879 - RNA, 15 nt, Human
gugcucccuaccacc

SEQ ID NO: 2361880 - RNA, 13 nt, Human
gugcuccaggcag

SEQ ID NO: 2361881 - RNA, 22 nt, Human
gugcucaguuguagaauguauu

SEQ ID NO: 2361882 - RNA, 16 nt, Human
gugcucauuucaggau

SEQ ID NO: 2361883 - RNA, 16 nt, Human
gugcuccagccuggcu

SEQ ID NO: 2361884 - RNA, 14 nt, Human
gugcucgcccugcg

SEQ ID NO: 2361885 - RNA, 15 nt, Human
gugcucgcuguugcu

SEQ ID NO: 2361886 - RNA, 18 nt, Human
gugcucgcuguugcugaa

SEQ ID NO: 2361887 - RNA, 19 nt, Human
gugcucgcuguugcugaau

SEQ ID NO: 2361888 - RNA, 16 nt, Human
gugcucgccccagcag

SEQ ID NO: 2361889 - RNA, 14 nt, Human
gugcucgccccagc

SEQ ID NO: 2361890 - RNA, 14 nt, Human
gugcuccuccuugg

SEQ ID NO: 2361891 - RNA, 18 nt, Human
gugcuccgugccuccacc

SEQ ID NO: 2361892 - RNA, 22 nt, Human
gugcuccgugccuccaccacca

SEQ ID NO: 2361893 - RNA, 19 nt, Human
aagaaagcccuuaggaaga

SEQ ID NO: 2361894 - RNA, 16 nt, Human
aagaaagcauagacau

SEQ ID NO: 2361895 - RNA, 17 nt, Human
aagaaagcugguaaacu

SEQ ID NO: 2361896 - RNA, 22 nt, Human
aagaaagcuucaaacugcauga

SEQ ID NO: 2361897 - RNA, 23 nt, Human
aagaaagagcaacaauccaucuc

SEQ ID NO: 2361898 - RNA, 20 nt, Human
aagaaagagagaaaauaaaa

SEQ ID NO: 2361899 - RNA, 17 nt, Human
aagaaagaggagugcuu

SEQ ID NO: 2361900 - RNA, 18 nt, Human
aagaaagagagaaaauaa

SEQ ID NO: 2361901 - RNA, 16 nt, Human
aagaaagagagaaaau

SEQ ID NO: 2361902 - RNA, 15 nt, Human
aagaaagagagaaaa

SEQ ID NO: 2361903 - RNA, 14 nt, Human
aagaaagagagaaa

SEQ ID NO: 2361904 - RNA, 18 nt, Human
aagaaacccgacagaggg

SEQ ID NO: 2361905 - RNA, 16 nt, Human
aagaaacccgacagag

SEQ ID NO: 2361906 - RNA, 13 nt, Human
aagaaagagagaa

SEQ ID NO: 2361907 - RNA, 12 nt, Human
aagaaagagaga

SEQ ID NO: 2361908 - RNA, 16 nt, Human
aagaaagaaaaucagg

SEQ ID NO: 2361909 - RNA, 13 nt, Human
aagaaagaaaauc

SEQ ID NO: 2361910 - RNA, 14 nt, Human
aagaaagaaaauca

SEQ ID NO: 2361911 - RNA, 22 nt, Human
aagaaacacacugaggcaggga

SEQ ID NO: 2361912 - RNA, 19 nt, Human
aagaaacaacucuuugaga

SEQ ID NO: 2361913 - RNA, 14 nt, Human
aagaaacaacagaa

SEQ ID NO: 2361914 - RNA, 11 nt, Human
aagaaacccaa

SEQ ID NO: 2361915 - RNA, 19 nt, Human
aagaaacagaucuccuggc

SEQ ID NO: 2361916 - RNA, 11 nt, Human
aagaaacauuu

SEQ ID NO: 2361917 - RNA, 22 nt, Human
aagaaaauaguggugugauuug

SEQ ID NO: 2361918 - RNA, 21 nt, Human
aagaaaauaguggugugauuu

SEQ ID NO: 2361919 - RNA, 15 nt, Human
aagaaaauaguggug

SEQ ID NO: 2361920 - RNA, 16 nt, Human
aagaaaacaucuauuc

SEQ ID NO: 2361921 - RNA, 13 nt, Human
aagaaaacaucua

SEQ ID NO: 2361922 - RNA, 16 nt, Human
aagaaaauaccaagga

SEQ ID NO: 2361923 - RNA, 22 nt, Human
gugcauuuuugugaaaugaaaa

SEQ ID NO: 2361924 - RNA, 18 nt, Human
gugcauuuuugugaaaug

SEQ ID NO: 2361925 - RNA, 20 nt, Human
gugccaacaauccuagugcu

SEQ ID NO: 2361926 - RNA, 13 nt, Human
gugccaacacuca

SEQ ID NO: 2361927 - RNA, 18 nt, Human
gugccaacacucaagaag

SEQ ID NO: 2361928 - RNA, 19 nt, Human
gugccagauuuaugcauau

SEQ ID NO: 2361929 - RNA, 14 nt, Human
gugccagagguggg

SEQ ID NO: 2361930 - RNA, 15 nt, Human
gugccagaggugggc

SEQ ID NO: 2361931 - RNA, 16 nt, Human
gugccagaggugggca

SEQ ID NO: 2361932 - RNA, 17 nt, Human
gugccagaggugggcag

SEQ ID NO: 2361933 - RNA, 18 nt, Human
gugccagaggugggcagg

SEQ ID NO: 2361934 - RNA, 19 nt, Human
gugccagaggugggcaggu

SEQ ID NO: 2361935 - RNA, 20 nt, Human
gugccagaggugggcaggug

SEQ ID NO: 2361936 - RNA, 21 nt, Human
gugccagaggugggcaggugg

SEQ ID NO: 2361937 - RNA, 23 nt, Human
aacuuuaccuuuuuuauacauaa

SEQ ID NO: 2361938 - RNA, 22 nt, Human
aacuuuaccuuuuuuauacaua

SEQ ID NO: 2361939 - RNA, 21 nt, Human
aacuuuaccuuuuuuauacau

SEQ ID NO: 2361940 - RNA, 22 nt, Human
gugccagaggugggcagguggu

SEQ ID NO: 2361941 - RNA, 14 nt, Human
gugccagcaaagcc

SEQ ID NO: 2361942 - RNA, 15 nt, Human
gugccagcaaagccc

SEQ ID NO: 2361943 - RNA, 16 nt, Human
gugccagcaaagcccc

SEQ ID NO: 2361944 - RNA, 17 nt, Human
gugccagcaaagcccca

SEQ ID NO: 2361945 - RNA, 18 nt, Human
gugccagcaaagccccau

SEQ ID NO: 2361946 - RNA, 19 nt, Human
gugccagcaaagccccaug

SEQ ID NO: 2361947 - RNA, 12 nt, Human
gugccagcaacu

SEQ ID NO: 2361948 - RNA, 18 nt, Human
aagaaaaagaaaaagaaa

SEQ ID NO: 2361949 - RNA, 13 nt, Human
aagaaaaagaaaa

SEQ ID NO: 2361950 - RNA, 22 nt, Human
aacuuuagaguagcaugagaga

SEQ ID NO: 2361951 - RNA, 20 nt, Human
aacuuuacuaagaugacauu

SEQ ID NO: 2361952 - RNA, 16 nt, Human
gugccagcaacugaau

SEQ ID NO: 2361953 - RNA, 18 nt, Human
gugccagcaacugaauaa

SEQ ID NO: 2361954 - RNA, 22 nt, Human
gugccaacacucaagaagcagg

SEQ ID NO: 2361955 - RNA, 21 nt, Human
gugccagcaacugaauaaaua

SEQ ID NO: 2361956 - RNA, 19 nt, Human
aacuuuacuaagaugacau

SEQ ID NO: 2361957 - RNA, 19 nt, Human
aagaaaaaauauuuucccu

SEQ ID NO: 2361958 - RNA, 18 nt, Human
aagaaaaaugagccuggc

SEQ ID NO: 2361959 - RNA, 19 nt, Human
aagaaaaaucauguuugcu

SEQ ID NO: 2361960 - RNA, 22 nt, Human
aagaaaaaucauguuugcucuc

SEQ ID NO: 2361961 - RNA, 14 nt, Human
aagaaaacaacuuc

SEQ ID NO: 2361962 - RNA, 17 nt, Human
aagaaaaaugagccugg

SEQ ID NO: 2361963 - RNA, 16 nt, Human
aagaaaaaauacauuu

SEQ ID NO: 2361964 - RNA, 14 nt, Human
aagaaaaaauacau

SEQ ID NO: 2361965 - RNA, 12 nt, Human
aagaaaaaauac

SEQ ID NO: 2361966 - RNA, 17 nt, Human
aagaaaaaucauguuug

SEQ ID NO: 2361967 - RNA, 17 nt, Human
aacucuuuuugggcucc

SEQ ID NO: 2361968 - RNA, 23 nt, Human
aacucuuuuugggcuccuuuuuc

SEQ ID NO: 2361969 - RNA, 14 nt, Human
aacucuuugagaaa

SEQ ID NO: 2361970 - RNA, 13 nt, Human
aacucuuucaaaa

SEQ ID NO: 2361971 - RNA, 19 nt, Human
aacucuuugaaugacaaag

SEQ ID NO: 2361972 - RNA, 20 nt, Human
aacugauuuuuuuuuccuuc

SEQ ID NO: 2361973 - RNA, 21 nt, Human
aacugauuuuuuuuuccuuca

SEQ ID NO: 2361974 - RNA, 14 nt, Human
aacugcauugagaa

SEQ ID NO: 2361975 - RNA, 16 nt, Human
aacugcauuagaaauu

SEQ ID NO: 2361976 - RNA, 20 nt, Human
aacugcauugagaacugcau

SEQ ID NO: 2361977 - RNA, 18 nt, Human
aacugccaaaaugcucua

SEQ ID NO: 2361978 - RNA, 16 nt, Human
aacugcauuggcuuug

SEQ ID NO: 2361979 - RNA, 22 nt, Human
aacugauuuuuuuuuccuucag

SEQ ID NO: 2361980 - RNA, 23 nt, Human
aacugauuuuuuuuuccuucagu

SEQ ID NO: 2361981 - RNA, 12 nt, Human
aacucucugaac

SEQ ID NO: 2361982 - RNA, 22 nt, Human
aacucucuccacccuauaugua

SEQ ID NO: 2361983 - RNA, 12 nt, Human
aacucucuccac

SEQ ID NO: 2361984 - RNA, 13 nt, Human
gugaggccuugcu

SEQ ID NO: 2361985 - RNA, 10 nt, Human
aacucucuuu

SEQ ID NO: 2361986 - RNA, 19 nt, Human
aacucucuuugggaauguu

SEQ ID NO: 2361987 - RNA, 22 nt, Human
aacucuccucugcugcuggcug

SEQ ID NO: 2361988 - RNA, 23 nt, Human
aacucuccucugcugcuggcugg

SEQ ID NO: 2361989 - RNA, 11 nt, Human
aacucuugauu

SEQ ID NO: 2361990 - RNA, 12 nt, Human
aacucuuucaaa

SEQ ID NO: 2361991 - RNA, 17 nt, Human
aacucuugguuucuuca

SEQ ID NO: 2361992 - RNA, 17 nt, Human
aacucuugauuauccau

SEQ ID NO: 2361993 - RNA, 16 nt, Human
aacucugacaacagac

SEQ ID NO: 2361994 - RNA, 19 nt, Human
aacucugaauuuuaaagca

SEQ ID NO: 2361995 - RNA, 14 nt, Human
gugaggcuguccug

SEQ ID NO: 2361996 - RNA, 16 nt, Human
gugaggcuguccugua

SEQ ID NO: 2361997 - RNA, 18 nt, Human
gugaggcucugcccuugg

SEQ ID NO: 2361998 - RNA, 17 nt, Human
gugagucaccaagccca

SEQ ID NO: 2361999 - RNA, 23 nt, Human
gugaguacuacaguccucccauc

SEQ ID NO: 2362000 - RNA, 19 nt, Human
gugagucaccaagcccagu

SEQ ID NO: 2362001 - RNA, 17 nt, Human
aacucuccucugcugcu

SEQ ID NO: 2362002 - RNA, 19 nt, Human
aacucuccucugcugcugg

SEQ ID NO: 2362003 - RNA, 21 nt, Human
aacucuccucugcugcuggcu

SEQ ID NO: 2362004 - RNA, 18 nt, Human
gugagacucugucucaaa

SEQ ID NO: 2362005 - RNA, 17 nt, Human
gugagagagaugggagc

SEQ ID NO: 2362006 - RNA, 19 nt, Human
gugagacgccaccauuccu

SEQ ID NO: 2362007 - RNA, 12 nt, Human
gugaggcucugc

SEQ ID NO: 2362008 - RNA, 13 nt, Human
gugaggcucugcc

SEQ ID NO: 2362009 - RNA, 14 nt, Human
gugaggcucugccc

SEQ ID NO: 2362010 - RNA, 15 nt, Human
gugaggcucugcccu

SEQ ID NO: 2362011 - RNA, 16 nt, Human
gugaggcucugcccuu

SEQ ID NO: 2362012 - RNA, 17 nt, Human
gugaggcucugcccuug

SEQ ID NO: 2362013 - RNA, 15 nt, Human
gugaauaauaaaagu

SEQ ID NO: 2362014 - RNA, 13 nt, Human
gugaauaaauguc

SEQ ID NO: 2362015 - RNA, 16 nt, Human
gugaauaaaugucuug

SEQ ID NO: 2362016 - RNA, 23 nt, Human
gugacagaggcagccccauucug

SEQ ID NO: 2362017 - RNA, 20 nt, Human
gugacagagugagacucugu

SEQ ID NO: 2362018 - RNA, 22 nt, Human
gugacagagugagacucugucu

SEQ ID NO: 2362019 - RNA, 18 nt, Human
gugacagaguucacuaua

SEQ ID NO: 2362020 - RNA, 17 nt, Human
gugacagaguucacuau

SEQ ID NO: 2362021 - RNA, 16 nt, Human
gugacagauuauacag

SEQ ID NO: 2362022 - RNA, 14 nt, Human
gugacaggcagcag

SEQ ID NO: 2362023 - RNA, 15 nt, Human
gugacaggcagcaga

SEQ ID NO: 2362024 - RNA, 16 nt, Human
gugacaggcagcagag

SEQ ID NO: 2362025 - RNA, 13 nt, Human
gugacagggaagc

SEQ ID NO: 2362026 - RNA, 16 nt, Human
gugacagggaagcuac

SEQ ID NO: 2362027 - RNA, 22 nt, Human
gugacagggaagcuacagguua

SEQ ID NO: 2362028 - RNA, 17 nt, Human
gugacagggaagcuaca

SEQ ID NO: 2362029 - RNA, 18 nt, Human
gugacagggaagcuacag

SEQ ID NO: 2362030 - RNA, 19 nt, Human
gugacagggaagcuacagg

SEQ ID NO: 2362031 - RNA, 20 nt, Human
gugacagggaagcuacaggu

SEQ ID NO: 2362032 - RNA, 23 nt, Human
gugacagugccugggaauguauu

SEQ ID NO: 2362033 - RNA, 17 nt, Human
gugacagugccugggaa

SEQ ID NO: 2362034 - RNA, 15 nt, Human
gugacagugccuggg

SEQ ID NO: 2362035 - RNA, 19 nt, Human
gugacaguauuuugguucu

SEQ ID NO: 2362036 - RNA, 15 nt, Human
gugacaucaguggca

SEQ ID NO: 2362037 - RNA, 14 nt, Human
gugacaucaguggc

SEQ ID NO: 2362038 - RNA, 18 nt, Human
gugacaguggauugcauu

SEQ ID NO: 2362039 - RNA, 14 nt, Human
gugaaguuuacauu

SEQ ID NO: 2362040 - RNA, 23 nt, Human
gugaauaauacaguaucucaggg

SEQ ID NO: 2362041 - RNA, 19 nt, Human
gugaaguuuaauugacuua

SEQ ID NO: 2362042 - RNA, 18 nt, Human
aacuccuggaaauaucag

SEQ ID NO: 2362043 - RNA, 17 nt, Human
aacuccugccccuguuc

SEQ ID NO: 2362044 - RNA, 18 nt, Human
aacuccugccccuguucu

SEQ ID NO: 2362045 - RNA, 12 nt, Human
aacuccugcccc

SEQ ID NO: 2362046 - RNA, 16 nt, Human
aacuccugacagucuu

SEQ ID NO: 2362047 - RNA, 14 nt, Human
aacuccugaccuca

SEQ ID NO: 2362048 - RNA, 12 nt, Human
aacuccugaccu

SEQ ID NO: 2362049 - RNA, 23 nt, Human
aacuccaccaacccaucagaagg

SEQ ID NO: 2362050 - RNA, 15 nt, Human
aacuccaccaaccca

SEQ ID NO: 2362051 - RNA, 17 nt, Human
aacuccacaucugccuu

SEQ ID NO: 2362052 - RNA, 18 nt, Human
aacuccacaucugccuua

SEQ ID NO: 2362053 - RNA, 14 nt, Human
aacuccacaucugc

SEQ ID NO: 2362054 - RNA, 15 nt, Human
aacuccacaucugcc

SEQ ID NO: 2362055 - RNA, 16 nt, Human
aacuccacaucugccu

SEQ ID NO: 2362056 - RNA, 19 nt, Human
aacuccaccuugcggggau

SEQ ID NO: 2362057 - RNA, 21 nt, Human
aacuccuagggccacugaaga

SEQ ID NO: 2362058 - RNA, 18 nt, Human
gugacuguggcacacgcc

SEQ ID NO: 2362059 - RNA, 21 nt, Human
gugacuuagcagaugcugguc

SEQ ID NO: 2362060 - RNA, 22 nt, Human
gugacauguguuggcagccucu

SEQ ID NO: 2362061 - RNA, 21 nt, Human
gugacauuuauuuuucucaug

SEQ ID NO: 2362062 - RNA, 22 nt, Human
gugacauuugggagacauguga

SEQ ID NO: 2362063 - RNA, 19 nt, Human
gugacaugucuuuucuugc

SEQ ID NO: 2362064 - RNA, 14 nt, Human
gugacaugugaaac

SEQ ID NO: 2362065 - RNA, 15 nt, Human
gugacaugugaaacc

SEQ ID NO: 2362066 - RNA, 16 nt, Human
gugacaugugaaaccu

SEQ ID NO: 2362067 - RNA, 17 nt, Human
gugacaugugaaaccuu

SEQ ID NO: 2362068 - RNA, 18 nt, Human
gugacaugugaaaccuuu

SEQ ID NO: 2362069 - RNA, 19 nt, Human
gugacaugugaaaccuuuu

SEQ ID NO: 2362070 - RNA, 20 nt, Human
gugacaugugaaaccuuuuu

SEQ ID NO: 2362071 - RNA, 22 nt, Human
gugacaugugaaaccuuuuuua

SEQ ID NO: 2362072 - RNA, 16 nt, Human
gugacuucagcucugu

SEQ ID NO: 2362073 - RNA, 21 nt, Human
gugacuugcaucguggagaca

SEQ ID NO: 2362074 - RNA, 15 nt, Human
gugacuucuccaggu

SEQ ID NO: 2362075 - RNA, 22 nt, Human
gugacuugcaucguggagacag

SEQ ID NO: 2362076 - RNA, 17 nt, Human
gugacuugugucccaug

SEQ ID NO: 2362077 - RNA, 16 nt, Human
gugagacagugggaaa

SEQ ID NO: 2362078 - RNA, 18 nt, Human
gugacuuuggcugcaugc

SEQ ID NO: 2362079 - RNA, 23 nt, Human
gugacuugugucccaugaucccu

SEQ ID NO: 2362080 - RNA, 15 nt, Human
gugagacccccacac

SEQ ID NO: 2362081 - RNA, 14 nt, Human
gugagacccccaca

SEQ ID NO: 2362082 - RNA, 20 nt, Human
gugagacccagcccucaucc

SEQ ID NO: 2362083 - RNA, 22 nt, Human
gugagacccugucucaaaaaaa

SEQ ID NO: 2362084 - RNA, 17 nt, Human
gugagacccccacaccu

SEQ ID NO: 2362085 - RNA, 16 nt, Human
gugagacccccacacc

SEQ ID NO: 2362086 - RNA, 13 nt, Human
gugagaccugccc

SEQ ID NO: 2362087 - RNA, 15 nt, Human
gugagaccugccccu

SEQ ID NO: 2362088 - RNA, 14 nt, Human
gugagaccugcccc

SEQ ID NO: 2362089 - RNA, 16 nt, Human
gugagacccugucucu

SEQ ID NO: 2362090 - RNA, 17 nt, Human
gugagacucgagaacuu

SEQ ID NO: 2362091 - RNA, 20 nt, Human
gugagacucgagaacuuuca

SEQ ID NO: 2362092 - RNA, 22 nt, Human
gugagacucgagaacuuucauu

SEQ ID NO: 2362093 - RNA, 23 nt, Human
gugagaccugccccuccucucug

SEQ ID NO: 2362094 - RNA, 16 nt, Human
gugagaccugccccuc

SEQ ID NO: 2362095 - RNA, 14 nt, Human
gugagacucugucu

SEQ ID NO: 2362096 - RNA, 16 nt, Human
gugagacucugucuca

SEQ ID NO: 2362097 - RNA, 20 nt, Human
aacgugaugaucagcuguuu

SEQ ID NO: 2362098 - RNA, 15 nt, Human
aacgugaugaucagc

SEQ ID NO: 2362099 - RNA, 11 nt, Human
aacgugcauug

SEQ ID NO: 2362100 - RNA, 12 nt, Human
aacgugaaaaug

SEQ ID NO: 2362101 - RNA, 13 nt, Human
aacguggcccaga

SEQ ID NO: 2362102 - RNA, 15 nt, Human
aacguggcucugcug

SEQ ID NO: 2362103 - RNA, 16 nt, Human
aacguggcucugcugg

SEQ ID NO: 2362104 - RNA, 17 nt, Human
aacguggcucugcuggc

SEQ ID NO: 2362105 - RNA, 23 nt, Human
aacgugcauugugcuucuuucuu

SEQ ID NO: 2362106 - RNA, 17 nt, Human
aacgugcagacuaugca

SEQ ID NO: 2362107 - RNA, 14 nt, Human
aacgugcauugugc

SEQ ID NO: 2362108 - RNA, 16 nt, Human
aacgugcauugugcuu

SEQ ID NO: 2362109 - RNA, 17 nt, Human
aaccuuccaucucgcca

SEQ ID NO: 2362110 - RNA, 13 nt, Human
aaccuuccaucuc

SEQ ID NO: 2362111 - RNA, 19 nt, Human
aaccuuccaucucgccacc

SEQ ID NO: 2362112 - RNA, 21 nt, Human
aaccuucgccaccuggguucc

SEQ ID NO: 2362113 - RNA, 12 nt, Human
aaccuucuggcc

SEQ ID NO: 2362114 - RNA, 13 nt, Human
aacgucugugcca

SEQ ID NO: 2362115 - RNA, 13 nt, Human
gucuuucuggaga

SEQ ID NO: 2362116 - RNA, 16 nt, Human
gucuuuccuggcacua

SEQ ID NO: 2362117 - RNA, 12 nt, Human
gucuuuccuaga

SEQ ID NO: 2362118 - RNA, 20 nt, Human
gucuuucccauggggaggga

SEQ ID NO: 2362119 - RNA, 20 nt, Human
gucuuuccauuggaucucau

SEQ ID NO: 2362120 - RNA, 19 nt, Human
gucuuucccauggggaggg

SEQ ID NO: 2362121 - RNA, 19 nt, Human
aaccuggagggcuagaacc

SEQ ID NO: 2362122 - RNA, 22 nt, Human
aaccuggagggcuagaaucugg

SEQ ID NO: 2362123 - RNA, 19 nt, Human
aaccuggcaagcuagaacc

SEQ ID NO: 2362124 - RNA, 22 nt, Human
aaccuggagggcuggaaucugg

SEQ ID NO: 2362125 - RNA, 20 nt, Human
aaccuggaggggcuagaacc

SEQ ID NO: 2362126 - RNA, 16 nt, Human
aaccuuauuguaccuc

SEQ ID NO: 2362127 - RNA, 17 nt, Human
aaccuuauuguaccucu

SEQ ID NO: 2362128 - RNA, 18 nt, Human
aaccuuauuguaccucuc

SEQ ID NO: 2362129 - RNA, 19 nt, Human
aaccuuauuguaccucucu

SEQ ID NO: 2362130 - RNA, 15 nt, Human
aaccuuauuguaccu

SEQ ID NO: 2362131 - RNA, 21 nt, Human
aaccugggauucaggaaugug

SEQ ID NO: 2362132 - RNA, 20 nt, Human
aaccugggauucaggaaugu

SEQ ID NO: 2362133 - RNA, 17 nt, Human
aaccugggauucaggaa

SEQ ID NO: 2362134 - RNA, 14 nt, Human
aaccugggauucag

SEQ ID NO: 2362135 - RNA, 12 nt, Human
aaccuggggggc

SEQ ID NO: 2362136 - RNA, 22 nt, Human
aaccugggaggcggagaguaca

SEQ ID NO: 2362137 - RNA, 17 nt, Human
aaccuggguccaaauaa

SEQ ID NO: 2362138 - RNA, 22 nt, Human
aaccuggguccaaauaaaaacu

SEQ ID NO: 2362139 - RNA, 18 nt, Human
aaccuggguccaaauaaa

SEQ ID NO: 2362140 - RNA, 19 nt, Human
aaccuggguccaaauaaaa

SEQ ID NO: 2362141 - RNA, 17 nt, Human
aacguuuuuccuguucu

SEQ ID NO: 2362142 - RNA, 20 nt, Human
aacguuuugaacuaauaaaa

SEQ ID NO: 2362143 - RNA, 15 nt, Human
aacguuuugaacuaa

SEQ ID NO: 2362144 - RNA, 23 nt, Human
aacguuuucuguuuggaggagca

SEQ ID NO: 2362145 - RNA, 15 nt, Human
aacguuuuauugugu

SEQ ID NO: 2362146 - RNA, 13 nt, Human
aacguuuuauugu

SEQ ID NO: 2362147 - RNA, 12 nt, Human
aacguggcugcu

SEQ ID NO: 2362148 - RNA, 13 nt, Human
aacguggcugcuu

SEQ ID NO: 2362149 - RNA, 17 nt, Human
aacuagggaagauaaua

SEQ ID NO: 2362150 - RNA, 21 nt, Human
aacuaggugcauauuuauaaa

SEQ ID NO: 2362151 - RNA, 23 nt, Human
aacguuuuuccuuuaaaaaaauu

SEQ ID NO: 2362152 - RNA, 18 nt, Human
aacuauggaucagaauag

SEQ ID NO: 2362153 - RNA, 12 nt, Human
aacuauggccug

SEQ ID NO: 2362154 - RNA, 14 nt, Human
aacuauaugugaau

SEQ ID NO: 2362155 - RNA, 15 nt, Human
aacuaguccuuuacu

SEQ ID NO: 2362156 - RNA, 22 nt, Human
aacuaggucugauauucaaaug

SEQ ID NO: 2362157 - RNA, 17 nt, Human
aacuagggccaagccca

SEQ ID NO: 2362158 - RNA, 15 nt, Human
aacuauguugauaaa

SEQ ID NO: 2362159 - RNA, 22 nt, Human
aacuauuaagaggcagaaaauu

SEQ ID NO: 2362160 - RNA, 21 nt, Human
aacucauuuuuguuuucauua

SEQ ID NO: 2362161 - RNA, 23 nt, Human
aacuauucaggagaguagaacag

SEQ ID NO: 2362162 - RNA, 24 nt, Human
aacucauuuuuguuuucauuaucu

SEQ ID NO: 2362163 - RNA, 22 nt, Human
gucucuuucaugaguuuuuccc

SEQ ID NO: 2362164 - RNA, 16 nt, Human
gucuauuuuugucuua

SEQ ID NO: 2362165 - RNA, 23 nt, Human
gucucuuuucuuuagagcauugc

SEQ ID NO: 2362166 - RNA, 14 nt, Human
gucugaagcagaug

SEQ ID NO: 2362167 - RNA, 19 nt, Human
gucugaaggacacuuccug

SEQ ID NO: 2362168 - RNA, 15 nt, Human
gucugaacagcugua

SEQ ID NO: 2362169 - RNA, 13 nt, Human
gucugaauguucu

SEQ ID NO: 2362170 - RNA, 11 nt, Human
gucugaaaugg

SEQ ID NO: 2362171 - RNA, 17 nt, Human
gucuauuucugcugaau

SEQ ID NO: 2362172 - RNA, 14 nt, Human
gucuauuucuaguu

SEQ ID NO: 2362173 - RNA, 13 nt, Human
gucuauuucugcu

SEQ ID NO: 2362174 - RNA, 12 nt, Human
gucuauuuaagc

SEQ ID NO: 2362175 - RNA, 16 nt, Human
gucuauuuaagccuca

SEQ ID NO: 2362176 - RNA, 14 nt, Human
gucucaaaaaaaca

SEQ ID NO: 2362177 - RNA, 17 nt, Human
gucucaaaaaaagaaaa

SEQ ID NO: 2362178 - RNA, 14 nt, Human
gucuggaaguccaa

SEQ ID NO: 2362179 - RNA, 20 nt, Human
gucugacaggcaaugcuggc

SEQ ID NO: 2362180 - RNA, 15 nt, Human
gucugacaggcaaug

SEQ ID NO: 2362181 - RNA, 18 nt, Human
gucugacaggcaaugcug

SEQ ID NO: 2362182 - RNA, 20 nt, Human
gucugaauguucugacauua

SEQ ID NO: 2362183 - RNA, 18 nt, Human
gucugaauguucugacau

SEQ ID NO: 2362184 - RNA, 17 nt, Human
gucugaauguucugaca

SEQ ID NO: 2362185 - RNA, 15 nt, Human
gucugaauguucuga

SEQ ID NO: 2362186 - RNA, 14 nt, Human
gucugaauguucug

SEQ ID NO: 2362187 - RNA, 22 nt, Human
gucugaaggacacuuccugccu

SEQ ID NO: 2362188 - RNA, 20 nt, Human
gucugaaggacacuuccugc

SEQ ID NO: 2362189 - RNA, 21 nt, Human
gucugaaggacacuuccugcc

SEQ ID NO: 2362190 - RNA, 12 nt, Human
gucugacaggca

SEQ ID NO: 2362191 - RNA, 13 nt, Human
gucugacaggcaa

SEQ ID NO: 2362192 - RNA, 14 nt, Human
gucugacaggcaau

SEQ ID NO: 2362193 - RNA, 14 nt, Human
gucuucaagggcuu

SEQ ID NO: 2362194 - RNA, 14 nt, Human
gucuuauuuccuca

SEQ ID NO: 2362195 - RNA, 16 nt, Human
gucuucaacagcuccc

SEQ ID NO: 2362196 - RNA, 14 nt, Human
gucuuauuuauuau

SEQ ID NO: 2362197 - RNA, 19 nt, Human
gucuucaacagcuccccau

SEQ ID NO: 2362198 - RNA, 15 nt, Human
gucuuaucaagcagc

SEQ ID NO: 2362199 - RNA, 20 nt, Human
gucuuguguuucuuuaguuu

SEQ ID NO: 2362200 - RNA, 23 nt, Human
gucuuguguuuccacagccugca

SEQ ID NO: 2362201 - RNA, 22 nt, Human
gucuuguuuuuuuuuuccacuu

SEQ ID NO: 2362202 - RNA, 20 nt, Human
gucuuguuaagugcagucug

SEQ ID NO: 2362203 - RNA, 18 nt, Human
gucuuuccacggagccac

SEQ ID NO: 2362204 - RNA, 22 nt, Human
gucuuuccacuccuccuagcca

SEQ ID NO: 2362205 - RNA, 21 nt, Human
gucuuucaggaccuuuugaag

SEQ ID NO: 2362206 - RNA, 12 nt, Human
gucuuguucugu

SEQ ID NO: 2362207 - RNA, 12 nt, Human
gucuuaaaauaa

SEQ ID NO: 2362208 - RNA, 15 nt, Human
gucuuaaaauaacuu

SEQ ID NO: 2362209 - RNA, 22 nt, Human
gucuuaaaauaacuuauaucau

SEQ ID NO: 2362210 - RNA, 18 nt, Human
gucuggaaugcaguggua

SEQ ID NO: 2362211 - RNA, 15 nt, Human
gucuggaaugcagug

SEQ ID NO: 2362212 - RNA, 16 nt, Human
gucuggaaugcagugg

SEQ ID NO: 2362213 - RNA, 19 nt, Human
gucuuauauauuguagaua

SEQ ID NO: 2362214 - RNA, 14 nt, Human
gucuuaauuaaaag

SEQ ID NO: 2362215 - RNA, 14 nt, Human
gucuuaaugaaguu

SEQ ID NO: 2362216 - RNA, 23 nt, Human
gucuuaagccuuuugcucacaaa

SEQ ID NO: 2362217 - RNA, 16 nt, Human
gucuuaaugaaguuug

SEQ ID NO: 2362218 - RNA, 17 nt, Human
gucuuaaugaaguuuga

SEQ ID NO: 2362219 - RNA, 18 nt, Human
gucuuaaugaaguuugaa

SEQ ID NO: 2362220 - RNA, 19 nt, Human
gucuuaaugaaguuugaau

SEQ ID NO: 2362221 - RNA, 20 nt, Human
gucuuaaugaaguuugaaug

SEQ ID NO: 2362222 - RNA, 22 nt, Human
gucuuaaugaaguuugaauguu

SEQ ID NO: 2362223 - RNA, 9 nt, Human
guauuuaac

SEQ ID NO: 2362224 - RNA, 20 nt, Human
guauuguuuugguuugcuac

SEQ ID NO: 2362225 - RNA, 14 nt, Human
guauuguucccagu

SEQ ID NO: 2362226 - RNA, 11 nt, Human
guauuguuccc

SEQ ID NO: 2362227 - RNA, 18 nt, Human
guauuguucccagugaca

SEQ ID NO: 2362228 - RNA, 17 nt, Human
guauugugucuuuugca

SEQ ID NO: 2362229 - RNA, 18 nt, Human
guauugugucuuuugcau

SEQ ID NO: 2362230 - RNA, 21 nt, Human
guauugugucuuuugcaugau

SEQ ID NO: 2362231 - RNA, 13 nt, Human
guauuuauauauu

SEQ ID NO: 2362232 - RNA, 12 nt, Human
guauuuauauau

SEQ ID NO: 2362233 - RNA, 13 nt, Human
guauuuauaaaua

SEQ ID NO: 2362234 - RNA, 19 nt, Human
guauuuacgcuuugauuca

SEQ ID NO: 2362235 - RNA, 17 nt, Human
guauuuacgcuuugauu

SEQ ID NO: 2362236 - RNA, 16 nt, Human
guauuuacgcuuugau

SEQ ID NO: 2362237 - RNA, 16 nt, Human
guauuuauauauuuau

SEQ ID NO: 2362238 - RNA, 15 nt, Human
guauuuauauauuua

SEQ ID NO: 2362239 - RNA, 17 nt, Human
guauuuauauauuuaua

SEQ ID NO: 2362240 - RNA, 13 nt, Human
guauuuaucuuua

SEQ ID NO: 2362241 - RNA, 11 nt, Human
guauuuauuca

SEQ ID NO: 2362242 - RNA, 15 nt, Human
aaauguauaugcacu

SEQ ID NO: 2362243 - RNA, 14 nt, Human
aaauguauaugcac

SEQ ID NO: 2362244 - RNA, 17 nt, Human
aaauguaucuuauucac

SEQ ID NO: 2362245 - RNA, 18 nt, Human
aaauguaugauuacauca

SEQ ID NO: 2362246 - RNA, 14 nt, Human
aaauguaucuuauu

SEQ ID NO: 2362247 - RNA, 17 nt, Human
aaauguaucauagaaau

SEQ ID NO: 2362248 - RNA, 20 nt, Human
aaauguaucauagaaaugua

SEQ ID NO: 2362249 - RNA, 16 nt, Human
aaaugucuauuaaggu

SEQ ID NO: 2362250 - RNA, 21 nt, Human
aaaugucucuuuaaugucaca

SEQ ID NO: 2362251 - RNA, 17 nt, Human
aaaugugauuuuucuga

SEQ ID NO: 2362252 - RNA, 17 nt, Human
aaaugugcaaaacagcg

SEQ ID NO: 2362253 - RNA, 22 nt, Human
aaaugugcauucuuuuaaaaga

SEQ ID NO: 2362254 - RNA, 23 nt, Human
aaaugugcauucuuuuaaaagac

SEQ ID NO: 2362255 - RNA, 16 nt, Human
aaaugugauuuuucug

SEQ ID NO: 2362256 - RNA, 16 nt, Human
aaaugucuucuguauu

SEQ ID NO: 2362257 - RNA, 15 nt, Human
aaaugugauuuuucu

SEQ ID NO: 2362258 - RNA, 14 nt, Human
aaaugucuuccugg

SEQ ID NO: 2362259 - RNA, 12 nt, Human
aaaugucuugug

SEQ ID NO: 2362260 - RNA, 18 nt, Human
aaaugucuucuguauuca

SEQ ID NO: 2362261 - RNA, 18 nt, Human
guauucuaguuuugucaa

SEQ ID NO: 2362262 - RNA, 21 nt, Human
aaaucauugcuuugaagcagu

SEQ ID NO: 2362263 - RNA, 19 nt, Human
guauucuagcuaauguaau

SEQ ID NO: 2362264 - RNA, 11 nt, Human
guauucuuuga

SEQ ID NO: 2362265 - RNA, 14 nt, Human
guauucuuugaugu

SEQ ID NO: 2362266 - RNA, 21 nt, Human
guauucucuccuguaccucuu

SEQ ID NO: 2362267 - RNA, 14 nt, Human
guauucuugucaaa

SEQ ID NO: 2362268 - RNA, 18 nt, Human
guauucucuccuguaccu

SEQ ID NO: 2362269 - RNA, 17 nt, Human
aaaucauguacauuucu

SEQ ID NO: 2362270 - RNA, 12 nt, Human
aaaucauguuug

SEQ ID NO: 2362271 - RNA, 19 nt, Human
aaaucauuaauacucuucu

SEQ ID NO: 2362272 - RNA, 11 nt, Human
aaaucauuucu

SEQ ID NO: 2362273 - RNA, 16 nt, Human
aaaucauucauuuucu

SEQ ID NO: 2362274 - RNA, 16 nt, Human
aaaucauguacauuuc

SEQ ID NO: 2362275 - RNA, 17 nt, Human
aaaucauggaaugguua

SEQ ID NO: 2362276 - RNA, 21 nt, Human
aaaucaugaagauauuuuucc

SEQ ID NO: 2362277 - RNA, 20 nt, Human
guauuguaccuuuuaacacc

SEQ ID NO: 2362278 - RNA, 22 nt, Human
guauuguauuuauucaauaaag

SEQ ID NO: 2362279 - RNA, 17 nt, Human
guauuguauuuauucaa

SEQ ID NO: 2362280 - RNA, 18 nt, Human
guauuguauuuauucaau

SEQ ID NO: 2362281 - RNA, 12 nt, Human
guauuguauuua

SEQ ID NO: 2362282 - RNA, 13 nt, Human
guauuguauuuau

SEQ ID NO: 2362283 - RNA, 15 nt, Human
guauuguauuuauuc

SEQ ID NO: 2362284 - RNA, 16 nt, Human
guauuguauuuauuca

SEQ ID NO: 2362285 - RNA, 17 nt, Human
guauugaaucauguagu

SEQ ID NO: 2362286 - RNA, 12 nt, Human
guauugaaucau

SEQ ID NO: 2362287 - RNA, 14 nt, Human
guauugaaucaugu

SEQ ID NO: 2362288 - RNA, 17 nt, Human
guauuguaaacaugugu

SEQ ID NO: 2362289 - RNA, 22 nt, Human
guauugaagcauuuuauaaauc

SEQ ID NO: 2362290 - RNA, 18 nt, Human
guauugaagcauuuuaua

SEQ ID NO: 2362291 - RNA, 17 nt, Human
guauugaagcauuuuau

SEQ ID NO: 2362292 - RNA, 13 nt, Human
guauugaagcauu

SEQ ID NO: 2362293 - RNA, 10 nt, Human
guauugaagc

SEQ ID NO: 2362294 - RNA, 16 nt, Human
guauucuuugauguua

SEQ ID NO: 2362295 - RNA, 18 nt, Human
guauucuuugauguuaac

SEQ ID NO: 2362296 - RNA, 21 nt, Human
guauucuuugauguuaacaca

SEQ ID NO: 2362297 - RNA, 23 nt, Human
guauucuuugauguuaacacauu

SEQ ID NO: 2362298 - RNA, 13 nt, Human
aaauuccacugga

SEQ ID NO: 2362299 - RNA, 16 nt, Human
aaauucacaauagaaa

SEQ ID NO: 2362300 - RNA, 23 nt, Human
aaauuccuuagcuuagaccucag

SEQ ID NO: 2362301 - RNA, 17 nt, Human
aaauucgaccugauuua

SEQ ID NO: 2362302 - RNA, 18 nt, Human
aaauucgaccugauuuac

SEQ ID NO: 2362303 - RNA, 21 nt, Human
aaauucgcugcaaccuguuga

SEQ ID NO: 2362304 - RNA, 23 nt, Human
aaauucgaccugauuuacaguuu

SEQ ID NO: 2362305 - RNA, 22 nt, Human
aaauuccuuagcuuagaccuca

SEQ ID NO: 2362306 - RNA, 20 nt, Human
aaauuccucuuugcuuugcu

SEQ ID NO: 2362307 - RNA, 14 nt, Human
aaauuccuguagca

SEQ ID NO: 2362308 - RNA, 16 nt, Human
aaauuccccacccuga

SEQ ID NO: 2362309 - RNA, 19 nt, Human
aaauucacaaguuguguuu

SEQ ID NO: 2362310 - RNA, 18 nt, Human
aaauucacaaguuguguu

SEQ ID NO: 2362311 - RNA, 18 nt, Human
aaauucacaaacuuuuau

SEQ ID NO: 2362312 - RNA, 17 nt, Human
aaauucacaaacuuuua

SEQ ID NO: 2362313 - RNA, 23 nt, Human
aaauucaauuguaaauugaauca

SEQ ID NO: 2362314 - RNA, 20 nt, Human
aaauucaauuguaaauugaa

SEQ ID NO: 2362315 - RNA, 19 nt, Human
aaauucaauuguaaauuga

SEQ ID NO: 2362316 - RNA, 17 nt, Human
aaauucaauuguaaauu

SEQ ID NO: 2362317 - RNA, 15 nt, Human
aaauucacaaacuuu

SEQ ID NO: 2362318 - RNA, 14 nt, Human
aaauucacaaacuu

SEQ ID NO: 2362319 - RNA, 17 nt, Human
aaauuccaagugauuga

SEQ ID NO: 2362320 - RNA, 20 nt, Human
aaauucucagucaguaauug

SEQ ID NO: 2362321 - RNA, 13 nt, Human
aaauucuccugga

SEQ ID NO: 2362322 - RNA, 19 nt, Human
aaauucuauuacaguaugu

SEQ ID NO: 2362323 - RNA, 21 nt, Human
aaauucuauucugaucuuauu

SEQ ID NO: 2362324 - RNA, 23 nt, Human
aaauucuauaggaacauaugaaa

SEQ ID NO: 2362325 - RNA, 22 nt, Human
aaauucuauaggaacauaugaa

SEQ ID NO: 2362326 - RNA, 19 nt, Human
aaauucuauaggaacauau

SEQ ID NO: 2362327 - RNA, 15 nt, Human
aaauucuacaacaca

SEQ ID NO: 2362328 - RNA, 17 nt, Human
aaauuguauuacaaauc

SEQ ID NO: 2362329 - RNA, 22 nt, Human
aaauuguaucuagugcagcuga

SEQ ID NO: 2362330 - RNA, 18 nt, Human
aaauugucagaugcugug

SEQ ID NO: 2362331 - RNA, 17 nt, Human
aaauuguauauucacuu

SEQ ID NO: 2362332 - RNA, 14 nt, Human
aaauucuccuggag

SEQ ID NO: 2362333 - RNA, 16 nt, Human
aaauucuccuggaggu

SEQ ID NO: 2362334 - RNA, 21 nt, Human
aaauugucccuuaaacaaaaa

SEQ ID NO: 2362335 - RNA, 23 nt, Human
aaauuguccguguucauacauuu

SEQ ID NO: 2362336 - RNA, 23 nt, Human
aaauuuaaaagacacuguuuaca

SEQ ID NO: 2362337 - RNA, 20 nt, Human
aaauuguuuugagcuuucca

SEQ ID NO: 2362338 - RNA, 19 nt, Human
aaauuagcugugugaaaua

SEQ ID NO: 2362339 - RNA, 18 nt, Human
aaauuaggaauaaauaaa

SEQ ID NO: 2362340 - RNA, 18 nt, Human
aaauuaggauuucaugau

SEQ ID NO: 2362341 - RNA, 16 nt, Human
aaauuaggaauaaaua

SEQ ID NO: 2362342 - RNA, 15 nt, Human
aaauuaggaauaaau

SEQ ID NO: 2362343 - RNA, 14 nt, Human
aaauuaggaauaaa

SEQ ID NO: 2362344 - RNA, 18 nt, Human
aaauuagcugugugaaau

SEQ ID NO: 2362345 - RNA, 17 nt, Human
aaauuagcugugugaaa

SEQ ID NO: 2362346 - RNA, 19 nt, Human
aaauuaggauuucaugauu

SEQ ID NO: 2362347 - RNA, 15 nt, Human
aaauucaauuguaaa

SEQ ID NO: 2362348 - RNA, 20 nt, Human
aaauuauguuacaucuguuu

SEQ ID NO: 2362349 - RNA, 19 nt, Human
aaauuauguauguuuacau

SEQ ID NO: 2362350 - RNA, 14 nt, Human
aaauuauguuuaua

SEQ ID NO: 2362351 - RNA, 17 nt, Human
aaauuauguuuauauaa

SEQ ID NO: 2362352 - RNA, 23 nt, Human
aaauuauguuuauauaaaugcuu

SEQ ID NO: 2362353 - RNA, 24 nt, Human
aaauuauguuuauauaaaugcuuu

SEQ ID NO: 2362354 - RNA, 23 nt, Human
aaauuaugugccagauuuaugca

SEQ ID NO: 2362355 - RNA, 17 nt, Human
aaauuauguauguuuac

SEQ ID NO: 2362356 - RNA, 15 nt, Human
aaauguggcuccugg

SEQ ID NO: 2362357 - RNA, 14 nt, Human
aaauuaaucugggc

SEQ ID NO: 2362358 - RNA, 16 nt, Human
aaauuaauuggcagca

SEQ ID NO: 2362359 - RNA, 21 nt, Human
aaauuaauuggcagcagauuu

SEQ ID NO: 2362360 - RNA, 18 nt, Human
aaauuaauuggcagcaga

SEQ ID NO: 2362361 - RNA, 19 nt, Human
aaauuaauuggcagcagau

SEQ ID NO: 2362362 - RNA, 15 nt, Human
aaaugugcuuuuaaa

SEQ ID NO: 2362363 - RNA, 18 nt, Human
aaaugugccuucauuuuu

SEQ ID NO: 2362364 - RNA, 15 nt, Human
aaauuagccgggcgu

SEQ ID NO: 2362365 - RNA, 22 nt, Human
aaauuacacccaaagagguauu

SEQ ID NO: 2362366 - RNA, 16 nt, Human
aaauuacacccaaaga

SEQ ID NO: 2362367 - RNA, 16 nt, Human
gucacuuugcucuggg

SEQ ID NO: 2362368 - RNA, 17 nt, Human
gucacuuugcucugggu

SEQ ID NO: 2362369 - RNA, 23 nt, Human
gucacuuugcucuggguggaagu

SEQ ID NO: 2362370 - RNA, 17 nt, Human
gucacuuuguuuuacug

SEQ ID NO: 2362371 - RNA, 20 nt, Human
gucacuuaccuagauuuaca

SEQ ID NO: 2362372 - RNA, 16 nt, Human
gucacuguuucucugc

SEQ ID NO: 2362373 - RNA, 15 nt, Human
gucacuuauuucaua

SEQ ID NO: 2362374 - RNA, 16 nt, Human
gucacuuacuguuucu

SEQ ID NO: 2362375 - RNA, 18 nt, Human
gucacuuacuguuucugu

SEQ ID NO: 2362376 - RNA, 23 nt, Human
gucacuugaugugccauuuuaaa

SEQ ID NO: 2362377 - RNA, 24 nt, Human
gucacuucgcgugcccucgcugcu

SEQ ID NO: 2362378 - RNA, 16 nt, Human
gucacuuauuucauaa

SEQ ID NO: 2362379 - RNA, 18 nt, Human
gucacuucgcgugcccuc

SEQ ID NO: 2362380 - RNA, 13 nt, Human
gucagaaacuguu

SEQ ID NO: 2362381 - RNA, 21 nt, Human
gucagaaguuucugccgcagc

SEQ ID NO: 2362382 - RNA, 14 nt, Human
gucaggaaagagaa

SEQ ID NO: 2362383 - RNA, 13 nt, Human
gucaggaaagaga

SEQ ID NO: 2362384 - RNA, 18 nt, Human
gucacugccugcagaggu

SEQ ID NO: 2362385 - RNA, 23 nt, Human
gucacugccugcagaggucugug

SEQ ID NO: 2362386 - RNA, 11 nt, Human
gucacugcugu

SEQ ID NO: 2362387 - RNA, 12 nt, Human
gucacugcuguc

SEQ ID NO: 2362388 - RNA, 12 nt, Human
gucacuggaaag

SEQ ID NO: 2362389 - RNA, 19 nt, Human
gucacuggaccacugggca

SEQ ID NO: 2362390 - RNA, 18 nt, Human
gucacuggagguugaagc

SEQ ID NO: 2362391 - RNA, 20 nt, Human
gucacuggagguugaagcca

SEQ ID NO: 2362392 - RNA, 15 nt, Human
gucacuggaaagggg

SEQ ID NO: 2362393 - RNA, 18 nt, Human
gucacuggaaaggggaga

SEQ ID NO: 2362394 - RNA, 20 nt, Human
gucacuggaaaggggagagc

SEQ ID NO: 2362395 - RNA, 23 nt, Human
gucacuggaaaggggagagccug

SEQ ID NO: 2362396 - RNA, 21 nt, Human
gucacugcuuaacuucacaua

SEQ ID NO: 2362397 - RNA, 15 nt, Human
gucacugcuuaacuu

SEQ ID NO: 2362398 - RNA, 15 nt, Human
gucacuguuucucug

SEQ ID NO: 2362399 - RNA, 13 nt, Human
gucacuguuucuc

SEQ ID NO: 2362400 - RNA, 17 nt, Human
gucacuguuccuuguca

SEQ ID NO: 2362401 - RNA, 19 nt, Human
gucacuguuuauuuuuuua

SEQ ID NO: 2362402 - RNA, 14 nt, Human
gucacugugguccu

SEQ ID NO: 2362403 - RNA, 21 nt, Human
gucacugguagaccaaaauaa

SEQ ID NO: 2362404 - RNA, 17 nt, Human
gucacugucccucaaau

SEQ ID NO: 2362405 - RNA, 23 nt, Human
gucacuggcugccuccacuccca

SEQ ID NO: 2362406 - RNA, 20 nt, Human
gucacuggcugccuccacuc

SEQ ID NO: 2362407 - RNA, 21 nt, Human
gucacuggcugccuccacucc

SEQ ID NO: 2362408 - RNA, 21 nt, Human
gucacuggcucuccaagugcc

SEQ ID NO: 2362409 - RNA, 14 nt, Human
gucacuggcugccu

SEQ ID NO: 2362410 - RNA, 16 nt, Human
gucacuggcugccucc

SEQ ID NO: 2362411 - RNA, 19 nt, Human
gucacuggcugccuccacu

SEQ ID NO: 2362412 - RNA, 23 nt, Human
gucacuggagguugaagccaagu

SEQ ID NO: 2362413 - RNA, 12 nt, Human
gucacuggcucu

SEQ ID NO: 2362414 - RNA, 14 nt, Human
gucacuggcucucc

SEQ ID NO: 2362415 - RNA, 15 nt, Human
gucacuggcucucca

SEQ ID NO: 2362416 - RNA, 16 nt, Human
gucacuggcucuccaa

SEQ ID NO: 2362417 - RNA, 17 nt, Human
gucacuggcucuccaag

SEQ ID NO: 2362418 - RNA, 18 nt, Human
gucacuggcucuccaagu

SEQ ID NO: 2362419 - RNA, 20 nt, Human
gucacuggcucuccaagugc

SEQ ID NO: 2362420 - RNA, 22 nt, Human
gucagucaugauggcaccacug

SEQ ID NO: 2362421 - RNA, 13 nt, Human
gucagguuugagu

SEQ ID NO: 2362422 - RNA, 23 nt, Human
gucagugcagcccguguggcccc

SEQ ID NO: 2362423 - RNA, 16 nt, Human
gucagugcagcccgug

SEQ ID NO: 2362424 - RNA, 17 nt, Human
gucagugccgccgccuc

SEQ ID NO: 2362425 - RNA, 22 nt, Human
gucagugccgccgccucgccca

SEQ ID NO: 2362426 - RNA, 22 nt, Human
gucagugggaacgugacugccc

SEQ ID NO: 2362427 - RNA, 23 nt, Human
gucagugaggcccagggagaggc

SEQ ID NO: 2362428 - RNA, 18 nt, Human
gucagugcaaaugucaga

SEQ ID NO: 2362429 - RNA, 14 nt, Human
gucagugaggccca

SEQ ID NO: 2362430 - RNA, 17 nt, Human
gucaguguccaaagcag

SEQ ID NO: 2362431 - RNA, 20 nt, Human
gucaguguccaaagcagggu

SEQ ID NO: 2362432 - RNA, 23 nt, Human
gucaguguccaaagcagggucug

SEQ ID NO: 2362433 - RNA, 22 nt, Human
gucagugguccacaucccggga

SEQ ID NO: 2362434 - RNA, 23 nt, Human
gucagugccgccgccucgcccac

SEQ ID NO: 2362435 - RNA, 12 nt, Human
aaauuucuaaau

SEQ ID NO: 2362436 - RNA, 15 nt, Human
aaauuucuaaaucuc

SEQ ID NO: 2362437 - RNA, 13 nt, Human
aaauuucuaaauc

SEQ ID NO: 2362438 - RNA, 16 nt, Human
gucagguggggcagcu

SEQ ID NO: 2362439 - RNA, 17 nt, Human
gucagguggggcagcuu

SEQ ID NO: 2362440 - RNA, 18 nt, Human
gucagguggggcagcuug

SEQ ID NO: 2362441 - RNA, 22 nt, Human
gucagguggggcagcuugaggg

SEQ ID NO: 2362442 - RNA, 16 nt, Human
gucaggaacagaagga

SEQ ID NO: 2362443 - RNA, 15 nt, Human
gucaggaacagaagg

SEQ ID NO: 2362444 - RNA, 17 nt, Human
gucaggaacagaaggau

SEQ ID NO: 2362445 - RNA, 15 nt, Human
gucaggaagaaauca

SEQ ID NO: 2362446 - RNA, 18 nt, Human
gucaggaaggaugagcau

SEQ ID NO: 2362447 - RNA, 17 nt, Human
gucaggaaggaugagca

SEQ ID NO: 2362448 - RNA, 12 nt, Human
gucaggagagca

SEQ ID NO: 2362449 - RNA, 14 nt, Human
gucaggagagcagc

SEQ ID NO: 2362450 - RNA, 15 nt, Human
gucaggagagcagcg

SEQ ID NO: 2362451 - RNA, 12 nt, Human
gucagggcccaa

SEQ ID NO: 2362452 - RNA, 14 nt, Human
gucagggcccaagu

SEQ ID NO: 2362453 - RNA, 15 nt, Human
gucagggcccaaguc

SEQ ID NO: 2362454 - RNA, 19 nt, Human
gucagggcccaagucccug

SEQ ID NO: 2362455 - RNA, 21 nt, Human
gucagggcccaagucccuguu

SEQ ID NO: 2362456 - RNA, 20 nt, Human
gucagggcccaagucccugu

SEQ ID NO: 2362457 - RNA, 14 nt, Human
gucaggggcagcug

SEQ ID NO: 2362458 - RNA, 17 nt, Human
gucaggggcagcugacc

SEQ ID NO: 2362459 - RNA, 17 nt, Human
gucaauuucuguguugc

SEQ ID NO: 2362460 - RNA, 22 nt, Human
gucaauuucuguguugccaagc

SEQ ID NO: 2362461 - RNA, 21 nt, Human
gucaauuuuguuauguauauu

SEQ ID NO: 2362462 - RNA, 15 nt, Human
gucacaggaaguaga

SEQ ID NO: 2362463 - RNA, 13 nt, Human
gucacaggaagua

SEQ ID NO: 2362464 - RNA, 17 nt, Human
aaauuuaagcauuguuu

SEQ ID NO: 2362465 - RNA, 16 nt, Human
aaauuuaagcauuguu

SEQ ID NO: 2362466 - RNA, 15 nt, Human
aaauuuaagcauugu

SEQ ID NO: 2362467 - RNA, 14 nt, Human
aaauuuaagcauug

SEQ ID NO: 2362468 - RNA, 15 nt, Human
aaauuuaaguaucuu

SEQ ID NO: 2362469 - RNA, 23 nt, Human
aaauuuaaguaucuuuuuucaaa

SEQ ID NO: 2362470 - RNA, 16 nt, Human
aaauuuaagugcgugu

SEQ ID NO: 2362471 - RNA, 21 nt, Human
aaauuuaagugcguguguaga

SEQ ID NO: 2362472 - RNA, 13 nt, Human
aaauuuaagcauu

SEQ ID NO: 2362473 - RNA, 12 nt, Human
aaauuuaagcau

SEQ ID NO: 2362474 - RNA, 23 nt, Human
aaauuuaaaggguguacuuauau

SEQ ID NO: 2362475 - RNA, 20 nt, Human
aaauuuaauauagcuauuuu

SEQ ID NO: 2362476 - RNA, 22 nt, Human
gucaauuucccugacuccucua

SEQ ID NO: 2362477 - RNA, 22 nt, Human
gucaauuacaggaaguacugga

SEQ ID NO: 2362478 - RNA, 17 nt, Human
gucacaggacucugccu

SEQ ID NO: 2362479 - RNA, 18 nt, Human
gucacaggacucugccuc

SEQ ID NO: 2362480 - RNA, 20 nt, Human
gucacaggaaguagaggagg

SEQ ID NO: 2362481 - RNA, 12 nt, Human
gucacaggcagg

SEQ ID NO: 2362482 - RNA, 19 nt, Human
gucacaggacucugccucc

SEQ ID NO: 2362483 - RNA, 16 nt, Human
gucacaggagggaggg

SEQ ID NO: 2362484 - RNA, 22 nt, Human
gucaccaaaucagcugcuacua

SEQ ID NO: 2362485 - RNA, 21 nt, Human
gucacauggccuaugcacaua

SEQ ID NO: 2362486 - RNA, 23 nt, Human
gucacauggccuaugcacauaug

SEQ ID NO: 2362487 - RNA, 14 nt, Human
gucacauacaauua

SEQ ID NO: 2362488 - RNA, 15 nt, Human
gucacagggccaacu

SEQ ID NO: 2362489 - RNA, 15 nt, Human
gucacaucacaggac

SEQ ID NO: 2362490 - RNA, 13 nt, Human
gucacaugaaaca

SEQ ID NO: 2362491 - RNA, 20 nt, Human
gucacagggcaugccccggc

SEQ ID NO: 2362492 - RNA, 18 nt, Human
gucacagggccuggggag

SEQ ID NO: 2362493 - RNA, 12 nt, Human
gucacagggcca

SEQ ID NO: 2362494 - RNA, 13 nt, Human
gucacagggccaa

SEQ ID NO: 2362495 - RNA, 16 nt, Human
gucacugccauggagg

SEQ ID NO: 2362496 - RNA, 20 nt, Human
gucacugccauggaggcaca

SEQ ID NO: 2362497 - RNA, 23 nt, Human
gucacugccucucccuggcccuc

SEQ ID NO: 2362498 - RNA, 22 nt, Human
gucacugccucucccuggcccu

SEQ ID NO: 2362499 - RNA, 20 nt, Human
gucacugccucucccuggcc

SEQ ID NO: 2362500 - RNA, 12 nt, Human
gucacugccucu

SEQ ID NO: 2362501 - RNA, 10 nt, Human
gucacugcuu

SEQ ID NO: 2362502 - RNA, 21 nt, Human
gucacugaaggccuggcccac

SEQ ID NO: 2362503 - RNA, 20 nt, Human
gucacugcacagugcaucuc

SEQ ID NO: 2362504 - RNA, 23 nt, Human
gucacugcacagugcaucucagc

SEQ ID NO: 2362505 - RNA, 14 nt, Human
gucacugcaggcac

SEQ ID NO: 2362506 - RNA, 17 nt, Human
gucacugagacagcccg

SEQ ID NO: 2362507 - RNA, 18 nt, Human
gucacugagacagcccgg

SEQ ID NO: 2362508 - RNA, 21 nt, Human
gucacugagacagcccgggcu

SEQ ID NO: 2362509 - RNA, 23 nt, Human
gucacugagacagcccgggcucu

SEQ ID NO: 2362510 - RNA, 12 nt, Human
gucaccaagccc

SEQ ID NO: 2362511 - RNA, 15 nt, Human
gucaccaagcccagu

SEQ ID NO: 2362512 - RNA, 14 nt, Human
gucacauucaggaa

SEQ ID NO: 2362513 - RNA, 17 nt, Human
gucaccaagcucacagu

SEQ ID NO: 2362514 - RNA, 16 nt, Human
gucacauucaggaaga

SEQ ID NO: 2362515 - RNA, 23 nt, Human
gucacucuggcagcucagagagg

SEQ ID NO: 2362516 - RNA, 14 nt, Human
gucacugagacagc

SEQ ID NO: 2362517 - RNA, 19 nt, Human
gucacucuuccugcaagga

SEQ ID NO: 2362518 - RNA, 20 nt, Human
gucacucuuccugcaaggac

SEQ ID NO: 2362519 - RNA, 15 nt, Human
gucacugaaggccug

SEQ ID NO: 2362520 - RNA, 15 nt, Human
gucacugagacagcc

SEQ ID NO: 2362521 - RNA, 16 nt, Human
gucacugagacagccc

SEQ ID NO: 2362522 - RNA, 15 nt, Human
guccccaccugggac

SEQ ID NO: 2362523 - RNA, 13 nt, Human
guccccucuugcc

SEQ ID NO: 2362524 - RNA, 16 nt, Human
guccccuccccggccc

SEQ ID NO: 2362525 - RNA, 22 nt, Human
guccccuccccggcccuaccag

SEQ ID NO: 2362526 - RNA, 17 nt, Human
guccccucccaucuggg

SEQ ID NO: 2362527 - RNA, 19 nt, Human
guccccucccaucugggag

SEQ ID NO: 2362528 - RNA, 18 nt, Human
guccccuguuuguuucug

SEQ ID NO: 2362529 - RNA, 23 nt, Human
guccccucuugccccaaccccca

SEQ ID NO: 2362530 - RNA, 15 nt, Human
guccccucuugcccc

SEQ ID NO: 2362531 - RNA, 16 nt, Human
guccccucuugcccca

SEQ ID NO: 2362532 - RNA, 21 nt, Human
guccccucuugccccaacccc

SEQ ID NO: 2362533 - RNA, 15 nt, Human
gucccggggcuccac

SEQ ID NO: 2362534 - RNA, 14 nt, Human
gucccgggguccug

SEQ ID NO: 2362535 - RNA, 16 nt, Human
gucccgggguccugug

SEQ ID NO: 2362536 - RNA, 19 nt, Human
gucccgggguccuguggca

SEQ ID NO: 2362537 - RNA, 20 nt, Human
gucccgggguccuguggcag

SEQ ID NO: 2362538 - RNA, 21 nt, Human
gucccgggguccuguggcagg

SEQ ID NO: 2362539 - RNA, 12 nt, Human
gucccuaauaaa

SEQ ID NO: 2362540 - RNA, 22 nt, Human
guccccuguuuguuucugaaag

SEQ ID NO: 2362541 - RNA, 18 nt, Human
gucccuuccccucccugg

SEQ ID NO: 2362542 - RNA, 17 nt, Human
gucccuuccccucccug

SEQ ID NO: 2362543 - RNA, 14 nt, Human
gucccuuccccucc

SEQ ID NO: 2362544 - RNA, 13 nt, Human
gucccuuccccuc

SEQ ID NO: 2362545 - RNA, 12 nt, Human
gucccuuccccu

SEQ ID NO: 2362546 - RNA, 20 nt, Human
gucccuuccacacccccacc

SEQ ID NO: 2362547 - RNA, 22 nt, Human
gucccuuccacacccccacccc

SEQ ID NO: 2362548 - RNA, 17 nt, Human
gucccuucacauaguuu

SEQ ID NO: 2362549 - RNA, 20 nt, Human
gucccuguuuucugagcccg

SEQ ID NO: 2362550 - RNA, 18 nt, Human
gucccuuccacaccccca

SEQ ID NO: 2362551 - RNA, 18 nt, Human
gucccuuacgugaguccu

SEQ ID NO: 2362552 - RNA, 19 nt, Human
gucccuuacgugaguccug

SEQ ID NO: 2362553 - RNA, 19 nt, Human
gucccgucaggacguugag

SEQ ID NO: 2362554 - RNA, 23 nt, Human
gucccgggguccuguggcaggca

SEQ ID NO: 2362555 - RNA, 21 nt, Human
gucccgugcagcuucuguccu

SEQ ID NO: 2362556 - RNA, 15 nt, Human
gucccuaaagaaaaa

SEQ ID NO: 2362557 - RNA, 15 nt, Human
gucccuaauaaagcu

SEQ ID NO: 2362558 - RNA, 18 nt, Human
gucccugguggcagcuca

SEQ ID NO: 2362559 - RNA, 17 nt, Human
gucccuaaagaaaaaaa

SEQ ID NO: 2362560 - RNA, 15 nt, Human
gucccugugccuaac

SEQ ID NO: 2362561 - RNA, 15 nt, Human
gucccuguuuucuga

SEQ ID NO: 2362562 - RNA, 17 nt, Human
gucccuguuuucugagc

SEQ ID NO: 2362563 - RNA, 18 nt, Human
gucccuguuuucugagcc

SEQ ID NO: 2362564 - RNA, 19 nt, Human
gucccuguuuucugagccc

SEQ ID NO: 2362565 - RNA, 19 nt, Human
gucccugguggcagcucac

SEQ ID NO: 2362566 - RNA, 17 nt, Human
gucccacacuggugacu

SEQ ID NO: 2362567 - RNA, 23 nt, Human
gucccaaggaaagccccagcacu

SEQ ID NO: 2362568 - RNA, 15 nt, Human
gucccaccccacaca

SEQ ID NO: 2362569 - RNA, 22 nt, Human
guccccaccgcagacaggacca

SEQ ID NO: 2362570 - RNA, 22 nt, Human
guccccagacuccaccaagccu

SEQ ID NO: 2362571 - RNA, 20 nt, Human
gucccaccaugcagugcccc

SEQ ID NO: 2362572 - RNA, 14 nt, Human
guccccaccuggga

SEQ ID NO: 2362573 - RNA, 20 nt, Human
gucccaccccacacacgcca

SEQ ID NO: 2362574 - RNA, 18 nt, Human
guccccaccgcagacagg

SEQ ID NO: 2362575 - RNA, 20 nt, Human
guccaaaggaggcuggcagg

SEQ ID NO: 2362576 - RNA, 16 nt, Human
guccaaaggaggcugg

SEQ ID NO: 2362577 - RNA, 11 nt, Human
guccaaauaaa

SEQ ID NO: 2362578 - RNA, 13 nt, Human
guccaaauaaaaa

SEQ ID NO: 2362579 - RNA, 15 nt, Human
guccaaauaaaaacu

SEQ ID NO: 2362580 - RNA, 18 nt, Human
guccaaauaaaaacuaaa

SEQ ID NO: 2362581 - RNA, 14 nt, Human
guccaaaggaggcu

SEQ ID NO: 2362582 - RNA, 17 nt, Human
guccaaagcagggucug

SEQ ID NO: 2362583 - RNA, 19 nt, Human
gucauuugagcagggcuca

SEQ ID NO: 2362584 - RNA, 14 nt, Human
guccaaacugccua

SEQ ID NO: 2362585 - RNA, 21 nt, Human
guccaaacugccuaagcccuc

SEQ ID NO: 2362586 - RNA, 18 nt, Human
guccaaaagauugcugaa

SEQ ID NO: 2362587 - RNA, 22 nt, Human
guccaaauguccuccagaagcc

SEQ ID NO: 2362588 - RNA, 20 nt, Human
guccaaauaaaaacuaaauu

SEQ ID NO: 2362589 - RNA, 18 nt, Human
guccaaauguuuacaggg

SEQ ID NO: 2362590 - RNA, 17 nt, Human
guccaaccuaaccccuu

SEQ ID NO: 2362591 - RNA, 14 nt, Human
guccaaccuaaccc

SEQ ID NO: 2362592 - RNA, 20 nt, Human
guccaacccgaggcccgcau

SEQ ID NO: 2362593 - RNA, 21 nt, Human
guccaaccuaaccccuuuccu

SEQ ID NO: 2362594 - RNA, 20 nt, Human
guccaaccuaaccccuuucc

SEQ ID NO: 2362595 - RNA, 23 nt, Human
guccaugaagauguagaggagaa

SEQ ID NO: 2362596 - RNA, 22 nt, Human
guccaugaagauguagaggaga

SEQ ID NO: 2362597 - RNA, 17 nt, Human
aacacaaacccccacuc

SEQ ID NO: 2362598 - RNA, 19 nt, Human
aacacaaacuguaaauaaa

SEQ ID NO: 2362599 - RNA, 16 nt, Human
aacacaaacuguaaau

SEQ ID NO: 2362600 - RNA, 15 nt, Human
aacacaaacuguaaa

SEQ ID NO: 2362601 - RNA, 20 nt, Human
aaauuugaauggguccauuu

SEQ ID NO: 2362602 - RNA, 13 nt, Human
aacacaaacugua

SEQ ID NO: 2362603 - RNA, 19 nt, Human
aacacaaacgggcucagca

SEQ ID NO: 2362604 - RNA, 14 nt, Human
aaauuucuggaccu

SEQ ID NO: 2362605 - RNA, 24 nt, Human
gucaguguccaaagcagggucugg

SEQ ID NO: 2362606 - RNA, 19 nt, Human
aaauuucuaaaucuccaaa

SEQ ID NO: 2362607 - RNA, 10 nt, Human
aaauuugaau

SEQ ID NO: 2362608 - RNA, 16 nt, Human
aaauuugaagaaugaa

SEQ ID NO: 2362609 - RNA, 16 nt, Human
aacacaaguccuguga

SEQ ID NO: 2362610 - RNA, 18 nt, Human
aacacaagcuggaagcac

SEQ ID NO: 2362611 - RNA, 14 nt, Human
aacacacaaaggua

SEQ ID NO: 2362612 - RNA, 12 nt, Human
aacacaagcaaa

SEQ ID NO: 2362613 - RNA, 13 nt, Human
aacacaagcaaaa

SEQ ID NO: 2362614 - RNA, 16 nt, Human
aacacaagcaaaaaaa

SEQ ID NO: 2362615 - RNA, 14 nt, Human
aacacaagccacag

SEQ ID NO: 2362616 - RNA, 16 nt, Human
aacacaagccacagaa

SEQ ID NO: 2362617 - RNA, 17 nt, Human
aacacaagccacagaag

SEQ ID NO: 2362618 - RNA, 18 nt, Human
aacacagcauguguauuu

SEQ ID NO: 2362619 - RNA, 16 nt, Human
aacacagcauguguau

SEQ ID NO: 2362620 - RNA, 20 nt, Human
aacacagcaagggugauggg

SEQ ID NO: 2362621 - RNA, 15 nt, Human
aacacaccaggcugu

SEQ ID NO: 2362622 - RNA, 16 nt, Human
aacacaccaggcugug

SEQ ID NO: 2362623 - RNA, 12 nt, Human
aacacacagaca

SEQ ID NO: 2362624 - RNA, 15 nt, Human
aacacaagcuggaag

SEQ ID NO: 2362625 - RNA, 18 nt, Human
aacacagcaagggugaug

SEQ ID NO: 2362626 - RNA, 16 nt, Human
aacacugggggagggg

SEQ ID NO: 2362627 - RNA, 15 nt, Human
aacacuggggcuggc

SEQ ID NO: 2362628 - RNA, 18 nt, Human
aacacuggggcuggcaca

SEQ ID NO: 2362629 - RNA, 17 nt, Human
aacacugggggagggga

SEQ ID NO: 2362630 - RNA, 13 nt, Human
aacacuggccccu

SEQ ID NO: 2362631 - RNA, 12 nt, Human
aacacuggcccc

SEQ ID NO: 2362632 - RNA, 15 nt, Human
aacacucaugcugaa

SEQ ID NO: 2362633 - RNA, 16 nt, Human
aacacucaugcugaaa

SEQ ID NO: 2362634 - RNA, 15 nt, Human
aacacuggccccuag

SEQ ID NO: 2362635 - RNA, 14 nt, Human
aacacuggggcugg

SEQ ID NO: 2362636 - RNA, 21 nt, Human
aacacugggagaaaugaaaaa

SEQ ID NO: 2362637 - RNA, 19 nt, Human
aacacuggcaacaacaaag

SEQ ID NO: 2362638 - RNA, 14 nt, Human
aacacucaugcuga

SEQ ID NO: 2362639 - RNA, 19 nt, Human
aacacagcgagacuccguc

SEQ ID NO: 2362640 - RNA, 15 nt, Human
aacacaggcaaaauc

SEQ ID NO: 2362641 - RNA, 19 nt, Human
aacacagcugagagacuuu

SEQ ID NO: 2362642 - RNA, 17 nt, Human
aacacucaagaagcagg

SEQ ID NO: 2362643 - RNA, 21 nt, Human
aacacuauauggcagugucuu

SEQ ID NO: 2362644 - RNA, 16 nt, Human
aacacuauguuuauuu

SEQ ID NO: 2362645 - RNA, 13 nt, Human
aacacuauuuuau

SEQ ID NO: 2362646 - RNA, 21 nt, Human
aacacucacauuuauucugcu

SEQ ID NO: 2362647 - RNA, 16 nt, Human
aacacuauuuuaugca

SEQ ID NO: 2362648 - RNA, 17 nt, Human
gucauuugagcagggcu

SEQ ID NO: 2362649 - RNA, 15 nt, Human
gucauuucauuuccu

SEQ ID NO: 2362650 - RNA, 19 nt, Human
aacacuguucucugcccuc

SEQ ID NO: 2362651 - RNA, 14 nt, Human
gucauuuauaaaac

SEQ ID NO: 2362652 - RNA, 23 nt, Human
gucauuuauauagauuauaacuu

SEQ ID NO: 2362653 - RNA, 23 nt, Human
aacacugguggaggauggaaagg

SEQ ID NO: 2362654 - RNA, 17 nt, Human
aacacuggugugaccug

SEQ ID NO: 2362655 - RNA, 20 nt, Human
aacacuggugugaccugagg

SEQ ID NO: 2362656 - RNA, 22 nt, Human
aacacuggugugaccugagggc

SEQ ID NO: 2362657 - RNA, 16 nt, Human
aacacuguucucugcc

SEQ ID NO: 2362658 - RNA, 17 nt, Human
aacacuguucucugccc

SEQ ID NO: 2362659 - RNA, 18 nt, Human
aacacuguucucugcccu

SEQ ID NO: 2362660 - RNA, 16 nt, Human
aacauuauuuauucag

SEQ ID NO: 2362661 - RNA, 23 nt, Human
aacauuauuuauucagcuucauu

SEQ ID NO: 2362662 - RNA, 23 nt, Human
aacauuccauccuugagucaaaa

SEQ ID NO: 2362663 - RNA, 14 nt, Human
aacauuccauccuu

SEQ ID NO: 2362664 - RNA, 13 nt, Human
aacauuccauccu

SEQ ID NO: 2362665 - RNA, 10 nt, Human
aacauuccau

SEQ ID NO: 2362666 - RNA, 17 nt, Human
aacauguauaauauuuu

SEQ ID NO: 2362667 - RNA, 22 nt, Human
aacauauaauguuguuauuuaa

SEQ ID NO: 2362668 - RNA, 15 nt, Human
aacauguaggaagua

SEQ ID NO: 2362669 - RNA, 13 nt, Human
aacauguguacuu

SEQ ID NO: 2362670 - RNA, 19 nt, Human
aacaugucuccuauccugg

SEQ ID NO: 2362671 - RNA, 13 nt, Human
aacauguguuuua

SEQ ID NO: 2362672 - RNA, 15 nt, Human
aacauguacuguucu

SEQ ID NO: 2362673 - RNA, 13 nt, Human
aacaugucuccua

SEQ ID NO: 2362674 - RNA, 21 nt, Human
guccuccucggaucaccgaga

SEQ ID NO: 2362675 - RNA, 22 nt, Human
guccuccucggaucaccgagag

SEQ ID NO: 2362676 - RNA, 12 nt, Human
guccuccucugu

SEQ ID NO: 2362677 - RNA, 18 nt, Human
aacauugggaaaucuuau

SEQ ID NO: 2362678 - RNA, 13 nt, Human
guccuccucaccu

SEQ ID NO: 2362679 - RNA, 21 nt, Human
guccuccucaccucaugccca

SEQ ID NO: 2362680 - RNA, 15 nt, Human
guccuccucaccuca

SEQ ID NO: 2362681 - RNA, 17 nt, Human
guccuccucaccucaug

SEQ ID NO: 2362682 - RNA, 17 nt, Human
guccucguagccaucuc

SEQ ID NO: 2362683 - RNA, 12 nt, Human
guccucuccacc

SEQ ID NO: 2362684 - RNA, 21 nt, Human
guccuccugguggguccaggg

SEQ ID NO: 2362685 - RNA, 22 nt, Human
guccuccugguggguccagggg

SEQ ID NO: 2362686 - RNA, 23 nt, Human
guccuccugguggguccaggggc

SEQ ID NO: 2362687 - RNA, 14 nt, Human
guccuccucuguga

SEQ ID NO: 2362688 - RNA, 13 nt, Human
guccuccucugug

SEQ ID NO: 2362689 - RNA, 14 nt, Human
aacauugccuauuu

SEQ ID NO: 2362690 - RNA, 16 nt, Human
aacauugccuauuuca

SEQ ID NO: 2362691 - RNA, 20 nt, Human
aacauugccuauuucagugg

SEQ ID NO: 2362692 - RNA, 16 nt, Human
aacauugguucuugua

SEQ ID NO: 2362693 - RNA, 23 nt, Human
aacauugguucuuguauuaagaa

SEQ ID NO: 2362694 - RNA, 22 nt, Human
aacauugguucuuguauuaaga

SEQ ID NO: 2362695 - RNA, 19 nt, Human
aacauugguucuuguauua

SEQ ID NO: 2362696 - RNA, 18 nt, Human
aacauugguucuuguauu

SEQ ID NO: 2362697 - RNA, 14 nt, Human
aacauaaauaaaau

SEQ ID NO: 2362698 - RNA, 17 nt, Human
aacauaaauaaaaugac

SEQ ID NO: 2362699 - RNA, 15 nt, Human
aacauauaaagcacu

SEQ ID NO: 2362700 - RNA, 13 nt, Human
aacauauaauguu

SEQ ID NO: 2362701 - RNA, 18 nt, Human
aacauauaauguuguuau

SEQ ID NO: 2362702 - RNA, 21 nt, Human
aacauauaauguuguuauuua

SEQ ID NO: 2362703 - RNA, 12 nt, Human
aacauauauaac

SEQ ID NO: 2362704 - RNA, 21 nt, Human
aacaguuuuuuaugcuaauca

SEQ ID NO: 2362705 - RNA, 14 nt, Human
aacagucauuuaaa

SEQ ID NO: 2362706 - RNA, 14 nt, Human
aacagucucaggaa

SEQ ID NO: 2362707 - RNA, 14 nt, Human
aacauaaaauacaa

SEQ ID NO: 2362708 - RNA, 17 nt, Human
aacagucaaaacagaga

SEQ ID NO: 2362709 - RNA, 22 nt, Human
guccgugcugacagcugcuccu

SEQ ID NO: 2362710 - RNA, 13 nt, Human
aacagucauuuaa

SEQ ID NO: 2362711 - RNA, 21 nt, Human
guccgugcugacagcugcucc

SEQ ID NO: 2362712 - RNA, 20 nt, Human
guccgugcugacagcugcuc

SEQ ID NO: 2362713 - RNA, 19 nt, Human
guccgugcugacagcugcu

SEQ ID NO: 2362714 - RNA, 15 nt, Human
guccgugcugacagc

SEQ ID NO: 2362715 - RNA, 19 nt, Human
guccgugggacggugccca

SEQ ID NO: 2362716 - RNA, 18 nt, Human
aacaguccauugaaaggg

SEQ ID NO: 2362717 - RNA, 13 nt, Human
aacagucucagga

SEQ ID NO: 2362718 - RNA, 19 nt, Human
gucccuucucuuaauuuaa

SEQ ID NO: 2362719 - RNA, 22 nt, Human
gucccuuccccucccuggcucc

SEQ ID NO: 2362720 - RNA, 20 nt, Human
gucccuuccccucccuggcu

SEQ ID NO: 2362721 - RNA, 19 nt, Human
gucccuuccccucccuggc

SEQ ID NO: 2362722 - RNA, 24 nt, Human
guccgguguccuuuucacuacacc

SEQ ID NO: 2362723 - RNA, 14 nt, Human
gucccuugagaccu

SEQ ID NO: 2362724 - RNA, 17 nt, Human
guccgguguccuuuuca

SEQ ID NO: 2362725 - RNA, 16 nt, Human
gucccuugagaccuca

SEQ ID NO: 2362726 - RNA, 15 nt, Human
guccucuuucaaagg

SEQ ID NO: 2362727 - RNA, 20 nt, Human
guccucuccaccuaguggcu

SEQ ID NO: 2362728 - RNA, 18 nt, Human
guccucuugccuccugga

SEQ ID NO: 2362729 - RNA, 13 nt, Human
guccucuccaccu

SEQ ID NO: 2362730 - RNA, 14 nt, Human
guccucuccaccua

SEQ ID NO: 2362731 - RNA, 18 nt, Human
guccucuccaccuagugg

SEQ ID NO: 2362732 - RNA, 14 nt, Human
guccucuuuucuga

SEQ ID NO: 2362733 - RNA, 16 nt, Human
guccugaagaggcggg

SEQ ID NO: 2362734 - RNA, 17 nt, Human
guccugaagaggcgggc

SEQ ID NO: 2362735 - RNA, 20 nt, Human
guccugaagaggcgggccag

SEQ ID NO: 2362736 - RNA, 21 nt, Human
guccugaagaggcgggccagc

SEQ ID NO: 2362737 - RNA, 22 nt, Human
guccugaagaggcgggccagcc

SEQ ID NO: 2362738 - RNA, 19 nt, Human
guccugcugcaguugccag

SEQ ID NO: 2362739 - RNA, 23 nt, Human
guccugaagaggcgggccagcca

SEQ ID NO: 2362740 - RNA, 12 nt, Human
guccugaccacc

SEQ ID NO: 2362741 - RNA, 16 nt, Human
guccugaccacccucc

SEQ ID NO: 2362742 - RNA, 16 nt, Human
guccuggcaugggaau

SEQ ID NO: 2362743 - RNA, 21 nt, Human
guccuggaagcgcgagggccu

SEQ ID NO: 2362744 - RNA, 20 nt, Human
guccuggacaccgggccagu

SEQ ID NO: 2362745 - RNA, 13 nt, Human
guccugaccaccc

SEQ ID NO: 2362746 - RNA, 14 nt, Human
guccugaccacccu

SEQ ID NO: 2362747 - RNA, 15 nt, Human
guccugaccacccuc

SEQ ID NO: 2362748 - RNA, 14 nt, Human
gucgauaaucagag

SEQ ID NO: 2362749 - RNA, 14 nt, Human
gucgauagagcugu

SEQ ID NO: 2362750 - RNA, 14 nt, Human
gucgaggggcucuc

SEQ ID NO: 2362751 - RNA, 15 nt, Human
gucgaggggcucuca

SEQ ID NO: 2362752 - RNA, 16 nt, Human
gucgaggggcucucag

SEQ ID NO: 2362753 - RNA, 19 nt, Human
gucgaggggcucucagcuc

SEQ ID NO: 2362754 - RNA, 12 nt, Human
gucgaggcagga

SEQ ID NO: 2362755 - RNA, 16 nt, Human
gucgaggacagggagg

SEQ ID NO: 2362756 - RNA, 13 nt, Human
guccuuucccucc

SEQ ID NO: 2362757 - RNA, 11 nt, Human
guccuuucccu

SEQ ID NO: 2362758 - RNA, 22 nt, Human
guccuuuauguggaaaacagaa

SEQ ID NO: 2362759 - RNA, 18 nt, Human
guccuuuccaaggcuucu

SEQ ID NO: 2362760 - RNA, 20 nt, Human
guccuuuccaaggcuucucc

SEQ ID NO: 2362761 - RNA, 22 nt, Human
guccuuuccaaggcuucuccaa

SEQ ID NO: 2362762 - RNA, 19 nt, Human
guccuggagcagaccaccc

SEQ ID NO: 2362763 - RNA, 18 nt, Human
guccuuuucacuacacca

SEQ ID NO: 2362764 - RNA, 15 nt, Human
guccuuuucacuaca

SEQ ID NO: 2362765 - RNA, 15 nt, Human
guccuuucccuccac

SEQ ID NO: 2362766 - RNA, 14 nt, Human
guccuuucccucca

SEQ ID NO: 2362767 - RNA, 15 nt, Human
guccuuuucagaagu

SEQ ID NO: 2362768 - RNA, 22 nt, Human
guccuuuucagaagugagcuuu

SEQ ID NO: 2362769 - RNA, 13 nt, Human
gucgcgcucagca

SEQ ID NO: 2362770 - RNA, 12 nt, Human
gucgcgcugccu

SEQ ID NO: 2362771 - RNA, 13 nt, Human
gucgcgcugccug

SEQ ID NO: 2362772 - RNA, 16 nt, Human
gucgcgcugccugugu

SEQ ID NO: 2362773 - RNA, 17 nt, Human
gucgcgcugccugugug

SEQ ID NO: 2362774 - RNA, 16 nt, Human
gucgcucaugugugca

SEQ ID NO: 2362775 - RNA, 21 nt, Human
gucgcucaugugugcaacagg

SEQ ID NO: 2362776 - RNA, 11 nt, Human
gucgcuccugc

SEQ ID NO: 2362777 - RNA, 15 nt, Human
gucgcuccugcccac

SEQ ID NO: 2362778 - RNA, 14 nt, Human
gucgaugaacuauu

SEQ ID NO: 2362779 - RNA, 19 nt, Human
gucgccaccuggcauuccu

SEQ ID NO: 2362780 - RNA, 12 nt, Human
gucgccucugca

SEQ ID NO: 2362781 - RNA, 17 nt, Human
gucgccuuagcauguuu

SEQ ID NO: 2362782 - RNA, 18 nt, Human
gucgccuuagcauguuug

SEQ ID NO: 2362783 - RNA, 20 nt, Human
gucgccuuagcauguuugcu

SEQ ID NO: 2362784 - RNA, 14 nt, Human
gucuaccugagggg

SEQ ID NO: 2362785 - RNA, 13 nt, Human
gucuaccugaggg

SEQ ID NO: 2362786 - RNA, 15 nt, Human
gucuaccugaggggc

SEQ ID NO: 2362787 - RNA, 16 nt, Human
gucuaccugaggggcc

SEQ ID NO: 2362788 - RNA, 19 nt, Human
gucuagcagagcaggggca

SEQ ID NO: 2362789 - RNA, 13 nt, Human
gucuaggagcugg

SEQ ID NO: 2362790 - RNA, 21 nt, Human
gucuaggagcugggaggaaaa

SEQ ID NO: 2362791 - RNA, 23 nt, Human
gucuaggcaggaccuguggccaa

SEQ ID NO: 2362792 - RNA, 14 nt, Human
gucuagggagagac

SEQ ID NO: 2362793 - RNA, 12 nt, Human
gucuagggagag

SEQ ID NO: 2362794 - RNA, 21 nt, Human
gucuagauggcuccucucagu

SEQ ID NO: 2362795 - RNA, 20 nt, Human
gucuagauggcuccucucag

SEQ ID NO: 2362796 - RNA, 20 nt, Human
gucgcucugcuggccuggcc

SEQ ID NO: 2362797 - RNA, 18 nt, Human
gucgcgcugccugugugg

SEQ ID NO: 2362798 - RNA, 18 nt, Human
gucgcucugcuggccugg

SEQ ID NO: 2362799 - RNA, 17 nt, Human
gucuauucuccagcuga

SEQ ID NO: 2362800 - RNA, 10 nt, Human
gucuauuuaa

SEQ ID NO: 2362801 - RNA, 13 nt, Human
gucuauucuaguc

SEQ ID NO: 2362802 - RNA, 13 nt, Human
gucuauucagcuu

SEQ ID NO: 2362803 - RNA, 12 nt, Human
gucuauucauua

SEQ ID NO: 2362804 - RNA, 19 nt, Human
gucuaguuaacauuucaag

SEQ ID NO: 2362805 - RNA, 22 nt, Human
gucuauguaaaugcaucugucc

SEQ ID NO: 2362806 - RNA, 22 nt, Human
gucuaugggacucaaugcacug

SEQ ID NO: 2362807 - RNA, 15 nt, Human
aaguauuuugcugga

SEQ ID NO: 2362808 - RNA, 23 nt, Human
aaguauucuuauuuaaugaaaga

SEQ ID NO: 2362809 - RNA, 19 nt, Human
aaguauugcaucuguauaa

SEQ ID NO: 2362810 - RNA, 22 nt, Human
aaguauugcaucuguauaagua

SEQ ID NO: 2362811 - RNA, 15 nt, Human
aaguauuaugucucu

SEQ ID NO: 2362812 - RNA, 17 nt, Human
aaguauuauaaauuaug

SEQ ID NO: 2362813 - RNA, 18 nt, Human
aaguauugcaucuguaua

SEQ ID NO: 2362814 - RNA, 21 nt, Human
aaguauucuuauuuaaugaaa

SEQ ID NO: 2362815 - RNA, 13 nt, Human
aaguauuaucaga

SEQ ID NO: 2362816 - RNA, 13 nt, Human
aaguauuauaaau

SEQ ID NO: 2362817 - RNA, 19 nt, Human
aaguauuauaccuuuuuua

SEQ ID NO: 2362818 - RNA, 16 nt, Human
aaguauuauaccuuuu

SEQ ID NO: 2362819 - RNA, 14 nt, Human
aagucaaaguaaaa

SEQ ID NO: 2362820 - RNA, 20 nt, Human
aagucaaagcaaggaaacua

SEQ ID NO: 2362821 - RNA, 22 nt, Human
aagucaaaguaaaacuugcugc

SEQ ID NO: 2362822 - RNA, 19 nt, Human
aagucaaauuaauaaucuu

SEQ ID NO: 2362823 - RNA, 15 nt, Human
aagucaaauuaauaa

SEQ ID NO: 2362824 - RNA, 22 nt, Human
aagucacugcacagugcaucuc

SEQ ID NO: 2362825 - RNA, 21 nt, Human
aagucacuggccaguggcugg

SEQ ID NO: 2362826 - RNA, 23 nt, Human
aagucaaagacauucugacaucu

SEQ ID NO: 2362827 - RNA, 19 nt, Human
aagucaaaaggugccugug

SEQ ID NO: 2362828 - RNA, 16 nt, Human
aagucaaaaggugccu

SEQ ID NO: 2362829 - RNA, 15 nt, Human
aaguauuuuuuuauc

SEQ ID NO: 2362830 - RNA, 20 nt, Human
aagucagacugcugggacug

SEQ ID NO: 2362831 - RNA, 12 nt, Human
aagucagaggau

SEQ ID NO: 2362832 - RNA, 17 nt, Human
aagucagacugcuggga

SEQ ID NO: 2362833 - RNA, 16 nt, Human
aagucagacugcuggg

SEQ ID NO: 2362834 - RNA, 14 nt, Human
aagucacugcacag

SEQ ID NO: 2362835 - RNA, 15 nt, Human
aagucagaggauggc

SEQ ID NO: 2362836 - RNA, 20 nt, Human
aagucagaggauggccagug

SEQ ID NO: 2362837 - RNA, 21 nt, Human
aagucagaggauggccagugu

SEQ ID NO: 2362838 - RNA, 22 nt, Human
aagucagaggauggccaguguc

SEQ ID NO: 2362839 - RNA, 13 nt, Human
aaguacuauguau

SEQ ID NO: 2362840 - RNA, 17 nt, Human
aaguacuauaauuuacc

SEQ ID NO: 2362841 - RNA, 14 nt, Human
aaguacuauaauuu

SEQ ID NO: 2362842 - RNA, 20 nt, Human
aaguacccguucacauuuuu

SEQ ID NO: 2362843 - RNA, 15 nt, Human
aaguacguuauuguu

SEQ ID NO: 2362844 - RNA, 16 nt, Human
aaguacguuauuguug

SEQ ID NO: 2362845 - RNA, 23 nt, Human
aaguaauuaucgggaacaguguu

SEQ ID NO: 2362846 - RNA, 22 nt, Human
aaguaauuaucgggaacagugu

SEQ ID NO: 2362847 - RNA, 15 nt, Human
aaguaauuaucggga

SEQ ID NO: 2362848 - RNA, 13 nt, Human
aaguaauuaucgg

SEQ ID NO: 2362849 - RNA, 11 nt, Human
aaguaauuauc

SEQ ID NO: 2362850 - RNA, 19 nt, Human
guuuugauuuguacugaaa

SEQ ID NO: 2362851 - RNA, 16 nt, Human
aaguaauugugaaaaa

SEQ ID NO: 2362852 - RNA, 14 nt, Human
aaguaauuccucuc

SEQ ID NO: 2362853 - RNA, 22 nt, Human
aaguaauucugcugucucagcc

SEQ ID NO: 2362854 - RNA, 16 nt, Human
aaguacuguguacaga

SEQ ID NO: 2362855 - RNA, 18 nt, Human
aaguacuucuccacccug

SEQ ID NO: 2362856 - RNA, 19 nt, Human
aaguacuucuccacccugc

SEQ ID NO: 2362857 - RNA, 20 nt, Human
aaguacuucuccacccugcu

SEQ ID NO: 2362858 - RNA, 19 nt, Human
aaguauguguaaaauguga

SEQ ID NO: 2362859 - RNA, 15 nt, Human
aaguauuauaccuuu

SEQ ID NO: 2362860 - RNA, 18 nt, Human
aaguauguuagugcaaau

SEQ ID NO: 2362861 - RNA, 19 nt, Human
aaguauguuagugcaaauu

SEQ ID NO: 2362862 - RNA, 21 nt, Human
guuuuaauuuaaacaccuccu

SEQ ID NO: 2362863 - RNA, 14 nt, Human
guuuuaauuuaaac

SEQ ID NO: 2362864 - RNA, 19 nt, Human
guuuuauauuuuuauagac

SEQ ID NO: 2362865 - RNA, 18 nt, Human
guuuuaucacauguaugu

SEQ ID NO: 2362866 - RNA, 20 nt, Human
guuuuaucacauguauguuu

SEQ ID NO: 2362867 - RNA, 21 nt, Human
guuuuaucacauguauguuuu

SEQ ID NO: 2362868 - RNA, 22 nt, Human
guuuuaucacauguauguuuug

SEQ ID NO: 2362869 - RNA, 14 nt, Human
guuuuaucaugaca

SEQ ID NO: 2362870 - RNA, 22 nt, Human
guuuuaucaugacauguuauau

SEQ ID NO: 2362871 - RNA, 18 nt, Human
guuuuaugacuucauuaa

SEQ ID NO: 2362872 - RNA, 13 nt, Human
guuuuaugacuuc

SEQ ID NO: 2362873 - RNA, 13 nt, Human
guuuuauuguguu

SEQ ID NO: 2362874 - RNA, 14 nt, Human
guuuuauuccugua

SEQ ID NO: 2362875 - RNA, 20 nt, Human
guuuuauuccuguauguugu

SEQ ID NO: 2362876 - RNA, 19 nt, Human
guuuuaacuagaauuuauu

SEQ ID NO: 2362877 - RNA, 14 nt, Human
guuuuaacaaaaac

SEQ ID NO: 2362878 - RNA, 22 nt, Human
guuuuaacaauuuccuuuauau

SEQ ID NO: 2362879 - RNA, 22 nt, Human
guuuuaaggaugcuuguacaua

SEQ ID NO: 2362880 - RNA, 18 nt, Human
guuuuaaguuguuugcau

SEQ ID NO: 2362881 - RNA, 17 nt, Human
guuuuaaguuguuugca

SEQ ID NO: 2362882 - RNA, 20 nt, Human
guuuuaauuccaauaugaug

SEQ ID NO: 2362883 - RNA, 23 nt, Human
guuuuaauuccaauaugaugacu

SEQ ID NO: 2362884 - RNA, 13 nt, Human
guuuuaauuccau

SEQ ID NO: 2362885 - RNA, 14 nt, Human
guuuuaauuccaug

SEQ ID NO: 2362886 - RNA, 16 nt, Human
guuuuaauuccaugaa

SEQ ID NO: 2362887 - RNA, 22 nt, Human
guuuuaauuccaugaaucgcuu

SEQ ID NO: 2362888 - RNA, 21 nt, Human
guuuugauguuuguggccuca

SEQ ID NO: 2362889 - RNA, 20 nt, Human
guuuugauaaaguaguaaaa

SEQ ID NO: 2362890 - RNA, 23 nt, Human
guuuugagguuuccuucagacag

SEQ ID NO: 2362891 - RNA, 14 nt, Human
guuuugauaaagua

SEQ ID NO: 2362892 - RNA, 19 nt, Human
guuuugauaaaguaguaaa

SEQ ID NO: 2362893 - RNA, 23 nt, Human
guuuugauguuuguggccucaga

SEQ ID NO: 2362894 - RNA, 22 nt, Human
guuuugauguuuguggccucag

SEQ ID NO: 2362895 - RNA, 20 nt, Human
guuuugauuuaauguuuuca

SEQ ID NO: 2362896 - RNA, 13 nt, Human
guuuugauugaga

SEQ ID NO: 2362897 - RNA, 19 nt, Human
guuuugauugagaguaacu

SEQ ID NO: 2362898 - RNA, 12 nt, Human
guuuugagcuuu

SEQ ID NO: 2362899 - RNA, 16 nt, Human
guuuugacggaugauu

SEQ ID NO: 2362900 - RNA, 14 nt, Human
guuuugacauuuuu

SEQ ID NO: 2362901 - RNA, 17 nt, Human
guuuugacauuuuuagu

SEQ ID NO: 2362902 - RNA, 15 nt, Human
guuuugaaggcaaaa

SEQ ID NO: 2362903 - RNA, 21 nt, Human
guuuugaaggcaaaauugcaa

SEQ ID NO: 2362904 - RNA, 18 nt, Human
guuuugaaugguguugua

SEQ ID NO: 2362905 - RNA, 16 nt, Human
guuuucuguucuuucu

SEQ ID NO: 2362906 - RNA, 15 nt, Human
guuuucuguucuuuc

SEQ ID NO: 2362907 - RNA, 14 nt, Human
guuuucuguucuuu

SEQ ID NO: 2362908 - RNA, 11 nt, Human
aaguaagaaaa

SEQ ID NO: 2362909 - RNA, 12 nt, Human
aaguaagaaaau

SEQ ID NO: 2362910 - RNA, 13 nt, Human
aaguaagaaaaua

SEQ ID NO: 2362911 - RNA, 14 nt, Human
aaguaagaaaauau

SEQ ID NO: 2362912 - RNA, 15 nt, Human
aaguaagaaaauauu

SEQ ID NO: 2362913 - RNA, 16 nt, Human
aaguaagaaaauauuu

SEQ ID NO: 2362914 - RNA, 18 nt, Human
aaguaagaaaauauuuug

SEQ ID NO: 2362915 - RNA, 17 nt, Human
aaguaauaugcacacau

SEQ ID NO: 2362916 - RNA, 20 nt, Human
aaguaauaugcacacauuuu

SEQ ID NO: 2362917 - RNA, 18 nt, Human
aaguaauaugcacacauu

SEQ ID NO: 2362918 - RNA, 20 nt, Human
aaguaagaaagugaagcaaa

SEQ ID NO: 2362919 - RNA, 19 nt, Human
aaguaagaaaauauuuugu

SEQ ID NO: 2362920 - RNA, 18 nt, Human
aaguaagaaagugaagca

SEQ ID NO: 2362921 - RNA, 19 nt, Human
guuugcugaacaccuugug

SEQ ID NO: 2362922 - RNA, 21 nt, Human
aaguaauaugcacacauuuuu

SEQ ID NO: 2362923 - RNA, 18 nt, Human
guuugcuuauuguuccaa

SEQ ID NO: 2362924 - RNA, 17 nt, Human
guuugcuucauaaauga

SEQ ID NO: 2362925 - RNA, 16 nt, Human
guuugcuucauaaaug

SEQ ID NO: 2362926 - RNA, 17 nt, Human
guuugcuuauuguucca

SEQ ID NO: 2362927 - RNA, 16 nt, Human
guuugcuuauuguucc

SEQ ID NO: 2362928 - RNA, 15 nt, Human
guuugcuuauuguuc

SEQ ID NO: 2362929 - RNA, 14 nt, Human
guuugcuuauuguu

SEQ ID NO: 2362930 - RNA, 13 nt, Human
guuugcuuauugu

SEQ ID NO: 2362931 - RNA, 18 nt, Human
guuugcuguugauuucuu

SEQ ID NO: 2362932 - RNA, 22 nt, Human
guuuuaaagaccugacaccuuu

SEQ ID NO: 2362933 - RNA, 19 nt, Human
guuuuaaauuuauuucaaa

SEQ ID NO: 2362934 - RNA, 15 nt, Human
guuuuaaagugauua

SEQ ID NO: 2362935 - RNA, 12 nt, Human
guuuuaaauucu

SEQ ID NO: 2362936 - RNA, 22 nt, Human
guuuuaaauacgcacuacaugu

SEQ ID NO: 2362937 - RNA, 14 nt, Human
guuuuaaaauuaaa

SEQ ID NO: 2362938 - RNA, 18 nt, Human
guuuggauucuuauguag

SEQ ID NO: 2362939 - RNA, 19 nt, Human
guuuuaaacauagaaaguu

SEQ ID NO: 2362940 - RNA, 12 nt, Human
guuuuaaaauua

SEQ ID NO: 2362941 - RNA, 17 nt, Human
guuuuaaaaugagaaau

SEQ ID NO: 2362942 - RNA, 20 nt, Human
guuuggaugggagugagaca

SEQ ID NO: 2362943 - RNA, 21 nt, Human
guuuggaggagcaaaggcuga

SEQ ID NO: 2362944 - RNA, 13 nt, Human
guuuggagacauu

SEQ ID NO: 2362945 - RNA, 23 nt, Human
guuuggagacauuccugggcaca

SEQ ID NO: 2362946 - RNA, 20 nt, Human
guuugcuuuguaugcacuuu

SEQ ID NO: 2362947 - RNA, 13 nt, Human
guuuggagacaga

SEQ ID NO: 2362948 - RNA, 17 nt, Human
guuuggaccccagcugg

SEQ ID NO: 2362949 - RNA, 18 nt, Human
guuuggaccccagcuggg

SEQ ID NO: 2362950 - RNA, 19 nt, Human
guuuggaccccagcuggga

SEQ ID NO: 2362951 - RNA, 13 nt, Human
guuuggaaugcuu

SEQ ID NO: 2362952 - RNA, 15 nt, Human
guuuggaaugcuucu

SEQ ID NO: 2362953 - RNA, 15 nt, Human
guuuggaccccagcu

SEQ ID NO: 2362954 - RNA, 16 nt, Human
guuuggaccccagcug

SEQ ID NO: 2362955 - RNA, 23 nt, Human
aaggcuguugcaugggcuaauga

SEQ ID NO: 2362956 - RNA, 13 nt, Human
aaggcuguugcau

SEQ ID NO: 2362957 - RNA, 22 nt, Human
aaggcugugcucccugguucug

SEQ ID NO: 2362958 - RNA, 19 nt, Human
aaggcuguguacacugaca

SEQ ID NO: 2362959 - RNA, 19 nt, Human
aagggcuagaaccuggagg

SEQ ID NO: 2362960 - RNA, 15 nt, Human
aagggcuguuauaau

SEQ ID NO: 2362961 - RNA, 16 nt, Human
aaggggacccccgccc

SEQ ID NO: 2362962 - RNA, 20 nt, Human
aaggggacccccgcccccug

SEQ ID NO: 2362963 - RNA, 19 nt, Human
aagggcuucugcacccucc

SEQ ID NO: 2362964 - RNA, 21 nt, Human
aagggcuuacacguggaggaa

SEQ ID NO: 2362965 - RNA, 17 nt, Human
aagggcuucugcacccu

SEQ ID NO: 2362966 - RNA, 18 nt, Human
aagggcuucugcacccuc

SEQ ID NO: 2362967 - RNA, 17 nt, Human
aagggcuguuauaaucu

SEQ ID NO: 2362968 - RNA, 17 nt, Human
aaggggaauugaggaca

SEQ ID NO: 2362969 - RNA, 21 nt, Human
guuucacuuucacauagaugu

SEQ ID NO: 2362970 - RNA, 20 nt, Human
guuucacugacuuagaacca

SEQ ID NO: 2362971 - RNA, 22 nt, Human
aaggcuguccuuacccaucugc

SEQ ID NO: 2362972 - RNA, 16 nt, Human
aaggcugugcucccug

SEQ ID NO: 2362973 - RNA, 20 nt, Human
aaggcugucaauuacaggaa

SEQ ID NO: 2362974 - RNA, 22 nt, Human
aaggcugggggaagaagcucuc

SEQ ID NO: 2362975 - RNA, 19 nt, Human
aaggcugggggaagaagcu

SEQ ID NO: 2362976 - RNA, 14 nt, Human
aaggcugggggaag

SEQ ID NO: 2362977 - RNA, 16 nt, Human
aaggcugggggaagaa

SEQ ID NO: 2362978 - RNA, 13 nt, Human
guuucagaaaugu

SEQ ID NO: 2362979 - RNA, 11 nt, Human
guuucagaaau

SEQ ID NO: 2362980 - RNA, 13 nt, Human
aagguuuggugug

SEQ ID NO: 2362981 - RNA, 17 nt, Human
aagguuuguauauuguc

SEQ ID NO: 2362982 - RNA, 16 nt, Human
aagguuucugaaaauu

SEQ ID NO: 2362983 - RNA, 21 nt, Human
aagguuucguuucuguauaca

SEQ ID NO: 2362984 - RNA, 22 nt, Human
aagguuucguuucuguauacaa

SEQ ID NO: 2362985 - RNA, 23 nt, Human
aagguuucagaaagaagugggga

SEQ ID NO: 2362986 - RNA, 22 nt, Human
aagguuuaggcugguggcccag

SEQ ID NO: 2362987 - RNA, 16 nt, Human
aagguuucguuucugu

SEQ ID NO: 2362988 - RNA, 11 nt, Human
aagguauaauu

SEQ ID NO: 2362989 - RNA, 20 nt, Human
aagguaucaguugcaauaau

SEQ ID NO: 2362990 - RNA, 19 nt, Human
aagguaucaguugcaauaa

SEQ ID NO: 2362991 - RNA, 22 nt, Human
aagguauuaaauugauguugcu

SEQ ID NO: 2362992 - RNA, 18 nt, Human
aagguauuaaauugaugu

SEQ ID NO: 2362993 - RNA, 20 nt, Human
aagguuuuauaaggcugaug

SEQ ID NO: 2362994 - RNA, 12 nt, Human
aaguaaaugcua

SEQ ID NO: 2362995 - RNA, 21 nt, Human
aagggggauaugaauggagau

SEQ ID NO: 2362996 - RNA, 15 nt, Human
aaggggggagcuggg

SEQ ID NO: 2362997 - RNA, 16 nt, Human
aaggggguccacccag

SEQ ID NO: 2362998 - RNA, 19 nt, Human
aagggggucccagugggag

SEQ ID NO: 2362999 - RNA, 17 nt, Human
aaggggguggugucucc

SEQ ID NO: 2363000 - RNA, 12 nt, Human
aaggggguccca

SEQ ID NO: 2363001 - RNA, 17 nt, Human
aagggggucccaguggg

SEQ ID NO: 2363002 - RNA, 20 nt, Human
aagguagcccuggccagagg

SEQ ID NO: 2363003 - RNA, 22 nt, Human
aagguaguuuuuaccuaccaca

SEQ ID NO: 2363004 - RNA, 12 nt, Human
aagguaguuuuu

SEQ ID NO: 2363005 - RNA, 14 nt, Human
aagguagccauccc

SEQ ID NO: 2363006 - RNA, 13 nt, Human
aaggggagaguaa

SEQ ID NO: 2363007 - RNA, 19 nt, Human
aaggggagagccugcuggc

SEQ ID NO: 2363008 - RNA, 12 nt, Human
aaggggagagcc

SEQ ID NO: 2363009 - RNA, 14 nt, Human
aaggggagagccug

SEQ ID NO: 2363010 - RNA, 15 nt, Human
aaggggagagccugc

SEQ ID NO: 2363011 - RNA, 18 nt, Human
aaggggagagccugcugg

SEQ ID NO: 2363012 - RNA, 12 nt, Human
aagggggcuggg

SEQ ID NO: 2363013 - RNA, 23 nt, Human
aagggggcugggacaugggaaag

SEQ ID NO: 2363014 - RNA, 17 nt, Human
aaggaaaauaguaaugu

SEQ ID NO: 2363015 - RNA, 12 nt, Human
aaggaaacucuu

SEQ ID NO: 2363016 - RNA, 13 nt, Human
aaggaaacucuua

SEQ ID NO: 2363017 - RNA, 20 nt, Human
aaggaaacuggguuccugca

SEQ ID NO: 2363018 - RNA, 16 nt, Human
aaggaaacucuuaucu

SEQ ID NO: 2363019 - RNA, 19 nt, Human
aaggaaacucuuaucucag

SEQ ID NO: 2363020 - RNA, 13 nt, Human
guuguuuguaugu

SEQ ID NO: 2363021 - RNA, 21 nt, Human
aaggaaacuugaaucaaagca

SEQ ID NO: 2363022 - RNA, 12 nt, Human
guuguuugcaug

SEQ ID NO: 2363023 - RNA, 23 nt, Human
guuguuugauucagacagcugcc

SEQ ID NO: 2363024 - RNA, 17 nt, Human
aaggaaacccagcucug

SEQ ID NO: 2363025 - RNA, 22 nt, Human
aaggaaacccagcucuggucca

SEQ ID NO: 2363026 - RNA, 21 nt, Human
aaggaaaaagcacaagaagcg

SEQ ID NO: 2363027 - RNA, 17 nt, Human
aaggaaaaauaaauauu

SEQ ID NO: 2363028 - RNA, 14 nt, Human
aaggaaaaaugugu

SEQ ID NO: 2363029 - RNA, 15 nt, Human
aaggaaaaaugugua

SEQ ID NO: 2363030 - RNA, 16 nt, Human
aaggaaaaauguguaa

SEQ ID NO: 2363031 - RNA, 17 nt, Human
aaggaaaaauguguaau

SEQ ID NO: 2363032 - RNA, 21 nt, Human
aaggaaaaauguguaauuuug

SEQ ID NO: 2363033 - RNA, 13 nt, Human
guuuaaauaaagu

SEQ ID NO: 2363034 - RNA, 14 nt, Human
guuuaaagcaacug

SEQ ID NO: 2363035 - RNA, 14 nt, Human
guuuaaauaaagua

SEQ ID NO: 2363036 - RNA, 15 nt, Human
guuuaaauaaaguau

SEQ ID NO: 2363037 - RNA, 16 nt, Human
guuuaaauaaaguauc

SEQ ID NO: 2363038 - RNA, 17 nt, Human
guuuaaauaaaguauca

SEQ ID NO: 2363039 - RNA, 19 nt, Human
guuuaaauaaaguaucaug

SEQ ID NO: 2363040 - RNA, 22 nt, Human
guuuaaauaaaguaucaugcau

SEQ ID NO: 2363041 - RNA, 23 nt, Human
guuuaaauaaaguaucaugcauu

SEQ ID NO: 2363042 - RNA, 13 nt, Human
guuuaaauauuuc

SEQ ID NO: 2363043 - RNA, 14 nt, Human
guuuaaauauuuca

SEQ ID NO: 2363044 - RNA, 21 nt, Human
guuuaagugacugauggcuaa

SEQ ID NO: 2363045 - RNA, 12 nt, Human
guuuaaguguug

SEQ ID NO: 2363046 - RNA, 13 nt, Human
guuuaauacucau

SEQ ID NO: 2363047 - RNA, 19 nt, Human
guuuaaauauuucaagaca

SEQ ID NO: 2363048 - RNA, 19 nt, Human
guuguuuuuugaaaacaug

SEQ ID NO: 2363049 - RNA, 17 nt, Human
guuguuuguauguauaa

SEQ ID NO: 2363050 - RNA, 15 nt, Human
guuuaaagagagguu

SEQ ID NO: 2363051 - RNA, 16 nt, Human
guuuaaagagagguua

SEQ ID NO: 2363052 - RNA, 13 nt, Human
guuuaugagccag

SEQ ID NO: 2363053 - RNA, 20 nt, Human
guuuaauacucauccuugua

SEQ ID NO: 2363054 - RNA, 14 nt, Human
guuuaugauuccac

SEQ ID NO: 2363055 - RNA, 23 nt, Human
guuuauggccucagcugccucac

SEQ ID NO: 2363056 - RNA, 22 nt, Human
guuuauggccucagcugccuca

SEQ ID NO: 2363057 - RNA, 18 nt, Human
guuuauggccucagcugc

SEQ ID NO: 2363058 - RNA, 15 nt, Human
guuuauggccucagc

SEQ ID NO: 2363059 - RNA, 14 nt, Human
guuuauggccucag

SEQ ID NO: 2363060 - RNA, 13 nt, Human
guuuauggccuca

SEQ ID NO: 2363061 - RNA, 17 nt, Human
guuuaugcaaggaagga

SEQ ID NO: 2363062 - RNA, 23 nt, Human
guuucaaccaagucaugugcauu

SEQ ID NO: 2363063 - RNA, 17 nt, Human
guuucaaacuuuacuau

SEQ ID NO: 2363064 - RNA, 15 nt, Human
guuucaauucagugc

SEQ ID NO: 2363065 - RNA, 22 nt, Human
guuucaauuccaccugcaauca

SEQ ID NO: 2363066 - RNA, 13 nt, Human
guuucaaugugau

SEQ ID NO: 2363067 - RNA, 19 nt, Human
guuucaaugugauucuaau

SEQ ID NO: 2363068 - RNA, 21 nt, Human
guuucaaugugauucuaaugu

SEQ ID NO: 2363069 - RNA, 19 nt, Human
guuucacggugccagguuu

SEQ ID NO: 2363070 - RNA, 17 nt, Human
guuucaauugcaucucc

SEQ ID NO: 2363071 - RNA, 16 nt, Human
guuucaauugcaucuc

SEQ ID NO: 2363072 - RNA, 22 nt, Human
guuucaauugcaucucccagau

SEQ ID NO: 2363073 - RNA, 16 nt, Human
uaaaacugaagucuga

SEQ ID NO: 2363074 - RNA, 13 nt, Human
uaaaacccaagug

SEQ ID NO: 2363075 - RNA, 20 nt, Human
uaaaacugaagucugaaauu

SEQ ID NO: 2363076 - RNA, 18 nt, Human
uaaaacuggcuuuggcuu

SEQ ID NO: 2363077 - RNA, 13 nt, Human
uaaaacuguacuu

SEQ ID NO: 2363078 - RNA, 17 nt, Human
uaaaacuggcuuuggcu

SEQ ID NO: 2363079 - RNA, 17 nt, Human
uaaaacugaagucugaa

SEQ ID NO: 2363080 - RNA, 18 nt, Human
uaaaacugaagucugaaa

SEQ ID NO: 2363081 - RNA, 19 nt, Human
uaaaacugaagucugaaau

SEQ ID NO: 2363082 - RNA, 13 nt, Human
uaaaacugaauug

SEQ ID NO: 2363083 - RNA, 10 nt, Human
uaaaacugcg

SEQ ID NO: 2363084 - RNA, 13 nt, Human
uaaaacugucccu

SEQ ID NO: 2363085 - RNA, 15 nt, Human
uaaaacuuugcugcc

SEQ ID NO: 2363086 - RNA, 14 nt, Human
uaaaacuuugcugc

SEQ ID NO: 2363087 - RNA, 17 nt, Human
uaaaacuguuaaagucu

SEQ ID NO: 2363088 - RNA, 20 nt, Human
uaaaacuucucaagauacug

SEQ ID NO: 2363089 - RNA, 15 nt, Human
uaaaacuuuuuaaaa

SEQ ID NO: 2363090 - RNA, 12 nt, Human
uaaaacuuuuua

SEQ ID NO: 2363091 - RNA, 15 nt, Human
uaaaaaugagguacu

SEQ ID NO: 2363092 - RNA, 15 nt, Human
uaaaaauauguacaa

SEQ ID NO: 2363093 - RNA, 23 nt, Human
uaaaaauauggaacuucuaauau

SEQ ID NO: 2363094 - RNA, 14 nt, Human
uaaaaaugaaauua

SEQ ID NO: 2363095 - RNA, 18 nt, Human
uaaaaaugaaauuauuua

SEQ ID NO: 2363096 - RNA, 14 nt, Human
uaaaaaugaaauuu

SEQ ID NO: 2363097 - RNA, 23 nt, Human
uaaaaaucucaaauuucuaaauc

SEQ ID NO: 2363098 - RNA, 21 nt, Human
uaaaaauauuguguugugaau

SEQ ID NO: 2363099 - RNA, 22 nt, Human
uaaaaauauuguguugugaaug

SEQ ID NO: 2363100 - RNA, 14 nt, Human
uaaaaaugaauccu

SEQ ID NO: 2363101 - RNA, 21 nt, Human
uaaaaccauguagaaaauuug

SEQ ID NO: 2363102 - RNA, 15 nt, Human
uaaaaccacagcagu

SEQ ID NO: 2363103 - RNA, 22 nt, Human
uaaaaaugagguacucuccugg

SEQ ID NO: 2363104 - RNA, 14 nt, Human
uaaaaccacagcag

SEQ ID NO: 2363105 - RNA, 19 nt, Human
aagucagcuuugccuucca

SEQ ID NO: 2363106 - RNA, 23 nt, Human
aagucagaggauggccagugucu

SEQ ID NO: 2363107 - RNA, 13 nt, Human
aagucagaugugg

SEQ ID NO: 2363108 - RNA, 21 nt, Human
aagucagaugugguaacuguu

SEQ ID NO: 2363109 - RNA, 15 nt, Human
aagucagguccaauu

SEQ ID NO: 2363110 - RNA, 16 nt, Human
aagucagguccaauuu

SEQ ID NO: 2363111 - RNA, 21 nt, Human
aagucaggcccuuauuuucaa

SEQ ID NO: 2363112 - RNA, 16 nt, Human
uaaaaaaaaaaaagua

SEQ ID NO: 2363113 - RNA, 17 nt, Human
uaaaaaaaaaaaaguua

SEQ ID NO: 2363114 - RNA, 18 nt, Human
uaaaaaaaaaaaaguuau

SEQ ID NO: 2363115 - RNA, 19 nt, Human
uaaaaaaaaaaaaguuaua

SEQ ID NO: 2363116 - RNA, 22 nt, Human
uaaaaaaaaaaaccaaaacugu

SEQ ID NO: 2363117 - RNA, 20 nt, Human
uaaaaaaaaaaaaguuauau

SEQ ID NO: 2363118 - RNA, 22 nt, Human
uaaaaagcuccaaaugcagcuu

SEQ ID NO: 2363119 - RNA, 20 nt, Human
uaaaaagcuuccaugauucu

SEQ ID NO: 2363120 - RNA, 11 nt, Human
uaaaaagcuga

SEQ ID NO: 2363121 - RNA, 13 nt, Human
uaaaaagcugacc

SEQ ID NO: 2363122 - RNA, 19 nt, Human
uaaaaagccugcaauuuca

SEQ ID NO: 2363123 - RNA, 22 nt, Human
uaaaaagccugcaauuucauau

SEQ ID NO: 2363124 - RNA, 21 nt, Human
uaaaaaaaaaccugagcccca

SEQ ID NO: 2363125 - RNA, 14 nt, Human
uaaaaagucuucac

SEQ ID NO: 2363126 - RNA, 17 nt, Human
uaaaaagucuucacucu

SEQ ID NO: 2363127 - RNA, 16 nt, Human
uaaaaagucaauguuu

SEQ ID NO: 2363128 - RNA, 15 nt, Human
uaaaaagugacacag

SEQ ID NO: 2363129 - RNA, 17 nt, Human
uaaaaagugacacagca

SEQ ID NO: 2363130 - RNA, 18 nt, Human
uaaaaagugacacagcag

SEQ ID NO: 2363131 - RNA, 10 nt, Human
uaaaaauaua

SEQ ID NO: 2363132 - RNA, 12 nt, Human
uaaaaauauaaa

SEQ ID NO: 2363133 - RNA, 14 nt, Human
uaaaaauauaaaac

SEQ ID NO: 2363134 - RNA, 15 nt, Human
uaaaaauauaaaacu

SEQ ID NO: 2363135 - RNA, 19 nt, Human
uaaaaauauggaacuucua

SEQ ID NO: 2363136 - RNA, 14 nt, Human
uaaaaauauugugu

SEQ ID NO: 2363137 - RNA, 19 nt, Human
uaaaaaggcaccuauaaaa

SEQ ID NO: 2363138 - RNA, 20 nt, Human
uaaaaaggaauccacuccca

SEQ ID NO: 2363139 - RNA, 20 nt, Human
uaaaaagggcagggcaucuc

SEQ ID NO: 2363140 - RNA, 16 nt, Human
uaaaaaguauauguua

SEQ ID NO: 2363141 - RNA, 22 nt, Human
uaaaagaaagccucagagaauu

SEQ ID NO: 2363142 - RNA, 21 nt, Human
uaaaagaaagccucagagaau

SEQ ID NO: 2363143 - RNA, 17 nt, Human
uaaaagaacaguaaaca

SEQ ID NO: 2363144 - RNA, 18 nt, Human
uaaaagaacaguaaacau

SEQ ID NO: 2363145 - RNA, 23 nt, Human
uaaaacuuuuuauauuuuauaca

SEQ ID NO: 2363146 - RNA, 14 nt, Human
uaaaagaaaauaaa

SEQ ID NO: 2363147 - RNA, 13 nt, Human
uaaaacuuuuuau

SEQ ID NO: 2363148 - RNA, 16 nt, Human
uaaaacuuugcugcca

SEQ ID NO: 2363149 - RNA, 22 nt, Human
uaaaagaaaauaaaaaaaagaa

SEQ ID NO: 2363150 - RNA, 17 nt, Human
uaaaagaaaauaaaaaa

SEQ ID NO: 2363151 - RNA, 21 nt, Human
uaaaagguucagggaaccguu

SEQ ID NO: 2363152 - RNA, 15 nt, Human
uaaaagguucaggga

SEQ ID NO: 2363153 - RNA, 12 nt, Human
uaaaaguaaaca

SEQ ID NO: 2363154 - RNA, 13 nt, Human
uaaaaguaaacau

SEQ ID NO: 2363155 - RNA, 14 nt, Human
uaaaaguaaacauu

SEQ ID NO: 2363156 - RNA, 13 nt, Human
uaaaagucuugug

SEQ ID NO: 2363157 - RNA, 16 nt, Human
uaaaagaauauuuuaa

SEQ ID NO: 2363158 - RNA, 13 nt, Human
uaaaagaauauuu

SEQ ID NO: 2363159 - RNA, 24 nt, Human
uaaaauaacuaguguugcuuggac

SEQ ID NO: 2363160 - RNA, 20 nt, Human
uaaaauaagcacugugcuaa

SEQ ID NO: 2363161 - RNA, 22 nt, Human
uaaaauaauuuuuauauuugaa

SEQ ID NO: 2363162 - RNA, 21 nt, Human
uaaaauacacacucaaaucaa

SEQ ID NO: 2363163 - RNA, 23 nt, Human
uaaaauaaauauauauaaaccua

SEQ ID NO: 2363164 - RNA, 21 nt, Human
uaaaauaacuaguguugcuug

SEQ ID NO: 2363165 - RNA, 17 nt, Human
uaaaauaaaguauauau

SEQ ID NO: 2363166 - RNA, 13 nt, Human
uaaaauaaaguau

SEQ ID NO: 2363167 - RNA, 13 nt, Human
uaaaauaaauaaa

SEQ ID NO: 2363168 - RNA, 13 nt, Human
uaaaauaaauaua

SEQ ID NO: 2363169 - RNA, 14 nt, Human
uaaaauaaauauau

SEQ ID NO: 2363170 - RNA, 20 nt, Human
uaaaaguacauguuaaacuu

SEQ ID NO: 2363171 - RNA, 15 nt, Human
uaaaagugaucaaua

SEQ ID NO: 2363172 - RNA, 13 nt, Human
uaaaagugaucaa

SEQ ID NO: 2363173 - RNA, 19 nt, Human
uaaaagugggcuugauucu

SEQ ID NO: 2363174 - RNA, 21 nt, Human
aagugauucuccugccucagc

SEQ ID NO: 2363175 - RNA, 17 nt, Human
aagugauucucaugccu

SEQ ID NO: 2363176 - RNA, 13 nt, Human
aagugauuguaug

SEQ ID NO: 2363177 - RNA, 18 nt, Human
aagugauuguaugaauuu

SEQ ID NO: 2363178 - RNA, 18 nt, Human
aagugauggagcagagca

SEQ ID NO: 2363179 - RNA, 19 nt, Human
aagugauggagcagagcaa

SEQ ID NO: 2363180 - RNA, 21 nt, Human
aagugauuaaacgugcagacu

SEQ ID NO: 2363181 - RNA, 14 nt, Human
aagugauugaaaau

SEQ ID NO: 2363182 - RNA, 21 nt, Human
aagugcaggcuggcaccgccu

SEQ ID NO: 2363183 - RNA, 17 nt, Human
aagugcaggcuggcacc

SEQ ID NO: 2363184 - RNA, 13 nt, Human
aagugcaggcugg

SEQ ID NO: 2363185 - RNA, 12 nt, Human
aagugcaggcug

SEQ ID NO: 2363186 - RNA, 17 nt, Human
aagugauuuuuuugucc

SEQ ID NO: 2363187 - RNA, 23 nt, Human
aagugcaauaaaucugacccagu

SEQ ID NO: 2363188 - RNA, 22 nt, Human
aagugcaauaaaucugacccag

SEQ ID NO: 2363189 - RNA, 18 nt, Human
aagugauugggacagagg

SEQ ID NO: 2363190 - RNA, 15 nt, Human
aagugauuguuggca

SEQ ID NO: 2363191 - RNA, 23 nt, Human
aagugaucaauaaaaugugauuu

SEQ ID NO: 2363192 - RNA, 23 nt, Human
aagugauccucccaccucagccu

SEQ ID NO: 2363193 - RNA, 19 nt, Human
aagugauucucaugccuca

SEQ ID NO: 2363194 - RNA, 20 nt, Human
aagugauucuccugccucag

SEQ ID NO: 2363195 - RNA, 16 nt, Human
aagugauucucaugcc

SEQ ID NO: 2363196 - RNA, 13 nt, Human
aagugauucucau

SEQ ID NO: 2363197 - RNA, 21 nt, Human
uaaaauagccacuuaccuuca

SEQ ID NO: 2363198 - RNA, 15 nt, Human
uaaaauagccacuua

SEQ ID NO: 2363199 - RNA, 23 nt, Human
uaaaauagccacuuaccuucaau

SEQ ID NO: 2363200 - RNA, 21 nt, Human
uaaaauagcaacacucuauau

SEQ ID NO: 2363201 - RNA, 14 nt, Human
uaaaauagcuugua

SEQ ID NO: 2363202 - RNA, 21 nt, Human
uaaaauaccagccaguaaaug

SEQ ID NO: 2363203 - RNA, 17 nt, Human
uaaaauauauuucagau

SEQ ID NO: 2363204 - RNA, 19 nt, Human
uaaaauauagcuguacaaa

SEQ ID NO: 2363205 - RNA, 18 nt, Human
uaaaauauagcuguacaa

SEQ ID NO: 2363206 - RNA, 18 nt, Human
uaaaauagcuuguauagu

SEQ ID NO: 2363207 - RNA, 13 nt, Human
aagugauccuccc

SEQ ID NO: 2363208 - RNA, 19 nt, Human
aagugauccucccaccuca

SEQ ID NO: 2363209 - RNA, 20 nt, Human
aagugauccucccaccucag

SEQ ID NO: 2363210 - RNA, 16 nt, Human
aaguuuccuuggcugg

SEQ ID NO: 2363211 - RNA, 20 nt, Human
aaguuuccuuggcuggugca

SEQ ID NO: 2363212 - RNA, 17 nt, Human
aaguuuccuuggcuggu

SEQ ID NO: 2363213 - RNA, 18 nt, Human
aaguuuccuuggcuggug

SEQ ID NO: 2363214 - RNA, 19 nt, Human
aaguuucuagcuagaaaua

SEQ ID NO: 2363215 - RNA, 21 nt, Human
aaguuucuagcuagaaauaug

SEQ ID NO: 2363216 - RNA, 23 nt, Human
aaguuucuagcuagaaauaugau

SEQ ID NO: 2363217 - RNA, 13 nt, Human
aaguuucucagau

SEQ ID NO: 2363218 - RNA, 22 nt, Human
aaguuucucagauccuuguuuc

SEQ ID NO: 2363219 - RNA, 23 nt, Human
aaguuucucagauccuuguuuca

SEQ ID NO: 2363220 - RNA, 13 nt, Human
aaguuucucagcu

SEQ ID NO: 2363221 - RNA, 14 nt, Human
aaguuucucagcuc

SEQ ID NO: 2363222 - RNA, 16 nt, Human
aaguuucucagcuccc

SEQ ID NO: 2363223 - RNA, 17 nt, Human
aaguuucucagcuccca

SEQ ID NO: 2363224 - RNA, 18 nt, Human
aaguuucucagcucccau

SEQ ID NO: 2363225 - RNA, 16 nt, Human
aaguuucuuugcuuca

SEQ ID NO: 2363226 - RNA, 13 nt, Human
aaguuugaauguu

SEQ ID NO: 2363227 - RNA, 14 nt, Human
aaguuugaauguua

SEQ ID NO: 2363228 - RNA, 15 nt, Human
aaguuugaauguuaa

SEQ ID NO: 2363229 - RNA, 16 nt, Human
aaguuugaauguuaaa

SEQ ID NO: 2363230 - RNA, 18 nt, Human
aaguuugaauguuaaaua

SEQ ID NO: 2363231 - RNA, 22 nt, Human
aaguuugaauguuaaauaaauu

SEQ ID NO: 2363232 - RNA, 19 nt, Human
aaguuucugccgcagcccu

SEQ ID NO: 2363233 - RNA, 21 nt, Human
aaguuucugccgcagcccugc

SEQ ID NO: 2363234 - RNA, 23 nt, Human
aaguucaaauucuucugaacuca

SEQ ID NO: 2363235 - RNA, 18 nt, Human
aaguuauuuucuacagug

SEQ ID NO: 2363236 - RNA, 21 nt, Human
aaguuauuuucuacagugguu

SEQ ID NO: 2363237 - RNA, 14 nt, Human
aaguuauuuucuac

SEQ ID NO: 2363238 - RNA, 15 nt, Human
aaguucaccauuaaa

SEQ ID NO: 2363239 - RNA, 19 nt, Human
aaguucaaucuguuuuuca

SEQ ID NO: 2363240 - RNA, 19 nt, Human
aaguuccaaguugcuaaua

SEQ ID NO: 2363241 - RNA, 15 nt, Human
aaguuccacugagcu

SEQ ID NO: 2363242 - RNA, 19 nt, Human
aaguuccaguguucucucu

SEQ ID NO: 2363243 - RNA, 20 nt, Human
aaguuccuuauguauauuua

SEQ ID NO: 2363244 - RNA, 14 nt, Human
aaguuccuuugggu

SEQ ID NO: 2363245 - RNA, 12 nt, Human
aaguuuccauau

SEQ ID NO: 2363246 - RNA, 18 nt, Human
aaguuuccauauguuaua

SEQ ID NO: 2363247 - RNA, 14 nt, Human
aaguucccuacuuc

SEQ ID NO: 2363248 - RNA, 17 nt, Human
aaguucccuacuuccug

SEQ ID NO: 2363249 - RNA, 14 nt, Human
aaguuccucuagug

SEQ ID NO: 2363250 - RNA, 20 nt, Human
aaguucccuacuuccuguga

SEQ ID NO: 2363251 - RNA, 23 nt, Human
uaaaauguauucuuaaauucauu

SEQ ID NO: 2363252 - RNA, 22 nt, Human
uaaaauguauucuuaaauucau

SEQ ID NO: 2363253 - RNA, 11 nt, Human
uaaaaugugaa

SEQ ID NO: 2363254 - RNA, 20 nt, Human
aaguuugagaucagccuggg

SEQ ID NO: 2363255 - RNA, 17 nt, Human
aaguuugaaggaaacag

SEQ ID NO: 2363256 - RNA, 15 nt, Human
aaguuugauuucauu

SEQ ID NO: 2363257 - RNA, 16 nt, Human
aaguuugauuucauua

SEQ ID NO: 2363258 - RNA, 9 nt, Human
uaaaauggu

SEQ ID NO: 2363259 - RNA, 19 nt, Human
uaaaaugugauuuuucuga

SEQ ID NO: 2363260 - RNA, 18 nt, Human
uaaaaugugauuuuucug

SEQ ID NO: 2363261 - RNA, 13 nt, Human
uaaaaugugaagu

SEQ ID NO: 2363262 - RNA, 16 nt, Human
uaaaauucuacuguau

SEQ ID NO: 2363263 - RNA, 13 nt, Human
uaaaauugaaagg

SEQ ID NO: 2363264 - RNA, 14 nt, Human
uaaaauugcacuuu

SEQ ID NO: 2363265 - RNA, 14 nt, Human
uaaaauuauuuugg

SEQ ID NO: 2363266 - RNA, 15 nt, Human
uaaaauuauuuugga

SEQ ID NO: 2363267 - RNA, 21 nt, Human
uaaaauuauuuuggauuuugu

SEQ ID NO: 2363268 - RNA, 12 nt, Human
uaaaauuccacu

SEQ ID NO: 2363269 - RNA, 22 nt, Human
uaaaauuccacugcguugucca

SEQ ID NO: 2363270 - RNA, 16 nt, Human
uaaaauugugaugugu

SEQ ID NO: 2363271 - RNA, 14 nt, Human
uaaaauuguauaga

SEQ ID NO: 2363272 - RNA, 16 nt, Human
uaaaauuguauagaga

SEQ ID NO: 2363273 - RNA, 23 nt, Human
uaaaauuguauagagauaugcag

SEQ ID NO: 2363274 - RNA, 22 nt, Human
uaaaauuguaaaauuguauaga

SEQ ID NO: 2363275 - RNA, 16 nt, Human
uaaaauuguaaaauug

SEQ ID NO: 2363276 - RNA, 19 nt, Human
uaaaauuguaaaauuguau

SEQ ID NO: 2363277 - RNA, 15 nt, Human
uaaaauugugaugug

SEQ ID NO: 2363278 - RNA, 12 nt, Human
uaaaauugccau

SEQ ID NO: 2363279 - RNA, 13 nt, Human
uaaaauugccaua

SEQ ID NO: 2363280 - RNA, 14 nt, Human
uaaaauugccauau

SEQ ID NO: 2363281 - RNA, 15 nt, Human
uaaaauugccauauu

SEQ ID NO: 2363282 - RNA, 16 nt, Human
uaaaauugccauauug

SEQ ID NO: 2363283 - RNA, 18 nt, Human
uaaaauugccauauugca

SEQ ID NO: 2363284 - RNA, 19 nt, Human
uaaaauugccauauugcac

SEQ ID NO: 2363285 - RNA, 14 nt, Human
uaaaauuguaaaau

SEQ ID NO: 2363286 - RNA, 15 nt, Human
uaaaauuguaaaauu

SEQ ID NO: 2363287 - RNA, 14 nt, Human
aagugccagaggug

SEQ ID NO: 2363288 - RNA, 15 nt, Human
aagugccagaggugg

SEQ ID NO: 2363289 - RNA, 18 nt, Human
aagugccagaggugggca

SEQ ID NO: 2363290 - RNA, 19 nt, Human
aagugccagaggugggcag

SEQ ID NO: 2363291 - RNA, 20 nt, Human
aagugccagaggugggcagg

SEQ ID NO: 2363292 - RNA, 23 nt, Human
aaguguauuuuuuuacuaauaga

SEQ ID NO: 2363293 - RNA, 23 nt, Human
aagugccacugcccgagcuggug

SEQ ID NO: 2363294 - RNA, 22 nt, Human
aagugccacugcccgagcuggu

SEQ ID NO: 2363295 - RNA, 21 nt, Human
aagugccacugcccgagcugg

SEQ ID NO: 2363296 - RNA, 21 nt, Human
aagugccacucauuccuguag

SEQ ID NO: 2363297 - RNA, 15 nt, Human
aagugcauccaaagg

SEQ ID NO: 2363298 - RNA, 16 nt, Human
aagugcauccaaaggu

SEQ ID NO: 2363299 - RNA, 19 nt, Human
aagugcauccaaaggugcu

SEQ ID NO: 2363300 - RNA, 20 nt, Human
aagugccacucauuccugua

SEQ ID NO: 2363301 - RNA, 16 nt, Human
aagugcaugcucucug

SEQ ID NO: 2363302 - RNA, 21 nt, Human
aagugccagucuugugucugc

SEQ ID NO: 2363303 - RNA, 13 nt, Human
aagugccccugcu

SEQ ID NO: 2363304 - RNA, 12 nt, Human
aagugccccugc

SEQ ID NO: 2363305 - RNA, 24 nt, Human
aagugucauauguaggugucugca

SEQ ID NO: 2363306 - RNA, 22 nt, Human
aagugucauauguaggugucug

SEQ ID NO: 2363307 - RNA, 18 nt, Human
aaguguccauugacaugu

SEQ ID NO: 2363308 - RNA, 19 nt, Human
aaguguccauugacaugua

SEQ ID NO: 2363309 - RNA, 21 nt, Human
aaguguccauugacauguaca

SEQ ID NO: 2363310 - RNA, 14 nt, Human
aagugucugugugc

SEQ ID NO: 2363311 - RNA, 17 nt, Human
aagugugaacaaaagau

SEQ ID NO: 2363312 - RNA, 19 nt, Human
aagugucucaguccaccug

SEQ ID NO: 2363313 - RNA, 22 nt, Human
aaguguccauugacauguacag

SEQ ID NO: 2363314 - RNA, 23 nt, Human
aaguguccauugacauguacaga

SEQ ID NO: 2363315 - RNA, 13 nt, Human
aagugugaacugg

SEQ ID NO: 2363316 - RNA, 21 nt, Human
aagugugaacuggacccuguu

SEQ ID NO: 2363317 - RNA, 21 nt, Human
aagugugaguaagagcuggug

SEQ ID NO: 2363318 - RNA, 11 nt, Human
aagugugauug

SEQ ID NO: 2363319 - RNA, 20 nt, Human
aagugugauugggaauaaau

SEQ ID NO: 2363320 - RNA, 21 nt, Human
aagugugauugggaauaaaua

SEQ ID NO: 2363321 - RNA, 22 nt, Human
aagugugauugggaauaaauau

SEQ ID NO: 2363322 - RNA, 11 nt, Human
aagugugcaua

SEQ ID NO: 2363323 - RNA, 17 nt, Human
aagugugcauauuguac

SEQ ID NO: 2363324 - RNA, 18 nt, Human
aagugugcauauuguaca

SEQ ID NO: 2363325 - RNA, 20 nt, Human
aagugugaguaagagcuggu

SEQ ID NO: 2363326 - RNA, 19 nt, Human
aagugugaguaagagcugg

SEQ ID NO: 2363327 - RNA, 18 nt, Human
aagugugaguaagagcug

SEQ ID NO: 2363328 - RNA, 11 nt, Human
aagugugagua

SEQ ID NO: 2363329 - RNA, 13 nt, Human
aagugugagcaaa

SEQ ID NO: 2363330 - RNA, 15 nt, Human
aagugugagcaguga

SEQ ID NO: 2363331 - RNA, 18 nt, Human
aagugugggucugugugu

SEQ ID NO: 2363332 - RNA, 17 nt, Human
aagugugggucugugug

SEQ ID NO: 2363333 - RNA, 10 nt, Human
aagugugggu

SEQ ID NO: 2363334 - RNA, 21 nt, Human
aagugugcuuuaugcugaaac

SEQ ID NO: 2363335 - RNA, 22 nt, Human
aagugugcauauuguacacuuu

SEQ ID NO: 2363336 - RNA, 19 nt, Human
aagugugcauauuguacac

SEQ ID NO: 2363337 - RNA, 21 nt, Human
aagugugcauauuguacacuu

SEQ ID NO: 2363338 - RNA, 13 nt, Human
aagugugguagag

SEQ ID NO: 2363339 - RNA, 20 nt, Human
aagugugggucugugugugu

SEQ ID NO: 2363340 - RNA, 23 nt, Human
aagugugcuuuaugcugaaacag

SEQ ID NO: 2363341 - RNA, 19 nt, Human
aaguguggucccaacagga

SEQ ID NO: 2363342 - RNA, 22 nt, Human
aaguguguaugugcgugugugc

SEQ ID NO: 2363343 - RNA, 12 nt, Human
aaguguguaugu

SEQ ID NO: 2363344 - RNA, 13 nt, Human
aaguguguauuaa

SEQ ID NO: 2363345 - RNA, 15 nt, Human
aaguguguauuaaaa

SEQ ID NO: 2363346 - RNA, 16 nt, Human
aaguguguauuaaaaa

SEQ ID NO: 2363347 - RNA, 23 nt, Human
aaguguguggucccaaguuggaa

SEQ ID NO: 2363348 - RNA, 12 nt, Human
aaguguguguuu

SEQ ID NO: 2363349 - RNA, 22 nt, Human
aaguuaucagacacucuggcug

SEQ ID NO: 2363350 - RNA, 23 nt, Human
aaguuauauagguuuuguuugcu

SEQ ID NO: 2363351 - RNA, 16 nt, Human
aaguuauaguauaucu

SEQ ID NO: 2363352 - RNA, 17 nt, Human
aaguuauaguauaucug

SEQ ID NO: 2363353 - RNA, 14 nt, Human
aaguuauuaauauu

SEQ ID NO: 2363354 - RNA, 11 nt, Human
aaguuauugua

SEQ ID NO: 2363355 - RNA, 12 nt, Human
aaguuauuguac

SEQ ID NO: 2363356 - RNA, 20 nt, Human
aaguuauuguacagcuguuu

SEQ ID NO: 2363357 - RNA, 20 nt, Human
aaguuauaaaucaaugucac

SEQ ID NO: 2363358 - RNA, 19 nt, Human
aaguuauaaaucaauguca

SEQ ID NO: 2363359 - RNA, 18 nt, Human
aaguuauaaaucaauguc

SEQ ID NO: 2363360 - RNA, 15 nt, Human
aaguuagcucaggag

SEQ ID NO: 2363361 - RNA, 14 nt, Human
aaguuagcucagga

SEQ ID NO: 2363362 - RNA, 14 nt, Human
aaguuagcugagcg

SEQ ID NO: 2363363 - RNA, 21 nt, Human
aaguuagcugagcgugguggc

SEQ ID NO: 2363364 - RNA, 11 nt, Human
aaguuagucua

SEQ ID NO: 2363365 - RNA, 23 nt, Human
aaguuagucuacucuuaagccau

SEQ ID NO: 2363366 - RNA, 14 nt, Human
aaguuaaauuuuau

SEQ ID NO: 2363367 - RNA, 13 nt, Human
aaguuaacagaga

SEQ ID NO: 2363368 - RNA, 16 nt, Human
aaguguuaauacuagu

SEQ ID NO: 2363369 - RNA, 15 nt, Human
aaguguuagauagaa

SEQ ID NO: 2363370 - RNA, 11 nt, Human
aaguuaagaau

SEQ ID NO: 2363371 - RNA, 21 nt, Human
aaguguguuuccuucagugca

SEQ ID NO: 2363372 - RNA, 17 nt, Human
aaguguguuuccuucag

SEQ ID NO: 2363373 - RNA, 11 nt, Human
aagugugugug

SEQ ID NO: 2363374 - RNA, 16 nt, Human
aaguguguuguugcuu

SEQ ID NO: 2363375 - RNA, 13 nt, Human
aagugugugugcg

SEQ ID NO: 2363376 - RNA, 16 nt, Human
aaguguguguuuuuca

SEQ ID NO: 2363377 - RNA, 21 nt, Human
aaguguguguuuuucauaaag

SEQ ID NO: 2363378 - RNA, 14 nt, Human
aaguuacacauuuu

SEQ ID NO: 2363379 - RNA, 18 nt, Human
aaguuacaacuuccuaau

SEQ ID NO: 2363380 - RNA, 15 nt, Human
aaguuagaauuccuu

SEQ ID NO: 2363381 - RNA, 13 nt, Human
aaguuagcucagg

SEQ ID NO: 2363382 - RNA, 17 nt, Human
aaguuagaauuccuuca

SEQ ID NO: 2363383 - RNA, 21 nt, Human
aaguuagaauuccuucagggu

SEQ ID NO: 2363384 - RNA, 22 nt, Human
aaguuagaauuccuucagggug

SEQ ID NO: 2363385 - RNA, 20 nt, Human
aaguuacaaauugcuugaaa

SEQ ID NO: 2363386 - RNA, 23 nt, Human
aaguuaagaauguucuuauguug

SEQ ID NO: 2363387 - RNA, 19 nt, Human
aaguuaauccacugugacu

SEQ ID NO: 2363388 - RNA, 17 nt, Human
aagcucuugaagacacu

SEQ ID NO: 2363389 - RNA, 21 nt, Human
aagcucuggugacaccagccu

SEQ ID NO: 2363390 - RNA, 22 nt, Human
aagcucuuacacuacauuagaa

SEQ ID NO: 2363391 - RNA, 20 nt, Human
aagcucuggugacaccagcc

SEQ ID NO: 2363392 - RNA, 24 nt, Human
aagcucuggcugaacccugugcug

SEQ ID NO: 2363393 - RNA, 22 nt, Human
aagcucuggcugaacccugugc

SEQ ID NO: 2363394 - RNA, 23 nt, Human
aagcucuggcugaacccugugcu

SEQ ID NO: 2363395 - RNA, 20 nt, Human
aagcucuugaagacacugaa

SEQ ID NO: 2363396 - RNA, 19 nt, Human
aagcucuugaagacacuga

SEQ ID NO: 2363397 - RNA, 12 nt, Human
aagcugaaaaua

SEQ ID NO: 2363398 - RNA, 14 nt, Human
aagcucagcccacc

SEQ ID NO: 2363399 - RNA, 13 nt, Human
aagcucagcccac

SEQ ID NO: 2363400 - RNA, 17 nt, Human
aagcucagacugguuga

SEQ ID NO: 2363401 - RNA, 15 nt, Human
aagcucagccagccc

SEQ ID NO: 2363402 - RNA, 11 nt, Human
aagcucuggcu

SEQ ID NO: 2363403 - RNA, 13 nt, Human
aagcucuggcuga

SEQ ID NO: 2363404 - RNA, 15 nt, Human
aagcucuggcugaac

SEQ ID NO: 2363405 - RNA, 21 nt, Human
aagcucuggcugaacccugug

SEQ ID NO: 2363406 - RNA, 17 nt, Human
aagcucugcuccucucc

SEQ ID NO: 2363407 - RNA, 23 nt, Human
aagcucacaguuccucgcccugg

SEQ ID NO: 2363408 - RNA, 16 nt, Human
aagcucaccuguugcu

SEQ ID NO: 2363409 - RNA, 18 nt, Human
aagcucaccuguugcuua

SEQ ID NO: 2363410 - RNA, 22 nt, Human
aagcucaccuguugcuuacaau

SEQ ID NO: 2363411 - RNA, 23 nt, Human
aagcucaccuguugcuuacaauu

SEQ ID NO: 2363412 - RNA, 22 nt, Human
aagcucacaguuccucgcccug

SEQ ID NO: 2363413 - RNA, 20 nt, Human
aagcucacaguuccucgccc

SEQ ID NO: 2363414 - RNA, 19 nt, Human
aagcucacaguuccucgcc

SEQ ID NO: 2363415 - RNA, 18 nt, Human
aagcuauaaauuccucuu

SEQ ID NO: 2363416 - RNA, 14 nt, Human
aagcucagaaggcu

SEQ ID NO: 2363417 - RNA, 16 nt, Human
aagcucagaaggcucu

SEQ ID NO: 2363418 - RNA, 23 nt, Human
aagcucacuucugggcuucaucu

SEQ ID NO: 2363419 - RNA, 14 nt, Human
aagcucacuucugg

SEQ ID NO: 2363420 - RNA, 23 nt, Human
aagcucagaggcgcacugugacc

SEQ ID NO: 2363421 - RNA, 22 nt, Human
aagcucagaggcgcacugugac

SEQ ID NO: 2363422 - RNA, 12 nt, Human
aagcucagaauc

SEQ ID NO: 2363423 - RNA, 13 nt, Human
aagcucagaaucc

SEQ ID NO: 2363424 - RNA, 14 nt, Human
aagcucagaaucca

SEQ ID NO: 2363425 - RNA, 15 nt, Human
aagcucagaauccaa

SEQ ID NO: 2363426 - RNA, 21 nt, Human
aagcucuugaagacacugaaa

SEQ ID NO: 2363427 - RNA, 10 nt, Human
aagcuuagaa

SEQ ID NO: 2363428 - RNA, 11 nt, Human
aagcuuagaac

SEQ ID NO: 2363429 - RNA, 13 nt, Human
aagcuuagcagga

SEQ ID NO: 2363430 - RNA, 15 nt, Human
aagcuuagcaggaga

SEQ ID NO: 2363431 - RNA, 16 nt, Human
aagcuuagcaggagag

SEQ ID NO: 2363432 - RNA, 20 nt, Human
aagcuuagcaggagaggaga

SEQ ID NO: 2363433 - RNA, 22 nt, Human
aagcuuagcaggagaggagagc

SEQ ID NO: 2363434 - RNA, 13 nt, Human
aagcuuaggcagg

SEQ ID NO: 2363435 - RNA, 18 nt, Human
aagcuuauuaaaacucau

SEQ ID NO: 2363436 - RNA, 13 nt, Human
aagcuuccuuggc

SEQ ID NO: 2363437 - RNA, 23 nt, Human
aagcuuccuuuguuuuuuuuucc

SEQ ID NO: 2363438 - RNA, 22 nt, Human
aagcuucgaggcccagcgaccu

SEQ ID NO: 2363439 - RNA, 21 nt, Human
aagcuuccaugauucuauuua

SEQ ID NO: 2363440 - RNA, 21 nt, Human
aagcuuggcuguagaaggaga

SEQ ID NO: 2363441 - RNA, 21 nt, Human
aagcuuggcagccgagcucgu

SEQ ID NO: 2363442 - RNA, 14 nt, Human
aagcuuggcagccg

SEQ ID NO: 2363443 - RNA, 23 nt, Human
aagcuuguauuccuuuuucucuc

SEQ ID NO: 2363444 - RNA, 22 nt, Human
aagcuucuuaaaugagaaggaa

SEQ ID NO: 2363445 - RNA, 20 nt, Human
aagcuucuuaaaugagaagg

SEQ ID NO: 2363446 - RNA, 14 nt, Human
aagcuugcucacau

SEQ ID NO: 2363447 - RNA, 19 nt, Human
guuccggaauccuguccuc

SEQ ID NO: 2363448 - RNA, 22 nt, Human
guuccggaauccuguccucagc

SEQ ID NO: 2363449 - RNA, 21 nt, Human
guuccgaaaccaaagaagaaa

SEQ ID NO: 2363450 - RNA, 21 nt, Human
guucccuuuuuuggcugcuga

SEQ ID NO: 2363451 - RNA, 22 nt, Human
guucccuuuuuuggcugcugaa

SEQ ID NO: 2363452 - RNA, 16 nt, Human
guucccuuggccucag

SEQ ID NO: 2363453 - RNA, 15 nt, Human
guucccuuggccuca

SEQ ID NO: 2363454 - RNA, 14 nt, Human
guucccuuggccuc

SEQ ID NO: 2363455 - RNA, 13 nt, Human
guucccuuggccu

SEQ ID NO: 2363456 - RNA, 12 nt, Human
guucccuuggcc

SEQ ID NO: 2363457 - RNA, 21 nt, Human
guucccugaaaacccagagag

SEQ ID NO: 2363458 - RNA, 16 nt, Human
guucccugucuugucc

SEQ ID NO: 2363459 - RNA, 20 nt, Human
guucccugaaaacccagaga

SEQ ID NO: 2363460 - RNA, 19 nt, Human
guucccugaaaacccagag

SEQ ID NO: 2363461 - RNA, 18 nt, Human
guucccugaaaacccaga

SEQ ID NO: 2363462 - RNA, 17 nt, Human
guucccugaaaacccag

SEQ ID NO: 2363463 - RNA, 20 nt, Human
guuccccuaguaagugccuu

SEQ ID NO: 2363464 - RNA, 21 nt, Human
guuccccuaguaagugccuuc

SEQ ID NO: 2363465 - RNA, 16 nt, Human
guucccucugcuccug

SEQ ID NO: 2363466 - RNA, 21 nt, Human
guucccucugcuccuggagcc

SEQ ID NO: 2363467 - RNA, 18 nt, Human
guucccuugaugaagaag

SEQ ID NO: 2363468 - RNA, 14 nt, Human
guucccccagcccu

SEQ ID NO: 2363469 - RNA, 13 nt, Human
guucccccagccc

SEQ ID NO: 2363470 - RNA, 23 nt, Human
guuccccaucuggguccuugcac

SEQ ID NO: 2363471 - RNA, 14 nt, Human
guuccccaugcaga

SEQ ID NO: 2363472 - RNA, 14 nt, Human
guuccccagagaaa

SEQ ID NO: 2363473 - RNA, 18 nt, Human
guuccccaucuggguccu

SEQ ID NO: 2363474 - RNA, 19 nt, Human
guuccccaucuggguccuu

SEQ ID NO: 2363475 - RNA, 20 nt, Human
guucccccagcccuguggaa

SEQ ID NO: 2363476 - RNA, 17 nt, Human
guucccccagcccugug

SEQ ID NO: 2363477 - RNA, 16 nt, Human
guucccccagcccugu

SEQ ID NO: 2363478 - RNA, 15 nt, Human
guucccccagcccug

SEQ ID NO: 2363479 - RNA, 21 nt, Human
guucccccuucacaaagccca

SEQ ID NO: 2363480 - RNA, 15 nt, Human
guuccccaagacauu

SEQ ID NO: 2363481 - RNA, 23 nt, Human
aagcuuuuuauuccuccugcuca

SEQ ID NO: 2363482 - RNA, 13 nt, Human
guuccccagagaa

SEQ ID NO: 2363483 - RNA, 12 nt, Human
guuccccagaga

SEQ ID NO: 2363484 - RNA, 19 nt, Human
aagcuuuuaugugaaacau

SEQ ID NO: 2363485 - RNA, 21 nt, Human
aagcuuuuaugugaaacaugu

SEQ ID NO: 2363486 - RNA, 14 nt, Human
guucuugguuugua

SEQ ID NO: 2363487 - RNA, 14 nt, Human
guucuucgaggugg

SEQ ID NO: 2363488 - RNA, 14 nt, Human
guucuucgggaaga

SEQ ID NO: 2363489 - RNA, 16 nt, Human
guucuucgggaagaga

SEQ ID NO: 2363490 - RNA, 21 nt, Human
guucuucgggaagagaggagu

SEQ ID NO: 2363491 - RNA, 22 nt, Human
guucuucgggaagagaggaguu

SEQ ID NO: 2363492 - RNA, 17 nt, Human
guucuucuuccugaagc

SEQ ID NO: 2363493 - RNA, 20 nt, Human
guucuucuuccugaagcuga

SEQ ID NO: 2363494 - RNA, 15 nt, Human
guucuugaagcagua

SEQ ID NO: 2363495 - RNA, 15 nt, Human
guugaccccagagga

SEQ ID NO: 2363496 - RNA, 19 nt, Human
guucuuggggcccuacacc

SEQ ID NO: 2363497 - RNA, 16 nt, Human
guucuugguagagauu

SEQ ID NO: 2363498 - RNA, 14 nt, Human
guugaccccagagg

SEQ ID NO: 2363499 - RNA, 18 nt, Human
guucuugguuuguaaauu

SEQ ID NO: 2363500 - RNA, 15 nt, Human
guucuugguuuguaa

SEQ ID NO: 2363501 - RNA, 19 nt, Human
guugacuugacagaacacu

SEQ ID NO: 2363502 - RNA, 20 nt, Human
guugacuugacagaacacug

SEQ ID NO: 2363503 - RNA, 20 nt, Human
guugacuuauuuucucugug

SEQ ID NO: 2363504 - RNA, 14 nt, Human
guugacuuucaggu

SEQ ID NO: 2363505 - RNA, 21 nt, Human
guugacuuauuuucucugugu

SEQ ID NO: 2363506 - RNA, 15 nt, Human
guugacuuuagggac

SEQ ID NO: 2363507 - RNA, 12 nt, Human
guugagaaauga

SEQ ID NO: 2363508 - RNA, 18 nt, Human
guugacuuuagggacuca

SEQ ID NO: 2363509 - RNA, 16 nt, Human
guugagaaucccaaau

SEQ ID NO: 2363510 - RNA, 22 nt, Human
guugauagcaagugaauuuuuc

SEQ ID NO: 2363511 - RNA, 19 nt, Human
guugagaaucccaaauuug

SEQ ID NO: 2363512 - RNA, 14 nt, Human
guugauaacuuugc

SEQ ID NO: 2363513 - RNA, 17 nt, Human
guugauaacuuugcuug

SEQ ID NO: 2363514 - RNA, 20 nt, Human
guugagaauugugcucaaaa

SEQ ID NO: 2363515 - RNA, 15 nt, Human
guugauaacuuugcu

SEQ ID NO: 2363516 - RNA, 23 nt, Human
guugauagcaagugaauuuuucu

SEQ ID NO: 2363517 - RNA, 15 nt, Human
aaggaaaaaauguug

SEQ ID NO: 2363518 - RNA, 16 nt, Human
aaggaaaaacacaagc

SEQ ID NO: 2363519 - RNA, 17 nt, Human
aaggaaaaaauguugga

SEQ ID NO: 2363520 - RNA, 19 nt, Human
aaggaaaaacacaagcaaa

SEQ ID NO: 2363521 - RNA, 20 nt, Human
aaggaaaaacacaagcaaaa

SEQ ID NO: 2363522 - RNA, 16 nt, Human
aaggaaaaagcacaag

SEQ ID NO: 2363523 - RNA, 19 nt, Human
aaggaaaaagcacaagaag

SEQ ID NO: 2363524 - RNA, 14 nt, Human
guugauagcacaga

SEQ ID NO: 2363525 - RNA, 19 nt, Human
guugauagcacagacccug

SEQ ID NO: 2363526 - RNA, 16 nt, Human
guucuuaagacgugau

SEQ ID NO: 2363527 - RNA, 13 nt, Human
guucuuaauucuu

SEQ ID NO: 2363528 - RNA, 17 nt, Human
guucucugcccuccaag

SEQ ID NO: 2363529 - RNA, 18 nt, Human
guucucugcccuccaaga

SEQ ID NO: 2363530 - RNA, 13 nt, Human
guucuuaauugca

SEQ ID NO: 2363531 - RNA, 15 nt, Human
guucuuaauugcacu

SEQ ID NO: 2363532 - RNA, 17 nt, Human
guucuuaauugcacucu

SEQ ID NO: 2363533 - RNA, 14 nt, Human
guucuucaucuaag

SEQ ID NO: 2363534 - RNA, 17 nt, Human
guucuuaauucuuagcu

SEQ ID NO: 2363535 - RNA, 14 nt, Human
guucuuaauucuua

SEQ ID NO: 2363536 - RNA, 15 nt, Human
guucucucuucucca

SEQ ID NO: 2363537 - RNA, 12 nt, Human
guucucugagga

SEQ ID NO: 2363538 - RNA, 14 nt, Human
guucucugaggaca

SEQ ID NO: 2363539 - RNA, 13 nt, Human
guucucugcccuc

SEQ ID NO: 2363540 - RNA, 15 nt, Human
guucucugcccucca

SEQ ID NO: 2363541 - RNA, 13 nt, Human
guucucuccuucu

SEQ ID NO: 2363542 - RNA, 14 nt, Human
guucuaguugcuug

SEQ ID NO: 2363543 - RNA, 23 nt, Human
guucuagucuccuuugcacugag

SEQ ID NO: 2363544 - RNA, 14 nt, Human
guucuagucuccuu

SEQ ID NO: 2363545 - RNA, 21 nt, Human
guucuagucuccuuugcacug

SEQ ID NO: 2363546 - RNA, 14 nt, Human
guucuagucucucu

SEQ ID NO: 2363547 - RNA, 20 nt, Human
guuccgaaaccaaagaagaa

SEQ ID NO: 2363548 - RNA, 19 nt, Human
guuccggauuggcuugugu

SEQ ID NO: 2363549 - RNA, 19 nt, Human
guucuagcauggcugccaa

SEQ ID NO: 2363550 - RNA, 16 nt, Human
aagccuuccacacuca

SEQ ID NO: 2363551 - RNA, 21 nt, Human
aagccuuggggcugaugcagu

SEQ ID NO: 2363552 - RNA, 16 nt, Human
aagccuucauugccuu

SEQ ID NO: 2363553 - RNA, 16 nt, Human
aagccuuaucaagugu

SEQ ID NO: 2363554 - RNA, 22 nt, Human
aagccuuaucaagugucuucca

SEQ ID NO: 2363555 - RNA, 23 nt, Human
aagccuuaucaagugucuuccau

SEQ ID NO: 2363556 - RNA, 19 nt, Human
aagcuaggguggcccuugc

SEQ ID NO: 2363557 - RNA, 15 nt, Human
aagcuaggguggccc

SEQ ID NO: 2363558 - RNA, 22 nt, Human
aagcuaggguggcccuugcagu

SEQ ID NO: 2363559 - RNA, 19 nt, Human
aagcuaguggcuucaaaau

SEQ ID NO: 2363560 - RNA, 18 nt, Human
aagcuaguggcuucaaaa

SEQ ID NO: 2363561 - RNA, 17 nt, Human
aagccuguaaucccagc

SEQ ID NO: 2363562 - RNA, 16 nt, Human
aagccuguuccccuca

SEQ ID NO: 2363563 - RNA, 20 nt, Human
aagccuguuccccucacugg

SEQ ID NO: 2363564 - RNA, 18 nt, Human
aagccuguuccccucacu

SEQ ID NO: 2363565 - RNA, 19 nt, Human
aagccuguuuuguuggaag

SEQ ID NO: 2363566 - RNA, 18 nt, Human
aagccuguuuaagagaca

SEQ ID NO: 2363567 - RNA, 22 nt, Human
aagccuccauuuaguucuuugu

SEQ ID NO: 2363568 - RNA, 20 nt, Human
aagccuccauuuaguucuuu

SEQ ID NO: 2363569 - RNA, 14 nt, Human
aagccuccccagcu

SEQ ID NO: 2363570 - RNA, 21 nt, Human
aagccuguauucucaaacaca

SEQ ID NO: 2363571 - RNA, 15 nt, Human
aagccuguuuaagag

SEQ ID NO: 2363572 - RNA, 15 nt, Human
aagccuccuccagcc

SEQ ID NO: 2363573 - RNA, 18 nt, Human
aagccuggucagcccaaa

SEQ ID NO: 2363574 - RNA, 19 nt, Human
aagccuccauuuaguucuu

SEQ ID NO: 2363575 - RNA, 20 nt, Human
aagccucauauuuaaagaca

SEQ ID NO: 2363576 - RNA, 14 nt, Human
aagccucauauuua

SEQ ID NO: 2363577 - RNA, 16 nt, Human
aagccucccacgacug

SEQ ID NO: 2363578 - RNA, 17 nt, Human
guucaguggcagggcuc

SEQ ID NO: 2363579 - RNA, 16 nt, Human
guucaguaccuggagg

SEQ ID NO: 2363580 - RNA, 18 nt, Human
guucaguggcagggcuca

SEQ ID NO: 2363581 - RNA, 20 nt, Human
guucaguggcagggcucagg

SEQ ID NO: 2363582 - RNA, 14 nt, Human
guucaguaccugga

SEQ ID NO: 2363583 - RNA, 17 nt, Human
guucaguaccuggagga

SEQ ID NO: 2363584 - RNA, 18 nt, Human
guucaggggacucagccc

SEQ ID NO: 2363585 - RNA, 15 nt, Human
guucaggggacucag

SEQ ID NO: 2363586 - RNA, 13 nt, Human
guucagguagcug

SEQ ID NO: 2363587 - RNA, 19 nt, Human
guucaggggacucagcccu

SEQ ID NO: 2363588 - RNA, 13 nt, Human
guucaguaccugg

SEQ ID NO: 2363589 - RNA, 17 nt, Human
guucagguaacaggcag

SEQ ID NO: 2363590 - RNA, 18 nt, Human
guucagguaacaggcaga

SEQ ID NO: 2363591 - RNA, 14 nt, Human
aagccgugcccugc

SEQ ID NO: 2363592 - RNA, 22 nt, Human
aagccguuguuuacuuaaagau

SEQ ID NO: 2363593 - RNA, 23 nt, Human
aagccuaaaagugggcuugauuc

SEQ ID NO: 2363594 - RNA, 15 nt, Human
aagccguggcuuccc

SEQ ID NO: 2363595 - RNA, 13 nt, Human
aagccguggcuuc

SEQ ID NO: 2363596 - RNA, 14 nt, Human
aagccguggcuucc

SEQ ID NO: 2363597 - RNA, 21 nt, Human
aagccgugauuuucauugcug

SEQ ID NO: 2363598 - RNA, 22 nt, Human
aagccgugcucgccccagcagg

SEQ ID NO: 2363599 - RNA, 13 nt, Human
guucaguguaauu

SEQ ID NO: 2363600 - RNA, 16 nt, Human
guucaguguaauuucu

SEQ ID NO: 2363601 - RNA, 16 nt, Human
guucaguguaaauagu

SEQ ID NO: 2363602 - RNA, 12 nt, Human
guucaguguaau

SEQ ID NO: 2363603 - RNA, 21 nt, Human
guucaguggcagggcucagga

SEQ ID NO: 2363604 - RNA, 22 nt, Human
guucaguggcagggcucaggau

SEQ ID NO: 2363605 - RNA, 20 nt, Human
guucaggguuggccccugcc

SEQ ID NO: 2363606 - RNA, 21 nt, Human
guucaggagucccaaggaaag

SEQ ID NO: 2363607 - RNA, 20 nt, Human
guucaggagucccaaggaaa

SEQ ID NO: 2363608 - RNA, 15 nt, Human
guucagcugccccac

SEQ ID NO: 2363609 - RNA, 21 nt, Human
guucaggguuggccccugccc

SEQ ID NO: 2363610 - RNA, 22 nt, Human
guucaggguuggccccugcccg

SEQ ID NO: 2363611 - RNA, 18 nt, Human
guucaggagucccaagga

SEQ ID NO: 2363612 - RNA, 15 nt, Human
guucaggagucccaa

SEQ ID NO: 2363613 - RNA, 12 nt, Human
guucagcuuggg

SEQ ID NO: 2363614 - RNA, 23 nt, Human
guucagcuuguaaauagcucagg

SEQ ID NO: 2363615 - RNA, 20 nt, Human
guuauuuucuacagugguuu

SEQ ID NO: 2363616 - RNA, 15 nt, Human
guuauuuucuacagu

SEQ ID NO: 2363617 - RNA, 17 nt, Human
guuauuuucuacagugg

SEQ ID NO: 2363618 - RNA, 12 nt, Human
guuauuuucuac

SEQ ID NO: 2363619 - RNA, 17 nt, Human
guuauuuucaguauuuu

SEQ ID NO: 2363620 - RNA, 14 nt, Human
guuauuuucuacag

SEQ ID NO: 2363621 - RNA, 23 nt, Human
guuauuuucuuugaaauuguuua

SEQ ID NO: 2363622 - RNA, 20 nt, Human
guuauugggcaagugauuga

SEQ ID NO: 2363623 - RNA, 21 nt, Human
guuauugggcaagugauugaa

SEQ ID NO: 2363624 - RNA, 16 nt, Human
guuauugcaguuuauc

SEQ ID NO: 2363625 - RNA, 23 nt, Human
guuauugcaguuuaucauucaag

SEQ ID NO: 2363626 - RNA, 10 nt, Human
guuauuuaaa

SEQ ID NO: 2363627 - RNA, 13 nt, Human
guuauuuaaagaa

SEQ ID NO: 2363628 - RNA, 17 nt, Human
guuauuguacagcuguu

SEQ ID NO: 2363629 - RNA, 17 nt, Human
guuauuuguuuaccacu

SEQ ID NO: 2363630 - RNA, 15 nt, Human
guuauuuaaagaaga

SEQ ID NO: 2363631 - RNA, 19 nt, Human
guuauuuguuauuuucagu

SEQ ID NO: 2363632 - RNA, 13 nt, Human
guuauuuuaguuu

SEQ ID NO: 2363633 - RNA, 15 nt, Human
guuauuuuaguuucu

SEQ ID NO: 2363634 - RNA, 21 nt, Human
guuauuuuauugauuauuacu

SEQ ID NO: 2363635 - RNA, 19 nt, Human
guuauuuuaguuucuguuc

SEQ ID NO: 2363636 - RNA, 12 nt, Human
guuauuuucagu

SEQ ID NO: 2363637 - RNA, 14 nt, Human
guuauuuucaguau

SEQ ID NO: 2363638 - RNA, 15 nt, Human
guuauuuucaguauu

SEQ ID NO: 2363639 - RNA, 17 nt, Human
guuauuauauuuacaaa

SEQ ID NO: 2363640 - RNA, 20 nt, Human
guuauuauauuuacaaaugg

SEQ ID NO: 2363641 - RNA, 22 nt, Human
guuagagguuuuaaagugauua

SEQ ID NO: 2363642 - RNA, 13 nt, Human
guuauugcaguuu

SEQ ID NO: 2363643 - RNA, 14 nt, Human
guuauugcaguuua

SEQ ID NO: 2363644 - RNA, 16 nt, Human
guuacuguuauagagg

SEQ ID NO: 2363645 - RNA, 13 nt, Human
guuacuguaauuc

SEQ ID NO: 2363646 - RNA, 20 nt, Human
guuagaauuccuucagggug

SEQ ID NO: 2363647 - RNA, 18 nt, Human
guuagacucuuacuuuuu

SEQ ID NO: 2363648 - RNA, 16 nt, Human
guuacuguugugaccu

SEQ ID NO: 2363649 - RNA, 14 nt, Human
guuacuguugugac

SEQ ID NO: 2363650 - RNA, 13 nt, Human
guuagaauuccuu

SEQ ID NO: 2363651 - RNA, 19 nt, Human
guuagagguucccuuugac

SEQ ID NO: 2363652 - RNA, 19 nt, Human
guuauuauauuuacaaaug

SEQ ID NO: 2363653 - RNA, 12 nt, Human
guuaauaaaagu

SEQ ID NO: 2363654 - RNA, 15 nt, Human
guuaauaaauuaaaa

SEQ ID NO: 2363655 - RNA, 15 nt, Human
guuaauauuuaagac

SEQ ID NO: 2363656 - RNA, 12 nt, Human
guuaauacuagu

SEQ ID NO: 2363657 - RNA, 21 nt, Human
guuaauauaucccagaaauua

SEQ ID NO: 2363658 - RNA, 13 nt, Human
aagcccagcuuga

SEQ ID NO: 2363659 - RNA, 23 nt, Human
aagcccagcacugcuugaggaaa

SEQ ID NO: 2363660 - RNA, 20 nt, Human
aagcccagcacugcuugagg

SEQ ID NO: 2363661 - RNA, 18 nt, Human
aagcccagaaaaggacag

SEQ ID NO: 2363662 - RNA, 20 nt, Human
aagccauucuaaggaaauua

SEQ ID NO: 2363663 - RNA, 20 nt, Human
aagccaauccccuccuuggg

SEQ ID NO: 2363664 - RNA, 12 nt, Human
aagccauugucu

SEQ ID NO: 2363665 - RNA, 22 nt, Human
aagcccaaccuccugaccuguc

SEQ ID NO: 2363666 - RNA, 17 nt, Human
aagcccaaccuccugac

SEQ ID NO: 2363667 - RNA, 18 nt, Human
aagcccaauauuauaauu

SEQ ID NO: 2363668 - RNA, 16 nt, Human
aagcccaaccuccuga

SEQ ID NO: 2363669 - RNA, 13 nt, Human
aagccauugucuu

SEQ ID NO: 2363670 - RNA, 14 nt, Human
aagccauugucuuc

SEQ ID NO: 2363671 - RNA, 12 nt, Human
guuaaucaauuu

SEQ ID NO: 2363672 - RNA, 13 nt, Human
guuaaucaauuua

SEQ ID NO: 2363673 - RNA, 14 nt, Human
guuaaucaauuuaa

SEQ ID NO: 2363674 - RNA, 19 nt, Human
guuaauauuuauaggucac

SEQ ID NO: 2363675 - RNA, 18 nt, Human
guuaaucauuagguguga

SEQ ID NO: 2363676 - RNA, 19 nt, Human
guuaauuccaauuauauga

SEQ ID NO: 2363677 - RNA, 17 nt, Human
guuaaucaauuuaaacc

SEQ ID NO: 2363678 - RNA, 21 nt, Human
guuaaucaauuuaaacccauu

SEQ ID NO: 2363679 - RNA, 22 nt, Human
guuaaucaauuuaaacccauuu

SEQ ID NO: 2363680 - RNA, 21 nt, Human
guuaauucagcacugauuuca

SEQ ID NO: 2363681 - RNA, 19 nt, Human
guuacugaucaugcauugu

SEQ ID NO: 2363682 - RNA, 18 nt, Human
guuacugaucaugcauug

SEQ ID NO: 2363683 - RNA, 17 nt, Human
guuacugaucaugcauu

SEQ ID NO: 2363684 - RNA, 14 nt, Human
guuacucugguucu

SEQ ID NO: 2363685 - RNA, 23 nt, Human
guuacucuucaguuaagccuuug

SEQ ID NO: 2363686 - RNA, 14 nt, Human
guuaauuuuuccua

SEQ ID NO: 2363687 - RNA, 12 nt, Human
aagcauguuuca

SEQ ID NO: 2363688 - RNA, 14 nt, Human
aagcauguuucaug

SEQ ID NO: 2363689 - RNA, 15 nt, Human
aagcauguuucaugu

SEQ ID NO: 2363690 - RNA, 19 nt, Human
aagcauguggcauguucau

SEQ ID NO: 2363691 - RNA, 13 nt, Human
aagcauguggcau

SEQ ID NO: 2363692 - RNA, 17 nt, Human
aagcaugucucaauagu

SEQ ID NO: 2363693 - RNA, 18 nt, Human
aagcauuguaaaugugcu

SEQ ID NO: 2363694 - RNA, 16 nt, Human
aagcauguaggagaau

SEQ ID NO: 2363695 - RNA, 22 nt, Human
aagcauguacaguguucuguuu

SEQ ID NO: 2363696 - RNA, 18 nt, Human
aagcauguauucagcuuu

SEQ ID NO: 2363697 - RNA, 16 nt, Human
aagcauguacaguguu

SEQ ID NO: 2363698 - RNA, 17 nt, Human
aagcauguacaguguuc

SEQ ID NO: 2363699 - RNA, 18 nt, Human
aagcauguacaguguucu

SEQ ID NO: 2363700 - RNA, 21 nt, Human
aagcauguacaguguucuguu

SEQ ID NO: 2363701 - RNA, 12 nt, Human
aagcaugugaga

SEQ ID NO: 2363702 - RNA, 13 nt, Human
aagcaugaaaaag

SEQ ID NO: 2363703 - RNA, 20 nt, Human
aagcaucuuggggggguggc

SEQ ID NO: 2363704 - RNA, 23 nt, Human
aagcaugcacaaauucugucucu

SEQ ID NO: 2363705 - RNA, 12 nt, Human
aagcauguacag

SEQ ID NO: 2363706 - RNA, 13 nt, Human
aagcauguacagu

SEQ ID NO: 2363707 - RNA, 15 nt, Human
aagcauguacagugu

SEQ ID NO: 2363708 - RNA, 15 nt, Human
aagcaucaaacucuu

SEQ ID NO: 2363709 - RNA, 23 nt, Human
aagcaucaccucaggccaggugc

SEQ ID NO: 2363710 - RNA, 21 nt, Human
aagcaucuuccagaaguguga

SEQ ID NO: 2363711 - RNA, 19 nt, Human
aagcaucaccucaggccag

SEQ ID NO: 2363712 - RNA, 18 nt, Human
aagcaucaccucaggcca

SEQ ID NO: 2363713 - RNA, 16 nt, Human
aagcaucaccucaggc

SEQ ID NO: 2363714 - RNA, 15 nt, Human
aagcaucaccucagg

SEQ ID NO: 2363715 - RNA, 14 nt, Human
aagcaucaaacucu

SEQ ID NO: 2363716 - RNA, 23 nt, Human
aagcauauuguuauuauauaauu

SEQ ID NO: 2363717 - RNA, 17 nt, Human
aagcauauuguuauuau

SEQ ID NO: 2363718 - RNA, 19 nt, Human
aagcauauguguuggcuug

SEQ ID NO: 2363719 - RNA, 21 nt, Human
aagcacugaccugucaugccc

SEQ ID NO: 2363720 - RNA, 16 nt, Human
aagcacugaccuguca

SEQ ID NO: 2363721 - RNA, 19 nt, Human
aagcacugcuaggcgagug

SEQ ID NO: 2363722 - RNA, 23 nt, Human
aagcacugcuaggcgagugccag

SEQ ID NO: 2363723 - RNA, 12 nt, Human
aagcacugugcu

SEQ ID NO: 2363724 - RNA, 13 nt, Human
aagcacugugcua

SEQ ID NO: 2363725 - RNA, 20 nt, Human
aagcacugacuucuaaguaa

SEQ ID NO: 2363726 - RNA, 19 nt, Human
aagcacugacuucuaagua

SEQ ID NO: 2363727 - RNA, 16 nt, Human
aagccaaagacuuagu

SEQ ID NO: 2363728 - RNA, 12 nt, Human
aagccaaagagu

SEQ ID NO: 2363729 - RNA, 21 nt, Human
aagcauuuuauaaaucgcuuu

SEQ ID NO: 2363730 - RNA, 19 nt, Human
aagcauuuuauaaaucgcu

SEQ ID NO: 2363731 - RNA, 17 nt, Human
aagcauuuuauaaaucg

SEQ ID NO: 2363732 - RNA, 18 nt, Human
aagcauuugaaugcauuu

SEQ ID NO: 2363733 - RNA, 21 nt, Human
aagcauuugaaugcauuuugu

SEQ ID NO: 2363734 - RNA, 15 nt, Human
aagcauuuuauaaau

SEQ ID NO: 2363735 - RNA, 14 nt, Human
aagcauuuuauaaa

SEQ ID NO: 2363736 - RNA, 12 nt, Human
aagcauuuuaua

SEQ ID NO: 2363737 - RNA, 16 nt, Human
aagcauuuacuuugaa

SEQ ID NO: 2363738 - RNA, 23 nt, Human
aagcauuuaauguagccauggga

SEQ ID NO: 2363739 - RNA, 19 nt, Human
aagcauuuaauguagccau

SEQ ID NO: 2363740 - RNA, 20 nt, Human
aagcauuuaauguagccaug

SEQ ID NO: 2363741 - RNA, 21 nt, Human
aagcauuguuugcuuauuguu

SEQ ID NO: 2363742 - RNA, 20 nt, Human
aagcauuguuugcuuauugu

SEQ ID NO: 2363743 - RNA, 14 nt, Human
aagcauuguuugcu

SEQ ID NO: 2363744 - RNA, 11 nt, Human
aagcauuguuu

SEQ ID NO: 2363745 - RNA, 23 nt, Human
aagcauuguuugcuuauuguucc

SEQ ID NO: 2363746 - RNA, 22 nt, Human
aagcauuguuugcuuauuguuc

SEQ ID NO: 2363747 - RNA, 17 nt, Human
aagcauuaacuucucug

SEQ ID NO: 2363748 - RNA, 16 nt, Human
aagcauguuucauguu

SEQ ID NO: 2363749 - RNA, 20 nt, Human
aagcauguuucauguuuugu

SEQ ID NO: 2363750 - RNA, 19 nt, Human
aagcauuguaaaugugcuu

SEQ ID NO: 2363751 - RNA, 22 nt, Human
aagccaagucagcuuugccuuc

SEQ ID NO: 2363752 - RNA, 13 nt, Human
aagccaagugggg

SEQ ID NO: 2363753 - RNA, 16 nt, Human
aagccaagggccucuu

SEQ ID NO: 2363754 - RNA, 19 nt, Human
aagccaaguggggugcugg

SEQ ID NO: 2363755 - RNA, 17 nt, Human
aagccaauaacacacag

SEQ ID NO: 2363756 - RNA, 18 nt, Human
aagccaauaacacacagc

SEQ ID NO: 2363757 - RNA, 20 nt, Human
aagccaauaacacacagcua

SEQ ID NO: 2363758 - RNA, 13 nt, Human
aagccaagggccu

SEQ ID NO: 2363759 - RNA, 23 nt, Human
aagccaagggaaaggggugcuuu

SEQ ID NO: 2363760 - RNA, 20 nt, Human
aagccaagggaaccuguguc

SEQ ID NO: 2363761 - RNA, 18 nt, Human
aagccaagggaaccugug

SEQ ID NO: 2363762 - RNA, 19 nt, Human
aagccaagggaaccugugu

SEQ ID NO: 2363763 - RNA, 14 nt, Human
aagccaauccccuc

SEQ ID NO: 2363764 - RNA, 15 nt, Human
aagccaauccccucc

SEQ ID NO: 2363765 - RNA, 16 nt, Human
aagccaauccccuccu

SEQ ID NO: 2363766 - RNA, 19 nt, Human
aagccaauccccuccuugg

SEQ ID NO: 2363767 - RNA, 17 nt, Human
aagccaaagcuaggccu

SEQ ID NO: 2363768 - RNA, 18 nt, Human
aagccaaagcuaggccug

SEQ ID NO: 2363769 - RNA, 17 nt, Human
aagccaagcagccaagc

SEQ ID NO: 2363770 - RNA, 13 nt, Human
aagccaagggaaa

SEQ ID NO: 2363771 - RNA, 14 nt, Human
aagccaagggaaag

SEQ ID NO: 2363772 - RNA, 16 nt, Human
aagccaagggaaaggg

SEQ ID NO: 2363773 - RNA, 16 nt, Human
aagccaagcagccaag

SEQ ID NO: 2363774 - RNA, 14 nt, Human
aagccaagcagcca

SEQ ID NO: 2363775 - RNA, 13 nt, Human
aagccaaagccaa

SEQ ID NO: 2363776 - RNA, 13 nt, Human
aagccaagcagcc

SEQ ID NO: 2363777 - RNA, 20 nt, Human
aagccaaagcuaggccuggc

SEQ ID NO: 2363778 - RNA, 19 nt, Human
aagcacacucauccccuca

SEQ ID NO: 2363779 - RNA, 19 nt, Human
aagcacagaaggaggagga

SEQ ID NO: 2363780 - RNA, 16 nt, Human
aagcacacuugacauc

SEQ ID NO: 2363781 - RNA, 13 nt, Human
aagcacaagaagc

SEQ ID NO: 2363782 - RNA, 21 nt, Human
aagcaauuuuccuugaagccg

SEQ ID NO: 2363783 - RNA, 22 nt, Human
aagcaauuuuccuugaagccga

SEQ ID NO: 2363784 - RNA, 18 nt, Human
aagcaauuuuccuugaag

SEQ ID NO: 2363785 - RNA, 19 nt, Human
aagcaauuuuccuugaagc

SEQ ID NO: 2363786 - RNA, 20 nt, Human
aagcaauuuuccuugaagcc

SEQ ID NO: 2363787 - RNA, 22 nt, Human
guguuugcacguuaugguguuu

SEQ ID NO: 2363788 - RNA, 17 nt, Human
gugugaaguuagaauuc

SEQ ID NO: 2363789 - RNA, 21 nt, Human
gugugaaguuagaauuccuuc

SEQ ID NO: 2363790 - RNA, 18 nt, Human
gugugaagguccugcuau

SEQ ID NO: 2363791 - RNA, 11 nt, Human
gugugaaguua

SEQ ID NO: 2363792 - RNA, 12 nt, Human
gugugaaguuag

SEQ ID NO: 2363793 - RNA, 13 nt, Human
gugugaaguuaga

SEQ ID NO: 2363794 - RNA, 17 nt, Human
guguuucuauugacuuc

SEQ ID NO: 2363795 - RNA, 13 nt, Human
guguuucugacuc

SEQ ID NO: 2363796 - RNA, 13 nt, Human
guguuucucccuc

SEQ ID NO: 2363797 - RNA, 21 nt, Human
guguuucucccucucacuguc

SEQ ID NO: 2363798 - RNA, 13 nt, Human
guguuucuuuagu

SEQ ID NO: 2363799 - RNA, 16 nt, Human
guguuucuuuaguuuu

SEQ ID NO: 2363800 - RNA, 22 nt, Human
guguuucucccucucacugucu

SEQ ID NO: 2363801 - RNA, 13 nt, Human
guguuucugugca

SEQ ID NO: 2363802 - RNA, 15 nt, Human
guguuucuguuauua

SEQ ID NO: 2363803 - RNA, 12 nt, Human
guguuucuguau

SEQ ID NO: 2363804 - RNA, 15 nt, Human
aagcacagugccugc

SEQ ID NO: 2363805 - RNA, 12 nt, Human
aagcacaguggu

SEQ ID NO: 2363806 - RNA, 20 nt, Human
aagcacagucugaugacaca

SEQ ID NO: 2363807 - RNA, 13 nt, Human
aagcacaguggug

SEQ ID NO: 2363808 - RNA, 14 nt, Human
aagcacaguggugg

SEQ ID NO: 2363809 - RNA, 18 nt, Human
aagcacagugguggcagg

SEQ ID NO: 2363810 - RNA, 19 nt, Human
aagcacagugguggcaggg

SEQ ID NO: 2363811 - RNA, 16 nt, Human
aagcacagcagccugg

SEQ ID NO: 2363812 - RNA, 11 nt, Human
aagcacagcag

SEQ ID NO: 2363813 - RNA, 14 nt, Human
aagcacaugccucu

SEQ ID NO: 2363814 - RNA, 20 nt, Human
aagcacagugguggcagggc

SEQ ID NO: 2363815 - RNA, 23 nt, Human
aagcacagugguggcagggccua

SEQ ID NO: 2363816 - RNA, 24 nt, Human
aagcacagugguggcagggccuag

SEQ ID NO: 2363817 - RNA, 13 nt, Human
aagcacaguguua

SEQ ID NO: 2363818 - RNA, 18 nt, Human
aagcacaguguuaaauga

SEQ ID NO: 2363819 - RNA, 20 nt, Human
aagcacaguguuaaaugaaa

SEQ ID NO: 2363820 - RNA, 14 nt, Human
aagcacaguuugaa

SEQ ID NO: 2363821 - RNA, 15 nt, Human
aagcacaguuugaac

SEQ ID NO: 2363822 - RNA, 15 nt, Human
aagcacaugccucuc

SEQ ID NO: 2363823 - RNA, 16 nt, Human
aagcacaugccucucu

SEQ ID NO: 2363824 - RNA, 19 nt, Human
aagcacaugccucucucag

SEQ ID NO: 2363825 - RNA, 20 nt, Human
aagcacaugccucucucagg

SEQ ID NO: 2363826 - RNA, 16 nt, Human
aagcacaucugcauuu

SEQ ID NO: 2363827 - RNA, 18 nt, Human
aagcacaguuugaacaaa

SEQ ID NO: 2363828 - RNA, 16 nt, Human
aagcacauguuuauuu

SEQ ID NO: 2363829 - RNA, 16 nt, Human
aagcacauauugagca

SEQ ID NO: 2363830 - RNA, 16 nt, Human
aagcacaguuugaaca

SEQ ID NO: 2363831 - RNA, 17 nt, Human
aagcacaguuugaacaa

SEQ ID NO: 2363832 - RNA, 21 nt, Human
aagcacaugccucucucaggc

SEQ ID NO: 2363833 - RNA, 20 nt, Human
aagcaccagcuucuccaggc

SEQ ID NO: 2363834 - RNA, 21 nt, Human
aagcaccagcuucuccaggcu

SEQ ID NO: 2363835 - RNA, 22 nt, Human
aagcaccaaaauaagaaaagau

SEQ ID NO: 2363836 - RNA, 14 nt, Human
aagcaccaagcuca

SEQ ID NO: 2363837 - RNA, 19 nt, Human
aagcaccagcuucuccagg

SEQ ID NO: 2363838 - RNA, 21 nt, Human
aagcaccaaaauaagaaaaga

SEQ ID NO: 2363839 - RNA, 19 nt, Human
aagcaccaaaauaagaaaa

SEQ ID NO: 2363840 - RNA, 17 nt, Human
aagcaccaaaauaagaa

SEQ ID NO: 2363841 - RNA, 16 nt, Human
aagcaccaaaauaaga

SEQ ID NO: 2363842 - RNA, 13 nt, Human
aagcaccuccugc

SEQ ID NO: 2363843 - RNA, 14 nt, Human
aagcaccuccugcc

SEQ ID NO: 2363844 - RNA, 15 nt, Human
aagcaccuccugccu

SEQ ID NO: 2363845 - RNA, 16 nt, Human
aagcaccuccugccuc

SEQ ID NO: 2363846 - RNA, 23 nt, Human
aagcacuacauaaacugacuuua

SEQ ID NO: 2363847 - RNA, 17 nt, Human
aagcacuacauaaacug

SEQ ID NO: 2363848 - RNA, 20 nt, Human
aagcaccugccgaccucguc

SEQ ID NO: 2363849 - RNA, 16 nt, Human
aagcaccuuagcuggc

SEQ ID NO: 2363850 - RNA, 15 nt, Human
aagcacgaaauguua

SEQ ID NO: 2363851 - RNA, 19 nt, Human
aagcaccuuagcuggcauu

SEQ ID NO: 2363852 - RNA, 17 nt, Human
aagcacugacuucuaag

SEQ ID NO: 2363853 - RNA, 16 nt, Human
aagcacugacuucuaa

SEQ ID NO: 2363854 - RNA, 17 nt, Human
aagcaccugccgaccuc

SEQ ID NO: 2363855 - RNA, 13 nt, Human
aagcaccugccga

SEQ ID NO: 2363856 - RNA, 12 nt, Human
aagcaccugccg

SEQ ID NO: 2363857 - RNA, 12 nt, Human
aagcacccuuga

SEQ ID NO: 2363858 - RNA, 19 nt, Human
aagcaccgccuccaaaugc

SEQ ID NO: 2363859 - RNA, 14 nt, Human
aagcaccccaugcc

SEQ ID NO: 2363860 - RNA, 17 nt, Human
aagcaccuccugccucg

SEQ ID NO: 2363861 - RNA, 16 nt, Human
aagcacuaaacaaaga

SEQ ID NO: 2363862 - RNA, 19 nt, Human
gugcugccucuaccugaca

SEQ ID NO: 2363863 - RNA, 12 nt, Human
gugcugccucua

SEQ ID NO: 2363864 - RNA, 11 nt, Human
gugcugccucu

SEQ ID NO: 2363865 - RNA, 15 nt, Human
gugcugcuacccucc

SEQ ID NO: 2363866 - RNA, 17 nt, Human
gugcugcuacccucccu

SEQ ID NO: 2363867 - RNA, 18 nt, Human
gugcugcuacccucccug

SEQ ID NO: 2363868 - RNA, 19 nt, Human
gugcugcuacccucccugc

SEQ ID NO: 2363869 - RNA, 21 nt, Human
gugcugcuacccucccugcug

SEQ ID NO: 2363870 - RNA, 23 nt, Human
gugcugcccugcccaccuggccu

SEQ ID NO: 2363871 - RNA, 13 nt, Human
gugcucucugcca

SEQ ID NO: 2363872 - RNA, 20 nt, Human
gugcucucugccacuggaag

SEQ ID NO: 2363873 - RNA, 13 nt, Human
gugcugcugaaga

SEQ ID NO: 2363874 - RNA, 18 nt, Human
gugguuccccaccgaagu

SEQ ID NO: 2363875 - RNA, 18 nt, Human
gugguugcuguuuuccuc

SEQ ID NO: 2363876 - RNA, 15 nt, Human
gugguuucagaaaug

SEQ ID NO: 2363877 - RNA, 15 nt, Human
gugcugcugcugcug

SEQ ID NO: 2363878 - RNA, 14 nt, Human
gugcugcugcugcu

SEQ ID NO: 2363879 - RNA, 22 nt, Human
gugcugcuacccucccugcugu

SEQ ID NO: 2363880 - RNA, 23 nt, Human
gugcugcuacccucccugcuguc

SEQ ID NO: 2363881 - RNA, 23 nt, Human
gugguucacucuuggagccugca

SEQ ID NO: 2363882 - RNA, 22 nt, Human
gugguucacucuuggagccugc

SEQ ID NO: 2363883 - RNA, 19 nt, Human
gugguugcuguuuuccucc

SEQ ID NO: 2363884 - RNA, 20 nt, Human
gugguugcuguuuuccuccc

SEQ ID NO: 2363885 - RNA, 23 nt, Human
guguaaaacgagaauccacccau

SEQ ID NO: 2363886 - RNA, 17 nt, Human
guguaaaauauuuugaa

SEQ ID NO: 2363887 - RNA, 18 nt, Human
guguaaaauauuuugaau

SEQ ID NO: 2363888 - RNA, 19 nt, Human
guguaaaauauuuugaauc

SEQ ID NO: 2363889 - RNA, 15 nt, Human
guguaaaaugugaag

SEQ ID NO: 2363890 - RNA, 15 nt, Human
guguaaaccaaagcc

SEQ ID NO: 2363891 - RNA, 22 nt, Human
guguaaaccaaagcccuaaaau

SEQ ID NO: 2363892 - RNA, 12 nt, Human
guguaaagcauu

SEQ ID NO: 2363893 - RNA, 21 nt, Human
guguaaagcauuccaacaaag

SEQ ID NO: 2363894 - RNA, 13 nt, Human
guguaaaguuagu

SEQ ID NO: 2363895 - RNA, 16 nt, Human
guguaaaguuagucua

SEQ ID NO: 2363896 - RNA, 19 nt, Human
guguaaaguuagucuacuc

SEQ ID NO: 2363897 - RNA, 19 nt, Human
guguaacaggucuccucuu

SEQ ID NO: 2363898 - RNA, 17 nt, Human
guguaacaggucuccuc

SEQ ID NO: 2363899 - RNA, 18 nt, Human
guguaacuggcaguuuuc

SEQ ID NO: 2363900 - RNA, 23 nt, Human
guguaacugucagccgggcccug

SEQ ID NO: 2363901 - RNA, 21 nt, Human
guguaacagcugaggucucuu

SEQ ID NO: 2363902 - RNA, 15 nt, Human
guguaacagcugagg

SEQ ID NO: 2363903 - RNA, 12 nt, Human
guguaacagcug

SEQ ID NO: 2363904 - RNA, 23 nt, Human
guguaacagcuccuugggaggaa

SEQ ID NO: 2363905 - RNA, 13 nt, Human
guguaacagcucc

SEQ ID NO: 2363906 - RNA, 14 nt, Human
guguaacagcuccu

SEQ ID NO: 2363907 - RNA, 15 nt, Human
guguaacagcuccuu

SEQ ID NO: 2363908 - RNA, 19 nt, Human
guguaaauaguuacuccag

SEQ ID NO: 2363909 - RNA, 17 nt, Human
aagauagcuucacccca

SEQ ID NO: 2363910 - RNA, 15 nt, Human
aagauagcagggcau

SEQ ID NO: 2363911 - RNA, 18 nt, Human
aagauaggcucugcacag

SEQ ID NO: 2363912 - RNA, 17 nt, Human
aagauaggcucugcaca

SEQ ID NO: 2363913 - RNA, 16 nt, Human
aagauaggcucugcac

SEQ ID NO: 2363914 - RNA, 15 nt, Human
aagauaggcucugca

SEQ ID NO: 2363915 - RNA, 14 nt, Human
aagauaggcucugc

SEQ ID NO: 2363916 - RNA, 13 nt, Human
aagauaggcucug

SEQ ID NO: 2363917 - RNA, 15 nt, Human
aagauauaagugcug

SEQ ID NO: 2363918 - RNA, 20 nt, Human
aagauauaacuauugcccag

SEQ ID NO: 2363919 - RNA, 16 nt, Human
aagauauaagugcugu

SEQ ID NO: 2363920 - RNA, 17 nt, Human
aagauauaagugcugua

SEQ ID NO: 2363921 - RNA, 22 nt, Human
aagagggucugaggaauccaga

SEQ ID NO: 2363922 - RNA, 21 nt, Human
aagagguauuuaucuuuacuu

SEQ ID NO: 2363923 - RNA, 19 nt, Human
aagagguagaaaagauugg

SEQ ID NO: 2363924 - RNA, 18 nt, Human
aagaggugugcaagagag

SEQ ID NO: 2363925 - RNA, 16 nt, Human
aagaggugugcaagag

SEQ ID NO: 2363926 - RNA, 16 nt, Human
aagaggugacugggcc

SEQ ID NO: 2363927 - RNA, 11 nt, Human
aagaggcaggg

SEQ ID NO: 2363928 - RNA, 18 nt, Human
aagaggcaccugucccag

SEQ ID NO: 2363929 - RNA, 15 nt, Human
aagaggcaccugucc

SEQ ID NO: 2363930 - RNA, 14 nt, Human
aagaggcagggucu

SEQ ID NO: 2363931 - RNA, 15 nt, Human
aagaggccaaugccc

SEQ ID NO: 2363932 - RNA, 14 nt, Human
aagaggcgggccag

SEQ ID NO: 2363933 - RNA, 19 nt, Human
aagaggcagaaaauugcac

SEQ ID NO: 2363934 - RNA, 16 nt, Human
aagaggcagaaaauug

SEQ ID NO: 2363935 - RNA, 18 nt, Human
aagagggagaagcaugaa

SEQ ID NO: 2363936 - RNA, 17 nt, Human
aagagggagaagcauga

SEQ ID NO: 2363937 - RNA, 19 nt, Human
aagagggagagguggagca

SEQ ID NO: 2363938 - RNA, 18 nt, Human
aagagggagauggagacu

SEQ ID NO: 2363939 - RNA, 17 nt, Human
aagagggacgccugggg

SEQ ID NO: 2363940 - RNA, 16 nt, Human
aagagggacgccuggg

SEQ ID NO: 2363941 - RNA, 23 nt, Human
aagaggcccugucuguaccuaac

SEQ ID NO: 2363942 - RNA, 17 nt, Human
aagaggcuggugcugug

SEQ ID NO: 2363943 - RNA, 13 nt, Human
aagaggcugguuc

SEQ ID NO: 2363944 - RNA, 23 nt, Human
aagagggaagaaagagaaggagc

SEQ ID NO: 2363945 - RNA, 22 nt, Human
aagagggaauccccgaaggugc

SEQ ID NO: 2363946 - RNA, 21 nt, Human
aagagggagggagggcuccag

SEQ ID NO: 2363947 - RNA, 22 nt, Human
aagagggagggagggcuccaga

SEQ ID NO: 2363948 - RNA, 18 nt, Human
guguauuuaacagggagg

SEQ ID NO: 2363949 - RNA, 12 nt, Human
guguauuguucc

SEQ ID NO: 2363950 - RNA, 16 nt, Human
gugucaaguugugcuu

SEQ ID NO: 2363951 - RNA, 17 nt, Human
guguauuuaacagggag

SEQ ID NO: 2363952 - RNA, 19 nt, Human
guguauucuaguuuuguca

SEQ ID NO: 2363953 - RNA, 14 nt, Human
gugucaccugaaga

SEQ ID NO: 2363954 - RNA, 18 nt, Human
guguauguuugcacacuu

SEQ ID NO: 2363955 - RNA, 22 nt, Human
guguauguuugcacacuugugu

SEQ ID NO: 2363956 - RNA, 18 nt, Human
guguaugugcgugugugc

SEQ ID NO: 2363957 - RNA, 16 nt, Human
guguauuaaaaaaaac

SEQ ID NO: 2363958 - RNA, 20 nt, Human
guguauuccaagacaugucu

SEQ ID NO: 2363959 - RNA, 13 nt, Human
guguauuccaaga

SEQ ID NO: 2363960 - RNA, 22 nt, Human
gugucaccugaagacucauucu

SEQ ID NO: 2363961 - RNA, 14 nt, Human
gugucaccugugcu

SEQ ID NO: 2363962 - RNA, 18 nt, Human
gugucaaguugugcuugu

SEQ ID NO: 2363963 - RNA, 23 nt, Human
gugucaaguugugcuuguuuaca

SEQ ID NO: 2363964 - RNA, 14 nt, Human
gugucagguggggc

SEQ ID NO: 2363965 - RNA, 18 nt, Human
gugucagguggggcagcu

SEQ ID NO: 2363966 - RNA, 14 nt, Human
gugucuguauuuau

SEQ ID NO: 2363967 - RNA, 13 nt, Human
gugucuguauuua

SEQ ID NO: 2363968 - RNA, 13 nt, Human
gugucugggcuga

SEQ ID NO: 2363969 - RNA, 14 nt, Human
gugucuuaauuauu

SEQ ID NO: 2363970 - RNA, 23 nt, Human
gugugaaccaccacacccagccc

SEQ ID NO: 2363971 - RNA, 18 nt, Human
gugugaaagucagaugcc

SEQ ID NO: 2363972 - RNA, 14 nt, Human
gugugaacuggacc

SEQ ID NO: 2363973 - RNA, 15 nt, Human
gugucuuaauuauua

SEQ ID NO: 2363974 - RNA, 19 nt, Human
gugucuuaauuauuauuug

SEQ ID NO: 2363975 - RNA, 13 nt, Human
gugugaagguccu

SEQ ID NO: 2363976 - RNA, 17 nt, Human
gugugaacuggacccug

SEQ ID NO: 2363977 - RNA, 22 nt, Human
gugugaacuggacccuguugcu

SEQ ID NO: 2363978 - RNA, 23 nt, Human
gugucacuacucacagucucuuu

SEQ ID NO: 2363979 - RNA, 12 nt, Human
gugucuguacac

SEQ ID NO: 2363980 - RNA, 12 nt, Human
gugucugggcug

SEQ ID NO: 2363981 - RNA, 19 nt, Human
gugucagguggggcagcuu

SEQ ID NO: 2363982 - RNA, 13 nt, Human
gugucuguacacg

SEQ ID NO: 2363983 - RNA, 16 nt, Human
gugucuguacacgugu

SEQ ID NO: 2363984 - RNA, 21 nt, Human
gugucuguacacguguccugu

SEQ ID NO: 2363985 - RNA, 22 nt, Human
gugucuguacacguguccugua

SEQ ID NO: 2363986 - RNA, 22 nt, Human
gugucuuaauuaaaagaauauu

SEQ ID NO: 2363987 - RNA, 18 nt, Human
aagcaaaugugaccugug

SEQ ID NO: 2363988 - RNA, 17 nt, Human
aagcaaaaucauggaau

SEQ ID NO: 2363989 - RNA, 23 nt, Human
aagcaaaaucauuuuauauguca

SEQ ID NO: 2363990 - RNA, 13 nt, Human
aagcaaaauauua

SEQ ID NO: 2363991 - RNA, 14 nt, Human
aagcaaaauauuau

SEQ ID NO: 2363992 - RNA, 20 nt, Human
aagcaaaugugaaucauuuu

SEQ ID NO: 2363993 - RNA, 14 nt, Human
aagcaaauugauga

SEQ ID NO: 2363994 - RNA, 14 nt, Human
aagcaacagguuuu

SEQ ID NO: 2363995 - RNA, 17 nt, Human
aagcaacccaaauguuc

SEQ ID NO: 2363996 - RNA, 21 nt, Human
guguaugugggggucugugug

SEQ ID NO: 2363997 - RNA, 13 nt, Human
guguauguggggg

SEQ ID NO: 2363998 - RNA, 23 nt, Human
aagauggcacuuauaaccaaagc

SEQ ID NO: 2363999 - RNA, 18 nt, Human
aagauggcauccugugaa

SEQ ID NO: 2364000 - RNA, 21 nt, Human
aagauggcccagcuccccaag

SEQ ID NO: 2364001 - RNA, 21 nt, Human
aagauggauugguguaaaagg

SEQ ID NO: 2364002 - RNA, 21 nt, Human
aagauggauucucagauauuu

SEQ ID NO: 2364003 - RNA, 17 nt, Human
aagauggauucucagau

SEQ ID NO: 2364004 - RNA, 16 nt, Human
aagauggauucucaga

SEQ ID NO: 2364005 - RNA, 14 nt, Human
aagauggauucuca

SEQ ID NO: 2364006 - RNA, 15 nt, Human
aagauggaugugcuu

SEQ ID NO: 2364007 - RNA, 17 nt, Human
aagauggcugacuuugc

SEQ ID NO: 2364008 - RNA, 16 nt, Human
aagauggcugugccuc

SEQ ID NO: 2364009 - RNA, 15 nt, Human
aagauuuuucucaaa

SEQ ID NO: 2364010 - RNA, 22 nt, Human
aagauggcccagcuccccaaga

SEQ ID NO: 2364011 - RNA, 19 nt, Human
aagauuuuucucaaaguuu

SEQ ID NO: 2364012 - RNA, 20 nt, Human
aagauuuuucucaaaguuuu

SEQ ID NO: 2364013 - RNA, 21 nt, Human
aagauuuuucucaaaguuuug

SEQ ID NO: 2364014 - RNA, 20 nt, Human
aagaucaaaagguuaauaaa

SEQ ID NO: 2364015 - RNA, 15 nt, Human
aagauauuuuucaug

SEQ ID NO: 2364016 - RNA, 17 nt, Human
aagauauuuuucaugau

SEQ ID NO: 2364017 - RNA, 19 nt, Human
aagauauuuuuaucuuuau

SEQ ID NO: 2364018 - RNA, 17 nt, Human
aagauauuuuuaucuuu

SEQ ID NO: 2364019 - RNA, 23 nt, Human
aagaucaaaagguuaauaaagua

SEQ ID NO: 2364020 - RNA, 13 nt, Human
aagauauuuuucc

SEQ ID NO: 2364021 - RNA, 22 nt, Human
aagaucaaaagcuuauucaucu

SEQ ID NO: 2364022 - RNA, 15 nt, Human
aagaucaaaauaaaa

SEQ ID NO: 2364023 - RNA, 12 nt, Human
aaaaaauuuaag

SEQ ID NO: 2364024 - RNA, 11 nt, Human
aaaaaauuggu

SEQ ID NO: 2364025 - RNA, 14 nt, Human
aaaaacacaaaagu

SEQ ID NO: 2364026 - RNA, 11 nt, Human
aaaaacaaaaa

SEQ ID NO: 2364027 - RNA, 16 nt, Human
aaaaaauuuccaguga

SEQ ID NO: 2364028 - RNA, 14 nt, Human
aaaaaauuuaagug

SEQ ID NO: 2364029 - RNA, 22 nt, Human
aaaaaauuugagaaagccuuca

SEQ ID NO: 2364030 - RNA, 19 nt, Human
aaaaacagccucacagaag

SEQ ID NO: 2364031 - RNA, 21 nt, Human
aaaaacagcauugcuuucuga

SEQ ID NO: 2364032 - RNA, 20 nt, Human
aaaaacagcauugcuuucug

SEQ ID NO: 2364033 - RNA, 19 nt, Human
aaaaacagcauugcuuucu

SEQ ID NO: 2364034 - RNA, 12 nt, Human
aaaaacacagca

SEQ ID NO: 2364035 - RNA, 18 nt, Human
aaaaauugguucuuuauu

SEQ ID NO: 2364036 - RNA, 14 nt, Human
aaaaauugugauca

SEQ ID NO: 2364037 - RNA, 21 nt, Human
aaaaauuguuaauuuuuccua

SEQ ID NO: 2364038 - RNA, 19 nt, Human
aaaaauuccuuuguguuuc

SEQ ID NO: 2364039 - RNA, 14 nt, Human
aaaaagacagggcu

SEQ ID NO: 2364040 - RNA, 13 nt, Human
aaaaagaccagac

SEQ ID NO: 2364041 - RNA, 19 nt, Human
aaaaagagaaguauuauaa

SEQ ID NO: 2364042 - RNA, 18 nt, Human
aaaaagaggaaagaauga

SEQ ID NO: 2364043 - RNA, 12 nt, Human
aaaaagaggcua

SEQ ID NO: 2364044 - RNA, 20 nt, Human
aaaaagauguucagucauuu

SEQ ID NO: 2364045 - RNA, 19 nt, Human
aaaaagaggaaagaaugaa

SEQ ID NO: 2364046 - RNA, 22 nt, Human
aaaaagauauauuaaaaauaua

SEQ ID NO: 2364047 - RNA, 13 nt, Human
aaaaagauauauu

SEQ ID NO: 2364048 - RNA, 17 nt, Human
aaaaagauauauuaaaa

SEQ ID NO: 2364049 - RNA, 12 nt, Human
aaaaacuuguaa

SEQ ID NO: 2364050 - RNA, 18 nt, Human
aaaaacuuguaaaugcug

SEQ ID NO: 2364051 - RNA, 19 nt, Human
aaaaacuucaguaaguacg

SEQ ID NO: 2364052 - RNA, 12 nt, Human
aaaaacuguauu

SEQ ID NO: 2364053 - RNA, 12 nt, Human
aaaaacugaaug

SEQ ID NO: 2364054 - RNA, 15 nt, Human
aaaaacugauuuuuu

SEQ ID NO: 2364055 - RNA, 14 nt, Human
aaaaaccaaaacug

SEQ ID NO: 2364056 - RNA, 14 nt, Human
aaaaacauggccuu

SEQ ID NO: 2364057 - RNA, 13 nt, Human
aaaaacugauuuu

SEQ ID NO: 2364058 - RNA, 18 nt, Human
aaaacaacuucuuuguaa

SEQ ID NO: 2364059 - RNA, 22 nt, Human
aaaacaacuauggaucagaaua

SEQ ID NO: 2364060 - RNA, 16 nt, Human
aaaacaauaaaauuuu

SEQ ID NO: 2364061 - RNA, 17 nt, Human
aaaacaaggaugaauua

SEQ ID NO: 2364062 - RNA, 13 nt, Human
aaaacaaugaaga

SEQ ID NO: 2364063 - RNA, 14 nt, Human
aaaacaauuguaau

SEQ ID NO: 2364064 - RNA, 15 nt, Human
aaaacacaagcaaaa

SEQ ID NO: 2364065 - RNA, 19 nt, Human
aaaacaaucauuugcuuuu

SEQ ID NO: 2364066 - RNA, 18 nt, Human
aaaacaauauuguuucua

SEQ ID NO: 2364067 - RNA, 17 nt, Human
aaaacaauauuguuucu

SEQ ID NO: 2364068 - RNA, 15 nt, Human
aaaacaauauuguuu

SEQ ID NO: 2364069 - RNA, 12 nt, Human
aaaacacauuuu

SEQ ID NO: 2364070 - RNA, 18 nt, Human
aaaacacagcaaggguga

SEQ ID NO: 2364071 - RNA, 13 nt, Human
aaaacacagcaag

SEQ ID NO: 2364072 - RNA, 12 nt, Human
aaaacacagcaa

SEQ ID NO: 2364073 - RNA, 22 nt, Human
aaaaauuuuauaaaauuaagca

SEQ ID NO: 2364074 - RNA, 20 nt, Human
aaaaauuuaagcauuguuug

SEQ ID NO: 2364075 - RNA, 18 nt, Human
aaaaauuuaagcauuguu

SEQ ID NO: 2364076 - RNA, 16 nt, Human
aaaaauuuaagcauug

SEQ ID NO: 2364077 - RNA, 15 nt, Human
aaaaauuuaagcauu

SEQ ID NO: 2364078 - RNA, 14 nt, Human
aaaaauuuaagcau

SEQ ID NO: 2364079 - RNA, 21 nt, Human
aaaaauuuaaaggguguacuu

SEQ ID NO: 2364080 - RNA, 23 nt, Human
aaaaauuguuucaaaauaaaaac

SEQ ID NO: 2364081 - RNA, 22 nt, Human
aaaaauuuaagcauuguuugcu

SEQ ID NO: 2364082 - RNA, 21 nt, Human
aaaaauuuaagcauuguuugc

SEQ ID NO: 2364083 - RNA, 13 nt, Human
aaaaauuuaagug

SEQ ID NO: 2364084 - RNA, 15 nt, Human
aaaacaaaugccaca

SEQ ID NO: 2364085 - RNA, 14 nt, Human
aaaacaaggaugaa

SEQ ID NO: 2364086 - RNA, 16 nt, Human
aaaacaaaaagaacaa

SEQ ID NO: 2364087 - RNA, 17 nt, Human
aaaacaaaaagaacaaa

SEQ ID NO: 2364088 - RNA, 15 nt, Human
aaaacaaaaagaaca

SEQ ID NO: 2364089 - RNA, 12 nt, Human
aaaacaaagaag

SEQ ID NO: 2364090 - RNA, 18 nt, Human
aggaccucugaaacccug

SEQ ID NO: 2364091 - RNA, 23 nt, Human
aggaccccucaccuugcaacaca

SEQ ID NO: 2364092 - RNA, 15 nt, Human
aggaccccucaccuu

SEQ ID NO: 2364093 - RNA, 17 nt, Human
aggacccggaggggccu

SEQ ID NO: 2364094 - RNA, 20 nt, Human
aggaccucaggugagaagca

SEQ ID NO: 2364095 - RNA, 14 nt, Human
aggaccucagguga

SEQ ID NO: 2364096 - RNA, 11 nt, Human
aggagaagcca

SEQ ID NO: 2364097 - RNA, 13 nt, Human
aggagaagccagg

SEQ ID NO: 2364098 - RNA, 12 nt, Human
aggagaagccag

SEQ ID NO: 2364099 - RNA, 15 nt, Human
aggagaaccacuaca

SEQ ID NO: 2364100 - RNA, 14 nt, Human
aggagaaccacuac

SEQ ID NO: 2364101 - RNA, 19 nt, Human
aggagaaccaaaucuggaa

SEQ ID NO: 2364102 - RNA, 22 nt, Human
aggagaaccaaaucuggaagcc

SEQ ID NO: 2364103 - RNA, 20 nt, Human
aggaccucugaaacccugga

SEQ ID NO: 2364104 - RNA, 16 nt, Human
aggagaaccaaaucug

SEQ ID NO: 2364105 - RNA, 19 nt, Human
aggagaggggcagaacagc

SEQ ID NO: 2364106 - RNA, 18 nt, Human
aggagaggggcagaacag

SEQ ID NO: 2364107 - RNA, 13 nt, Human
aggagaggggcag

SEQ ID NO: 2364108 - RNA, 16 nt, Human
aggagaggagagccag

SEQ ID NO: 2364109 - RNA, 17 nt, Human
aggagaggagagccaga

SEQ ID NO: 2364110 - RNA, 18 nt, Human
aggagaggggcacagggu

SEQ ID NO: 2364111 - RNA, 16 nt, Human
aggagaggggcacagg

SEQ ID NO: 2364112 - RNA, 14 nt, Human
aggagaggggcaca

SEQ ID NO: 2364113 - RNA, 12 nt, Human
aggagaggaaag

SEQ ID NO: 2364114 - RNA, 13 nt, Human
aggagaggagaga

SEQ ID NO: 2364115 - RNA, 15 nt, Human
aggagaggaaaagua

SEQ ID NO: 2364116 - RNA, 20 nt, Human
aggagaggaaaaguaaggug

SEQ ID NO: 2364117 - RNA, 14 nt, Human
aggagaggagagag

SEQ ID NO: 2364118 - RNA, 15 nt, Human
aggagaggagagagg

SEQ ID NO: 2364119 - RNA, 16 nt, Human
aggagaggagagaggc

SEQ ID NO: 2364120 - RNA, 17 nt, Human
aggagaggagagaggca

SEQ ID NO: 2364121 - RNA, 18 nt, Human
aggagaggagagaggcag

SEQ ID NO: 2364122 - RNA, 13 nt, Human
aggagaggagagc

SEQ ID NO: 2364123 - RNA, 14 nt, Human
aggagaggagagcc

SEQ ID NO: 2364124 - RNA, 15 nt, Human
aggagaggagagcca

SEQ ID NO: 2364125 - RNA, 15 nt, Human
aggagagcuagcagc

SEQ ID NO: 2364126 - RNA, 15 nt, Human
aggagaagccaggaa

SEQ ID NO: 2364127 - RNA, 14 nt, Human
aggagaagccagga

SEQ ID NO: 2364128 - RNA, 22 nt, Human
aggaccacuccuguacacugaa

SEQ ID NO: 2364129 - RNA, 16 nt, Human
aggaccacuccuguac

SEQ ID NO: 2364130 - RNA, 12 nt, Human
aggaccacuccu

SEQ ID NO: 2364131 - RNA, 12 nt, Human
aggaccagcuca

SEQ ID NO: 2364132 - RNA, 17 nt, Human
aggaccaagcaucuugg

SEQ ID NO: 2364133 - RNA, 19 nt, Human
aggaccaagcaucuugggg

SEQ ID NO: 2364134 - RNA, 13 nt, Human
aggaccccucacc

SEQ ID NO: 2364135 - RNA, 17 nt, Human
aggacccccuuccccua

SEQ ID NO: 2364136 - RNA, 15 nt, Human
aggacccccuucccc

SEQ ID NO: 2364137 - RNA, 16 nt, Human
aggacccccuuccccu

SEQ ID NO: 2364138 - RNA, 13 nt, Human
aggacccccuucc

SEQ ID NO: 2364139 - RNA, 20 nt, Human
aggaccccuccaugugggcu

SEQ ID NO: 2364140 - RNA, 18 nt, Human
aggaccagcucaggacag

SEQ ID NO: 2364141 - RNA, 15 nt, Human
aggaccagcucagga

SEQ ID NO: 2364142 - RNA, 14 nt, Human
aggaccagcucagg

SEQ ID NO: 2364143 - RNA, 13 nt, Human
aggaccagcucag

SEQ ID NO: 2364144 - RNA, 23 nt, Human
aggaccagcucaggacagaugcc

SEQ ID NO: 2364145 - RNA, 20 nt, Human
aggaacgguaaauuucugug

SEQ ID NO: 2364146 - RNA, 13 nt, Human
aggaacucccagc

SEQ ID NO: 2364147 - RNA, 14 nt, Human
aggaacucccagca

SEQ ID NO: 2364148 - RNA, 23 nt, Human
aggaacucccagcaacacaagcu

SEQ ID NO: 2364149 - RNA, 13 nt, Human
aggaacucuggcu

SEQ ID NO: 2364150 - RNA, 16 nt, Human
aggaacucuggcuucc

SEQ ID NO: 2364151 - RNA, 18 nt, Human
aggaacucuggcuuccag

SEQ ID NO: 2364152 - RNA, 15 nt, Human
aggaacuacugagga

SEQ ID NO: 2364153 - RNA, 16 nt, Human
aggaacugcugggcuu

SEQ ID NO: 2364154 - RNA, 21 nt, Human
aggaacucuggcuuccaggua

SEQ ID NO: 2364155 - RNA, 19 nt, Human
aggaacucuggcuuccagg

SEQ ID NO: 2364156 - RNA, 16 nt, Human
aggauucuaugaggca

SEQ ID NO: 2364157 - RNA, 15 nt, Human
aggauucuaugaggc

SEQ ID NO: 2364158 - RNA, 13 nt, Human
aggauucuaugag

SEQ ID NO: 2364159 - RNA, 12 nt, Human
aggauucuuccu

SEQ ID NO: 2364160 - RNA, 16 nt, Human
aggauucuuccucccu

SEQ ID NO: 2364161 - RNA, 17 nt, Human
aggaggggauagagaga

SEQ ID NO: 2364162 - RNA, 19 nt, Human
aggagaggagagccagaga

SEQ ID NO: 2364163 - RNA, 13 nt, Human
aggaggggccgcu

SEQ ID NO: 2364164 - RNA, 20 nt, Human
aggaggggcccguugucucc

SEQ ID NO: 2364165 - RNA, 16 nt, Human
aggaggggcuguaaaa

SEQ ID NO: 2364166 - RNA, 17 nt, Human
aggagggucaggaagga

SEQ ID NO: 2364167 - RNA, 14 nt, Human
aggagggucaggaa

SEQ ID NO: 2364168 - RNA, 17 nt, Human
aggauguugaaaaaguu

SEQ ID NO: 2364169 - RNA, 20 nt, Human
aggauguucugggacacagu

SEQ ID NO: 2364170 - RNA, 14 nt, Human
aggauguugaaaaa

SEQ ID NO: 2364171 - RNA, 14 nt, Human
aggcacugcugccc

SEQ ID NO: 2364172 - RNA, 16 nt, Human
aggcacugcugcccag

SEQ ID NO: 2364173 - RNA, 22 nt, Human
aggcacugcugcccagccucca

SEQ ID NO: 2364174 - RNA, 14 nt, Human
aggcacugccugau

SEQ ID NO: 2364175 - RNA, 22 nt, Human
aggcagaagaauugaacccagg

SEQ ID NO: 2364176 - RNA, 23 nt, Human
aggcacugggggcagcgggggcc

SEQ ID NO: 2364177 - RNA, 23 nt, Human
aggcagaagaauugaacccagga

SEQ ID NO: 2364178 - RNA, 20 nt, Human
aggcagaauccuggcccucu

SEQ ID NO: 2364179 - RNA, 21 nt, Human
aggcagaauccuggcccucug

SEQ ID NO: 2364180 - RNA, 11 nt, Human
aggcagacaca

SEQ ID NO: 2364181 - RNA, 14 nt, Human
aggcagacacaggg

SEQ ID NO: 2364182 - RNA, 15 nt, Human
aggcagacacaggga

SEQ ID NO: 2364183 - RNA, 21 nt, Human
aggcagacacagggacuugaa

SEQ ID NO: 2364184 - RNA, 13 nt, Human
aggcacugccuga

SEQ ID NO: 2364185 - RNA, 15 nt, Human
agcuccucauccagg

SEQ ID NO: 2364186 - RNA, 18 nt, Human
agcuccucauccagggcu

SEQ ID NO: 2364187 - RNA, 12 nt, Human
agcuccucccac

SEQ ID NO: 2364188 - RNA, 19 nt, Human
agcuccucauccagggcuc

SEQ ID NO: 2364189 - RNA, 21 nt, Human
agcuccucauccagggcucug

SEQ ID NO: 2364190 - RNA, 16 nt, Human
agcuccucaacucacc

SEQ ID NO: 2364191 - RNA, 23 nt, Human
agcuccucaacucaccuaauguu

SEQ ID NO: 2364192 - RNA, 17 nt, Human
agcuccuccucccugca

SEQ ID NO: 2364193 - RNA, 16 nt, Human
agcuccuccucccugc

SEQ ID NO: 2364194 - RNA, 15 nt, Human
agcuccuccucccug

SEQ ID NO: 2364195 - RNA, 14 nt, Human
agcuccuccucccu

SEQ ID NO: 2364196 - RNA, 13 nt, Human
agcuccuccuccc

SEQ ID NO: 2364197 - RNA, 22 nt, Human
agcuccuccgugcuuccucagu

SEQ ID NO: 2364198 - RNA, 20 nt, Human
agcuccucccuuguucucua

SEQ ID NO: 2364199 - RNA, 20 nt, Human
agcuccuccgugcuuccuca

SEQ ID NO: 2364200 - RNA, 16 nt, Human
agcuccucccuuguuc

SEQ ID NO: 2364201 - RNA, 20 nt, Human
agcuccuggucuugagaugu

SEQ ID NO: 2364202 - RNA, 22 nt, Human
agcuccuggucuugagaugucu

SEQ ID NO: 2364203 - RNA, 11 nt, Human
agcuccuguaa

SEQ ID NO: 2364204 - RNA, 23 nt, Human
agcuccugcuccacagccauccc

SEQ ID NO: 2364205 - RNA, 13 nt, Human
agcuccucuuccu

SEQ ID NO: 2364206 - RNA, 20 nt, Human
agcuccucugggcaggaccu

SEQ ID NO: 2364207 - RNA, 19 nt, Human
agcuccucugggcaggacc

SEQ ID NO: 2364208 - RNA, 17 nt, Human
agcuccucugggcagga

SEQ ID NO: 2364209 - RNA, 21 nt, Human
agcuccuccucccugcaucug

SEQ ID NO: 2364210 - RNA, 23 nt, Human
agcuccuccucccugcaucugac

SEQ ID NO: 2364211 - RNA, 14 nt, Human
agcugacacaaacc

SEQ ID NO: 2364212 - RNA, 12 nt, Human
agcuccuguccu

SEQ ID NO: 2364213 - RNA, 14 nt, Human
agcuccuguccucc

SEQ ID NO: 2364214 - RNA, 13 nt, Human
agcuccuguccuc

SEQ ID NO: 2364215 - RNA, 19 nt, Human
agcugacacaaaccugccu

SEQ ID NO: 2364216 - RNA, 20 nt, Human
agcugacacaaaccugccug

SEQ ID NO: 2364217 - RNA, 21 nt, Human
agcugacacaaaccugccugg

SEQ ID NO: 2364218 - RNA, 22 nt, Human
agcugacacaaaccugccuggg

SEQ ID NO: 2364219 - RNA, 23 nt, Human
agcugacacaaaccugccugggu

SEQ ID NO: 2364220 - RNA, 13 nt, Human
agcugacaguccu

SEQ ID NO: 2364221 - RNA, 14 nt, Human
agcugacaguccuc

SEQ ID NO: 2364222 - RNA, 21 nt, Human
agcugacaguccucuccaccu

SEQ ID NO: 2364223 - RNA, 16 nt, Human
agcugacaguccucuc

SEQ ID NO: 2364224 - RNA, 12 nt, Human
agcugacaugga

SEQ ID NO: 2364225 - RNA, 14 nt, Human
agcugacauggaaa

SEQ ID NO: 2364226 - RNA, 16 nt, Human
agcugaccacaggcag

SEQ ID NO: 2364227 - RNA, 17 nt, Human
agcugaccacaggcagu

SEQ ID NO: 2364228 - RNA, 23 nt, Human
agcugaggucucuugagggagcu

SEQ ID NO: 2364229 - RNA, 21 nt, Human
agcugaggucucuugagggag

SEQ ID NO: 2364230 - RNA, 16 nt, Human
agcugacccagccccu

SEQ ID NO: 2364231 - RNA, 23 nt, Human
agcugacccagccccuugagaaa

SEQ ID NO: 2364232 - RNA, 12 nt, Human
agcugaccucug

SEQ ID NO: 2364233 - RNA, 15 nt, Human
agcugaccucuguug

SEQ ID NO: 2364234 - RNA, 18 nt, Human
agcugaggucucuugagg

SEQ ID NO: 2364235 - RNA, 23 nt, Human
agcugaggggggccgugcccagg

SEQ ID NO: 2364236 - RNA, 13 nt, Human
agcugaggggggc

SEQ ID NO: 2364237 - RNA, 22 nt, Human
agcugaggggggccgugcccag

SEQ ID NO: 2364238 - RNA, 22 nt, Human
agcugaggccacacucagcaca

SEQ ID NO: 2364239 - RNA, 21 nt, Human
agcugaggccacacucagcac

SEQ ID NO: 2364240 - RNA, 17 nt, Human
agcugaccucuguuguc

SEQ ID NO: 2364241 - RNA, 12 nt, Human
agcugcuccccu

SEQ ID NO: 2364242 - RNA, 20 nt, Human
agcugcuccccagcagcgga

SEQ ID NO: 2364243 - RNA, 17 nt, Human
agcugcuccccagcagc

SEQ ID NO: 2364244 - RNA, 15 nt, Human
agcugauccagagca

SEQ ID NO: 2364245 - RNA, 13 nt, Human
agcugcuccccag

SEQ ID NO: 2364246 - RNA, 13 nt, Human
agcugauccagag

SEQ ID NO: 2364247 - RNA, 21 nt, Human
agcugauacaaauugcagacu

SEQ ID NO: 2364248 - RNA, 19 nt, Human
agcugcuccccucccuccu

SEQ ID NO: 2364249 - RNA, 14 nt, Human
agcugcuccccucc

SEQ ID NO: 2364250 - RNA, 13 nt, Human
agcugcuccccuc

SEQ ID NO: 2364251 - RNA, 15 nt, Human
agcugcuccccuccc

SEQ ID NO: 2364252 - RNA, 22 nt, Human
agcugcuccuagagggaggggc

SEQ ID NO: 2364253 - RNA, 20 nt, Human
agcugcuccuagagggaggg

SEQ ID NO: 2364254 - RNA, 14 nt, Human
agcugcucuauugu

SEQ ID NO: 2364255 - RNA, 23 nt, Human
agcugcucugaauuaguccuugc

SEQ ID NO: 2364256 - RNA, 19 nt, Human
agcugcuccuagagggagg

SEQ ID NO: 2364257 - RNA, 18 nt, Human
agcugcuccuagagggag

SEQ ID NO: 2364258 - RNA, 17 nt, Human
agcugcuccuagaggga

SEQ ID NO: 2364259 - RNA, 14 nt, Human
agcugcucuggaaa

SEQ ID NO: 2364260 - RNA, 16 nt, Human
agcugcucugucuucu

SEQ ID NO: 2364261 - RNA, 15 nt, Human
agcugggucaggcag

SEQ ID NO: 2364262 - RNA, 18 nt, Human
agcuggguggcacugcca

SEQ ID NO: 2364263 - RNA, 15 nt, Human
agcugcucuggaaaa

SEQ ID NO: 2364264 - RNA, 19 nt, Human
agcuggguggcacugccau

SEQ ID NO: 2364265 - RNA, 17 nt, Human
agcugggucaggcaggg

SEQ ID NO: 2364266 - RNA, 16 nt, Human
agcugggucaggcagg

SEQ ID NO: 2364267 - RNA, 17 nt, Human
agcugggugucaagagg

SEQ ID NO: 2364268 - RNA, 22 nt, Human
agcugggugucaagagggucug

SEQ ID NO: 2364269 - RNA, 18 nt, Human
agcuggugcauuacagag

SEQ ID NO: 2364270 - RNA, 17 nt, Human
agcuggugcauuacaga

SEQ ID NO: 2364271 - RNA, 14 nt, Human
agcuggugcauuac

SEQ ID NO: 2364272 - RNA, 13 nt, Human
agcuggugcauua

SEQ ID NO: 2364273 - RNA, 12 nt, Human
agcuggugcauu

SEQ ID NO: 2364274 - RNA, 10 nt, Human
agcuggugca

SEQ ID NO: 2364275 - RNA, 20 nt, Human
agcuggguggcacugccaug

SEQ ID NO: 2364276 - RNA, 18 nt, Human
agcuggugagugaugcgg

SEQ ID NO: 2364277 - RNA, 22 nt, Human
agcuggugcauuacagagagga

SEQ ID NO: 2364278 - RNA, 21 nt, Human
agcuggugcauuacagagagg

SEQ ID NO: 2364279 - RNA, 20 nt, Human
agcuggugcauuacagagag

SEQ ID NO: 2364280 - RNA, 19 nt, Human
agcuggugcauuacagaga

SEQ ID NO: 2364281 - RNA, 21 nt, Human
agcuggucccacucaguccau

SEQ ID NO: 2364282 - RNA, 19 nt, Human
agcuucucauccugcaggc

SEQ ID NO: 2364283 - RNA, 20 nt, Human
agcuucuguugcugccucau

SEQ ID NO: 2364284 - RNA, 22 nt, Human
agcuucuguugcugccucaugc

SEQ ID NO: 2364285 - RNA, 21 nt, Human
agcuucuguugcugccucaug

SEQ ID NO: 2364286 - RNA, 14 nt, Human
agcuuccuuggcuu

SEQ ID NO: 2364287 - RNA, 15 nt, Human
agcuuccuuggcuuu

SEQ ID NO: 2364288 - RNA, 23 nt, Human
agcuuccuuuguuuuuuuuuccu

SEQ ID NO: 2364289 - RNA, 14 nt, Human
agcuucgcgugaga

SEQ ID NO: 2364290 - RNA, 17 nt, Human
agcuucuaucccaggag

SEQ ID NO: 2364291 - RNA, 18 nt, Human
agcuucuaucccaggagg

SEQ ID NO: 2364292 - RNA, 17 nt, Human
agcuucuaccaugaaca

SEQ ID NO: 2364293 - RNA, 18 nt, Human
agcuucuaccaugaacag

SEQ ID NO: 2364294 - RNA, 20 nt, Human
agcuucguuuauuuucaaga

SEQ ID NO: 2364295 - RNA, 17 nt, Human
agcuucagccaggagcu

SEQ ID NO: 2364296 - RNA, 19 nt, Human
agcuucagccaggagcugg

SEQ ID NO: 2364297 - RNA, 20 nt, Human
agcuucagccaggagcuggg

SEQ ID NO: 2364298 - RNA, 11 nt, Human
agcuucagguu

SEQ ID NO: 2364299 - RNA, 19 nt, Human
agcuucaguuguuuucccg

SEQ ID NO: 2364300 - RNA, 15 nt, Human
agcuucaguuuccug

SEQ ID NO: 2364301 - RNA, 16 nt, Human
agcuucagaaguuugg

SEQ ID NO: 2364302 - RNA, 13 nt, Human
agcuucagguuau

SEQ ID NO: 2364303 - RNA, 23 nt, Human
agcuucagguuaucgaaauaaca

SEQ ID NO: 2364304 - RNA, 17 nt, Human
agcuucauauaccagca

SEQ ID NO: 2364305 - RNA, 16 nt, Human
agcuucauacuucaug

SEQ ID NO: 2364306 - RNA, 19 nt, Human
agcuuccuucugugaaagu

SEQ ID NO: 2364307 - RNA, 15 nt, Human
agcuucagccaggag

SEQ ID NO: 2364308 - RNA, 21 nt, Human
agcuucagaaguuuggcaaua

SEQ ID NO: 2364309 - RNA, 20 nt, Human
agcuucuuaauauaacugcc

SEQ ID NO: 2364310 - RNA, 21 nt, Human
agcuucuuaauauaacugccu

SEQ ID NO: 2364311 - RNA, 22 nt, Human
agcuucuuaauauaacugccuu

SEQ ID NO: 2364312 - RNA, 23 nt, Human
agcuucuuaauauaacugccuua

SEQ ID NO: 2364313 - RNA, 18 nt, Human
agcuucuuaaaugagaag

SEQ ID NO: 2364314 - RNA, 16 nt, Human
agcuucuuaaaugaga

SEQ ID NO: 2364315 - RNA, 17 nt, Human
agcuucuauuagccagu

SEQ ID NO: 2364316 - RNA, 23 nt, Human
agcuucuauuauagccacauccc

SEQ ID NO: 2364317 - RNA, 23 nt, Human
agcuucuguugcugccucaugcu

SEQ ID NO: 2364318 - RNA, 13 nt, Human
agcuuuucccuuc

SEQ ID NO: 2364319 - RNA, 17 nt, Human
agcuuuuauuguauaaa

SEQ ID NO: 2364320 - RNA, 15 nt, Human
agcuuuuauuguaua

SEQ ID NO: 2364321 - RNA, 21 nt, Human
agcuuuuaugugaaacauguu

SEQ ID NO: 2364322 - RNA, 19 nt, Human
agcuuuuauuguauaaacu

SEQ ID NO: 2364323 - RNA, 16 nt, Human
agcuuuucccuucuuu

SEQ ID NO: 2364324 - RNA, 14 nt, Human
aggaaaaacagguc

SEQ ID NO: 2364325 - RNA, 15 nt, Human
agcuuuucccuuuuu

SEQ ID NO: 2364326 - RNA, 13 nt, Human
aggaaaaacugau

SEQ ID NO: 2364327 - RNA, 15 nt, Human
aggaaaaacugauuu

SEQ ID NO: 2364328 - RNA, 16 nt, Human
aggaaaucucacccca

SEQ ID NO: 2364329 - RNA, 19 nt, Human
aggaaaugaaaaugucuug

SEQ ID NO: 2364330 - RNA, 13 nt, Human
aggaaaugaaugu

SEQ ID NO: 2364331 - RNA, 14 nt, Human
aggaaaugaaugug

SEQ ID NO: 2364332 - RNA, 15 nt, Human
aggaaaugaaugugu

SEQ ID NO: 2364333 - RNA, 17 nt, Human
aggaaaugaaugugugu

SEQ ID NO: 2364334 - RNA, 20 nt, Human
aggaaauggcuguggagugu

SEQ ID NO: 2364335 - RNA, 16 nt, Human
aggaacgguaaauuuc

SEQ ID NO: 2364336 - RNA, 22 nt, Human
aggaacguaaucguguccccua

SEQ ID NO: 2364337 - RNA, 18 nt, Human
aggaaauggaauacugaa

SEQ ID NO: 2364338 - RNA, 14 nt, Human
aggaaaucucaccc

SEQ ID NO: 2364339 - RNA, 13 nt, Human
aggaaaaaugugu

SEQ ID NO: 2364340 - RNA, 14 nt, Human
aggaaaaaugugua

SEQ ID NO: 2364341 - RNA, 17 nt, Human
aggaaauccaggguggu

SEQ ID NO: 2364342 - RNA, 15 nt, Human
aggaaauccagggug

SEQ ID NO: 2364343 - RNA, 17 nt, Human
aggaaaaagcacaagaa

SEQ ID NO: 2364344 - RNA, 18 nt, Human
agcuuuucccaaaagccc

SEQ ID NO: 2364345 - RNA, 15 nt, Human
aggaaaaagcacaag

SEQ ID NO: 2364346 - RNA, 18 nt, Human
aggaaaaagcacaagaag

SEQ ID NO: 2364347 - RNA, 22 nt, Human
agcuguaguagcccuuucugug

SEQ ID NO: 2364348 - RNA, 20 nt, Human
agcuguaggugugcgggacc

SEQ ID NO: 2364349 - RNA, 19 nt, Human
agcuguacuucgucuucua

SEQ ID NO: 2364350 - RNA, 21 nt, Human
agcuguacuucgucuucuaau

SEQ ID NO: 2364351 - RNA, 20 nt, Human
agcuguaguagcccuuucug

SEQ ID NO: 2364352 - RNA, 21 nt, Human
agcuguaguagcccuuucugu

SEQ ID NO: 2364353 - RNA, 23 nt, Human
agcuguaguagcccuuucugugu

SEQ ID NO: 2364354 - RNA, 14 nt, Human
agcuguaugauucc

SEQ ID NO: 2364355 - RNA, 23 nt, Human
agcuguaagaagagacugggaag

SEQ ID NO: 2364356 - RNA, 22 nt, Human
agcuguaagaagagacugggaa

SEQ ID NO: 2364357 - RNA, 14 nt, Human
agcuggugcccgga

SEQ ID NO: 2364358 - RNA, 17 nt, Human
agcuguaaggcaugaag

SEQ ID NO: 2364359 - RNA, 13 nt, Human
agcuguaaggcau

SEQ ID NO: 2364360 - RNA, 19 nt, Human
agcuguaaggcaugaagga

SEQ ID NO: 2364361 - RNA, 18 nt, Human
agcuguaaggcaugaagg

SEQ ID NO: 2364362 - RNA, 13 nt, Human
agcuguacaaaua

SEQ ID NO: 2364363 - RNA, 17 nt, Human
agcuguacaaauauaag

SEQ ID NO: 2364364 - RNA, 22 nt, Human
agcuguacaaauauaagaauaa

SEQ ID NO: 2364365 - RNA, 23 nt, Human
agcuguacaaauauaagaauaaa

SEQ ID NO: 2364366 - RNA, 14 nt, Human
agggcacacacugu

SEQ ID NO: 2364367 - RNA, 17 nt, Human
agggcacaccgggcacu

SEQ ID NO: 2364368 - RNA, 15 nt, Human
agggccuggccugag

SEQ ID NO: 2364369 - RNA, 16 nt, Human
agggccuggccugagc

SEQ ID NO: 2364370 - RNA, 17 nt, Human
agggccuggccugagcu

SEQ ID NO: 2364371 - RNA, 20 nt, Human
agggcacaccgggcacucag

SEQ ID NO: 2364372 - RNA, 21 nt, Human
agggcacaccgggcacucaga

SEQ ID NO: 2364373 - RNA, 22 nt, Human
agggcacagaaaauggaagaca

SEQ ID NO: 2364374 - RNA, 12 nt, Human
aggggcagcccu

SEQ ID NO: 2364375 - RNA, 13 nt, Human
aggggcagcccuu

SEQ ID NO: 2364376 - RNA, 16 nt, Human
aggggcagcccuugcu

SEQ ID NO: 2364377 - RNA, 17 nt, Human
aggggcagaaaaacucu

SEQ ID NO: 2364378 - RNA, 19 nt, Human
aggggcacuucauugagag

SEQ ID NO: 2364379 - RNA, 19 nt, Human
aggggauugaagcccucca

SEQ ID NO: 2364380 - RNA, 14 nt, Human
aggggcagaacagc

SEQ ID NO: 2364381 - RNA, 15 nt, Human
aggggcacagggucu

SEQ ID NO: 2364382 - RNA, 14 nt, Human
aggggcccguggga

SEQ ID NO: 2364383 - RNA, 23 nt, Human
aggggcccggccagccaugucug

SEQ ID NO: 2364384 - RNA, 21 nt, Human
aggggcccggccagccauguc

SEQ ID NO: 2364385 - RNA, 19 nt, Human
aggggcccggccagccaug

SEQ ID NO: 2364386 - RNA, 17 nt, Human
aggggcccggccagcca

SEQ ID NO: 2364387 - RNA, 15 nt, Human
aggggcccggccagc

SEQ ID NO: 2364388 - RNA, 13 nt, Human
aggggcccggcca

SEQ ID NO: 2364389 - RNA, 20 nt, Human
aggggcccgcuugccucggc

SEQ ID NO: 2364390 - RNA, 14 nt, Human
aggggcagcugacc

SEQ ID NO: 2364391 - RNA, 15 nt, Human
aggggcagcugacca

SEQ ID NO: 2364392 - RNA, 11 nt, Human
aggggcagcuu

SEQ ID NO: 2364393 - RNA, 14 nt, Human
aggggcagcuucua

SEQ ID NO: 2364394 - RNA, 16 nt, Human
aggggcccgcuugccu

SEQ ID NO: 2364395 - RNA, 19 nt, Human
aggggcccgcuugccucgg

SEQ ID NO: 2364396 - RNA, 12 nt, Human
aggggcccuggu

SEQ ID NO: 2364397 - RNA, 20 nt, Human
aggggcccguugucucccug

SEQ ID NO: 2364398 - RNA, 21 nt, Human
aggggcccguugucucccugg

SEQ ID NO: 2364399 - RNA, 22 nt, Human
aggggccgcugccacccaccuc

SEQ ID NO: 2364400 - RNA, 16 nt, Human
aggggccgcugccacc

SEQ ID NO: 2364401 - RNA, 15 nt, Human
aggggccgcugccac

SEQ ID NO: 2364402 - RNA, 14 nt, Human
aggggaugggaggu

SEQ ID NO: 2364403 - RNA, 15 nt, Human
agggcgugacucacc

SEQ ID NO: 2364404 - RNA, 17 nt, Human
aggggauauaggagagg

SEQ ID NO: 2364405 - RNA, 18 nt, Human
aggggauauaggagagga

SEQ ID NO: 2364406 - RNA, 22 nt, Human
aggggauguauccaugggggca

SEQ ID NO: 2364407 - RNA, 19 nt, Human
aggggauguauccaugggg

SEQ ID NO: 2364408 - RNA, 18 nt, Human
aggggauuaauaugaaaa

SEQ ID NO: 2364409 - RNA, 17 nt, Human
aggggauugaagcccuc

SEQ ID NO: 2364410 - RNA, 16 nt, Human
agggcgugacucaccc

SEQ ID NO: 2364411 - RNA, 21 nt, Human
aggggauagagagagaccacu

SEQ ID NO: 2364412 - RNA, 19 nt, Human
agggcgggaggauguucug

SEQ ID NO: 2364413 - RNA, 13 nt, Human
agggcggcacuca

SEQ ID NO: 2364414 - RNA, 19 nt, Human
agggcggcaggggccugga

SEQ ID NO: 2364415 - RNA, 23 nt, Human
agggcggcaggggccuggagauc

SEQ ID NO: 2364416 - RNA, 18 nt, Human
agggccuggccugagcug

SEQ ID NO: 2364417 - RNA, 13 nt, Human
agggcggcagggg

SEQ ID NO: 2364418 - RNA, 15 nt, Human
agggcggcaggggcc

SEQ ID NO: 2364419 - RNA, 16 nt, Human
agggcggcaggggccu

SEQ ID NO: 2364420 - RNA, 18 nt, Human
agggcggcaggggccugg

SEQ ID NO: 2364421 - RNA, 17 nt, Human
agggacgcuacccggga

SEQ ID NO: 2364422 - RNA, 21 nt, Human
agggacgcuacccgggaaggg

SEQ ID NO: 2364423 - RNA, 20 nt, Human
agggacucaucauuuccauu

SEQ ID NO: 2364424 - RNA, 17 nt, Human
agggacuaggagcacug

SEQ ID NO: 2364425 - RNA, 20 nt, Human
agggacuaugaaugggcaaa

SEQ ID NO: 2364426 - RNA, 20 nt, Human
agggacucaauuucucccca

SEQ ID NO: 2364427 - RNA, 14 nt, Human
agggacucugaagc

SEQ ID NO: 2364428 - RNA, 19 nt, Human
agggacucugaagccucug

SEQ ID NO: 2364429 - RNA, 12 nt, Human
agggacagaggg

SEQ ID NO: 2364430 - RNA, 22 nt, Human
agggacagaggccccagccucc

SEQ ID NO: 2364431 - RNA, 21 nt, Human
agggacagaggccccagccuc

SEQ ID NO: 2364432 - RNA, 20 nt, Human
agggacagaggccccagccu

SEQ ID NO: 2364433 - RNA, 17 nt, Human
agggacagaggccccag

SEQ ID NO: 2364434 - RNA, 13 nt, Human
agggacagagggg

SEQ ID NO: 2364435 - RNA, 20 nt, Human
agggacagaggggguggccu

SEQ ID NO: 2364436 - RNA, 18 nt, Human
aggcugccucucccauca

SEQ ID NO: 2364437 - RNA, 20 nt, Human
aggcugcccccggcccccug

SEQ ID NO: 2364438 - RNA, 22 nt, Human
aggcugcccccggcccccuggu

SEQ ID NO: 2364439 - RNA, 21 nt, Human
aggcugcagaaggccaagaau

SEQ ID NO: 2364440 - RNA, 12 nt, Human
aggcugcccccg

SEQ ID NO: 2364441 - RNA, 15 nt, Human
aggcugcccccggcc

SEQ ID NO: 2364442 - RNA, 18 nt, Human
aggcugugggccucaagg

SEQ ID NO: 2364443 - RNA, 15 nt, Human
aggcugugggccuca

SEQ ID NO: 2364444 - RNA, 16 nt, Human
aggcuguggucacagc

SEQ ID NO: 2364445 - RNA, 23 nt, Human
aggcugucuucucaggcucugcc

SEQ ID NO: 2364446 - RNA, 22 nt, Human
aggcugucuucucaggcucugc

SEQ ID NO: 2364447 - RNA, 21 nt, Human
aggcugucuucucaggcucug

SEQ ID NO: 2364448 - RNA, 20 nt, Human
aggcugucuucucaggcucu

SEQ ID NO: 2364449 - RNA, 13 nt, Human
aggcugugcuccc

SEQ ID NO: 2364450 - RNA, 14 nt, Human
aggcugugcucccu

SEQ ID NO: 2364451 - RNA, 20 nt, Human
aggcugugcucccugguucu

SEQ ID NO: 2364452 - RNA, 24 nt, Human
aggcugugcucccugguucugaug

SEQ ID NO: 2364453 - RNA, 15 nt, Human
aggcugcagcgagcu

SEQ ID NO: 2364454 - RNA, 18 nt, Human
aggcugcagaaggccaag

SEQ ID NO: 2364455 - RNA, 20 nt, Human
aggcugcagaaggccaagaa

SEQ ID NO: 2364456 - RNA, 18 nt, Human
aggcugcagccaggccac

SEQ ID NO: 2364457 - RNA, 22 nt, Human
aggcugcaagguuuaggcuggu

SEQ ID NO: 2364458 - RNA, 17 nt, Human
aggcugcagaaggccaa

SEQ ID NO: 2364459 - RNA, 21 nt, Human
aggcugcaagguuuaggcugg

SEQ ID NO: 2364460 - RNA, 23 nt, Human
aggcugaugccaaguuguuugag

SEQ ID NO: 2364461 - RNA, 21 nt, Human
aggcugaugucaauuucugug

SEQ ID NO: 2364462 - RNA, 22 nt, Human
aggcugaggggaggaucacugg

SEQ ID NO: 2364463 - RNA, 14 nt, Human
aggcugaggugucu

SEQ ID NO: 2364464 - RNA, 19 nt, Human
aggcugagguugcgccacu

SEQ ID NO: 2364465 - RNA, 17 nt, Human
aggcugauaauuccagu

SEQ ID NO: 2364466 - RNA, 20 nt, Human
aggcugauaauuccaguggu

SEQ ID NO: 2364467 - RNA, 17 nt, Human
aggcugaaagaggccaa

SEQ ID NO: 2364468 - RNA, 16 nt, Human
aggcugaaagaggcca

SEQ ID NO: 2364469 - RNA, 14 nt, Human
aggcugaccaagag

SEQ ID NO: 2364470 - RNA, 17 nt, Human
aggcugaccaagagaga

SEQ ID NO: 2364471 - RNA, 15 nt, Human
aggcugaccaagaga

SEQ ID NO: 2364472 - RNA, 18 nt, Human
aggcugaggcuggcacag

SEQ ID NO: 2364473 - RNA, 21 nt, Human
aggcugaacuuguuuucuggg

SEQ ID NO: 2364474 - RNA, 20 nt, Human
aggcugaacuuguuuucugg

SEQ ID NO: 2364475 - RNA, 13 nt, Human
aggcugaaagagg

SEQ ID NO: 2364476 - RNA, 23 nt, Human
aggcucuuuggggucagccaggg

SEQ ID NO: 2364477 - RNA, 21 nt, Human
aggcucuuuggggucagccag

SEQ ID NO: 2364478 - RNA, 22 nt, Human
aggcucuuuggggucagccagg

SEQ ID NO: 2364479 - RNA, 20 nt, Human
aggcucuuucugggccaagu

SEQ ID NO: 2364480 - RNA, 18 nt, Human
aggcucuuucugggccaa

SEQ ID NO: 2364481 - RNA, 15 nt, Human
aggcucuuucugggc

SEQ ID NO: 2364482 - RNA, 15 nt, Human
aggcucuucugacua

SEQ ID NO: 2364483 - RNA, 14 nt, Human
aggcucuucuccuu

SEQ ID NO: 2364484 - RNA, 23 nt, Human
aggcuauacuugucuuguucacc

SEQ ID NO: 2364485 - RNA, 22 nt, Human
aggcuauggacagggcaugcca

SEQ ID NO: 2364486 - RNA, 19 nt, Human
aggcuauggggauagaugu

SEQ ID NO: 2364487 - RNA, 22 nt, Human
aggcuauggggauagaugugug

SEQ ID NO: 2364488 - RNA, 21 nt, Human
aggcuauggggauagaugugu

SEQ ID NO: 2364489 - RNA, 23 nt, Human
aggcuagugugguguuuccuggc

SEQ ID NO: 2364490 - RNA, 21 nt, Human
aggcagacagcagcucaggca

SEQ ID NO: 2364491 - RNA, 20 nt, Human
aggcagacagcagcucaggc

SEQ ID NO: 2364492 - RNA, 19 nt, Human
aggcagacagcagcucagg

SEQ ID NO: 2364493 - RNA, 18 nt, Human
aggcagacagcagcucag

SEQ ID NO: 2364494 - RNA, 15 nt, Human
aggcagacagcagcu

SEQ ID NO: 2364495 - RNA, 14 nt, Human
aggcagacagcagc

SEQ ID NO: 2364496 - RNA, 13 nt, Human
aggcagacagcag

SEQ ID NO: 2364497 - RNA, 11 nt, Human
aggcagacacg

SEQ ID NO: 2364498 - RNA, 18 nt, Human
aggcagacacggaucuga

SEQ ID NO: 2364499 - RNA, 20 nt, Human
aggcagacacggaucugaga

SEQ ID NO: 2364500 - RNA, 14 nt, Human
agguggaagcccuc

SEQ ID NO: 2364501 - RNA, 13 nt, Human
agguggaagcccu

SEQ ID NO: 2364502 - RNA, 11 nt, Human
agguggaagcc

SEQ ID NO: 2364503 - RNA, 22 nt, Human
agguggaagaagggagaagaaa

SEQ ID NO: 2364504 - RNA, 16 nt, Human
agguggaagcccuccu

SEQ ID NO: 2364505 - RNA, 15 nt, Human
agguggaagcccucc

SEQ ID NO: 2364506 - RNA, 16 nt, Human
agguggauggccccag

SEQ ID NO: 2364507 - RNA, 23 nt, Human
agguggauggccccagcacagcu

SEQ ID NO: 2364508 - RNA, 15 nt, Human
agguggauggcccca

SEQ ID NO: 2364509 - RNA, 14 nt, Human
agguggcaaggcug

SEQ ID NO: 2364510 - RNA, 15 nt, Human
agguggcaaggcugu

SEQ ID NO: 2364511 - RNA, 16 nt, Human
agguggcaaggcugug

SEQ ID NO: 2364512 - RNA, 18 nt, Human
agguggcaaggcugugcu

SEQ ID NO: 2364513 - RNA, 18 nt, Human
agguggaaaaacaucuga

SEQ ID NO: 2364514 - RNA, 15 nt, Human
agguggaagaaggga

SEQ ID NO: 2364515 - RNA, 13 nt, Human
agguggaaaaaca

SEQ ID NO: 2364516 - RNA, 16 nt, Human
agguggaagagggcug

SEQ ID NO: 2364517 - RNA, 16 nt, Human
agguggaagaagggag

SEQ ID NO: 2364518 - RNA, 17 nt, Human
agguggaagaagggaga

SEQ ID NO: 2364519 - RNA, 18 nt, Human
agguggaagaagggagaa

SEQ ID NO: 2364520 - RNA, 19 nt, Human
agguggaagaagggagaag

SEQ ID NO: 2364521 - RNA, 15 nt, Human
aggugcugggaggga

SEQ ID NO: 2364522 - RNA, 20 nt, Human
aggugcuuaagcagaagcau

SEQ ID NO: 2364523 - RNA, 21 nt, Human
aggugcuucaggauaccauau

SEQ ID NO: 2364524 - RNA, 19 nt, Human
aggugcuuaagcagaagca

SEQ ID NO: 2364525 - RNA, 23 nt, Human
aggugcuguuauccauggggaag

SEQ ID NO: 2364526 - RNA, 13 nt, Human
aggugcugggagg

SEQ ID NO: 2364527 - RNA, 12 nt, Human
aggugcugggag

SEQ ID NO: 2364528 - RNA, 19 nt, Human
aggugcuggaggugggagc

SEQ ID NO: 2364529 - RNA, 23 nt, Human
aggugcuggaggugggagcagga

SEQ ID NO: 2364530 - RNA, 14 nt, Human
aggugcuggaggug

SEQ ID NO: 2364531 - RNA, 17 nt, Human
aggugcuggagguggga

SEQ ID NO: 2364532 - RNA, 15 nt, Human
agguggaaauaaacu

SEQ ID NO: 2364533 - RNA, 14 nt, Human
aggucgaggcagga

SEQ ID NO: 2364534 - RNA, 21 nt, Human
aggucgaccccaaagccccuu

SEQ ID NO: 2364535 - RNA, 17 nt, Human
agguccuugcccuuugu

SEQ ID NO: 2364536 - RNA, 12 nt, Human
agguccuugccc

SEQ ID NO: 2364537 - RNA, 20 nt, Human
agguccugcagucuggcuga

SEQ ID NO: 2364538 - RNA, 21 nt, Human
agguccugcagucuggcugag

SEQ ID NO: 2364539 - RNA, 16 nt, Human
agguccuucugcugga

SEQ ID NO: 2364540 - RNA, 16 nt, Human
aggugcugccauccag

SEQ ID NO: 2364541 - RNA, 17 nt, Human
aggucggaggcuuggga

SEQ ID NO: 2364542 - RNA, 16 nt, Human
aggugcugacggccag

SEQ ID NO: 2364543 - RNA, 20 nt, Human
aggugcugacggccagggag

SEQ ID NO: 2364544 - RNA, 17 nt, Human
aggugcugacggccagg

SEQ ID NO: 2364545 - RNA, 17 nt, Human
aggugcugccauccagg

SEQ ID NO: 2364546 - RNA, 22 nt, Human
aggugcugcuacccucccugcu

SEQ ID NO: 2364547 - RNA, 23 nt, Human
aggugcugcuacccucccugcug

SEQ ID NO: 2364548 - RNA, 21 nt, Human
aggugcugagcaaagggaaca

SEQ ID NO: 2364549 - RNA, 20 nt, Human
aggugcugcuacccucccug

SEQ ID NO: 2364550 - RNA, 21 nt, Human
aggugcugcuacccucccugc

SEQ ID NO: 2364551 - RNA, 14 nt, Human
agguggcagcccug

SEQ ID NO: 2364552 - RNA, 13 nt, Human
agguggcagcccu

SEQ ID NO: 2364553 - RNA, 17 nt, Human
agguggcacuuuuucau

SEQ ID NO: 2364554 - RNA, 18 nt, Human
agguggcacuuuuucauu

SEQ ID NO: 2364555 - RNA, 19 nt, Human
agguggcacuuuuucauuu

SEQ ID NO: 2364556 - RNA, 23 nt, Human
agguggcacuuuuucauuugccu

SEQ ID NO: 2364557 - RNA, 15 nt, Human
agguggcagcccugu

SEQ ID NO: 2364558 - RNA, 14 nt, Human
agguggcaggacca

SEQ ID NO: 2364559 - RNA, 17 nt, Human
agguggcaggaccagga

SEQ ID NO: 2364560 - RNA, 22 nt, Human
agguggcaucagugucuuucca

SEQ ID NO: 2364561 - RNA, 15 nt, Human
agguuaauaaaguaa

SEQ ID NO: 2364562 - RNA, 19 nt, Human
agguggcaggaccaggacu

SEQ ID NO: 2364563 - RNA, 13 nt, Human
agguuaauauuua

SEQ ID NO: 2364564 - RNA, 23 nt, Human
agguggcaucagugucuuuccac

SEQ ID NO: 2364565 - RNA, 14 nt, Human
agguuaauguucau

SEQ ID NO: 2364566 - RNA, 15 nt, Human
agguuaauuccaauu

SEQ ID NO: 2364567 - RNA, 22 nt, Human
agguuaauuccaauuauaugag

SEQ ID NO: 2364568 - RNA, 17 nt, Human
agguucaaagauauuuu

SEQ ID NO: 2364569 - RNA, 14 nt, Human
agguuacaacagau

SEQ ID NO: 2364570 - RNA, 16 nt, Human
agguuaauauuuaaga

SEQ ID NO: 2364571 - RNA, 15 nt, Human
agguuacaacagauu

SEQ ID NO: 2364572 - RNA, 21 nt, Human
agguucaugccaccauggcca

SEQ ID NO: 2364573 - RNA, 15 nt, Human
agguucagccaaggu

SEQ ID NO: 2364574 - RNA, 19 nt, Human
agguucagccaagguuuua

SEQ ID NO: 2364575 - RNA, 17 nt, Human
agguucaugcaaacuuu

SEQ ID NO: 2364576 - RNA, 16 nt, Human
agguucacuaaagcag

SEQ ID NO: 2364577 - RNA, 13 nt, Human
agguucagccaag

SEQ ID NO: 2364578 - RNA, 16 nt, Human
agguucacgugcagcu

SEQ ID NO: 2364579 - RNA, 13 nt, Human
agguucagcuugu

SEQ ID NO: 2364580 - RNA, 14 nt, Human
agguucccaagcuc

SEQ ID NO: 2364581 - RNA, 17 nt, Human
agguuccaacuguauau

SEQ ID NO: 2364582 - RNA, 18 nt, Human
agguuccaacuguauaua

SEQ ID NO: 2364583 - RNA, 16 nt, Human
agguucccaagcucag

SEQ ID NO: 2364584 - RNA, 15 nt, Human
agguucccaagcuca

SEQ ID NO: 2364585 - RNA, 16 nt, Human
agguucccagagauga

SEQ ID NO: 2364586 - RNA, 11 nt, Human
agguucuaaaa

SEQ ID NO: 2364587 - RNA, 17 nt, Human
agguuccucugccugcc

SEQ ID NO: 2364588 - RNA, 18 nt, Human
agguuccucugccugccc

SEQ ID NO: 2364589 - RNA, 19 nt, Human
agguuccucugccugcccc

SEQ ID NO: 2364590 - RNA, 20 nt, Human
agguuccucugccugccccg

SEQ ID NO: 2364591 - RNA, 13 nt, Human
agguuccucugcc

SEQ ID NO: 2364592 - RNA, 16 nt, Human
agguucccucugagaa

SEQ ID NO: 2364593 - RNA, 14 nt, Human
agguuccucugccu

SEQ ID NO: 2364594 - RNA, 15 nt, Human
agguuccucugccug

SEQ ID NO: 2364595 - RNA, 16 nt, Human
agguuccucugccugc

SEQ ID NO: 2364596 - RNA, 21 nt, Human
agguaccacugauuuggagau

SEQ ID NO: 2364597 - RNA, 22 nt, Human
agguaccagcaauauguaaaua

SEQ ID NO: 2364598 - RNA, 13 nt, Human
agguaccagcugc

SEQ ID NO: 2364599 - RNA, 16 nt, Human
agguaccagcugcgcu

SEQ ID NO: 2364600 - RNA, 21 nt, Human
agguaauccaagauauuuuaa

SEQ ID NO: 2364601 - RNA, 17 nt, Human
aggucccuaauaaagcu

SEQ ID NO: 2364602 - RNA, 17 nt, Human
agguaccccuuucuggc

SEQ ID NO: 2364603 - RNA, 21 nt, Human
agguaccccuuucuggcucuc

SEQ ID NO: 2364604 - RNA, 23 nt, Human
agguaccagcugcgcuugcuuuu

SEQ ID NO: 2364605 - RNA, 18 nt, Human
aggucccuaauaaagcug

SEQ ID NO: 2364606 - RNA, 19 nt, Human
aggucccuaauaaagcugu

SEQ ID NO: 2364607 - RNA, 20 nt, Human
aggucccuaauaaagcugug

SEQ ID NO: 2364608 - RNA, 16 nt, Human
agguaccuuucacaua

SEQ ID NO: 2364609 - RNA, 19 nt, Human
agguaccuuucacauagag

SEQ ID NO: 2364610 - RNA, 18 nt, Human
agguaaucgaccugccuc

SEQ ID NO: 2364611 - RNA, 17 nt, Human
agguaaucgaccugccu

SEQ ID NO: 2364612 - RNA, 18 nt, Human
agguaauauaaaaagcuu

SEQ ID NO: 2364613 - RNA, 17 nt, Human
agguaaggaauaccugu

SEQ ID NO: 2364614 - RNA, 19 nt, Human
agguaagcaggaggaggug

SEQ ID NO: 2364615 - RNA, 16 nt, Human
agguaaggugaaggug

SEQ ID NO: 2364616 - RNA, 21 nt, Human
agguaagcaggaggaggugcc

SEQ ID NO: 2364617 - RNA, 17 nt, Human
aggggccgcugccaccc

SEQ ID NO: 2364618 - RNA, 22 nt, Human
agauagaaauaaauagcuauau

SEQ ID NO: 2364619 - RNA, 18 nt, Human
agauagaaauaaauagcu

SEQ ID NO: 2364620 - RNA, 15 nt, Human
agauagaaauaaaua

SEQ ID NO: 2364621 - RNA, 11 nt, Human
agauagaaaua

SEQ ID NO: 2364622 - RNA, 13 nt, Human
agauagccaaggc

SEQ ID NO: 2364623 - RNA, 20 nt, Human
agaguuaauauauagaaggg

SEQ ID NO: 2364624 - RNA, 20 nt, Human
agaguuaagaagcuguugua

SEQ ID NO: 2364625 - RNA, 21 nt, Human
agaguuaagaagcuguuguac

SEQ ID NO: 2364626 - RNA, 22 nt, Human
agaguuaacaaugauauaugga

SEQ ID NO: 2364627 - RNA, 12 nt, Human
agaguuaagaag

SEQ ID NO: 2364628 - RNA, 13 nt, Human
agaguuaagaagc

SEQ ID NO: 2364629 - RNA, 14 nt, Human
agaguuaagaagcu

SEQ ID NO: 2364630 - RNA, 15 nt, Human
agaguuaagaagcug

SEQ ID NO: 2364631 - RNA, 16 nt, Human
agaguuaagaagcugu

SEQ ID NO: 2364632 - RNA, 17 nt, Human
agaguuaagaagcuguu

SEQ ID NO: 2364633 - RNA, 18 nt, Human
agaguuaagaagcuguug

SEQ ID NO: 2364634 - RNA, 22 nt, Human
agauacuuggggggcugaggug

SEQ ID NO: 2364635 - RNA, 12 nt, Human
agaggggcagcc

SEQ ID NO: 2364636 - RNA, 16 nt, Human
agaggggcagaacagc

SEQ ID NO: 2364637 - RNA, 15 nt, Human
agaggggcagaacag

SEQ ID NO: 2364638 - RNA, 13 nt, Human
agaggggcagccc

SEQ ID NO: 2364639 - RNA, 14 nt, Human
agaggggcagcccu

SEQ ID NO: 2364640 - RNA, 15 nt, Human
agaggggcagcccuu

SEQ ID NO: 2364641 - RNA, 16 nt, Human
agaggggcagcccuug

SEQ ID NO: 2364642 - RNA, 18 nt, Human
agaggggcagcccuugcu

SEQ ID NO: 2364643 - RNA, 19 nt, Human
agaggggcagcccuugcuu

SEQ ID NO: 2364644 - RNA, 15 nt, Human
agaggggcaggcccu

SEQ ID NO: 2364645 - RNA, 18 nt, Human
agaggggcuuucuggaga

SEQ ID NO: 2364646 - RNA, 13 nt, Human
agaggggcugucc

SEQ ID NO: 2364647 - RNA, 21 nt, Human
agaggggcugaauagcagaag

SEQ ID NO: 2364648 - RNA, 23 nt, Human
agaggguggugaccucugccuga

SEQ ID NO: 2364649 - RNA, 13 nt, Human
agaggguuccugu

SEQ ID NO: 2364650 - RNA, 16 nt, Human
agagguaaaaguguga

SEQ ID NO: 2364651 - RNA, 18 nt, Human
agagguaaaagugugagc

SEQ ID NO: 2364652 - RNA, 19 nt, Human
agagguaaaagugugagca

SEQ ID NO: 2364653 - RNA, 20 nt, Human
agagguaaaagugugagcag

SEQ ID NO: 2364654 - RNA, 22 nt, Human
agagguaaaagugugagcagug

SEQ ID NO: 2364655 - RNA, 23 nt, Human
agagguaaaagugugagcaguga

SEQ ID NO: 2364656 - RNA, 16 nt, Human
agagguaacagaacag

SEQ ID NO: 2364657 - RNA, 17 nt, Human
agagguaacagaacagc

SEQ ID NO: 2364658 - RNA, 18 nt, Human
agagguaacagaacagcu

SEQ ID NO: 2364659 - RNA, 23 nt, Human
agaguuaaauagaguauaugcac

SEQ ID NO: 2364660 - RNA, 16 nt, Human
agaguuaacaaugaua

SEQ ID NO: 2364661 - RNA, 22 nt, Human
agagguaacagaacagcuucag

SEQ ID NO: 2364662 - RNA, 20 nt, Human
agagguaacagaacagcuuc

SEQ ID NO: 2364663 - RNA, 14 nt, Human
agaggauggccagu

SEQ ID NO: 2364664 - RNA, 20 nt, Human
agaggaugagcucuacccag

SEQ ID NO: 2364665 - RNA, 22 nt, Human
agaggaugagagcccagaggua

SEQ ID NO: 2364666 - RNA, 15 nt, Human
agaggauggccagug

SEQ ID NO: 2364667 - RNA, 16 nt, Human
agaggauggccagugu

SEQ ID NO: 2364668 - RNA, 18 nt, Human
agaggauggccagugucu

SEQ ID NO: 2364669 - RNA, 20 nt, Human
agaggaugaauguaugugca

SEQ ID NO: 2364670 - RNA, 21 nt, Human
agaggaugaauguaugugcac

SEQ ID NO: 2364671 - RNA, 22 nt, Human
agaggaugaauguaugugcacu

SEQ ID NO: 2364672 - RNA, 13 nt, Human
agaggaugagagc

SEQ ID NO: 2364673 - RNA, 14 nt, Human
agaggaugagagcc

SEQ ID NO: 2364674 - RNA, 17 nt, Human
agaggaugagagcccag

SEQ ID NO: 2364675 - RNA, 18 nt, Human
agaggaugagagcccaga

SEQ ID NO: 2364676 - RNA, 18 nt, Human
agaggauuuuuuucugag

SEQ ID NO: 2364677 - RNA, 22 nt, Human
agaggauggccagugucugucc

SEQ ID NO: 2364678 - RNA, 16 nt, Human
agaggggaaaagagau

SEQ ID NO: 2364679 - RNA, 19 nt, Human
agaggauuuuuuucugagc

SEQ ID NO: 2364680 - RNA, 20 nt, Human
agaggauuuuuuucugagcg

SEQ ID NO: 2364681 - RNA, 22 nt, Human
agagggcuuccucuagaagcca

SEQ ID NO: 2364682 - RNA, 20 nt, Human
agaggggaauaauagaagaa

SEQ ID NO: 2364683 - RNA, 19 nt, Human
agaggggaauaauagaaga

SEQ ID NO: 2364684 - RNA, 20 nt, Human
agaggggacaaaacccaccu

SEQ ID NO: 2364685 - RNA, 22 nt, Human
agaggggaaaccaguguagccu

SEQ ID NO: 2364686 - RNA, 22 nt, Human
agaggggaagaguguacugggg

SEQ ID NO: 2364687 - RNA, 16 nt, Human
agaggggaagggccag

SEQ ID NO: 2364688 - RNA, 16 nt, Human
agaggggaagagacuu

SEQ ID NO: 2364689 - RNA, 22 nt, Human
agaggggaacagacuggaagca

SEQ ID NO: 2364690 - RNA, 13 nt, Human
agagggcuuccuc

SEQ ID NO: 2364691 - RNA, 17 nt, Human
agagggcuuuaauuuuu

SEQ ID NO: 2364692 - RNA, 18 nt, Human
agaggggaaaagagauga

SEQ ID NO: 2364693 - RNA, 13 nt, Human
agaggagaggggc

SEQ ID NO: 2364694 - RNA, 16 nt, Human
agaggagaggagagag

SEQ ID NO: 2364695 - RNA, 17 nt, Human
agaggagaggagagagg

SEQ ID NO: 2364696 - RNA, 21 nt, Human
agaggagagccagagaaguga

SEQ ID NO: 2364697 - RNA, 23 nt, Human
agaggagagccagagaagugaca

SEQ ID NO: 2364698 - RNA, 12 nt, Human
agaggagaggag

SEQ ID NO: 2364699 - RNA, 15 nt, Human
agaggagaggagaga

SEQ ID NO: 2364700 - RNA, 14 nt, Human
agaggaguucaaug

SEQ ID NO: 2364701 - RNA, 15 nt, Human
agaggaguucaauga

SEQ ID NO: 2364702 - RNA, 16 nt, Human
agaggaguucaaugau

SEQ ID NO: 2364703 - RNA, 17 nt, Human
agaggaguucaaugauc

SEQ ID NO: 2364704 - RNA, 18 nt, Human
agaggaguucaaugaucu

SEQ ID NO: 2364705 - RNA, 19 nt, Human
agaggaguucaaugaucua

SEQ ID NO: 2364706 - RNA, 23 nt, Human
agaggaguucaaugaucuagguu

SEQ ID NO: 2364707 - RNA, 13 nt, Human
agaggagagccag

SEQ ID NO: 2364708 - RNA, 14 nt, Human
agaggagagccaga

SEQ ID NO: 2364709 - RNA, 15 nt, Human
agaggagagccagag

SEQ ID NO: 2364710 - RNA, 16 nt, Human
agaggagagccagaga

SEQ ID NO: 2364711 - RNA, 17 nt, Human
agaggagagccagagaa

SEQ ID NO: 2364712 - RNA, 15 nt, Human
agauaguuacuauau

SEQ ID NO: 2364713 - RNA, 17 nt, Human
agauaguagcauacauu

SEQ ID NO: 2364714 - RNA, 18 nt, Human
agauaguacauaaaggug

SEQ ID NO: 2364715 - RNA, 14 nt, Human
agauaguacauaaa

SEQ ID NO: 2364716 - RNA, 15 nt, Human
agauagguaaauacc

SEQ ID NO: 2364717 - RNA, 19 nt, Human
agauaguaucuagcaauca

SEQ ID NO: 2364718 - RNA, 22 nt, Human
agauaguaucuagcaaucacaa

SEQ ID NO: 2364719 - RNA, 19 nt, Human
agauagcauugugaacuga

SEQ ID NO: 2364720 - RNA, 22 nt, Human
agauagcauugugaacugacag

SEQ ID NO: 2364721 - RNA, 14 nt, Human
agauagcauuguga

SEQ ID NO: 2364722 - RNA, 16 nt, Human
agauagcauugugaac

SEQ ID NO: 2364723 - RNA, 17 nt, Human
agauagcauugugaacu

SEQ ID NO: 2364724 - RNA, 18 nt, Human
agauagcauugugaacug

SEQ ID NO: 2364725 - RNA, 21 nt, Human
agauaggucagugcaaauacu

SEQ ID NO: 2364726 - RNA, 15 nt, Human
agauagccaaggcca

SEQ ID NO: 2364727 - RNA, 16 nt, Human
agauagccaaggccaa

SEQ ID NO: 2364728 - RNA, 14 nt, Human
agaugaccccuccc

SEQ ID NO: 2364729 - RNA, 18 nt, Human
agaucuguuuugaaggca

SEQ ID NO: 2364730 - RNA, 13 nt, Human
agaucuuaaauuu

SEQ ID NO: 2364731 - RNA, 14 nt, Human
agaucuuaaauuuu

SEQ ID NO: 2364732 - RNA, 16 nt, Human
agaucuuaaauuuugu

SEQ ID NO: 2364733 - RNA, 15 nt, Human
agaugacugaguccu

SEQ ID NO: 2364734 - RNA, 14 nt, Human
agaugacugagucc

SEQ ID NO: 2364735 - RNA, 23 nt, Human
agauggcugugccucugccuguc

SEQ ID NO: 2364736 - RNA, 14 nt, Human
agaugggaaugaag

SEQ ID NO: 2364737 - RNA, 15 nt, Human
agaugggaaugaagc

SEQ ID NO: 2364738 - RNA, 16 nt, Human
agaugggaaugaagcu

SEQ ID NO: 2364739 - RNA, 17 nt, Human
agaugggaaugaagcuu

SEQ ID NO: 2364740 - RNA, 18 nt, Human
agaugggaaugaagcuug

SEQ ID NO: 2364741 - RNA, 23 nt, Human
agaugggaaugaagcuuguguau

SEQ ID NO: 2364742 - RNA, 13 nt, Human
agaugggaaugag

SEQ ID NO: 2364743 - RNA, 18 nt, Human
agaugggaaugagguggg

SEQ ID NO: 2364744 - RNA, 13 nt, Human
agaugagcuuuuc

SEQ ID NO: 2364745 - RNA, 16 nt, Human
agaugagcuuuucuag

SEQ ID NO: 2364746 - RNA, 16 nt, Human
agaucugugccccaug

SEQ ID NO: 2364747 - RNA, 14 nt, Human
agaucugugcccca

SEQ ID NO: 2364748 - RNA, 13 nt, Human
agaucugugcccc

SEQ ID NO: 2364749 - RNA, 12 nt, Human
agaucugugccc

SEQ ID NO: 2364750 - RNA, 19 nt, Human
agaucugugccccaugccu

SEQ ID NO: 2364751 - RNA, 14 nt, Human
agaucuguuuugaa

SEQ ID NO: 2364752 - RNA, 21 nt, Human
agaucuguuuugaaggcaaaa

SEQ ID NO: 2364753 - RNA, 23 nt, Human
agaucuguccucagccuugccag

SEQ ID NO: 2364754 - RNA, 19 nt, Human
agaucuguccucagccuug

SEQ ID NO: 2364755 - RNA, 19 nt, Human
agacguguggcaauagugg

SEQ ID NO: 2364756 - RNA, 13 nt, Human
agacuaagcccug

SEQ ID NO: 2364757 - RNA, 14 nt, Human
agacuaagcccugu

SEQ ID NO: 2364758 - RNA, 15 nt, Human
agacuaagcccuguc

SEQ ID NO: 2364759 - RNA, 14 nt, Human
agacuagaauucua

SEQ ID NO: 2364760 - RNA, 17 nt, Human
agacuagaauucuagug

SEQ ID NO: 2364761 - RNA, 19 nt, Human
agacuagaauucuagugcu

SEQ ID NO: 2364762 - RNA, 14 nt, Human
agacuaauuuaaaa

SEQ ID NO: 2364763 - RNA, 23 nt, Human
agacuaagcccugucgagacacu

SEQ ID NO: 2364764 - RNA, 19 nt, Human
agacuaauuccugcccugc

SEQ ID NO: 2364765 - RNA, 15 nt, Human
agacuaauuuaaaaa

SEQ ID NO: 2364766 - RNA, 14 nt, Human
agacguguuugugu

SEQ ID NO: 2364767 - RNA, 18 nt, Human
agacgggggcagagaggg

SEQ ID NO: 2364768 - RNA, 19 nt, Human
agacggagucccaccuugg

SEQ ID NO: 2364769 - RNA, 16 nt, Human
agacggcacccaccca

SEQ ID NO: 2364770 - RNA, 14 nt, Human
agacggauugcauu

SEQ ID NO: 2364771 - RNA, 15 nt, Human
agacggagucucgcu

SEQ ID NO: 2364772 - RNA, 20 nt, Human
agacggagucucgcucuguc

SEQ ID NO: 2364773 - RNA, 20 nt, Human
agacuagaauucuagugcug

SEQ ID NO: 2364774 - RNA, 23 nt, Human
agaccaaggcgggagcaucucuu

SEQ ID NO: 2364775 - RNA, 17 nt, Human
agaccaaggcgggagca

SEQ ID NO: 2364776 - RNA, 14 nt, Human
agaccaaggcggga

SEQ ID NO: 2364777 - RNA, 16 nt, Human
agaccaagcuugucca

SEQ ID NO: 2364778 - RNA, 17 nt, Human
agaccaagacucugaaa

SEQ ID NO: 2364779 - RNA, 19 nt, Human
agacacaacaacuccuagg

SEQ ID NO: 2364780 - RNA, 13 nt, Human
agaccaagcuugu

SEQ ID NO: 2364781 - RNA, 14 nt, Human
agaccaaccugacc

SEQ ID NO: 2364782 - RNA, 21 nt, Human
agaccacaggguucaaaaugu

SEQ ID NO: 2364783 - RNA, 20 nt, Human
agaccacaggguucaaaaug

SEQ ID NO: 2364784 - RNA, 14 nt, Human
agaccacaaauagu

SEQ ID NO: 2364785 - RNA, 21 nt, Human
agaccacaaauagugcucgcu

SEQ ID NO: 2364786 - RNA, 16 nt, Human
agaccacaaaaauuga

SEQ ID NO: 2364787 - RNA, 16 nt, Human
agaccaccacuucgaa

SEQ ID NO: 2364788 - RNA, 15 nt, Human
agaccaccaccucag

SEQ ID NO: 2364789 - RNA, 13 nt, Human
agaccacaucuuu

SEQ ID NO: 2364790 - RNA, 23 nt, Human
agaccacaucuuuaucuguucuu

SEQ ID NO: 2364791 - RNA, 18 nt, Human
agacagcccgggcucugc

SEQ ID NO: 2364792 - RNA, 20 nt, Human
agacagcccgggcucugccu

SEQ ID NO: 2364793 - RNA, 16 nt, Human
agacagcccgggcucu

SEQ ID NO: 2364794 - RNA, 14 nt, Human
agacacaacuauuu

SEQ ID NO: 2364795 - RNA, 17 nt, Human
agacagcccgggcucug

SEQ ID NO: 2364796 - RNA, 15 nt, Human
agaccauagugacca

SEQ ID NO: 2364797 - RNA, 23 nt, Human
agaccaguugggagcacuggagu

SEQ ID NO: 2364798 - RNA, 13 nt, Human
agaccauaauguu

SEQ ID NO: 2364799 - RNA, 21 nt, Human
agaccaguugggagcacugga

SEQ ID NO: 2364800 - RNA, 22 nt, Human
agaccaguugggagcacuggag

SEQ ID NO: 2364801 - RNA, 13 nt, Human
agaccaucccuga

SEQ ID NO: 2364802 - RNA, 15 nt, Human
agaccagggagccuu

SEQ ID NO: 2364803 - RNA, 16 nt, Human
agaccaggcaaagcaa

SEQ ID NO: 2364804 - RNA, 16 nt, Human
agaccaccaccucaga

SEQ ID NO: 2364805 - RNA, 17 nt, Human
agaccaggcaaagcaag

SEQ ID NO: 2364806 - RNA, 14 nt, Human
agaccagucuggcc

SEQ ID NO: 2364807 - RNA, 13 nt, Human
agaccaguuggga

SEQ ID NO: 2364808 - RNA, 18 nt, Human
agaccaguugggagcacu

SEQ ID NO: 2364809 - RNA, 19 nt, Human
agaccaguugggagcacug

SEQ ID NO: 2364810 - RNA, 20 nt, Human
agaccaguugggagcacugg

SEQ ID NO: 2364811 - RNA, 14 nt, Human
agaccaucccugaa

SEQ ID NO: 2364812 - RNA, 17 nt, Human
agaccaucccugaaggc

SEQ ID NO: 2364813 - RNA, 18 nt, Human
agaccaucccugaaggcc

SEQ ID NO: 2364814 - RNA, 21 nt, Human
agaccaucccugaaggccccg

SEQ ID NO: 2364815 - RNA, 15 nt, Human
agacacaacaacucc

SEQ ID NO: 2364816 - RNA, 18 nt, Human
agacacaacaacuccuag

SEQ ID NO: 2364817 - RNA, 21 nt, Human
agacaauuuauuauggcacau

SEQ ID NO: 2364818 - RNA, 15 nt, Human
agacaauuuauuaug

SEQ ID NO: 2364819 - RNA, 19 nt, Human
agacaaugacuuacuguac

SEQ ID NO: 2364820 - RNA, 17 nt, Human
agacaaugacuuacugu

SEQ ID NO: 2364821 - RNA, 13 nt, Human
agacaaugacuua

SEQ ID NO: 2364822 - RNA, 23 nt, Human
agacugaguacguugugcauuug

SEQ ID NO: 2364823 - RNA, 18 nt, Human
agagaaaggggagcccac

SEQ ID NO: 2364824 - RNA, 21 nt, Human
agagaaaggggagcccacugu

SEQ ID NO: 2364825 - RNA, 19 nt, Human
agagaaaggggagcccacu

SEQ ID NO: 2364826 - RNA, 18 nt, Human
agagaaagcacgugucuc

SEQ ID NO: 2364827 - RNA, 13 nt, Human
agagaaagccagg

SEQ ID NO: 2364828 - RNA, 14 nt, Human
agagaaagccaggc

SEQ ID NO: 2364829 - RNA, 16 nt, Human
agagaaagccaggcag

SEQ ID NO: 2364830 - RNA, 17 nt, Human
agagaaagccaggcagg

SEQ ID NO: 2364831 - RNA, 19 nt, Human
agagaaagccaggcaggua

SEQ ID NO: 2364832 - RNA, 22 nt, Human
agagaaagccaggcagguagcc

SEQ ID NO: 2364833 - RNA, 17 nt, Human
agacugcauuauauuua

SEQ ID NO: 2364834 - RNA, 15 nt, Human
agagaaagaagagac

SEQ ID NO: 2364835 - RNA, 16 nt, Human
agagaaagaagagaca

SEQ ID NO: 2364836 - RNA, 17 nt, Human
agagaaagaagagacag

SEQ ID NO: 2364837 - RNA, 13 nt, Human
agagaaagagaga

SEQ ID NO: 2364838 - RNA, 21 nt, Human
agagaagagauugugguuuca

SEQ ID NO: 2364839 - RNA, 10 nt, Human
agagaagaga

SEQ ID NO: 2364840 - RNA, 12 nt, Human
agagaaagggga

SEQ ID NO: 2364841 - RNA, 23 nt, Human
agagaaaggggagcccacugucc

SEQ ID NO: 2364842 - RNA, 18 nt, Human
agagaaaguacuucucca

SEQ ID NO: 2364843 - RNA, 12 nt, Human
agagaagaggcu

SEQ ID NO: 2364844 - RNA, 18 nt, Human
agagaggacgugggcggc

SEQ ID NO: 2364845 - RNA, 17 nt, Human
agagaggaaucagacuu

SEQ ID NO: 2364846 - RNA, 13 nt, Human
agagaggacagcu

SEQ ID NO: 2364847 - RNA, 14 nt, Human
agagaggaaucaga

SEQ ID NO: 2364848 - RNA, 23 nt, Human
agagaggaaagguuugagaagca

SEQ ID NO: 2364849 - RNA, 18 nt, Human
agagagcuuaaugauaau

SEQ ID NO: 2364850 - RNA, 23 nt, Human
agagagcuucuguugcugccuca

SEQ ID NO: 2364851 - RNA, 20 nt, Human
agagagcuucuguugcugcc

SEQ ID NO: 2364852 - RNA, 12 nt, Human
agagaaggggag

SEQ ID NO: 2364853 - RNA, 18 nt, Human
agagaaggccucccuagc

SEQ ID NO: 2364854 - RNA, 20 nt, Human
agagaaggcaggaaugugug

SEQ ID NO: 2364855 - RNA, 13 nt, Human
agagaaggcagga

SEQ ID NO: 2364856 - RNA, 12 nt, Human
agagaaggcagg

SEQ ID NO: 2364857 - RNA, 15 nt, Human
agagaaggggaggag

SEQ ID NO: 2364858 - RNA, 17 nt, Human
agagagcuguucccaaa

SEQ ID NO: 2364859 - RNA, 16 nt, Human
agagagcuucuguugc

SEQ ID NO: 2364860 - RNA, 20 nt, Human
agagaagcuaaaaccugagc

SEQ ID NO: 2364861 - RNA, 13 nt, Human
agagaaggagcca

SEQ ID NO: 2364862 - RNA, 12 nt, Human
agagaaggagcc

SEQ ID NO: 2364863 - RNA, 23 nt, Human
agagaagccccuuccccauggga

SEQ ID NO: 2364864 - RNA, 13 nt, Human
agagaagccugug

SEQ ID NO: 2364865 - RNA, 16 nt, Human
agagaagcaaguggug

SEQ ID NO: 2364866 - RNA, 13 nt, Human
agagaagccccuu

SEQ ID NO: 2364867 - RNA, 17 nt, Human
agagaagccccuucccc

SEQ ID NO: 2364868 - RNA, 20 nt, Human
agagaagccccuuccccaug

SEQ ID NO: 2364869 - RNA, 23 nt, Human
agagaggucaagcccaggaggac

SEQ ID NO: 2364870 - RNA, 20 nt, Human
agagagguuauagaguagaa

SEQ ID NO: 2364871 - RNA, 22 nt, Human
agagaggucaagcccaggagga

SEQ ID NO: 2364872 - RNA, 15 nt, Human
agagaggagaggaga

SEQ ID NO: 2364873 - RNA, 18 nt, Human
agagaggagaaacacauc

SEQ ID NO: 2364874 - RNA, 13 nt, Human
agagaggagagga

SEQ ID NO: 2364875 - RNA, 16 nt, Human
agagaggagaaacaca

SEQ ID NO: 2364876 - RNA, 14 nt, Human
agagaggagaaaca

SEQ ID NO: 2364877 - RNA, 23 nt, Human
agagaggguggugaccucugccu

SEQ ID NO: 2364878 - RNA, 14 nt, Human
agagaguggcuccu

SEQ ID NO: 2364879 - RNA, 16 nt, Human
agagaguggcuccucc

SEQ ID NO: 2364880 - RNA, 22 nt, Human
agagaguaauggguuucauauu

SEQ ID NO: 2364881 - RNA, 15 nt, Human
agagagucccacugc

SEQ ID NO: 2364882 - RNA, 18 nt, Human
agagagucccacugccuc

SEQ ID NO: 2364883 - RNA, 20 nt, Human
agagagucccacugccucag

SEQ ID NO: 2364884 - RNA, 21 nt, Human
agagagucccacugccucagg

SEQ ID NO: 2364885 - RNA, 23 nt, Human
agagagucccacugccucagguu

SEQ ID NO: 2364886 - RNA, 15 nt, Human
agagaguccucugga

SEQ ID NO: 2364887 - RNA, 14 nt, Human
agagccccagcuga

SEQ ID NO: 2364888 - RNA, 15 nt, Human
agagccccagcugac

SEQ ID NO: 2364889 - RNA, 16 nt, Human
agagccccagcugaca

SEQ ID NO: 2364890 - RNA, 17 nt, Human
agagcccgggagcugcu

SEQ ID NO: 2364891 - RNA, 15 nt, Human
agagccccacacgga

SEQ ID NO: 2364892 - RNA, 16 nt, Human
agagaguccucuggau

SEQ ID NO: 2364893 - RNA, 22 nt, Human
agagaguccucuggauggcacc

SEQ ID NO: 2364894 - RNA, 17 nt, Human
agagccccacacggagg

SEQ ID NO: 2364895 - RNA, 13 nt, Human
agagccccagcug

SEQ ID NO: 2364896 - RNA, 16 nt, Human
agagccuggugcugcu

SEQ ID NO: 2364897 - RNA, 18 nt, Human
agagccuggugcugcugc

SEQ ID NO: 2364898 - RNA, 17 nt, Human
agagccuggagaagcug

SEQ ID NO: 2364899 - RNA, 13 nt, Human
agagccuggagaa

SEQ ID NO: 2364900 - RNA, 14 nt, Human
agagccuggagaag

SEQ ID NO: 2364901 - RNA, 15 nt, Human
agagccuggagaagc

SEQ ID NO: 2364902 - RNA, 16 nt, Human
agagccuggagaagcu

SEQ ID NO: 2364903 - RNA, 13 nt, Human
agagccugcuggc

SEQ ID NO: 2364904 - RNA, 19 nt, Human
agagccugcuggcacccac

SEQ ID NO: 2364905 - RNA, 24 nt, Human
agagccugcuggcacccaccgugg

SEQ ID NO: 2364906 - RNA, 17 nt, Human
agagccugcugcauggg

SEQ ID NO: 2364907 - RNA, 12 nt, Human
agagccugcugg

SEQ ID NO: 2364908 - RNA, 13 nt, Human
agcaugaggaacu

SEQ ID NO: 2364909 - RNA, 14 nt, Human
agcaugcacaaauu

SEQ ID NO: 2364910 - RNA, 12 nt, Human
agcaugccugga

SEQ ID NO: 2364911 - RNA, 19 nt, Human
agccaaagcuaggccuggc

SEQ ID NO: 2364912 - RNA, 20 nt, Human
agccaaagcuaggccuggcc

SEQ ID NO: 2364913 - RNA, 23 nt, Human
agccaaagcuaggccuggccaga

SEQ ID NO: 2364914 - RNA, 12 nt, Human
agcaucuucugg

SEQ ID NO: 2364915 - RNA, 22 nt, Human
agcaucuuccagaagugugauu

SEQ ID NO: 2364916 - RNA, 23 nt, Human
agcaucuuccagaagugugauug

SEQ ID NO: 2364917 - RNA, 23 nt, Human
agcaucuucacuucuaaaugcau

SEQ ID NO: 2364918 - RNA, 20 nt, Human
agcaucuucacuucuaaaug

SEQ ID NO: 2364919 - RNA, 17 nt, Human
agcaucuuccagaagug

SEQ ID NO: 2364920 - RNA, 20 nt, Human
agcaucuuccagaaguguga

SEQ ID NO: 2364921 - RNA, 18 nt, Human
agcaucuucacuucuaaa

SEQ ID NO: 2364922 - RNA, 14 nt, Human
agcaugaaaaagca

SEQ ID NO: 2364923 - RNA, 13 nt, Human
agcaugaaaaagc

SEQ ID NO: 2364924 - RNA, 15 nt, Human
agcaucuucuggagu

SEQ ID NO: 2364925 - RNA, 19 nt, Human
agcaucuuggggggguggc

SEQ ID NO: 2364926 - RNA, 21 nt, Human
agcaucuuggggggguggccg

SEQ ID NO: 2364927 - RNA, 23 nt, Human
agcaucuuggggggguggccgcu

SEQ ID NO: 2364928 - RNA, 14 nt, Human
agccaagggaaagg

SEQ ID NO: 2364929 - RNA, 20 nt, Human
agccaaggccgaagcucugg

SEQ ID NO: 2364930 - RNA, 22 nt, Human
agccaaggccgaagcucuggcu

SEQ ID NO: 2364931 - RNA, 23 nt, Human
agccaaggcccugaguuggcagu

SEQ ID NO: 2364932 - RNA, 23 nt, Human
agccaaggccaaaggaagcacau

SEQ ID NO: 2364933 - RNA, 22 nt, Human
agccaaggccaaaggaagcaca

SEQ ID NO: 2364934 - RNA, 20 nt, Human
agccaaggccaaaggaagca

SEQ ID NO: 2364935 - RNA, 16 nt, Human
agccaagggaaagggg

SEQ ID NO: 2364936 - RNA, 23 nt, Human
agccaagggaaaggggugcuuuu

SEQ ID NO: 2364937 - RNA, 11 nt, Human
agccagaggcu

SEQ ID NO: 2364938 - RNA, 14 nt, Human
agccagaggcuggg

SEQ ID NO: 2364939 - RNA, 20 nt, Human
agccagaggagagaggaccc

SEQ ID NO: 2364940 - RNA, 13 nt, Human
agccagaggucug

SEQ ID NO: 2364941 - RNA, 15 nt, Human
agccagaggcugggu

SEQ ID NO: 2364942 - RNA, 18 nt, Human
agccagaggcuggguuca

SEQ ID NO: 2364943 - RNA, 20 nt, Human
agccaagggaaaggggugcu

SEQ ID NO: 2364944 - RNA, 15 nt, Human
agccagaguuccugc

SEQ ID NO: 2364945 - RNA, 12 nt, Human
agccagauccuc

SEQ ID NO: 2364946 - RNA, 14 nt, Human
agccagauccucuu

SEQ ID NO: 2364947 - RNA, 15 nt, Human
agccagauccucuug

SEQ ID NO: 2364948 - RNA, 16 nt, Human
agccagauccucuugg

SEQ ID NO: 2364949 - RNA, 22 nt, Human
agccagauggacuccagccugc

SEQ ID NO: 2364950 - RNA, 14 nt, Human
agcccaaagaagga

SEQ ID NO: 2364951 - RNA, 16 nt, Human
agcccaaagaaggaaa

SEQ ID NO: 2364952 - RNA, 14 nt, Human
agccauuucuuguu

SEQ ID NO: 2364953 - RNA, 21 nt, Human
agccauuggcuauuuaaaacu

SEQ ID NO: 2364954 - RNA, 22 nt, Human
agccauuggcuauuuaaaacuu

SEQ ID NO: 2364955 - RNA, 12 nt, Human
agccauugucuu

SEQ ID NO: 2364956 - RNA, 17 nt, Human
agccauugucuucggaa

SEQ ID NO: 2364957 - RNA, 18 nt, Human
agccauuguuggcuuucc

SEQ ID NO: 2364958 - RNA, 20 nt, Human
agccauuaccauggagacaa

SEQ ID NO: 2364959 - RNA, 18 nt, Human
agccauuaccauggagac

SEQ ID NO: 2364960 - RNA, 17 nt, Human
agccauucugacucaua

SEQ ID NO: 2364961 - RNA, 22 nt, Human
agccauuccugguacccagcca

SEQ ID NO: 2364962 - RNA, 23 nt, Human
agccauuccugguacccagccau

SEQ ID NO: 2364963 - RNA, 24 nt, Human
agccagcaaugauguccagaagaa

SEQ ID NO: 2364964 - RNA, 14 nt, Human
agccauucacugcc

SEQ ID NO: 2364965 - RNA, 12 nt, Human
agccauuccugg

SEQ ID NO: 2364966 - RNA, 20 nt, Human
agccauuccugguacccagc

SEQ ID NO: 2364967 - RNA, 13 nt, Human
agccagcacacag

SEQ ID NO: 2364968 - RNA, 23 nt, Human
agccagcaaugauguccagaaga

SEQ ID NO: 2364969 - RNA, 22 nt, Human
agccagcaaugauguccagaag

SEQ ID NO: 2364970 - RNA, 17 nt, Human
agccagauccucuuggu

SEQ ID NO: 2364971 - RNA, 15 nt, Human
agccagauuuuccug

SEQ ID NO: 2364972 - RNA, 19 nt, Human
agccagauuuuccugaaaa

SEQ ID NO: 2364973 - RNA, 13 nt, Human
agcaguuguguca

SEQ ID NO: 2364974 - RNA, 23 nt, Human
agcaguugagucgucaucacuuu

SEQ ID NO: 2364975 - RNA, 15 nt, Human
agaugggacugggag

SEQ ID NO: 2364976 - RNA, 19 nt, Human
agaugggacugggagggcc

SEQ ID NO: 2364977 - RNA, 22 nt, Human
agauguaauuguuugucuuuaa

SEQ ID NO: 2364978 - RNA, 21 nt, Human
agaugggagaaucacuugaac

SEQ ID NO: 2364979 - RNA, 14 nt, Human
agauguagaggaga

SEQ ID NO: 2364980 - RNA, 14 nt, Human
agcacuaaagcagu

SEQ ID NO: 2364981 - RNA, 13 nt, Human
agcacuaaagcag

SEQ ID NO: 2364982 - RNA, 16 nt, Human
agcacuaacguaaaua

SEQ ID NO: 2364983 - RNA, 12 nt, Human
agcacugcccaa

SEQ ID NO: 2364984 - RNA, 23 nt, Human
agcacuaaagcaguggacaccag

SEQ ID NO: 2364985 - RNA, 20 nt, Human
agcacuaaagcaguggacac

SEQ ID NO: 2364986 - RNA, 17 nt, Human
agcacuaaagcagugga

SEQ ID NO: 2364987 - RNA, 16 nt, Human
agcacuaaagcagugg

SEQ ID NO: 2364988 - RNA, 19 nt, Human
agcacuaaggugugcucug

SEQ ID NO: 2364989 - RNA, 21 nt, Human
agcagccacauuccugaugcu

SEQ ID NO: 2364990 - RNA, 15 nt, Human
agcacuggccugcac

SEQ ID NO: 2364991 - RNA, 17 nt, Human
agcacuggccugcacgg

SEQ ID NO: 2364992 - RNA, 13 nt, Human
agcacuggcucuc

SEQ ID NO: 2364993 - RNA, 14 nt, Human
agcacuggcucucu

SEQ ID NO: 2364994 - RNA, 17 nt, Human
agcacuggcucucucca

SEQ ID NO: 2364995 - RNA, 18 nt, Human
agcacuggcucucuccag

SEQ ID NO: 2364996 - RNA, 19 nt, Human
agcacuggcucucuccagg

SEQ ID NO: 2364997 - RNA, 20 nt, Human
agcacuggcucucuccagga

SEQ ID NO: 2364998 - RNA, 17 nt, Human
agcacugcuugaggaaa

SEQ ID NO: 2364999 - RNA, 21 nt, Human
agcacugcuaggcgagugcca

SEQ ID NO: 2365000 - RNA, 22 nt, Human
agcacugcuaggcgagugccag

SEQ ID NO: 2365001 - RNA, 23 nt, Human
agcacugcuaggcgagugccagg

SEQ ID NO: 2365002 - RNA, 16 nt, Human
agcacuggagugcagg

SEQ ID NO: 2365003 - RNA, 17 nt, Human
agcacuggagugcaggg

SEQ ID NO: 2365004 - RNA, 19 nt, Human
agcacuggagugcagggag

SEQ ID NO: 2365005 - RNA, 20 nt, Human
agcacuggagugcagggagg

SEQ ID NO: 2365006 - RNA, 22 nt, Human
agcacuggagugcagggaggag

SEQ ID NO: 2365007 - RNA, 23 nt, Human
agcacuggagugcagggaggaga

SEQ ID NO: 2365008 - RNA, 12 nt, Human
agcacuggccug

SEQ ID NO: 2365009 - RNA, 13 nt, Human
agcacuggccugc

SEQ ID NO: 2365010 - RNA, 14 nt, Human
agcagcccuccuca

SEQ ID NO: 2365011 - RNA, 13 nt, Human
agcagcccuccuc

SEQ ID NO: 2365012 - RNA, 12 nt, Human
agcagcccuccu

SEQ ID NO: 2365013 - RNA, 14 nt, Human
agcagcccuaagga

SEQ ID NO: 2365014 - RNA, 18 nt, Human
agcagcccuaaggaucuc

SEQ ID NO: 2365015 - RNA, 20 nt, Human
agcagccaucauaggaaggg

SEQ ID NO: 2365016 - RNA, 21 nt, Human
agcagcccgcugaguggacug

SEQ ID NO: 2365017 - RNA, 19 nt, Human
agcagccagcucucagcca

SEQ ID NO: 2365018 - RNA, 18 nt, Human
agcagccagcucucagcc

SEQ ID NO: 2365019 - RNA, 17 nt, Human
agcagccagcucucagc

SEQ ID NO: 2365020 - RNA, 16 nt, Human
agcagccagcucucag

SEQ ID NO: 2365021 - RNA, 23 nt, Human
agcagccagcucucagccaacga

SEQ ID NO: 2365022 - RNA, 19 nt, Human
agcagccaucauaggaagg

SEQ ID NO: 2365023 - RNA, 15 nt, Human
agcagccagcucuca

SEQ ID NO: 2365024 - RNA, 14 nt, Human
agcagccagcucuc

SEQ ID NO: 2365025 - RNA, 13 nt, Human
agcagccagcucu

SEQ ID NO: 2365026 - RNA, 13 nt, Human
agcagccacgagg

SEQ ID NO: 2365027 - RNA, 10 nt, Human
agcagccacg

SEQ ID NO: 2365028 - RNA, 23 nt, Human
agcagucuacccaccucagccuc

SEQ ID NO: 2365029 - RNA, 19 nt, Human
agcagucgugccugugucc

SEQ ID NO: 2365030 - RNA, 21 nt, Human
agcagucgugccuguguccau

SEQ ID NO: 2365031 - RNA, 21 nt, Human
agcagucuacccaccucagcc

SEQ ID NO: 2365032 - RNA, 20 nt, Human
agcagugaaugauucagugu

SEQ ID NO: 2365033 - RNA, 22 nt, Human
agcagugagccgcaucuucucc

SEQ ID NO: 2365034 - RNA, 14 nt, Human
agcagugagccgca

SEQ ID NO: 2365035 - RNA, 16 nt, Human
agcagugagucucuuc

SEQ ID NO: 2365036 - RNA, 23 nt, Human
agcagugaguuacagcgagaggc

SEQ ID NO: 2365037 - RNA, 22 nt, Human
agcagugaaugauucaguguua

SEQ ID NO: 2365038 - RNA, 21 nt, Human
agcagugaaugauucaguguu

SEQ ID NO: 2365039 - RNA, 17 nt, Human
agcagugaaaacaagug

SEQ ID NO: 2365040 - RNA, 16 nt, Human
agcagugagaaaaagc

SEQ ID NO: 2365041 - RNA, 21 nt, Human
agcagugagaaaaagcuccug

SEQ ID NO: 2365042 - RNA, 22 nt, Human
agcagugagaaaaagcuccugu

SEQ ID NO: 2365043 - RNA, 21 nt, Human
agcaguugaaaagacuccaaa

SEQ ID NO: 2365044 - RNA, 23 nt, Human
agcaguugaaaagacuccaaaga

SEQ ID NO: 2365045 - RNA, 15 nt, Human
agcccugacccugug

SEQ ID NO: 2365046 - RNA, 17 nt, Human
agcccugacccugugga

SEQ ID NO: 2365047 - RNA, 21 nt, Human
agcccugacccuguggaagca

SEQ ID NO: 2365048 - RNA, 17 nt, Human
agcccugacuggugcua

SEQ ID NO: 2365049 - RNA, 13 nt, Human
agcccugacccug

SEQ ID NO: 2365050 - RNA, 23 nt, Human
agcccucuuccaucaugucccca

SEQ ID NO: 2365051 - RNA, 16 nt, Human
agcccucuuccaucau

SEQ ID NO: 2365052 - RNA, 16 nt, Human
agcccuauggaugugg

SEQ ID NO: 2365053 - RNA, 17 nt, Human
agcccucuuccaucaug

SEQ ID NO: 2365054 - RNA, 19 nt, Human
agcccucuuccaucauguc

SEQ ID NO: 2365055 - RNA, 20 nt, Human
agcccuaggguggagagcca

SEQ ID NO: 2365056 - RNA, 17 nt, Human
agcccuaggguggagag

SEQ ID NO: 2365057 - RNA, 12 nt, Human
agcccuauggau

SEQ ID NO: 2365058 - RNA, 13 nt, Human
agcccuauggaug

SEQ ID NO: 2365059 - RNA, 14 nt, Human
agcccuauggaugu

SEQ ID NO: 2365060 - RNA, 15 nt, Human
agcccuauggaugug

SEQ ID NO: 2365061 - RNA, 16 nt, Human
agcccuaggguggaga

SEQ ID NO: 2365062 - RNA, 20 nt, Human
agcccuagagccugccugga

SEQ ID NO: 2365063 - RNA, 22 nt, Human
agcccuagagccugccuggagc

SEQ ID NO: 2365064 - RNA, 15 nt, Human
agcccuagagccugc

SEQ ID NO: 2365065 - RNA, 16 nt, Human
agcccuagagccugcc

SEQ ID NO: 2365066 - RNA, 17 nt, Human
agcccuagagccugccu

SEQ ID NO: 2365067 - RNA, 15 nt, Human
agcccugagcuuucu

SEQ ID NO: 2365068 - RNA, 22 nt, Human
agcccugaggugaaagggagcu

SEQ ID NO: 2365069 - RNA, 21 nt, Human
agcccugaggugaaagggagc

SEQ ID NO: 2365070 - RNA, 19 nt, Human
agccgagaucacgccacug

SEQ ID NO: 2365071 - RNA, 20 nt, Human
agccgagaucacgccacugc

SEQ ID NO: 2365072 - RNA, 21 nt, Human
agcccuaaggaucucucagga

SEQ ID NO: 2365073 - RNA, 16 nt, Human
agcccuaaggaucucu

SEQ ID NO: 2365074 - RNA, 14 nt, Human
agcccuagagccug

SEQ ID NO: 2365075 - RNA, 20 nt, Human
agccccaucccaaacccuuc

SEQ ID NO: 2365076 - RNA, 11 nt, Human
agccccauccu

SEQ ID NO: 2365077 - RNA, 22 nt, Human
agccccagggucuucccuaccu

SEQ ID NO: 2365078 - RNA, 20 nt, Human
agccccagggucuucccuac

SEQ ID NO: 2365079 - RNA, 18 nt, Human
agccccagggucuucccu

SEQ ID NO: 2365080 - RNA, 21 nt, Human
agccccaggccucuguguccu

SEQ ID NO: 2365081 - RNA, 20 nt, Human
agccccaggcaggcugugcg

SEQ ID NO: 2365082 - RNA, 16 nt, Human
agccccaggcaggcug

SEQ ID NO: 2365083 - RNA, 13 nt, Human
agccccaggcagg

SEQ ID NO: 2365084 - RNA, 12 nt, Human
agccccagcuga

SEQ ID NO: 2365085 - RNA, 12 nt, Human
agccccaggccu

SEQ ID NO: 2365086 - RNA, 15 nt, Human
agccccaggccucug

SEQ ID NO: 2365087 - RNA, 16 nt, Human
agccccaggccucugu

SEQ ID NO: 2365088 - RNA, 18 nt, Human
agccccaggccucugugu

SEQ ID NO: 2365089 - RNA, 16 nt, Human
agccccagugcccaca

SEQ ID NO: 2365090 - RNA, 23 nt, Human
agccccagggucuucccuaccuc

SEQ ID NO: 2365091 - RNA, 17 nt, Human
agccccaucagcuccag

SEQ ID NO: 2365092 - RNA, 23 nt, Human
agccccauaauuuuuuuuuuccu

SEQ ID NO: 2365093 - RNA, 12 nt, Human
agccccagcccc

SEQ ID NO: 2365094 - RNA, 16 nt, Human
agccccagagcagggu

SEQ ID NO: 2365095 - RNA, 11 nt, Human
agccccagccc

SEQ ID NO: 2365096 - RNA, 18 nt, Human
agccccagcccccuuugg

SEQ ID NO: 2365097 - RNA, 14 nt, Human
agccccagcccccu

SEQ ID NO: 2365098 - RNA, 15 nt, Human
agccccagcacuaac

SEQ ID NO: 2365099 - RNA, 12 nt, Human
agccccagcacu

SEQ ID NO: 2365100 - RNA, 12 nt, Human
agccccagagca

SEQ ID NO: 2365101 - RNA, 14 nt, Human
agccccaccccagg

SEQ ID NO: 2365102 - RNA, 20 nt, Human
agcccaaagugguauagaaa

SEQ ID NO: 2365103 - RNA, 23 nt, Human
agcccaaagugguauagaaaugc

SEQ ID NO: 2365104 - RNA, 16 nt, Human
agcccaaagcuguugg

SEQ ID NO: 2365105 - RNA, 23 nt, Human
agcccaacagacaccaucuuuug

SEQ ID NO: 2365106 - RNA, 16 nt, Human
agcccaagggaucugg

SEQ ID NO: 2365107 - RNA, 22 nt, Human
agcccaagggaucugguccuac

SEQ ID NO: 2365108 - RNA, 22 nt, Human
agcccaagguuuaaacuucucu

SEQ ID NO: 2365109 - RNA, 21 nt, Human
agcccaagggaucugguccua

SEQ ID NO: 2365110 - RNA, 23 nt, Human
agcccaagguuuaaacuucucug

SEQ ID NO: 2365111 - RNA, 10 nt, Human
agcccaaguc

SEQ ID NO: 2365112 - RNA, 14 nt, Human
agcccaaguccaaa

SEQ ID NO: 2365113 - RNA, 17 nt, Human
agcccaaguccaaaugu

SEQ ID NO: 2365114 - RNA, 11 nt, Human
agccuccugag

SEQ ID NO: 2365115 - RNA, 14 nt, Human
agccuccugaccug

SEQ ID NO: 2365116 - RNA, 16 nt, Human
agccuccugaccugag

SEQ ID NO: 2365117 - RNA, 17 nt, Human
agccuccugaccugagg

SEQ ID NO: 2365118 - RNA, 18 nt, Human
agccuccugaccugaggc

SEQ ID NO: 2365119 - RNA, 19 nt, Human
agccuccucuggacggcag

SEQ ID NO: 2365120 - RNA, 12 nt, Human
agccuccucugu

SEQ ID NO: 2365121 - RNA, 15 nt, Human
agccuccucugucug

SEQ ID NO: 2365122 - RNA, 16 nt, Human
agccuccucugucugc

SEQ ID NO: 2365123 - RNA, 18 nt, Human
agccuccucugucugccc

SEQ ID NO: 2365124 - RNA, 19 nt, Human
agccuccucugucugcccu

SEQ ID NO: 2365125 - RNA, 20 nt, Human
agccuccucugucugcccuu

SEQ ID NO: 2365126 - RNA, 21 nt, Human
agccuccucugucugcccuuc

SEQ ID NO: 2365127 - RNA, 19 nt, Human
agccgucagccaaauguaa

SEQ ID NO: 2365128 - RNA, 19 nt, Human
agccuccuccugaccacgg

SEQ ID NO: 2365129 - RNA, 13 nt, Human
agccuccucucuc

SEQ ID NO: 2365130 - RNA, 11 nt, Human
agccuccucug

SEQ ID NO: 2365131 - RNA, 12 nt, Human
agccuccucugg

SEQ ID NO: 2365132 - RNA, 13 nt, Human
agccuccucugga

SEQ ID NO: 2365133 - RNA, 14 nt, Human
agccuccucuggac

SEQ ID NO: 2365134 - RNA, 18 nt, Human
agccuccucuggacggca

SEQ ID NO: 2365135 - RNA, 15 nt, Human
agccucccugaagcc

SEQ ID NO: 2365136 - RNA, 14 nt, Human
agccucccugaagc

SEQ ID NO: 2365137 - RNA, 17 nt, Human
agccucccugaagacca

SEQ ID NO: 2365138 - RNA, 21 nt, Human
agccucccucugaccugcagg

SEQ ID NO: 2365139 - RNA, 15 nt, Human
agccucccucugacc

SEQ ID NO: 2365140 - RNA, 14 nt, Human
agccucccucugac

SEQ ID NO: 2365141 - RNA, 13 nt, Human
agccucccucuga

SEQ ID NO: 2365142 - RNA, 11 nt, Human
agccucccuga

SEQ ID NO: 2365143 - RNA, 22 nt, Human
agccucccucugaccugcaggc

SEQ ID NO: 2365144 - RNA, 12 nt, Human
agccucccugaa

SEQ ID NO: 2365145 - RNA, 13 nt, Human
agccucccugaag

SEQ ID NO: 2365146 - RNA, 22 nt, Human
agccucccgaguagcugggacu

SEQ ID NO: 2365147 - RNA, 22 nt, Human
agccuccccugccagggcaggg

SEQ ID NO: 2365148 - RNA, 20 nt, Human
agccuccccugccagggcag

SEQ ID NO: 2365149 - RNA, 23 nt, Human
agccucccuauuuuuuuucuguu

SEQ ID NO: 2365150 - RNA, 17 nt, Human
agccucccaaagugcug

SEQ ID NO: 2365151 - RNA, 15 nt, Human
agccuccccugccag

SEQ ID NO: 2365152 - RNA, 14 nt, Human
agccuccccugcca

SEQ ID NO: 2365153 - RNA, 20 nt, Human
agccucccaaagugcuggga

SEQ ID NO: 2365154 - RNA, 18 nt, Human
agccucccgaauagcugg

SEQ ID NO: 2365155 - RNA, 19 nt, Human
agccuccccugccagggca

SEQ ID NO: 2365156 - RNA, 18 nt, Human
agccuccccugccagggc

SEQ ID NO: 2365157 - RNA, 17 nt, Human
agccuccccugccaggg

SEQ ID NO: 2365158 - RNA, 16 nt, Human
agccuccccugccagg

SEQ ID NO: 2365159 - RNA, 19 nt, Human
agccucccgaauagcuggg

SEQ ID NO: 2365160 - RNA, 20 nt, Human
agccucccgaauagcuggga

SEQ ID NO: 2365161 - RNA, 22 nt, Human
agccucccgaauagcugggacu

SEQ ID NO: 2365162 - RNA, 17 nt, Human
agccucccgaguagcug

SEQ ID NO: 2365163 - RNA, 23 nt, Human
agccgagcucguguauccugggg

SEQ ID NO: 2365164 - RNA, 16 nt, Human
agccgcugugagcccc

SEQ ID NO: 2365165 - RNA, 19 nt, Human
agccgcugugagccccugg

SEQ ID NO: 2365166 - RNA, 16 nt, Human
agccgcaucuucucca

SEQ ID NO: 2365167 - RNA, 18 nt, Human
agccgcagccucccucug

SEQ ID NO: 2365168 - RNA, 22 nt, Human
agccgcuggggccaguuggucc

SEQ ID NO: 2365169 - RNA, 14 nt, Human
agccgcagccuccc

SEQ ID NO: 2365170 - RNA, 18 nt, Human
agccgauucaccugagca

SEQ ID NO: 2365171 - RNA, 17 nt, Human
agccgagccgggccugg

SEQ ID NO: 2365172 - RNA, 18 nt, Human
agccgagccgggccuggg

SEQ ID NO: 2365173 - RNA, 21 nt, Human
agccgagccgggccuggggcu

SEQ ID NO: 2365174 - RNA, 14 nt, Human
agccgcuggggcca

SEQ ID NO: 2365175 - RNA, 20 nt, Human
agccgagauugcaccacugc

SEQ ID NO: 2365176 - RNA, 16 nt, Human
agccgagccgggccug

SEQ ID NO: 2365177 - RNA, 14 nt, Human
agcccugaguuccu

SEQ ID NO: 2365178 - RNA, 19 nt, Human
agccgagauugcaccacug

SEQ ID NO: 2365179 - RNA, 21 nt, Human
agccgagaucacgccacugca

SEQ ID NO: 2365180 - RNA, 21 nt, Human
agccggggaguuucuuuccug

SEQ ID NO: 2365181 - RNA, 20 nt, Human
agccggggaguuucuuuccu

SEQ ID NO: 2365182 - RNA, 16 nt, Human
agccggcacagggucu

SEQ ID NO: 2365183 - RNA, 21 nt, Human
agccggagccuccagcugccc

SEQ ID NO: 2365184 - RNA, 16 nt, Human
agccggcauggcuggg

SEQ ID NO: 2365185 - RNA, 16 nt, Human
agccgggucugccucu

SEQ ID NO: 2365186 - RNA, 22 nt, Human
agccgcugugagccccuggucc

SEQ ID NO: 2365187 - RNA, 23 nt, Human
agccggacuuucggaguuggggg

SEQ ID NO: 2365188 - RNA, 14 nt, Human
agccggcacagggu

SEQ ID NO: 2365189 - RNA, 15 nt, Human
agccggcacaggguc

SEQ ID NO: 2365190 - RNA, 14 nt, Human
agccggccucucug

SEQ ID NO: 2365191 - RNA, 18 nt, Human
agccucccaaagugcugg

SEQ ID NO: 2365192 - RNA, 19 nt, Human
agccucccaaagugcuggg

SEQ ID NO: 2365193 - RNA, 16 nt, Human
agccgucagccaaaug

SEQ ID NO: 2365194 - RNA, 22 nt, Human
agccgggucugccucuucuggg

SEQ ID NO: 2365195 - RNA, 21 nt, Human
agccgggucugccucuucugg

SEQ ID NO: 2365196 - RNA, 20 nt, Human
agccgggucugccucuucug

SEQ ID NO: 2365197 - RNA, 19 nt, Human
agccuccugaccugaggcu

SEQ ID NO: 2365198 - RNA, 22 nt, Human
agccuccugaccugaggcuccu

SEQ ID NO: 2365199 - RNA, 19 nt, Human
augggaaggagggagguau

SEQ ID NO: 2365200 - RNA, 17 nt, Human
augggaaggagggaggu

SEQ ID NO: 2365201 - RNA, 14 nt, Human
augggaaggaggga

SEQ ID NO: 2365202 - RNA, 19 nt, Human
augggaagacgaggcccuc

SEQ ID NO: 2365203 - RNA, 20 nt, Human
augggaagacgaggcccucg

SEQ ID NO: 2365204 - RNA, 13 nt, Human
augggaaugaagc

SEQ ID NO: 2365205 - RNA, 18 nt, Human
augggaaucaagauuuaa

SEQ ID NO: 2365206 - RNA, 14 nt, Human
augggaaugaagcu

SEQ ID NO: 2365207 - RNA, 15 nt, Human
augggaaugaagcuu

SEQ ID NO: 2365208 - RNA, 16 nt, Human
augggaaugaagcuug

SEQ ID NO: 2365209 - RNA, 21 nt, Human
augggaaugaagcuuguguau

SEQ ID NO: 2365210 - RNA, 21 nt, Human
augggaaugaaugucagugug

SEQ ID NO: 2365211 - RNA, 15 nt, Human
augggaaugaauguc

SEQ ID NO: 2365212 - RNA, 18 nt, Human
auggcugacuuugcucuu

SEQ ID NO: 2365213 - RNA, 22 nt, Human
auggcugaaggaaaccagugca

SEQ ID NO: 2365214 - RNA, 12 nt, Human
auggcugcugaa

SEQ ID NO: 2365215 - RNA, 14 nt, Human
auggcugcugaagc

SEQ ID NO: 2365216 - RNA, 19 nt, Human
auggcugcugaagcugccu

SEQ ID NO: 2365217 - RNA, 22 nt, Human
auggcugcugaagcugccugcu

SEQ ID NO: 2365218 - RNA, 23 nt, Human
auggcugcugaagcugccugcuu

SEQ ID NO: 2365219 - RNA, 17 nt, Human
augggaagacgaggccc

SEQ ID NO: 2365220 - RNA, 23 nt, Human
auggcugccaaugggagcucaug

SEQ ID NO: 2365221 - RNA, 13 nt, Human
auggcuccucuca

SEQ ID NO: 2365222 - RNA, 12 nt, Human
auggcuccucuc

SEQ ID NO: 2365223 - RNA, 12 nt, Human
auggcucuucau

SEQ ID NO: 2365224 - RNA, 21 nt, Human
auggcugaaggaaaccagugc

SEQ ID NO: 2365225 - RNA, 18 nt, Human
auggcucuaaaaaguuuu

SEQ ID NO: 2365226 - RNA, 19 nt, Human
auggaugggggaacucaga

SEQ ID NO: 2365227 - RNA, 12 nt, Human
auggaugugcuu

SEQ ID NO: 2365228 - RNA, 14 nt, Human
auggauggcuucua

SEQ ID NO: 2365229 - RNA, 17 nt, Human
auggauguggggucccc

SEQ ID NO: 2365230 - RNA, 20 nt, Human
auggaugugggguccccauc

SEQ ID NO: 2365231 - RNA, 22 nt, Human
auggauguuuuagccauuguug

SEQ ID NO: 2365232 - RNA, 18 nt, Human
auggauucauuacagcuu

SEQ ID NO: 2365233 - RNA, 13 nt, Human
auggagcuggccg

SEQ ID NO: 2365234 - RNA, 13 nt, Human
auggaugauucag

SEQ ID NO: 2365235 - RNA, 18 nt, Human
auggaugauucagaaauu

SEQ ID NO: 2365236 - RNA, 23 nt, Human
auggaugccaauauuaaaucugc

SEQ ID NO: 2365237 - RNA, 21 nt, Human
auggaugauucagaaauugga

SEQ ID NO: 2365238 - RNA, 22 nt, Human
auggaugccaauauuaaaucug

SEQ ID NO: 2365239 - RNA, 13 nt, Human
auggaugccaaua

SEQ ID NO: 2365240 - RNA, 23 nt, Human
auggagcgcaccugcccccuggu

SEQ ID NO: 2365241 - RNA, 17 nt, Human
auggagcgcaccugccc

SEQ ID NO: 2365242 - RNA, 12 nt, Human
auggagccccag

SEQ ID NO: 2365243 - RNA, 15 nt, Human
auggagccccagccc

SEQ ID NO: 2365244 - RNA, 16 nt, Human
auggagccccagcccc

SEQ ID NO: 2365245 - RNA, 14 nt, Human
auggagcucagaga

SEQ ID NO: 2365246 - RNA, 22 nt, Human
auggagcucagagagggcaggc

SEQ ID NO: 2365247 - RNA, 21 nt, Human
auggagccagcucugcauuau

SEQ ID NO: 2365248 - RNA, 12 nt, Human
auggagcccagg

SEQ ID NO: 2365249 - RNA, 13 nt, Human
auggagcccaggc

SEQ ID NO: 2365250 - RNA, 14 nt, Human
auggagcccaggcg

SEQ ID NO: 2365251 - RNA, 23 nt, Human
auggagcccaggcgggagcggug

SEQ ID NO: 2365252 - RNA, 16 nt, Human
augcuuuuugaauguu

SEQ ID NO: 2365253 - RNA, 22 nt, Human
augcuuuuugaauguuauuugu

SEQ ID NO: 2365254 - RNA, 14 nt, Human
auggaaaaaaugau

SEQ ID NO: 2365255 - RNA, 23 nt, Human
augcuuuuuauuucugcauaugu

SEQ ID NO: 2365256 - RNA, 19 nt, Human
augcuuuuuauuucugcau

SEQ ID NO: 2365257 - RNA, 16 nt, Human
augcuuuuuauuucug

SEQ ID NO: 2365258 - RNA, 22 nt, Human
augcuuuuuauuauuauuauuu

SEQ ID NO: 2365259 - RNA, 15 nt, Human
augcuuugugaacaa

SEQ ID NO: 2365260 - RNA, 22 nt, Human
augcuuuuauauuuuuuuaaaa

SEQ ID NO: 2365261 - RNA, 19 nt, Human
augcuuuucugucucugcc

SEQ ID NO: 2365262 - RNA, 20 nt, Human
augcuuuucugucucugccu

SEQ ID NO: 2365263 - RNA, 16 nt, Human
augcuuugugugauug

SEQ ID NO: 2365264 - RNA, 22 nt, Human
augcuuugugugauugaaucug

SEQ ID NO: 2365265 - RNA, 17 nt, Human
augcuuuuaaaaaucua

SEQ ID NO: 2365266 - RNA, 12 nt, Human
auggaaaaggaa

SEQ ID NO: 2365267 - RNA, 13 nt, Human
auggaaauguuua

SEQ ID NO: 2365268 - RNA, 20 nt, Human
auggaaauucccuucaucug

SEQ ID NO: 2365269 - RNA, 19 nt, Human
auggaaaugggcagagcag

SEQ ID NO: 2365270 - RNA, 20 nt, Human
auggaaaugggcagagcaga

SEQ ID NO: 2365271 - RNA, 12 nt, Human
augcuugaaaaa

SEQ ID NO: 2365272 - RNA, 15 nt, Human
augcuugaaaaaugu

SEQ ID NO: 2365273 - RNA, 23 nt, Human
augcuugccuagggccuggucca

SEQ ID NO: 2365274 - RNA, 21 nt, Human
augcuugccuagggccugguc

SEQ ID NO: 2365275 - RNA, 20 nt, Human
augcuugccuagggccuggu

SEQ ID NO: 2365276 - RNA, 16 nt, Human
augcuugccuagggcc

SEQ ID NO: 2365277 - RNA, 11 nt, Human
augcuugccua

SEQ ID NO: 2365278 - RNA, 12 nt, Human
augcuucuugga

SEQ ID NO: 2365279 - RNA, 15 nt, Human
augcuucuucucagg

SEQ ID NO: 2365280 - RNA, 15 nt, Human
augcuucuuccuuac

SEQ ID NO: 2365281 - RNA, 19 nt, Human
augaugugggucaaggaau

SEQ ID NO: 2365282 - RNA, 19 nt, Human
augauguggaguggggcag

SEQ ID NO: 2365283 - RNA, 19 nt, Human
augauguguacccaaacgu

SEQ ID NO: 2365284 - RNA, 23 nt, Human
augauguggaguggggcaguaga

SEQ ID NO: 2365285 - RNA, 20 nt, Human
augauguggugccugagguc

SEQ ID NO: 2365286 - RNA, 16 nt, Human
augaugugugaaaacu

SEQ ID NO: 2365287 - RNA, 13 nt, Human
augcaauauguau

SEQ ID NO: 2365288 - RNA, 22 nt, Human
augcaauauaucuaaauugaau

SEQ ID NO: 2365289 - RNA, 20 nt, Human
augcaauauaucuaaauuga

SEQ ID NO: 2365290 - RNA, 21 nt, Human
augcaauauaucuaaauugaa

SEQ ID NO: 2365291 - RNA, 15 nt, Human
augcaauauaucuaa

SEQ ID NO: 2365292 - RNA, 23 nt, Human
augauguggugccugaggucugu

SEQ ID NO: 2365293 - RNA, 19 nt, Human
augcaauauaucuaaauug

SEQ ID NO: 2365294 - RNA, 14 nt, Human
augcaauauguauu

SEQ ID NO: 2365295 - RNA, 23 nt, Human
augauguccagaagaauauucag

SEQ ID NO: 2365296 - RNA, 14 nt, Human
augaugugccuggg

SEQ ID NO: 2365297 - RNA, 16 nt, Human
augaugugccugggug

SEQ ID NO: 2365298 - RNA, 15 nt, Human
augauguauuuuugu

SEQ ID NO: 2365299 - RNA, 16 nt, Human
augauguauuuuugua

SEQ ID NO: 2365300 - RNA, 14 nt, Human
augauguccagaag

SEQ ID NO: 2365301 - RNA, 15 nt, Human
augauguccagaaga

SEQ ID NO: 2365302 - RNA, 18 nt, Human
augauguccagaagaaua

SEQ ID NO: 2365303 - RNA, 19 nt, Human
augauguccagaagaauau

SEQ ID NO: 2365304 - RNA, 23 nt, Human
augauguauguugaagccuuugu

SEQ ID NO: 2365305 - RNA, 18 nt, Human
augcaaugugcuacugau

SEQ ID NO: 2365306 - RNA, 17 nt, Human
augcaaugugcuacuga

SEQ ID NO: 2365307 - RNA, 16 nt, Human
augcaaugugcuacug

SEQ ID NO: 2365308 - RNA, 13 nt, Human
augcaaugugcua

SEQ ID NO: 2365309 - RNA, 14 nt, Human
augcaaugugaagc

SEQ ID NO: 2365310 - RNA, 19 nt, Human
augcaaugacaucuucaaa

SEQ ID NO: 2365311 - RNA, 17 nt, Human
augcacacauuuuuuaa

SEQ ID NO: 2365312 - RNA, 22 nt, Human
augcacacauuuuuuaaaugca

SEQ ID NO: 2365313 - RNA, 19 nt, Human
augcacacauuuuuuaaau

SEQ ID NO: 2365314 - RNA, 21 nt, Human
augcacagcuaacauggaagu

SEQ ID NO: 2365315 - RNA, 19 nt, Human
augcaauuuauuaaaauga

SEQ ID NO: 2365316 - RNA, 23 nt, Human
augcacacauuuuuuaaaugcac

SEQ ID NO: 2365317 - RNA, 23 nt, Human
augcacagaguuguuacauuuuu

SEQ ID NO: 2365318 - RNA, 14 nt, Human
augcacagcuaaca

SEQ ID NO: 2365319 - RNA, 15 nt, Human
augccugguggcagc

SEQ ID NO: 2365320 - RNA, 16 nt, Human
augccugguggcagcu

SEQ ID NO: 2365321 - RNA, 17 nt, Human
augccugguggcagcug

SEQ ID NO: 2365322 - RNA, 13 nt, Human
augccuuucuagu

SEQ ID NO: 2365323 - RNA, 21 nt, Human
augccuuucuaguccuauucu

SEQ ID NO: 2365324 - RNA, 22 nt, Human
augccuuucuaguccuauucua

SEQ ID NO: 2365325 - RNA, 12 nt, Human
augccuuugaga

SEQ ID NO: 2365326 - RNA, 13 nt, Human
augccuuugagac

SEQ ID NO: 2365327 - RNA, 14 nt, Human
augccuuugagaca

SEQ ID NO: 2365328 - RNA, 21 nt, Human
augccuggauggggcugcacc

SEQ ID NO: 2365329 - RNA, 23 nt, Human
augccuggauggggcugcaccgg

SEQ ID NO: 2365330 - RNA, 18 nt, Human
augccuggucuuuccucu

SEQ ID NO: 2365331 - RNA, 13 nt, Human
augccuggcuucg

SEQ ID NO: 2365332 - RNA, 16 nt, Human
augccuggucuuuccu

SEQ ID NO: 2365333 - RNA, 17 nt, Human
augccugggcagaagga

SEQ ID NO: 2365334 - RNA, 17 nt, Human
augcauuugaggucaag

SEQ ID NO: 2365335 - RNA, 13 nt, Human
augcauuugaggu

SEQ ID NO: 2365336 - RNA, 22 nt, Human
augcauuguuguucugcucaau

SEQ ID NO: 2365337 - RNA, 16 nt, Human
augcauuguugaggug

SEQ ID NO: 2365338 - RNA, 15 nt, Human
augcauuguugaggu

SEQ ID NO: 2365339 - RNA, 18 nt, Human
augcauuugaaaauuuug

SEQ ID NO: 2365340 - RNA, 12 nt, Human
augcauuugaaa

SEQ ID NO: 2365341 - RNA, 10 nt, Human
augcauuuga

SEQ ID NO: 2365342 - RNA, 18 nt, Human
augcacauauggacucug

SEQ ID NO: 2365343 - RNA, 20 nt, Human
augcaugaaguaauaugcac

SEQ ID NO: 2365344 - RNA, 23 nt, Human
augcaugaaguaauaugcacaca

SEQ ID NO: 2365345 - RNA, 12 nt, Human
augcauggaaac

SEQ ID NO: 2365346 - RNA, 12 nt, Human
augcauggaaau

SEQ ID NO: 2365347 - RNA, 20 nt, Human
augcauggaaaccugaaaaa

SEQ ID NO: 2365348 - RNA, 23 nt, Human
augcauggaaaccugaaaaaaag

SEQ ID NO: 2365349 - RNA, 20 nt, Human
augcaugcagccacugugcu

SEQ ID NO: 2365350 - RNA, 17 nt, Human
augcaugcacuguuccc

SEQ ID NO: 2365351 - RNA, 14 nt, Human
augccuuuuauuuc

SEQ ID NO: 2365352 - RNA, 23 nt, Human
augccuuugagacaguuucuuag

SEQ ID NO: 2365353 - RNA, 21 nt, Human
augccuuugagacaguuucuu

SEQ ID NO: 2365354 - RNA, 22 nt, Human
augccuuugagacaguuucuua

SEQ ID NO: 2365355 - RNA, 15 nt, Human
augccuuugagacag

SEQ ID NO: 2365356 - RNA, 16 nt, Human
augccuuugagacagu

SEQ ID NO: 2365357 - RNA, 19 nt, Human
augccuuugagacaguuuc

SEQ ID NO: 2365358 - RNA, 20 nt, Human
augccuuugagacaguuucu

SEQ ID NO: 2365359 - RNA, 21 nt, Human
augccuuuguacuuuagggaa

SEQ ID NO: 2365360 - RNA, 13 nt, Human
auguacagucugu

SEQ ID NO: 2365361 - RNA, 14 nt, Human
auguacagucuguc

SEQ ID NO: 2365362 - RNA, 15 nt, Human
auguacagucuguca

SEQ ID NO: 2365363 - RNA, 16 nt, Human
auguacagucugucau

SEQ ID NO: 2365364 - RNA, 17 nt, Human
auguacagucugucaug

SEQ ID NO: 2365365 - RNA, 11 nt, Human
auguacagugu

SEQ ID NO: 2365366 - RNA, 14 nt, Human
auguacaguguucu

SEQ ID NO: 2365367 - RNA, 17 nt, Human
auguacauguacugauu

SEQ ID NO: 2365368 - RNA, 17 nt, Human
auguacaguguucuguu

SEQ ID NO: 2365369 - RNA, 20 nt, Human
auguacaguguucuguuuaa

SEQ ID NO: 2365370 - RNA, 21 nt, Human
auguacagagaacuaacacua

SEQ ID NO: 2365371 - RNA, 14 nt, Human
auguacaagaugaa

SEQ ID NO: 2365372 - RNA, 23 nt, Human
auguacagagaacuaacacuauu

SEQ ID NO: 2365373 - RNA, 19 nt, Human
auguaaucuugaauuguaa

SEQ ID NO: 2365374 - RNA, 23 nt, Human
auguaaucugauggcuucuccag

SEQ ID NO: 2365375 - RNA, 16 nt, Human
augucaaguaccaaaa

SEQ ID NO: 2365376 - RNA, 16 nt, Human
augucaaucagccuag

SEQ ID NO: 2365377 - RNA, 19 nt, Human
augucaacuucuggcuccu

SEQ ID NO: 2365378 - RNA, 17 nt, Human
augucaacuucuggcuc

SEQ ID NO: 2365379 - RNA, 18 nt, Human
augucaacuucuggcucc

SEQ ID NO: 2365380 - RNA, 20 nt, Human
augucaaagagaaaacuuau

SEQ ID NO: 2365381 - RNA, 17 nt, Human
augucaacugaccuaaa

SEQ ID NO: 2365382 - RNA, 14 nt, Human
augucaacuucugg

SEQ ID NO: 2365383 - RNA, 15 nt, Human
auguacaugagaagg

SEQ ID NO: 2365384 - RNA, 15 nt, Human
augucacaggcaggu

SEQ ID NO: 2365385 - RNA, 14 nt, Human
augucacaggcagg

SEQ ID NO: 2365386 - RNA, 16 nt, Human
augucacaggcagguc

SEQ ID NO: 2365387 - RNA, 17 nt, Human
augucacaggcaggucc

SEQ ID NO: 2365388 - RNA, 14 nt, Human
augucacugugguc

SEQ ID NO: 2365389 - RNA, 16 nt, Human
augucacugugguccu

SEQ ID NO: 2365390 - RNA, 16 nt, Human
augucagacuggcugg

SEQ ID NO: 2365391 - RNA, 23 nt, Human
augucagacauccauguuuguaa

SEQ ID NO: 2365392 - RNA, 14 nt, Human
augucagauacaau

SEQ ID NO: 2365393 - RNA, 16 nt, Human
augucagauacaaugu

SEQ ID NO: 2365394 - RNA, 18 nt, Human
augucagauacaauguau

SEQ ID NO: 2365395 - RNA, 13 nt, Human
augucagcaaaaa

SEQ ID NO: 2365396 - RNA, 15 nt, Human
augucagcaaaaagc

SEQ ID NO: 2365397 - RNA, 16 nt, Human
augucagcaaaaagca

SEQ ID NO: 2365398 - RNA, 22 nt, Human
augucagcaaaaagcaaaauca

SEQ ID NO: 2365399 - RNA, 23 nt, Human
augucagcaaaaagcaaaaucau

SEQ ID NO: 2365400 - RNA, 20 nt, Human
auguaagagcaccuuccuca

SEQ ID NO: 2365401 - RNA, 18 nt, Human
auguaacuuuuguaagac

SEQ ID NO: 2365402 - RNA, 17 nt, Human
auguaacuuuuguaaga

SEQ ID NO: 2365403 - RNA, 24 nt, Human
auggugaaaccccgucucuacuaa

SEQ ID NO: 2365404 - RNA, 16 nt, Human
auggugaaaauguacu

SEQ ID NO: 2365405 - RNA, 17 nt, Human
auggugaaaauguacug

SEQ ID NO: 2365406 - RNA, 23 nt, Human
auggugacuuuugaaaagaggug

SEQ ID NO: 2365407 - RNA, 17 nt, Human
auggugaaauuuauuag

SEQ ID NO: 2365408 - RNA, 21 nt, Human
auggugagagaagccugugcc

SEQ ID NO: 2365409 - RNA, 16 nt, Human
auguaacuuuuguaag

SEQ ID NO: 2365410 - RNA, 18 nt, Human
auggugagaugcagcugg

SEQ ID NO: 2365411 - RNA, 14 nt, Human
auguaacuuuugua

SEQ ID NO: 2365412 - RNA, 14 nt, Human
auggucucagaaac

SEQ ID NO: 2365413 - RNA, 18 nt, Human
auggucucagaaaccaaa

SEQ ID NO: 2365414 - RNA, 15 nt, Human
auggucuucagccuc

SEQ ID NO: 2365415 - RNA, 17 nt, Human
auggucuucagccucuu

SEQ ID NO: 2365416 - RNA, 12 nt, Human
auggugaaaaug

SEQ ID NO: 2365417 - RNA, 14 nt, Human
auggugaaaaugua

SEQ ID NO: 2365418 - RNA, 17 nt, Human
auguaagcucuacugag

SEQ ID NO: 2365419 - RNA, 20 nt, Human
auguaagggaaacugccagc

SEQ ID NO: 2365420 - RNA, 22 nt, Human
auguaagggaaacugccagcaa

SEQ ID NO: 2365421 - RNA, 21 nt, Human
auguaagggaaacugccagca

SEQ ID NO: 2365422 - RNA, 14 nt, Human
auguaauaauguga

SEQ ID NO: 2365423 - RNA, 19 nt, Human
auguaauaaaaaguauaug

SEQ ID NO: 2365424 - RNA, 22 nt, Human
auguaauaagguugaacacuuu

SEQ ID NO: 2365425 - RNA, 17 nt, Human
auguaauaacugugaag

SEQ ID NO: 2365426 - RNA, 16 nt, Human
auguaauaaugugaau

SEQ ID NO: 2365427 - RNA, 15 nt, Human
auguaaucaauguuu

SEQ ID NO: 2365428 - RNA, 16 nt, Human
auguaaucaauguuuc

SEQ ID NO: 2365429 - RNA, 18 nt, Human
auguaaguuuaccuaugu

SEQ ID NO: 2365430 - RNA, 14 nt, Human
auguaauaaacuuu

SEQ ID NO: 2365431 - RNA, 15 nt, Human
auguaauaaacuuua

SEQ ID NO: 2365432 - RNA, 16 nt, Human
auguaauaaacuuuaa

SEQ ID NO: 2365433 - RNA, 14 nt, Human
augucuuguacaug

SEQ ID NO: 2365434 - RNA, 17 nt, Human
augucuuguacaugugu

SEQ ID NO: 2365435 - RNA, 22 nt, Human
augucuuguacauguguagccu

SEQ ID NO: 2365436 - RNA, 19 nt, Human
augucuuggguaggcggga

SEQ ID NO: 2365437 - RNA, 20 nt, Human
augucuuggacacuguacaa

SEQ ID NO: 2365438 - RNA, 16 nt, Human
augucuuggacacugu

SEQ ID NO: 2365439 - RNA, 19 nt, Human
augucuuggacacuguaca

SEQ ID NO: 2365440 - RNA, 14 nt, Human
augucuucugccug

SEQ ID NO: 2365441 - RNA, 12 nt, Human
augucuucugcc

SEQ ID NO: 2365442 - RNA, 15 nt, Human
augucuucugccugu

SEQ ID NO: 2365443 - RNA, 17 nt, Human
augucuucugccuguua

SEQ ID NO: 2365444 - RNA, 19 nt, Human
augucuucugccuguuaua

SEQ ID NO: 2365445 - RNA, 20 nt, Human
augucuucuguauucacuua

SEQ ID NO: 2365446 - RNA, 13 nt, Human
augucuuggacac

SEQ ID NO: 2365447 - RNA, 23 nt, Human
augucuugaugcaugcacuguuc

SEQ ID NO: 2365448 - RNA, 17 nt, Human
augugguuauuucucug

SEQ ID NO: 2365449 - RNA, 15 nt, Human
augugguucuucaaa

SEQ ID NO: 2365450 - RNA, 20 nt, Human
augugguugcaaggccgcug

SEQ ID NO: 2365451 - RNA, 18 nt, Human
augugguuauuucucuga

SEQ ID NO: 2365452 - RNA, 19 nt, Human
augugguuuauagagggcc

SEQ ID NO: 2365453 - RNA, 21 nt, Human
auguggugggacagggaccca

SEQ ID NO: 2365454 - RNA, 15 nt, Human
auguggugggacagg

SEQ ID NO: 2365455 - RNA, 15 nt, Human
augugguuacacacu

SEQ ID NO: 2365456 - RNA, 13 nt, Human
auguggugccuga

SEQ ID NO: 2365457 - RNA, 14 nt, Human
auguguaaguauuc

SEQ ID NO: 2365458 - RNA, 13 nt, Human
augugguuuauag

SEQ ID NO: 2365459 - RNA, 16 nt, Human
auguguaaucaauaaa

SEQ ID NO: 2365460 - RNA, 17 nt, Human
auguguaaucaauaaac

SEQ ID NO: 2365461 - RNA, 20 nt, Human
auguguaaucaauaaacgau

SEQ ID NO: 2365462 - RNA, 21 nt, Human
auguguaaucaauaaacgauu

SEQ ID NO: 2365463 - RNA, 16 nt, Human
augugggucaaggaau

SEQ ID NO: 2365464 - RNA, 21 nt, Human
augugggguccccaucauccc

SEQ ID NO: 2365465 - RNA, 18 nt, Human
augugggggucugugugu

SEQ ID NO: 2365466 - RNA, 17 nt, Human
augugggggucugugug

SEQ ID NO: 2365467 - RNA, 18 nt, Human
auguggugaggcaggcuu

SEQ ID NO: 2365468 - RNA, 18 nt, Human
augugguggcacaggccc

SEQ ID NO: 2365469 - RNA, 22 nt, Human
augugguggcacaggcccccuu

SEQ ID NO: 2365470 - RNA, 16 nt, Human
augugggggucugugu

SEQ ID NO: 2365471 - RNA, 13 nt, Human
auguggggccagg

SEQ ID NO: 2365472 - RNA, 16 nt, Human
auguggggccagguca

SEQ ID NO: 2365473 - RNA, 11 nt, Human
auuaaauuaug

SEQ ID NO: 2365474 - RNA, 13 nt, Human
auuaaauucacaa

SEQ ID NO: 2365475 - RNA, 16 nt, Human
auuaaaugcccagccc

SEQ ID NO: 2365476 - RNA, 13 nt, Human
auuaaauucuugc

SEQ ID NO: 2365477 - RNA, 18 nt, Human
auuaaauucacaaacuuu

SEQ ID NO: 2365478 - RNA, 17 nt, Human
auuaaauucacaaacuu

SEQ ID NO: 2365479 - RNA, 16 nt, Human
auuaaauucacaaacu

SEQ ID NO: 2365480 - RNA, 14 nt, Human
auuaaauucacaaa

SEQ ID NO: 2365481 - RNA, 14 nt, Human
auuaaaugcccagc

SEQ ID NO: 2365482 - RNA, 15 nt, Human
auuaaaugcccagcc

SEQ ID NO: 2365483 - RNA, 16 nt, Human
auguuuuaagaggcag

SEQ ID NO: 2365484 - RNA, 18 nt, Human
auguuuuaagaggcaggg

SEQ ID NO: 2365485 - RNA, 16 nt, Human
auguuugcacuuguga

SEQ ID NO: 2365486 - RNA, 18 nt, Human
auguuuguggccucagaa

SEQ ID NO: 2365487 - RNA, 21 nt, Human
auguuuuaaacauagaaaguu

SEQ ID NO: 2365488 - RNA, 14 nt, Human
auguuuuaauucca

SEQ ID NO: 2365489 - RNA, 16 nt, Human
auguuuuaacaaaaac

SEQ ID NO: 2365490 - RNA, 15 nt, Human
auguuuuaacaaaaa

SEQ ID NO: 2365491 - RNA, 15 nt, Human
auguuuuaauuccau

SEQ ID NO: 2365492 - RNA, 16 nt, Human
auguuuuaauuccaug

SEQ ID NO: 2365493 - RNA, 17 nt, Human
auguuuuaauuccauga

SEQ ID NO: 2365494 - RNA, 18 nt, Human
auguuuuaauuccaugaa

SEQ ID NO: 2365495 - RNA, 23 nt, Human
auuaaaguguccauugacaugua

SEQ ID NO: 2365496 - RNA, 12 nt, Human
auuaaaguucua

SEQ ID NO: 2365497 - RNA, 19 nt, Human
auuaaaguucuagugaccg

SEQ ID NO: 2365498 - RNA, 21 nt, Human
auuaaaguucuguaaaauaua

SEQ ID NO: 2365499 - RNA, 15 nt, Human
auuaaaguguccauu

SEQ ID NO: 2365500 - RNA, 17 nt, Human
auuaaaguguccauuga

SEQ ID NO: 2365501 - RNA, 19 nt, Human
auuaaaguguccauugaca

SEQ ID NO: 2365502 - RNA, 20 nt, Human
auuaaaguguccauugacau

SEQ ID NO: 2365503 - RNA, 22 nt, Human
auuaaaguguccauugacaugu

SEQ ID NO: 2365504 - RNA, 17 nt, Human
auguucugacauuaaca

SEQ ID NO: 2365505 - RNA, 16 nt, Human
auguucugacauuaac

SEQ ID NO: 2365506 - RNA, 15 nt, Human
auguucugacauuaa

SEQ ID NO: 2365507 - RNA, 14 nt, Human
auguucugacauua

SEQ ID NO: 2365508 - RNA, 22 nt, Human
auguucugacccugcuucaaau

SEQ ID NO: 2365509 - RNA, 20 nt, Human
auguucuuaguggauguucu

SEQ ID NO: 2365510 - RNA, 15 nt, Human
auguucuuaauucuu

SEQ ID NO: 2365511 - RNA, 20 nt, Human
auguucuuucacccuuuucu

SEQ ID NO: 2365512 - RNA, 20 nt, Human
auguucugacauuaacaguu

SEQ ID NO: 2365513 - RNA, 19 nt, Human
auguucugacauuaacagu

SEQ ID NO: 2365514 - RNA, 18 nt, Human
auguucugacauuaacag

SEQ ID NO: 2365515 - RNA, 18 nt, Human
auguuucuuuguaaugaa

SEQ ID NO: 2365516 - RNA, 21 nt, Human
auguuucuuuuguauguaaau

SEQ ID NO: 2365517 - RNA, 18 nt, Human
auguuucuuuuguaugua

SEQ ID NO: 2365518 - RNA, 19 nt, Human
auguuucuuuuguauguaa

SEQ ID NO: 2365519 - RNA, 20 nt, Human
auguuucuuuuguauguaaa

SEQ ID NO: 2365520 - RNA, 18 nt, Human
auguucucugaggacacu

SEQ ID NO: 2365521 - RNA, 16 nt, Human
auguucugaauaauuu

SEQ ID NO: 2365522 - RNA, 18 nt, Human
auguucugaauaauuucu

SEQ ID NO: 2365523 - RNA, 21 nt, Human
augugucaacuucaacauuua

SEQ ID NO: 2365524 - RNA, 13 nt, Human
auguguccugguu

SEQ ID NO: 2365525 - RNA, 21 nt, Human
augugucacuacucacagucu

SEQ ID NO: 2365526 - RNA, 17 nt, Human
auguguauuuuauuaca

SEQ ID NO: 2365527 - RNA, 20 nt, Human
auguguauuuccagugcaau

SEQ ID NO: 2365528 - RNA, 18 nt, Human
auguguauuacaaauauu

SEQ ID NO: 2365529 - RNA, 20 nt, Human
auguguaugggcaaaaaacu

SEQ ID NO: 2365530 - RNA, 20 nt, Human
auguguauguacguuuguau

SEQ ID NO: 2365531 - RNA, 19 nt, Human
auguguacaucccauguaa

SEQ ID NO: 2365532 - RNA, 21 nt, Human
auguguacaucccauguaaca

SEQ ID NO: 2365533 - RNA, 14 nt, Human
auguguacauggca

SEQ ID NO: 2365534 - RNA, 16 nt, Human
auguguacauggcaga

SEQ ID NO: 2365535 - RNA, 22 nt, Human
auguguacauggcagaguuugu

SEQ ID NO: 2365536 - RNA, 16 nt, Human
auguguacgugugugu

SEQ ID NO: 2365537 - RNA, 22 nt, Human
auguguaaucaauaaacgauuu

SEQ ID NO: 2365538 - RNA, 22 nt, Human
auguguacaaaaguuucauccu

SEQ ID NO: 2365539 - RNA, 14 nt, Human
aucccuagcuguga

SEQ ID NO: 2365540 - RNA, 19 nt, Human
aucccuaugcugccuaggc

SEQ ID NO: 2365541 - RNA, 14 nt, Human
aucccuaugcugcc

SEQ ID NO: 2365542 - RNA, 21 nt, Human
aucccuagucuucaagcagau

SEQ ID NO: 2365543 - RNA, 19 nt, Human
aucccuagucuucaagcag

SEQ ID NO: 2365544 - RNA, 17 nt, Human
aucccuaugggauucag

SEQ ID NO: 2365545 - RNA, 13 nt, Human
aucccucaccugu

SEQ ID NO: 2365546 - RNA, 22 nt, Human
aucccgccucuucuucuucaga

SEQ ID NO: 2365547 - RNA, 16 nt, Human
aucccgccaccuaucu

SEQ ID NO: 2365548 - RNA, 14 nt, Human
aucccggcugcccu

SEQ ID NO: 2365549 - RNA, 15 nt, Human
aucccuacuguaauu

SEQ ID NO: 2365550 - RNA, 18 nt, Human
auccucauacccaccccc

SEQ ID NO: 2365551 - RNA, 14 nt, Human
aucccucaccugua

SEQ ID NO: 2365552 - RNA, 17 nt, Human
aucccucaccuguagca

SEQ ID NO: 2365553 - RNA, 19 nt, Human
auccucauacccaccccca

SEQ ID NO: 2365554 - RNA, 22 nt, Human
auccucauacccacccccaccc

SEQ ID NO: 2365555 - RNA, 18 nt, Human
auccacccaccucagccu

SEQ ID NO: 2365556 - RNA, 20 nt, Human
auccacccaccucagccucc

SEQ ID NO: 2365557 - RNA, 16 nt, Human
auccacccaccucagc

SEQ ID NO: 2365558 - RNA, 15 nt, Human
aucccgauucacccu

SEQ ID NO: 2365559 - RNA, 20 nt, Human
aucccgauucacccugucca

SEQ ID NO: 2365560 - RNA, 19 nt, Human
aucccgagcaccuccacau

SEQ ID NO: 2365561 - RNA, 17 nt, Human
aucccgagcaccuccac

SEQ ID NO: 2365562 - RNA, 14 nt, Human
aucccgagcaccuc

SEQ ID NO: 2365563 - RNA, 14 nt, Human
aucccgaaaaucuc

SEQ ID NO: 2365564 - RNA, 15 nt, Human
auccacccagcccau

SEQ ID NO: 2365565 - RNA, 13 nt, Human
auccacccagccc

SEQ ID NO: 2365566 - RNA, 14 nt, Human
auccacccagccca

SEQ ID NO: 2365567 - RNA, 16 nt, Human
auccuccguccagccg

SEQ ID NO: 2365568 - RNA, 15 nt, Human
auccuccguccagcc

SEQ ID NO: 2365569 - RNA, 19 nt, Human
auccuccccuucccugcaa

SEQ ID NO: 2365570 - RNA, 11 nt, Human
auccuccucag

SEQ ID NO: 2365571 - RNA, 18 nt, Human
auccuccccuucccugca

SEQ ID NO: 2365572 - RNA, 15 nt, Human
auccuccccuucccu

SEQ ID NO: 2365573 - RNA, 13 nt, Human
auccuccccuucc

SEQ ID NO: 2365574 - RNA, 11 nt, Human
auccuccccuu

SEQ ID NO: 2365575 - RNA, 12 nt, Human
auccucccaggc

SEQ ID NO: 2365576 - RNA, 23 nt, Human
auccucauacccacccccaccca

SEQ ID NO: 2365577 - RNA, 13 nt, Human
auccuccaggugc

SEQ ID NO: 2365578 - RNA, 14 nt, Human
auccuccaggugca

SEQ ID NO: 2365579 - RNA, 19 nt, Human
auccuccaggugcacaagc

SEQ ID NO: 2365580 - RNA, 22 nt, Human
auccuccaggugcacaagcucc

SEQ ID NO: 2365581 - RNA, 13 nt, Human
aucgaugcagugc

SEQ ID NO: 2365582 - RNA, 15 nt, Human
auccuuuuucuuuau

SEQ ID NO: 2365583 - RNA, 19 nt, Human
auccuuuuauguuauuuau

SEQ ID NO: 2365584 - RNA, 13 nt, Human
aucgauguuaugu

SEQ ID NO: 2365585 - RNA, 15 nt, Human
aucgauguuauguaa

SEQ ID NO: 2365586 - RNA, 20 nt, Human
aucgauuuuuaaaaauuaaa

SEQ ID NO: 2365587 - RNA, 11 nt, Human
aucgauuggcu

SEQ ID NO: 2365588 - RNA, 12 nt, Human
aucgauuggcuu

SEQ ID NO: 2365589 - RNA, 15 nt, Human
aucgaggaaccagag

SEQ ID NO: 2365590 - RNA, 22 nt, Human
auccuuuuuaaauucaguccua

SEQ ID NO: 2365591 - RNA, 23 nt, Human
aucgaugggggagucugaagcag

SEQ ID NO: 2365592 - RNA, 13 nt, Human
aucgauggccuug

SEQ ID NO: 2365593 - RNA, 15 nt, Human
auccuuuucugcaga

SEQ ID NO: 2365594 - RNA, 17 nt, Human
auccuuuuauguuauuu

SEQ ID NO: 2365595 - RNA, 18 nt, Human
auccuuuuauguuauuua

SEQ ID NO: 2365596 - RNA, 13 nt, Human
auccuuuuauguu

SEQ ID NO: 2365597 - RNA, 16 nt, Human
auccuuuuauguuauu

SEQ ID NO: 2365598 - RNA, 17 nt, Human
auccuuucugccucuca

SEQ ID NO: 2365599 - RNA, 19 nt, Human
auccuuucugccucucaac

SEQ ID NO: 2365600 - RNA, 14 nt, Human
auccuccucagauc

SEQ ID NO: 2365601 - RNA, 15 nt, Human
auccuuucuaaacaa

SEQ ID NO: 2365602 - RNA, 15 nt, Human
auccuuucuauugaa

SEQ ID NO: 2365603 - RNA, 13 nt, Human
auccuuucuaaca

SEQ ID NO: 2365604 - RNA, 20 nt, Human
aucgcaccacuguguauuua

SEQ ID NO: 2365605 - RNA, 17 nt, Human
aucgcaccauucugacu

SEQ ID NO: 2365606 - RNA, 18 nt, Human
aucgcaccauucugacuc

SEQ ID NO: 2365607 - RNA, 13 nt, Human
aucauguacauuu

SEQ ID NO: 2365608 - RNA, 23 nt, Human
aucaugguguaauaagacauaac

SEQ ID NO: 2365609 - RNA, 17 nt, Human
aucaugguguaauaaga

SEQ ID NO: 2365610 - RNA, 18 nt, Human
aucaugguguaauaagac

SEQ ID NO: 2365611 - RNA, 19 nt, Human
aucaugguguaauaagaca

SEQ ID NO: 2365612 - RNA, 20 nt, Human
aucaugguguaauaagacau

SEQ ID NO: 2365613 - RNA, 14 nt, Human
aucauguacauuuc

SEQ ID NO: 2365614 - RNA, 21 nt, Human
aucaugguguaauaagacaua

SEQ ID NO: 2365615 - RNA, 20 nt, Human
aucauggauucauuacagcu

SEQ ID NO: 2365616 - RNA, 21 nt, Human
aucauggauucauuacagcuu

SEQ ID NO: 2365617 - RNA, 15 nt, Human
aucauggcuaucugu

SEQ ID NO: 2365618 - RNA, 14 nt, Human
aucaugguguaaua

SEQ ID NO: 2365619 - RNA, 16 nt, Human
aucaugguguaauaag

SEQ ID NO: 2365620 - RNA, 21 nt, Human
aucaucuauugcuggcaaaga

SEQ ID NO: 2365621 - RNA, 23 nt, Human
aucaucuccugccuuccuccugg

SEQ ID NO: 2365622 - RNA, 20 nt, Human
aucaucuccugccuuccucc

SEQ ID NO: 2365623 - RNA, 19 nt, Human
aucauggagguuugaagau

SEQ ID NO: 2365624 - RNA, 12 nt, Human
aucauggaguga

SEQ ID NO: 2365625 - RNA, 18 nt, Human
aucaucugugugaaaaug

SEQ ID NO: 2365626 - RNA, 19 nt, Human
aucaucugugugaaaaugg

SEQ ID NO: 2365627 - RNA, 18 nt, Human
aucaucuguggaacccau

SEQ ID NO: 2365628 - RNA, 13 nt, Human
aucaucuguguga

SEQ ID NO: 2365629 - RNA, 16 nt, Human
aucaucugugugaaaa

SEQ ID NO: 2365630 - RNA, 13 nt, Human
aucaucugccgug

SEQ ID NO: 2365631 - RNA, 18 nt, Human
aucaucuauaaagaagaa

SEQ ID NO: 2365632 - RNA, 23 nt, Human
aucagcugcuacuacuccuguag

SEQ ID NO: 2365633 - RNA, 13 nt, Human
aucagcugcuacu

SEQ ID NO: 2365634 - RNA, 17 nt, Human
aucagcugcugaaacaa

SEQ ID NO: 2365635 - RNA, 14 nt, Human
aucagccugucucu

SEQ ID NO: 2365636 - RNA, 22 nt, Human
aucagccugagucuccugugcc

SEQ ID NO: 2365637 - RNA, 12 nt, Human
aucagcugcuac

SEQ ID NO: 2365638 - RNA, 21 nt, Human
aucagccugggcaaugugaua

SEQ ID NO: 2365639 - RNA, 20 nt, Human
aucagccugggcaaugugau

SEQ ID NO: 2365640 - RNA, 11 nt, Human
aucagccuggg

SEQ ID NO: 2365641 - RNA, 15 nt, Human
aucagccucuuaaag

SEQ ID NO: 2365642 - RNA, 12 nt, Human
aucagccugagu

SEQ ID NO: 2365643 - RNA, 17 nt, Human
aucagccugagucuccu

SEQ ID NO: 2365644 - RNA, 18 nt, Human
aucagccugagucuccug

SEQ ID NO: 2365645 - RNA, 19 nt, Human
aucagccugagucuccugu

SEQ ID NO: 2365646 - RNA, 20 nt, Human
aucagccugagucuccugug

SEQ ID NO: 2365647 - RNA, 13 nt, Human
aucagccucuuaa

SEQ ID NO: 2365648 - RNA, 11 nt, Human
aucagccucuu

SEQ ID NO: 2365649 - RNA, 20 nt, Human
aucagccuaggggucaggga

SEQ ID NO: 2365650 - RNA, 15 nt, Human
aucagccacauucua

SEQ ID NO: 2365651 - RNA, 16 nt, Human
aucagccaauuauguu

SEQ ID NO: 2365652 - RNA, 18 nt, Human
aucagccaauuauguuaa

SEQ ID NO: 2365653 - RNA, 19 nt, Human
aucagccaauuauguuaaa

SEQ ID NO: 2365654 - RNA, 14 nt, Human
aucaccucaggcca

SEQ ID NO: 2365655 - RNA, 13 nt, Human
aucaccuccccuc

SEQ ID NO: 2365656 - RNA, 15 nt, Human
aucagccaauuaugu

SEQ ID NO: 2365657 - RNA, 14 nt, Human
aucagccaauuaug

SEQ ID NO: 2365658 - RNA, 12 nt, Human
aucaccugaggu

SEQ ID NO: 2365659 - RNA, 15 nt, Human
aucaccuccccuccu

SEQ ID NO: 2365660 - RNA, 15 nt, Human
aucaccucaggccag

SEQ ID NO: 2365661 - RNA, 12 nt, Human
aucaccuccccu

SEQ ID NO: 2365662 - RNA, 13 nt, Human
aucaccugcccug

SEQ ID NO: 2365663 - RNA, 12 nt, Human
aucaccugcccu

SEQ ID NO: 2365664 - RNA, 13 nt, Human
augaccuuacauu

SEQ ID NO: 2365665 - RNA, 19 nt, Human
augacucaggacauccccc

SEQ ID NO: 2365666 - RNA, 17 nt, Human
augacucacaugaugca

SEQ ID NO: 2365667 - RNA, 14 nt, Human
augacucagaauau

SEQ ID NO: 2365668 - RNA, 19 nt, Human
augacuagaggcagggagg

SEQ ID NO: 2365669 - RNA, 15 nt, Human
augacuagaggcagg

SEQ ID NO: 2365670 - RNA, 21 nt, Human
augaccugugaccagcacugu

SEQ ID NO: 2365671 - RNA, 19 nt, Human
augaccugugaccagcacu

SEQ ID NO: 2365672 - RNA, 14 nt, Human
augaccuggauaac

SEQ ID NO: 2365673 - RNA, 22 nt, Human
augacuagaggcagggagggga

SEQ ID NO: 2365674 - RNA, 17 nt, Human
augacuccagaauuucc

SEQ ID NO: 2365675 - RNA, 16 nt, Human
augacucggggguggg

SEQ ID NO: 2365676 - RNA, 12 nt, Human
augacuccagaa

SEQ ID NO: 2365677 - RNA, 16 nt, Human
augacuccagaauuuc

SEQ ID NO: 2365678 - RNA, 11 nt, Human
augaccccucc

SEQ ID NO: 2365679 - RNA, 22 nt, Human
augacccaggcugggcaaggag

SEQ ID NO: 2365680 - RNA, 19 nt, Human
augaagcuuguguauccau

SEQ ID NO: 2365681 - RNA, 23 nt, Human
augaagcuuuauacguguagcua

SEQ ID NO: 2365682 - RNA, 12 nt, Human
augacccagugg

SEQ ID NO: 2365683 - RNA, 16 nt, Human
augaccucaugcaucu

SEQ ID NO: 2365684 - RNA, 18 nt, Human
augaccucuuccuuuagg

SEQ ID NO: 2365685 - RNA, 23 nt, Human
augacccugcgaaggggcccugg

SEQ ID NO: 2365686 - RNA, 18 nt, Human
augaccuaguuuuccaug

SEQ ID NO: 2365687 - RNA, 18 nt, Human
augaagcuuuuaugugaa

SEQ ID NO: 2365688 - RNA, 19 nt, Human
augaagcuuuuaugugaaa

SEQ ID NO: 2365689 - RNA, 20 nt, Human
augaagcuuuuaugugaaac

SEQ ID NO: 2365690 - RNA, 21 nt, Human
augaagcuuuuaugugaaaca

SEQ ID NO: 2365691 - RNA, 20 nt, Human
augaaaacguuuuauugugu

SEQ ID NO: 2365692 - RNA, 18 nt, Human
augaaaacguuuuauugu

SEQ ID NO: 2365693 - RNA, 21 nt, Human
augaaaaaaggacaauuucaa

SEQ ID NO: 2365694 - RNA, 12 nt, Human
augaaaacuuau

SEQ ID NO: 2365695 - RNA, 19 nt, Human
augaaaacguuuuauugug

SEQ ID NO: 2365696 - RNA, 12 nt, Human
augaaaacucau

SEQ ID NO: 2365697 - RNA, 17 nt, Human
augaaaauacaacuuaa

SEQ ID NO: 2365698 - RNA, 13 nt, Human
augaaaauacaac

SEQ ID NO: 2365699 - RNA, 22 nt, Human
augaaaauacaacuuaaauaau

SEQ ID NO: 2365700 - RNA, 16 nt, Human
augaaaaugucuugug

SEQ ID NO: 2365701 - RNA, 14 nt, Human
augaaaauuguaug

SEQ ID NO: 2365702 - RNA, 12 nt, Human
augaaacaccuu

SEQ ID NO: 2365703 - RNA, 16 nt, Human
augaaacaccuucucu

SEQ ID NO: 2365704 - RNA, 20 nt, Human
augaaacacucaguuguuca

SEQ ID NO: 2365705 - RNA, 13 nt, Human
augaaacagaaac

SEQ ID NO: 2365706 - RNA, 17 nt, Human
augaaacaccuucucug

SEQ ID NO: 2365707 - RNA, 19 nt, Human
augaaacaccuucucugga

SEQ ID NO: 2365708 - RNA, 22 nt, Human
augaaacagaaacaaaaacacu

SEQ ID NO: 2365709 - RNA, 18 nt, Human
augaaacagaaacaaaaa

SEQ ID NO: 2365710 - RNA, 16 nt, Human
augaaacccccacaca

SEQ ID NO: 2365711 - RNA, 15 nt, Human
augaaacccccacac

SEQ ID NO: 2365712 - RNA, 19 nt, Human
augaaacccccacacacac

SEQ ID NO: 2365713 - RNA, 22 nt, Human
augaaaccuuauuuuuucccaa

SEQ ID NO: 2365714 - RNA, 18 nt, Human
augaagcuuguguaucca

SEQ ID NO: 2365715 - RNA, 18 nt, Human
augaaacccccacacaca

SEQ ID NO: 2365716 - RNA, 17 nt, Human
augaaacccccacacac

SEQ ID NO: 2365717 - RNA, 13 nt, Human
augaaaacaugua

SEQ ID NO: 2365718 - RNA, 20 nt, Human
aucuuuuuuuuauuccacau

SEQ ID NO: 2365719 - RNA, 14 nt, Human
aucuuuuuucacaa

SEQ ID NO: 2365720 - RNA, 17 nt, Human
aucuuuuuucacaaauu

SEQ ID NO: 2365721 - RNA, 22 nt, Human
augaaaaaauauauaucaaaua

SEQ ID NO: 2365722 - RNA, 14 nt, Human
augaaaaaauauau

SEQ ID NO: 2365723 - RNA, 17 nt, Human
augaaaaaauauauauc

SEQ ID NO: 2365724 - RNA, 14 nt, Human
aucuuuuuucaaaa

SEQ ID NO: 2365725 - RNA, 14 nt, Human
augagcuccagacc

SEQ ID NO: 2365726 - RNA, 14 nt, Human
augagccuggcaag

SEQ ID NO: 2365727 - RNA, 13 nt, Human
augagccuggcaa

SEQ ID NO: 2365728 - RNA, 13 nt, Human
augagcuccagac

SEQ ID NO: 2365729 - RNA, 20 nt, Human
augagcuauuuccauuccag

SEQ ID NO: 2365730 - RNA, 21 nt, Human
augagcuauuuccauuccaga

SEQ ID NO: 2365731 - RNA, 22 nt, Human
augagcuauuuccauuccagaa

SEQ ID NO: 2365732 - RNA, 23 nt, Human
augagcuauuuccauuccagaau

SEQ ID NO: 2365733 - RNA, 19 nt, Human
augagcuacgccugccucc

SEQ ID NO: 2365734 - RNA, 22 nt, Human
augacucccuuaaaauagaaau

SEQ ID NO: 2365735 - RNA, 14 nt, Human
augagcuauguauu

SEQ ID NO: 2365736 - RNA, 15 nt, Human
augagcuauguauua

SEQ ID NO: 2365737 - RNA, 16 nt, Human
augagcuauguauuaa

SEQ ID NO: 2365738 - RNA, 18 nt, Human
aucugggcauagaugcag

SEQ ID NO: 2365739 - RNA, 20 nt, Human
aucugggaguccccuuuucu

SEQ ID NO: 2365740 - RNA, 22 nt, Human
aucugggauucccaccaagguc

SEQ ID NO: 2365741 - RNA, 15 nt, Human
aucugggccagaauu

SEQ ID NO: 2365742 - RNA, 23 nt, Human
aucugggacccuuuccuuccuuc

SEQ ID NO: 2365743 - RNA, 18 nt, Human
aucugggaguccccuuuu

SEQ ID NO: 2365744 - RNA, 22 nt, Human
aucugggacccuuuccuuccuu

SEQ ID NO: 2365745 - RNA, 20 nt, Human
aucugggacccuuuccuucc

SEQ ID NO: 2365746 - RNA, 17 nt, Human
aucugggacccuuuccu

SEQ ID NO: 2365747 - RNA, 19 nt, Human
aucuggaccccaucuguga

SEQ ID NO: 2365748 - RNA, 21 nt, Human
aucuggaagccaaaauguagg

SEQ ID NO: 2365749 - RNA, 20 nt, Human
aucuggaaggggaucccacc

SEQ ID NO: 2365750 - RNA, 21 nt, Human
aucuggaaucuggagaccagg

SEQ ID NO: 2365751 - RNA, 22 nt, Human
aucuggaaccucagccuggcca

SEQ ID NO: 2365752 - RNA, 21 nt, Human
aucuggaaccucagccuggcc

SEQ ID NO: 2365753 - RNA, 20 nt, Human
aucuggaaccucagccuggc

SEQ ID NO: 2365754 - RNA, 19 nt, Human
aucuggaaccucagccugg

SEQ ID NO: 2365755 - RNA, 17 nt, Human
aucugggccagaauuuc

SEQ ID NO: 2365756 - RNA, 22 nt, Human
aucugggcuccuaaccuuccug

SEQ ID NO: 2365757 - RNA, 22 nt, Human
aucuuauaauuuaaaauaugcu

SEQ ID NO: 2365758 - RNA, 18 nt, Human
aucuuaucauggucucag

SEQ ID NO: 2365759 - RNA, 20 nt, Human
aucuuaucauggucucaguc

SEQ ID NO: 2365760 - RNA, 23 nt, Human
aucuucacuucuaaaugcauauc

SEQ ID NO: 2365761 - RNA, 13 nt, Human
aucuucacuucua

SEQ ID NO: 2365762 - RNA, 14 nt, Human
aucuucagagcagg

SEQ ID NO: 2365763 - RNA, 18 nt, Human
aucuucagagcagggguc

SEQ ID NO: 2365764 - RNA, 12 nt, Human
aucuucagcuuc

SEQ ID NO: 2365765 - RNA, 13 nt, Human
aucuucagcuucu

SEQ ID NO: 2365766 - RNA, 14 nt, Human
aucuucagcuucuu

SEQ ID NO: 2365767 - RNA, 15 nt, Human
aucuucagcuucuuc

SEQ ID NO: 2365768 - RNA, 21 nt, Human
aucuucaccagaggaaucacu

SEQ ID NO: 2365769 - RNA, 22 nt, Human
aucuucaccagaggaaucacuc

SEQ ID NO: 2365770 - RNA, 22 nt, Human
aucuucaguuuuaucuuuaauc

SEQ ID NO: 2365771 - RNA, 20 nt, Human
aucuucaguuuuaucuuuaa

SEQ ID NO: 2365772 - RNA, 14 nt, Human
aucuucaguuuuau

SEQ ID NO: 2365773 - RNA, 19 nt, Human
aucuuccaacucaaacucu

SEQ ID NO: 2365774 - RNA, 13 nt, Human
aucuucuaaaugg

SEQ ID NO: 2365775 - RNA, 15 nt, Human
aucucucuucuuuuc

SEQ ID NO: 2365776 - RNA, 12 nt, Human
aucucucuggcc

SEQ ID NO: 2365777 - RNA, 13 nt, Human
aucucucuggccc

SEQ ID NO: 2365778 - RNA, 14 nt, Human
aucucucuggcccu

SEQ ID NO: 2365779 - RNA, 22 nt, Human
aucucucugaauccuaagggcu

SEQ ID NO: 2365780 - RNA, 23 nt, Human
aucucucuacuccuaccucagcc

SEQ ID NO: 2365781 - RNA, 14 nt, Human
aucucucugcccaa

SEQ ID NO: 2365782 - RNA, 13 nt, Human
aucugcucuccuu

SEQ ID NO: 2365783 - RNA, 14 nt, Human
aucugcucuccuuc

SEQ ID NO: 2365784 - RNA, 20 nt, Human
aucugcucagcccuggaggu

SEQ ID NO: 2365785 - RNA, 18 nt, Human
aucucucugugcugugga

SEQ ID NO: 2365786 - RNA, 23 nt, Human
aucucucugugcuguggaagcaa

SEQ ID NO: 2365787 - RNA, 15 nt, Human
aucugcucuccuucc

SEQ ID NO: 2365788 - RNA, 16 nt, Human
aucugcucuccuuccu

SEQ ID NO: 2365789 - RNA, 17 nt, Human
aucugcucuccuuccug

SEQ ID NO: 2365790 - RNA, 20 nt, Human
aucugcucuccuuccuggag

SEQ ID NO: 2365791 - RNA, 11 nt, Human
aucugcugucc

SEQ ID NO: 2365792 - RNA, 16 nt, Human
aucugcuguccagaca

SEQ ID NO: 2365793 - RNA, 17 nt, Human
aucugcuguccagacag

SEQ ID NO: 2365794 - RNA, 18 nt, Human
aucugcuguccagacagc

SEQ ID NO: 2365795 - RNA, 21 nt, Human
aucugcuguccagacagccug

SEQ ID NO: 2365796 - RNA, 22 nt, Human
aucugcuguccagacagccugu

SEQ ID NO: 2365797 - RNA, 23 nt, Human
aucugcuguccagacagccugua

SEQ ID NO: 2365798 - RNA, 13 nt, Human
aucugcuccuccc

SEQ ID NO: 2365799 - RNA, 21 nt, Human
aucugcucuccuuccuggagc

SEQ ID NO: 2365800 - RNA, 18 nt, Human
aucugcuggaguuucaug

SEQ ID NO: 2365801 - RNA, 14 nt, Human
aucugcuggaguuu

SEQ ID NO: 2365802 - RNA, 23 nt, Human
aucuggaacccagacucagacau

SEQ ID NO: 2365803 - RNA, 19 nt, Human
aucuggaacccagacucag

SEQ ID NO: 2365804 - RNA, 18 nt, Human
aucuggaaccucagccug

SEQ ID NO: 2365805 - RNA, 17 nt, Human
aucuggaaccucagccu

SEQ ID NO: 2365806 - RNA, 16 nt, Human
aucuggaaccucagcc

SEQ ID NO: 2365807 - RNA, 11 nt, Human
aucuggaaccu

SEQ ID NO: 2365808 - RNA, 22 nt, Human
aucucucuacuccuaccucagc

SEQ ID NO: 2365809 - RNA, 21 nt, Human
aucucucuacuccuaccucag

SEQ ID NO: 2365810 - RNA, 13 nt, Human
aucucuauuuaau

SEQ ID NO: 2365811 - RNA, 14 nt, Human
aucucuauuuaaua

SEQ ID NO: 2365812 - RNA, 15 nt, Human
aucucuauuuaauau

SEQ ID NO: 2365813 - RNA, 16 nt, Human
aucucuauuuaauauu

SEQ ID NO: 2365814 - RNA, 22 nt, Human
aucucucgugauugauaagaac

SEQ ID NO: 2365815 - RNA, 18 nt, Human
aucucuacuaaaaauaca

SEQ ID NO: 2365816 - RNA, 23 nt, Human
aucucuaauuggaagaaauuccu

SEQ ID NO: 2365817 - RNA, 22 nt, Human
aucucuaauauggcaaaaaugg

SEQ ID NO: 2365818 - RNA, 15 nt, Human
aucucuaauuggaag

SEQ ID NO: 2365819 - RNA, 18 nt, Human
aucucuagaauuuuaagu

SEQ ID NO: 2365820 - RNA, 16 nt, Human
aucucuagaauuuuaa

SEQ ID NO: 2365821 - RNA, 15 nt, Human
aucucuagaauuuua

SEQ ID NO: 2365822 - RNA, 21 nt, Human
aucucuagaauuuuaagugcu

SEQ ID NO: 2365823 - RNA, 20 nt, Human
aucucuaacagcucaggauc

SEQ ID NO: 2365824 - RNA, 18 nt, Human
aucucuaacagcucagga

SEQ ID NO: 2365825 - RNA, 13 nt, Human
aucucuaauaugg

SEQ ID NO: 2365826 - RNA, 15 nt, Human
aucucuaauauggca

SEQ ID NO: 2365827 - RNA, 15 nt, Human
aucucguuucaaaaa

SEQ ID NO: 2365828 - RNA, 17 nt, Human
aucucguuucaaaaaca

SEQ ID NO: 2365829 - RNA, 22 nt, Human
aucucguuuuucuucuuaagac

SEQ ID NO: 2365830 - RNA, 23 nt, Human
aucucguuuuucuucuuaagacu

SEQ ID NO: 2365831 - RNA, 14 nt, Human
aucucguuucaaaa

SEQ ID NO: 2365832 - RNA, 22 nt, Human
aucuucuccaucuggcagggug

SEQ ID NO: 2365833 - RNA, 14 nt, Human
aucuucucuggcga

SEQ ID NO: 2365834 - RNA, 19 nt, Human
aucuucuccaucuggcagg

SEQ ID NO: 2365835 - RNA, 15 nt, Human
aucuucuccaucugg

SEQ ID NO: 2365836 - RNA, 22 nt, Human
aucuucucagcucccauuucua

SEQ ID NO: 2365837 - RNA, 15 nt, Human
aucuucuccaggaug

SEQ ID NO: 2365838 - RNA, 24 nt, Human
aucuucucagaaggcaaaugacuu

SEQ ID NO: 2365839 - RNA, 12 nt, Human
aucuucucagcu

SEQ ID NO: 2365840 - RNA, 13 nt, Human
aucuucucagcuc

SEQ ID NO: 2365841 - RNA, 14 nt, Human
aucuucucagcucc

SEQ ID NO: 2365842 - RNA, 15 nt, Human
aucuucucagcuccc

SEQ ID NO: 2365843 - RNA, 16 nt, Human
aucuucucagcuccca

SEQ ID NO: 2365844 - RNA, 21 nt, Human
aucuucucagcucccauuucu

SEQ ID NO: 2365845 - RNA, 17 nt, Human
aucuucuuuauaauucu

SEQ ID NO: 2365846 - RNA, 12 nt, Human
aucuugaaauua

SEQ ID NO: 2365847 - RNA, 14 nt, Human
aucuucuuugcagc

SEQ ID NO: 2365848 - RNA, 21 nt, Human
aucuucuuugcagccugggug

SEQ ID NO: 2365849 - RNA, 17 nt, Human
aucuugaaaugaaagua

SEQ ID NO: 2365850 - RNA, 23 nt, Human
aucuugaaauuaagaaggcaaaa

SEQ ID NO: 2365851 - RNA, 22 nt, Human
aucuugaaauuaagaaggcaaa

SEQ ID NO: 2365852 - RNA, 21 nt, Human
aucuugaaauuaagaaggcaa

SEQ ID NO: 2365853 - RNA, 17 nt, Human
aucuugaagacuuuucu

SEQ ID NO: 2365854 - RNA, 17 nt, Human
agucauucguucugugg

SEQ ID NO: 2365855 - RNA, 15 nt, Human
agucauuggcugucu

SEQ ID NO: 2365856 - RNA, 14 nt, Human
agucauuggcuuua

SEQ ID NO: 2365857 - RNA, 15 nt, Human
agucauuggcuuuau

SEQ ID NO: 2365858 - RNA, 18 nt, Human
agucauuggcuuuauccu

SEQ ID NO: 2365859 - RNA, 20 nt, Human
agucauuggcuuuauccucu

SEQ ID NO: 2365860 - RNA, 21 nt, Human
agucauuggcuuuauccucuu

SEQ ID NO: 2365861 - RNA, 22 nt, Human
agucauuggcuuuauccucuuu

SEQ ID NO: 2365862 - RNA, 16 nt, Human
aguccaagcauuuaga

SEQ ID NO: 2365863 - RNA, 17 nt, Human
aguccaaugucuuuuua

SEQ ID NO: 2365864 - RNA, 20 nt, Human
aguccaaucucauggagaag

SEQ ID NO: 2365865 - RNA, 14 nt, Human
aguccacaaaauaa

SEQ ID NO: 2365866 - RNA, 14 nt, Human
aguccaauguggca

SEQ ID NO: 2365867 - RNA, 21 nt, Human
aguccaaggaaaccacagcug

SEQ ID NO: 2365868 - RNA, 23 nt, Human
aguccaaggaaaccacagcugcu

SEQ ID NO: 2365869 - RNA, 16 nt, Human
aguccaagcugggaga

SEQ ID NO: 2365870 - RNA, 18 nt, Human
aguccaaggaaaccacag

SEQ ID NO: 2365871 - RNA, 14 nt, Human
aguccaagcuggga

SEQ ID NO: 2365872 - RNA, 11 nt, Human
aguccaagcug

SEQ ID NO: 2365873 - RNA, 21 nt, Human
aguccaagcauuuagauguau

SEQ ID NO: 2365874 - RNA, 22 nt, Human
agucauuaugagaggcaaugau

SEQ ID NO: 2365875 - RNA, 21 nt, Human
agucauuauagaucccccaga

SEQ ID NO: 2365876 - RNA, 23 nt, Human
agucauuauagaucccccagacu

SEQ ID NO: 2365877 - RNA, 18 nt, Human
agucauuauccuugcuau

SEQ ID NO: 2365878 - RNA, 20 nt, Human
agucauuauccuugcuauga

SEQ ID NO: 2365879 - RNA, 14 nt, Human
agucauuagacucc

SEQ ID NO: 2365880 - RNA, 15 nt, Human
agucauuagacuccu

SEQ ID NO: 2365881 - RNA, 16 nt, Human
agucauuagacuccuc

SEQ ID NO: 2365882 - RNA, 18 nt, Human
agucauuagacuccuccu

SEQ ID NO: 2365883 - RNA, 19 nt, Human
agucauuagacuccuccuc

SEQ ID NO: 2365884 - RNA, 20 nt, Human
agucauuagacuccuccucc

SEQ ID NO: 2365885 - RNA, 19 nt, Human
agucauuauagauccccca

SEQ ID NO: 2365886 - RNA, 20 nt, Human
agucauuauagaucccccag

SEQ ID NO: 2365887 - RNA, 16 nt, Human
agucaaggaguggcuu

SEQ ID NO: 2365888 - RNA, 22 nt, Human
agucaagcuccuccucccugca

SEQ ID NO: 2365889 - RNA, 20 nt, Human
agucaagcuccuccucccug

SEQ ID NO: 2365890 - RNA, 15 nt, Human
agucaagagcauccu

SEQ ID NO: 2365891 - RNA, 14 nt, Human
agucaagcuccucc

SEQ ID NO: 2365892 - RNA, 13 nt, Human
agucaagcuccuc

SEQ ID NO: 2365893 - RNA, 18 nt, Human
agucaagcuccuccuccc

SEQ ID NO: 2365894 - RNA, 17 nt, Human
agucaagcuccuccucc

SEQ ID NO: 2365895 - RNA, 16 nt, Human
agucaagcuccuccuc

SEQ ID NO: 2365896 - RNA, 15 nt, Human
agucaagcuccuccu

SEQ ID NO: 2365897 - RNA, 16 nt, Human
agucaagugaaaaagg

SEQ ID NO: 2365898 - RNA, 18 nt, Human
agucaaggguaggguggg

SEQ ID NO: 2365899 - RNA, 15 nt, Human
agucaaccugggcaa

SEQ ID NO: 2365900 - RNA, 14 nt, Human
agucaaccugggca

SEQ ID NO: 2365901 - RNA, 12 nt, Human
agucaagaaaaa

SEQ ID NO: 2365902 - RNA, 19 nt, Human
agucaagaaaaauuauugu

SEQ ID NO: 2365903 - RNA, 15 nt, Human
agucaaccugccuga

SEQ ID NO: 2365904 - RNA, 15 nt, Human
agucaaauuguguga

SEQ ID NO: 2365905 - RNA, 17 nt, Human
agucaaauugugugaaa

SEQ ID NO: 2365906 - RNA, 13 nt, Human
agucaaauugugu

SEQ ID NO: 2365907 - RNA, 20 nt, Human
agucaagugaaaaaggagga

SEQ ID NO: 2365908 - RNA, 17 nt, Human
agucaauauuuuuagau

SEQ ID NO: 2365909 - RNA, 20 nt, Human
agucaagugcguccacgagc

SEQ ID NO: 2365910 - RNA, 17 nt, Human
aguccaccugagcugcc

SEQ ID NO: 2365911 - RNA, 18 nt, Human
aguccaaugucuuuuuaa

SEQ ID NO: 2365912 - RNA, 12 nt, Human
aguccaccugag

SEQ ID NO: 2365913 - RNA, 14 nt, Human
aguccacuuuguuu

SEQ ID NO: 2365914 - RNA, 14 nt, Human
aguccacucccagu

SEQ ID NO: 2365915 - RNA, 16 nt, Human
aguccacucccagugc

SEQ ID NO: 2365916 - RNA, 20 nt, Human
aguccacucccagugcuugc

SEQ ID NO: 2365917 - RNA, 21 nt, Human
aguccugccuggccaggcaga

SEQ ID NO: 2365918 - RNA, 20 nt, Human
aguccugccuggccaggcag

SEQ ID NO: 2365919 - RNA, 17 nt, Human
aguccugccuggccagg

SEQ ID NO: 2365920 - RNA, 16 nt, Human
aguccugccuggccag

SEQ ID NO: 2365921 - RNA, 15 nt, Human
aguccugccuggcca

SEQ ID NO: 2365922 - RNA, 14 nt, Human
aguccugccuggcc

SEQ ID NO: 2365923 - RNA, 13 nt, Human
aguccugccuggc

SEQ ID NO: 2365924 - RNA, 16 nt, Human
aguccugccucagccu

SEQ ID NO: 2365925 - RNA, 14 nt, Human
aguccuggaagcca

SEQ ID NO: 2365926 - RNA, 23 nt, Human
aguccuggaagccagcuuucccu

SEQ ID NO: 2365927 - RNA, 22 nt, Human
aguccuggaagccagcuuuccc

SEQ ID NO: 2365928 - RNA, 20 nt, Human
aguccuggaagccagcuuuc

SEQ ID NO: 2365929 - RNA, 23 nt, Human
agugacaaggccccagagacuca

SEQ ID NO: 2365930 - RNA, 13 nt, Human
agugacacagcag

SEQ ID NO: 2365931 - RNA, 21 nt, Human
agugacaaggccccagagacu

SEQ ID NO: 2365932 - RNA, 20 nt, Human
agugacaaggccccagagac

SEQ ID NO: 2365933 - RNA, 18 nt, Human
agugacaaggccccagag

SEQ ID NO: 2365934 - RNA, 16 nt, Human
agugacaaggccccag

SEQ ID NO: 2365935 - RNA, 15 nt, Human
agugacaaggcccca

SEQ ID NO: 2365936 - RNA, 14 nt, Human
agugacaaggcccc

SEQ ID NO: 2365937 - RNA, 22 nt, Human
agugacacuucagagagcuggu

SEQ ID NO: 2365938 - RNA, 21 nt, Human
agugacacuucagagagcugg

SEQ ID NO: 2365939 - RNA, 20 nt, Human
agugacacuucagagagcug

SEQ ID NO: 2365940 - RNA, 18 nt, Human
agugacacuucagagagc

SEQ ID NO: 2365941 - RNA, 15 nt, Human
agugacacuucagag

SEQ ID NO: 2365942 - RNA, 23 nt, Human
agugacacagcagcuucaccaga

SEQ ID NO: 2365943 - RNA, 17 nt, Human
agugacacagcagcuuc

SEQ ID NO: 2365944 - RNA, 18 nt, Human
agugacacagcagcuuca

SEQ ID NO: 2365945 - RNA, 23 nt, Human
agugacacuucagagagcuggua

SEQ ID NO: 2365946 - RNA, 21 nt, Human
agugacagaccacaucuuuau

SEQ ID NO: 2365947 - RNA, 16 nt, Human
agugacagacaggcuc

SEQ ID NO: 2365948 - RNA, 17 nt, Human
agugacagacaggcucu

SEQ ID NO: 2365949 - RNA, 13 nt, Human
agugauccuccca

SEQ ID NO: 2365950 - RNA, 19 nt, Human
agugaucaauaaaauguga

SEQ ID NO: 2365951 - RNA, 17 nt, Human
agugaucaauaaaaugu

SEQ ID NO: 2365952 - RNA, 16 nt, Human
agugaucaauaaaaug

SEQ ID NO: 2365953 - RNA, 24 nt, Human
agugauauggcagaagacaccaga

SEQ ID NO: 2365954 - RNA, 21 nt, Human
agugauauggcagaagacacc

SEQ ID NO: 2365955 - RNA, 22 nt, Human
agugauauggcagaagacacca

SEQ ID NO: 2365956 - RNA, 20 nt, Human
agugugaagcuuccuuggcu

SEQ ID NO: 2365957 - RNA, 12 nt, Human
agugugaaguua

SEQ ID NO: 2365958 - RNA, 13 nt, Human
agugugaaguuag

SEQ ID NO: 2365959 - RNA, 14 nt, Human
agugugaaguuaga

SEQ ID NO: 2365960 - RNA, 15 nt, Human
agugugaaguuagaa

SEQ ID NO: 2365961 - RNA, 18 nt, Human
agugugaaguuagaauuc

SEQ ID NO: 2365962 - RNA, 20 nt, Human
agugugaaguuagaauuccu

SEQ ID NO: 2365963 - RNA, 21 nt, Human
agugugaaguuagaauuccuu

SEQ ID NO: 2365964 - RNA, 22 nt, Human
agugugaaguuagaauuccuuc

SEQ ID NO: 2365965 - RNA, 23 nt, Human
agugugacaaggauugcuacugu

SEQ ID NO: 2365966 - RNA, 15 nt, Human
agugugaaauagaca

SEQ ID NO: 2365967 - RNA, 16 nt, Human
agugucuuccuguggg

SEQ ID NO: 2365968 - RNA, 14 nt, Human
agugugaacuggac

SEQ ID NO: 2365969 - RNA, 13 nt, Human
agugugaacaaaa

SEQ ID NO: 2365970 - RNA, 22 nt, Human
agugugaacaaaagaugcucuu

SEQ ID NO: 2365971 - RNA, 22 nt, Human
agugugaacuggacccuguugc

SEQ ID NO: 2365972 - RNA, 23 nt, Human
agugugaacuggacccuguugcu

SEQ ID NO: 2365973 - RNA, 15 nt, Human
agugucuuccauaau

SEQ ID NO: 2365974 - RNA, 14 nt, Human
agugucuuccugug

SEQ ID NO: 2365975 - RNA, 13 nt, Human
agugucuuuccac

SEQ ID NO: 2365976 - RNA, 14 nt, Human
agugucuuccauaa

SEQ ID NO: 2365977 - RNA, 13 nt, Human
agugucuuccaua

SEQ ID NO: 2365978 - RNA, 19 nt, Human
agugucuucacggcaggac

SEQ ID NO: 2365979 - RNA, 14 nt, Human
agugauuacuguca

SEQ ID NO: 2365980 - RNA, 23 nt, Human
agugucuuuccacggagccacuc

SEQ ID NO: 2365981 - RNA, 16 nt, Human
agugucuuuccacucc

SEQ ID NO: 2365982 - RNA, 20 nt, Human
agugaucaauaaaaugugau

SEQ ID NO: 2365983 - RNA, 14 nt, Human
agugaucacagcag

SEQ ID NO: 2365984 - RNA, 15 nt, Human
agugaucacagcagc

SEQ ID NO: 2365985 - RNA, 16 nt, Human
agugaucacagcagcu

SEQ ID NO: 2365986 - RNA, 18 nt, Human
agugauucucaugccuca

SEQ ID NO: 2365987 - RNA, 19 nt, Human
agugauucucaugccucag

SEQ ID NO: 2365988 - RNA, 15 nt, Human
agugauuaccaggga

SEQ ID NO: 2365989 - RNA, 18 nt, Human
agugauuaccagggacug

SEQ ID NO: 2365990 - RNA, 16 nt, Human
aguuaacuauuuuauu

SEQ ID NO: 2365991 - RNA, 14 nt, Human
aguuaacuuucaga

SEQ ID NO: 2365992 - RNA, 18 nt, Human
aguuaacuuuaagacuga

SEQ ID NO: 2365993 - RNA, 12 nt, Human
aguuaagaagcu

SEQ ID NO: 2365994 - RNA, 15 nt, Human
aguuaagaagcuguu

SEQ ID NO: 2365995 - RNA, 16 nt, Human
aguuaagaagcuguug

SEQ ID NO: 2365996 - RNA, 20 nt, Human
aguuaagacaugauuuccuu

SEQ ID NO: 2365997 - RNA, 19 nt, Human
aguuaagacaugauuuccu

SEQ ID NO: 2365998 - RNA, 17 nt, Human
aguuaagaagcuguugu

SEQ ID NO: 2365999 - RNA, 18 nt, Human
aguuaagaagcuguugua

SEQ ID NO: 2366000 - RNA, 20 nt, Human
aguuaagaagcuguuguaca

SEQ ID NO: 2366001 - RNA, 21 nt, Human
aguuaagaagcuguuguacau

SEQ ID NO: 2366002 - RNA, 23 nt, Human
aguuguuaauaaaaguacauguu

SEQ ID NO: 2366003 - RNA, 16 nt, Human
aguuguuaauaaaagu

SEQ ID NO: 2366004 - RNA, 16 nt, Human
aguuguuacauuuuua

SEQ ID NO: 2366005 - RNA, 15 nt, Human
aguuguuacauuuuu

SEQ ID NO: 2366006 - RNA, 13 nt, Human
aguuguuacauuu

SEQ ID NO: 2366007 - RNA, 19 nt, Human
aguugucaagucucugcug

SEQ ID NO: 2366008 - RNA, 16 nt, Human
aguuguaucucuuuug

SEQ ID NO: 2366009 - RNA, 15 nt, Human
aguuguaucucuuuu

SEQ ID NO: 2366010 - RNA, 14 nt, Human
aguuguaucucuuu

SEQ ID NO: 2366011 - RNA, 22 nt, Human
aguuguaucucuuuugaaucca

SEQ ID NO: 2366012 - RNA, 17 nt, Human
aguuguaucucuuuuga

SEQ ID NO: 2366013 - RNA, 22 nt, Human
aguuguaggcgaaucauuuguu

SEQ ID NO: 2366014 - RNA, 21 nt, Human
aguuguaggcgaaucauuugu

SEQ ID NO: 2366015 - RNA, 18 nt, Human
aguuguagaauguauugu

SEQ ID NO: 2366016 - RNA, 20 nt, Human
aguuguagaauguauuguac

SEQ ID NO: 2366017 - RNA, 21 nt, Human
aguuguagaauguauuguacc

SEQ ID NO: 2366018 - RNA, 23 nt, Human
aguuguaucagcacguguggccu

SEQ ID NO: 2366019 - RNA, 20 nt, Human
aguuguaucagcacgugugg

SEQ ID NO: 2366020 - RNA, 13 nt, Human
aguuguagaaugu

SEQ ID NO: 2366021 - RNA, 16 nt, Human
aguuguagaauguauu

SEQ ID NO: 2366022 - RNA, 17 nt, Human
aguuguagaauguauug

SEQ ID NO: 2366023 - RNA, 19 nt, Human
aguuguaccgcaaugugac

SEQ ID NO: 2366024 - RNA, 18 nt, Human
aguuguaccgcaauguga

SEQ ID NO: 2366025 - RNA, 20 nt, Human
aguugaauggccugccuuga

SEQ ID NO: 2366026 - RNA, 23 nt, Human
aguugaauugaggggauuaauau

SEQ ID NO: 2366027 - RNA, 22 nt, Human
aguuacaugcauacuucaaaag

SEQ ID NO: 2366028 - RNA, 20 nt, Human
aguuacaugcauacuucaaa

SEQ ID NO: 2366029 - RNA, 21 nt, Human
aguuacaugcauacuucaaaa

SEQ ID NO: 2366030 - RNA, 17 nt, Human
aguuacaugcauacuuc

SEQ ID NO: 2366031 - RNA, 18 nt, Human
aguuacagacaaagcgug

SEQ ID NO: 2366032 - RNA, 17 nt, Human
aguuaagaccuggcagc

SEQ ID NO: 2366033 - RNA, 16 nt, Human
aguuaagaccuggcag

SEQ ID NO: 2366034 - RNA, 13 nt, Human
aguuaagaccugg

SEQ ID NO: 2366035 - RNA, 22 nt, Human
aguuacagccuguuaguaacau

SEQ ID NO: 2366036 - RNA, 17 nt, Human
aguuacagcgagaggca

SEQ ID NO: 2366037 - RNA, 20 nt, Human
aguuacagccuguuaguaac

SEQ ID NO: 2366038 - RNA, 22 nt, Human
aguuaagaagcuguuguacauu

SEQ ID NO: 2366039 - RNA, 14 nt, Human
aguuaagaguagca

SEQ ID NO: 2366040 - RNA, 22 nt, Human
aguuacagcgagaggcagagaa

SEQ ID NO: 2366041 - RNA, 23 nt, Human
aguuacagcgagaggcagagaaa

SEQ ID NO: 2366042 - RNA, 13 nt, Human
aguuacagcugug

SEQ ID NO: 2366043 - RNA, 16 nt, Human
aguuacagcugugauu

SEQ ID NO: 2366044 - RNA, 20 nt, Human
auaccugggauacugugccc

SEQ ID NO: 2366045 - RNA, 11 nt, Human
auaccugcccu

SEQ ID NO: 2366046 - RNA, 18 nt, Human
auaccugggcauacuaau

SEQ ID NO: 2366047 - RNA, 13 nt, Human
auaccuguccccc

SEQ ID NO: 2366048 - RNA, 12 nt, Human
auaccugucccc

SEQ ID NO: 2366049 - RNA, 15 nt, Human
auaccuacauguauu

SEQ ID NO: 2366050 - RNA, 19 nt, Human
auacccuggccgcccccug

SEQ ID NO: 2366051 - RNA, 12 nt, Human
auacccuccccc

SEQ ID NO: 2366052 - RNA, 13 nt, Human
auaccuaaaagag

SEQ ID NO: 2366053 - RNA, 17 nt, Human
auaccugggauacugug

SEQ ID NO: 2366054 - RNA, 20 nt, Human
auaccugauuuuuuuuccuu

SEQ ID NO: 2366055 - RNA, 17 nt, Human
auaccucuuagcugagu

SEQ ID NO: 2366056 - RNA, 20 nt, Human
auaccucuuagcugagugga

SEQ ID NO: 2366057 - RNA, 16 nt, Human
auaccucugugugcuc

SEQ ID NO: 2366058 - RNA, 17 nt, Human
auaccucugugugcucc

SEQ ID NO: 2366059 - RNA, 15 nt, Human
auaccucuuagcuga

SEQ ID NO: 2366060 - RNA, 16 nt, Human
auaccucuuagcugag

SEQ ID NO: 2366061 - RNA, 15 nt, Human
auacacaacacacac

SEQ ID NO: 2366062 - RNA, 11 nt, Human
auacacaaauu

SEQ ID NO: 2366063 - RNA, 16 nt, Human
auaauuauaauauacu

SEQ ID NO: 2366064 - RNA, 14 nt, Human
auaauuacuauguc

SEQ ID NO: 2366065 - RNA, 22 nt, Human
auacccccugcaaagcccagcu

SEQ ID NO: 2366066 - RNA, 21 nt, Human
auacacacacacacacagcca

SEQ ID NO: 2366067 - RNA, 20 nt, Human
auacacacacacacacagcc

SEQ ID NO: 2366068 - RNA, 15 nt, Human
auacacacacacaca

SEQ ID NO: 2366069 - RNA, 19 nt, Human
auacacacacacacacagc

SEQ ID NO: 2366070 - RNA, 18 nt, Human
auacacacacacacacag

SEQ ID NO: 2366071 - RNA, 15 nt, Human
auacacaaguaaaca

SEQ ID NO: 2366072 - RNA, 11 nt, Human
auacacacaca

SEQ ID NO: 2366073 - RNA, 14 nt, Human
auacacacacacac

SEQ ID NO: 2366074 - RNA, 13 nt, Human
auacacacacaca

SEQ ID NO: 2366075 - RNA, 16 nt, Human
auacuuaucucucugu

SEQ ID NO: 2366076 - RNA, 17 nt, Human
auacuuaucucucugug

SEQ ID NO: 2366077 - RNA, 18 nt, Human
auacuuaucucucugugc

SEQ ID NO: 2366078 - RNA, 20 nt, Human
auacuuaucucucugugcug

SEQ ID NO: 2366079 - RNA, 15 nt, Human
auacuuaucucucug

SEQ ID NO: 2366080 - RNA, 22 nt, Human
auacuuagcaaaguuuuaccug

SEQ ID NO: 2366081 - RNA, 12 nt, Human
auaacagcacug

SEQ ID NO: 2366082 - RNA, 13 nt, Human
auaacagguuauu

SEQ ID NO: 2366083 - RNA, 16 nt, Human
auaacaguaaaugugc

SEQ ID NO: 2366084 - RNA, 14 nt, Human
auaacagguuauuu

SEQ ID NO: 2366085 - RNA, 18 nt, Human
auaacagguuauuuuagu

SEQ ID NO: 2366086 - RNA, 22 nt, Human
auaacagguuauuuuaguuucu

SEQ ID NO: 2366087 - RNA, 23 nt, Human
auaacagguuauuuuaguuucug

SEQ ID NO: 2366088 - RNA, 23 nt, Human
auaacacuauaaagguugacaau

SEQ ID NO: 2366089 - RNA, 23 nt, Human
auaacagaaagccugggugacau

SEQ ID NO: 2366090 - RNA, 21 nt, Human
auaaguccuugcaagaaucag

SEQ ID NO: 2366091 - RNA, 16 nt, Human
auaagucauguuccuu

SEQ ID NO: 2366092 - RNA, 14 nt, Human
auaagucuaaauaa

SEQ ID NO: 2366093 - RNA, 14 nt, Human
auaagucauguucc

SEQ ID NO: 2366094 - RNA, 15 nt, Human
auaaguggugugugu

SEQ ID NO: 2366095 - RNA, 13 nt, Human
auaaguguacaua

SEQ ID NO: 2366096 - RNA, 14 nt, Human
auaaguguacauau

SEQ ID NO: 2366097 - RNA, 16 nt, Human
auaaguguauuuuuca

SEQ ID NO: 2366098 - RNA, 14 nt, Human
auaaguguauuuuu

SEQ ID NO: 2366099 - RNA, 19 nt, Human
auaaguguacauaugugcu

SEQ ID NO: 2366100 - RNA, 20 nt, Human
auaaguguacauaugugcug

SEQ ID NO: 2366101 - RNA, 19 nt, Human
auaaguacuguguacagaa

SEQ ID NO: 2366102 - RNA, 19 nt, Human
auaaguauuuaauucaugu

SEQ ID NO: 2366103 - RNA, 19 nt, Human
auaaguauuucaaauugga

SEQ ID NO: 2366104 - RNA, 18 nt, Human
auaaguauuucaaauugg

SEQ ID NO: 2366105 - RNA, 16 nt, Human
auaaguauuucaaauu

SEQ ID NO: 2366106 - RNA, 16 nt, Human
auaaugugaaaauggu

SEQ ID NO: 2366107 - RNA, 13 nt, Human
auaaugugaaaau

SEQ ID NO: 2366108 - RNA, 18 nt, Human
auaaugugaaacuggauu

SEQ ID NO: 2366109 - RNA, 19 nt, Human
auaaguguguguuuuucau

SEQ ID NO: 2366110 - RNA, 22 nt, Human
auaaguguguguuuuucauaaa

SEQ ID NO: 2366111 - RNA, 21 nt, Human
auaaguguguggucccaaguu

SEQ ID NO: 2366112 - RNA, 21 nt, Human
auaaugugaaacuggauuaaa

SEQ ID NO: 2366113 - RNA, 19 nt, Human
auaaugugaaacuggauua

SEQ ID NO: 2366114 - RNA, 21 nt, Human
auacuucucaaaccuguuuaa

SEQ ID NO: 2366115 - RNA, 22 nt, Human
auacuucagcucacacaugaga

SEQ ID NO: 2366116 - RNA, 14 nt, Human
auacuucaaaagua

SEQ ID NO: 2366117 - RNA, 21 nt, Human
auacuucaugaaauccugggu

SEQ ID NO: 2366118 - RNA, 12 nt, Human
auacuucaaaag

SEQ ID NO: 2366119 - RNA, 15 nt, Human
auacuugaaaauuaa

SEQ ID NO: 2366120 - RNA, 16 nt, Human
auacuugaaaauuaac

SEQ ID NO: 2366121 - RNA, 13 nt, Human
auaguaguaugau

SEQ ID NO: 2366122 - RNA, 16 nt, Human
auaguauaucuggaca

SEQ ID NO: 2366123 - RNA, 17 nt, Human
auaguagcauacauuua

SEQ ID NO: 2366124 - RNA, 15 nt, Human
auaguauaucuggac

SEQ ID NO: 2366125 - RNA, 15 nt, Human
auaguaugguggcug

SEQ ID NO: 2366126 - RNA, 17 nt, Human
auaguauaucuggacaa

SEQ ID NO: 2366127 - RNA, 16 nt, Human
auaguauccuccaggu

SEQ ID NO: 2366128 - RNA, 17 nt, Human
auaguauccuccagguu

SEQ ID NO: 2366129 - RNA, 18 nt, Human
auaguauccuccagguuu

SEQ ID NO: 2366130 - RNA, 19 nt, Human
auaguauccuccagguuuu

SEQ ID NO: 2366131 - RNA, 20 nt, Human
auaguauccuccagguuuuu

SEQ ID NO: 2366132 - RNA, 22 nt, Human
auaguauccuccagguuuuuca

SEQ ID NO: 2366133 - RNA, 16 nt, Human
auaguaugguggcugg

SEQ ID NO: 2366134 - RNA, 15 nt, Human
auauaagugauugcu

SEQ ID NO: 2366135 - RNA, 20 nt, Human
auauaagugcuguauaaaau

SEQ ID NO: 2366136 - RNA, 14 nt, Human
auauaaguguacau

SEQ ID NO: 2366137 - RNA, 17 nt, Human
auauaagugcuguauaa

SEQ ID NO: 2366138 - RNA, 18 nt, Human
auauaagugcuguauaaa

SEQ ID NO: 2366139 - RNA, 13 nt, Human
auauaagugcugu

SEQ ID NO: 2366140 - RNA, 15 nt, Human
auauaagugcuguau

SEQ ID NO: 2366141 - RNA, 21 nt, Human
auauaauuaucggaagcagug

SEQ ID NO: 2366142 - RNA, 14 nt, Human
auauaauuaucgga

SEQ ID NO: 2366143 - RNA, 12 nt, Human
auauaauucugu

SEQ ID NO: 2366144 - RNA, 13 nt, Human
auauaauucugua

SEQ ID NO: 2366145 - RNA, 14 nt, Human
auauaauucuguaa

SEQ ID NO: 2366146 - RNA, 16 nt, Human
auauaauucuguaaau

SEQ ID NO: 2366147 - RNA, 17 nt, Human
auauaauucuguaaaug

SEQ ID NO: 2366148 - RNA, 14 nt, Human
auauaauucuguac

SEQ ID NO: 2366149 - RNA, 15 nt, Human
auauaaguguguguu

SEQ ID NO: 2366150 - RNA, 21 nt, Human
auauaauguuguuauuuaaag

SEQ ID NO: 2366151 - RNA, 22 nt, Human
auauaauguuguuauuuaaaga

SEQ ID NO: 2366152 - RNA, 15 nt, Human
auauaaguguacaua

SEQ ID NO: 2366153 - RNA, 18 nt, Human
auauaaguguacauaugu

SEQ ID NO: 2366154 - RNA, 16 nt, Human
auauagcccagccagg

SEQ ID NO: 2366155 - RNA, 21 nt, Human
auauagcuauuuuuauggaau

SEQ ID NO: 2366156 - RNA, 14 nt, Human
auauagcuguacaa

SEQ ID NO: 2366157 - RNA, 15 nt, Human
auauagcuguacaaa

SEQ ID NO: 2366158 - RNA, 17 nt, Human
auauagcuguacaaaua

SEQ ID NO: 2366159 - RNA, 18 nt, Human
auauagcuguacaaauau

SEQ ID NO: 2366160 - RNA, 19 nt, Human
auauagcuguacaaauaua

SEQ ID NO: 2366161 - RNA, 20 nt, Human
auauagcuguacaaauauaa

SEQ ID NO: 2366162 - RNA, 19 nt, Human
auauacucacuuucuagau

SEQ ID NO: 2366163 - RNA, 18 nt, Human
auauacauucuuuaucuu

SEQ ID NO: 2366164 - RNA, 20 nt, Human
auauacgugaaaauuauuug

SEQ ID NO: 2366165 - RNA, 15 nt, Human
auauagauuauaacu

SEQ ID NO: 2366166 - RNA, 18 nt, Human
auauagauuauaacuugu

SEQ ID NO: 2366167 - RNA, 23 nt, Human
auauagauuauaacuugucuaaa

SEQ ID NO: 2366168 - RNA, 20 nt, Human
auauaauuuuuuagagagcu

SEQ ID NO: 2366169 - RNA, 22 nt, Human
auauaauucuguacauagccua

SEQ ID NO: 2366170 - RNA, 17 nt, Human
auauaauucuguacaua

SEQ ID NO: 2366171 - RNA, 19 nt, Human
auauaauucuguacauagc

SEQ ID NO: 2366172 - RNA, 14 nt, Human
auauaccauuuauc

SEQ ID NO: 2366173 - RNA, 18 nt, Human
auauacauucaaacuuaa

SEQ ID NO: 2366174 - RNA, 16 nt, Human
auauaggaacuuaaau

SEQ ID NO: 2366175 - RNA, 19 nt, Human
auauuuagcaaauaauuuc

SEQ ID NO: 2366176 - RNA, 15 nt, Human
auauuuagcaaauaa

SEQ ID NO: 2366177 - RNA, 14 nt, Human
auauuuauaaaacu

SEQ ID NO: 2366178 - RNA, 21 nt, Human
auauuuaguuauaguuucaga

SEQ ID NO: 2366179 - RNA, 22 nt, Human
auauuuaguuauaguuucagau

SEQ ID NO: 2366180 - RNA, 13 nt, Human
auauuuauaacuc

SEQ ID NO: 2366181 - RNA, 11 nt, Human
auauuuauaac

SEQ ID NO: 2366182 - RNA, 15 nt, Human
auauuuauaacucau

SEQ ID NO: 2366183 - RNA, 14 nt, Human
auauuuauuaccuc

SEQ ID NO: 2366184 - RNA, 18 nt, Human
auauuuaguguucauaaa

SEQ ID NO: 2366185 - RNA, 16 nt, Human
auauuuauaaaaauaa

SEQ ID NO: 2366186 - RNA, 16 nt, Human
auauuuauuaccucug

SEQ ID NO: 2366187 - RNA, 21 nt, Human
auauuuauuuucuuucuguaa

SEQ ID NO: 2366188 - RNA, 22 nt, Human
auauuuauuacuguaagaaaau

SEQ ID NO: 2366189 - RNA, 18 nt, Human
auauuuauuuuaauaaug

SEQ ID NO: 2366190 - RNA, 14 nt, Human
auauuuauuacugu

SEQ ID NO: 2366191 - RNA, 19 nt, Human
auauuuauuacuguaagaa

SEQ ID NO: 2366192 - RNA, 15 nt, Human
auauuaggaaaauau

SEQ ID NO: 2366193 - RNA, 17 nt, Human
auauuauaacuuaaaaa

SEQ ID NO: 2366194 - RNA, 22 nt, Human
auauuauaauuuuuuucaauau

SEQ ID NO: 2366195 - RNA, 13 nt, Human
auauucaggaagc

SEQ ID NO: 2366196 - RNA, 21 nt, Human
auauuagcuuuacuguuuguu

SEQ ID NO: 2366197 - RNA, 20 nt, Human
auauuagcuuuacuguuugu

SEQ ID NO: 2366198 - RNA, 22 nt, Human
auauuagcauuuaguccaaugu

SEQ ID NO: 2366199 - RNA, 15 nt, Human
auauuagcauuuagu

SEQ ID NO: 2366200 - RNA, 13 nt, Human
auauuagauguga

SEQ ID NO: 2366201 - RNA, 14 nt, Human
auauuagaugugau

SEQ ID NO: 2366202 - RNA, 15 nt, Human
auauuagaugugauu

SEQ ID NO: 2366203 - RNA, 16 nt, Human
auauuagaugugauuu

SEQ ID NO: 2366204 - RNA, 17 nt, Human
auauuagaugugauuua

SEQ ID NO: 2366205 - RNA, 18 nt, Human
auauuagaugugauuuaa

SEQ ID NO: 2366206 - RNA, 20 nt, Human
auauuagaugugauuuaaua

SEQ ID NO: 2366207 - RNA, 20 nt, Human
auauuauacuaagaaaagau

SEQ ID NO: 2366208 - RNA, 17 nt, Human
auauucaggaagcucag

SEQ ID NO: 2366209 - RNA, 19 nt, Human
auauuuagauuguuaaaau

SEQ ID NO: 2366210 - RNA, 14 nt, Human
auauucaggaagcu

SEQ ID NO: 2366211 - RNA, 16 nt, Human
auauucaggaagcuca

SEQ ID NO: 2366212 - RNA, 18 nt, Human
auauuuauuuuuuuaagc

SEQ ID NO: 2366213 - RNA, 13 nt, Human
auauuucaagaca

SEQ ID NO: 2366214 - RNA, 19 nt, Human
auauuuauuuuuuuuaagu

SEQ ID NO: 2366215 - RNA, 23 nt, Human
auauuucagauaaucacaauaca

SEQ ID NO: 2366216 - RNA, 17 nt, Human
auaugcaguuuuccuua

SEQ ID NO: 2366217 - RNA, 15 nt, Human
auauccuuucuaaca

SEQ ID NO: 2366218 - RNA, 16 nt, Human
auauccuuucuaacaa

SEQ ID NO: 2366219 - RNA, 15 nt, Human
auauccugagccauc

SEQ ID NO: 2366220 - RNA, 11 nt, Human
auauccugccu

SEQ ID NO: 2366221 - RNA, 12 nt, Human
auauccugccuc

SEQ ID NO: 2366222 - RNA, 13 nt, Human
auauccugccuca

SEQ ID NO: 2366223 - RNA, 14 nt, Human
auauccugccucag

SEQ ID NO: 2366224 - RNA, 14 nt, Human
auauccugagccau

SEQ ID NO: 2366225 - RNA, 13 nt, Human
auauccugagcca

SEQ ID NO: 2366226 - RNA, 11 nt, Human
auauccucugu

SEQ ID NO: 2366227 - RNA, 16 nt, Human
auauccuacuucucca

SEQ ID NO: 2366228 - RNA, 14 nt, Human
auaugcuuacugau

SEQ ID NO: 2366229 - RNA, 13 nt, Human
auaugcuuaguaa

SEQ ID NO: 2366230 - RNA, 15 nt, Human
auaugcuuaguaaug

SEQ ID NO: 2366231 - RNA, 22 nt, Human
auaugccucuccuuuguauauu

SEQ ID NO: 2366232 - RNA, 19 nt, Human
auaugccucuccuuuguau

SEQ ID NO: 2366233 - RNA, 22 nt, Human
auaugccugggcagaaggaaga

SEQ ID NO: 2366234 - RNA, 19 nt, Human
auaugcuuauacacuuaca

SEQ ID NO: 2366235 - RNA, 23 nt, Human
auaugcuucuguuuuauaauuuu

SEQ ID NO: 2366236 - RNA, 16 nt, Human
auaugcuuauacacuu

SEQ ID NO: 2366237 - RNA, 14 nt, Human
auaugcuuauacac

SEQ ID NO: 2366238 - RNA, 18 nt, Human
auauggacucaguuuucu

SEQ ID NO: 2366239 - RNA, 18 nt, Human
auauuagaaguguuaacu

SEQ ID NO: 2366240 - RNA, 20 nt, Human
auauggacacuuaauacuac

SEQ ID NO: 2366241 - RNA, 15 nt, Human
auauggacacuuaau

SEQ ID NO: 2366242 - RNA, 19 nt, Human
auauggaacuuacauuguu

SEQ ID NO: 2366243 - RNA, 18 nt, Human
auauggaacuucuaauau

SEQ ID NO: 2366244 - RNA, 20 nt, Human
auauggaacuucuaauauau

SEQ ID NO: 2366245 - RNA, 18 nt, Human
auauccauguacuguagu

SEQ ID NO: 2366246 - RNA, 17 nt, Human
auauccauguacuguag

SEQ ID NO: 2366247 - RNA, 15 nt, Human
auauccauguacugu

SEQ ID NO: 2366248 - RNA, 14 nt, Human
auauccauguacug

SEQ ID NO: 2366249 - RNA, 18 nt, Human
auauccccuauuuaacag

SEQ ID NO: 2366250 - RNA, 18 nt, Human
auauccauucuuucugau

SEQ ID NO: 2366251 - RNA, 12 nt, Human
auauccauguac

SEQ ID NO: 2366252 - RNA, 21 nt, Human
auauccaugaccuaguuuucc

SEQ ID NO: 2366253 - RNA, 16 nt, Human
auauccaccaccuccc

SEQ ID NO: 2366254 - RNA, 17 nt, Human
auauccauucuuucuga

SEQ ID NO: 2366255 - RNA, 15 nt, Human
auauccccucccagu

SEQ ID NO: 2366256 - RNA, 15 nt, Human
auaucccuacaugua

SEQ ID NO: 2366257 - RNA, 16 nt, Human
auaucccuacauguau

SEQ ID NO: 2366258 - RNA, 17 nt, Human
auaucccuacauguauu

SEQ ID NO: 2366259 - RNA, 18 nt, Human
auaucacauguuuucucu

SEQ ID NO: 2366260 - RNA, 18 nt, Human
auaucacuugucaauaaa

SEQ ID NO: 2366261 - RNA, 14 nt, Human
auaucagaaaaggg

SEQ ID NO: 2366262 - RNA, 17 nt, Human
auaucagaaaagggaag

SEQ ID NO: 2366263 - RNA, 15 nt, Human
auaucaauuuaaaaa

SEQ ID NO: 2366264 - RNA, 18 nt, Human
acacugcuaggugggcca

SEQ ID NO: 2366265 - RNA, 19 nt, Human
acacugcggggcuuggcug

SEQ ID NO: 2366266 - RNA, 18 nt, Human
acacugcggggcuuggcu

SEQ ID NO: 2366267 - RNA, 21 nt, Human
acacugcugcuccagugcagg

SEQ ID NO: 2366268 - RNA, 13 nt, Human
acacugucuugaa

SEQ ID NO: 2366269 - RNA, 23 nt, Human
acacugcuaggugggccagcccc

SEQ ID NO: 2366270 - RNA, 21 nt, Human
acacuguauuuguaucucuga

SEQ ID NO: 2366271 - RNA, 22 nt, Human
acacugucugguuucaccgagg

SEQ ID NO: 2366272 - RNA, 18 nt, Human
acacugugcacaucugug

SEQ ID NO: 2366273 - RNA, 18 nt, Human
acacugugcccuggugga

SEQ ID NO: 2366274 - RNA, 14 nt, Human
acacugugcccugg

SEQ ID NO: 2366275 - RNA, 15 nt, Human
acacugugcccuggu

SEQ ID NO: 2366276 - RNA, 16 nt, Human
acacugugcccuggug

SEQ ID NO: 2366277 - RNA, 17 nt, Human
acacugugcccuggugg

SEQ ID NO: 2366278 - RNA, 21 nt, Human
acacugugcacaucugugucu

SEQ ID NO: 2366279 - RNA, 20 nt, Human
acacugugcacaucuguguc

SEQ ID NO: 2366280 - RNA, 22 nt, Human
acacugugcccagcccggaccu

SEQ ID NO: 2366281 - RNA, 23 nt, Human
acacugugcccagcccggaccuu

SEQ ID NO: 2366282 - RNA, 12 nt, Human
acacugugcccu

SEQ ID NO: 2366283 - RNA, 13 nt, Human
acacugugcccug

SEQ ID NO: 2366284 - RNA, 12 nt, Human
acagaacacugu

SEQ ID NO: 2366285 - RNA, 14 nt, Human
acagaacacugucu

SEQ ID NO: 2366286 - RNA, 13 nt, Human
acagaacacuaaa

SEQ ID NO: 2366287 - RNA, 21 nt, Human
acagaacacauaauucaggaa

SEQ ID NO: 2366288 - RNA, 16 nt, Human
acagaagaaggcagca

SEQ ID NO: 2366289 - RNA, 18 nt, Human
acagaacagcuucagguu

SEQ ID NO: 2366290 - RNA, 20 nt, Human
acagaacagcuucagguuau

SEQ ID NO: 2366291 - RNA, 12 nt, Human
acagaacagcuu

SEQ ID NO: 2366292 - RNA, 13 nt, Human
acagaacagcuuc

SEQ ID NO: 2366293 - RNA, 14 nt, Human
acagaacagcuuca

SEQ ID NO: 2366294 - RNA, 15 nt, Human
acagaacagcuucag

SEQ ID NO: 2366295 - RNA, 16 nt, Human
acagaacagcuucagg

SEQ ID NO: 2366296 - RNA, 17 nt, Human
acagaacagcuucaggu

SEQ ID NO: 2366297 - RNA, 20 nt, Human
acagaagaaggcagcaggug

SEQ ID NO: 2366298 - RNA, 12 nt, Human
acagaagcagcu

SEQ ID NO: 2366299 - RNA, 14 nt, Human
acagaagcagcucu

SEQ ID NO: 2366300 - RNA, 13 nt, Human
acagaagcagcuc

SEQ ID NO: 2366301 - RNA, 17 nt, Human
acagaagucaugaagcc

SEQ ID NO: 2366302 - RNA, 18 nt, Human
acagaagccaggagcaaa

SEQ ID NO: 2366303 - RNA, 16 nt, Human
acagaagccaggagca

SEQ ID NO: 2366304 - RNA, 18 nt, Human
acagaagcaggcuggagg

SEQ ID NO: 2366305 - RNA, 19 nt, Human
acagaagcaggcuggaggu

SEQ ID NO: 2366306 - RNA, 13 nt, Human
acagaagccagga

SEQ ID NO: 2366307 - RNA, 15 nt, Human
acagaagccaggagc

SEQ ID NO: 2366308 - RNA, 15 nt, Human
acagaagcagcucuu

SEQ ID NO: 2366309 - RNA, 22 nt, Human
acagaagcaguugagucgucau

SEQ ID NO: 2366310 - RNA, 21 nt, Human
acacugaagcucuugaagaca

SEQ ID NO: 2366311 - RNA, 22 nt, Human
acacugccaucuuaguuuggau

SEQ ID NO: 2366312 - RNA, 17 nt, Human
acacugaggcagggaag

SEQ ID NO: 2366313 - RNA, 16 nt, Human
acacugaggcagggaa

SEQ ID NO: 2366314 - RNA, 22 nt, Human
acacugaugcuuagauguucca

SEQ ID NO: 2366315 - RNA, 14 nt, Human
acacugaggcaggg

SEQ ID NO: 2366316 - RNA, 14 nt, Human
acacugagcuguca

SEQ ID NO: 2366317 - RNA, 22 nt, Human
acacugacaccuuugcaggcau

SEQ ID NO: 2366318 - RNA, 15 nt, Human
acacugauccagccc

SEQ ID NO: 2366319 - RNA, 17 nt, Human
acacugaccauccacuc

SEQ ID NO: 2366320 - RNA, 19 nt, Human
acacugagaauguaagaac

SEQ ID NO: 2366321 - RNA, 20 nt, Human
acacugagaauguaagaacu

SEQ ID NO: 2366322 - RNA, 22 nt, Human
acacugagaauguaagaacuac

SEQ ID NO: 2366323 - RNA, 23 nt, Human
acacugaauauuuauauuucacu

SEQ ID NO: 2366324 - RNA, 18 nt, Human
acacugaauauuuauauu

SEQ ID NO: 2366325 - RNA, 19 nt, Human
acacugaaguuaacagaga

SEQ ID NO: 2366326 - RNA, 23 nt, Human
acagaguaugaacaccugggcuu

SEQ ID NO: 2366327 - RNA, 21 nt, Human
acagaguaaauagcauucucu

SEQ ID NO: 2366328 - RNA, 22 nt, Human
acagaggggguggccucccaac

SEQ ID NO: 2366329 - RNA, 12 nt, Human
acagagucucac

SEQ ID NO: 2366330 - RNA, 14 nt, Human
acagagucucacug

SEQ ID NO: 2366331 - RNA, 18 nt, Human
acagaagucaugaagccc

SEQ ID NO: 2366332 - RNA, 15 nt, Human
acagaauaaugaaug

SEQ ID NO: 2366333 - RNA, 22 nt, Human
acagaauacuguuaaaggaaaa

SEQ ID NO: 2366334 - RNA, 22 nt, Human
acagaaucauaugauucugcuu

SEQ ID NO: 2366335 - RNA, 21 nt, Human
acagaggggguggccucccaa

SEQ ID NO: 2366336 - RNA, 16 nt, Human
acagcaucauuuugca

SEQ ID NO: 2366337 - RNA, 13 nt, Human
acagcaguguucc

SEQ ID NO: 2366338 - RNA, 19 nt, Human
acagcaguguuccccaucu

SEQ ID NO: 2366339 - RNA, 16 nt, Human
acagcagugucaucag

SEQ ID NO: 2366340 - RNA, 17 nt, Human
acagcagugucaucaga

SEQ ID NO: 2366341 - RNA, 17 nt, Human
acagcaucauuuugcau

SEQ ID NO: 2366342 - RNA, 20 nt, Human
acagcaucauuuugcauuca

SEQ ID NO: 2366343 - RNA, 21 nt, Human
acagcaucauuuugcauucaa

SEQ ID NO: 2366344 - RNA, 18 nt, Human
acagcaguugaaaagacu

SEQ ID NO: 2366345 - RNA, 15 nt, Human
acagcaguugaaaag

SEQ ID NO: 2366346 - RNA, 17 nt, Human
acagagucucacuguug

SEQ ID NO: 2366347 - RNA, 19 nt, Human
acagagucucacuguugcc

SEQ ID NO: 2366348 - RNA, 11 nt, Human
acagcaggugu

SEQ ID NO: 2366349 - RNA, 22 nt, Human
acagcaggguagucugguuucu

SEQ ID NO: 2366350 - RNA, 23 nt, Human
acagccaaaugcauggugcaguu

SEQ ID NO: 2366351 - RNA, 19 nt, Human
acagccacggccaggccag

SEQ ID NO: 2366352 - RNA, 11 nt, Human
acagcauugcu

SEQ ID NO: 2366353 - RNA, 13 nt, Human
acagcauguguau

SEQ ID NO: 2366354 - RNA, 13 nt, Human
acagcauugcuuu

SEQ ID NO: 2366355 - RNA, 12 nt, Human
acagcauugcuu

SEQ ID NO: 2366356 - RNA, 15 nt, Human
acagcauugcuuucu

SEQ ID NO: 2366357 - RNA, 20 nt, Human
acagcaugagaggcucugug

SEQ ID NO: 2366358 - RNA, 13 nt, Human
acagccagcaccu

SEQ ID NO: 2366359 - RNA, 16 nt, Human
acagccagcaccuggc

SEQ ID NO: 2366360 - RNA, 16 nt, Human
acagccagacuggcac

SEQ ID NO: 2366361 - RNA, 15 nt, Human
acagccagacuggca

SEQ ID NO: 2366362 - RNA, 13 nt, Human
acagccagacugg

SEQ ID NO: 2366363 - RNA, 16 nt, Human
acagcccaaagaagga

SEQ ID NO: 2366364 - RNA, 19 nt, Human
acagccaucccagccuugg

SEQ ID NO: 2366365 - RNA, 17 nt, Human
acagcccaaagaaggaa

SEQ ID NO: 2366366 - RNA, 18 nt, Human
acagcccaaagaaggaaa

SEQ ID NO: 2366367 - RNA, 15 nt, Human
acagccaucccagcc

SEQ ID NO: 2366368 - RNA, 16 nt, Human
acagccaucccagccu

SEQ ID NO: 2366369 - RNA, 18 nt, Human
acagccaucccagccuug

SEQ ID NO: 2366370 - RNA, 15 nt, Human
acagccaggugccuu

SEQ ID NO: 2366371 - RNA, 16 nt, Human
acagccaggugccuug

SEQ ID NO: 2366372 - RNA, 17 nt, Human
acagccaggugccuugg

SEQ ID NO: 2366373 - RNA, 19 nt, Human
acagccaggugccuuggag

SEQ ID NO: 2366374 - RNA, 15 nt, Human
acagccaugauucuu

SEQ ID NO: 2366375 - RNA, 15 nt, Human
acaggggcaggagga

SEQ ID NO: 2366376 - RNA, 20 nt, Human
acaggggaagguggccucug

SEQ ID NO: 2366377 - RNA, 20 nt, Human
acagcugcuccuagagggag

SEQ ID NO: 2366378 - RNA, 21 nt, Human
acagcugcucaauaaaguaca

SEQ ID NO: 2366379 - RNA, 18 nt, Human
acaggcaagcaccuccug

SEQ ID NO: 2366380 - RNA, 15 nt, Human
acaggcaagcaccuc

SEQ ID NO: 2366381 - RNA, 16 nt, Human
acaggcaagcaccucc

SEQ ID NO: 2366382 - RNA, 23 nt, Human
acaggucaauacaguacaggcag

SEQ ID NO: 2366383 - RNA, 22 nt, Human
acaggucaauacaguacaggca

SEQ ID NO: 2366384 - RNA, 21 nt, Human
acagggucucuagugcuguga

SEQ ID NO: 2366385 - RNA, 17 nt, Human
acaggguagcagguacc

SEQ ID NO: 2366386 - RNA, 19 nt, Human
acagggucucuagugcugu

SEQ ID NO: 2366387 - RNA, 19 nt, Human
acagguaacgucuguaagc

SEQ ID NO: 2366388 - RNA, 15 nt, Human
acagguaauauaaaa

SEQ ID NO: 2366389 - RNA, 18 nt, Human
acagguaaacuaucuugg

SEQ ID NO: 2366390 - RNA, 20 nt, Human
acaggugugaaccaccacac

SEQ ID NO: 2366391 - RNA, 23 nt, Human
acaggugugaaccaccacaccca

SEQ ID NO: 2366392 - RNA, 18 nt, Human
acaggucuccucuuaaaa

SEQ ID NO: 2366393 - RNA, 22 nt, Human
acaggugugagccaccacgccc

SEQ ID NO: 2366394 - RNA, 14 nt, Human
acaggucuccucuu

SEQ ID NO: 2366395 - RNA, 21 nt, Human
acaggugugagccaccacgcc

SEQ ID NO: 2366396 - RNA, 12 nt, Human
acagcuccuucu

SEQ ID NO: 2366397 - RNA, 13 nt, Human
acagcuccuucug

SEQ ID NO: 2366398 - RNA, 14 nt, Human
acagcuccuucugu

SEQ ID NO: 2366399 - RNA, 13 nt, Human
acagcuccuuggg

SEQ ID NO: 2366400 - RNA, 14 nt, Human
acagcuccuuggga

SEQ ID NO: 2366401 - RNA, 15 nt, Human
acagcuccuugggag

SEQ ID NO: 2366402 - RNA, 17 nt, Human
acagcuccuugggagga

SEQ ID NO: 2366403 - RNA, 23 nt, Human
acagcuccuugggaggaagcaga

SEQ ID NO: 2366404 - RNA, 19 nt, Human
acagcuccuugggaggaag

SEQ ID NO: 2366405 - RNA, 20 nt, Human
acagcuccuugggaggaagc

SEQ ID NO: 2366406 - RNA, 21 nt, Human
acagcuccuugggaggaagca

SEQ ID NO: 2366407 - RNA, 22 nt, Human
acagcuccuugggaggaagcag

SEQ ID NO: 2366408 - RNA, 20 nt, Human
acagcucugcauacucauua

SEQ ID NO: 2366409 - RNA, 14 nt, Human
acagcugccuggga

SEQ ID NO: 2366410 - RNA, 23 nt, Human
acagcugccugggaucccucauc

SEQ ID NO: 2366411 - RNA, 10 nt, Human
acagcugcuc

SEQ ID NO: 2366412 - RNA, 13 nt, Human
acagcucuagaca

SEQ ID NO: 2366413 - RNA, 14 nt, Human
acaccagacagaca

SEQ ID NO: 2366414 - RNA, 13 nt, Human
acaccagagcaga

SEQ ID NO: 2366415 - RNA, 17 nt, Human
acaccagagcagaugca

SEQ ID NO: 2366416 - RNA, 21 nt, Human
acaccacuacauucuguuaau

SEQ ID NO: 2366417 - RNA, 14 nt, Human
acaccacuacauuc

SEQ ID NO: 2366418 - RNA, 18 nt, Human
acaccacagacacacaca

SEQ ID NO: 2366419 - RNA, 21 nt, Human
acaccacagacacacacacgc

SEQ ID NO: 2366420 - RNA, 22 nt, Human
acaccacagacacacacacgca

SEQ ID NO: 2366421 - RNA, 18 nt, Human
acaccaccucacuccugu

SEQ ID NO: 2366422 - RNA, 17 nt, Human
acaccacacccagccuc

SEQ ID NO: 2366423 - RNA, 18 nt, Human
acaccacacccagccuca

SEQ ID NO: 2366424 - RNA, 12 nt, Human
acaccacagaca

SEQ ID NO: 2366425 - RNA, 13 nt, Human
acaccacagacac

SEQ ID NO: 2366426 - RNA, 14 nt, Human
acaccacagacaca

SEQ ID NO: 2366427 - RNA, 15 nt, Human
acaccacagacacac

SEQ ID NO: 2366428 - RNA, 16 nt, Human
acaccacagacacaca

SEQ ID NO: 2366429 - RNA, 17 nt, Human
acaccacagacacacac

SEQ ID NO: 2366430 - RNA, 12 nt, Human
acaccagagccc

SEQ ID NO: 2366431 - RNA, 18 nt, Human
acaccagagcagaugcag

SEQ ID NO: 2366432 - RNA, 19 nt, Human
acaccagagcagaugcaga

SEQ ID NO: 2366433 - RNA, 20 nt, Human
acaccagagcagaugcagag

SEQ ID NO: 2366434 - RNA, 22 nt, Human
acaccagagcagaugcagagag

SEQ ID NO: 2366435 - RNA, 19 nt, Human
acacgcuccuuccucugag

SEQ ID NO: 2366436 - RNA, 17 nt, Human
acacgcuccuuccucug

SEQ ID NO: 2366437 - RNA, 20 nt, Human
acacagcuaacacacagcuc

SEQ ID NO: 2366438 - RNA, 23 nt, Human
acacagcuaacacacagcuccca

SEQ ID NO: 2366439 - RNA, 23 nt, Human
acacagacugcgauuugucccag

SEQ ID NO: 2366440 - RNA, 23 nt, Human
acacagacauucugccaggcccc

SEQ ID NO: 2366441 - RNA, 13 nt, Human
acacagaaaccuu

SEQ ID NO: 2366442 - RNA, 19 nt, Human
acacagaaaccuuuuuaaa

SEQ ID NO: 2366443 - RNA, 18 nt, Human
acacagaaaccuuuuuaa

SEQ ID NO: 2366444 - RNA, 21 nt, Human
acacagaaaccuuuuuaaaaa

SEQ ID NO: 2366445 - RNA, 17 nt, Human
acacagaaagccuauca

SEQ ID NO: 2366446 - RNA, 11 nt, Human
acacagcucug

SEQ ID NO: 2366447 - RNA, 12 nt, Human
acacagcucugu

SEQ ID NO: 2366448 - RNA, 13 nt, Human
acaccacacccag

SEQ ID NO: 2366449 - RNA, 14 nt, Human
acaccacacccagc

SEQ ID NO: 2366450 - RNA, 15 nt, Human
acaccacacccagcc

SEQ ID NO: 2366451 - RNA, 16 nt, Human
acaccacacccagccu

SEQ ID NO: 2366452 - RNA, 21 nt, Human
acacagcuaacacacagcucc

SEQ ID NO: 2366453 - RNA, 15 nt, Human
acacggacacucaaa

SEQ ID NO: 2366454 - RNA, 22 nt, Human
acacggagcccagcccucccca

SEQ ID NO: 2366455 - RNA, 18 nt, Human
acacggagcccagcccuc

SEQ ID NO: 2366456 - RNA, 14 nt, Human
acacuaaaaauaaa

SEQ ID NO: 2366457 - RNA, 15 nt, Human
acacuaaacagacua

SEQ ID NO: 2366458 - RNA, 20 nt, Human
acacuaaacagacuauuuaa

SEQ ID NO: 2366459 - RNA, 21 nt, Human
acacuaaacagacuauuuaac

SEQ ID NO: 2366460 - RNA, 14 nt, Human
acacuaaccacgcu

SEQ ID NO: 2366461 - RNA, 15 nt, Human
acacuaaccacgcug

SEQ ID NO: 2366462 - RNA, 11 nt, Human
acaauguuaag

SEQ ID NO: 2366463 - RNA, 14 nt, Human
acaauguuaaggaa

SEQ ID NO: 2366464 - RNA, 19 nt, Human
acaauguuaaggaaacucu

SEQ ID NO: 2366465 - RNA, 20 nt, Human
acaauguuaaggaaacucuu

SEQ ID NO: 2366466 - RNA, 21 nt, Human
acaauguuaaggaaacucuua

SEQ ID NO: 2366467 - RNA, 22 nt, Human
acaauguuaaggaaacucuuau

SEQ ID NO: 2366468 - RNA, 15 nt, Human
acaauguucauccca

SEQ ID NO: 2366469 - RNA, 21 nt, Human
acaauguucaucccaugaugu

SEQ ID NO: 2366470 - RNA, 19 nt, Human
acaauuaaagcuguuauuu

SEQ ID NO: 2366471 - RNA, 16 nt, Human
acaauuaaagcuguua

SEQ ID NO: 2366472 - RNA, 15 nt, Human
acaauuuauuauggc

SEQ ID NO: 2366473 - RNA, 19 nt, Human
acaauuucaaaaaaauaaa

SEQ ID NO: 2366474 - RNA, 20 nt, Human
acaauuucaaaaaaauaaaa

SEQ ID NO: 2366475 - RNA, 16 nt, Human
acaauuuccuuuauau

SEQ ID NO: 2366476 - RNA, 17 nt, Human
acaauuuccuuuauauu

SEQ ID NO: 2366477 - RNA, 16 nt, Human
acaauuuauuauggca

SEQ ID NO: 2366478 - RNA, 11 nt, Human
acaauuucugu

SEQ ID NO: 2366479 - RNA, 20 nt, Human
acaauuuccuuuauauuuag

SEQ ID NO: 2366480 - RNA, 23 nt, Human
acaauuuccuuuauauuuaguga

SEQ ID NO: 2366481 - RNA, 21 nt, Human
acaauuugagauguauuucaa

SEQ ID NO: 2366482 - RNA, 15 nt, Human
acacaaacguaugua

SEQ ID NO: 2366483 - RNA, 19 nt, Human
acacaaacuguaaauaaaa

SEQ ID NO: 2366484 - RNA, 18 nt, Human
acacaaacgggcucagca

SEQ ID NO: 2366485 - RNA, 16 nt, Human
acacaaacuguaaaua

SEQ ID NO: 2366486 - RNA, 15 nt, Human
acacaaacuguaaau

SEQ ID NO: 2366487 - RNA, 14 nt, Human
acacaaacuguaaa

SEQ ID NO: 2366488 - RNA, 16 nt, Human
acacaaaccugccugg

SEQ ID NO: 2366489 - RNA, 17 nt, Human
acacaaaccugccuggg

SEQ ID NO: 2366490 - RNA, 15 nt, Human
acaauuuuguacaaa

SEQ ID NO: 2366491 - RNA, 15 nt, Human
acacaaaccugccug

SEQ ID NO: 2366492 - RNA, 12 nt, Human
acaauuuuguac

SEQ ID NO: 2366493 - RNA, 22 nt, Human
acaaugugaacuuuauuaaaua

SEQ ID NO: 2366494 - RNA, 19 nt, Human
acaaugugaacuuuauuaa

SEQ ID NO: 2366495 - RNA, 17 nt, Human
aauuauaacuuaaaaua

SEQ ID NO: 2366496 - RNA, 23 nt, Human
aauuauaacuuaaaauauuuuau

SEQ ID NO: 2366497 - RNA, 17 nt, Human
aauuauaagaggcugau

SEQ ID NO: 2366498 - RNA, 20 nt, Human
aauuauaagaggcugauaau

SEQ ID NO: 2366499 - RNA, 16 nt, Human
aauuauaauauacuau

SEQ ID NO: 2366500 - RNA, 19 nt, Human
aauuuuauagcucaguuua

SEQ ID NO: 2366501 - RNA, 14 nt, Human
aauuuuaucccuca

SEQ ID NO: 2366502 - RNA, 20 nt, Human
aauuuuaucccucaccugua

SEQ ID NO: 2366503 - RNA, 12 nt, Human
aauuuuaugaau

SEQ ID NO: 2366504 - RNA, 19 nt, Human
aauuuuaugagggccacgg

SEQ ID NO: 2366505 - RNA, 16 nt, Human
aauuuuaucucuuauu

SEQ ID NO: 2366506 - RNA, 20 nt, Human
aauuuuauagcucaguuuau

SEQ ID NO: 2366507 - RNA, 13 nt, Human
aauuuugaaaaac

SEQ ID NO: 2366508 - RNA, 19 nt, Human
aauuuuaguagagacaggg

SEQ ID NO: 2366509 - RNA, 23 nt, Human
aauuuuagugacagcucugccug

SEQ ID NO: 2366510 - RNA, 22 nt, Human
acaaagacaaauucuguuucuu

SEQ ID NO: 2366511 - RNA, 19 nt, Human
acaaagacaaauucuguuu

SEQ ID NO: 2366512 - RNA, 13 nt, Human
acaaagacugagu

SEQ ID NO: 2366513 - RNA, 18 nt, Human
acaacuaugauuuggaaa

SEQ ID NO: 2366514 - RNA, 13 nt, Human
acaacuauauugu

SEQ ID NO: 2366515 - RNA, 18 nt, Human
acaaagaagacaacauua

SEQ ID NO: 2366516 - RNA, 21 nt, Human
acaaacguauguaaauguaua

SEQ ID NO: 2366517 - RNA, 13 nt, Human
acaaagaagacau

SEQ ID NO: 2366518 - RNA, 14 nt, Human
acaaaccugccugg

SEQ ID NO: 2366519 - RNA, 18 nt, Human
acaaaccugccuggguuu

SEQ ID NO: 2366520 - RNA, 18 nt, Human
acaaacguauguaaaugu

SEQ ID NO: 2366521 - RNA, 18 nt, Human
acaaagacaaauucuguu

SEQ ID NO: 2366522 - RNA, 22 nt, Human
acaaagaagacauguuuuagac

SEQ ID NO: 2366523 - RNA, 15 nt, Human
acaaagaagacaugu

SEQ ID NO: 2366524 - RNA, 16 nt, Human
acaaagaagacauguu

SEQ ID NO: 2366525 - RNA, 19 nt, Human
acaaagaagacauguuuua

SEQ ID NO: 2366526 - RNA, 21 nt, Human
acaaagaagacauguuuuaga

SEQ ID NO: 2366527 - RNA, 15 nt, Human
acaaacgggcucagc

SEQ ID NO: 2366528 - RNA, 21 nt, Human
acaaaccuguuucugcagcca

SEQ ID NO: 2366529 - RNA, 21 nt, Human
aauuuugaauaaauaaaugua

SEQ ID NO: 2366530 - RNA, 16 nt, Human
aauuuugacacuauau

SEQ ID NO: 2366531 - RNA, 21 nt, Human
aauuuucuuuuuaauaaaaag

SEQ ID NO: 2366532 - RNA, 19 nt, Human
aauuuugacacuauaucug

SEQ ID NO: 2366533 - RNA, 20 nt, Human
aauuuugaguucuacauaag

SEQ ID NO: 2366534 - RNA, 20 nt, Human
acaaaauguaggguuauaau

SEQ ID NO: 2366535 - RNA, 12 nt, Human
acaaaccugccu

SEQ ID NO: 2366536 - RNA, 21 nt, Human
acaaaccgagugcaaugaaug

SEQ ID NO: 2366537 - RNA, 14 nt, Human
acaaaccagaagca

SEQ ID NO: 2366538 - RNA, 14 nt, Human
acaaaccaugcaaa

SEQ ID NO: 2366539 - RNA, 18 nt, Human
acaacuucccagugaauu

SEQ ID NO: 2366540 - RNA, 17 nt, Human
acaacuucaagugcaug

SEQ ID NO: 2366541 - RNA, 17 nt, Human
acaacuucaauauccaa

SEQ ID NO: 2366542 - RNA, 19 nt, Human
acaacuaggcuucagcaua

SEQ ID NO: 2366543 - RNA, 17 nt, Human
acaacuauggaucagaa

SEQ ID NO: 2366544 - RNA, 16 nt, Human
acaacuauuuuuccaa

SEQ ID NO: 2366545 - RNA, 14 nt, Human
acaacuucuuugua

SEQ ID NO: 2366546 - RNA, 22 nt, Human
acaacuugucuauuaccuguua

SEQ ID NO: 2366547 - RNA, 13 nt, Human
acaacuuugccag

SEQ ID NO: 2366548 - RNA, 17 nt, Human
acaacuuuaagaggaca

SEQ ID NO: 2366549 - RNA, 14 nt, Human
acaacuucagcagu

SEQ ID NO: 2366550 - RNA, 22 nt, Human
acaagugaguuguugcccuggg

SEQ ID NO: 2366551 - RNA, 18 nt, Human
acaagugaaaaacaucca

SEQ ID NO: 2366552 - RNA, 12 nt, Human
acaagugccacu

SEQ ID NO: 2366553 - RNA, 21 nt, Human
acaaguaugaauaaagacacc

SEQ ID NO: 2366554 - RNA, 23 nt, Human
acaaguaugaauaaagacaccua

SEQ ID NO: 2366555 - RNA, 23 nt, Human
acaagucauuuuaacuuuaucac

SEQ ID NO: 2366556 - RNA, 21 nt, Human
acaagucauuuuaacuuuauc

SEQ ID NO: 2366557 - RNA, 16 nt, Human
acaagucccuguaauu

SEQ ID NO: 2366558 - RNA, 23 nt, Human
acaagucauagguuaauauuuaa

SEQ ID NO: 2366559 - RNA, 17 nt, Human
acaagucccuguaauug

SEQ ID NO: 2366560 - RNA, 15 nt, Human
acaaguccugugaau

SEQ ID NO: 2366561 - RNA, 16 nt, Human
acaaguccugugaauu

SEQ ID NO: 2366562 - RNA, 17 nt, Human
acaaguccugugaauuu

SEQ ID NO: 2366563 - RNA, 19 nt, Human
acaaguccugugaauuucu

SEQ ID NO: 2366564 - RNA, 20 nt, Human
accccgucgaggggcucuca

SEQ ID NO: 2366565 - RNA, 23 nt, Human
accccgucugggguucagccccu

SEQ ID NO: 2366566 - RNA, 22 nt, Human
accccgucugggguucagcccc

SEQ ID NO: 2366567 - RNA, 23 nt, Human
accccggggugcccacaggccgc

SEQ ID NO: 2366568 - RNA, 21 nt, Human
accccggggugcccacaggcc

SEQ ID NO: 2366569 - RNA, 20 nt, Human
accccggggugcccacaggc

SEQ ID NO: 2366570 - RNA, 15 nt, Human
accccggggacccug

SEQ ID NO: 2366571 - RNA, 16 nt, Human
accccggggacccugu

SEQ ID NO: 2366572 - RNA, 17 nt, Human
accccggggacccugug

SEQ ID NO: 2366573 - RNA, 18 nt, Human
accccggggacccuguga

SEQ ID NO: 2366574 - RNA, 21 nt, Human
accccguguccccggccucag

SEQ ID NO: 2366575 - RNA, 22 nt, Human
accccuaaagagauacuuugau

SEQ ID NO: 2366576 - RNA, 21 nt, Human
accccgggcucucugcuguac

SEQ ID NO: 2366577 - RNA, 18 nt, Human
accccgggcucucugcug

SEQ ID NO: 2366578 - RNA, 17 nt, Human
accccgggcucucugcu

SEQ ID NO: 2366579 - RNA, 16 nt, Human
accccgggcucucugc

SEQ ID NO: 2366580 - RNA, 15 nt, Human
accccgggcucucug

SEQ ID NO: 2366581 - RNA, 13 nt, Human
accccgggcucuc

SEQ ID NO: 2366582 - RNA, 21 nt, Human
accccgcucugcaugcggccc

SEQ ID NO: 2366583 - RNA, 22 nt, Human
accccgcucugcaugcggccca

SEQ ID NO: 2366584 - RNA, 13 nt, Human
accccgggcgggu

SEQ ID NO: 2366585 - RNA, 15 nt, Human
accccggccaccugc

SEQ ID NO: 2366586 - RNA, 19 nt, Human
accccgccugcccucaugg

SEQ ID NO: 2366587 - RNA, 14 nt, Human
accccgcucugcau

SEQ ID NO: 2366588 - RNA, 16 nt, Human
accccgcucugcaugc

SEQ ID NO: 2366589 - RNA, 23 nt, Human
accccgcucugcaugcggcccag

SEQ ID NO: 2366590 - RNA, 23 nt, Human
acccccuucucugcuccaccaca

SEQ ID NO: 2366591 - RNA, 13 nt, Human
acccccuucuggg

SEQ ID NO: 2366592 - RNA, 14 nt, Human
acccccuucugggc

SEQ ID NO: 2366593 - RNA, 20 nt, Human
acccccuucucugcuccacc

SEQ ID NO: 2366594 - RNA, 19 nt, Human
acccccuucucugcuccac

SEQ ID NO: 2366595 - RNA, 18 nt, Human
acccccuucucugcucca

SEQ ID NO: 2366596 - RNA, 17 nt, Human
acccccuucucugcucc

SEQ ID NO: 2366597 - RNA, 16 nt, Human
acccccuucucugcuc

SEQ ID NO: 2366598 - RNA, 18 nt, Human
accccaaagccccuugcu

SEQ ID NO: 2366599 - RNA, 16 nt, Human
accccaaagccccuug

SEQ ID NO: 2366600 - RNA, 15 nt, Human
accccaaagccccuu

SEQ ID NO: 2366601 - RNA, 21 nt, Human
accccaaagagccuggagaag

SEQ ID NO: 2366602 - RNA, 22 nt, Human
accccaaagagccuggagaagc

SEQ ID NO: 2366603 - RNA, 15 nt, Human
accccaaagcuuucc

SEQ ID NO: 2366604 - RNA, 17 nt, Human
accccaaagcuuuccug

SEQ ID NO: 2366605 - RNA, 18 nt, Human
accccaaagcuuuccugc

SEQ ID NO: 2366606 - RNA, 15 nt, Human
accccgcagacaccu

SEQ ID NO: 2366607 - RNA, 17 nt, Human
accccgcagacaccuug

SEQ ID NO: 2366608 - RNA, 18 nt, Human
accccgcagacaccuugg

SEQ ID NO: 2366609 - RNA, 20 nt, Human
accccgcagacaccuuggac

SEQ ID NO: 2366610 - RNA, 14 nt, Human
accccgccugcccu

SEQ ID NO: 2366611 - RNA, 18 nt, Human
accccgaccaccugccca

SEQ ID NO: 2366612 - RNA, 15 nt, Human
acccccuucugggca

SEQ ID NO: 2366613 - RNA, 16 nt, Human
acccccuucugggcau

SEQ ID NO: 2366614 - RNA, 17 nt, Human
acccccuucugggcauc

SEQ ID NO: 2366615 - RNA, 18 nt, Human
acccccuuugugcugugg

SEQ ID NO: 2366616 - RNA, 14 nt, Human
acccauuuucacau

SEQ ID NO: 2366617 - RNA, 16 nt, Human
acccaugcugcccugu

SEQ ID NO: 2366618 - RNA, 19 nt, Human
acccaugcugcccugugag

SEQ ID NO: 2366619 - RNA, 20 nt, Human
acccauuuugagugacucga

SEQ ID NO: 2366620 - RNA, 16 nt, Human
accccaaacaccuucc

SEQ ID NO: 2366621 - RNA, 18 nt, Human
accccaaacaccuuccag

SEQ ID NO: 2366622 - RNA, 20 nt, Human
accccaaacaccuuccagcu

SEQ ID NO: 2366623 - RNA, 23 nt, Human
accccaaacaccuuccagcuccu

SEQ ID NO: 2366624 - RNA, 14 nt, Human
accccaaaccucca

SEQ ID NO: 2366625 - RNA, 14 nt, Human
accccaaagagccu

SEQ ID NO: 2366626 - RNA, 15 nt, Human
accccaaagagccug

SEQ ID NO: 2366627 - RNA, 19 nt, Human
accccaaagagccuggaga

SEQ ID NO: 2366628 - RNA, 20 nt, Human
acccaugaggcaaugucagg

SEQ ID NO: 2366629 - RNA, 13 nt, Human
acccaugaggcaa

SEQ ID NO: 2366630 - RNA, 21 nt, Human
acccaugaguuggggucuggc

SEQ ID NO: 2366631 - RNA, 20 nt, Human
acccaugaguuggggucugg

SEQ ID NO: 2366632 - RNA, 20 nt, Human
acccaugaagacaggacagu

SEQ ID NO: 2366633 - RNA, 19 nt, Human
acccaugaagacaggacag

SEQ ID NO: 2366634 - RNA, 14 nt, Human
acccaugaaucaaa

SEQ ID NO: 2366635 - RNA, 17 nt, Human
acccaugaaucaaagac

SEQ ID NO: 2366636 - RNA, 23 nt, Human
acccaugacuuuauauggaugau

SEQ ID NO: 2366637 - RNA, 17 nt, Human
acccaugcugcccugug

SEQ ID NO: 2366638 - RNA, 18 nt, Human
acccaugcugcccuguga

SEQ ID NO: 2366639 - RNA, 20 nt, Human
acccacaaaaguacaauuua

SEQ ID NO: 2366640 - RNA, 13 nt, Human
acccaaugauuca

SEQ ID NO: 2366641 - RNA, 20 nt, Human
acccaaugcacacaaaacaa

SEQ ID NO: 2366642 - RNA, 14 nt, Human
acccaauccaaaug

SEQ ID NO: 2366643 - RNA, 13 nt, Human
acccaauccaaau

SEQ ID NO: 2366644 - RNA, 15 nt, Human
acccacaagaaauga

SEQ ID NO: 2366645 - RNA, 20 nt, Human
acccaucugcaccccccugg

SEQ ID NO: 2366646 - RNA, 13 nt, Human
acccaucugcacc

SEQ ID NO: 2366647 - RNA, 15 nt, Human
acccaucgcugugug

SEQ ID NO: 2366648 - RNA, 17 nt, Human
acccaucgcuguguguu

SEQ ID NO: 2366649 - RNA, 20 nt, Human
acccauccuaccaaugcaug

SEQ ID NO: 2366650 - RNA, 21 nt, Human
acccauccuaccaaugcaugc

SEQ ID NO: 2366651 - RNA, 22 nt, Human
acccaucugcaccccccugggc

SEQ ID NO: 2366652 - RNA, 21 nt, Human
acccaucugcaccccccuggg

SEQ ID NO: 2366653 - RNA, 13 nt, Human
acccaucugggcu

SEQ ID NO: 2366654 - RNA, 17 nt, Human
acccaucuguuuuuugu

SEQ ID NO: 2366655 - RNA, 18 nt, Human
acccaucuguuuuuugua

SEQ ID NO: 2366656 - RNA, 15 nt, Human
acccaaggaggaaaa

SEQ ID NO: 2366657 - RNA, 16 nt, Human
acccaagugggggcag

SEQ ID NO: 2366658 - RNA, 13 nt, Human
acccaaggacuga

SEQ ID NO: 2366659 - RNA, 16 nt, Human
acccaaguccaagcau

SEQ ID NO: 2366660 - RNA, 13 nt, Human
acccaagggccug

SEQ ID NO: 2366661 - RNA, 16 nt, Human
acccaagggccuggcc

SEQ ID NO: 2366662 - RNA, 14 nt, Human
accaucaugucugg

SEQ ID NO: 2366663 - RNA, 12 nt, Human
accaucauccua

SEQ ID NO: 2366664 - RNA, 16 nt, Human
accaucaugucuggcu

SEQ ID NO: 2366665 - RNA, 17 nt, Human
accaucaugucuggcua

SEQ ID NO: 2366666 - RNA, 18 nt, Human
accaucccugaaggcccc

SEQ ID NO: 2366667 - RNA, 16 nt, Human
accaucccugaaggcc

SEQ ID NO: 2366668 - RNA, 21 nt, Human
accaucccugaaggccccgcc

SEQ ID NO: 2366669 - RNA, 22 nt, Human
accaucccugaaggccccgccc

SEQ ID NO: 2366670 - RNA, 18 nt, Human
accaucccuuuuugaagu

SEQ ID NO: 2366671 - RNA, 15 nt, Human
accaucccuuuuuga

SEQ ID NO: 2366672 - RNA, 15 nt, Human
acccaagcuuagaac

SEQ ID NO: 2366673 - RNA, 13 nt, Human
acccaagcuuggc

SEQ ID NO: 2366674 - RNA, 14 nt, Human
acccaagcuuggca

SEQ ID NO: 2366675 - RNA, 18 nt, Human
acccaagcuuggcagccg

SEQ ID NO: 2366676 - RNA, 22 nt, Human
acccaagcuuggcagccgagcu

SEQ ID NO: 2366677 - RNA, 17 nt, Human
acccaaggacugaggga

SEQ ID NO: 2366678 - RNA, 20 nt, Human
accccucaacaccucugcac

SEQ ID NO: 2366679 - RNA, 16 nt, Human
accccuacaugaaaca

SEQ ID NO: 2366680 - RNA, 21 nt, Human
acauuuguagcauccucuuua

SEQ ID NO: 2366681 - RNA, 19 nt, Human
acauuugggagacauguga

SEQ ID NO: 2366682 - RNA, 20 nt, Human
acauuugggagacaugugac

SEQ ID NO: 2366683 - RNA, 21 nt, Human
acauuugggagacaugugaca

SEQ ID NO: 2366684 - RNA, 18 nt, Human
acauuuggaauacuuuuu

SEQ ID NO: 2366685 - RNA, 17 nt, Human
acauuuggaauacuuuu

SEQ ID NO: 2366686 - RNA, 16 nt, Human
acauuuggaauacuuu

SEQ ID NO: 2366687 - RNA, 15 nt, Human
acauuuggaauacuu

SEQ ID NO: 2366688 - RNA, 20 nt, Human
acauuuggaguguuccccuu

SEQ ID NO: 2366689 - RNA, 17 nt, Human
acauuugggagacaugu

SEQ ID NO: 2366690 - RNA, 15 nt, Human
acauuuggaguguuc

SEQ ID NO: 2366691 - RNA, 14 nt, Human
accaacugggccca

SEQ ID NO: 2366692 - RNA, 20 nt, Human
accaacuagacauucugucg

SEQ ID NO: 2366693 - RNA, 14 nt, Human
accaacucuugcag

SEQ ID NO: 2366694 - RNA, 23 nt, Human
accaacugucacucauugcugag

SEQ ID NO: 2366695 - RNA, 16 nt, Human
accaacuacaaccaag

SEQ ID NO: 2366696 - RNA, 15 nt, Human
accaacuagacauuc

SEQ ID NO: 2366697 - RNA, 17 nt, Human
accaacuagacauucug

SEQ ID NO: 2366698 - RNA, 19 nt, Human
accaacuagacauucuguc

SEQ ID NO: 2366699 - RNA, 14 nt, Human
acauuuguauaaaa

SEQ ID NO: 2366700 - RNA, 12 nt, Human
acauuuggaaua

SEQ ID NO: 2366701 - RNA, 18 nt, Human
acauuugcucauggaauu

SEQ ID NO: 2366702 - RNA, 17 nt, Human
accacuacaugcagccc

SEQ ID NO: 2366703 - RNA, 17 nt, Human
accagcagcgccuuucc

SEQ ID NO: 2366704 - RNA, 18 nt, Human
accagcagcgccuuuccc

SEQ ID NO: 2366705 - RNA, 17 nt, Human
accagcagccuggaccc

SEQ ID NO: 2366706 - RNA, 14 nt, Human
accagcagccugga

SEQ ID NO: 2366707 - RNA, 13 nt, Human
accagcagccugg

SEQ ID NO: 2366708 - RNA, 23 nt, Human
accacuaaaagaucgcaguuugc

SEQ ID NO: 2366709 - RNA, 14 nt, Human
accacuacauucug

SEQ ID NO: 2366710 - RNA, 19 nt, Human
accacguuucuaaaggcua

SEQ ID NO: 2366711 - RNA, 15 nt, Human
accacguuucuaaag

SEQ ID NO: 2366712 - RNA, 19 nt, Human
accaagcucacaguuccuc

SEQ ID NO: 2366713 - RNA, 18 nt, Human
accaagcucacaguuccu

SEQ ID NO: 2366714 - RNA, 14 nt, Human
accaagcucucugc

SEQ ID NO: 2366715 - RNA, 12 nt, Human
accaagcugugc

SEQ ID NO: 2366716 - RNA, 17 nt, Human
accaagcucacaguucc

SEQ ID NO: 2366717 - RNA, 13 nt, Human
accaacuuucugu

SEQ ID NO: 2366718 - RNA, 17 nt, Human
accaagcuauccuggcu

SEQ ID NO: 2366719 - RNA, 15 nt, Human
accaagcuauccugg

SEQ ID NO: 2366720 - RNA, 14 nt, Human
accaacuuucugua

SEQ ID NO: 2366721 - RNA, 12 nt, Human
accaacuuucug

SEQ ID NO: 2366722 - RNA, 20 nt, Human
accaagccuggucagcccaa

SEQ ID NO: 2366723 - RNA, 19 nt, Human
accaagccuggucagccca

SEQ ID NO: 2366724 - RNA, 22 nt, Human
accacgauguggcccuggccug

SEQ ID NO: 2366725 - RNA, 23 nt, Human
accacgcccguccugccuguggc

SEQ ID NO: 2366726 - RNA, 20 nt, Human
accacgcccguccugccugu

SEQ ID NO: 2366727 - RNA, 21 nt, Human
accacgcccguccugccugug

SEQ ID NO: 2366728 - RNA, 20 nt, Human
accacgcccggcuaauuuuu

SEQ ID NO: 2366729 - RNA, 18 nt, Human
accacgcccguccugccu

SEQ ID NO: 2366730 - RNA, 19 nt, Human
accacgcccguccugccug

SEQ ID NO: 2366731 - RNA, 21 nt, Human
accacgauguggcccuggccu

SEQ ID NO: 2366732 - RNA, 20 nt, Human
accacgauguggcccuggcc

SEQ ID NO: 2366733 - RNA, 13 nt, Human
accaaggaccccu

SEQ ID NO: 2366734 - RNA, 14 nt, Human
accacgcccggcua

SEQ ID NO: 2366735 - RNA, 13 nt, Human
accaagcugugcc

SEQ ID NO: 2366736 - RNA, 14 nt, Human
accaagcugugcca

SEQ ID NO: 2366737 - RNA, 18 nt, Human
accaagcugugccacccu

SEQ ID NO: 2366738 - RNA, 19 nt, Human
accaagcugugccacccug

SEQ ID NO: 2366739 - RNA, 20 nt, Human
accaagcugugccacccugg

SEQ ID NO: 2366740 - RNA, 23 nt, Human
accaagcugugccacccugggcu

SEQ ID NO: 2366741 - RNA, 22 nt, Human
accagcaucccuugaccaggcc

SEQ ID NO: 2366742 - RNA, 15 nt, Human
acauaaacugacuuu

SEQ ID NO: 2366743 - RNA, 13 nt, Human
acauaaacugacu

SEQ ID NO: 2366744 - RNA, 23 nt, Human
acauaaacaagaccacguuucua

SEQ ID NO: 2366745 - RNA, 14 nt, Human
acagguuuuauaau

SEQ ID NO: 2366746 - RNA, 18 nt, Human
acagguuugggaccccug

SEQ ID NO: 2366747 - RNA, 15 nt, Human
acagguuugggaccc

SEQ ID NO: 2366748 - RNA, 19 nt, Human
acagguuacaacagauuug

SEQ ID NO: 2366749 - RNA, 20 nt, Human
acagguuacaacagauuugu

SEQ ID NO: 2366750 - RNA, 21 nt, Human
acagguuacaacagauuugug

SEQ ID NO: 2366751 - RNA, 22 nt, Human
acagguuacaacagauuuguga

SEQ ID NO: 2366752 - RNA, 23 nt, Human
acagguuacaacagauuugugaa

SEQ ID NO: 2366753 - RNA, 14 nt, Human
acagguuauuuuag

SEQ ID NO: 2366754 - RNA, 21 nt, Human
acagguuauuuuaguuucugu

SEQ ID NO: 2366755 - RNA, 22 nt, Human
acagguuauuuuaguuucuguu

SEQ ID NO: 2366756 - RNA, 23 nt, Human
acagguuauuuuaguuucuguuc

SEQ ID NO: 2366757 - RNA, 16 nt, Human
acaucccauguaacag

SEQ ID NO: 2366758 - RNA, 16 nt, Human
acauccuguguuucua

SEQ ID NO: 2366759 - RNA, 14 nt, Human
acauccuguguuuc

SEQ ID NO: 2366760 - RNA, 13 nt, Human
acauccuuucuaa

SEQ ID NO: 2366761 - RNA, 14 nt, Human
acauccuuccuucc

SEQ ID NO: 2366762 - RNA, 15 nt, Human
acauccuuccuuccc

SEQ ID NO: 2366763 - RNA, 23 nt, Human
acauccuguguuucuagggaaau

SEQ ID NO: 2366764 - RNA, 13 nt, Human
acauccuuccuuc

SEQ ID NO: 2366765 - RNA, 17 nt, Human
acaucgugaaacccugu

SEQ ID NO: 2366766 - RNA, 17 nt, Human
acaucuaaccucaucuu

SEQ ID NO: 2366767 - RNA, 16 nt, Human
acaucuaaccucaucu

SEQ ID NO: 2366768 - RNA, 14 nt, Human
acaucgcccuccac

SEQ ID NO: 2366769 - RNA, 19 nt, Human
acauccuuucuaaacaaga

SEQ ID NO: 2366770 - RNA, 14 nt, Human
acaucgaaugugua

SEQ ID NO: 2366771 - RNA, 17 nt, Human
acauccuuucuaaacaa

SEQ ID NO: 2366772 - RNA, 18 nt, Human
acauccuuucuaaacaag

SEQ ID NO: 2366773 - RNA, 21 nt, Human
acauccuuucuauugaaaaau

SEQ ID NO: 2366774 - RNA, 22 nt, Human
acauccaaggagaaacagagac

SEQ ID NO: 2366775 - RNA, 14 nt, Human
acauccaaggagaa

SEQ ID NO: 2366776 - RNA, 13 nt, Human
acauccaaggaga

SEQ ID NO: 2366777 - RNA, 23 nt, Human
acauccaaggagaaacagagaca

SEQ ID NO: 2366778 - RNA, 20 nt, Human
acauccaauauuuucuuuaa

SEQ ID NO: 2366779 - RNA, 13 nt, Human
acauccauaaaga

SEQ ID NO: 2366780 - RNA, 20 nt, Human
acauccauuucaucuauuuc

SEQ ID NO: 2366781 - RNA, 18 nt, Human
acauccauguuuguaaaa

SEQ ID NO: 2366782 - RNA, 15 nt, Human
acauccauaaagaag

SEQ ID NO: 2366783 - RNA, 17 nt, Human
acauccauaaagaagca

SEQ ID NO: 2366784 - RNA, 19 nt, Human
acauccauaaagaagcaau

SEQ ID NO: 2366785 - RNA, 20 nt, Human
acauccauguuuguaaaacu

SEQ ID NO: 2366786 - RNA, 16 nt, Human
acauccaagcuuccuu

SEQ ID NO: 2366787 - RNA, 13 nt, Human
acauaaauuagag

SEQ ID NO: 2366788 - RNA, 19 nt, Human
acauaaauaaaaugaccag

SEQ ID NO: 2366789 - RNA, 22 nt, Human
acaucagcacgauuucuguuua

SEQ ID NO: 2366790 - RNA, 21 nt, Human
acaucagcacgauuucuguuu

SEQ ID NO: 2366791 - RNA, 20 nt, Human
acaucagcacgauuucuguu

SEQ ID NO: 2366792 - RNA, 21 nt, Human
acauaaaggugguaugugugu

SEQ ID NO: 2366793 - RNA, 15 nt, Human
acauaaauaaaauga

SEQ ID NO: 2366794 - RNA, 19 nt, Human
acaucagcacgauuucugu

SEQ ID NO: 2366795 - RNA, 17 nt, Human
acauguuaaacuuacuu

SEQ ID NO: 2366796 - RNA, 16 nt, Human
acauguuacugaccag

SEQ ID NO: 2366797 - RNA, 17 nt, Human
acauguuacugaccagc

SEQ ID NO: 2366798 - RNA, 14 nt, Human
acauguuauauauu

SEQ ID NO: 2366799 - RNA, 19 nt, Human
acauguuacugaccagcaa

SEQ ID NO: 2366800 - RNA, 13 nt, Human
acauguuacaaca

SEQ ID NO: 2366801 - RNA, 15 nt, Human
acauguuauauauuu

SEQ ID NO: 2366802 - RNA, 20 nt, Human
acauguugggaaacuuggcu

SEQ ID NO: 2366803 - RNA, 21 nt, Human
acauguuuuucuucucccuca

SEQ ID NO: 2366804 - RNA, 19 nt, Human
acaugcaaggucauuuuuu

SEQ ID NO: 2366805 - RNA, 13 nt, Human
acaucuaagccug

SEQ ID NO: 2366806 - RNA, 20 nt, Human
acaucgugaaacccugucuc

SEQ ID NO: 2366807 - RNA, 15 nt, Human
acaucuaagccugaa

SEQ ID NO: 2366808 - RNA, 20 nt, Human
acaugcacagcuaacaugga

SEQ ID NO: 2366809 - RNA, 18 nt, Human
acaugcacaccucccccu

SEQ ID NO: 2366810 - RNA, 21 nt, Human
acaugcaauuuauuaaaauga

SEQ ID NO: 2366811 - RNA, 23 nt, Human
acaugcacagcuaacauggaagu

SEQ ID NO: 2366812 - RNA, 17 nt, Human
acauuaaaucuaugaag

SEQ ID NO: 2366813 - RNA, 20 nt, Human
acauguuuagaguugcaauc

SEQ ID NO: 2366814 - RNA, 22 nt, Human
acauuaaaacaauauuguuucu

SEQ ID NO: 2366815 - RNA, 15 nt, Human
acauuaaaacaauau

SEQ ID NO: 2366816 - RNA, 21 nt, Human
acauguuuacuuuucagggca

SEQ ID NO: 2366817 - RNA, 18 nt, Human
acauguuuagaguugcaa

SEQ ID NO: 2366818 - RNA, 23 nt, Human
acauguuuuuguuuucuuugaau

SEQ ID NO: 2366819 - RNA, 12 nt, Human
acuguuuguuau

SEQ ID NO: 2366820 - RNA, 18 nt, Human
acuguuugucuucucccc

SEQ ID NO: 2366821 - RNA, 19 nt, Human
acuguuugucuucucccca

SEQ ID NO: 2366822 - RNA, 20 nt, Human
acuguuugucuucuccccag

SEQ ID NO: 2366823 - RNA, 21 nt, Human
acuguuugucuucuccccagg

SEQ ID NO: 2366824 - RNA, 15 nt, Human
acuguuugucuucuc

SEQ ID NO: 2366825 - RNA, 13 nt, Human
acuguuucaaacu

SEQ ID NO: 2366826 - RNA, 16 nt, Human
acuguugugaccugaa

SEQ ID NO: 2366827 - RNA, 19 nt, Human
acuguugugaccugaaguu

SEQ ID NO: 2366828 - RNA, 19 nt, Human
acuguuguauaaauuuauu

SEQ ID NO: 2366829 - RNA, 15 nt, Human
acuguuguauaaauu

SEQ ID NO: 2366830 - RNA, 20 nt, Human
acuguuuacaagaaaaaaug

SEQ ID NO: 2366831 - RNA, 20 nt, Human
acuuauuggaacucugcuug

SEQ ID NO: 2366832 - RNA, 21 nt, Human
acuuauuggaacucugcuuga

SEQ ID NO: 2366833 - RNA, 13 nt, Human
acuguuuuuaccc

SEQ ID NO: 2366834 - RNA, 12 nt, Human
acuguuuuuacc

SEQ ID NO: 2366835 - RNA, 22 nt, Human
acuguuuucucucggcucccca

SEQ ID NO: 2366836 - RNA, 23 nt, Human
acuguuuucucucggcuccccau

SEQ ID NO: 2366837 - RNA, 23 nt, Human
acuucacacugcaagagccuugg

SEQ ID NO: 2366838 - RNA, 19 nt, Human
acuucacacugcaagagcc

SEQ ID NO: 2366839 - RNA, 12 nt, Human
acuucacagagu

SEQ ID NO: 2366840 - RNA, 16 nt, Human
acuucacagagugugc

SEQ ID NO: 2366841 - RNA, 16 nt, Human
acuucacacugcaaga

SEQ ID NO: 2366842 - RNA, 15 nt, Human
acuucacacugcaag

SEQ ID NO: 2366843 - RNA, 14 nt, Human
acuucacacugcaa

SEQ ID NO: 2366844 - RNA, 13 nt, Human
acuucacacugca

SEQ ID NO: 2366845 - RNA, 19 nt, Human
acuucacauauugauuucc

SEQ ID NO: 2366846 - RNA, 19 nt, Human
acuucacacacaggcaacu

SEQ ID NO: 2366847 - RNA, 17 nt, Human
acuucacacacaggcaa

SEQ ID NO: 2366848 - RNA, 13 nt, Human
acuuauuuaaugc

SEQ ID NO: 2366849 - RNA, 15 nt, Human
acuuauuuaaacucu

SEQ ID NO: 2366850 - RNA, 19 nt, Human
acuucugccauauucuguu

SEQ ID NO: 2366851 - RNA, 22 nt, Human
acuucuuuuauaacuaguccuu

SEQ ID NO: 2366852 - RNA, 15 nt, Human
acuucuuuuauaacu

SEQ ID NO: 2366853 - RNA, 21 nt, Human
acuucuuugcuuugcccagca

SEQ ID NO: 2366854 - RNA, 11 nt, Human
acuucuuuuca

SEQ ID NO: 2366855 - RNA, 12 nt, Human
acuucuuuucac

SEQ ID NO: 2366856 - RNA, 14 nt, Human
acuucuuuucacau

SEQ ID NO: 2366857 - RNA, 16 nt, Human
acuucuuugcuuugcc

SEQ ID NO: 2366858 - RNA, 18 nt, Human
acuucuuugcuuugccca

SEQ ID NO: 2366859 - RNA, 20 nt, Human
acuucuuugcuuugcccagc

SEQ ID NO: 2366860 - RNA, 16 nt, Human
acuucugaccacacuu

SEQ ID NO: 2366861 - RNA, 23 nt, Human
acuucacauauugauuuccguua

SEQ ID NO: 2366862 - RNA, 15 nt, Human
acuucugaccacacu

SEQ ID NO: 2366863 - RNA, 18 nt, Human
acuucacagagugugcug

SEQ ID NO: 2366864 - RNA, 19 nt, Human
acuucacagagugugcugg

SEQ ID NO: 2366865 - RNA, 20 nt, Human
acuucacagagugugcugga

SEQ ID NO: 2366866 - RNA, 22 nt, Human
acuucacagagugugcuggagg

SEQ ID NO: 2366867 - RNA, 18 nt, Human
acuucugccauauucugu

SEQ ID NO: 2366868 - RNA, 22 nt, Human
acuucugccagcauaauacuug

SEQ ID NO: 2366869 - RNA, 18 nt, Human
acuuguaaaggaauuuaa

SEQ ID NO: 2366870 - RNA, 15 nt, Human
acuuggucugugaga

SEQ ID NO: 2366871 - RNA, 14 nt, Human
acuuggucugugag

SEQ ID NO: 2366872 - RNA, 20 nt, Human
acuucuuuugcucuuagcug

SEQ ID NO: 2366873 - RNA, 15 nt, Human
acuucuuuucacauu

SEQ ID NO: 2366874 - RNA, 17 nt, Human
acuucuuuucacauucu

SEQ ID NO: 2366875 - RNA, 18 nt, Human
acuucuuuucacauucuu

SEQ ID NO: 2366876 - RNA, 19 nt, Human
acuucuuuucacauucuua

SEQ ID NO: 2366877 - RNA, 20 nt, Human
acuuguaaaggaauuuaaaa

SEQ ID NO: 2366878 - RNA, 19 nt, Human
acuuguaaaggaauuuaaa

SEQ ID NO: 2366879 - RNA, 20 nt, Human
acuuguaaaugugguaaaga

SEQ ID NO: 2366880 - RNA, 14 nt, Human
acuuguaaguugcu

SEQ ID NO: 2366881 - RNA, 14 nt, Human
acuuguaaaugcug

SEQ ID NO: 2366882 - RNA, 18 nt, Human
acuuguaaaugugguaaa

SEQ ID NO: 2366883 - RNA, 21 nt, Human
acuuggucugugagaugcuag

SEQ ID NO: 2366884 - RNA, 19 nt, Human
acuucuuuugcucuuagcu

SEQ ID NO: 2366885 - RNA, 21 nt, Human
acuucuuuucacauucuuaua

SEQ ID NO: 2366886 - RNA, 13 nt, Human
acuuguaaauaca

SEQ ID NO: 2366887 - RNA, 16 nt, Human
acuuguaaauacacca

SEQ ID NO: 2366888 - RNA, 14 nt, Human
acuuguaaauacac

SEQ ID NO: 2366889 - RNA, 15 nt, Human
acuuguaaauacacc

SEQ ID NO: 2366890 - RNA, 17 nt, Human
acugucugguuuuaaca

SEQ ID NO: 2366891 - RNA, 18 nt, Human
acugucugguuuuaacaa

SEQ ID NO: 2366892 - RNA, 19 nt, Human
acugucugguuuuaacaau

SEQ ID NO: 2366893 - RNA, 13 nt, Human
acugucugguuuu

SEQ ID NO: 2366894 - RNA, 19 nt, Human
acugucuauuucugcugaa

SEQ ID NO: 2366895 - RNA, 23 nt, Human
acugucuauuucugcugaauuuu

SEQ ID NO: 2366896 - RNA, 15 nt, Human
acugucugagaguuu

SEQ ID NO: 2366897 - RNA, 20 nt, Human
acugucugagaguuuaguug

SEQ ID NO: 2366898 - RNA, 23 nt, Human
acugugaucaggcuauguaugga

SEQ ID NO: 2366899 - RNA, 12 nt, Human
acugucuuucag

SEQ ID NO: 2366900 - RNA, 12 nt, Human
acugucuuuccu

SEQ ID NO: 2366901 - RNA, 16 nt, Human
acugucuucuucaggg

SEQ ID NO: 2366902 - RNA, 12 nt, Human
acugucuucagu

SEQ ID NO: 2366903 - RNA, 13 nt, Human
acugugaugccac

SEQ ID NO: 2366904 - RNA, 22 nt, Human
acugugaugccacacagagugg

SEQ ID NO: 2366905 - RNA, 20 nt, Human
acugugaugccacacagagu

SEQ ID NO: 2366906 - RNA, 21 nt, Human
acugugcacaucugugucuug

SEQ ID NO: 2366907 - RNA, 20 nt, Human
acugugcacaucugugucuu

SEQ ID NO: 2366908 - RNA, 19 nt, Human
acugugcacaucugugucu

SEQ ID NO: 2366909 - RNA, 15 nt, Human
acugugcacaucugu

SEQ ID NO: 2366910 - RNA, 18 nt, Human
acugugcaccaagcagga

SEQ ID NO: 2366911 - RNA, 12 nt, Human
acugugcagagu

SEQ ID NO: 2366912 - RNA, 21 nt, Human
acugugcagagucuagaaguu

SEQ ID NO: 2366913 - RNA, 20 nt, Human
acuggugggaucugugccca

SEQ ID NO: 2366914 - RNA, 17 nt, Human
acuggugugaccugagg

SEQ ID NO: 2366915 - RNA, 14 nt, Human
acuggugugaccug

SEQ ID NO: 2366916 - RNA, 23 nt, Human
acugguggcccgacagccuggca

SEQ ID NO: 2366917 - RNA, 16 nt, Human
acuguccugggccugc

SEQ ID NO: 2366918 - RNA, 21 nt, Human
acuggugugaccugagggcag

SEQ ID NO: 2366919 - RNA, 17 nt, Human
acuguccugggccugca

SEQ ID NO: 2366920 - RNA, 22 nt, Human
acugguguuaucaccgugggcu

SEQ ID NO: 2366921 - RNA, 21 nt, Human
acugguguuaucaccgugggc

SEQ ID NO: 2366922 - RNA, 21 nt, Human
acugguggcccgacagccugg

SEQ ID NO: 2366923 - RNA, 22 nt, Human
acugguggcccgacagccuggc

SEQ ID NO: 2366924 - RNA, 20 nt, Human
acugguggcccgacagccug

SEQ ID NO: 2366925 - RNA, 23 nt, Human
acuggguuuggaccccagcuggg

SEQ ID NO: 2366926 - RNA, 15 nt, Human
acugucucuccugau

SEQ ID NO: 2366927 - RNA, 13 nt, Human
acugucuauuucu

SEQ ID NO: 2366928 - RNA, 16 nt, Human
acugucuauuucugcu

SEQ ID NO: 2366929 - RNA, 17 nt, Human
acugucuauuucugcug

SEQ ID NO: 2366930 - RNA, 18 nt, Human
acugucuauuucugcuga

SEQ ID NO: 2366931 - RNA, 19 nt, Human
acuguccugggccugcaga

SEQ ID NO: 2366932 - RNA, 13 nt, Human
acuguccugggcg

SEQ ID NO: 2366933 - RNA, 18 nt, Human
acuguccugggcgcccug

SEQ ID NO: 2366934 - RNA, 23 nt, Human
acuguccugggcgcccuggaagc

SEQ ID NO: 2366935 - RNA, 22 nt, Human
acuguccugggcgcccuggaag

SEQ ID NO: 2366936 - RNA, 19 nt, Human
acuguccugggcgcccugg

SEQ ID NO: 2366937 - RNA, 20 nt, Human
acuguccugggcgcccugga

SEQ ID NO: 2366938 - RNA, 14 nt, Human
acuggacuccggcc

SEQ ID NO: 2366939 - RNA, 16 nt, Human
acuggacuccggcccu

SEQ ID NO: 2366940 - RNA, 19 nt, Human
acuggacuccggcccuccu

SEQ ID NO: 2366941 - RNA, 14 nt, Human
acuggagaaaaugg

SEQ ID NO: 2366942 - RNA, 23 nt, Human
acuggacucaggaugcccagggc

SEQ ID NO: 2366943 - RNA, 21 nt, Human
acuggacucaggaugcccagg

SEQ ID NO: 2366944 - RNA, 20 nt, Human
acuggacucaggaugcccag

SEQ ID NO: 2366945 - RNA, 14 nt, Human
acuggacucaggau

SEQ ID NO: 2366946 - RNA, 19 nt, Human
acuggacccuguugcuaag

SEQ ID NO: 2366947 - RNA, 20 nt, Human
acuggacccuguugcuaagc

SEQ ID NO: 2366948 - RNA, 17 nt, Human
acuggacccuguugcua

SEQ ID NO: 2366949 - RNA, 18 nt, Human
acuggacccuguugcuaa

SEQ ID NO: 2366950 - RNA, 16 nt, Human
acuggacccuguugcu

SEQ ID NO: 2366951 - RNA, 18 nt, Human
acuggacuccggcccucc

SEQ ID NO: 2366952 - RNA, 22 nt, Human
acuggacuugagcuuggcagcu

SEQ ID NO: 2366953 - RNA, 18 nt, Human
acuggguggggugaggac

SEQ ID NO: 2366954 - RNA, 21 nt, Human
acugggugcccaagcucagaa

SEQ ID NO: 2366955 - RNA, 22 nt, Human
acuggguggggugaggaccacu

SEQ ID NO: 2366956 - RNA, 20 nt, Human
acuggguggggugaggacca

SEQ ID NO: 2366957 - RNA, 20 nt, Human
acuggguuucucuguauagu

SEQ ID NO: 2366958 - RNA, 15 nt, Human
acuggguuucuagcc

SEQ ID NO: 2366959 - RNA, 16 nt, Human
acuggguuuggacccc

SEQ ID NO: 2366960 - RNA, 19 nt, Human
acuggguuuggaccccagc

SEQ ID NO: 2366961 - RNA, 20 nt, Human
acuggguuuggaccccagcu

SEQ ID NO: 2366962 - RNA, 21 nt, Human
acuggguuuggaccccagcug

SEQ ID NO: 2366963 - RNA, 22 nt, Human
acuggguuuggaccccagcugg

SEQ ID NO: 2366964 - RNA, 20 nt, Human
acuggguugacuuucaggua

SEQ ID NO: 2366965 - RNA, 16 nt, Human
acuggguucccaugcu

SEQ ID NO: 2366966 - RNA, 14 nt, Human
acuggguuucuagc

SEQ ID NO: 2366967 - RNA, 13 nt, Human
acuggguugacuu

SEQ ID NO: 2366968 - RNA, 14 nt, Human
acuggguuccugca

SEQ ID NO: 2366969 - RNA, 20 nt, Human
acugcccgagcuggugcauu

SEQ ID NO: 2366970 - RNA, 19 nt, Human
acugcccgagcuggugcau

SEQ ID NO: 2366971 - RNA, 16 nt, Human
acuggaagcacagcuu

SEQ ID NO: 2366972 - RNA, 15 nt, Human
acuggaagcacagcu

SEQ ID NO: 2366973 - RNA, 21 nt, Human
acugcccgagcuggugcauua

SEQ ID NO: 2366974 - RNA, 14 nt, Human
acuggaagcacagc

SEQ ID NO: 2366975 - RNA, 18 nt, Human
acugcccgagcuggugca

SEQ ID NO: 2366976 - RNA, 16 nt, Human
acugcccgagcuggug

SEQ ID NO: 2366977 - RNA, 15 nt, Human
acugcccgagcuggu

SEQ ID NO: 2366978 - RNA, 14 nt, Human
acugcccgagcugg

SEQ ID NO: 2366979 - RNA, 23 nt, Human
acugccccgugcagacuggaggg

SEQ ID NO: 2366980 - RNA, 19 nt, Human
acugccccgugcagacugg

SEQ ID NO: 2366981 - RNA, 18 nt, Human
acugccccgugcagacug

SEQ ID NO: 2366982 - RNA, 17 nt, Human
acugccccgugcagacu

SEQ ID NO: 2366983 - RNA, 20 nt, Human
acugcccccucugcccugcg

SEQ ID NO: 2366984 - RNA, 14 nt, Human
acugccagaugcug

SEQ ID NO: 2366985 - RNA, 18 nt, Human
acugcccccucugcccug

SEQ ID NO: 2366986 - RNA, 19 nt, Human
acugcccccucugcccugc

SEQ ID NO: 2366987 - RNA, 18 nt, Human
acugccaaaaugcucuag

SEQ ID NO: 2366988 - RNA, 17 nt, Human
acugccaaaaugcucua

SEQ ID NO: 2366989 - RNA, 21 nt, Human
acugccaaagggaaauaucau

SEQ ID NO: 2366990 - RNA, 22 nt, Human
acugccacacgucugacccucu

SEQ ID NO: 2366991 - RNA, 14 nt, Human
acugccaaccuggg

SEQ ID NO: 2366992 - RNA, 17 nt, Human
acugaagguaaaauuga

SEQ ID NO: 2366993 - RNA, 19 nt, Human
acugaaguagugugcaguu

SEQ ID NO: 2366994 - RNA, 13 nt, Human
acugaagugcuua

SEQ ID NO: 2366995 - RNA, 17 nt, Human
acugaagugcuuagugu

SEQ ID NO: 2366996 - RNA, 13 nt, Human
acugaagucugaa

SEQ ID NO: 2366997 - RNA, 14 nt, Human
acugaagucugaaa

SEQ ID NO: 2366998 - RNA, 16 nt, Human
acugaagucugaaauu

SEQ ID NO: 2366999 - RNA, 11 nt, Human
acugaaggaga

SEQ ID NO: 2367000 - RNA, 23 nt, Human
acugaaggaaaaacacaagcaaa

SEQ ID NO: 2367001 - RNA, 20 nt, Human
acugaaggaaaaacacaagc

SEQ ID NO: 2367002 - RNA, 22 nt, Human
acugaaggaaaaacacaagcaa

SEQ ID NO: 2367003 - RNA, 18 nt, Human
acugaaggaaaaacacaa

SEQ ID NO: 2367004 - RNA, 21 nt, Human
acugaaggagaaggugcccca

SEQ ID NO: 2367005 - RNA, 14 nt, Human
acugaaggagaagg

SEQ ID NO: 2367006 - RNA, 13 nt, Human
acugaaggagaag

SEQ ID NO: 2367007 - RNA, 17 nt, Human
acugaaggccuggccca

SEQ ID NO: 2367008 - RNA, 20 nt, Human
acugaaggccuggcccacag

SEQ ID NO: 2367009 - RNA, 15 nt, Human
acugaagucugaaau

SEQ ID NO: 2367010 - RNA, 18 nt, Human
acuuucagugaaagcauc

SEQ ID NO: 2367011 - RNA, 19 nt, Human
acuuucauuaaagcauuua

SEQ ID NO: 2367012 - RNA, 17 nt, Human
acuuucauuuuuuucca

SEQ ID NO: 2367013 - RNA, 20 nt, Human
acuuucauuuuuuuccaggc

SEQ ID NO: 2367014 - RNA, 19 nt, Human
acuuucauccugacucugc

SEQ ID NO: 2367015 - RNA, 21 nt, Human
acuuucauccugacucugccc

SEQ ID NO: 2367016 - RNA, 23 nt, Human
acuuucauccugacucugccccc

SEQ ID NO: 2367017 - RNA, 23 nt, Human
acuuuagggaaguacuuuuggca

SEQ ID NO: 2367018 - RNA, 23 nt, Human
acuuuagggcuguaaaaugcaug

SEQ ID NO: 2367019 - RNA, 22 nt, Human
acuuuagggcuguaaaaugcau

SEQ ID NO: 2367020 - RNA, 15 nt, Human
acuuuagggcuguaa

SEQ ID NO: 2367021 - RNA, 15 nt, Human
acuuuagucugcaaa

SEQ ID NO: 2367022 - RNA, 16 nt, Human
acuuuagucugcaaaa

SEQ ID NO: 2367023 - RNA, 17 nt, Human
acuuuagucugcaaaau

SEQ ID NO: 2367024 - RNA, 18 nt, Human
acuuuagucugcaaaaug

SEQ ID NO: 2367025 - RNA, 20 nt, Human
acuuuccacccccucccugg

SEQ ID NO: 2367026 - RNA, 19 nt, Human
acuuuccacccccucccug

SEQ ID NO: 2367027 - RNA, 18 nt, Human
acuuuccacccccucccu

SEQ ID NO: 2367028 - RNA, 14 nt, Human
acuuuccugcaacu

SEQ ID NO: 2367029 - RNA, 16 nt, Human
acuuuccacccccucc

SEQ ID NO: 2367030 - RNA, 21 nt, Human
acuuucauuuuuuuccaggcu

SEQ ID NO: 2367031 - RNA, 23 nt, Human
acuuucauuuuuuuccaggcugg

SEQ ID NO: 2367032 - RNA, 23 nt, Human
acuuuccuucauucaacccaccu

SEQ ID NO: 2367033 - RNA, 17 nt, Human
acuuuccuuuccccagc

SEQ ID NO: 2367034 - RNA, 18 nt, Human
acuuuccuuuccccagcc

SEQ ID NO: 2367035 - RNA, 22 nt, Human
acuuuccuuuccccagcccagg

SEQ ID NO: 2367036 - RNA, 19 nt, Human
acuuuccuuuccccagccc

SEQ ID NO: 2367037 - RNA, 15 nt, Human
acuuucguacauugg

SEQ ID NO: 2367038 - RNA, 16 nt, Human
acuuucguacauuggc

SEQ ID NO: 2367039 - RNA, 15 nt, Human
acuuuguucuuuagg

SEQ ID NO: 2367040 - RNA, 15 nt, Human
acuuucuagauuaag

SEQ ID NO: 2367041 - RNA, 20 nt, Human
acuuuguuucguggggaggu

SEQ ID NO: 2367042 - RNA, 20 nt, Human
acuuuguucuuuaggagauu

SEQ ID NO: 2367043 - RNA, 13 nt, Human
acuuuuaaacugu

SEQ ID NO: 2367044 - RNA, 15 nt, Human
acuuuuaaacaguga

SEQ ID NO: 2367045 - RNA, 12 nt, Human
acuuuuaaacag

SEQ ID NO: 2367046 - RNA, 19 nt, Human
acuuuguucuuuaggagau

SEQ ID NO: 2367047 - RNA, 23 nt, Human
acuuuguucuggcucuuccaggc

SEQ ID NO: 2367048 - RNA, 21 nt, Human
acuuucuacaaugugaacuuu

SEQ ID NO: 2367049 - RNA, 19 nt, Human
acuuucuacaaugugaacu

SEQ ID NO: 2367050 - RNA, 17 nt, Human
acuuucuacaaugugaa

SEQ ID NO: 2367051 - RNA, 15 nt, Human
agaaaauggacacug

SEQ ID NO: 2367052 - RNA, 23 nt, Human
agaaaauauuauguguuuccaua

SEQ ID NO: 2367053 - RNA, 13 nt, Human
agaaaauguuauu

SEQ ID NO: 2367054 - RNA, 18 nt, Human
agaaaauguuauuuaaca

SEQ ID NO: 2367055 - RNA, 16 nt, Human
agaaaauguuauuuaa

SEQ ID NO: 2367056 - RNA, 19 nt, Human
agaaaauguuauuuaacag

SEQ ID NO: 2367057 - RNA, 22 nt, Human
agaaaauggacguguuaugacu

SEQ ID NO: 2367058 - RNA, 23 nt, Human
agaaaauggacguguuaugacuc

SEQ ID NO: 2367059 - RNA, 18 nt, Human
agaaaauucaauuguaaa

SEQ ID NO: 2367060 - RNA, 17 nt, Human
agaaaauucaauuguaa

SEQ ID NO: 2367061 - RNA, 15 nt, Human
agaaaauucaauugu

SEQ ID NO: 2367062 - RNA, 13 nt, Human
agaaaauucaauu

SEQ ID NO: 2367063 - RNA, 12 nt, Human
agaaaauucaau

SEQ ID NO: 2367064 - RNA, 17 nt, Human
agaaaauguugagaauc

SEQ ID NO: 2367065 - RNA, 16 nt, Human
agaaaauguugagaau

SEQ ID NO: 2367066 - RNA, 18 nt, Human
agaaaauugcugugccuc

SEQ ID NO: 2367067 - RNA, 18 nt, Human
agaaacaacaauuucuac

SEQ ID NO: 2367068 - RNA, 14 nt, Human
agaaaauugcugug

SEQ ID NO: 2367069 - RNA, 12 nt, Human
agaaaauauacu

SEQ ID NO: 2367070 - RNA, 14 nt, Human
agaaaauauacugu

SEQ ID NO: 2367071 - RNA, 13 nt, Human
agaaaauauacug

SEQ ID NO: 2367072 - RNA, 11 nt, Human
agaaaauauac

SEQ ID NO: 2367073 - RNA, 22 nt, Human
agaaaauauacuguaaagaaag

SEQ ID NO: 2367074 - RNA, 21 nt, Human
agaaaauauacuguaaagaaa

SEQ ID NO: 2367075 - RNA, 20 nt, Human
agaaaauauacuguaaagaa

SEQ ID NO: 2367076 - RNA, 19 nt, Human
agaaaauauacuguaaaga

SEQ ID NO: 2367077 - RNA, 18 nt, Human
agaaaauauacuguaaag

SEQ ID NO: 2367078 - RNA, 17 nt, Human
agaaaauauacuguaaa

SEQ ID NO: 2367079 - RNA, 16 nt, Human
agaaaauauacuguaa

SEQ ID NO: 2367080 - RNA, 15 nt, Human
agaaaauauacugua

SEQ ID NO: 2367081 - RNA, 22 nt, Human
agaaaauaucugaaaugugaua

SEQ ID NO: 2367082 - RNA, 23 nt, Human
agaaaauauacuguaaagaaaga

SEQ ID NO: 2367083 - RNA, 23 nt, Human
agaaaauggaagacagcucuuau

SEQ ID NO: 2367084 - RNA, 15 nt, Human
agaaaauggacgugu

SEQ ID NO: 2367085 - RNA, 20 nt, Human
agaaaauggacguguuauga

SEQ ID NO: 2367086 - RNA, 20 nt, Human
agaaaagggaacugaacauu

SEQ ID NO: 2367087 - RNA, 23 nt, Human
agaaaagggaaguugugccuuuu

SEQ ID NO: 2367088 - RNA, 24 nt, Human
acuuuucuuaaaccuucaguuaug

SEQ ID NO: 2367089 - RNA, 16 nt, Human
acuuuucuuaaaccuu

SEQ ID NO: 2367090 - RNA, 15 nt, Human
agaaaaguaagcccu

SEQ ID NO: 2367091 - RNA, 22 nt, Human
agaaaauaaaaaaaagaaaaaa

SEQ ID NO: 2367092 - RNA, 21 nt, Human
agaaaauaaaaaaaagaaaaa

SEQ ID NO: 2367093 - RNA, 14 nt, Human
agaaaauaaaaagu

SEQ ID NO: 2367094 - RNA, 13 nt, Human
agaaaauaaaaag

SEQ ID NO: 2367095 - RNA, 18 nt, Human
agaaaauaaaaaguuaaa

SEQ ID NO: 2367096 - RNA, 17 nt, Human
agaaaauaaaaaguuaa

SEQ ID NO: 2367097 - RNA, 16 nt, Human
agaaaauaaaaaguua

SEQ ID NO: 2367098 - RNA, 15 nt, Human
agaaaauaaaaaguu

SEQ ID NO: 2367099 - RNA, 20 nt, Human
agaaaauaaaaaaaagaaaa

SEQ ID NO: 2367100 - RNA, 19 nt, Human
agaaaauaaaaaaaagaaa

SEQ ID NO: 2367101 - RNA, 18 nt, Human
agaaaauaaaaaaaagaa

SEQ ID NO: 2367102 - RNA, 17 nt, Human
agaaaauaaaaaaaaga

SEQ ID NO: 2367103 - RNA, 16 nt, Human
agaaaauaaaaaaaag

SEQ ID NO: 2367104 - RNA, 12 nt, Human
agaaaauaaaaa

SEQ ID NO: 2367105 - RNA, 11 nt, Human
acuuuuauaau

SEQ ID NO: 2367106 - RNA, 23 nt, Human
acuuuuauacucuuucuguauau

SEQ ID NO: 2367107 - RNA, 17 nt, Human
acuuuuccucccucagu

SEQ ID NO: 2367108 - RNA, 19 nt, Human
acuuuuauaauaaaaggaa

SEQ ID NO: 2367109 - RNA, 15 nt, Human
acuuuucuccaugag

SEQ ID NO: 2367110 - RNA, 19 nt, Human
acuuuuccuuugaauccuc

SEQ ID NO: 2367111 - RNA, 18 nt, Human
acuuuuccuuugaauccu

SEQ ID NO: 2367112 - RNA, 22 nt, Human
acuuuuauaaacuuuaccuuuu

SEQ ID NO: 2367113 - RNA, 17 nt, Human
acuuuuaaacuguguac

SEQ ID NO: 2367114 - RNA, 15 nt, Human
acuuuuaaacugugu

SEQ ID NO: 2367115 - RNA, 14 nt, Human
acuuuuaaacugug

SEQ ID NO: 2367116 - RNA, 19 nt, Human
acuuuuauaaacuuuaccu

SEQ ID NO: 2367117 - RNA, 15 nt, Human
acuuuuauaaacuuu

SEQ ID NO: 2367118 - RNA, 19 nt, Human
agaaauaaaguuggugaca

SEQ ID NO: 2367119 - RNA, 21 nt, Human
agaaauaaaguuggugacaga

SEQ ID NO: 2367120 - RNA, 18 nt, Human
agaaauaaaguuugcuua

SEQ ID NO: 2367121 - RNA, 18 nt, Human
agaaauaaaguuucuguu

SEQ ID NO: 2367122 - RNA, 15 nt, Human
agaaauaaaguuucu

SEQ ID NO: 2367123 - RNA, 20 nt, Human
agaaauaaaaggaagccaaa

SEQ ID NO: 2367124 - RNA, 19 nt, Human
agaaauaaaaggaagccaa

SEQ ID NO: 2367125 - RNA, 18 nt, Human
agaaauaaaaggaagcca

SEQ ID NO: 2367126 - RNA, 20 nt, Human
agaaaggaggggauagagag

SEQ ID NO: 2367127 - RNA, 23 nt, Human
agaaaggaggggauagagagaga

SEQ ID NO: 2367128 - RNA, 15 nt, Human
agaaaggacucuggg

SEQ ID NO: 2367129 - RNA, 11 nt, Human
agaaaggagac

SEQ ID NO: 2367130 - RNA, 14 nt, Human
agaaaggacucugg

SEQ ID NO: 2367131 - RNA, 17 nt, Human
agaaacaacucuuugag

SEQ ID NO: 2367132 - RNA, 17 nt, Human
agaaaggagucugcaca

SEQ ID NO: 2367133 - RNA, 22 nt, Human
acuaggggauauaggagaggaa

SEQ ID NO: 2367134 - RNA, 14 nt, Human
acuagguaacuuca

SEQ ID NO: 2367135 - RNA, 16 nt, Human
acuaggguccugggga

SEQ ID NO: 2367136 - RNA, 22 nt, Human
acuaguuacacaucuucaacag

SEQ ID NO: 2367137 - RNA, 17 nt, Human
acuaguugugaccuuag

SEQ ID NO: 2367138 - RNA, 20 nt, Human
acuaguugugaccuuagugu

SEQ ID NO: 2367139 - RNA, 21 nt, Human
acuaguugugaccuuaguguu

SEQ ID NO: 2367140 - RNA, 18 nt, Human
acuaguuacacaucuuca

SEQ ID NO: 2367141 - RNA, 15 nt, Human
acuaguuacacaucu

SEQ ID NO: 2367142 - RNA, 16 nt, Human
acuagguaacuucaua

SEQ ID NO: 2367143 - RNA, 15 nt, Human
acuagguaacuucau

SEQ ID NO: 2367144 - RNA, 19 nt, Human
acuagggauucaggcugcu

SEQ ID NO: 2367145 - RNA, 18 nt, Human
acuagggauucaggcugc

SEQ ID NO: 2367146 - RNA, 17 nt, Human
acuagggauucaggcug

SEQ ID NO: 2367147 - RNA, 16 nt, Human
acuagggauucaggcu

SEQ ID NO: 2367148 - RNA, 21 nt, Human
acuagggauucaggcugcuug

SEQ ID NO: 2367149 - RNA, 16 nt, Human
acuagggccaagccca

SEQ ID NO: 2367150 - RNA, 15 nt, Human
acuaggguccugggg

SEQ ID NO: 2367151 - RNA, 18 nt, Human
acuaggcccccacuugcc

SEQ ID NO: 2367152 - RNA, 20 nt, Human
acuagggaucccucaucugu

SEQ ID NO: 2367153 - RNA, 19 nt, Human
acuagggaucccucaucug

SEQ ID NO: 2367154 - RNA, 18 nt, Human
acuagggaucccucaucu

SEQ ID NO: 2367155 - RNA, 20 nt, Human
acuaggcccccacuugccuc

SEQ ID NO: 2367156 - RNA, 23 nt, Human
acuagcuagaagugggccaggac

SEQ ID NO: 2367157 - RNA, 17 nt, Human
acuaggacucugaggcu

SEQ ID NO: 2367158 - RNA, 18 nt, Human
acuaggagaaccaaaucu

SEQ ID NO: 2367159 - RNA, 16 nt, Human
acuaggacucugaggc

SEQ ID NO: 2367160 - RNA, 18 nt, Human
acuaggaaauccauucac

SEQ ID NO: 2367161 - RNA, 15 nt, Human
acuagccucuccagg

SEQ ID NO: 2367162 - RNA, 21 nt, Human
acuagccccuguggagacugg

SEQ ID NO: 2367163 - RNA, 17 nt, Human
acuagccuuuggcucug

SEQ ID NO: 2367164 - RNA, 18 nt, Human
acuagccuuuggcucugg

SEQ ID NO: 2367165 - RNA, 19 nt, Human
acuagccuuuggcucugga

SEQ ID NO: 2367166 - RNA, 20 nt, Human
acuagccuuuggcucuggag

SEQ ID NO: 2367167 - RNA, 22 nt, Human
acuagccuuuggcucuggagac

SEQ ID NO: 2367168 - RNA, 17 nt, Human
acuagcccaaugaaaug

SEQ ID NO: 2367169 - RNA, 15 nt, Human
acuagcccaaugaaa

SEQ ID NO: 2367170 - RNA, 22 nt, Human
acuagccagacacucugcucug

SEQ ID NO: 2367171 - RNA, 21 nt, Human
acuagccaugauaacugcaau

SEQ ID NO: 2367172 - RNA, 14 nt, Human
acuagcuauggugu

SEQ ID NO: 2367173 - RNA, 15 nt, Human
acuagccaccaacuc

SEQ ID NO: 2367174 - RNA, 16 nt, Human
acuagccaccaacucu

SEQ ID NO: 2367175 - RNA, 23 nt, Human
acuagccaccaacucuugcaggu

SEQ ID NO: 2367176 - RNA, 22 nt, Human
acucagcucuuggcuccacugg

SEQ ID NO: 2367177 - RNA, 14 nt, Human
acucagcuccguga

SEQ ID NO: 2367178 - RNA, 21 nt, Human
acucagcccugggccccacca

SEQ ID NO: 2367179 - RNA, 14 nt, Human
acucagcuccccag

SEQ ID NO: 2367180 - RNA, 15 nt, Human
acucagcuccccaga

SEQ ID NO: 2367181 - RNA, 19 nt, Human
acucagcuccccagagucc

SEQ ID NO: 2367182 - RNA, 11 nt, Human
acucagccuuc

SEQ ID NO: 2367183 - RNA, 23 nt, Human
acucagccuucagacagagagga

SEQ ID NO: 2367184 - RNA, 17 nt, Human
acucaggcccaaagccu

SEQ ID NO: 2367185 - RNA, 15 nt, Human
acucaggcuuucacu

SEQ ID NO: 2367186 - RNA, 23 nt, Human
acucaggcuuucacuauuuccuu

SEQ ID NO: 2367187 - RNA, 13 nt, Human
acucagggacaga

SEQ ID NO: 2367188 - RNA, 15 nt, Human
acucagggacagagc

SEQ ID NO: 2367189 - RNA, 17 nt, Human
acucagggacagagcca

SEQ ID NO: 2367190 - RNA, 18 nt, Human
acucagggacagagccau

SEQ ID NO: 2367191 - RNA, 20 nt, Human
acucagggacagagccaugc

SEQ ID NO: 2367192 - RNA, 14 nt, Human
acucagggccccag

SEQ ID NO: 2367193 - RNA, 13 nt, Human
acucagggcccca

SEQ ID NO: 2367194 - RNA, 22 nt, Human
acucagggcagcgccaggcuga

SEQ ID NO: 2367195 - RNA, 21 nt, Human
acucagggcagcgccaggcug

SEQ ID NO: 2367196 - RNA, 20 nt, Human
acucagggcagcgccaggcu

SEQ ID NO: 2367197 - RNA, 17 nt, Human
acucagggcagcgccag

SEQ ID NO: 2367198 - RNA, 19 nt, Human
acucaguuugucagacuuu

SEQ ID NO: 2367199 - RNA, 15 nt, Human
acucaguuugucaga

SEQ ID NO: 2367200 - RNA, 14 nt, Human
acucaguuugucag

SEQ ID NO: 2367201 - RNA, 13 nt, Human
acucaguuuguca

SEQ ID NO: 2367202 - RNA, 18 nt, Human
acucagggccaugccugc

SEQ ID NO: 2367203 - RNA, 14 nt, Human
acucaguggggagg

SEQ ID NO: 2367204 - RNA, 13 nt, Human
acucagucuuuaa

SEQ ID NO: 2367205 - RNA, 15 nt, Human
acucaguuuuaacua

SEQ ID NO: 2367206 - RNA, 22 nt, Human
acucaguuuuaacuagaauuua

SEQ ID NO: 2367207 - RNA, 21 nt, Human
acucauaaaaagccugcaauu

SEQ ID NO: 2367208 - RNA, 13 nt, Human
acucaguuuucuu

SEQ ID NO: 2367209 - RNA, 22 nt, Human
acucaguuugucagacuuuaaa

SEQ ID NO: 2367210 - RNA, 12 nt, Human
acuccccaggcc

SEQ ID NO: 2367211 - RNA, 14 nt, Human
acucccccaggugg

SEQ ID NO: 2367212 - RNA, 16 nt, Human
acuccccgaagucuuu

SEQ ID NO: 2367213 - RNA, 14 nt, Human
acuccccgaagucu

SEQ ID NO: 2367214 - RNA, 13 nt, Human
acuccccaggcca

SEQ ID NO: 2367215 - RNA, 15 nt, Human
acuccccaggccagg

SEQ ID NO: 2367216 - RNA, 19 nt, Human
acuccccaggccaggccac

SEQ ID NO: 2367217 - RNA, 22 nt, Human
acuccccugcacuggaguccag

SEQ ID NO: 2367218 - RNA, 16 nt, Human
acuccccugcacugga

SEQ ID NO: 2367219 - RNA, 12 nt, Human
acuccccugcac

SEQ ID NO: 2367220 - RNA, 11 nt, Human
acuccccucca

SEQ ID NO: 2367221 - RNA, 17 nt, Human
acuccccgaagucuuuu

SEQ ID NO: 2367222 - RNA, 17 nt, Human
acuccccugcugggugu

SEQ ID NO: 2367223 - RNA, 12 nt, Human
acuccccuccuu

SEQ ID NO: 2367224 - RNA, 13 nt, Human
acuccccugcugg

SEQ ID NO: 2367225 - RNA, 23 nt, Human
acucaaacuuuuccccuguccug

SEQ ID NO: 2367226 - RNA, 21 nt, Human
acucaaacugccuuggcuuca

SEQ ID NO: 2367227 - RNA, 23 nt, Human
acucaaacugaggaauuucaccu

SEQ ID NO: 2367228 - RNA, 20 nt, Human
acucaaaguuucagagacca

SEQ ID NO: 2367229 - RNA, 19 nt, Human
acucaaaguuucagagacc

SEQ ID NO: 2367230 - RNA, 22 nt, Human
acucaaaguuucagagaccauu

SEQ ID NO: 2367231 - RNA, 19 nt, Human
acucagauccagggacaga

SEQ ID NO: 2367232 - RNA, 17 nt, Human
acucagauccagggaca

SEQ ID NO: 2367233 - RNA, 16 nt, Human
acucagauccagggac

SEQ ID NO: 2367234 - RNA, 14 nt, Human
acucagauccaggg

SEQ ID NO: 2367235 - RNA, 12 nt, Human
acucagauccag

SEQ ID NO: 2367236 - RNA, 11 nt, Human
acucagaucca

SEQ ID NO: 2367237 - RNA, 14 nt, Human
acucaaaucaagaa

SEQ ID NO: 2367238 - RNA, 22 nt, Human
acucagcccugggccccaccac

SEQ ID NO: 2367239 - RNA, 16 nt, Human
acucagcccugggccc

SEQ ID NO: 2367240 - RNA, 15 nt, Human
acucagcccugggcc

SEQ ID NO: 2367241 - RNA, 22 nt, Human
acucagccucaauaagccuugu

SEQ ID NO: 2367242 - RNA, 14 nt, Human
acucagcccugggc

SEQ ID NO: 2367243 - RNA, 13 nt, Human
acucagcccuggg

SEQ ID NO: 2367244 - RNA, 12 nt, Human
acucagcccugg

SEQ ID NO: 2367245 - RNA, 17 nt, Human
acucagcagcccuccuc

SEQ ID NO: 2367246 - RNA, 15 nt, Human
acucagcccugaggu

SEQ ID NO: 2367247 - RNA, 15 nt, Human
acucagcagcccucc

SEQ ID NO: 2367248 - RNA, 14 nt, Human
acucagcagcccuc

SEQ ID NO: 2367249 - RNA, 22 nt, Human
acucagaugucucuggcgugug

SEQ ID NO: 2367250 - RNA, 23 nt, Human
acucagauggaaccgcaggaagc

SEQ ID NO: 2367251 - RNA, 22 nt, Human
acucagauggaaccgcaggaag

SEQ ID NO: 2367252 - RNA, 21 nt, Human
acucagauggaaccgcaggaa

SEQ ID NO: 2367253 - RNA, 16 nt, Human
acucagaucugucuga

SEQ ID NO: 2367254 - RNA, 13 nt, Human
acucagcagcccu

SEQ ID NO: 2367255 - RNA, 15 nt, Human
acucagcacaaggcc

SEQ ID NO: 2367256 - RNA, 20 nt, Human
acucaaaauauuuguacaua

SEQ ID NO: 2367257 - RNA, 19 nt, Human
acucaaaauauuuguacau

SEQ ID NO: 2367258 - RNA, 17 nt, Human
acucaaaauauuuguac

SEQ ID NO: 2367259 - RNA, 16 nt, Human
acucaaacucuuaaaa

SEQ ID NO: 2367260 - RNA, 17 nt, Human
acucaaacucuuaaaac

SEQ ID NO: 2367261 - RNA, 20 nt, Human
acucaaaccaaaucacugaa

SEQ ID NO: 2367262 - RNA, 19 nt, Human
acucaaaccaaaucacuga

SEQ ID NO: 2367263 - RNA, 21 nt, Human
acucaaacugaggaauuucac

SEQ ID NO: 2367264 - RNA, 14 nt, Human
acucaaacugagga

SEQ ID NO: 2367265 - RNA, 11 nt, Human
acuauaaugua

SEQ ID NO: 2367266 - RNA, 18 nt, Human
acucaaaagcugggcagg

SEQ ID NO: 2367267 - RNA, 15 nt, Human
acucaaaauauuugu

SEQ ID NO: 2367268 - RNA, 17 nt, Human
acuaguuuugugccagc

SEQ ID NO: 2367269 - RNA, 19 nt, Human
acuaguuuaguuaaaugag

SEQ ID NO: 2367270 - RNA, 20 nt, Human
acuauaaagaaguaacaaaa

SEQ ID NO: 2367271 - RNA, 18 nt, Human
acuauaaagguugacaau

SEQ ID NO: 2367272 - RNA, 16 nt, Human
acucugggcuccagag

SEQ ID NO: 2367273 - RNA, 14 nt, Human
acucugggcuccag

SEQ ID NO: 2367274 - RNA, 17 nt, Human
acucugggcugcuaccc

SEQ ID NO: 2367275 - RNA, 17 nt, Human
acucugggguuuuuacu

SEQ ID NO: 2367276 - RNA, 18 nt, Human
acucuggucuucuuuggg

SEQ ID NO: 2367277 - RNA, 12 nt, Human
acucuggcuggu

SEQ ID NO: 2367278 - RNA, 11 nt, Human
acucuggccuc

SEQ ID NO: 2367279 - RNA, 22 nt, Human
acucuggcugguuuggaaugcu

SEQ ID NO: 2367280 - RNA, 23 nt, Human
acucuggcugguuuggaaugcuu

SEQ ID NO: 2367281 - RNA, 14 nt, Human
acucuggcuuccag

SEQ ID NO: 2367282 - RNA, 13 nt, Human
acucugggaaaua

SEQ ID NO: 2367283 - RNA, 15 nt, Human
acucuggcuuccagg

SEQ ID NO: 2367284 - RNA, 17 nt, Human
acucuggcuuccaggua

SEQ ID NO: 2367285 - RNA, 19 nt, Human
acucugggaaauaagagag

SEQ ID NO: 2367286 - RNA, 18 nt, Human
acucuauagacucuagga

SEQ ID NO: 2367287 - RNA, 16 nt, Human
acucuaucaaguauua

SEQ ID NO: 2367288 - RNA, 15 nt, Human
acucuauagacucua

SEQ ID NO: 2367289 - RNA, 14 nt, Human
acucuaucaaguau

SEQ ID NO: 2367290 - RNA, 14 nt, Human
acucuguuccuuca

SEQ ID NO: 2367291 - RNA, 17 nt, Human
acucuguuccuucacau

SEQ ID NO: 2367292 - RNA, 22 nt, Human
acucuguuccuucacauccugu

SEQ ID NO: 2367293 - RNA, 20 nt, Human
acucuguuccuucacauccu

SEQ ID NO: 2367294 - RNA, 20 nt, Human
acucuguugcaagugcaaua

SEQ ID NO: 2367295 - RNA, 18 nt, Human
acucuuaaaacccaagug

SEQ ID NO: 2367296 - RNA, 11 nt, Human
acucuuaaaac

SEQ ID NO: 2367297 - RNA, 16 nt, Human
acucuguggggccuug

SEQ ID NO: 2367298 - RNA, 15 nt, Human
acucuguggccaaag

SEQ ID NO: 2367299 - RNA, 17 nt, Human
acucuguggggccuugg

SEQ ID NO: 2367300 - RNA, 16 nt, Human
acucugugucaggugg

SEQ ID NO: 2367301 - RNA, 12 nt, Human
acucugugccca

SEQ ID NO: 2367302 - RNA, 20 nt, Human
acucugugccugaccuugag

SEQ ID NO: 2367303 - RNA, 23 nt, Human
acucugugcccaugggcacugcu

SEQ ID NO: 2367304 - RNA, 24 nt, Human
acucugugcccaugggcacugcug

SEQ ID NO: 2367305 - RNA, 13 nt, Human
acucugugcccau

SEQ ID NO: 2367306 - RNA, 15 nt, Human
acucugugcccaugg

SEQ ID NO: 2367307 - RNA, 18 nt, Human
acucugugcccaugggca

SEQ ID NO: 2367308 - RNA, 21 nt, Human
acucugugcccaugggcacug

SEQ ID NO: 2367309 - RNA, 18 nt, Human
acucuacccucuuagaaa

SEQ ID NO: 2367310 - RNA, 13 nt, Human
acucuacccucuu

SEQ ID NO: 2367311 - RNA, 21 nt, Human
acucuacccucuuagaaaaac

SEQ ID NO: 2367312 - RNA, 22 nt, Human
acucuaccucauaucaguuugc

SEQ ID NO: 2367313 - RNA, 13 nt, Human
acucuaccucaua

SEQ ID NO: 2367314 - RNA, 17 nt, Human
acuccccuugagcugag

SEQ ID NO: 2367315 - RNA, 15 nt, Human
acuccccuugagcug

SEQ ID NO: 2367316 - RNA, 20 nt, Human
acuccccuugagcugagaug

SEQ ID NO: 2367317 - RNA, 18 nt, Human
acucccggcacuccaugc

SEQ ID NO: 2367318 - RNA, 19 nt, Human
acucccggcacuccaugcu

SEQ ID NO: 2367319 - RNA, 13 nt, Human
acucccuccucac

SEQ ID NO: 2367320 - RNA, 22 nt, Human
acucccuucuaccugccacuca

SEQ ID NO: 2367321 - RNA, 13 nt, Human
acucccuuucaac

SEQ ID NO: 2367322 - RNA, 12 nt, Human
acucccuuucaa

SEQ ID NO: 2367323 - RNA, 14 nt, Human
acucccuugggcuc

SEQ ID NO: 2367324 - RNA, 19 nt, Human
acucccuugguggcaagag

SEQ ID NO: 2367325 - RNA, 21 nt, Human
acucccuugguggcaagagcc

SEQ ID NO: 2367326 - RNA, 22 nt, Human
acucccuugguggcaagagccc

SEQ ID NO: 2367327 - RNA, 18 nt, Human
accuuucauaaucuuugc

SEQ ID NO: 2367328 - RNA, 23 nt, Human
accuuucagauaacuguuauuua

SEQ ID NO: 2367329 - RNA, 16 nt, Human
accuuucagcugugaa

SEQ ID NO: 2367330 - RNA, 17 nt, Human
accuuucagcugugaac

SEQ ID NO: 2367331 - RNA, 17 nt, Human
accuuuauuuuagaauu

SEQ ID NO: 2367332 - RNA, 17 nt, Human
accuuucaaauuucaca

SEQ ID NO: 2367333 - RNA, 15 nt, Human
accuuucacauagag

SEQ ID NO: 2367334 - RNA, 23 nt, Human
accuuucaauaggaaaaacugau

SEQ ID NO: 2367335 - RNA, 17 nt, Human
accuuucaauaggaaaa

SEQ ID NO: 2367336 - RNA, 21 nt, Human
accuuucaauaggaaaaacug

SEQ ID NO: 2367337 - RNA, 14 nt, Human
accuguagucccag

SEQ ID NO: 2367338 - RNA, 12 nt, Human
accuguacucag

SEQ ID NO: 2367339 - RNA, 18 nt, Human
accuguagucccagcuac

SEQ ID NO: 2367340 - RNA, 17 nt, Human
accuguagucccagcua

SEQ ID NO: 2367341 - RNA, 21 nt, Human
accuguauaaguggaggcacu

SEQ ID NO: 2367342 - RNA, 23 nt, Human
accuguauaaguggaggcacuuu

SEQ ID NO: 2367343 - RNA, 16 nt, Human
accugcccccuucucc

SEQ ID NO: 2367344 - RNA, 15 nt, Human
accugcccccuucuc

SEQ ID NO: 2367345 - RNA, 17 nt, Human
accugcccccuucuccc

SEQ ID NO: 2367346 - RNA, 22 nt, Human
accugccccuccucucugcccu

SEQ ID NO: 2367347 - RNA, 20 nt, Human
accugccccuccucucugcc

SEQ ID NO: 2367348 - RNA, 14 nt, Human
accuuggcucaagu

SEQ ID NO: 2367349 - RNA, 12 nt, Human
accuuggcugca

SEQ ID NO: 2367350 - RNA, 22 nt, Human
accugucaaugauacagucccu

SEQ ID NO: 2367351 - RNA, 24 nt, Human
accugucaaacaaagccagaagcu

SEQ ID NO: 2367352 - RNA, 20 nt, Human
accugucaaacaaagccaga

SEQ ID NO: 2367353 - RNA, 19 nt, Human
accugucaaacaaagccag

SEQ ID NO: 2367354 - RNA, 17 nt, Human
accuguaugucuccagu

SEQ ID NO: 2367355 - RNA, 12 nt, Human
accuuggcucaa

SEQ ID NO: 2367356 - RNA, 14 nt, Human
accuuuauugugau

SEQ ID NO: 2367357 - RNA, 16 nt, Human
accuuuauugugaucu

SEQ ID NO: 2367358 - RNA, 18 nt, Human
accuuuauugugaucuau

SEQ ID NO: 2367359 - RNA, 22 nt, Human
accuuguugcaugauguauuuu

SEQ ID NO: 2367360 - RNA, 16 nt, Human
accuuucaauaggaaa

SEQ ID NO: 2367361 - RNA, 13 nt, Human
accuuuauucugg

SEQ ID NO: 2367362 - RNA, 12 nt, Human
accuuuauucug

SEQ ID NO: 2367363 - RNA, 22 nt, Human
accuuguuauuucucagacuuu

SEQ ID NO: 2367364 - RNA, 14 nt, Human
accuuguucacacu

SEQ ID NO: 2367365 - RNA, 16 nt, Human
accuuguucacacucu

SEQ ID NO: 2367366 - RNA, 21 nt, Human
accuuguucacacucucacau

SEQ ID NO: 2367367 - RNA, 17 nt, Human
accuuguuauuucucag

SEQ ID NO: 2367368 - RNA, 18 nt, Human
accuuguguguaugugua

SEQ ID NO: 2367369 - RNA, 17 nt, Human
accuuguuacuucugag

SEQ ID NO: 2367370 - RNA, 14 nt, Human
accuuggcugcagg

SEQ ID NO: 2367371 - RNA, 17 nt, Human
accuugugccuggcuca

SEQ ID NO: 2367372 - RNA, 18 nt, Human
accuugugucuguacacg

SEQ ID NO: 2367373 - RNA, 21 nt, Human
accuugugucuguacacgugu

SEQ ID NO: 2367374 - RNA, 15 nt, Human
accuuguuacuucug

SEQ ID NO: 2367375 - RNA, 16 nt, Human
accuuguuacuucuga

SEQ ID NO: 2367376 - RNA, 12 nt, Human
accuugugucug

SEQ ID NO: 2367377 - RNA, 14 nt, Human
accuugugccuggc

SEQ ID NO: 2367378 - RNA, 20 nt, Human
accuuguggcaagccccugc

SEQ ID NO: 2367379 - RNA, 13 nt, Human
accuugugucugu

SEQ ID NO: 2367380 - RNA, 15 nt, Human
accuugugucuguac

SEQ ID NO: 2367381 - RNA, 14 nt, Human
accucuuagcugag

SEQ ID NO: 2367382 - RNA, 21 nt, Human
accucuuaaagaaaacccacc

SEQ ID NO: 2367383 - RNA, 22 nt, Human
accucuuaaagaaaacccaccc

SEQ ID NO: 2367384 - RNA, 15 nt, Human
accucuucagaggcc

SEQ ID NO: 2367385 - RNA, 20 nt, Human
accucuuaacaauuucuguc

SEQ ID NO: 2367386 - RNA, 15 nt, Human
accucuuagcugagu

SEQ ID NO: 2367387 - RNA, 14 nt, Human
accucuuccccaga

SEQ ID NO: 2367388 - RNA, 13 nt, Human
accucuuccccag

SEQ ID NO: 2367389 - RNA, 18 nt, Human
accucuucagaggcccuc

SEQ ID NO: 2367390 - RNA, 17 nt, Human
accucuucagaggcccu

SEQ ID NO: 2367391 - RNA, 21 nt, Human
accucugcacaagcugcaccc

SEQ ID NO: 2367392 - RNA, 20 nt, Human
accucuguuguccuccccuu

SEQ ID NO: 2367393 - RNA, 22 nt, Human
accucuguuguccuccccuugg

SEQ ID NO: 2367394 - RNA, 21 nt, Human
accucugcacuacugacaugu

SEQ ID NO: 2367395 - RNA, 18 nt, Human
accucugcacaagcugca

SEQ ID NO: 2367396 - RNA, 16 nt, Human
accucugcacaagcug

SEQ ID NO: 2367397 - RNA, 12 nt, Human
accugcccccuu

SEQ ID NO: 2367398 - RNA, 15 nt, Human
accugcccccuggug

SEQ ID NO: 2367399 - RNA, 18 nt, Human
accugcccccuucuccca

SEQ ID NO: 2367400 - RNA, 13 nt, Human
accugcccccugg

SEQ ID NO: 2367401 - RNA, 16 nt, Human
accugcccccaaucca

SEQ ID NO: 2367402 - RNA, 18 nt, Human
accugccccuccucucug

SEQ ID NO: 2367403 - RNA, 14 nt, Human
accugccccuccuc

SEQ ID NO: 2367404 - RNA, 23 nt, Human
accugccccucaacucuccucca

SEQ ID NO: 2367405 - RNA, 22 nt, Human
accugcccagaucccagaagga

SEQ ID NO: 2367406 - RNA, 15 nt, Human
accugcccaucacag

SEQ ID NO: 2367407 - RNA, 17 nt, Human
accugccccaacucucc

SEQ ID NO: 2367408 - RNA, 20 nt, Human
accugcccagaucccagaag

SEQ ID NO: 2367409 - RNA, 21 nt, Human
accucuucucuuccuguaaca

SEQ ID NO: 2367410 - RNA, 16 nt, Human
accucuucuggcucaa

SEQ ID NO: 2367411 - RNA, 21 nt, Human
accugcccaaccugcucuccu

SEQ ID NO: 2367412 - RNA, 13 nt, Human
accugcccaaccu

SEQ ID NO: 2367413 - RNA, 14 nt, Human
accucuucuggcuc

SEQ ID NO: 2367414 - RNA, 16 nt, Human
accucuucucuuccug

SEQ ID NO: 2367415 - RNA, 17 nt, Human
accucuucucuuccugu

SEQ ID NO: 2367416 - RNA, 23 nt, Human
accucuuccccagaaaggagacu

SEQ ID NO: 2367417 - RNA, 22 nt, Human
accucuuccccagaaaggagac

SEQ ID NO: 2367418 - RNA, 19 nt, Human
accucuuccggagauguag

SEQ ID NO: 2367419 - RNA, 15 nt, Human
accucuucacccccc

SEQ ID NO: 2367420 - RNA, 19 nt, Human
acgugauuuugcuguagaa

SEQ ID NO: 2367421 - RNA, 23 nt, Human
acgccacugcacuccagccuggg

SEQ ID NO: 2367422 - RNA, 22 nt, Human
acgugauucaauucaacacucc

SEQ ID NO: 2367423 - RNA, 18 nt, Human
acgcugugcugcccugcc

SEQ ID NO: 2367424 - RNA, 20 nt, Human
acgugcaccuguacucagga

SEQ ID NO: 2367425 - RNA, 21 nt, Human
acgugcaauuuguuugugcuu

SEQ ID NO: 2367426 - RNA, 22 nt, Human
acgugcaauuuguuugugcuuc

SEQ ID NO: 2367427 - RNA, 14 nt, Human
acgugcaauuuguu

SEQ ID NO: 2367428 - RNA, 19 nt, Human
acgugcaauuuguuugugc

SEQ ID NO: 2367429 - RNA, 20 nt, Human
acgugcaauuuguuugugcu

SEQ ID NO: 2367430 - RNA, 23 nt, Human
acgugcaccuguacucaggaggc

SEQ ID NO: 2367431 - RNA, 21 nt, Human
acgugcaccuguacucaggag

SEQ ID NO: 2367432 - RNA, 15 nt, Human
acgcugugcugcccu

SEQ ID NO: 2367433 - RNA, 16 nt, Human
acgcugugcugcccug

SEQ ID NO: 2367434 - RNA, 17 nt, Human
acgcugugcugcccugc

SEQ ID NO: 2367435 - RNA, 17 nt, Human
acuaagaugacauugcu

SEQ ID NO: 2367436 - RNA, 18 nt, Human
acuaagaugacauugcua

SEQ ID NO: 2367437 - RNA, 19 nt, Human
acuaagaugacauugcuaa

SEQ ID NO: 2367438 - RNA, 11 nt, Human
acguggcugcu

SEQ ID NO: 2367439 - RNA, 22 nt, Human
acgugcauugugcuucuuucuu

SEQ ID NO: 2367440 - RNA, 15 nt, Human
acuaagagagaauga

SEQ ID NO: 2367441 - RNA, 16 nt, Human
acuaagagagaaugag

SEQ ID NO: 2367442 - RNA, 13 nt, Human
acguggcugcuuc

SEQ ID NO: 2367443 - RNA, 12 nt, Human
acgugcauugug

SEQ ID NO: 2367444 - RNA, 14 nt, Human
acgugcauugugcu

SEQ ID NO: 2367445 - RNA, 15 nt, Human
acgugcauugugcuu

SEQ ID NO: 2367446 - RNA, 16 nt, Human
acgugcauugugcuuc

SEQ ID NO: 2367447 - RNA, 14 nt, Human
acguggcugcuuca

SEQ ID NO: 2367448 - RNA, 15 nt, Human
acguggcugcuucaa

SEQ ID NO: 2367449 - RNA, 22 nt, Human
acuaauaaaagcauaaaugcaa

SEQ ID NO: 2367450 - RNA, 12 nt, Human
acuaagcagagg

SEQ ID NO: 2367451 - RNA, 20 nt, Human
acuaagaugacauugcuaag

SEQ ID NO: 2367452 - RNA, 15 nt, Human
acuaagcagaggagg

SEQ ID NO: 2367453 - RNA, 14 nt, Human
acuaagcagaggag

SEQ ID NO: 2367454 - RNA, 13 nt, Human
acuaagcagagga

SEQ ID NO: 2367455 - RNA, 22 nt, Human
acuaaguuuuuauggcuuuugu

SEQ ID NO: 2367456 - RNA, 15 nt, Human
acuaaguuuuuaugg

SEQ ID NO: 2367457 - RNA, 14 nt, Human
acgaugaaaaacuu

SEQ ID NO: 2367458 - RNA, 15 nt, Human
acgauggcacccagu

SEQ ID NO: 2367459 - RNA, 14 nt, Human
acgauguggcccug

SEQ ID NO: 2367460 - RNA, 21 nt, Human
acgauguggaaaaaugagaga

SEQ ID NO: 2367461 - RNA, 13 nt, Human
acgaugucuucau

SEQ ID NO: 2367462 - RNA, 19 nt, Human
acgauguggcccuggccug

SEQ ID NO: 2367463 - RNA, 18 nt, Human
acgauguggcccuggccu

SEQ ID NO: 2367464 - RNA, 17 nt, Human
acgauguggcccuggcc

SEQ ID NO: 2367465 - RNA, 16 nt, Human
acgauguggcccuggc

SEQ ID NO: 2367466 - RNA, 22 nt, Human
acgauguggcccuggccugcug

SEQ ID NO: 2367467 - RNA, 18 nt, Human
acgauuuagaaagaagcc

SEQ ID NO: 2367468 - RNA, 14 nt, Human
acgauuuaauucuc

SEQ ID NO: 2367469 - RNA, 15 nt, Human
acgauuuaauucucu

SEQ ID NO: 2367470 - RNA, 17 nt, Human
acgauuuaauucucuug

SEQ ID NO: 2367471 - RNA, 19 nt, Human
acgauuuaauucucuugaa

SEQ ID NO: 2367472 - RNA, 13 nt, Human
acgauuucuguuu

SEQ ID NO: 2367473 - RNA, 12 nt, Human
acgauuucuguu

SEQ ID NO: 2367474 - RNA, 22 nt, Human
acgccacugcacuccagccugg

SEQ ID NO: 2367475 - RNA, 20 nt, Human
acgccacugcacuccagccu

SEQ ID NO: 2367476 - RNA, 18 nt, Human
acgccacugcacuauagc

SEQ ID NO: 2367477 - RNA, 17 nt, Human
acgauuucuguuuagau

SEQ ID NO: 2367478 - RNA, 14 nt, Human
acgauuucuguuua

SEQ ID NO: 2367479 - RNA, 14 nt, Human
aacaaaaauuaggu

SEQ ID NO: 2367480 - RNA, 15 nt, Human
aacaaaagcaagacu

SEQ ID NO: 2367481 - RNA, 16 nt, Human
aacaaaaagcuucccc

SEQ ID NO: 2367482 - RNA, 14 nt, Human
aacaaaaagcuucc

SEQ ID NO: 2367483 - RNA, 13 nt, Human
aacaaaaauuagg

SEQ ID NO: 2367484 - RNA, 11 nt, Human
aacaaaaauaa

SEQ ID NO: 2367485 - RNA, 13 nt, Human
aacaaaaauuguc

SEQ ID NO: 2367486 - RNA, 13 nt, Human
aacaaaaagaaca

SEQ ID NO: 2367487 - RNA, 12 nt, Human
aacaaaauagaa

SEQ ID NO: 2367488 - RNA, 20 nt, Human
aacaaaaucuccucuuuuag

SEQ ID NO: 2367489 - RNA, 15 nt, Human
aacaaagaaauuaug

SEQ ID NO: 2367490 - RNA, 17 nt, Human
aacaaagaaauuaugug

SEQ ID NO: 2367491 - RNA, 12 nt, Human
aaauugcacaau

SEQ ID NO: 2367492 - RNA, 13 nt, Human
aaauugcaaaucu

SEQ ID NO: 2367493 - RNA, 19 nt, Human
aaauugcaaaucuugaaau

SEQ ID NO: 2367494 - RNA, 14 nt, Human
aaauugcaaaucuu

SEQ ID NO: 2367495 - RNA, 21 nt, Human
aaauugauguguuuauuuaua

SEQ ID NO: 2367496 - RNA, 18 nt, Human
aaauugcauuuccugaca

SEQ ID NO: 2367497 - RNA, 14 nt, Human
aaauugccauauug

SEQ ID NO: 2367498 - RNA, 22 nt, Human
aaauugcugugccucccaaaau

SEQ ID NO: 2367499 - RNA, 13 nt, Human
aaauugcuugaaa

SEQ ID NO: 2367500 - RNA, 18 nt, Human
aaauugcuuacuuuggaa

SEQ ID NO: 2367501 - RNA, 14 nt, Human
aaauugcuguguau

SEQ ID NO: 2367502 - RNA, 16 nt, Human
aaauugcuugaaagaa

SEQ ID NO: 2367503 - RNA, 20 nt, Human
aaauugggaaaggaguagaa

SEQ ID NO: 2367504 - RNA, 15 nt, Human
aaauugggaaaggag

SEQ ID NO: 2367505 - RNA, 16 nt, Human
aaauuggaacagaaug

SEQ ID NO: 2367506 - RNA, 19 nt, Human
aaauuggaacagaauguuu

SEQ ID NO: 2367507 - RNA, 17 nt, Human
aacaccaagcacagcag

SEQ ID NO: 2367508 - RNA, 14 nt, Human
aacaccaagcacag

SEQ ID NO: 2367509 - RNA, 21 nt, Human
aacaccaagcacagcagccug

SEQ ID NO: 2367510 - RNA, 19 nt, Human
aacaccaagcacagcagcc

SEQ ID NO: 2367511 - RNA, 18 nt, Human
aacaccaagcacagcagc

SEQ ID NO: 2367512 - RNA, 13 nt, Human
aacaccugaugug

SEQ ID NO: 2367513 - RNA, 15 nt, Human
aacaccugaugugua

SEQ ID NO: 2367514 - RNA, 17 nt, Human
aacaccuuccagcuccu

SEQ ID NO: 2367515 - RNA, 17 nt, Human
aacaccugauguguaca

SEQ ID NO: 2367516 - RNA, 19 nt, Human
aacaccugggcuuaagaaa

SEQ ID NO: 2367517 - RNA, 15 nt, Human
aacacgagcaggcua

SEQ ID NO: 2367518 - RNA, 23 nt, Human
aacacauuuuguauaauuguauc

SEQ ID NO: 2367519 - RNA, 16 nt, Human
aacacauuuuguauaa

SEQ ID NO: 2367520 - RNA, 19 nt, Human
aacacauuuuguauaauug

SEQ ID NO: 2367521 - RNA, 21 nt, Human
aacacauuuuguauaauugua

SEQ ID NO: 2367522 - RNA, 22 nt, Human
aacacauuuuguauaauuguau

SEQ ID NO: 2367523 - RNA, 19 nt, Human
aacacauuuuucuuaggga

SEQ ID NO: 2367524 - RNA, 21 nt, Human
aacaagaagccacagaccuag

SEQ ID NO: 2367525 - RNA, 22 nt, Human
aacaagaccaccacuucgaaac

SEQ ID NO: 2367526 - RNA, 12 nt, Human
aacaagaauugg

SEQ ID NO: 2367527 - RNA, 14 nt, Human
aacacauuuuguau

SEQ ID NO: 2367528 - RNA, 15 nt, Human
aacacauuuuguaua

SEQ ID NO: 2367529 - RNA, 11 nt, Human
aacaaagccag

SEQ ID NO: 2367530 - RNA, 15 nt, Human
aacaaagcagccacg

SEQ ID NO: 2367531 - RNA, 14 nt, Human
aacaaagcagccac

SEQ ID NO: 2367532 - RNA, 16 nt, Human
aacaaagcacaguguu

SEQ ID NO: 2367533 - RNA, 17 nt, Human
aacaaagcacaguguua

SEQ ID NO: 2367534 - RNA, 17 nt, Human
aacaaagccagaagcug

SEQ ID NO: 2367535 - RNA, 14 nt, Human
aacaaagccagaag

SEQ ID NO: 2367536 - RNA, 15 nt, Human
aacaaagcuguugau

SEQ ID NO: 2367537 - RNA, 12 nt, Human
aacaaagccaga

SEQ ID NO: 2367538 - RNA, 17 nt, Human
aacaaagaagacaacau

SEQ ID NO: 2367539 - RNA, 13 nt, Human
aacaaagaagguu

SEQ ID NO: 2367540 - RNA, 15 nt, Human
aacaaagcacagugu

SEQ ID NO: 2367541 - RNA, 19 nt, Human
aacaaagagaaaaaauaca

SEQ ID NO: 2367542 - RNA, 16 nt, Human
aacaacuaggcuucag

SEQ ID NO: 2367543 - RNA, 17 nt, Human
aacaaagcuuagcagga

SEQ ID NO: 2367544 - RNA, 22 nt, Human
aacaaaauuuaguuuuuguucu

SEQ ID NO: 2367545 - RNA, 19 nt, Human
aacaaagcuuagcaggaga

SEQ ID NO: 2367546 - RNA, 14 nt, Human
aacaaagcuuagca

SEQ ID NO: 2367547 - RNA, 16 nt, Human
aacaaagcuuagcagg

SEQ ID NO: 2367548 - RNA, 17 nt, Human
aacaacuucuuuguaau

SEQ ID NO: 2367549 - RNA, 16 nt, Human
aacaacuucuuuguaa

SEQ ID NO: 2367550 - RNA, 15 nt, Human
aacaacucuuugaga

SEQ ID NO: 2367551 - RNA, 21 nt, Human
aacaacuccuagggccacuga

SEQ ID NO: 2367552 - RNA, 22 nt, Human
aacaacuuaauguucugaauaa

SEQ ID NO: 2367553 - RNA, 14 nt, Human
aacacgcaccugcc

SEQ ID NO: 2367554 - RNA, 13 nt, Human
aacaccuucucug

SEQ ID NO: 2367555 - RNA, 19 nt, Human
aacacgcaccugccucagg

SEQ ID NO: 2367556 - RNA, 15 nt, Human
aacacgcaccugccu

SEQ ID NO: 2367557 - RNA, 19 nt, Human
aacccugccccugccccgu

SEQ ID NO: 2367558 - RNA, 16 nt, Human
aacccugcguggggac

SEQ ID NO: 2367559 - RNA, 17 nt, Human
aacccugcguggggaca

SEQ ID NO: 2367560 - RNA, 19 nt, Human
aacccugcguggggacagg

SEQ ID NO: 2367561 - RNA, 12 nt, Human
aacccuggagag

SEQ ID NO: 2367562 - RNA, 14 nt, Human
aacccuggugacca

SEQ ID NO: 2367563 - RNA, 22 nt, Human
aaccaggagcugcucacuaccu

SEQ ID NO: 2367564 - RNA, 13 nt, Human
aacccuguuuccu

SEQ ID NO: 2367565 - RNA, 19 nt, Human
aacccugugcugguguccu

SEQ ID NO: 2367566 - RNA, 21 nt, Human
aacccugugcugguguccuga

SEQ ID NO: 2367567 - RNA, 14 nt, Human
aacccugugcuggu

SEQ ID NO: 2367568 - RNA, 12 nt, Human
aacccugugcug

SEQ ID NO: 2367569 - RNA, 21 nt, Human
aaccacgucugucuucacagc

SEQ ID NO: 2367570 - RNA, 19 nt, Human
aaccacucaaauuaaucuu

SEQ ID NO: 2367571 - RNA, 17 nt, Human
aaccacugaaucuggac

SEQ ID NO: 2367572 - RNA, 14 nt, Human
aaccacugcaacgg

SEQ ID NO: 2367573 - RNA, 13 nt, Human
aaccacugaaucu

SEQ ID NO: 2367574 - RNA, 11 nt, Human
aaccacugaau

SEQ ID NO: 2367575 - RNA, 14 nt, Human
aaccagaucauugu

SEQ ID NO: 2367576 - RNA, 12 nt, Human
aaccagaucauu

SEQ ID NO: 2367577 - RNA, 21 nt, Human
aacauguaauuaaguacuaug

SEQ ID NO: 2367578 - RNA, 14 nt, Human
aacauguaauuaag

SEQ ID NO: 2367579 - RNA, 23 nt, Human
aacauguaauuaaguacuaugua

SEQ ID NO: 2367580 - RNA, 22 nt, Human
aaccacucuaucaaguauuaua

SEQ ID NO: 2367581 - RNA, 14 nt, Human
aaccagcuaagaaa

SEQ ID NO: 2367582 - RNA, 21 nt, Human
aaccagcaucccuugaccagg

SEQ ID NO: 2367583 - RNA, 21 nt, Human
aaccagcuaagaaaagauuuu

SEQ ID NO: 2367584 - RNA, 16 nt, Human
aaccagcuaagaaaag

SEQ ID NO: 2367585 - RNA, 22 nt, Human
aaccagcuguaacacagcugag

SEQ ID NO: 2367586 - RNA, 15 nt, Human
aaccaggaaauggaa

SEQ ID NO: 2367587 - RNA, 15 nt, Human
aaccaggagcugcuc

SEQ ID NO: 2367588 - RNA, 14 nt, Human
aaccaguguagccu

SEQ ID NO: 2367589 - RNA, 11 nt, Human
aacccugcccc

SEQ ID NO: 2367590 - RNA, 14 nt, Human
aacccugccccugc

SEQ ID NO: 2367591 - RNA, 12 nt, Human
aacccugccccu

SEQ ID NO: 2367592 - RNA, 17 nt, Human
aacccugcccccaaaua

SEQ ID NO: 2367593 - RNA, 22 nt, Human
aaccaguccccccacccucauu

SEQ ID NO: 2367594 - RNA, 18 nt, Human
aaccaguccccccacccu

SEQ ID NO: 2367595 - RNA, 17 nt, Human
aaccaggagcugcucac

SEQ ID NO: 2367596 - RNA, 18 nt, Human
aaccaggagcugcucacu

SEQ ID NO: 2367597 - RNA, 17 nt, Human
aacaucacugaaaugcu

SEQ ID NO: 2367598 - RNA, 19 nt, Human
aacaucaauguucauugua

SEQ ID NO: 2367599 - RNA, 18 nt, Human
aacaucaauguucauugu

SEQ ID NO: 2367600 - RNA, 13 nt, Human
aacaucacacaca

SEQ ID NO: 2367601 - RNA, 21 nt, Human
aacaucaguuacucugaaggg

SEQ ID NO: 2367602 - RNA, 19 nt, Human
aacaucaguuacucugaag

SEQ ID NO: 2367603 - RNA, 18 nt, Human
aacaucaguuacucugaa

SEQ ID NO: 2367604 - RNA, 14 nt, Human
aacaucaucaaggc

SEQ ID NO: 2367605 - RNA, 16 nt, Human
aacaucaucaaggcac

SEQ ID NO: 2367606 - RNA, 21 nt, Human
aacaucaucaaggcacugccu

SEQ ID NO: 2367607 - RNA, 14 nt, Human
aacaucauuagaac

SEQ ID NO: 2367608 - RNA, 22 nt, Human
aacaucaucaaggcacugccug

SEQ ID NO: 2367609 - RNA, 13 nt, Human
aacaugauuuggg

SEQ ID NO: 2367610 - RNA, 21 nt, Human
aacaugccugccccaaacaaa

SEQ ID NO: 2367611 - RNA, 22 nt, Human
aacaugccugccccaaacaaau

SEQ ID NO: 2367612 - RNA, 14 nt, Human
aacaugcccuguuc

SEQ ID NO: 2367613 - RNA, 20 nt, Human
aacaugguuuugaaaugcuu

SEQ ID NO: 2367614 - RNA, 12 nt, Human
aacauguaauau

SEQ ID NO: 2367615 - RNA, 18 nt, Human
aacauguaauauaaagau

SEQ ID NO: 2367616 - RNA, 19 nt, Human
aacauguaauauaaagaug

SEQ ID NO: 2367617 - RNA, 22 nt, Human
aacauguaauauaaagauguua

SEQ ID NO: 2367618 - RNA, 22 nt, Human
aacaugcaauuuugcauuugaa

SEQ ID NO: 2367619 - RNA, 19 nt, Human
aacaugcaauuuugcauuu

SEQ ID NO: 2367620 - RNA, 17 nt, Human
aacaugagucaagagca

SEQ ID NO: 2367621 - RNA, 15 nt, Human
aacaucauuagaaca

SEQ ID NO: 2367622 - RNA, 18 nt, Human
aacagcucaguucuaguc

SEQ ID NO: 2367623 - RNA, 14 nt, Human
aacagcucaggauc

SEQ ID NO: 2367624 - RNA, 10 nt, Human
aacagcuccu

SEQ ID NO: 2367625 - RNA, 13 nt, Human
aacagcuccuugg

SEQ ID NO: 2367626 - RNA, 14 nt, Human
aacaucaauguuca

SEQ ID NO: 2367627 - RNA, 13 nt, Human
aacaucaauguuc

SEQ ID NO: 2367628 - RNA, 12 nt, Human
aacaucaauguu

SEQ ID NO: 2367629 - RNA, 20 nt, Human
aacagcugaggucucuugag

SEQ ID NO: 2367630 - RNA, 21 nt, Human
aacagcugaggucucuugagg

SEQ ID NO: 2367631 - RNA, 19 nt, Human
aacagcugaggucucuuga

SEQ ID NO: 2367632 - RNA, 23 nt, Human
aacagcuccuugggaggaagcag

SEQ ID NO: 2367633 - RNA, 13 nt, Human
aacagcucgacuu

SEQ ID NO: 2367634 - RNA, 14 nt, Human
aacagcuccuuggg

SEQ ID NO: 2367635 - RNA, 15 nt, Human
aacagcuccuuggga

SEQ ID NO: 2367636 - RNA, 18 nt, Human
aacagcuccuugggagga

SEQ ID NO: 2367637 - RNA, 22 nt, Human
aacagcuccuugggaggaagca

SEQ ID NO: 2367638 - RNA, 14 nt, Human
aacucaauauuuuc

SEQ ID NO: 2367639 - RNA, 20 nt, Human
aacucaauauuuuccaugaa

SEQ ID NO: 2367640 - RNA, 21 nt, Human
aacucaauauuuuccaugaaa

SEQ ID NO: 2367641 - RNA, 12 nt, Human
aacucaccccag

SEQ ID NO: 2367642 - RNA, 12 nt, Human
aacucaauauuu

SEQ ID NO: 2367643 - RNA, 13 nt, Human
aacucaauauuuu

SEQ ID NO: 2367644 - RNA, 22 nt, Human
aacucaccugcuggccccucac

SEQ ID NO: 2367645 - RNA, 16 nt, Human
aacucaccugcuggcc

SEQ ID NO: 2367646 - RNA, 12 nt, Human
aacucaccugcu

SEQ ID NO: 2367647 - RNA, 17 nt, Human
aacucaccucucaaggu

SEQ ID NO: 2367648 - RNA, 21 nt, Human
aacucaccuaauguuuaugag

SEQ ID NO: 2367649 - RNA, 16 nt, Human
aacucaccugccccuc

SEQ ID NO: 2367650 - RNA, 21 nt, Human
aacucaccauguaaaagaguc

SEQ ID NO: 2367651 - RNA, 16 nt, Human
aacucaccauguaaaa

SEQ ID NO: 2367652 - RNA, 15 nt, Human
aacucaccauguaaa

SEQ ID NO: 2367653 - RNA, 15 nt, Human
aacucaccccagccc

SEQ ID NO: 2367654 - RNA, 15 nt, Human
aacucaccugccccu

SEQ ID NO: 2367655 - RNA, 20 nt, Human
aacugaagcagccucucccc

SEQ ID NO: 2367656 - RNA, 16 nt, Human
aacucauacugugcug

SEQ ID NO: 2367657 - RNA, 18 nt, Human
aacugaagcagccucucc

SEQ ID NO: 2367658 - RNA, 23 nt, Human
aacugaacucugacaacagacuu

SEQ ID NO: 2367659 - RNA, 16 nt, Human
aacugaacucugacaa

SEQ ID NO: 2367660 - RNA, 18 nt, Human
aacucauaccuuuaaagg

SEQ ID NO: 2367661 - RNA, 22 nt, Human
aacucauacugugcuggagcca

SEQ ID NO: 2367662 - RNA, 14 nt, Human
aacugaacucugac

SEQ ID NO: 2367663 - RNA, 20 nt, Human
aacugaacucugacaacaga

SEQ ID NO: 2367664 - RNA, 19 nt, Human
aacugaacucugacaacag

SEQ ID NO: 2367665 - RNA, 21 nt, Human
aacucaccugcuggccccuca

SEQ ID NO: 2367666 - RNA, 20 nt, Human
aacucaccugcuggccccuc

SEQ ID NO: 2367667 - RNA, 20 nt, Human
aacucaccuggggcugcugg

SEQ ID NO: 2367668 - RNA, 17 nt, Human
aacucagaucugucuga

SEQ ID NO: 2367669 - RNA, 15 nt, Human
aacucaccuggggcu

SEQ ID NO: 2367670 - RNA, 12 nt, Human
aacucagccaag

SEQ ID NO: 2367671 - RNA, 14 nt, Human
aacucagccaagca

SEQ ID NO: 2367672 - RNA, 15 nt, Human
aacucagccaagcac

SEQ ID NO: 2367673 - RNA, 16 nt, Human
aacucagccaagcaca

SEQ ID NO: 2367674 - RNA, 17 nt, Human
aacucagccaagcacag

SEQ ID NO: 2367675 - RNA, 18 nt, Human
aacucagccaagcacagu

SEQ ID NO: 2367676 - RNA, 20 nt, Human
aacucagccaagcacagugg

SEQ ID NO: 2367677 - RNA, 22 nt, Human
aacucagccucaauaagccuug

SEQ ID NO: 2367678 - RNA, 21 nt, Human
aacucagccaagcacaguggu

SEQ ID NO: 2367679 - RNA, 13 nt, Human
aacucagggacag

SEQ ID NO: 2367680 - RNA, 16 nt, Human
aacucagggacagagc

SEQ ID NO: 2367681 - RNA, 17 nt, Human
aacucagggacagagcc

SEQ ID NO: 2367682 - RNA, 15 nt, Human
aacucaguuuuaacu

SEQ ID NO: 2367683 - RNA, 18 nt, Human
aacucaguuuuaacuaga

SEQ ID NO: 2367684 - RNA, 18 nt, Human
aacucagggacagagcca

SEQ ID NO: 2367685 - RNA, 22 nt, Human
aacucagucauuagacuccucc

SEQ ID NO: 2367686 - RNA, 23 nt, Human
aacucagucauuagacuccuccu

SEQ ID NO: 2367687 - RNA, 13 nt, Human
aacuuauucugua

SEQ ID NO: 2367688 - RNA, 14 nt, Human
aacuuauucuguag

SEQ ID NO: 2367689 - RNA, 19 nt, Human
aacuuauccuaaaacaaau

SEQ ID NO: 2367690 - RNA, 21 nt, Human
aacuuaugaccucuuccuuua

SEQ ID NO: 2367691 - RNA, 22 nt, Human
aacuuagugcggacaaguuuua

SEQ ID NO: 2367692 - RNA, 20 nt, Human
aacuuauauacuauuucccu

SEQ ID NO: 2367693 - RNA, 23 nt, Human
aacuuauaucaucagcauaccuu

SEQ ID NO: 2367694 - RNA, 21 nt, Human
aacuuauauuguaagaaauac

SEQ ID NO: 2367695 - RNA, 20 nt, Human
aacuuauauuguaagaaaua

SEQ ID NO: 2367696 - RNA, 19 nt, Human
aacuuauauuguaagaaau

SEQ ID NO: 2367697 - RNA, 15 nt, Human
aacuuauauuguaag

SEQ ID NO: 2367698 - RNA, 19 nt, Human
aacuuaaauaaaugucauu

SEQ ID NO: 2367699 - RNA, 15 nt, Human
aacuuaaauaaaugu

SEQ ID NO: 2367700 - RNA, 16 nt, Human
aacuuaaaauauuuua

SEQ ID NO: 2367701 - RNA, 14 nt, Human
aacuuaaaauauuu

SEQ ID NO: 2367702 - RNA, 13 nt, Human
aacuuaaaauauu

SEQ ID NO: 2367703 - RNA, 18 nt, Human
aacuuaaaaauguaaaua

SEQ ID NO: 2367704 - RNA, 21 nt, Human
aacuuaaaaauguaaauauuc

SEQ ID NO: 2367705 - RNA, 17 nt, Human
aacuuaaauaaugugaa

SEQ ID NO: 2367706 - RNA, 23 nt, Human
aacuuagugcggacaaguuuuaa

SEQ ID NO: 2367707 - RNA, 16 nt, Human
aacuuagguggcaagc

SEQ ID NO: 2367708 - RNA, 19 nt, Human
aacuuagcauguguugaaa

SEQ ID NO: 2367709 - RNA, 14 nt, Human
aacuuaaauaauaa

SEQ ID NO: 2367710 - RNA, 13 nt, Human
aacuuaaauaaua

SEQ ID NO: 2367711 - RNA, 19 nt, Human
aacuuaaauaaugugaaac

SEQ ID NO: 2367712 - RNA, 14 nt, Human
aacugaccagccuc

SEQ ID NO: 2367713 - RNA, 19 nt, Human
aacugaccagccuccaugc

SEQ ID NO: 2367714 - RNA, 21 nt, Human
aacugacaggcagccuggaca

SEQ ID NO: 2367715 - RNA, 13 nt, Human
aacugauucauaa

SEQ ID NO: 2367716 - RNA, 17 nt, Human
aacugauuuuuuuuucc

SEQ ID NO: 2367717 - RNA, 13 nt, Human
aacuuaaaaaugu

SEQ ID NO: 2367718 - RNA, 17 nt, Human
aacuuaaaaauguaaau

SEQ ID NO: 2367719 - RNA, 19 nt, Human
aacugauuuuuuuuuccuu

SEQ ID NO: 2367720 - RNA, 22 nt, Human
aacuucaagugcaugcucucug

SEQ ID NO: 2367721 - RNA, 13 nt, Human
aacuucacauauu

SEQ ID NO: 2367722 - RNA, 23 nt, Human
aacuuauucuguagauucugugg

SEQ ID NO: 2367723 - RNA, 19 nt, Human
aacuuauuugagugauuau

SEQ ID NO: 2367724 - RNA, 13 nt, Human
aacuuauuugagu

SEQ ID NO: 2367725 - RNA, 16 nt, Human
aacuuauuuuuuucug

SEQ ID NO: 2367726 - RNA, 17 nt, Human
aacuuauuuuuuucuga

SEQ ID NO: 2367727 - RNA, 18 nt, Human
aacuuauuuuuuucugau

SEQ ID NO: 2367728 - RNA, 19 nt, Human
aacuuauuuuuuucugauu

SEQ ID NO: 2367729 - RNA, 20 nt, Human
aacuuauuuuuuucugauug

SEQ ID NO: 2367730 - RNA, 21 nt, Human
aacuuauuuuuuucugauugu

SEQ ID NO: 2367731 - RNA, 22 nt, Human
aacuuauuuuuuucugauugua

SEQ ID NO: 2367732 - RNA, 14 nt, Human
aacuucaacauuua

SEQ ID NO: 2367733 - RNA, 19 nt, Human
aacuucaacauuuacaugu

SEQ ID NO: 2367734 - RNA, 20 nt, Human
aacuuuuuuuuaaguuacac

SEQ ID NO: 2367735 - RNA, 19 nt, Human
aacuuuuuugaaauaauaa

SEQ ID NO: 2367736 - RNA, 16 nt, Human
aacuuuuuuuugagaa

SEQ ID NO: 2367737 - RNA, 17 nt, Human
aacuuuuuuuugagaau

SEQ ID NO: 2367738 - RNA, 14 nt, Human
aacuuuuuuuuaag

SEQ ID NO: 2367739 - RNA, 13 nt, Human
aacuuuuuuccac

SEQ ID NO: 2367740 - RNA, 22 nt, Human
aacuuuuugguuugcagaugac

SEQ ID NO: 2367741 - RNA, 14 nt, Human
aagaaaugacacuu

SEQ ID NO: 2367742 - RNA, 14 nt, Human
aagaaauguaaggg

SEQ ID NO: 2367743 - RNA, 13 nt, Human
aagaaauguaagg

SEQ ID NO: 2367744 - RNA, 14 nt, Human
aacuuuuguaaaua

SEQ ID NO: 2367745 - RNA, 21 nt, Human
aacuuuuguaagacaaagguu

SEQ ID NO: 2367746 - RNA, 11 nt, Human
aacuuuuguaa

SEQ ID NO: 2367747 - RNA, 15 nt, Human
aacuuuuuaaagagu

SEQ ID NO: 2367748 - RNA, 15 nt, Human
aacuuuuccccuguc

SEQ ID NO: 2367749 - RNA, 18 nt, Human
aacuuuuccccuguccug

SEQ ID NO: 2367750 - RNA, 12 nt, Human
aacuuuucucag

SEQ ID NO: 2367751 - RNA, 19 nt, Human
aacuuuuauaaacuuuacc

SEQ ID NO: 2367752 - RNA, 16 nt, Human
aacuuuuauaaacuuu

SEQ ID NO: 2367753 - RNA, 17 nt, Human
aacuuugaccucugcag

SEQ ID NO: 2367754 - RNA, 14 nt, Human
aacuuugaccucug

SEQ ID NO: 2367755 - RNA, 11 nt, Human
aacuuucugua

SEQ ID NO: 2367756 - RNA, 15 nt, Human
aacuuucuguaaacu

SEQ ID NO: 2367757 - RNA, 13 nt, Human
aacuuugaccucu

SEQ ID NO: 2367758 - RNA, 15 nt, Human
aacuuugcugagccu

SEQ ID NO: 2367759 - RNA, 12 nt, Human
aacuuugcuugc

SEQ ID NO: 2367760 - RNA, 21 nt, Human
aacuuugcuugcaguagauuu

SEQ ID NO: 2367761 - RNA, 20 nt, Human
aacuuugaccucugcagcaa

SEQ ID NO: 2367762 - RNA, 19 nt, Human
aacuuugaccucugcagca

SEQ ID NO: 2367763 - RNA, 19 nt, Human
aacuuuguggaugucuucc

SEQ ID NO: 2367764 - RNA, 20 nt, Human
aacuuuguggaugucuuccu

SEQ ID NO: 2367765 - RNA, 22 nt, Human
aacuuuuaauuaaaugcucauc

SEQ ID NO: 2367766 - RNA, 18 nt, Human
aacuuuggaguccccuca

SEQ ID NO: 2367767 - RNA, 15 nt, Human
aacuuuuauaaacuu

SEQ ID NO: 2367768 - RNA, 12 nt, Human
aacuuuuauaaa

SEQ ID NO: 2367769 - RNA, 12 nt, Human
aaagauauauua

SEQ ID NO: 2367770 - RNA, 17 nt, Human
aaagauauauacacagg

SEQ ID NO: 2367771 - RNA, 19 nt, Human
aaagauauauuaaaaauau

SEQ ID NO: 2367772 - RNA, 20 nt, Human
aaagauaucucaucucuucu

SEQ ID NO: 2367773 - RNA, 20 nt, Human
aaagauauauuaaaaauaua

SEQ ID NO: 2367774 - RNA, 21 nt, Human
aaagauauauuaaaaauauaa

SEQ ID NO: 2367775 - RNA, 18 nt, Human
aaagauauaagugcugua

SEQ ID NO: 2367776 - RNA, 20 nt, Human
aaagauauaagugcuguaua

SEQ ID NO: 2367777 - RNA, 21 nt, Human
aaagauauaagugcuguauaa

SEQ ID NO: 2367778 - RNA, 22 nt, Human
aaagauauaagugcuguauaaa

SEQ ID NO: 2367779 - RNA, 22 nt, Human
aaagauacgacuuuauuuucug

SEQ ID NO: 2367780 - RNA, 15 nt, Human
aaagauauaagugcu

SEQ ID NO: 2367781 - RNA, 16 nt, Human
aaagauauaagugcug

SEQ ID NO: 2367782 - RNA, 17 nt, Human
aaagauauaagugcugu

SEQ ID NO: 2367783 - RNA, 20 nt, Human
aaagauacgacuuuauuuuc

SEQ ID NO: 2367784 - RNA, 16 nt, Human
aaagauacgacuuuau

SEQ ID NO: 2367785 - RNA, 23 nt, Human
aaagaguagacauuucucuuacu

SEQ ID NO: 2367786 - RNA, 18 nt, Human
aaagaguagaauugcauu

SEQ ID NO: 2367787 - RNA, 13 nt, Human
aaagaguagaauu

SEQ ID NO: 2367788 - RNA, 17 nt, Human
aaagaguacucuuguuu

SEQ ID NO: 2367789 - RNA, 12 nt, Human
aaagaguacucu

SEQ ID NO: 2367790 - RNA, 19 nt, Human
aaagagguuuuucuuaaau

SEQ ID NO: 2367791 - RNA, 22 nt, Human
aaagaacauggacuuguauauu

SEQ ID NO: 2367792 - RNA, 19 nt, Human
aaagaguaaaggaaaugau

SEQ ID NO: 2367793 - RNA, 16 nt, Human
aaagagguuuuucuua

SEQ ID NO: 2367794 - RNA, 20 nt, Human
aaagaacauggacuuguaua

SEQ ID NO: 2367795 - RNA, 21 nt, Human
aaagaacauggacuuguauau

SEQ ID NO: 2367796 - RNA, 18 nt, Human
aaagaaagccucagagaa

SEQ ID NO: 2367797 - RNA, 17 nt, Human
aaagaaagccucagaga

SEQ ID NO: 2367798 - RNA, 12 nt, Human
aaacugacuuua

SEQ ID NO: 2367799 - RNA, 18 nt, Human
aaagaaagagagaaaaua

SEQ ID NO: 2367800 - RNA, 17 nt, Human
aaagaaagagagaaaau

SEQ ID NO: 2367801 - RNA, 23 nt, Human
aaagaaaguugcacggcugcuga

SEQ ID NO: 2367802 - RNA, 13 nt, Human
aaagaaauuaugu

SEQ ID NO: 2367803 - RNA, 19 nt, Human
aaagaaaugucuauuaagg

SEQ ID NO: 2367804 - RNA, 15 nt, Human
aaagaaauuaugugc

SEQ ID NO: 2367805 - RNA, 11 nt, Human
aaagagguuuu

SEQ ID NO: 2367806 - RNA, 18 nt, Human
aaagaacauggacuugua

SEQ ID NO: 2367807 - RNA, 16 nt, Human
aaagaacaaaaaaauc

SEQ ID NO: 2367808 - RNA, 15 nt, Human
aaagaacaguaaaca

SEQ ID NO: 2367809 - RNA, 11 nt, Human
aaagaacaucc

SEQ ID NO: 2367810 - RNA, 14 nt, Human
aaacugaauggaag

SEQ ID NO: 2367811 - RNA, 16 nt, Human
aaacugaaugaaaccc

SEQ ID NO: 2367812 - RNA, 14 nt, Human
aaacugcauuagaa

SEQ ID NO: 2367813 - RNA, 19 nt, Human
aaacugaagucugaaauuu

SEQ ID NO: 2367814 - RNA, 17 nt, Human
aaacugacucuuaagaa

SEQ ID NO: 2367815 - RNA, 15 nt, Human
aaacugccagcaacg

SEQ ID NO: 2367816 - RNA, 14 nt, Human
aaacugccagcaac

SEQ ID NO: 2367817 - RNA, 14 nt, Human
aaacugaagccaga

SEQ ID NO: 2367818 - RNA, 15 nt, Human
aaacugaagucugaa

SEQ ID NO: 2367819 - RNA, 16 nt, Human
aaacugaagucugaaa

SEQ ID NO: 2367820 - RNA, 17 nt, Human
aaacugaagucugaaau

SEQ ID NO: 2367821 - RNA, 16 nt, Human
aaacugacucuuaaga

SEQ ID NO: 2367822 - RNA, 17 nt, Human
aaacugcauuagaaauu

SEQ ID NO: 2367823 - RNA, 20 nt, Human
aaacugccaguuuuguuucc

SEQ ID NO: 2367824 - RNA, 19 nt, Human
aaacugccagcaacgcagg

SEQ ID NO: 2367825 - RNA, 12 nt, Human
aaagaaaacuug

SEQ ID NO: 2367826 - RNA, 20 nt, Human
aaagaaaacuuguauuaugu

SEQ ID NO: 2367827 - RNA, 14 nt, Human
aaagaaagaaggaa

SEQ ID NO: 2367828 - RNA, 12 nt, Human
aaagaaagagag

SEQ ID NO: 2367829 - RNA, 21 nt, Human
aaagaaaauaaaaaaaagaaa

SEQ ID NO: 2367830 - RNA, 16 nt, Human
aaagaaagagagaaaa

SEQ ID NO: 2367831 - RNA, 15 nt, Human
aaagaaagagagaaa

SEQ ID NO: 2367832 - RNA, 14 nt, Human
aaagaaagagagaa

SEQ ID NO: 2367833 - RNA, 13 nt, Human
aaagaaagagaga

SEQ ID NO: 2367834 - RNA, 12 nt, Human
aaagaaaauaaa

SEQ ID NO: 2367835 - RNA, 14 nt, Human
aaagaaaagauaaa

SEQ ID NO: 2367836 - RNA, 23 nt, Human
aaagaaaagauaaagaugaucua

SEQ ID NO: 2367837 - RNA, 16 nt, Human
aaagaaaacccacccc

SEQ ID NO: 2367838 - RNA, 21 nt, Human
aaagaucuguuuugaaggcaa

SEQ ID NO: 2367839 - RNA, 23 nt, Human
aaagauauauuaaaaauauaaaa

SEQ ID NO: 2367840 - RNA, 17 nt, Human
aaagaugaaaauauuug

SEQ ID NO: 2367841 - RNA, 16 nt, Human
aaagaugaaaauauuu

SEQ ID NO: 2367842 - RNA, 13 nt, Human
aaagaugaaaaua

SEQ ID NO: 2367843 - RNA, 20 nt, Human
aaacagacucgauucauauu

SEQ ID NO: 2367844 - RNA, 14 nt, Human
aaacagacucaggu

SEQ ID NO: 2367845 - RNA, 16 nt, Human
aaacagagacaggccc

SEQ ID NO: 2367846 - RNA, 15 nt, Human
aaacagagacaggcc

SEQ ID NO: 2367847 - RNA, 23 nt, Human
aaacacugccaucuuaguuugga

SEQ ID NO: 2367848 - RNA, 19 nt, Human
aaacacuguucucugcccu

SEQ ID NO: 2367849 - RNA, 22 nt, Human
aaacacuguucucugcccucca

SEQ ID NO: 2367850 - RNA, 14 nt, Human
aaacagauuuuuac

SEQ ID NO: 2367851 - RNA, 19 nt, Human
aaacagauuuuuacaaaug

SEQ ID NO: 2367852 - RNA, 15 nt, Human
aaacagauuuuuaca

SEQ ID NO: 2367853 - RNA, 16 nt, Human
aaacagagaugugaua

SEQ ID NO: 2367854 - RNA, 22 nt, Human
aaacagagacaggcccaagaga

SEQ ID NO: 2367855 - RNA, 20 nt, Human
aaacagaggccauggcagaa

SEQ ID NO: 2367856 - RNA, 15 nt, Human
aaacagauauaaaug

SEQ ID NO: 2367857 - RNA, 12 nt, Human
aaacagauauaa

SEQ ID NO: 2367858 - RNA, 20 nt, Human
aaacagaucuccuggcaaag

SEQ ID NO: 2367859 - RNA, 23 nt, Human
aaaacacagacauucugccaggc

SEQ ID NO: 2367860 - RNA, 21 nt, Human
aaaacacaguguuuuuguaaa

SEQ ID NO: 2367861 - RNA, 20 nt, Human
aaaacacaguguuuuuguaa

SEQ ID NO: 2367862 - RNA, 14 nt, Human
aaaauucaaaaagu

SEQ ID NO: 2367863 - RNA, 16 nt, Human
aaaauucaaaaagugu

SEQ ID NO: 2367864 - RNA, 17 nt, Human
aaaauucaaaaaguguu

SEQ ID NO: 2367865 - RNA, 18 nt, Human
aaaauucaaaaaguguuu

SEQ ID NO: 2367866 - RNA, 15 nt, Human
aaaacacauuuuucu

SEQ ID NO: 2367867 - RNA, 13 nt, Human
aaaacacauuuuu

SEQ ID NO: 2367868 - RNA, 13 nt, Human
aaaauucagugga

SEQ ID NO: 2367869 - RNA, 17 nt, Human
aaaauucaauuguaaau

SEQ ID NO: 2367870 - RNA, 18 nt, Human
aaaauucacuauuggcug

SEQ ID NO: 2367871 - RNA, 14 nt, Human
aaaauucaauugua

SEQ ID NO: 2367872 - RNA, 13 nt, Human
aaaauugccauau

SEQ ID NO: 2367873 - RNA, 14 nt, Human
aaaauugccauauu

SEQ ID NO: 2367874 - RNA, 16 nt, Human
aaaauugccauauugc

SEQ ID NO: 2367875 - RNA, 17 nt, Human
aaaauugccauauugca

SEQ ID NO: 2367876 - RNA, 18 nt, Human
aaaauugccauauugcac

SEQ ID NO: 2367877 - RNA, 20 nt, Human
aaacacucggcauuucaaau

SEQ ID NO: 2367878 - RNA, 21 nt, Human
aaacacucggcauuucaaaug

SEQ ID NO: 2367879 - RNA, 14 nt, Human
aaacacugcaggca

SEQ ID NO: 2367880 - RNA, 15 nt, Human
aaacacugcaggcau

SEQ ID NO: 2367881 - RNA, 13 nt, Human
aaacacugccauc

SEQ ID NO: 2367882 - RNA, 18 nt, Human
aaacacuguucucugccc

SEQ ID NO: 2367883 - RNA, 14 nt, Human
aaacacucuugaaa

SEQ ID NO: 2367884 - RNA, 17 nt, Human
aaacacucuugaaaaau

SEQ ID NO: 2367885 - RNA, 21 nt, Human
aaaauugcugugccucccaaa

SEQ ID NO: 2367886 - RNA, 15 nt, Human
aaaauugcugugccu

SEQ ID NO: 2367887 - RNA, 19 nt, Human
aaaauugccauauugcaca

SEQ ID NO: 2367888 - RNA, 21 nt, Human
aaaauugccauauugcacaug

SEQ ID NO: 2367889 - RNA, 13 nt, Human
aaacacucuugaa

SEQ ID NO: 2367890 - RNA, 23 nt, Human
aaauggcugcaucccccccaccu

SEQ ID NO: 2367891 - RNA, 17 nt, Human
aaauggcugguuuuuag

SEQ ID NO: 2367892 - RNA, 19 nt, Human
aaauggccauuugcuuuuu

SEQ ID NO: 2367893 - RNA, 23 nt, Human
aaauggccauuugcuuuuucacc

SEQ ID NO: 2367894 - RNA, 22 nt, Human
aaauggccauuugcuuuuucac

SEQ ID NO: 2367895 - RNA, 11 nt, Human
aaauggccuca

SEQ ID NO: 2367896 - RNA, 15 nt, Human
aaauggccucaugug

SEQ ID NO: 2367897 - RNA, 21 nt, Human
aaauggcgucuggaaguccaa

SEQ ID NO: 2367898 - RNA, 16 nt, Human
aaauggcucagaugcc

SEQ ID NO: 2367899 - RNA, 21 nt, Human
aaauggccucauguggcugga

SEQ ID NO: 2367900 - RNA, 22 nt, Human
aaauggccucauguggcuggaa

SEQ ID NO: 2367901 - RNA, 18 nt, Human
aaauggcuuccuggcaau

SEQ ID NO: 2367902 - RNA, 17 nt, Human
aaaucuuggcacagaaa

SEQ ID NO: 2367903 - RNA, 13 nt, Human
aaaucuugaaauu

SEQ ID NO: 2367904 - RNA, 19 nt, Human
aaaucaaauaugcaaagca

SEQ ID NO: 2367905 - RNA, 18 nt, Human
aaaucaaauaugcaaagc

SEQ ID NO: 2367906 - RNA, 15 nt, Human
aaauauuuugaauca

SEQ ID NO: 2367907 - RNA, 21 nt, Human
aaauauuuugaaucaauaaua

SEQ ID NO: 2367908 - RNA, 20 nt, Human
aaauauuuucauacagcauu

SEQ ID NO: 2367909 - RNA, 16 nt, Human
aaauauuuucuggguu

SEQ ID NO: 2367910 - RNA, 16 nt, Human
aaauggaaaugggcag

SEQ ID NO: 2367911 - RNA, 18 nt, Human
aaauggaagacagcucuu

SEQ ID NO: 2367912 - RNA, 20 nt, Human
aaaucuuucuuucuuagaaa

SEQ ID NO: 2367913 - RNA, 20 nt, Human
aaaugcuuuuuauuucugca

SEQ ID NO: 2367914 - RNA, 16 nt, Human
aaaucuuucuuucuua

SEQ ID NO: 2367915 - RNA, 18 nt, Human
aaaucuuucuuucuuaga

SEQ ID NO: 2367916 - RNA, 21 nt, Human
aaauggaaaggagaggaaaga

SEQ ID NO: 2367917 - RNA, 15 nt, Human
aaauggaagacacau

SEQ ID NO: 2367918 - RNA, 18 nt, Human
aaauggaagacacauuga

SEQ ID NO: 2367919 - RNA, 20 nt, Human
aaauggacguguuaugacuc

SEQ ID NO: 2367920 - RNA, 21 nt, Human
aaauggacguguuaugacucc

SEQ ID NO: 2367921 - RNA, 22 nt, Human
aaauggacguguuaugacucca

SEQ ID NO: 2367922 - RNA, 14 nt, Human
aaauauaauugaca

SEQ ID NO: 2367923 - RNA, 19 nt, Human
aaauauaauucuguaaaug

SEQ ID NO: 2367924 - RNA, 17 nt, Human
aaauauaauucuguaaa

SEQ ID NO: 2367925 - RNA, 18 nt, Human
aaauauaauucuguaaau

SEQ ID NO: 2367926 - RNA, 14 nt, Human
aaauauaagaauaa

SEQ ID NO: 2367927 - RNA, 11 nt, Human
aaauauaauuc

SEQ ID NO: 2367928 - RNA, 12 nt, Human
aaauauaauucu

SEQ ID NO: 2367929 - RNA, 13 nt, Human
aaauauaauucug

SEQ ID NO: 2367930 - RNA, 16 nt, Human
aaauauaauucuguaa

SEQ ID NO: 2367931 - RNA, 12 nt, Human
aaauauaaaacu

SEQ ID NO: 2367932 - RNA, 13 nt, Human
aaauauaaaauau

SEQ ID NO: 2367933 - RNA, 16 nt, Human
aaauagggucuaacuc

SEQ ID NO: 2367934 - RNA, 20 nt, Human
aaauagugcagaaucucaua

SEQ ID NO: 2367935 - RNA, 21 nt, Human
aaauagugcagaaucucauag

SEQ ID NO: 2367936 - RNA, 13 nt, Human
aaauaguaaaaau

SEQ ID NO: 2367937 - RNA, 16 nt, Human
aaauaguaaaaauaaa

SEQ ID NO: 2367938 - RNA, 14 nt, Human
aaauaguauuugag

SEQ ID NO: 2367939 - RNA, 19 nt, Human
aaauagacaguauauuuau

SEQ ID NO: 2367940 - RNA, 16 nt, Human
aaauagacaguauauu

SEQ ID NO: 2367941 - RNA, 15 nt, Human
aaauagacaguauau

SEQ ID NO: 2367942 - RNA, 22 nt, Human
aaauagaagaauacaaacauau

SEQ ID NO: 2367943 - RNA, 16 nt, Human
aaauagaaccacuaug

SEQ ID NO: 2367944 - RNA, 14 nt, Human
aaauagaaauaagu

SEQ ID NO: 2367945 - RNA, 16 nt, Human
aaauacuuuaaaggaa

SEQ ID NO: 2367946 - RNA, 17 nt, Human
aaauacuuuaaaggaaa

SEQ ID NO: 2367947 - RNA, 11 nt, Human
aaauacuuguc

SEQ ID NO: 2367948 - RNA, 15 nt, Human
aaauacuuuaaagga

SEQ ID NO: 2367949 - RNA, 20 nt, Human
aaauacuugucaauauuuaa

SEQ ID NO: 2367950 - RNA, 21 nt, Human
aaauacuugucaauauuuaaa

SEQ ID NO: 2367951 - RNA, 22 nt, Human
aaauacuugucaauauuuaaac

SEQ ID NO: 2367952 - RNA, 22 nt, Human
aaauacuguuuuuaacaacuau

SEQ ID NO: 2367953 - RNA, 14 nt, Human
aaauacuguuugag

SEQ ID NO: 2367954 - RNA, 20 nt, Human
aaauacuguguuucagaagc

SEQ ID NO: 2367955 - RNA, 12 nt, Human
aaauaaagcccu

SEQ ID NO: 2367956 - RNA, 20 nt, Human
aaauaaagcuugcaacaaaa

SEQ ID NO: 2367957 - RNA, 13 nt, Human
aaauaaaguauau

SEQ ID NO: 2367958 - RNA, 23 nt, Human
aaauaaaggaugugauuguggaa

SEQ ID NO: 2367959 - RNA, 13 nt, Human
aaauaaaggaacc

SEQ ID NO: 2367960 - RNA, 12 nt, Human
aaauaacaauga

SEQ ID NO: 2367961 - RNA, 13 nt, Human
aaauaaaauuaug

SEQ ID NO: 2367962 - RNA, 15 nt, Human
aaauaaaauuuguug

SEQ ID NO: 2367963 - RNA, 16 nt, Human
aaauaaaauuuguugc

SEQ ID NO: 2367964 - RNA, 17 nt, Human
aaauaaaauuuguugca

SEQ ID NO: 2367965 - RNA, 22 nt, Human
aaauaaaauuaaagcugaaaac

SEQ ID NO: 2367966 - RNA, 15 nt, Human
aaauaaaauggauuu

SEQ ID NO: 2367967 - RNA, 14 nt, Human
aaauaaacucuaaa

SEQ ID NO: 2367968 - RNA, 17 nt, Human
aaauaaaaggaagccaa

SEQ ID NO: 2367969 - RNA, 12 nt, Human
aaagugcuggga

SEQ ID NO: 2367970 - RNA, 14 nt, Human
aaagugcugggauu

SEQ ID NO: 2367971 - RNA, 14 nt, Human
aaauaaaaugacca

SEQ ID NO: 2367972 - RNA, 15 nt, Human
aaauaaaaugaccag

SEQ ID NO: 2367973 - RNA, 16 nt, Human
aaauaaaaugaccagu

SEQ ID NO: 2367974 - RNA, 14 nt, Human
aaauaaaauaaagc

SEQ ID NO: 2367975 - RNA, 16 nt, Human
aaauaaaagugaucaa

SEQ ID NO: 2367976 - RNA, 18 nt, Human
aaauaaaaggaagccaaa

SEQ ID NO: 2367977 - RNA, 15 nt, Human
aaagugauaauuucu

SEQ ID NO: 2367978 - RNA, 20 nt, Human
aaagugagggccgagugaga

SEQ ID NO: 2367979 - RNA, 22 nt, Human
aaagugaauuugaaugaaaaau

SEQ ID NO: 2367980 - RNA, 21 nt, Human
aaagugaauuugaaugaaaaa

SEQ ID NO: 2367981 - RNA, 13 nt, Human
aaagugacacagc

SEQ ID NO: 2367982 - RNA, 14 nt, Human
aaagugacacagca

SEQ ID NO: 2367983 - RNA, 11 nt, Human
aaagugcuggg

SEQ ID NO: 2367984 - RNA, 20 nt, Human
aaagugaaaguccagaaacu

SEQ ID NO: 2367985 - RNA, 13 nt, Human
aaagugaagcaaa

SEQ ID NO: 2367986 - RNA, 20 nt, Human
aaagugaauuugaaugaaaa

SEQ ID NO: 2367987 - RNA, 19 nt, Human
aaagugaauuugaaugaaa

SEQ ID NO: 2367988 - RNA, 17 nt, Human
aaagugaauuugaauga

SEQ ID NO: 2367989 - RNA, 15 nt, Human
aaagugaauuugaau

SEQ ID NO: 2367990 - RNA, 23 nt, Human
aaagugaagcaaaucagaaacuu

SEQ ID NO: 2367991 - RNA, 12 nt, Human
aaagugaauuug

SEQ ID NO: 2367992 - RNA, 20 nt, Human
aaagucuucacucucugaag

SEQ ID NO: 2367993 - RNA, 11 nt, Human
aaagucugcaa

SEQ ID NO: 2367994 - RNA, 12 nt, Human
aaagucucuugu

SEQ ID NO: 2367995 - RNA, 22 nt, Human
aaagucugugugaugaacuuuc

SEQ ID NO: 2367996 - RNA, 23 nt, Human
aaagucugugugaugaacuuucu

SEQ ID NO: 2367997 - RNA, 20 nt, Human
aaagucucuggaauuugaaa

SEQ ID NO: 2367998 - RNA, 22 nt, Human
aaagucucuggaauuugaaaca

SEQ ID NO: 2367999 - RNA, 19 nt, Human
aaagucucuggaauuugaa

SEQ ID NO: 2368000 - RNA, 18 nt, Human
aaagggaaguugugccuu

SEQ ID NO: 2368001 - RNA, 16 nt, Human
aaagggacugagaaau

SEQ ID NO: 2368002 - RNA, 16 nt, Human
aaagggaacugaacau

SEQ ID NO: 2368003 - RNA, 21 nt, Human
aaagggaacugaacauuccag

SEQ ID NO: 2368004 - RNA, 14 nt, Human
aaagggaaacuauu

SEQ ID NO: 2368005 - RNA, 15 nt, Human
aaaggcuucucucuc

SEQ ID NO: 2368006 - RNA, 17 nt, Human
aaaggcuucucucucac

SEQ ID NO: 2368007 - RNA, 15 nt, Human
aaauaaaguauauau

SEQ ID NO: 2368008 - RNA, 19 nt, Human
aaauaaauuugguucuaau

SEQ ID NO: 2368009 - RNA, 23 nt, Human
aaauaacaaaucucaagcaaaca

SEQ ID NO: 2368010 - RNA, 17 nt, Human
aaauaacaaugugcucu

SEQ ID NO: 2368011 - RNA, 14 nt, Human
aaauaacaaugugc

SEQ ID NO: 2368012 - RNA, 21 nt, Human
aaauaacaagucgaugaacua

SEQ ID NO: 2368013 - RNA, 14 nt, Human
aaauaacaauguua

SEQ ID NO: 2368014 - RNA, 15 nt, Human
aaauaacaauguuaa

SEQ ID NO: 2368015 - RNA, 16 nt, Human
aaauaacaauguuaag

SEQ ID NO: 2368016 - RNA, 17 nt, Human
aaauaacaauguuaagg

SEQ ID NO: 2368017 - RNA, 22 nt, Human
aaugucuucuguauucacuuau

SEQ ID NO: 2368018 - RNA, 21 nt, Human
aaugucuucauuucauuguau

SEQ ID NO: 2368019 - RNA, 23 nt, Human
aaugucuguagcuccucaacuca

SEQ ID NO: 2368020 - RNA, 12 nt, Human
aaugucugugcu

SEQ ID NO: 2368021 - RNA, 13 nt, Human
aaugucugugcua

SEQ ID NO: 2368022 - RNA, 17 nt, Human
aaugucuucauuucauu

SEQ ID NO: 2368023 - RNA, 17 nt, Human
aaugucuguuaacuuaa

SEQ ID NO: 2368024 - RNA, 18 nt, Human
aauguuugccucugccuc

SEQ ID NO: 2368025 - RNA, 13 nt, Human
aaugucuuguguu

SEQ ID NO: 2368026 - RNA, 11 nt, Human
aaugucuugug

SEQ ID NO: 2368027 - RNA, 20 nt, Human
aaugucuugaugcaugcacu

SEQ ID NO: 2368028 - RNA, 17 nt, Human
aauguuuuauacuguuu

SEQ ID NO: 2368029 - RNA, 20 nt, Human
aauguuuuacugugaaacug

SEQ ID NO: 2368030 - RNA, 22 nt, Human
aauguuuuacugugaaacuggc

SEQ ID NO: 2368031 - RNA, 12 nt, Human
aauguuuugaca

SEQ ID NO: 2368032 - RNA, 15 nt, Human
aauguuuuaaauucu

SEQ ID NO: 2368033 - RNA, 14 nt, Human
aauguuuuaaauuc

SEQ ID NO: 2368034 - RNA, 13 nt, Human
aauguuuuaaauu

SEQ ID NO: 2368035 - RNA, 18 nt, Human
aauguuugucucauccca

SEQ ID NO: 2368036 - RNA, 18 nt, Human
aauguuugggcagaaggg

SEQ ID NO: 2368037 - RNA, 23 nt, Human
aauguuugggcagaagggagaag

SEQ ID NO: 2368038 - RNA, 12 nt, Human
aauguuugcuau

SEQ ID NO: 2368039 - RNA, 19 nt, Human
aauguuugccucugccucu

SEQ ID NO: 2368040 - RNA, 12 nt, Human
aauuaaacggau

SEQ ID NO: 2368041 - RNA, 18 nt, Human
aauuaaaaguugaauuuu

SEQ ID NO: 2368042 - RNA, 13 nt, Human
aauuaaacggauu

SEQ ID NO: 2368043 - RNA, 14 nt, Human
aauuaaacggauua

SEQ ID NO: 2368044 - RNA, 15 nt, Human
aauuaaacggauuau

SEQ ID NO: 2368045 - RNA, 23 nt, Human
aauuaaacggauuauuuuuucag

SEQ ID NO: 2368046 - RNA, 16 nt, Human
aauuaaacggauuauu

SEQ ID NO: 2368047 - RNA, 17 nt, Human
aauuaaacggauuauuu

SEQ ID NO: 2368048 - RNA, 21 nt, Human
aauuaaacggauuauuuuuuc

SEQ ID NO: 2368049 - RNA, 22 nt, Human
aauuaaacggauuauuuuuuca

SEQ ID NO: 2368050 - RNA, 18 nt, Human
aauuaaaacacaacaucu

SEQ ID NO: 2368051 - RNA, 13 nt, Human
aauuaaaacugaa

SEQ ID NO: 2368052 - RNA, 17 nt, Human
aauuaaaaaauuuccag

SEQ ID NO: 2368053 - RNA, 21 nt, Human
aauguuuuucugccagggagc

SEQ ID NO: 2368054 - RNA, 15 nt, Human
aauguuuuucugcca

SEQ ID NO: 2368055 - RNA, 13 nt, Human
aauguuuuucuau

SEQ ID NO: 2368056 - RNA, 14 nt, Human
aauuaaauuaggaa

SEQ ID NO: 2368057 - RNA, 14 nt, Human
aauuaaauuuugag

SEQ ID NO: 2368058 - RNA, 22 nt, Human
aauuaaauuuugaguucuacau

SEQ ID NO: 2368059 - RNA, 12 nt, Human
aauuaaauguag

SEQ ID NO: 2368060 - RNA, 11 nt, Human
aauuaaaugua

SEQ ID NO: 2368061 - RNA, 13 nt, Human
aauuaaagugucc

SEQ ID NO: 2368062 - RNA, 18 nt, Human
aauuaaaguguccauuga

SEQ ID NO: 2368063 - RNA, 20 nt, Human
aauuaaaguguccauugaca

SEQ ID NO: 2368064 - RNA, 21 nt, Human
aauuaaaguguccauugacau

SEQ ID NO: 2368065 - RNA, 15 nt, Human
aauuaaagcuguuau

SEQ ID NO: 2368066 - RNA, 12 nt, Human
aauuaaaguguc

SEQ ID NO: 2368067 - RNA, 14 nt, Human
aaugggaaaagaga

SEQ ID NO: 2368068 - RNA, 20 nt, Human
aaugggaaauacuacuccug

SEQ ID NO: 2368069 - RNA, 21 nt, Human
aauggcuuauccagcugguga

SEQ ID NO: 2368070 - RNA, 22 nt, Human
aauggcuuauccagcuggugag

SEQ ID NO: 2368071 - RNA, 23 nt, Human
aaugguaguaaucacaguuggcc

SEQ ID NO: 2368072 - RNA, 18 nt, Human
aaugguaggcauuuccua

SEQ ID NO: 2368073 - RNA, 17 nt, Human
aaugguaggcauuuccu

SEQ ID NO: 2368074 - RNA, 16 nt, Human
aaugguauaaauuuca

SEQ ID NO: 2368075 - RNA, 14 nt, Human
aauggggccagauc

SEQ ID NO: 2368076 - RNA, 15 nt, Human
aaugguaccagauaa

SEQ ID NO: 2368077 - RNA, 17 nt, Human
aauggggaucacagaga

SEQ ID NO: 2368078 - RNA, 16 nt, Human
aaugggaauauuuuau

SEQ ID NO: 2368079 - RNA, 16 nt, Human
aaugguaccagauaaa

SEQ ID NO: 2368080 - RNA, 22 nt, Human
aaugggaacugccucuuuccug

SEQ ID NO: 2368081 - RNA, 17 nt, Human
aaugggcaguuacaugc

SEQ ID NO: 2368082 - RNA, 18 nt, Human
aaugggcaguuacaugca

SEQ ID NO: 2368083 - RNA, 21 nt, Human
aaugggcaguuacaugcauac

SEQ ID NO: 2368084 - RNA, 22 nt, Human
aaugggcaguuacaugcauacu

SEQ ID NO: 2368085 - RNA, 13 nt, Human
aauggggccagau

SEQ ID NO: 2368086 - RNA, 12 nt, Human
aauggggccaga

SEQ ID NO: 2368087 - RNA, 17 nt, Human
aaugggcuuagagcagu

SEQ ID NO: 2368088 - RNA, 15 nt, Human
aaugggcagagcaga

SEQ ID NO: 2368089 - RNA, 13 nt, Human
aaugggcagagca

SEQ ID NO: 2368090 - RNA, 16 nt, Human
aauggucgcccaggag

SEQ ID NO: 2368091 - RNA, 15 nt, Human
aauggucgcccagga

SEQ ID NO: 2368092 - RNA, 22 nt, Human
aauggucuuucuaaugugugaa

SEQ ID NO: 2368093 - RNA, 22 nt, Human
aauggugaaaauaaaauaaagc

SEQ ID NO: 2368094 - RNA, 15 nt, Human
aaugguauagcaaau

SEQ ID NO: 2368095 - RNA, 13 nt, Human
aaugguguacaua

SEQ ID NO: 2368096 - RNA, 10 nt, Human
aauggugccu

SEQ ID NO: 2368097 - RNA, 16 nt, Human
aaugguguacauaaug

SEQ ID NO: 2368098 - RNA, 22 nt, Human
aaugguggggaacuauaaagaa

SEQ ID NO: 2368099 - RNA, 16 nt, Human
aauggugccuucauuu

SEQ ID NO: 2368100 - RNA, 15 nt, Human
aaugucagugugacu

SEQ ID NO: 2368101 - RNA, 16 nt, Human
aaugucagugugacug

SEQ ID NO: 2368102 - RNA, 13 nt, Human
aaugucaguguga

SEQ ID NO: 2368103 - RNA, 22 nt, Human
aaugucaguauguggaagugug

SEQ ID NO: 2368104 - RNA, 16 nt, Human
aaugucaguaugugga

SEQ ID NO: 2368105 - RNA, 22 nt, Human
aaugucuaguuguaacaccaug

SEQ ID NO: 2368106 - RNA, 17 nt, Human
aaugucagugugacuga

SEQ ID NO: 2368107 - RNA, 21 nt, Human
aaugucagugugacugaucuc

SEQ ID NO: 2368108 - RNA, 20 nt, Human
aaugucucuuuaaugucaca

SEQ ID NO: 2368109 - RNA, 17 nt, Human
aaugucugagugaaccu

SEQ ID NO: 2368110 - RNA, 16 nt, Human
aaugucuaauguauuu

SEQ ID NO: 2368111 - RNA, 14 nt, Human
aaugucuauuaagg

SEQ ID NO: 2368112 - RNA, 19 nt, Human
aaugucuaauguauuuuau

SEQ ID NO: 2368113 - RNA, 20 nt, Human
aaugucuaauguauuuuauu

SEQ ID NO: 2368114 - RNA, 17 nt, Human
aaugucucugugagacu

SEQ ID NO: 2368115 - RNA, 18 nt, Human
aaugucucugugagacuc

SEQ ID NO: 2368116 - RNA, 22 nt, Human
aauuagugcuaagugugaacug

SEQ ID NO: 2368117 - RNA, 14 nt, Human
aauuaguuuuauau

SEQ ID NO: 2368118 - RNA, 17 nt, Human
aauuaguuuuauaugcu

SEQ ID NO: 2368119 - RNA, 20 nt, Human
aauuaguuuuauaugcuucu

SEQ ID NO: 2368120 - RNA, 18 nt, Human
aauuaguggcacuugcuu

SEQ ID NO: 2368121 - RNA, 21 nt, Human
aaucuggaccccaucugugaa

SEQ ID NO: 2368122 - RNA, 22 nt, Human
aaucugcuuuuuaaagaaugcu

SEQ ID NO: 2368123 - RNA, 17 nt, Human
aaucucauugcuuacaa

SEQ ID NO: 2368124 - RNA, 23 nt, Human
aaucucauagguugccaauaaua

SEQ ID NO: 2368125 - RNA, 14 nt, Human
aaucugcagaagga

SEQ ID NO: 2368126 - RNA, 17 nt, Human
aaucugcagaaggaaaa

SEQ ID NO: 2368127 - RNA, 23 nt, Human
aaucugcagaaggaaaaaugugu

SEQ ID NO: 2368128 - RNA, 16 nt, Human
aaugaaccacaucuug

SEQ ID NO: 2368129 - RNA, 22 nt, Human
aaucuggaccccaucugugaau

SEQ ID NO: 2368130 - RNA, 17 nt, Human
aaugaaccacaucuugc

SEQ ID NO: 2368131 - RNA, 23 nt, Human
aaugaaccacaucuugcucugcu

SEQ ID NO: 2368132 - RNA, 17 nt, Human
aaugaaccccacugggu

SEQ ID NO: 2368133 - RNA, 21 nt, Human
aaugaacccccaugauguaag

SEQ ID NO: 2368134 - RNA, 22 nt, Human
aaugaacccccaugauguaagu

SEQ ID NO: 2368135 - RNA, 18 nt, Human
aaugaaccgcugaauaug

SEQ ID NO: 2368136 - RNA, 11 nt, Human
aaugaacugaa

SEQ ID NO: 2368137 - RNA, 14 nt, Human
aaugaacugaaguu

SEQ ID NO: 2368138 - RNA, 15 nt, Human
aaugaacugaaguuu

SEQ ID NO: 2368139 - RNA, 11 nt, Human
aaugaagaaag

SEQ ID NO: 2368140 - RNA, 17 nt, Human
aaugauaacuggaaacu

SEQ ID NO: 2368141 - RNA, 20 nt, Human
aaugauaauauuguggugcc

SEQ ID NO: 2368142 - RNA, 21 nt, Human
aaugauaaguaaaugcuaggu

SEQ ID NO: 2368143 - RNA, 21 nt, Human
aaugaugauccuaggcauuug

SEQ ID NO: 2368144 - RNA, 18 nt, Human
aaugauaaguaaaugcua

SEQ ID NO: 2368145 - RNA, 20 nt, Human
aaugauaacuggaaacuuca

SEQ ID NO: 2368146 - RNA, 22 nt, Human
aauccauguuaguuuuuacuuu

SEQ ID NO: 2368147 - RNA, 19 nt, Human
aauccauguuaguuuuuac

SEQ ID NO: 2368148 - RNA, 16 nt, Human
aaucccaaauuugauu

SEQ ID NO: 2368149 - RNA, 11 nt, Human
aaucccaaauu

SEQ ID NO: 2368150 - RNA, 18 nt, Human
aaucuccaaaauaaaacu

SEQ ID NO: 2368151 - RNA, 22 nt, Human
aaucugauuuguuuuccucuua

SEQ ID NO: 2368152 - RNA, 14 nt, Human
aaucuccaaaauaa

SEQ ID NO: 2368153 - RNA, 13 nt, Human
aaucuccaaaaua

SEQ ID NO: 2368154 - RNA, 18 nt, Human
aaucccaaauuugauuga

SEQ ID NO: 2368155 - RNA, 18 nt, Human
aauccaggguggugguga

SEQ ID NO: 2368156 - RNA, 22 nt, Human
aauccaggcagauccaggacua

SEQ ID NO: 2368157 - RNA, 21 nt, Human
aauccaggcagauccaggacu

SEQ ID NO: 2368158 - RNA, 20 nt, Human
aauccaggcagauccaggac

SEQ ID NO: 2368159 - RNA, 13 nt, Human
aauccauacauuu

SEQ ID NO: 2368160 - RNA, 14 nt, Human
aauccauacauuug

SEQ ID NO: 2368161 - RNA, 17 nt, Human
aaugaucuuuucaaguu

SEQ ID NO: 2368162 - RNA, 20 nt, Human
aaugaugaugggaauugugu

SEQ ID NO: 2368163 - RNA, 16 nt, Human
aaugaucucuucuuuu

SEQ ID NO: 2368164 - RNA, 19 nt, Human
aaugaugccaugaggaaca

SEQ ID NO: 2368165 - RNA, 21 nt, Human
aaugaugauguggaagaacuu

SEQ ID NO: 2368166 - RNA, 18 nt, Human
aauaugguguacauucuu

SEQ ID NO: 2368167 - RNA, 16 nt, Human
aauaugguugauaguu

SEQ ID NO: 2368168 - RNA, 13 nt, Human
aauaugggagaaa

SEQ ID NO: 2368169 - RNA, 15 nt, Human
aauauggcuauaaau

SEQ ID NO: 2368170 - RNA, 18 nt, Human
aauauggcuauaaauaua

SEQ ID NO: 2368171 - RNA, 19 nt, Human
aauaugggcauuguaguua

SEQ ID NO: 2368172 - RNA, 21 nt, Human
aauauauaaaaagaaaagaua

SEQ ID NO: 2368173 - RNA, 20 nt, Human
aauauguauuguaaacaugu

SEQ ID NO: 2368174 - RNA, 14 nt, Human
aauauguauuguaa

SEQ ID NO: 2368175 - RNA, 15 nt, Human
aauauguauuguaaa

SEQ ID NO: 2368176 - RNA, 14 nt, Human
aauauuauguguuu

SEQ ID NO: 2368177 - RNA, 16 nt, Human
aauauuauguuaaaac

SEQ ID NO: 2368178 - RNA, 14 nt, Human
aaucaacucuaaua

SEQ ID NO: 2368179 - RNA, 19 nt, Human
aaucaacugggcugaacac

SEQ ID NO: 2368180 - RNA, 14 nt, Human
aaucaacugggcug

SEQ ID NO: 2368181 - RNA, 15 nt, Human
aaucaagaaacuuaa

SEQ ID NO: 2368182 - RNA, 22 nt, Human
aaucaauuaauuuuuuuauugu

SEQ ID NO: 2368183 - RNA, 13 nt, Human
aaucacaauacau

SEQ ID NO: 2368184 - RNA, 15 nt, Human
aaucacaguuggccu

SEQ ID NO: 2368185 - RNA, 11 nt, Human
aaucacauccu

SEQ ID NO: 2368186 - RNA, 13 nt, Human
aaucacauccugg

SEQ ID NO: 2368187 - RNA, 16 nt, Human
aaucacauccuggccu

SEQ ID NO: 2368188 - RNA, 19 nt, Human
aaucacagcuuguauuuug

SEQ ID NO: 2368189 - RNA, 21 nt, Human
aaucacagcuuguauuuugug

SEQ ID NO: 2368190 - RNA, 20 nt, Human
aaucaauuuaaacccauuuu

SEQ ID NO: 2368191 - RNA, 22 nt, Human
aaucaauuuaaacccauuuuag

SEQ ID NO: 2368192 - RNA, 13 nt, Human
aaucacagaauca

SEQ ID NO: 2368193 - RNA, 18 nt, Human
aaucaauuuaaacccauu

SEQ ID NO: 2368194 - RNA, 20 nt, Human
aaucaauuacugguccaaaa

SEQ ID NO: 2368195 - RNA, 14 nt, Human
aauauaauacugua

SEQ ID NO: 2368196 - RNA, 17 nt, Human
aauauaaguuucuuugc

SEQ ID NO: 2368197 - RNA, 23 nt, Human
aauauaaggaaagcaauaaauga

SEQ ID NO: 2368198 - RNA, 16 nt, Human
aauauaaguuucuuug

SEQ ID NO: 2368199 - RNA, 21 nt, Human
aauauaaggaaagcaauaaau

SEQ ID NO: 2368200 - RNA, 19 nt, Human
aauauaaggaaagcaauaa

SEQ ID NO: 2368201 - RNA, 18 nt, Human
aauauaaggaaagcaaua

SEQ ID NO: 2368202 - RNA, 16 nt, Human
aauauaagaauaaaau

SEQ ID NO: 2368203 - RNA, 22 nt, Human
aauauaagaauaaaauguugaa

SEQ ID NO: 2368204 - RNA, 14 nt, Human
aauauaauuaucgg

SEQ ID NO: 2368205 - RNA, 13 nt, Human
aauauaauucugu

SEQ ID NO: 2368206 - RNA, 15 nt, Human
aauauaauucuguaa

SEQ ID NO: 2368207 - RNA, 16 nt, Human
aauauaauucuguaaa

SEQ ID NO: 2368208 - RNA, 11 nt, Human
aauauaauuau

SEQ ID NO: 2368209 - RNA, 18 nt, Human
aauauaggaacuuaaaua

SEQ ID NO: 2368210 - RNA, 13 nt, Human
aauauacacacag

SEQ ID NO: 2368211 - RNA, 18 nt, Human
aauauaauuuuuuagaga

SEQ ID NO: 2368212 - RNA, 18 nt, Human
aauauauaaaaagaaaag

SEQ ID NO: 2368213 - RNA, 17 nt, Human
aauauggacacuuaaua

SEQ ID NO: 2368214 - RNA, 17 nt, Human
aauauggacucaguuuu

SEQ ID NO: 2368215 - RNA, 21 nt, Human
aauauggacacuuaauacuac

SEQ ID NO: 2368216 - RNA, 21 nt, Human
aauauaggaacuuaaauaaug

SEQ ID NO: 2368217 - RNA, 20 nt, Human
aauauaggaacuuaaauaau

SEQ ID NO: 2368218 - RNA, 22 nt, Human
aauauaacugccuuaaaacuuu

SEQ ID NO: 2368219 - RNA, 21 nt, Human
aauauaacuuaaaaauguaaa

SEQ ID NO: 2368220 - RNA, 13 nt, Human
aauauaagaauaa

SEQ ID NO: 2368221 - RNA, 16 nt, Human
aagccaucuugguaaa

SEQ ID NO: 2368222 - RNA, 15 nt, Human
aagccaucuugguaa

SEQ ID NO: 2368223 - RNA, 14 nt, Human
aagccaucuuggua

SEQ ID NO: 2368224 - RNA, 18 nt, Human
aagccauaauuguucuua

SEQ ID NO: 2368225 - RNA, 14 nt, Human
aagcagaggaagga

SEQ ID NO: 2368226 - RNA, 13 nt, Human
aagauuuuaaauu

SEQ ID NO: 2368227 - RNA, 18 nt, Human
aagauuuuaaucaaguug

SEQ ID NO: 2368228 - RNA, 17 nt, Human
aagauuuuaaucaaguu

SEQ ID NO: 2368229 - RNA, 12 nt, Human
aagcagacagcu

SEQ ID NO: 2368230 - RNA, 15 nt, Human
aagcagacagcucca

SEQ ID NO: 2368231 - RNA, 14 nt, Human
aagcagacagcucc

SEQ ID NO: 2368232 - RNA, 21 nt, Human
aagcagaccacugauaaaacc

SEQ ID NO: 2368233 - RNA, 13 nt, Human
aagcagcucuccc

SEQ ID NO: 2368234 - RNA, 14 nt, Human
aagcagcucucccc

SEQ ID NO: 2368235 - RNA, 13 nt, Human
aagcagagcuucc

SEQ ID NO: 2368236 - RNA, 17 nt, Human
aagcagcucuccccuca

SEQ ID NO: 2368237 - RNA, 17 nt, Human
aagcagcucuugcuaau

SEQ ID NO: 2368238 - RNA, 11 nt, Human
aagcagcucuu

SEQ ID NO: 2368239 - RNA, 13 nt, Human
aagcaggaagcuc

SEQ ID NO: 2368240 - RNA, 12 nt, Human
aagcaggaagcu

SEQ ID NO: 2368241 - RNA, 11 nt, Human
aagcaggaagc

SEQ ID NO: 2368242 - RNA, 21 nt, Human
aagcagcuuuaaacaaauuca

SEQ ID NO: 2368243 - RNA, 22 nt, Human
aagcaggaaaugaaaaugucuu

SEQ ID NO: 2368244 - RNA, 16 nt, Human
aagcagcuuuaaacaa

SEQ ID NO: 2368245 - RNA, 17 nt, Human
aagcagcuuuaaacaaa

SEQ ID NO: 2368246 - RNA, 16 nt, Human
aagcaggaagcucaga

SEQ ID NO: 2368247 - RNA, 21 nt, Human
aagcaggaggaggugccaaca

SEQ ID NO: 2368248 - RNA, 16 nt, Human
aagcaggcuacacuga

SEQ ID NO: 2368249 - RNA, 22 nt, Human
aagcaggcuacacugacacugg

SEQ ID NO: 2368250 - RNA, 15 nt, Human
aagcaggcuggaggu

SEQ ID NO: 2368251 - RNA, 12 nt, Human
aagccagaagcu

SEQ ID NO: 2368252 - RNA, 15 nt, Human
aagccagaaccagau

SEQ ID NO: 2368253 - RNA, 18 nt, Human
aagccacuuaaaauguuc

SEQ ID NO: 2368254 - RNA, 20 nt, Human
aagccagaagcugagcacca

SEQ ID NO: 2368255 - RNA, 17 nt, Human
aagccagaagcugagca

SEQ ID NO: 2368256 - RNA, 14 nt, Human
aagccagaagcuga

SEQ ID NO: 2368257 - RNA, 13 nt, Human
aagccagaagcug

SEQ ID NO: 2368258 - RNA, 11 nt, Human
aagccagacag

SEQ ID NO: 2368259 - RNA, 14 nt, Human
aagccagaggcugg

SEQ ID NO: 2368260 - RNA, 13 nt, Human
aagccagauuuuc

SEQ ID NO: 2368261 - RNA, 15 nt, Human
aagccagaggcuggg

SEQ ID NO: 2368262 - RNA, 16 nt, Human
aagccagaggcugggu

SEQ ID NO: 2368263 - RNA, 23 nt, Human
aagccagcugccgaccagagccc

SEQ ID NO: 2368264 - RNA, 21 nt, Human
aagccagcugccgaccagagc

SEQ ID NO: 2368265 - RNA, 15 nt, Human
aagccagcugccgac

SEQ ID NO: 2368266 - RNA, 20 nt, Human
aagccagcguccuccucugu

SEQ ID NO: 2368267 - RNA, 22 nt, Human
aagccaggaauuucccaggacc

SEQ ID NO: 2368268 - RNA, 21 nt, Human
aagccaggaauuucccaggac

SEQ ID NO: 2368269 - RNA, 20 nt, Human
aagccaggaauuucccagga

SEQ ID NO: 2368270 - RNA, 23 nt, Human
aagccagcuuucccugccucuca

SEQ ID NO: 2368271 - RNA, 17 nt, Human
aagccagcuuucccugc

SEQ ID NO: 2368272 - RNA, 15 nt, Human
aagccagcuuucccu

SEQ ID NO: 2368273 - RNA, 14 nt, Human
aagccagcuuuccc

SEQ ID NO: 2368274 - RNA, 12 nt, Human
aagccagcuuuc

SEQ ID NO: 2368275 - RNA, 13 nt, Human
aagaaauuaugug

SEQ ID NO: 2368276 - RNA, 14 nt, Human
aagaaauuccugua

SEQ ID NO: 2368277 - RNA, 17 nt, Human
aagaaauuccuguagca

SEQ ID NO: 2368278 - RNA, 22 nt, Human
aagaaauuaugugccagauuua

SEQ ID NO: 2368279 - RNA, 21 nt, Human
aagaacaauauugacuuuguc

SEQ ID NO: 2368280 - RNA, 21 nt, Human
aagaacaaagagaaaaaauac

SEQ ID NO: 2368281 - RNA, 15 nt, Human
aagaacaauauugac

SEQ ID NO: 2368282 - RNA, 14 nt, Human
aagaacaagaauuu

SEQ ID NO: 2368283 - RNA, 12 nt, Human
aagaacauagaa

SEQ ID NO: 2368284 - RNA, 16 nt, Human
aagaacacccucuaaa

SEQ ID NO: 2368285 - RNA, 20 nt, Human
aagaacacuuuuaauaaacu

SEQ ID NO: 2368286 - RNA, 19 nt, Human
aagaacacccuauauuuug

SEQ ID NO: 2368287 - RNA, 21 nt, Human
aagaacacccuauauuuugca

SEQ ID NO: 2368288 - RNA, 16 nt, Human
aagaaauuugauuucu

SEQ ID NO: 2368289 - RNA, 17 nt, Human
aagaaauuuaaaagaca

SEQ ID NO: 2368290 - RNA, 13 nt, Human
aagaaauugcaau

SEQ ID NO: 2368291 - RNA, 16 nt, Human
aagaaauugcaauaac

SEQ ID NO: 2368292 - RNA, 20 nt, Human
aagaacaaaaaaaucugcag

SEQ ID NO: 2368293 - RNA, 21 nt, Human
aagaacaaaaaaaucugcaga

SEQ ID NO: 2368294 - RNA, 21 nt, Human
aagauuuguuuugucaagugu

SEQ ID NO: 2368295 - RNA, 16 nt, Human
aagauuuuaaagacau

SEQ ID NO: 2368296 - RNA, 13 nt, Human
aagauuucuugag

SEQ ID NO: 2368297 - RNA, 22 nt, Human
aagauuugaugcuggagagguu

SEQ ID NO: 2368298 - RNA, 23 nt, Human
aagauuugaugcuggagagguua

SEQ ID NO: 2368299 - RNA, 16 nt, Human
aagauuugcuuuaauu

SEQ ID NO: 2368300 - RNA, 17 nt, Human
aagauuuggaauaaagu

SEQ ID NO: 2368301 - RNA, 17 nt, Human
aagauuuccaagugcca

SEQ ID NO: 2368302 - RNA, 18 nt, Human
aagauuuaucaaaucagu

SEQ ID NO: 2368303 - RNA, 16 nt, Human
aagauuuccauauaaa

SEQ ID NO: 2368304 - RNA, 14 nt, Human
aagauuuaucaaau

SEQ ID NO: 2368305 - RNA, 17 nt, Human
aagauuuaucaaaucag

SEQ ID NO: 2368306 - RNA, 16 nt, Human
aagauugcuuaaaaua

SEQ ID NO: 2368307 - RNA, 16 nt, Human
aagauugcugaaauuu

SEQ ID NO: 2368308 - RNA, 18 nt, Human
aagaacauccaaggagaa

SEQ ID NO: 2368309 - RNA, 16 nt, Human
aagaacauagaacucu

SEQ ID NO: 2368310 - RNA, 16 nt, Human
aagauuuaccacuugu

SEQ ID NO: 2368311 - RNA, 22 nt, Human
aaggcaccuauaaaacagguca

SEQ ID NO: 2368312 - RNA, 20 nt, Human
aaggcaaguuucuagcuaga

SEQ ID NO: 2368313 - RNA, 22 nt, Human
aaggcaaugccauccucaaaca

SEQ ID NO: 2368314 - RNA, 14 nt, Human
aaggcaaaaaugua

SEQ ID NO: 2368315 - RNA, 16 nt, Human
aaggcaaggcugucaa

SEQ ID NO: 2368316 - RNA, 17 nt, Human
aaggcaaggcugucaau

SEQ ID NO: 2368317 - RNA, 18 nt, Human
aaggcaaggcugucaauu

SEQ ID NO: 2368318 - RNA, 13 nt, Human
aagcugggcaggu

SEQ ID NO: 2368319 - RNA, 13 nt, Human
aaggaccaggacu

SEQ ID NO: 2368320 - RNA, 12 nt, Human
aaggaccaggac

SEQ ID NO: 2368321 - RNA, 16 nt, Human
aaggaccacauuuuau

SEQ ID NO: 2368322 - RNA, 19 nt, Human
aaggaccacauuuuauauu

SEQ ID NO: 2368323 - RNA, 23 nt, Human
aaggaccacauuuuauauuuauu

SEQ ID NO: 2368324 - RNA, 18 nt, Human
aaggacauugcggacagc

SEQ ID NO: 2368325 - RNA, 21 nt, Human
aagcugccuguaguuaggaaa

SEQ ID NO: 2368326 - RNA, 19 nt, Human
aagcugccuguaguuagga

SEQ ID NO: 2368327 - RNA, 16 nt, Human
aagcugccuguaguua

SEQ ID NO: 2368328 - RNA, 15 nt, Human
aagcugccuguaguu

SEQ ID NO: 2368329 - RNA, 22 nt, Human
aagcugccuguaguuaggaaau

SEQ ID NO: 2368330 - RNA, 16 nt, Human
aagcugcucuggaauu

SEQ ID NO: 2368331 - RNA, 11 nt, Human
aagcugggcag

SEQ ID NO: 2368332 - RNA, 21 nt, Human
aagcuggccgaggguccuggc

SEQ ID NO: 2368333 - RNA, 22 nt, Human
aagcuggccgaggguccuggcu

SEQ ID NO: 2368334 - RNA, 20 nt, Human
aaggaccccucaccuugcaa

SEQ ID NO: 2368335 - RNA, 15 nt, Human
aaggaccccucaccu

SEQ ID NO: 2368336 - RNA, 13 nt, Human
aaggaccccucac

SEQ ID NO: 2368337 - RNA, 20 nt, Human
aaggaccacauuuuauauuu

SEQ ID NO: 2368338 - RNA, 18 nt, Human
aaggacccggaggggccu

SEQ ID NO: 2368339 - RNA, 21 nt, Human
aaggacccggaggggccuggc

SEQ ID NO: 2368340 - RNA, 15 nt, Human
aaggacuaggguccu

SEQ ID NO: 2368341 - RNA, 12 nt, Human
aaggacucuggg

SEQ ID NO: 2368342 - RNA, 13 nt, Human
aaggacuccaccc

SEQ ID NO: 2368343 - RNA, 20 nt, Human
aaggacuaggguccugggga

SEQ ID NO: 2368344 - RNA, 18 nt, Human
aaggacuaggguccuggg

SEQ ID NO: 2368345 - RNA, 22 nt, Human
aaggacugccgaccgaggcugg

SEQ ID NO: 2368346 - RNA, 13 nt, Human
aaggacugaggga

SEQ ID NO: 2368347 - RNA, 17 nt, Human
aaggacugagggacucu

SEQ ID NO: 2368348 - RNA, 23 nt, Human
aaggacugcgggacuugggucuc

SEQ ID NO: 2368349 - RNA, 17 nt, Human
aaggauugugauauuuu

SEQ ID NO: 2368350 - RNA, 20 nt, Human
aaggacugugacaggcagca

SEQ ID NO: 2368351 - RNA, 21 nt, Human
aaggacugugacaggcagcag

SEQ ID NO: 2368352 - RNA, 14 nt, Human
aaggauugugauau

SEQ ID NO: 2368353 - RNA, 13 nt, Human
aaggauuuuaugc

SEQ ID NO: 2368354 - RNA, 12 nt, Human
aaggauuuuaug

SEQ ID NO: 2368355 - RNA, 23 nt, Human
aaggauuuuaugcuuuaaacauu

SEQ ID NO: 2368356 - RNA, 22 nt, Human
aaggauuuuaugcuuuaaacau

SEQ ID NO: 2368357 - RNA, 21 nt, Human
aaggauuuuaugcuuuaaaca

SEQ ID NO: 2368358 - RNA, 20 nt, Human
aaggauuuuaugcuuuaaac

SEQ ID NO: 2368359 - RNA, 16 nt, Human
aaggauuuuaugcuuu

SEQ ID NO: 2368360 - RNA, 14 nt, Human
aagcugccuguagu

SEQ ID NO: 2368361 - RNA, 20 nt, Human
aagcugccugguauauccaa

SEQ ID NO: 2368362 - RNA, 15 nt, Human
aagcugccugguaua

SEQ ID NO: 2368363 - RNA, 17 nt, Human
aagcugccugcuuuuca

SEQ ID NO: 2368364 - RNA, 20 nt, Human
aagcugccugcuuuucacug

SEQ ID NO: 2368365 - RNA, 12 nt, Human
aagcugccugcu

SEQ ID NO: 2368366 - RNA, 15 nt, Human
aagcugccugcuuuu

SEQ ID NO: 2368367 - RNA, 22 nt, Human
aagcugcacccucaggcaggug

SEQ ID NO: 2368368 - RNA, 23 nt, Human
aagcugccuccccucuccuuccu

SEQ ID NO: 2368369 - RNA, 20 nt, Human
aagcugcacccucaggcagg

SEQ ID NO: 2368370 - RNA, 21 nt, Human
aagcugcacccucaggcaggu

SEQ ID NO: 2368371 - RNA, 11 nt, Human
aagcuaaagag

SEQ ID NO: 2368372 - RNA, 23 nt, Human
aagcuaaaaccugagcuagaagc

SEQ ID NO: 2368373 - RNA, 21 nt, Human
aagcuaaauccuuuacuguua

SEQ ID NO: 2368374 - RNA, 12 nt, Human
aagcguggugga

SEQ ID NO: 2368375 - RNA, 16 nt, Human
aagcuaaaaccugagc

SEQ ID NO: 2368376 - RNA, 14 nt, Human
aagucuccuucccc

SEQ ID NO: 2368377 - RNA, 17 nt, Human
aagucucuagguucuga

SEQ ID NO: 2368378 - RNA, 19 nt, Human
aagucucugaagugaaacu

SEQ ID NO: 2368379 - RNA, 15 nt, Human
aagucucugcuggcc

SEQ ID NO: 2368380 - RNA, 22 nt, Human
aagucucugaagugaaacugcu

SEQ ID NO: 2368381 - RNA, 22 nt, Human
aaguccccaggccccaggaagc

SEQ ID NO: 2368382 - RNA, 19 nt, Human
aagucccugacucucugug

SEQ ID NO: 2368383 - RNA, 23 nt, Human
aaguccccaggccccaggaagcc

SEQ ID NO: 2368384 - RNA, 21 nt, Human
aaguccccaggccccaggaag

SEQ ID NO: 2368385 - RNA, 18 nt, Human
aaguccccaggccccagg

SEQ ID NO: 2368386 - RNA, 14 nt, Human
aaguccccaggccc

SEQ ID NO: 2368387 - RNA, 21 nt, Human
aaguccccgaguuuccccaga

SEQ ID NO: 2368388 - RNA, 18 nt, Human
aagucucuuuucuuuaga

SEQ ID NO: 2368389 - RNA, 21 nt, Human
aagucucugcuggcccagcca

SEQ ID NO: 2368390 - RNA, 16 nt, Human
aagucucugcuggccc

SEQ ID NO: 2368391 - RNA, 19 nt, Human
aagucucuggaauuugaaa

SEQ ID NO: 2368392 - RNA, 23 nt, Human
aagucuguuuuaugacuucauua

SEQ ID NO: 2368393 - RNA, 20 nt, Human
aagucuguuuuaugacuuca

SEQ ID NO: 2368394 - RNA, 17 nt, Human
aagucuuaaaauaacuu

SEQ ID NO: 2368395 - RNA, 18 nt, Human
aagucuuaaaauaacuua

SEQ ID NO: 2368396 - RNA, 23 nt, Human
aagucuuaaaauaacuuauauca

SEQ ID NO: 2368397 - RNA, 19 nt, Human
aagucuguuuuaugacuuc

SEQ ID NO: 2368398 - RNA, 18 nt, Human
aagucuguuuuaugacuu

SEQ ID NO: 2368399 - RNA, 16 nt, Human
aagucuguuuuaugac

SEQ ID NO: 2368400 - RNA, 15 nt, Human
aagucuguuuuauga

SEQ ID NO: 2368401 - RNA, 16 nt, Human
aagucuuagauguaua

SEQ ID NO: 2368402 - RNA, 13 nt, Human
aaguauguaaaca

SEQ ID NO: 2368403 - RNA, 17 nt, Human
aaguaugagggaaaaug

SEQ ID NO: 2368404 - RNA, 21 nt, Human
aaguaugagggaaaaugagua

SEQ ID NO: 2368405 - RNA, 18 nt, Human
aaguaucuuuuuucaaaa

SEQ ID NO: 2368406 - RNA, 22 nt, Human
aaguaucugacaucucugcaau

SEQ ID NO: 2368407 - RNA, 14 nt, Human
aaguaucuucaugu

SEQ ID NO: 2368408 - RNA, 14 nt, Human
aaguaugaaucuau

SEQ ID NO: 2368409 - RNA, 16 nt, Human
aaguaugaaucuaugc

SEQ ID NO: 2368410 - RNA, 23 nt, Human
aaguaugaaucuaugccaaagau

SEQ ID NO: 2368411 - RNA, 15 nt, Human
aaguaucaugcauuc

SEQ ID NO: 2368412 - RNA, 12 nt, Human
aaguaucaugca

SEQ ID NO: 2368413 - RNA, 14 nt, Human
aaguaucaugcauu

SEQ ID NO: 2368414 - RNA, 15 nt, Human
aaguaucugacaucu

SEQ ID NO: 2368415 - RNA, 16 nt, Human
aaguaucccuacugua

SEQ ID NO: 2368416 - RNA, 18 nt, Human
aaguaugugagugugucc

SEQ ID NO: 2368417 - RNA, 18 nt, Human
aaguauguguaaaaugug

SEQ ID NO: 2368418 - RNA, 13 nt, Human
aaguaugugagug

SEQ ID NO: 2368419 - RNA, 22 nt, Human
aaguauguaaaguauguaaaca

SEQ ID NO: 2368420 - RNA, 21 nt, Human
aaguauguaaacaggagacag

SEQ ID NO: 2368421 - RNA, 12 nt, Human
aaguauguaaag

SEQ ID NO: 2368422 - RNA, 23 nt, Human
aaguccaggcuuuuuuaucaugu

SEQ ID NO: 2368423 - RNA, 13 nt, Human
aaguauauauuua

SEQ ID NO: 2368424 - RNA, 16 nt, Human
aaguauauauagaauc

SEQ ID NO: 2368425 - RNA, 11 nt, Human
aaguauauaua

SEQ ID NO: 2368426 - RNA, 18 nt, Human
aaguauauaaugguuuca

SEQ ID NO: 2368427 - RNA, 23 nt, Human
aaguauauaaugguuucaaagau

SEQ ID NO: 2368428 - RNA, 11 nt, Human
aaguaucaugc

SEQ ID NO: 2368429 - RNA, 18 nt, Human
aaguauauauauauauua

SEQ ID NO: 2368430 - RNA, 12 nt, Human
aaguauauaaug

SEQ ID NO: 2368431 - RNA, 11 nt, Human
aaguacuucuu

SEQ ID NO: 2368432 - RNA, 21 nt, Human
aagguuuaggcugguggccca

SEQ ID NO: 2368433 - RNA, 20 nt, Human
aagguuuaggcugguggccc

SEQ ID NO: 2368434 - RNA, 19 nt, Human
aagguuuaggcugguggcc

SEQ ID NO: 2368435 - RNA, 15 nt, Human
aagguuuaggcuggu

SEQ ID NO: 2368436 - RNA, 21 nt, Human
aagguuuacaauuuacaaagu

SEQ ID NO: 2368437 - RNA, 14 nt, Human
aaguacuuuuggca

SEQ ID NO: 2368438 - RNA, 15 nt, Human
aaguacuuuuggcau

SEQ ID NO: 2368439 - RNA, 16 nt, Human
aagguuaagcccugag

SEQ ID NO: 2368440 - RNA, 17 nt, Human
aagguuguauugcauau

SEQ ID NO: 2368441 - RNA, 22 nt, Human
aagguuuaaacuucucugaagg

SEQ ID NO: 2368442 - RNA, 23 nt, Human
aagguuuaaacuucucugaaggg

SEQ ID NO: 2368443 - RNA, 13 nt, Human
aagguuguauugc

SEQ ID NO: 2368444 - RNA, 16 nt, Human
aagguugggcagggug

SEQ ID NO: 2368445 - RNA, 22 nt, Human
aagguugacaauaaaugugcuu

SEQ ID NO: 2368446 - RNA, 21 nt, Human
aagguucuucccuuuuacaua

SEQ ID NO: 2368447 - RNA, 18 nt, Human
aagguucuggugugaacu

SEQ ID NO: 2368448 - RNA, 20 nt, Human
aagguuaauguucaucaucc

SEQ ID NO: 2368449 - RNA, 16 nt, Human
aagguuaauaaaguaa

SEQ ID NO: 2368450 - RNA, 15 nt, Human
aagguuaauaaagua

SEQ ID NO: 2368451 - RNA, 16 nt, Human
aaggugggcugagccc

SEQ ID NO: 2368452 - RNA, 17 nt, Human
aaggugggccuugcuac

SEQ ID NO: 2368453 - RNA, 19 nt, Human
aagguggauggccccagca

SEQ ID NO: 2368454 - RNA, 19 nt, Human
aaggugggcugagcccugg

SEQ ID NO: 2368455 - RNA, 18 nt, Human
aaggugggcugagcccug

SEQ ID NO: 2368456 - RNA, 22 nt, Human
aaggugggccuugcuaccucaa

SEQ ID NO: 2368457 - RNA, 20 nt, Human
aagguggacuggaaggggcc

SEQ ID NO: 2368458 - RNA, 15 nt, Human
aaggugcuggaggug

SEQ ID NO: 2368459 - RNA, 20 nt, Human
aaggugcuggaggugggagc

SEQ ID NO: 2368460 - RNA, 11 nt, Human
aaggugggagg

SEQ ID NO: 2368461 - RNA, 18 nt, Human
aaggugcugacggccagg

SEQ ID NO: 2368462 - RNA, 22 nt, Human
aauaaguuaacuauuuuauuuu

SEQ ID NO: 2368463 - RNA, 11 nt, Human
aauaaguuauu

SEQ ID NO: 2368464 - RNA, 17 nt, Human
aauaagugguuauuucu

SEQ ID NO: 2368465 - RNA, 17 nt, Human
aauaagugccaggaugg

SEQ ID NO: 2368466 - RNA, 15 nt, Human
aauaaacucuaaaca

SEQ ID NO: 2368467 - RNA, 17 nt, Human
aauaaacuuagaauaaa

SEQ ID NO: 2368468 - RNA, 19 nt, Human
aauaaacuuagaauaaaau

SEQ ID NO: 2368469 - RNA, 21 nt, Human
aauaaacuuagaauaaaauug

SEQ ID NO: 2368470 - RNA, 17 nt, Human
aauaaacuguguuuacu

SEQ ID NO: 2368471 - RNA, 18 nt, Human
aauaaacucaaugagcuc

SEQ ID NO: 2368472 - RNA, 18 nt, Human
aauaaacuggcagcucag

SEQ ID NO: 2368473 - RNA, 19 nt, Human
aauaaacuauuuguaaagu

SEQ ID NO: 2368474 - RNA, 14 nt, Human
aauaaaaugugauu

SEQ ID NO: 2368475 - RNA, 13 nt, Human
aauaaaaugugau

SEQ ID NO: 2368476 - RNA, 21 nt, Human
aauaaaaugugauuuuucuga

SEQ ID NO: 2368477 - RNA, 17 nt, Human
aauaaaauguugaaaag

SEQ ID NO: 2368478 - RNA, 23 nt, Human
aauaaaauuaaagcugaaaacug

SEQ ID NO: 2368479 - RNA, 15 nt, Human
aauaaaauuauuuug

SEQ ID NO: 2368480 - RNA, 14 nt, Human
aauaaaauugcacu

SEQ ID NO: 2368481 - RNA, 21 nt, Human
aaguuguuacuaacuaaacuc

SEQ ID NO: 2368482 - RNA, 23 nt, Human
aaguuguuacuaacuaaacucuc

SEQ ID NO: 2368483 - RNA, 17 nt, Human
aaguuguuaacuaaauu

SEQ ID NO: 2368484 - RNA, 20 nt, Human
aaguuguuacuaacuaaacu

SEQ ID NO: 2368485 - RNA, 16 nt, Human
aaguuguggugcugac

SEQ ID NO: 2368486 - RNA, 20 nt, Human
aaguuguggugcugacaaag

SEQ ID NO: 2368487 - RNA, 15 nt, Human
aaguuguuucauuga

SEQ ID NO: 2368488 - RNA, 12 nt, Human
aaguuguuugag

SEQ ID NO: 2368489 - RNA, 15 nt, Human
aaguuguuaauaaaa

SEQ ID NO: 2368490 - RNA, 15 nt, Human
aaguugugcuuguuu

SEQ ID NO: 2368491 - RNA, 19 nt, Human
aaguugugccuuuuauagc

SEQ ID NO: 2368492 - RNA, 20 nt, Human
aaguugugccuuuuauagcu

SEQ ID NO: 2368493 - RNA, 22 nt, Human
aaguuguaggcauaaagucagg

SEQ ID NO: 2368494 - RNA, 18 nt, Human
aaguugugccuuuuauag

SEQ ID NO: 2368495 - RNA, 20 nt, Human
aaguguaaagcauuccaaca

SEQ ID NO: 2368496 - RNA, 18 nt, Human
aaguguaaagcauuccaa

SEQ ID NO: 2368497 - RNA, 13 nt, Human
aagugguauagaa

SEQ ID NO: 2368498 - RNA, 17 nt, Human
aagugguauagaaaugc

SEQ ID NO: 2368499 - RNA, 17 nt, Human
aagugcuuccaaggcag

SEQ ID NO: 2368500 - RNA, 20 nt, Human
aaguggguuauucuggaguu

SEQ ID NO: 2368501 - RNA, 18 nt, Human
aaguggugguaacccugg

SEQ ID NO: 2368502 - RNA, 17 nt, Human
aaguggugguaacccug

SEQ ID NO: 2368503 - RNA, 13 nt, Human
aaguggugcucag

SEQ ID NO: 2368504 - RNA, 15 nt, Human
aaguggugcucaguu

SEQ ID NO: 2368505 - RNA, 17 nt, Human
aaguggugcucaguugu

SEQ ID NO: 2368506 - RNA, 19 nt, Human
aaguggugcucaguuguag

SEQ ID NO: 2368507 - RNA, 22 nt, Human
aaguguaaaauauuuugaauca

SEQ ID NO: 2368508 - RNA, 17 nt, Human
aaguguaaacaccauag

SEQ ID NO: 2368509 - RNA, 11 nt, Human
aaguguaaagc

SEQ ID NO: 2368510 - RNA, 13 nt, Human
aaguguaaagcau

SEQ ID NO: 2368511 - RNA, 14 nt, Human
aaguguaaagcauu

SEQ ID NO: 2368512 - RNA, 16 nt, Human
aaguguaaagcauucc

SEQ ID NO: 2368513 - RNA, 17 nt, Human
aaguguaaagcauucca

SEQ ID NO: 2368514 - RNA, 19 nt, Human
aauaauguacaucuggccu

SEQ ID NO: 2368515 - RNA, 20 nt, Human
aauaauggucccauccaggc

SEQ ID NO: 2368516 - RNA, 21 nt, Human
aauaauggucccauccaggca

SEQ ID NO: 2368517 - RNA, 17 nt, Human
aauaaugguaccagaua

SEQ ID NO: 2368518 - RNA, 20 nt, Human
aauaaugguaccagauaaaa

SEQ ID NO: 2368519 - RNA, 21 nt, Human
aauaaugguaccagauaaaau

SEQ ID NO: 2368520 - RNA, 23 nt, Human
aauaaugguaccagauaaaauua

SEQ ID NO: 2368521 - RNA, 13 nt, Human
aauaaugucucug

SEQ ID NO: 2368522 - RNA, 11 nt, Human
aauaaugucuc

SEQ ID NO: 2368523 - RNA, 12 nt, Human
aauaaugucucu

SEQ ID NO: 2368524 - RNA, 16 nt, Human
aauaaugugaaacugg

SEQ ID NO: 2368525 - RNA, 12 nt, Human
aauaauguaaga

SEQ ID NO: 2368526 - RNA, 19 nt, Human
aauaauguaagacaaauau

SEQ ID NO: 2368527 - RNA, 20 nt, Human
aauaaugggcuuagagcagu

SEQ ID NO: 2368528 - RNA, 19 nt, Human
aauaaugggcuuagagcag

SEQ ID NO: 2368529 - RNA, 13 nt, Human
aauaaugguacca

SEQ ID NO: 2368530 - RNA, 13 nt, Human
aauaauaaacuuu

SEQ ID NO: 2368531 - RNA, 13 nt, Human
aauaaucauugga

SEQ ID NO: 2368532 - RNA, 21 nt, Human
aauaaucacgcuuuccugaau

SEQ ID NO: 2368533 - RNA, 20 nt, Human
aauaaucacgcuuuccugaa

SEQ ID NO: 2368534 - RNA, 22 nt, Human
aauaaguucaaauucuucugaa

SEQ ID NO: 2368535 - RNA, 21 nt, Human
aauaaguucaaauucuucuga

SEQ ID NO: 2368536 - RNA, 18 nt, Human
aauaaguuauugcaguuu

SEQ ID NO: 2368537 - RNA, 13 nt, Human
aauaaguuauugc

SEQ ID NO: 2368538 - RNA, 14 nt, Human
aauaaguuauugca

SEQ ID NO: 2368539 - RNA, 14 nt, Human
aauaaucuuugggu

SEQ ID NO: 2368540 - RNA, 22 nt, Human
aauaaugaauggacucaaacug

SEQ ID NO: 2368541 - RNA, 23 nt, Human
aauaaucuuauuagggagaaaau

SEQ ID NO: 2368542 - RNA, 19 nt, Human
aauaaucuuauuagggaga

SEQ ID NO: 2368543 - RNA, 13 nt, Human
aauaaucuuauua

SEQ ID NO: 2368544 - RNA, 16 nt, Human
aauaaucggcccacag

SEQ ID NO: 2368545 - RNA, 13 nt, Human
aauaaucggccca

SEQ ID NO: 2368546 - RNA, 16 nt, Human
aauaaucuauuucuau

SEQ ID NO: 2368547 - RNA, 21 nt, Human
aauaauccuaaacauaugaau

SEQ ID NO: 2368548 - RNA, 22 nt, Human
aagugcugggauuacaggugug

SEQ ID NO: 2368549 - RNA, 23 nt, Human
aagugcuguauaaaaucagccaa

SEQ ID NO: 2368550 - RNA, 19 nt, Human
aagugcuguauaaaaucag

SEQ ID NO: 2368551 - RNA, 22 nt, Human
aagugcuguauaaaaucagcca

SEQ ID NO: 2368552 - RNA, 12 nt, Human
aagugcuguaua

SEQ ID NO: 2368553 - RNA, 13 nt, Human
aagugcuguauaa

SEQ ID NO: 2368554 - RNA, 15 nt, Human
aagugcuguauaaaa

SEQ ID NO: 2368555 - RNA, 16 nt, Human
aagugcuguauaaaau

SEQ ID NO: 2368556 - RNA, 17 nt, Human
aagugcuguauaaaauc

SEQ ID NO: 2368557 - RNA, 18 nt, Human
cacagugucuguaucgga

SEQ ID NO: 2368558 - RNA, 21 nt, Human
cacagugucugggcugacugg

SEQ ID NO: 2368559 - RNA, 14 nt, Human
cacagugucugggc

SEQ ID NO: 2368560 - RNA, 16 nt, Human
cacagugucugggcug

SEQ ID NO: 2368561 - RNA, 17 nt, Human
cacagugucugggcuga

SEQ ID NO: 2368562 - RNA, 20 nt, Human
cacagugucugggcugacug

SEQ ID NO: 2368563 - RNA, 13 nt, Human
cacagugucuggg

SEQ ID NO: 2368564 - RNA, 14 nt, Human
cacagugggagcca

SEQ ID NO: 2368565 - RNA, 18 nt, Human
cacagugggagccagggc

SEQ ID NO: 2368566 - RNA, 19 nt, Human
cacagugggagccagggcu

SEQ ID NO: 2368567 - RNA, 15 nt, Human
cacagugguggcagg

SEQ ID NO: 2368568 - RNA, 23 nt, Human
cacagugguggcagggccuagcu

SEQ ID NO: 2368569 - RNA, 17 nt, Human
cacagugguggcagggc

SEQ ID NO: 2368570 - RNA, 19 nt, Human
cacagugguggcagggccu

SEQ ID NO: 2368571 - RNA, 20 nt, Human
cacaguuccucgcccugggu

SEQ ID NO: 2368572 - RNA, 19 nt, Human
cacaguuccucgcccuggg

SEQ ID NO: 2368573 - RNA, 16 nt, Human
cacaguuccucgcccu

SEQ ID NO: 2368574 - RNA, 14 nt, Human
cacaguucucuccu

SEQ ID NO: 2368575 - RNA, 15 nt, Human
cacaguucucuccuu

SEQ ID NO: 2368576 - RNA, 20 nt, Human
cacaguucuuugggccagac

SEQ ID NO: 2368577 - RNA, 19 nt, Human
cacaguucuuugggccaga

SEQ ID NO: 2368578 - RNA, 18 nt, Human
cacaguucuuugggccag

SEQ ID NO: 2368579 - RNA, 19 nt, Human
cacaguucgaccugcggcu

SEQ ID NO: 2368580 - RNA, 14 nt, Human
cacagugcaucuca

SEQ ID NO: 2368581 - RNA, 11 nt, Human
cacagugauuu

SEQ ID NO: 2368582 - RNA, 14 nt, Human
cacagugauuuuuu

SEQ ID NO: 2368583 - RNA, 22 nt, Human
cacagugagucgaggacaggga

SEQ ID NO: 2368584 - RNA, 21 nt, Human
cacagugagucgaggacaggg

SEQ ID NO: 2368585 - RNA, 13 nt, Human
cacaguccuuacc

SEQ ID NO: 2368586 - RNA, 15 nt, Human
cacaguccuuaccag

SEQ ID NO: 2368587 - RNA, 21 nt, Human
cacaguccuuaccagcagagc

SEQ ID NO: 2368588 - RNA, 22 nt, Human
cacaguccuuaccagcagagca

SEQ ID NO: 2368589 - RNA, 11 nt, Human
cacaggcaggu

SEQ ID NO: 2368590 - RNA, 18 nt, Human
cacaggagugggaaaaca

SEQ ID NO: 2368591 - RNA, 14 nt, Human
cacaggcaggucca

SEQ ID NO: 2368592 - RNA, 15 nt, Human
cacaggcagguccag

SEQ ID NO: 2368593 - RNA, 22 nt, Human
cacaggaggagaaaucucacuu

SEQ ID NO: 2368594 - RNA, 14 nt, Human
cacaggagggaggg

SEQ ID NO: 2368595 - RNA, 21 nt, Human
cacaggagggagggggaaggc

SEQ ID NO: 2368596 - RNA, 19 nt, Human
cacaggagggagggggaag

SEQ ID NO: 2368597 - RNA, 14 nt, Human
cacagcuuccccuc

SEQ ID NO: 2368598 - RNA, 22 nt, Human
cacagcuucagccaggagcugg

SEQ ID NO: 2368599 - RNA, 18 nt, Human
cacagcuucagccaggag

SEQ ID NO: 2368600 - RNA, 19 nt, Human
cacagcuucagccaggagc

SEQ ID NO: 2368601 - RNA, 15 nt, Human
cacagcuuccccucu

SEQ ID NO: 2368602 - RNA, 15 nt, Human
cacaggagcauuugg

SEQ ID NO: 2368603 - RNA, 23 nt, Human
caauuuguaaaaacagcauugcu

SEQ ID NO: 2368604 - RNA, 23 nt, Human
caauuuguaauugcuuacauuuu

SEQ ID NO: 2368605 - RNA, 16 nt, Human
caauuuguuugugcuu

SEQ ID NO: 2368606 - RNA, 18 nt, Human
caauuuguuugugcuucu

SEQ ID NO: 2368607 - RNA, 19 nt, Human
caauuuguuugugcuucua

SEQ ID NO: 2368608 - RNA, 14 nt, Human
cacagcugcuggag

SEQ ID NO: 2368609 - RNA, 15 nt, Human
cacagcugcuggaga

SEQ ID NO: 2368610 - RNA, 19 nt, Human
caauuuguaaaaacagcau

SEQ ID NO: 2368611 - RNA, 18 nt, Human
caauuugggagauauauu

SEQ ID NO: 2368612 - RNA, 19 nt, Human
caauuugggagauauauuu

SEQ ID NO: 2368613 - RNA, 22 nt, Human
cacagcugggguggggaccuca

SEQ ID NO: 2368614 - RNA, 23 nt, Human
cacagcugggguggggaccucag

SEQ ID NO: 2368615 - RNA, 14 nt, Human
cacagcuucagcca

SEQ ID NO: 2368616 - RNA, 17 nt, Human
cacagcuucagccagga

SEQ ID NO: 2368617 - RNA, 14 nt, Human
cacagcugggcugu

SEQ ID NO: 2368618 - RNA, 15 nt, Human
cacagcugggcugug

SEQ ID NO: 2368619 - RNA, 20 nt, Human
cacagcugcuggagacuccu

SEQ ID NO: 2368620 - RNA, 14 nt, Human
cacagcugcuuucu

SEQ ID NO: 2368621 - RNA, 20 nt, Human
cacagcugcuuucuguuguc

SEQ ID NO: 2368622 - RNA, 14 nt, Human
cacagcuggccucc

SEQ ID NO: 2368623 - RNA, 21 nt, Human
cacagcuucauuuccuguguc

SEQ ID NO: 2368624 - RNA, 22 nt, Human
cacagcuucauuuccugugucu

SEQ ID NO: 2368625 - RNA, 21 nt, Human
cacaguucuuugggccagaca

SEQ ID NO: 2368626 - RNA, 22 nt, Human
cacaguuccucgcccugggucu

SEQ ID NO: 2368627 - RNA, 13 nt, Human
cacauacccuccc

SEQ ID NO: 2368628 - RNA, 15 nt, Human
cacauacccuccccc

SEQ ID NO: 2368629 - RNA, 22 nt, Human
cacauacccucuucauggaugg

SEQ ID NO: 2368630 - RNA, 19 nt, Human
cacauacccucuucaugga

SEQ ID NO: 2368631 - RNA, 16 nt, Human
cacauacuugagacug

SEQ ID NO: 2368632 - RNA, 20 nt, Human
cacauacgcaccacaucucu

SEQ ID NO: 2368633 - RNA, 18 nt, Human
cacauagcauguaauggu

SEQ ID NO: 2368634 - RNA, 15 nt, Human
cacauagagaucauc

SEQ ID NO: 2368635 - RNA, 14 nt, Human
cacauaucugucau

SEQ ID NO: 2368636 - RNA, 20 nt, Human
cacaguuuucugagaaagac

SEQ ID NO: 2368637 - RNA, 19 nt, Human
cacaguuuucugagaaaga

SEQ ID NO: 2368638 - RNA, 17 nt, Human
cacaguuuucugagaaa

SEQ ID NO: 2368639 - RNA, 16 nt, Human
cacaguuuucugagaa

SEQ ID NO: 2368640 - RNA, 13 nt, Human
cacauaugagggg

SEQ ID NO: 2368641 - RNA, 16 nt, Human
cacauagcugucuaga

SEQ ID NO: 2368642 - RNA, 18 nt, Human
cacauaugcaccuugugu

SEQ ID NO: 2368643 - RNA, 13 nt, Human
cacauagcugucu

SEQ ID NO: 2368644 - RNA, 19 nt, Human
cacauaugcaccuuguguc

SEQ ID NO: 2368645 - RNA, 20 nt, Human
cacauaugcaccuugugucu

SEQ ID NO: 2368646 - RNA, 21 nt, Human
cacauaugcaccuugugucug

SEQ ID NO: 2368647 - RNA, 22 nt, Human
cacauaugcaccuugugucugu

SEQ ID NO: 2368648 - RNA, 16 nt, Human
caaaaacuacacauau

SEQ ID NO: 2368649 - RNA, 17 nt, Human
caaaaaccucacccgag

SEQ ID NO: 2368650 - RNA, 23 nt, Human
caaaaacuuuggaguccccucac

SEQ ID NO: 2368651 - RNA, 22 nt, Human
caaaaacuguauugaugacagu

SEQ ID NO: 2368652 - RNA, 13 nt, Human
caaaaacuuguua

SEQ ID NO: 2368653 - RNA, 16 nt, Human
caaaaacagccucaca

SEQ ID NO: 2368654 - RNA, 15 nt, Human
caaaaacagccucac

SEQ ID NO: 2368655 - RNA, 22 nt, Human
caaaaacagccucacagaagaa

SEQ ID NO: 2368656 - RNA, 13 nt, Human
caaaaaggcagga

SEQ ID NO: 2368657 - RNA, 22 nt, Human
caaaaagcucuuacacuacauu

SEQ ID NO: 2368658 - RNA, 15 nt, Human
caaaaagcaaaauca

SEQ ID NO: 2368659 - RNA, 16 nt, Human
caaaaagcaaaaucau

SEQ ID NO: 2368660 - RNA, 21 nt, Human
caaaaagaacaaaaaaaucug

SEQ ID NO: 2368661 - RNA, 13 nt, Human
caaaaagaccaga

SEQ ID NO: 2368662 - RNA, 14 nt, Human
caaaaagaccagac

SEQ ID NO: 2368663 - RNA, 15 nt, Human
caaaaagaccagacu

SEQ ID NO: 2368664 - RNA, 12 nt, Human
caaaaagaacaa

SEQ ID NO: 2368665 - RNA, 13 nt, Human
caaaaagaacaaa

SEQ ID NO: 2368666 - RNA, 14 nt, Human
caaaaagaacaaaa

SEQ ID NO: 2368667 - RNA, 19 nt, Human
caaaaagaacaaaaaaauc

SEQ ID NO: 2368668 - RNA, 16 nt, Human
caaaaaauuagccggg

SEQ ID NO: 2368669 - RNA, 18 nt, Human
caaaaaauuagccgggcg

SEQ ID NO: 2368670 - RNA, 17 nt, Human
auuuuguaaacucaaaa

SEQ ID NO: 2368671 - RNA, 21 nt, Human
auuuugguuguauucuuugau

SEQ ID NO: 2368672 - RNA, 10 nt, Human
auuuuguaaa

SEQ ID NO: 2368673 - RNA, 14 nt, Human
caaaaacacagcaa

SEQ ID NO: 2368674 - RNA, 13 nt, Human
caaaaacacagca

SEQ ID NO: 2368675 - RNA, 14 nt, Human
caaaaacagccuca

SEQ ID NO: 2368676 - RNA, 13 nt, Human
caaaaacagccuc

SEQ ID NO: 2368677 - RNA, 22 nt, Human
caaaaacacaguguuuuuguaa

SEQ ID NO: 2368678 - RNA, 23 nt, Human
caaaaacacaguguuuuuguaaa

SEQ ID NO: 2368679 - RNA, 20 nt, Human
caaaaacacaguguuuuugu

SEQ ID NO: 2368680 - RNA, 20 nt, Human
caaaaacauggccuuugcuu

SEQ ID NO: 2368681 - RNA, 17 nt, Human
caaaaacacagcaaggg

SEQ ID NO: 2368682 - RNA, 15 nt, Human
caaaaacacagcaag

SEQ ID NO: 2368683 - RNA, 14 nt, Human
auuuucuacagugg

SEQ ID NO: 2368684 - RNA, 21 nt, Human
auuuucuaccuggucucuccu

SEQ ID NO: 2368685 - RNA, 16 nt, Human
auuuucuagacuuucu

SEQ ID NO: 2368686 - RNA, 18 nt, Human
auuuucuagacuuucugu

SEQ ID NO: 2368687 - RNA, 21 nt, Human
auuuuggagaaauuauuuaau

SEQ ID NO: 2368688 - RNA, 19 nt, Human
auuuucuagacuuucuguu

SEQ ID NO: 2368689 - RNA, 20 nt, Human
auuuuggagaguuuccugaa

SEQ ID NO: 2368690 - RNA, 21 nt, Human
auuuugggguacccacugcuc

SEQ ID NO: 2368691 - RNA, 21 nt, Human
auuuuggagaguuuccugaaa

SEQ ID NO: 2368692 - RNA, 22 nt, Human
auuuuggagaguuuccugaaac

SEQ ID NO: 2368693 - RNA, 13 nt, Human
auuuuccuuuuuu

SEQ ID NO: 2368694 - RNA, 17 nt, Human
auuuuccuuuuuuauac

SEQ ID NO: 2368695 - RNA, 18 nt, Human
auuuuccuuuuuuauaca

SEQ ID NO: 2368696 - RNA, 20 nt, Human
auuuuccuuuuuuauacaca

SEQ ID NO: 2368697 - RNA, 21 nt, Human
auuuuccuuuuuuauacacau

SEQ ID NO: 2368698 - RNA, 22 nt, Human
auuuuccuuuuuuauacacaua

SEQ ID NO: 2368699 - RNA, 16 nt, Human
auuuuccuugaagccg

SEQ ID NO: 2368700 - RNA, 14 nt, Human
auuuuccuuuucaa

SEQ ID NO: 2368701 - RNA, 13 nt, Human
auuuuccuugaag

SEQ ID NO: 2368702 - RNA, 14 nt, Human
auuuuccuugaagc

SEQ ID NO: 2368703 - RNA, 15 nt, Human
auuuuccuugaagcc

SEQ ID NO: 2368704 - RNA, 13 nt, Human
auuuuccugaaaa

SEQ ID NO: 2368705 - RNA, 22 nt, Human
auuuugggguacccacugcucu

SEQ ID NO: 2368706 - RNA, 23 nt, Human
auuuugggguacccacugcucug

SEQ ID NO: 2368707 - RNA, 19 nt, Human
auuuuggguuuugggucuu

SEQ ID NO: 2368708 - RNA, 22 nt, Human
auuuugguaaaauacuucuuga

SEQ ID NO: 2368709 - RNA, 15 nt, Human
auuuugguacuuuua

SEQ ID NO: 2368710 - RNA, 20 nt, Human
auuuugguauuacacuguau

SEQ ID NO: 2368711 - RNA, 21 nt, Human
auuuugguauuacacuguauu

SEQ ID NO: 2368712 - RNA, 16 nt, Human
auuuugggaaucuuuu

SEQ ID NO: 2368713 - RNA, 15 nt, Human
auuuugggaaucuuu

SEQ ID NO: 2368714 - RNA, 20 nt, Human
auuuugggguuguguuguca

SEQ ID NO: 2368715 - RNA, 16 nt, Human
caaaaaaugcuugcuu

SEQ ID NO: 2368716 - RNA, 17 nt, Human
auuuugguuuuguuccc

SEQ ID NO: 2368717 - RNA, 21 nt, Human
auuuugguuuuguuccccucc

SEQ ID NO: 2368718 - RNA, 22 nt, Human
auuuugguuuuguuccccuccu

SEQ ID NO: 2368719 - RNA, 23 nt, Human
auuuugguuuuguuccccuccuc

SEQ ID NO: 2368720 - RNA, 18 nt, Human
auuuugguccaaguugug

SEQ ID NO: 2368721 - RNA, 15 nt, Human
auuuuggugagaaau

SEQ ID NO: 2368722 - RNA, 14 nt, Human
auuuuggugagaaa

SEQ ID NO: 2368723 - RNA, 21 nt, Human
auuuuggugagaaaugggacu

SEQ ID NO: 2368724 - RNA, 16 nt, Human
auuuuggugagaaaug

SEQ ID NO: 2368725 - RNA, 16 nt, Human
auuuugguuuuguucc

SEQ ID NO: 2368726 - RNA, 19 nt, Human
auuuugguuguauucuuug

SEQ ID NO: 2368727 - RNA, 20 nt, Human
auuuugguuguauucuuuga

SEQ ID NO: 2368728 - RNA, 14 nt, Human
auuuugguuguauu

SEQ ID NO: 2368729 - RNA, 15 nt, Human
auuuugguuguauuc

SEQ ID NO: 2368730 - RNA, 16 nt, Human
auuuugguuguauucu

SEQ ID NO: 2368731 - RNA, 17 nt, Human
auuuugguuguauucuu

SEQ ID NO: 2368732 - RNA, 18 nt, Human
caaaacagcguuuaagac

SEQ ID NO: 2368733 - RNA, 19 nt, Human
caaaacagagaugugauaa

SEQ ID NO: 2368734 - RNA, 23 nt, Human
caaaacagcguuuaagacuguaa

SEQ ID NO: 2368735 - RNA, 22 nt, Human
caaaacaugucuccuauccugg

SEQ ID NO: 2368736 - RNA, 13 nt, Human
caaaaccacagcc

SEQ ID NO: 2368737 - RNA, 20 nt, Human
caaaacaaguuuuucuguca

SEQ ID NO: 2368738 - RNA, 21 nt, Human
caaaacaaaugccacacauca

SEQ ID NO: 2368739 - RNA, 19 nt, Human
caaaacacucggcauuuca

SEQ ID NO: 2368740 - RNA, 21 nt, Human
caaaaccacagcccugucagu

SEQ ID NO: 2368741 - RNA, 19 nt, Human
caaaaccacagcccuguca

SEQ ID NO: 2368742 - RNA, 18 nt, Human
caaaaccacagcccuguc

SEQ ID NO: 2368743 - RNA, 16 nt, Human
caaaaccacagcccug

SEQ ID NO: 2368744 - RNA, 13 nt, Human
caaaacccaccuu

SEQ ID NO: 2368745 - RNA, 15 nt, Human
caaaacccagaccug

SEQ ID NO: 2368746 - RNA, 13 nt, Human
caaaacccagacc

SEQ ID NO: 2368747 - RNA, 21 nt, Human
caaaaccugauguuaaaauuc

SEQ ID NO: 2368748 - RNA, 18 nt, Human
caaaaccugauguuaaaa

SEQ ID NO: 2368749 - RNA, 19 nt, Human
caaaaccccacuacacagu

SEQ ID NO: 2368750 - RNA, 21 nt, Human
caaaagaaaaaaaaaagcacc

SEQ ID NO: 2368751 - RNA, 13 nt, Human
caaaacuuaacau

SEQ ID NO: 2368752 - RNA, 23 nt, Human
caaaacuucagacauagaauuaa

SEQ ID NO: 2368753 - RNA, 17 nt, Human
caaaauaaaaaugaggu

SEQ ID NO: 2368754 - RNA, 19 nt, Human
caaaagaacaagaauuucu

SEQ ID NO: 2368755 - RNA, 19 nt, Human
caaaauaaaaagugacaca

SEQ ID NO: 2368756 - RNA, 21 nt, Human
caaaauaaaaagugacacagc

SEQ ID NO: 2368757 - RNA, 22 nt, Human
caaaacugccucaggaggcagg

SEQ ID NO: 2368758 - RNA, 14 nt, Human
caaaacugugcaga

SEQ ID NO: 2368759 - RNA, 22 nt, Human
caaaacucuccucugcugcugg

SEQ ID NO: 2368760 - RNA, 20 nt, Human
caaaacucuccucugcugcu

SEQ ID NO: 2368761 - RNA, 21 nt, Human
caaaacucuccucugcugcug

SEQ ID NO: 2368762 - RNA, 23 nt, Human
caaaacaaaaauuagguauuuug

SEQ ID NO: 2368763 - RNA, 22 nt, Human
caaaacaaaaauuagguauuuu

SEQ ID NO: 2368764 - RNA, 18 nt, Human
caaaacaaaaauuaggua

SEQ ID NO: 2368765 - RNA, 19 nt, Human
caaaaauuugcuucacuca

SEQ ID NO: 2368766 - RNA, 17 nt, Human
caaaacaaaaauuaggu

SEQ ID NO: 2368767 - RNA, 19 nt, Human
caaaaauucaacucagacu

SEQ ID NO: 2368768 - RNA, 16 nt, Human
caaaaauucucaguuc

SEQ ID NO: 2368769 - RNA, 18 nt, Human
caaaaauuagguauuuug

SEQ ID NO: 2368770 - RNA, 16 nt, Human
caaaaauuagguauuu

SEQ ID NO: 2368771 - RNA, 11 nt, Human
caaaaauuagg

SEQ ID NO: 2368772 - RNA, 20 nt, Human
caaaaauuagccgggcgugg

SEQ ID NO: 2368773 - RNA, 17 nt, Human
caaaaauuagccgggcg

SEQ ID NO: 2368774 - RNA, 15 nt, Human
caaaaauuagccggg

SEQ ID NO: 2368775 - RNA, 17 nt, Human
caaaaauuagccgggca

SEQ ID NO: 2368776 - RNA, 19 nt, Human
caaaaaugaaagcaugucu

SEQ ID NO: 2368777 - RNA, 17 nt, Human
caaaaaugaacugaagu

SEQ ID NO: 2368778 - RNA, 11 nt, Human
caaaaauauaa

SEQ ID NO: 2368779 - RNA, 12 nt, Human
caaaaauaaaua

SEQ ID NO: 2368780 - RNA, 17 nt, Human
caaaaaguguuuauuuu

SEQ ID NO: 2368781 - RNA, 22 nt, Human
caaaaauauuuauaaaacuucu

SEQ ID NO: 2368782 - RNA, 14 nt, Human
caaaaauauuuaua

SEQ ID NO: 2368783 - RNA, 15 nt, Human
caaaaauauaacuua

SEQ ID NO: 2368784 - RNA, 12 nt, Human
caaaaauauaaa

SEQ ID NO: 2368785 - RNA, 23 nt, Human
caaaaauauaaaauaugaagaca

SEQ ID NO: 2368786 - RNA, 20 nt, Human
caaaaagggaaacuauuguc

SEQ ID NO: 2368787 - RNA, 11 nt, Human
caaaaaguguu

SEQ ID NO: 2368788 - RNA, 12 nt, Human
caaaaaguguuu

SEQ ID NO: 2368789 - RNA, 15 nt, Human
caaaaaguuuccaua

SEQ ID NO: 2368790 - RNA, 14 nt, Human
caaaaagcuucccc

SEQ ID NO: 2368791 - RNA, 13 nt, Human
caaaaagcuuccc

SEQ ID NO: 2368792 - RNA, 19 nt, Human
caaaaaucucaauauuuca

SEQ ID NO: 2368793 - RNA, 15 nt, Human
caaaauguaggguua

SEQ ID NO: 2368794 - RNA, 13 nt, Human
caaaaugucugua

SEQ ID NO: 2368795 - RNA, 22 nt, Human
caaaaugucuguagcuccucaa

SEQ ID NO: 2368796 - RNA, 23 nt, Human
caaaauguaggcuuaguuugugu

SEQ ID NO: 2368797 - RNA, 23 nt, Human
caaaaugcuuuuuauuucugcau

SEQ ID NO: 2368798 - RNA, 20 nt, Human
caaaaugcuuuuuauuucug

SEQ ID NO: 2368799 - RNA, 18 nt, Human
caaaaugcuuuuuauuuc

SEQ ID NO: 2368800 - RNA, 18 nt, Human
caaaaugcucuagugccu

SEQ ID NO: 2368801 - RNA, 22 nt, Human
caaaaugaggaauguauauguu

SEQ ID NO: 2368802 - RNA, 20 nt, Human
caaaaugauggacccaaugc

SEQ ID NO: 2368803 - RNA, 14 nt, Human
caaaauaaaacuuu

SEQ ID NO: 2368804 - RNA, 22 nt, Human
caaaauaaaaagugacacagca

SEQ ID NO: 2368805 - RNA, 23 nt, Human
caaaauaaaaagugacacagcag

SEQ ID NO: 2368806 - RNA, 12 nt, Human
caaaauaaaacu

SEQ ID NO: 2368807 - RNA, 16 nt, Human
caaaauuauuucagaa

SEQ ID NO: 2368808 - RNA, 17 nt, Human
caaaauuauuucagaaa

SEQ ID NO: 2368809 - RNA, 15 nt, Human
caaaauuauuucaga

SEQ ID NO: 2368810 - RNA, 20 nt, Human
caaaauuaccaaaaaucuug

SEQ ID NO: 2368811 - RNA, 21 nt, Human
caaaauguuggucauuuuaug

SEQ ID NO: 2368812 - RNA, 18 nt, Human
caaaauguuggucauuuu

SEQ ID NO: 2368813 - RNA, 17 nt, Human
caaaauguuggucauuu

SEQ ID NO: 2368814 - RNA, 16 nt, Human
caaaauuguuacaaau

SEQ ID NO: 2368815 - RNA, 17 nt, Human
caaaauugcaaaucuug

SEQ ID NO: 2368816 - RNA, 16 nt, Human
caaaauugcaaaucuu

SEQ ID NO: 2368817 - RNA, 22 nt, Human
caaaauugauguguuuauuuau

SEQ ID NO: 2368818 - RNA, 13 nt, Human
caaaauugacauu

SEQ ID NO: 2368819 - RNA, 17 nt, Human
caaaauugacauugcuu

SEQ ID NO: 2368820 - RNA, 19 nt, Human
caaaauugacauugcuuua

SEQ ID NO: 2368821 - RNA, 11 nt, Human
caaaauuccca

SEQ ID NO: 2368822 - RNA, 13 nt, Human
caaaauucccagg

SEQ ID NO: 2368823 - RNA, 21 nt, Human
caaaauucgaccugauuuaca

SEQ ID NO: 2368824 - RNA, 23 nt, Human
caaaauucgaccugauuuacagu

SEQ ID NO: 2368825 - RNA, 15 nt, Human
caaaauugauguguu

SEQ ID NO: 2368826 - RNA, 16 nt, Human
caaaauugauguguuu

SEQ ID NO: 2368827 - RNA, 23 nt, Human
caaacacauuaagccuuccacac

SEQ ID NO: 2368828 - RNA, 21 nt, Human
caaacacaguuacacuugugc

SEQ ID NO: 2368829 - RNA, 15 nt, Human
caaacacauacagga

SEQ ID NO: 2368830 - RNA, 17 nt, Human
caaacaauggaaacuga

SEQ ID NO: 2368831 - RNA, 20 nt, Human
caaaauuuaguuuuuguucu

SEQ ID NO: 2368832 - RNA, 21 nt, Human
caaaauuuaguuuuuguucuu

SEQ ID NO: 2368833 - RNA, 14 nt, Human
caaacacaaaugca

SEQ ID NO: 2368834 - RNA, 15 nt, Human
caaacacaaaugcag

SEQ ID NO: 2368835 - RNA, 19 nt, Human
caaacaauggaaacugaau

SEQ ID NO: 2368836 - RNA, 20 nt, Human
caaacaauggaaacugaaug

SEQ ID NO: 2368837 - RNA, 21 nt, Human
caaacaauggaaacugaaugc

SEQ ID NO: 2368838 - RNA, 22 nt, Human
caaacaauggaaacugaaugcu

SEQ ID NO: 2368839 - RNA, 23 nt, Human
caaaauugggaaaggaguagaaa

SEQ ID NO: 2368840 - RNA, 22 nt, Human
caaaauugcaaaucuugaaauu

SEQ ID NO: 2368841 - RNA, 20 nt, Human
caaaauuguuuugagcuuuc

SEQ ID NO: 2368842 - RNA, 22 nt, Human
caaaauuguuuugagcuuucca

SEQ ID NO: 2368843 - RNA, 23 nt, Human
caaaauuguuuugagcuuuccau

SEQ ID NO: 2368844 - RNA, 17 nt, Human
caaaauuuaguuuuugu

SEQ ID NO: 2368845 - RNA, 16 nt, Human
caaaauuuuuucucua

SEQ ID NO: 2368846 - RNA, 21 nt, Human
caaaauuuuuucucuaggaaa

SEQ ID NO: 2368847 - RNA, 22 nt, Human
caaaauuuuuucucuaggaaau

SEQ ID NO: 2368848 - RNA, 13 nt, Human
caaacacauuaag

SEQ ID NO: 2368849 - RNA, 17 nt, Human
caaaccgccagcgaacu

SEQ ID NO: 2368850 - RNA, 21 nt, Human
caaaccgccagcgaacuugac

SEQ ID NO: 2368851 - RNA, 23 nt, Human
caaaccgccagcgaacuugacaa

SEQ ID NO: 2368852 - RNA, 15 nt, Human
caaaccuccucuucu

SEQ ID NO: 2368853 - RNA, 20 nt, Human
caaaccuagccccuuagccc

SEQ ID NO: 2368854 - RNA, 12 nt, Human
caaaccucuguu

SEQ ID NO: 2368855 - RNA, 11 nt, Human
caaaccucugu

SEQ ID NO: 2368856 - RNA, 21 nt, Human
caaaccuccaaaacuccugcc

SEQ ID NO: 2368857 - RNA, 14 nt, Human
caaacccuucagug

SEQ ID NO: 2368858 - RNA, 20 nt, Human
caaacccuucagugccaaaa

SEQ ID NO: 2368859 - RNA, 17 nt, Human
caaacgccuccccugcc

SEQ ID NO: 2368860 - RNA, 14 nt, Human
caaacgccuccccu

SEQ ID NO: 2368861 - RNA, 13 nt, Human
caaacgcuaaaga

SEQ ID NO: 2368862 - RNA, 21 nt, Human
caaacgcuaaagagcccuugc

SEQ ID NO: 2368863 - RNA, 22 nt, Human
caaacgcuaaagagcccuugcc

SEQ ID NO: 2368864 - RNA, 23 nt, Human
caaacgcuaaagagcccuugccu

SEQ ID NO: 2368865 - RNA, 19 nt, Human
caaaccucuguucagugua

SEQ ID NO: 2368866 - RNA, 15 nt, Human
caaaccucuguucag

SEQ ID NO: 2368867 - RNA, 14 nt, Human
caaaccucuguuca

SEQ ID NO: 2368868 - RNA, 13 nt, Human
caaaccucuguuc

SEQ ID NO: 2368869 - RNA, 17 nt, Human
caaacgcugccugccca

SEQ ID NO: 2368870 - RNA, 16 nt, Human
caaacgcugccugccc

SEQ ID NO: 2368871 - RNA, 19 nt, Human
caaacguauguaaauguau

SEQ ID NO: 2368872 - RNA, 15 nt, Human
caaacgcugccugcc

SEQ ID NO: 2368873 - RNA, 14 nt, Human
caaacgcugccugc

SEQ ID NO: 2368874 - RNA, 13 nt, Human
caaacgcugccug

SEQ ID NO: 2368875 - RNA, 12 nt, Human
caaacgcugccu

SEQ ID NO: 2368876 - RNA, 13 nt, Human
caaaggccagggu

SEQ ID NO: 2368877 - RNA, 15 nt, Human
caaaggccaggguca

SEQ ID NO: 2368878 - RNA, 13 nt, Human
caaaggccaugga

SEQ ID NO: 2368879 - RNA, 19 nt, Human
caaaggccauggagagcug

SEQ ID NO: 2368880 - RNA, 20 nt, Human
caaaggccauggagagcugg

SEQ ID NO: 2368881 - RNA, 21 nt, Human
caaaggccauggagagcugga

SEQ ID NO: 2368882 - RNA, 23 nt, Human
caaaggccauggagagcuggagc

SEQ ID NO: 2368883 - RNA, 23 nt, Human
caaaggcgcagugcuucucuaca

SEQ ID NO: 2368884 - RNA, 14 nt, Human
caaaggcugagaac

SEQ ID NO: 2368885 - RNA, 23 nt, Human
caaaggcugagaacacugugaaa

SEQ ID NO: 2368886 - RNA, 11 nt, Human
caaaggcuggg

SEQ ID NO: 2368887 - RNA, 17 nt, Human
caaaggccccagcaucu

SEQ ID NO: 2368888 - RNA, 13 nt, Human
caaaggcccccua

SEQ ID NO: 2368889 - RNA, 16 nt, Human
caaaggguaucaggug

SEQ ID NO: 2368890 - RNA, 18 nt, Human
caaaggguaucaggugcu

SEQ ID NO: 2368891 - RNA, 16 nt, Human
caaaggaagucuagga

SEQ ID NO: 2368892 - RNA, 19 nt, Human
caaaggaaucuccaguuuu

SEQ ID NO: 2368893 - RNA, 22 nt, Human
caaaggaaucuccaguuuucag

SEQ ID NO: 2368894 - RNA, 20 nt, Human
caaaggcacagugaaggcug

SEQ ID NO: 2368895 - RNA, 21 nt, Human
caaaggaaggacccugaggcc

SEQ ID NO: 2368896 - RNA, 17 nt, Human
caaaggaagguggaugg

SEQ ID NO: 2368897 - RNA, 14 nt, Human
caaaggaagcacau

SEQ ID NO: 2368898 - RNA, 23 nt, Human
caaagcucuauuaagauuuccaa

SEQ ID NO: 2368899 - RNA, 22 nt, Human
caaagcuaggguggcccuugca

SEQ ID NO: 2368900 - RNA, 21 nt, Human
caaagcuaggguggcccuugc

SEQ ID NO: 2368901 - RNA, 21 nt, Human
caaagccuugugucuacagag

SEQ ID NO: 2368902 - RNA, 23 nt, Human
caaagccuugugucuacagagaa

SEQ ID NO: 2368903 - RNA, 19 nt, Human
caaagcugaugacaacuuc

SEQ ID NO: 2368904 - RNA, 12 nt, Human
caaaggaagcac

SEQ ID NO: 2368905 - RNA, 13 nt, Human
caaaggaagcaca

SEQ ID NO: 2368906 - RNA, 13 nt, Human
caaagcuaggccu

SEQ ID NO: 2368907 - RNA, 14 nt, Human
caaagcuaggccug

SEQ ID NO: 2368908 - RNA, 19 nt, Human
caaagcuaggccuggccag

SEQ ID NO: 2368909 - RNA, 20 nt, Human
caaagcgaauuuuaaaagau

SEQ ID NO: 2368910 - RNA, 19 nt, Human
caaacuagggccaagccca

SEQ ID NO: 2368911 - RNA, 14 nt, Human
caaacuauuucuua

SEQ ID NO: 2368912 - RNA, 18 nt, Human
caaacuauuucuuauaua

SEQ ID NO: 2368913 - RNA, 17 nt, Human
caaacucaccugccccu

SEQ ID NO: 2368914 - RNA, 14 nt, Human
caaacguauguaaa

SEQ ID NO: 2368915 - RNA, 13 nt, Human
caaacuaagcccc

SEQ ID NO: 2368916 - RNA, 18 nt, Human
caaacgcugccugcccac

SEQ ID NO: 2368917 - RNA, 13 nt, Human
caaacuagggcca

SEQ ID NO: 2368918 - RNA, 19 nt, Human
caaacuaagcccccgcugu

SEQ ID NO: 2368919 - RNA, 20 nt, Human
caaacuaagcccccgcugua

SEQ ID NO: 2368920 - RNA, 16 nt, Human
caaacuacauguaauc

SEQ ID NO: 2368921 - RNA, 13 nt, Human
caaacuguugauu

SEQ ID NO: 2368922 - RNA, 20 nt, Human
caaacuguaaauaaaaagaa

SEQ ID NO: 2368923 - RNA, 14 nt, Human
caaacuguaaauaa

SEQ ID NO: 2368924 - RNA, 21 nt, Human
caaacuguaaauaaaaagaaa

SEQ ID NO: 2368925 - RNA, 21 nt, Human
caaacuggggccuccagaacu

SEQ ID NO: 2368926 - RNA, 17 nt, Human
caaacuggggccucccu

SEQ ID NO: 2368927 - RNA, 12 nt, Human
caaacuguaaau

SEQ ID NO: 2368928 - RNA, 19 nt, Human
caaacuggggccuccagaa

SEQ ID NO: 2368929 - RNA, 16 nt, Human
caaacuggggccucca

SEQ ID NO: 2368930 - RNA, 18 nt, Human
caaacucacugcucaaga

SEQ ID NO: 2368931 - RNA, 19 nt, Human
caaacucacugcucaagaa

SEQ ID NO: 2368932 - RNA, 14 nt, Human
caaacucagccuca

SEQ ID NO: 2368933 - RNA, 15 nt, Human
caaagccagacagca

SEQ ID NO: 2368934 - RNA, 14 nt, Human
caaagccagacagc

SEQ ID NO: 2368935 - RNA, 18 nt, Human
caaagccagaagcugagc

SEQ ID NO: 2368936 - RNA, 16 nt, Human
caaagccagaagcuga

SEQ ID NO: 2368937 - RNA, 14 nt, Human
caaagccagaagcu

SEQ ID NO: 2368938 - RNA, 13 nt, Human
caaagccagaagc

SEQ ID NO: 2368939 - RNA, 11 nt, Human
caaagccagaa

SEQ ID NO: 2368940 - RNA, 12 nt, Human
caaagccagaac

SEQ ID NO: 2368941 - RNA, 22 nt, Human
caaagccaaagcuaggccuggc

SEQ ID NO: 2368942 - RNA, 22 nt, Human
caaagccaacagucaaaacaga

SEQ ID NO: 2368943 - RNA, 18 nt, Human
caaagcccuuccaugucg

SEQ ID NO: 2368944 - RNA, 22 nt, Human
caaagccagcguccuccucugu

SEQ ID NO: 2368945 - RNA, 23 nt, Human
caaagccagcguccuccucugug

SEQ ID NO: 2368946 - RNA, 21 nt, Human
caaagccagcguccuccucug

SEQ ID NO: 2368947 - RNA, 20 nt, Human
caaagccagcguccuccucu

SEQ ID NO: 2368948 - RNA, 18 nt, Human
caaagccuccuccagccg

SEQ ID NO: 2368949 - RNA, 17 nt, Human
caaagccuccuccagcc

SEQ ID NO: 2368950 - RNA, 19 nt, Human
caaagcgaauuuuaaaaga

SEQ ID NO: 2368951 - RNA, 14 nt, Human
caaagcgaauuuua

SEQ ID NO: 2368952 - RNA, 11 nt, Human
caaagccuuau

SEQ ID NO: 2368953 - RNA, 18 nt, Human
caaagccuuaucaagugu

SEQ ID NO: 2368954 - RNA, 17 nt, Human
caaagccuugugucuac

SEQ ID NO: 2368955 - RNA, 21 nt, Human
caaauacuguguuucagaagc

SEQ ID NO: 2368956 - RNA, 14 nt, Human
caaauacucuuagg

SEQ ID NO: 2368957 - RNA, 17 nt, Human
caaauacucauguguau

SEQ ID NO: 2368958 - RNA, 18 nt, Human
caaauacucauguguaug

SEQ ID NO: 2368959 - RNA, 14 nt, Human
caaauacucaugug

SEQ ID NO: 2368960 - RNA, 15 nt, Human
caaauacucaugugu

SEQ ID NO: 2368961 - RNA, 16 nt, Human
caaauacucaugugua

SEQ ID NO: 2368962 - RNA, 22 nt, Human
caaagggggaggcuaaagccca

SEQ ID NO: 2368963 - RNA, 12 nt, Human
caaaggcuggga

SEQ ID NO: 2368964 - RNA, 13 nt, Human
caaaggcugggac

SEQ ID NO: 2368965 - RNA, 20 nt, Human
caaagugcugggauuacagg

SEQ ID NO: 2368966 - RNA, 23 nt, Human
caaagugcugggauuacaggugu

SEQ ID NO: 2368967 - RNA, 19 nt, Human
caaagugcugggauuacag

SEQ ID NO: 2368968 - RNA, 19 nt, Human
caaaggguaucaggugcug

SEQ ID NO: 2368969 - RNA, 20 nt, Human
caaaugguaggcauuuccua

SEQ ID NO: 2368970 - RNA, 15 nt, Human
caaaugguaggcauu

SEQ ID NO: 2368971 - RNA, 13 nt, Human
caaaugguaggca

SEQ ID NO: 2368972 - RNA, 23 nt, Human
caaauggggccagauccagccug

SEQ ID NO: 2368973 - RNA, 20 nt, Human
caaauggggccagauccagc

SEQ ID NO: 2368974 - RNA, 19 nt, Human
caaauggggccagauccag

SEQ ID NO: 2368975 - RNA, 18 nt, Human
caaauggggccagaucca

SEQ ID NO: 2368976 - RNA, 17 nt, Human
caaauggggccagaucc

SEQ ID NO: 2368977 - RNA, 16 nt, Human
caaauggggccagauc

SEQ ID NO: 2368978 - RNA, 15 nt, Human
caaauggggccagau

SEQ ID NO: 2368979 - RNA, 14 nt, Human
caaauggggccaga

SEQ ID NO: 2368980 - RNA, 20 nt, Human
caaauauuagaugugauuua

SEQ ID NO: 2368981 - RNA, 23 nt, Human
caaauauuagaugugauuuaaua

SEQ ID NO: 2368982 - RNA, 15 nt, Human
caaauauuagaugug

SEQ ID NO: 2368983 - RNA, 16 nt, Human
caaauauuagauguga

SEQ ID NO: 2368984 - RNA, 17 nt, Human
caaauauuagaugugau

SEQ ID NO: 2368985 - RNA, 19 nt, Human
caaauauuagaugugauuu

SEQ ID NO: 2368986 - RNA, 13 nt, Human
caaauauguccug

SEQ ID NO: 2368987 - RNA, 14 nt, Human
caaauauguccugg

SEQ ID NO: 2368988 - RNA, 15 nt, Human
caaauauguccuggg

SEQ ID NO: 2368989 - RNA, 17 nt, Human
caaauauguccuggggu

SEQ ID NO: 2368990 - RNA, 21 nt, Human
caaauaugcaaagcacugacu

SEQ ID NO: 2368991 - RNA, 19 nt, Human
caaauaugcaaagcacuga

SEQ ID NO: 2368992 - RNA, 19 nt, Human
caaauuguaucuagugcag

SEQ ID NO: 2368993 - RNA, 18 nt, Human
caaauuguaucuagugca

SEQ ID NO: 2368994 - RNA, 22 nt, Human
caaauuguaucuagugcagcug

SEQ ID NO: 2368995 - RNA, 15 nt, Human
caaauugugugaaag

SEQ ID NO: 2368996 - RNA, 21 nt, Human
caaauuguaagcaugcacaaa

SEQ ID NO: 2368997 - RNA, 11 nt, Human
caaauuucuaa

SEQ ID NO: 2368998 - RNA, 14 nt, Human
caaauuucuaaauc

SEQ ID NO: 2368999 - RNA, 12 nt, Human
caaauuucuaaa

SEQ ID NO: 2369000 - RNA, 21 nt, Human
caaauguaauugaauaaaguu

SEQ ID NO: 2369001 - RNA, 16 nt, Human
caaaugucagauacaa

SEQ ID NO: 2369002 - RNA, 19 nt, Human
caaaugucagauacaaugu

SEQ ID NO: 2369003 - RNA, 20 nt, Human
caaaugucagauacaaugua

SEQ ID NO: 2369004 - RNA, 17 nt, Human
caaaugucaucagaacu

SEQ ID NO: 2369005 - RNA, 18 nt, Human
caaaugucaucagaacuu

SEQ ID NO: 2369006 - RNA, 18 nt, Human
caaauguaauugaauaaa

SEQ ID NO: 2369007 - RNA, 23 nt, Human
caaaugguuuaacuucugccugu

SEQ ID NO: 2369008 - RNA, 19 nt, Human
caaauguccuccagaagcc

SEQ ID NO: 2369009 - RNA, 18 nt, Human
caaauguccuccagaagc

SEQ ID NO: 2369010 - RNA, 15 nt, Human
caaauuauuaaugaa

SEQ ID NO: 2369011 - RNA, 17 nt, Human
caaauuauuaaugaaaa

SEQ ID NO: 2369012 - RNA, 12 nt, Human
caaauuauuugu

SEQ ID NO: 2369013 - RNA, 14 nt, Human
caaauuauuugugu

SEQ ID NO: 2369014 - RNA, 15 nt, Human
caaauuauuugugua

SEQ ID NO: 2369015 - RNA, 16 nt, Human
caaauuauuuguguaa

SEQ ID NO: 2369016 - RNA, 20 nt, Human
caaauuauuuguguaauaga

SEQ ID NO: 2369017 - RNA, 17 nt, Human
caaauuauuuguguaau

SEQ ID NO: 2369018 - RNA, 18 nt, Human
caaauuauuuguguaaua

SEQ ID NO: 2369019 - RNA, 17 nt, Human
caaauuguaagcaugca

SEQ ID NO: 2369020 - RNA, 22 nt, Human
caagccagcgggaauggcagcu

SEQ ID NO: 2369021 - RNA, 17 nt, Human
caagccguggcuucccg

SEQ ID NO: 2369022 - RNA, 21 nt, Human
caagccagauuuuccugaaaa

SEQ ID NO: 2369023 - RNA, 13 nt, Human
caagcagggagga

SEQ ID NO: 2369024 - RNA, 15 nt, Human
caagcagggcucugc

SEQ ID NO: 2369025 - RNA, 22 nt, Human
caagccaccaacauacucccau

SEQ ID NO: 2369026 - RNA, 13 nt, Human
caagccagaggcu

SEQ ID NO: 2369027 - RNA, 15 nt, Human
caagccagaggcugg

SEQ ID NO: 2369028 - RNA, 16 nt, Human
caagccagaggcuggg

SEQ ID NO: 2369029 - RNA, 16 nt, Human
caagcaggaagcucag

SEQ ID NO: 2369030 - RNA, 15 nt, Human
caagcaggaagcuca

SEQ ID NO: 2369031 - RNA, 14 nt, Human
caagcaggacaugg

SEQ ID NO: 2369032 - RNA, 21 nt, Human
caagcaggaagcucagacugg

SEQ ID NO: 2369033 - RNA, 17 nt, Human
caagcaggaagcucaga

SEQ ID NO: 2369034 - RNA, 16 nt, Human
caagcaggaaguucaa

SEQ ID NO: 2369035 - RNA, 12 nt, Human
caagcagggagg

SEQ ID NO: 2369036 - RNA, 18 nt, Human
caagcaggacauggacaa

SEQ ID NO: 2369037 - RNA, 21 nt, Human
caagccugaccacgcuuucua

SEQ ID NO: 2369038 - RNA, 18 nt, Human
caagccguggcuucccgc

SEQ ID NO: 2369039 - RNA, 14 nt, Human
caagccugccuagg

SEQ ID NO: 2369040 - RNA, 22 nt, Human
caagccugcagucaucuugacc

SEQ ID NO: 2369041 - RNA, 23 nt, Human
caagccugcacaauaaaaauguu

SEQ ID NO: 2369042 - RNA, 13 nt, Human
caagccugcaacu

SEQ ID NO: 2369043 - RNA, 19 nt, Human
caagcgauucuucugcuuc

SEQ ID NO: 2369044 - RNA, 20 nt, Human
caagcgauucuucugcuuca

SEQ ID NO: 2369045 - RNA, 22 nt, Human
caagcgauucuucugcuucagc

SEQ ID NO: 2369046 - RNA, 11 nt, Human
caagcugggcc

SEQ ID NO: 2369047 - RNA, 14 nt, Human
caagccuggcaagg

SEQ ID NO: 2369048 - RNA, 19 nt, Human
caaggagggugagugcaag

SEQ ID NO: 2369049 - RNA, 18 nt, Human
caaggaggggcuguaaaa

SEQ ID NO: 2369050 - RNA, 12 nt, Human
caaggagggaga

SEQ ID NO: 2369051 - RNA, 21 nt, Human
caaggaggcuggcuggggccu

SEQ ID NO: 2369052 - RNA, 22 nt, Human
caaggaggcuggcuggggccua

SEQ ID NO: 2369053 - RNA, 20 nt, Human
caaggaggaaaaacagacaa

SEQ ID NO: 2369054 - RNA, 14 nt, Human
caaggaggcuggcu

SEQ ID NO: 2369055 - RNA, 16 nt, Human
caaggaggcuggcugg

SEQ ID NO: 2369056 - RNA, 19 nt, Human
caaggaggcuggcuggggc

SEQ ID NO: 2369057 - RNA, 14 nt, Human
caaggaggaaaaac

SEQ ID NO: 2369058 - RNA, 13 nt, Human
caaggaggaaaaa

SEQ ID NO: 2369059 - RNA, 12 nt, Human
caaggaggaaaa

SEQ ID NO: 2369060 - RNA, 22 nt, Human
caaggagcugcuauagccuggg

SEQ ID NO: 2369061 - RNA, 20 nt, Human
caaggagggugagugcaagg

SEQ ID NO: 2369062 - RNA, 17 nt, Human
caaggaggucugugcca

SEQ ID NO: 2369063 - RNA, 21 nt, Human
caaggcugaccaagagagaaa

SEQ ID NO: 2369064 - RNA, 20 nt, Human
caaggcugaccaagagagaa

SEQ ID NO: 2369065 - RNA, 17 nt, Human
caaggcugauuaaacca

SEQ ID NO: 2369066 - RNA, 14 nt, Human
caaggacugccgac

SEQ ID NO: 2369067 - RNA, 14 nt, Human
caaggacuuccugu

SEQ ID NO: 2369068 - RNA, 22 nt, Human
caaggacugcagggacugccag

SEQ ID NO: 2369069 - RNA, 23 nt, Human
caaggacuuccuguccagcucca

SEQ ID NO: 2369070 - RNA, 22 nt, Human
caaggacuuccuguccagcucc

SEQ ID NO: 2369071 - RNA, 21 nt, Human
caaggacuuccuguccagcuc

SEQ ID NO: 2369072 - RNA, 19 nt, Human
caaggacuuccuguccagc

SEQ ID NO: 2369073 - RNA, 20 nt, Human
caaggacuugaaagcaucca

SEQ ID NO: 2369074 - RNA, 16 nt, Human
caaggacuuugcagcc

SEQ ID NO: 2369075 - RNA, 18 nt, Human
caaggacuugaaagcauc

SEQ ID NO: 2369076 - RNA, 16 nt, Human
caaggacuugaaagca

SEQ ID NO: 2369077 - RNA, 15 nt, Human
caaggacuuugcagc

SEQ ID NO: 2369078 - RNA, 13 nt, Human
caaggagcugcua

SEQ ID NO: 2369079 - RNA, 11 nt, Human
caaggagcugc

SEQ ID NO: 2369080 - RNA, 14 nt, Human
caaggagccaaaca

SEQ ID NO: 2369081 - RNA, 17 nt, Human
caagcuggucccacuca

SEQ ID NO: 2369082 - RNA, 12 nt, Human
caagcugggccc

SEQ ID NO: 2369083 - RNA, 15 nt, Human
caagcugggccccag

SEQ ID NO: 2369084 - RNA, 16 nt, Human
caagcugggccccagc

SEQ ID NO: 2369085 - RNA, 17 nt, Human
caagcugggccccagcc

SEQ ID NO: 2369086 - RNA, 18 nt, Human
caagcugggccccagccc

SEQ ID NO: 2369087 - RNA, 19 nt, Human
caagcugggccccagccca

SEQ ID NO: 2369088 - RNA, 20 nt, Human
caagcugggccccagcccac

SEQ ID NO: 2369089 - RNA, 22 nt, Human
caagcugggccccagcccaccc

SEQ ID NO: 2369090 - RNA, 17 nt, Human
caaggaaggaaagaaag

SEQ ID NO: 2369091 - RNA, 16 nt, Human
caaggaaggaaagaaa

SEQ ID NO: 2369092 - RNA, 13 nt, Human
caaggaaggaaag

SEQ ID NO: 2369093 - RNA, 12 nt, Human
caaggaaggaaa

SEQ ID NO: 2369094 - RNA, 19 nt, Human
caagcuggucccacucagu

SEQ ID NO: 2369095 - RNA, 23 nt, Human
caaggaaggaaagaaagaaggaa

SEQ ID NO: 2369096 - RNA, 18 nt, Human
caaggaaggaaagaaaga

SEQ ID NO: 2369097 - RNA, 12 nt, Human
caaggaagucaa

SEQ ID NO: 2369098 - RNA, 16 nt, Human
caaggaagccacagcu

SEQ ID NO: 2369099 - RNA, 15 nt, Human
caaggacugcaggga

SEQ ID NO: 2369100 - RNA, 16 nt, Human
caagcaguagacaagc

SEQ ID NO: 2369101 - RNA, 23 nt, Human
caaggcugaccaagagagaaaga

SEQ ID NO: 2369102 - RNA, 21 nt, Human
caaggcugucaauuacaggaa

SEQ ID NO: 2369103 - RNA, 23 nt, Human
caaggcugucaauuacaggaagu

SEQ ID NO: 2369104 - RNA, 15 nt, Human
caaggcugcagugag

SEQ ID NO: 2369105 - RNA, 12 nt, Human
caaggcugcagu

SEQ ID NO: 2369106 - RNA, 17 nt, Human
caaggggcccaaauucu

SEQ ID NO: 2369107 - RNA, 18 nt, Human
caaggcugugcucccugg

SEQ ID NO: 2369108 - RNA, 17 nt, Human
caaggcugugcucccug

SEQ ID NO: 2369109 - RNA, 18 nt, Human
caaggcuguugcaugggc

SEQ ID NO: 2369110 - RNA, 18 nt, Human
caaggggcccaaauucuu

SEQ ID NO: 2369111 - RNA, 14 nt, Human
caaggcuguugcau

SEQ ID NO: 2369112 - RNA, 15 nt, Human
caagggggacugucu

SEQ ID NO: 2369113 - RNA, 21 nt, Human
caagggggaugacaugugacu

SEQ ID NO: 2369114 - RNA, 18 nt, Human
caaggguagggugggccu

SEQ ID NO: 2369115 - RNA, 20 nt, Human
caaggucauuuuuuuuaaga

SEQ ID NO: 2369116 - RNA, 14 nt, Human
caaggucauuuuuu

SEQ ID NO: 2369117 - RNA, 16 nt, Human
caaggucgguaaguug

SEQ ID NO: 2369118 - RNA, 22 nt, Human
caagguccucugucagucacag

SEQ ID NO: 2369119 - RNA, 21 nt, Human
caagguccucugucagucaca

SEQ ID NO: 2369120 - RNA, 20 nt, Human
caagguccucugucagucac

SEQ ID NO: 2369121 - RNA, 20 nt, Human
caagucccuguaauuguugu

SEQ ID NO: 2369122 - RNA, 11 nt, Human
caagucccugu

SEQ ID NO: 2369123 - RNA, 14 nt, Human
caaguccucuuuuc

SEQ ID NO: 2369124 - RNA, 22 nt, Human
caagucccuguuuucugagccc

SEQ ID NO: 2369125 - RNA, 23 nt, Human
caagucccuguuuucugagcccg

SEQ ID NO: 2369126 - RNA, 19 nt, Human
caagucccuguuuucugag

SEQ ID NO: 2369127 - RNA, 20 nt, Human
caagucccuguuuucugagc

SEQ ID NO: 2369128 - RNA, 21 nt, Human
caagucccuguuuucugagcc

SEQ ID NO: 2369129 - RNA, 21 nt, Human
caaguguaaaauauuuugaau

SEQ ID NO: 2369130 - RNA, 23 nt, Human
caaguguaaaauauuuugaauca

SEQ ID NO: 2369131 - RNA, 14 nt, Human
caaguguauaucag

SEQ ID NO: 2369132 - RNA, 20 nt, Human
caagugucucaguccaccug

SEQ ID NO: 2369133 - RNA, 17 nt, Human
caagugucucaguccac

SEQ ID NO: 2369134 - RNA, 13 nt, Human
caagugucuucca

SEQ ID NO: 2369135 - RNA, 14 nt, Human
caagugucuuccau

SEQ ID NO: 2369136 - RNA, 22 nt, Human
caaguguaugcacgugugcaca

SEQ ID NO: 2369137 - RNA, 18 nt, Human
caaguguauaucagaaaa

SEQ ID NO: 2369138 - RNA, 16 nt, Human
caaguguauaucagaa

SEQ ID NO: 2369139 - RNA, 14 nt, Human
caaguuaaauaaau

SEQ ID NO: 2369140 - RNA, 15 nt, Human
caagugugcauauug

SEQ ID NO: 2369141 - RNA, 17 nt, Human
caagugugcauauugua

SEQ ID NO: 2369142 - RNA, 19 nt, Human
caagugugaacaaaagaug

SEQ ID NO: 2369143 - RNA, 15 nt, Human
caagugucuuccauc

SEQ ID NO: 2369144 - RNA, 14 nt, Human
caagugugaacaaa

SEQ ID NO: 2369145 - RNA, 19 nt, Human
caaguggaccuugagacca

SEQ ID NO: 2369146 - RNA, 23 nt, Human
caaguggaccuuaggccuuccuc

SEQ ID NO: 2369147 - RNA, 16 nt, Human
caaguggacucagggc

SEQ ID NO: 2369148 - RNA, 15 nt, Human
caaguggacucaggg

SEQ ID NO: 2369149 - RNA, 22 nt, Human
caaguggaccuuaggccuuccu

SEQ ID NO: 2369150 - RNA, 21 nt, Human
caaguggaccuuaggccuucc

SEQ ID NO: 2369151 - RNA, 12 nt, Human
caaguggaccuu

SEQ ID NO: 2369152 - RNA, 19 nt, Human
caaguggcucccacacccu

SEQ ID NO: 2369153 - RNA, 18 nt, Human
caaguggcagagcuugga

SEQ ID NO: 2369154 - RNA, 23 nt, Human
caaguggcagagcuuggacugga

SEQ ID NO: 2369155 - RNA, 23 nt, Human
caaguggacucagggcagcgcca

SEQ ID NO: 2369156 - RNA, 18 nt, Human
caaguggacucagggcag

SEQ ID NO: 2369157 - RNA, 16 nt, Human
caaguccugaagaggc

SEQ ID NO: 2369158 - RNA, 14 nt, Human
caaguccugaagag

SEQ ID NO: 2369159 - RNA, 15 nt, Human
caaguccugaagagg

SEQ ID NO: 2369160 - RNA, 19 nt, Human
caaguccugaagaggcggg

SEQ ID NO: 2369161 - RNA, 18 nt, Human
caagugagagcugggugu

SEQ ID NO: 2369162 - RNA, 21 nt, Human
caagugauucucaugccucag

SEQ ID NO: 2369163 - RNA, 20 nt, Human
caagugauucucaugccuca

SEQ ID NO: 2369164 - RNA, 18 nt, Human
caagugauucucaugccu

SEQ ID NO: 2369165 - RNA, 17 nt, Human
caagugauucucaugcc

SEQ ID NO: 2369166 - RNA, 21 nt, Human
caaguccucuuuucugagagg

SEQ ID NO: 2369167 - RNA, 14 nt, Human
caagugagagcugg

SEQ ID NO: 2369168 - RNA, 15 nt, Human
caagugagagcuggg

SEQ ID NO: 2369169 - RNA, 17 nt, Human
caagugagagcugggug

SEQ ID NO: 2369170 - RNA, 20 nt, Human
caagaggcuguucccaccag

SEQ ID NO: 2369171 - RNA, 16 nt, Human
caagagggaauccccg

SEQ ID NO: 2369172 - RNA, 13 nt, Human
caagagggcacug

SEQ ID NO: 2369173 - RNA, 19 nt, Human
caagagggacgccuggggg

SEQ ID NO: 2369174 - RNA, 17 nt, Human
caagagggacgccuggg

SEQ ID NO: 2369175 - RNA, 16 nt, Human
caagagcccaggccuc

SEQ ID NO: 2369176 - RNA, 16 nt, Human
caagaggcugcagcca

SEQ ID NO: 2369177 - RNA, 14 nt, Human
caagaggcugcagc

SEQ ID NO: 2369178 - RNA, 15 nt, Human
caagcaccuccugcc

SEQ ID NO: 2369179 - RNA, 14 nt, Human
caagagggcacugg

SEQ ID NO: 2369180 - RNA, 15 nt, Human
caagagggcacuggu

SEQ ID NO: 2369181 - RNA, 16 nt, Human
caagcaccuccugccu

SEQ ID NO: 2369182 - RNA, 17 nt, Human
caagcaccuccugccuc

SEQ ID NO: 2369183 - RNA, 15 nt, Human
caagacucugucuca

SEQ ID NO: 2369184 - RNA, 22 nt, Human
caagacucccucgucgagcugg

SEQ ID NO: 2369185 - RNA, 23 nt, Human
caagacgcugugcugcccugccc

SEQ ID NO: 2369186 - RNA, 18 nt, Human
caagaagacauggagacu

SEQ ID NO: 2369187 - RNA, 19 nt, Human
caagacgcugugcugcccu

SEQ ID NO: 2369188 - RNA, 19 nt, Human
caagaagaagggcacccua

SEQ ID NO: 2369189 - RNA, 22 nt, Human
caagaagaaaugcuuuccaaaa

SEQ ID NO: 2369190 - RNA, 12 nt, Human
caagaagacaug

SEQ ID NO: 2369191 - RNA, 18 nt, Human
caagacgcugugcugccc

SEQ ID NO: 2369192 - RNA, 18 nt, Human
caagacucuuuggacacu

SEQ ID NO: 2369193 - RNA, 13 nt, Human
caagagcccaggc

SEQ ID NO: 2369194 - RNA, 19 nt, Human
caagacugcacaucaaaau

SEQ ID NO: 2369195 - RNA, 14 nt, Human
caagagcccaggcc

SEQ ID NO: 2369196 - RNA, 15 nt, Human
caagagcccaggccu

SEQ ID NO: 2369197 - RNA, 14 nt, Human
caagaacucugggc

SEQ ID NO: 2369198 - RNA, 16 nt, Human
caagaaauuugauuuc

SEQ ID NO: 2369199 - RNA, 20 nt, Human
caagaacuuuccaggaaggc

SEQ ID NO: 2369200 - RNA, 14 nt, Human
caagaccuucuccu

SEQ ID NO: 2369201 - RNA, 16 nt, Human
caagaccuucuccuuc

SEQ ID NO: 2369202 - RNA, 17 nt, Human
caagaccuucuccuuca

SEQ ID NO: 2369203 - RNA, 18 nt, Human
caagaccuucuccuucac

SEQ ID NO: 2369204 - RNA, 16 nt, Human
caagacgcugugcugc

SEQ ID NO: 2369205 - RNA, 17 nt, Human
caagacgcugugcugcc

SEQ ID NO: 2369206 - RNA, 21 nt, Human
caacugaggcagacagcagcu

SEQ ID NO: 2369207 - RNA, 20 nt, Human
caacugaggcagacagcagc

SEQ ID NO: 2369208 - RNA, 17 nt, Human
caacugaggcagacagc

SEQ ID NO: 2369209 - RNA, 16 nt, Human
caacugaggcagacag

SEQ ID NO: 2369210 - RNA, 14 nt, Human
caacugaggcagac

SEQ ID NO: 2369211 - RNA, 13 nt, Human
caacugaggcaga

SEQ ID NO: 2369212 - RNA, 19 nt, Human
caacugaccagccuccaug

SEQ ID NO: 2369213 - RNA, 22 nt, Human
caacugaggcagacagcagcuc

SEQ ID NO: 2369214 - RNA, 21 nt, Human
caacuuuguggaugucuuccu

SEQ ID NO: 2369215 - RNA, 20 nt, Human
caacuuuuccuuugaauccu

SEQ ID NO: 2369216 - RNA, 22 nt, Human
caacuuuguggaugucuuccuu

SEQ ID NO: 2369217 - RNA, 18 nt, Human
caagaaaacaacuucaau

SEQ ID NO: 2369218 - RNA, 13 nt, Human
caagaaauuugau

SEQ ID NO: 2369219 - RNA, 15 nt, Human
caagaaaacaacuuc

SEQ ID NO: 2369220 - RNA, 20 nt, Human
caacacugggaaacagaggc

SEQ ID NO: 2369221 - RNA, 13 nt, Human
caacacuggugug

SEQ ID NO: 2369222 - RNA, 18 nt, Human
caacacuggugugaccug

SEQ ID NO: 2369223 - RNA, 22 nt, Human
caaccccuucgcuccugugucu

SEQ ID NO: 2369224 - RNA, 11 nt, Human
caaauuucaca

SEQ ID NO: 2369225 - RNA, 22 nt, Human
caacacucacauuuauucugcu

SEQ ID NO: 2369226 - RNA, 18 nt, Human
caacacucauugaccuga

SEQ ID NO: 2369227 - RNA, 20 nt, Human
caacacucauugaccugagg

SEQ ID NO: 2369228 - RNA, 22 nt, Human
caacacucauugaccugaggcc

SEQ ID NO: 2369229 - RNA, 16 nt, Human
caacccugccccugcc

SEQ ID NO: 2369230 - RNA, 15 nt, Human
caacccugccccugc

SEQ ID NO: 2369231 - RNA, 14 nt, Human
caacccugccccug

SEQ ID NO: 2369232 - RNA, 13 nt, Human
caacccugccccu

SEQ ID NO: 2369233 - RNA, 11 nt, Human
caacccugccc

SEQ ID NO: 2369234 - RNA, 22 nt, Human
caacccugcaaaggacuguuuu

SEQ ID NO: 2369235 - RNA, 12 nt, Human
caacccugcaaa

SEQ ID NO: 2369236 - RNA, 11 nt, Human
caacccugcaa

SEQ ID NO: 2369237 - RNA, 22 nt, Human
caacccucccucagccccucuu

SEQ ID NO: 2369238 - RNA, 21 nt, Human
caacccucccucagccccucu

SEQ ID NO: 2369239 - RNA, 20 nt, Human
caacccucccucagccccuc

SEQ ID NO: 2369240 - RNA, 19 nt, Human
caacccucccucagccccu

SEQ ID NO: 2369241 - RNA, 22 nt, Human
caacccuccuaucaccuccccu

SEQ ID NO: 2369242 - RNA, 19 nt, Human
caacccuccuaucaccucc

SEQ ID NO: 2369243 - RNA, 15 nt, Human
caacccuccuaucac

SEQ ID NO: 2369244 - RNA, 21 nt, Human
caaccgaugcuccagccaacc

SEQ ID NO: 2369245 - RNA, 18 nt, Human
caaccgaugcuccagcca

SEQ ID NO: 2369246 - RNA, 17 nt, Human
caaccgaugcuccagcc

SEQ ID NO: 2369247 - RNA, 14 nt, Human
caaccgaugcucca

SEQ ID NO: 2369248 - RNA, 23 nt, Human
caacccuggagaguucaauggcu

SEQ ID NO: 2369249 - RNA, 19 nt, Human
caacccuggcauuaugucc

SEQ ID NO: 2369250 - RNA, 22 nt, Human
caacccugccccugccccguca

SEQ ID NO: 2369251 - RNA, 13 nt, Human
caacccuggagag

SEQ ID NO: 2369252 - RNA, 23 nt, Human
caacccugccccugccccgucac

SEQ ID NO: 2369253 - RNA, 17 nt, Human
caacccuggcacccagg

SEQ ID NO: 2369254 - RNA, 16 nt, Human
caacccgaggcccgca

SEQ ID NO: 2369255 - RNA, 14 nt, Human
caacacugugcccu

SEQ ID NO: 2369256 - RNA, 15 nt, Human
caacacugugcccug

SEQ ID NO: 2369257 - RNA, 13 nt, Human
caacacugugccc

SEQ ID NO: 2369258 - RNA, 22 nt, Human
caacacuggugugaccugaggg

SEQ ID NO: 2369259 - RNA, 23 nt, Human
caacacuggugugaccugagggc

SEQ ID NO: 2369260 - RNA, 13 nt, Human
caacccucagagc

SEQ ID NO: 2369261 - RNA, 15 nt, Human
caaccuccugggcua

SEQ ID NO: 2369262 - RNA, 16 nt, Human
caaccuguaauaaaua

SEQ ID NO: 2369263 - RNA, 13 nt, Human
caaccucuggagc

SEQ ID NO: 2369264 - RNA, 17 nt, Human
caaccuguaauaaauau

SEQ ID NO: 2369265 - RNA, 18 nt, Human
caaccuguaauaaauaug

SEQ ID NO: 2369266 - RNA, 19 nt, Human
caaccuguaauaaauauga

SEQ ID NO: 2369267 - RNA, 21 nt, Human
caaccuguaauaaauaugagu

SEQ ID NO: 2369268 - RNA, 22 nt, Human
caaccuguaauaaauaugagug

SEQ ID NO: 2369269 - RNA, 18 nt, Human
caaccguuggaaacauaa

SEQ ID NO: 2369270 - RNA, 16 nt, Human
caacacugugcccugg

SEQ ID NO: 2369271 - RNA, 14 nt, Human
caaccuccugggcu

SEQ ID NO: 2369272 - RNA, 20 nt, Human
caaccggggagcccccgccc

SEQ ID NO: 2369273 - RNA, 19 nt, Human
caaccggggagcccccgcc

SEQ ID NO: 2369274 - RNA, 21 nt, Human
caaccgguggauccucaaaca

SEQ ID NO: 2369275 - RNA, 22 nt, Human
caaccgaugcuccagccaaccc

SEQ ID NO: 2369276 - RNA, 22 nt, Human
caaccgccacacacacaggagc

SEQ ID NO: 2369277 - RNA, 15 nt, Human
caacugaccagccuc

SEQ ID NO: 2369278 - RNA, 17 nt, Human
caacugaccagccucca

SEQ ID NO: 2369279 - RNA, 13 nt, Human
caacgugcauugu

SEQ ID NO: 2369280 - RNA, 15 nt, Human
caacguagcuucuac

SEQ ID NO: 2369281 - RNA, 16 nt, Human
caacgugcauugugcu

SEQ ID NO: 2369282 - RNA, 17 nt, Human
caacgugcauugugcuu

SEQ ID NO: 2369283 - RNA, 13 nt, Human
caacgucugugcc

SEQ ID NO: 2369284 - RNA, 14 nt, Human
caacgucugugcca

SEQ ID NO: 2369285 - RNA, 20 nt, Human
caaccuguuaccuacuuuga

SEQ ID NO: 2369286 - RNA, 23 nt, Human
caaccuguuaccuacuuugacuu

SEQ ID NO: 2369287 - RNA, 22 nt, Human
caaccuguuaccuacuuugacu

SEQ ID NO: 2369288 - RNA, 20 nt, Human
caaccuguucugcuuuccuc

SEQ ID NO: 2369289 - RNA, 18 nt, Human
caaccuuagauguucuaa

SEQ ID NO: 2369290 - RNA, 17 nt, Human
caaccuuagauguucua

SEQ ID NO: 2369291 - RNA, 21 nt, Human
caacggagagcgccugccccu

SEQ ID NO: 2369292 - RNA, 22 nt, Human
caacgcuuaaaggugucuuccu

SEQ ID NO: 2369293 - RNA, 21 nt, Human
caacgcuuaaaggugucuucc

SEQ ID NO: 2369294 - RNA, 19 nt, Human
caaccuucgccaccugggu

SEQ ID NO: 2369295 - RNA, 11 nt, Human
caauguuaagg

SEQ ID NO: 2369296 - RNA, 15 nt, Human
caaugugauucuaau

SEQ ID NO: 2369297 - RNA, 12 nt, Human
caaugugcagug

SEQ ID NO: 2369298 - RNA, 13 nt, Human
caaugugcagugu

SEQ ID NO: 2369299 - RNA, 14 nt, Human
caauguuaaggaaa

SEQ ID NO: 2369300 - RNA, 16 nt, Human
caauguuaaggaaacu

SEQ ID NO: 2369301 - RNA, 18 nt, Human
caauguuaaggaaacucu

SEQ ID NO: 2369302 - RNA, 16 nt, Human
caaugucaggaacaga

SEQ ID NO: 2369303 - RNA, 17 nt, Human
caaugugauaaaacccc

SEQ ID NO: 2369304 - RNA, 15 nt, Human
caaugugauaaaacc

SEQ ID NO: 2369305 - RNA, 23 nt, Human
caauguucauuguaauguuacug

SEQ ID NO: 2369306 - RNA, 22 nt, Human
caauguucauuguaauguuacu

SEQ ID NO: 2369307 - RNA, 23 nt, Human
caauuaaggauuuuaugcuuuaa

SEQ ID NO: 2369308 - RNA, 18 nt, Human
caauuaauaaaaaaugga

SEQ ID NO: 2369309 - RNA, 12 nt, Human
caauuaauuuuu

SEQ ID NO: 2369310 - RNA, 18 nt, Human
caauguucauuguaaugu

SEQ ID NO: 2369311 - RNA, 15 nt, Human
caauguucauuguaa

SEQ ID NO: 2369312 - RNA, 14 nt, Human
caauguucauugua

SEQ ID NO: 2369313 - RNA, 13 nt, Human
caauguucauugu

SEQ ID NO: 2369314 - RNA, 12 nt, Human
caauguucauug

SEQ ID NO: 2369315 - RNA, 15 nt, Human
caauguucaucccau

SEQ ID NO: 2369316 - RNA, 14 nt, Human
caauguucauccca

SEQ ID NO: 2369317 - RNA, 19 nt, Human
caauguuacuaucugcuuu

SEQ ID NO: 2369318 - RNA, 19 nt, Human
caauguuaaggaaacucuu

SEQ ID NO: 2369319 - RNA, 20 nt, Human
caauguuaaggaaacucuua

SEQ ID NO: 2369320 - RNA, 13 nt, Human
caauguucaucau

SEQ ID NO: 2369321 - RNA, 24 nt, Human
caauguuaaggaaacucuuaucuc

SEQ ID NO: 2369322 - RNA, 23 nt, Human
caauucucauuugucacacacuu

SEQ ID NO: 2369323 - RNA, 16 nt, Human
caauucgauauccgga

SEQ ID NO: 2369324 - RNA, 13 nt, Human
caauucuccugcc

SEQ ID NO: 2369325 - RNA, 16 nt, Human
caauuacaggaaguac

SEQ ID NO: 2369326 - RNA, 22 nt, Human
caauuaauuuuuuuauuguuua

SEQ ID NO: 2369327 - RNA, 23 nt, Human
caauuaauuuuuuuauuguuuaa

SEQ ID NO: 2369328 - RNA, 15 nt, Human
caauuaauaaaaaau

SEQ ID NO: 2369329 - RNA, 13 nt, Human
caauuaauuuuuu

SEQ ID NO: 2369330 - RNA, 19 nt, Human
caauuaauuuuuuuauugu

SEQ ID NO: 2369331 - RNA, 20 nt, Human
caauuaauuuuuuuauuguu

SEQ ID NO: 2369332 - RNA, 16 nt, Human
caauuugggagauaua

SEQ ID NO: 2369333 - RNA, 15 nt, Human
caauucuccugccuc

SEQ ID NO: 2369334 - RNA, 14 nt, Human
caauucuccugccu

SEQ ID NO: 2369335 - RNA, 14 nt, Human
caaugacucucugg

SEQ ID NO: 2369336 - RNA, 17 nt, Human
caaugaggucugaaaug

SEQ ID NO: 2369337 - RNA, 17 nt, Human
caaugcacuuuguucug

SEQ ID NO: 2369338 - RNA, 18 nt, Human
caaugaggucugaaaugg

SEQ ID NO: 2369339 - RNA, 19 nt, Human
caaugggagcugaggccac

SEQ ID NO: 2369340 - RNA, 23 nt, Human
caaugggagcugaggccacacuc

SEQ ID NO: 2369341 - RNA, 22 nt, Human
caaugcacuuuguucuggcucu

SEQ ID NO: 2369342 - RNA, 20 nt, Human
caaugcacuuuguucuggcu

SEQ ID NO: 2369343 - RNA, 21 nt, Human
caaugcacuuuguucuggcuc

SEQ ID NO: 2369344 - RNA, 19 nt, Human
caauguagaggggaaaaga

SEQ ID NO: 2369345 - RNA, 20 nt, Human
caauguauugauaagagggc

SEQ ID NO: 2369346 - RNA, 15 nt, Human
caauguauuuauuua

SEQ ID NO: 2369347 - RNA, 17 nt, Human
caauguagaaagcuuug

SEQ ID NO: 2369348 - RNA, 19 nt, Human
caaugucaggaacagaagg

SEQ ID NO: 2369349 - RNA, 14 nt, Human
caaugucaggaaca

SEQ ID NO: 2369350 - RNA, 14 nt, Human
caaugucacuuaaa

SEQ ID NO: 2369351 - RNA, 18 nt, Human
caauguauuuauuuaaaa

SEQ ID NO: 2369352 - RNA, 20 nt, Human
caauguauuuauuuaaaaga

SEQ ID NO: 2369353 - RNA, 22 nt, Human
caauguauuuauuuaaaagauu

SEQ ID NO: 2369354 - RNA, 23 nt, Human
caauguauuuauuuaaaagauuc

SEQ ID NO: 2369355 - RNA, 22 nt, Human
caaugguguugcccugagugga

SEQ ID NO: 2369356 - RNA, 22 nt, Human
caaugguguucaccaucggcag

SEQ ID NO: 2369357 - RNA, 17 nt, Human
caaugguguugcccuga

SEQ ID NO: 2369358 - RNA, 23 nt, Human
caauggguuuuucccuguacagu

SEQ ID NO: 2369359 - RNA, 22 nt, Human
caauggggauguuguguuucug

SEQ ID NO: 2369360 - RNA, 18 nt, Human
caaugggcacugggauga

SEQ ID NO: 2369361 - RNA, 21 nt, Human
caaugggagcugaggccacac

SEQ ID NO: 2369362 - RNA, 15 nt, Human
caaugggcaaugaca

SEQ ID NO: 2369363 - RNA, 15 nt, Human
caaugggcacuggga

SEQ ID NO: 2369364 - RNA, 17 nt, Human
caaugggcacugggaug

SEQ ID NO: 2369365 - RNA, 19 nt, Human
caaugggcacugggaugag

SEQ ID NO: 2369366 - RNA, 19 nt, Human
caaucuuaaggggcagcuu

SEQ ID NO: 2369367 - RNA, 21 nt, Human
caaugaccuuucaauaggaaa

SEQ ID NO: 2369368 - RNA, 15 nt, Human
caaugacuuacugua

SEQ ID NO: 2369369 - RNA, 18 nt, Human
caaugacuuacuguacau

SEQ ID NO: 2369370 - RNA, 17 nt, Human
caaugacuuacuguaca

SEQ ID NO: 2369371 - RNA, 19 nt, Human
caaucugacauucucagga

SEQ ID NO: 2369372 - RNA, 17 nt, Human
caaucuguaaacugugu

SEQ ID NO: 2369373 - RNA, 16 nt, Human
caaucuguaaacugug

SEQ ID NO: 2369374 - RNA, 15 nt, Human
caaucuguaaacugu

SEQ ID NO: 2369375 - RNA, 12 nt, Human
caaucuguaaac

SEQ ID NO: 2369376 - RNA, 18 nt, Human
caaucuguaaacugugua

SEQ ID NO: 2369377 - RNA, 23 nt, Human
caaugaccuuucaauaggaaaaa

SEQ ID NO: 2369378 - RNA, 12 nt, Human
caauauagcaag

SEQ ID NO: 2369379 - RNA, 19 nt, Human
caauauagaaacacgaacu

SEQ ID NO: 2369380 - RNA, 19 nt, Human
caauauaucuaaauugaau

SEQ ID NO: 2369381 - RNA, 13 nt, Human
caauauagcaaga

SEQ ID NO: 2369382 - RNA, 23 nt, Human
caauauaaaaggcaaauguguac

SEQ ID NO: 2369383 - RNA, 12 nt, Human
caauauagaaac

SEQ ID NO: 2369384 - RNA, 14 nt, Human
caauauagaaacac

SEQ ID NO: 2369385 - RNA, 17 nt, Human
caauauucgcuguguca

SEQ ID NO: 2369386 - RNA, 20 nt, Human
caauauaucuaaauugaaua

SEQ ID NO: 2369387 - RNA, 21 nt, Human
caauauaucuaaauugaauaa

SEQ ID NO: 2369388 - RNA, 22 nt, Human
caauauaucuaaauugaauaau

SEQ ID NO: 2369389 - RNA, 14 nt, Human
caauauugacuuug

SEQ ID NO: 2369390 - RNA, 15 nt, Human
caauauugaacuuuu

SEQ ID NO: 2369391 - RNA, 21 nt, Human
caauauuccugaaugaaauau

SEQ ID NO: 2369392 - RNA, 16 nt, Human
caauauugacuuuguc

SEQ ID NO: 2369393 - RNA, 17 nt, Human
caaucugacauucucag

SEQ ID NO: 2369394 - RNA, 17 nt, Human
caauauugacuuugucu

SEQ ID NO: 2369395 - RNA, 14 nt, Human
caauauuguacagu

SEQ ID NO: 2369396 - RNA, 14 nt, Human
caauaauuucaggu

SEQ ID NO: 2369397 - RNA, 16 nt, Human
caauaauugcagaacu

SEQ ID NO: 2369398 - RNA, 22 nt, Human
caauaauuucagguuuuguaaa

SEQ ID NO: 2369399 - RNA, 23 nt, Human
caauaauggucccauccaggcag

SEQ ID NO: 2369400 - RNA, 19 nt, Human
caauaauggucccauccag

SEQ ID NO: 2369401 - RNA, 20 nt, Human
caauaauggucccauccagg

SEQ ID NO: 2369402 - RNA, 18 nt, Human
caauaauauauuuucugu

SEQ ID NO: 2369403 - RNA, 17 nt, Human
caauaauggucccaucc

SEQ ID NO: 2369404 - RNA, 18 nt, Human
caauaauggucccaucca

SEQ ID NO: 2369405 - RNA, 20 nt, Human
caauaauauauuuucuguuu

SEQ ID NO: 2369406 - RNA, 13 nt, Human
caauaauauauuu

SEQ ID NO: 2369407 - RNA, 14 nt, Human
caauaauauauuuu

SEQ ID NO: 2369408 - RNA, 16 nt, Human
caauaauauauuuucu

SEQ ID NO: 2369409 - RNA, 17 nt, Human
caauaauauauuuucug

SEQ ID NO: 2369410 - RNA, 13 nt, Human
caaguuagcucag

SEQ ID NO: 2369411 - RNA, 16 nt, Human
caaguuagaaaacaua

SEQ ID NO: 2369412 - RNA, 22 nt, Human
caagugugcauauuguacacuu

SEQ ID NO: 2369413 - RNA, 19 nt, Human
caagugugcuuuagcuuga

SEQ ID NO: 2369414 - RNA, 18 nt, Human
caagugugcauauuguac

SEQ ID NO: 2369415 - RNA, 21 nt, Human
caagugugcauauuguacacu

SEQ ID NO: 2369416 - RNA, 23 nt, Human
caagugugcauauuguacacuuu

SEQ ID NO: 2369417 - RNA, 19 nt, Human
caaguuagcucaggaggcu

SEQ ID NO: 2369418 - RNA, 17 nt, Human
caaguuagcucaggagg

SEQ ID NO: 2369419 - RNA, 16 nt, Human
caaguuagcucaggag

SEQ ID NO: 2369420 - RNA, 14 nt, Human
caaguuagcucagg

SEQ ID NO: 2369421 - RNA, 20 nt, Human
caaguuauaaaucaauguca

SEQ ID NO: 2369422 - RNA, 16 nt, Human
caaguuauaaaucaau

SEQ ID NO: 2369423 - RNA, 20 nt, Human
caaguuacagcugugacaau

SEQ ID NO: 2369424 - RNA, 22 nt, Human
caauauaaaacuguacuucacu

SEQ ID NO: 2369425 - RNA, 22 nt, Human
caauauaaaaggcaaaugugua

SEQ ID NO: 2369426 - RNA, 23 nt, Human
caauagcuuuacccucaggcaua

SEQ ID NO: 2369427 - RNA, 20 nt, Human
caauauaaaacuguacuuca

SEQ ID NO: 2369428 - RNA, 21 nt, Human
caauagcuuuacccucaggca

SEQ ID NO: 2369429 - RNA, 18 nt, Human
caauagcuuuacccucag

SEQ ID NO: 2369430 - RNA, 13 nt, Human
caauaggaaaaac

SEQ ID NO: 2369431 - RNA, 19 nt, Human
caauacccaaauccucucc

SEQ ID NO: 2369432 - RNA, 12 nt, Human
caauaggaaaaa

SEQ ID NO: 2369433 - RNA, 19 nt, Human
caauacaguacaggcagca

SEQ ID NO: 2369434 - RNA, 17 nt, Human
caauacaguacaggcag

SEQ ID NO: 2369435 - RNA, 18 nt, Human
caauacaguacaggcagc

SEQ ID NO: 2369436 - RNA, 15 nt, Human
caauacaugcugcua

SEQ ID NO: 2369437 - RNA, 17 nt, Human
caauacaugcugcuaau

SEQ ID NO: 2369438 - RNA, 23 nt, Human
caauacaucccuuaccugggaaa

SEQ ID NO: 2369439 - RNA, 17 nt, Human
caauacacuaguuguuu

SEQ ID NO: 2369440 - RNA, 19 nt, Human
caauacacuaguuguuucu

SEQ ID NO: 2369441 - RNA, 14 nt, Human
caauaauuuucuac

SEQ ID NO: 2369442 - RNA, 13 nt, Human
caauaauuuucua

SEQ ID NO: 2369443 - RNA, 14 nt, Human
caauguucucucuu

SEQ ID NO: 2369444 - RNA, 14 nt, Human
caauaggaaaaacu

SEQ ID NO: 2369445 - RNA, 16 nt, Human
uuauccugaaauuuca

SEQ ID NO: 2369446 - RNA, 13 nt, Human
uuaucgaaauaac

SEQ ID NO: 2369447 - RNA, 14 nt, Human
uuaucgaaauaaca

SEQ ID NO: 2369448 - RNA, 15 nt, Human
uuaucgaaauaacaa

SEQ ID NO: 2369449 - RNA, 18 nt, Human
uuauccucuuuagaguua

SEQ ID NO: 2369450 - RNA, 20 nt, Human
uuauccucuuuagaguuaga

SEQ ID NO: 2369451 - RNA, 17 nt, Human
uuauccugaaauuucag

SEQ ID NO: 2369452 - RNA, 14 nt, Human
uuauccucuuuaga

SEQ ID NO: 2369453 - RNA, 16 nt, Human
uuauccucugguuuaa

SEQ ID NO: 2369454 - RNA, 15 nt, Human
uuauccucuuuagag

SEQ ID NO: 2369455 - RNA, 17 nt, Human
uuauccucuuuagaguu

SEQ ID NO: 2369456 - RNA, 14 nt, Human
uuauccucugaucu

SEQ ID NO: 2369457 - RNA, 15 nt, Human
uuauccucugaucuc

SEQ ID NO: 2369458 - RNA, 16 nt, Human
uuauccucugaucucc

SEQ ID NO: 2369459 - RNA, 19 nt, Human
uuauccucugaucuccaug

SEQ ID NO: 2369460 - RNA, 20 nt, Human
uuauccucugaucuccaugg

SEQ ID NO: 2369461 - RNA, 21 nt, Human
uuauccucugaucuccauggc

SEQ ID NO: 2369462 - RNA, 23 nt, Human
uuaucccuuccuuuuagccuagu

SEQ ID NO: 2369463 - RNA, 19 nt, Human
uuauccuaaaacaaauagu

SEQ ID NO: 2369464 - RNA, 13 nt, Human
uuauauuugaaau

SEQ ID NO: 2369465 - RNA, 15 nt, Human
uuauauuugaaauau

SEQ ID NO: 2369466 - RNA, 15 nt, Human
uuauauugauaacag

SEQ ID NO: 2369467 - RNA, 14 nt, Human
uuauauuguaagaa

SEQ ID NO: 2369468 - RNA, 22 nt, Human
uuauauuguaagaaauacugua

SEQ ID NO: 2369469 - RNA, 16 nt, Human
uuauauuguaagaaau

SEQ ID NO: 2369470 - RNA, 24 nt, Human
uuauauuguaagaaauacuguaca

SEQ ID NO: 2369471 - RNA, 16 nt, Human
uuauauuuacaaaugg

SEQ ID NO: 2369472 - RNA, 12 nt, Human
uuauauuugaaa

SEQ ID NO: 2369473 - RNA, 19 nt, Human
uuauauuuaguuauaguuu

SEQ ID NO: 2369474 - RNA, 22 nt, Human
uuauauuuaguuauaguuucag

SEQ ID NO: 2369475 - RNA, 17 nt, Human
uuauauuuaguuauagu

SEQ ID NO: 2369476 - RNA, 18 nt, Human
uuauauuuaguuauaguu

SEQ ID NO: 2369477 - RNA, 20 nt, Human
uuauauuuauuacuguaaga

SEQ ID NO: 2369478 - RNA, 20 nt, Human
uuaucuaauaccucugugug

SEQ ID NO: 2369479 - RNA, 14 nt, Human
uuaucuagauacug

SEQ ID NO: 2369480 - RNA, 19 nt, Human
uuaucuauacauaucuuua

SEQ ID NO: 2369481 - RNA, 23 nt, Human
uuaucgggagcagugucuuccau

SEQ ID NO: 2369482 - RNA, 21 nt, Human
uuaucgggagcagugucuucc

SEQ ID NO: 2369483 - RNA, 15 nt, Human
uuaucuaaaagaaau

SEQ ID NO: 2369484 - RNA, 21 nt, Human
uuaucuaaaagaaaugucuau

SEQ ID NO: 2369485 - RNA, 19 nt, Human
uuaucuaauaccucugugu

SEQ ID NO: 2369486 - RNA, 19 nt, Human
uuaucgggagcagugucuu

SEQ ID NO: 2369487 - RNA, 18 nt, Human
uuaucgggagcagugucu

SEQ ID NO: 2369488 - RNA, 16 nt, Human
uuaucgggagcagugu

SEQ ID NO: 2369489 - RNA, 23 nt, Human
uuaucgggaacaguguuucccau

SEQ ID NO: 2369490 - RNA, 17 nt, Human
uuaucgggaacaguguu

SEQ ID NO: 2369491 - RNA, 16 nt, Human
uuaucgggaacagugu

SEQ ID NO: 2369492 - RNA, 14 nt, Human
uuaucgggaacagu

SEQ ID NO: 2369493 - RNA, 16 nt, Human
uuaucggaagcagugc

SEQ ID NO: 2369494 - RNA, 14 nt, Human
uuaucggaagcagu

SEQ ID NO: 2369495 - RNA, 15 nt, Human
uuaucggaagcagug

SEQ ID NO: 2369496 - RNA, 22 nt, Human
uuaucgaaauaacaauguuaag

SEQ ID NO: 2369497 - RNA, 19 nt, Human
uuaucgaaauaacaauguu

SEQ ID NO: 2369498 - RNA, 21 nt, Human
uuaucgaaauaacaauguuaa

SEQ ID NO: 2369499 - RNA, 17 nt, Human
uuaucuuaugccacggg

SEQ ID NO: 2369500 - RNA, 14 nt, Human
uuaucuugaauaau

SEQ ID NO: 2369501 - RNA, 16 nt, Human
uuaucuugaauaaugu

SEQ ID NO: 2369502 - RNA, 21 nt, Human
uuaucuccccuucacaugcau

SEQ ID NO: 2369503 - RNA, 21 nt, Human
uuaucucagucaugcauaaau

SEQ ID NO: 2369504 - RNA, 22 nt, Human
uuaucucagucaugcauaaaua

SEQ ID NO: 2369505 - RNA, 14 nt, Human
uuaucucuauuuaa

SEQ ID NO: 2369506 - RNA, 15 nt, Human
uuaucucuauuuaau

SEQ ID NO: 2369507 - RNA, 17 nt, Human
uuaucucagucaugcau

SEQ ID NO: 2369508 - RNA, 19 nt, Human
uuaucucagucaugcauaa

SEQ ID NO: 2369509 - RNA, 20 nt, Human
uuaucucagucaugcauaaa

SEQ ID NO: 2369510 - RNA, 16 nt, Human
uuaucucacuugugcc

SEQ ID NO: 2369511 - RNA, 11 nt, Human
uuaucucaaaa

SEQ ID NO: 2369512 - RNA, 22 nt, Human
uuauguuuuuuaaaauauuuau

SEQ ID NO: 2369513 - RNA, 18 nt, Human
uuauuaaauacaaaacuu

SEQ ID NO: 2369514 - RNA, 20 nt, Human
uuauuaaauacaaaacuucc

SEQ ID NO: 2369515 - RNA, 19 nt, Human
uuauuaacaaauuauguua

SEQ ID NO: 2369516 - RNA, 18 nt, Human
uuauuaacauaggugaaa

SEQ ID NO: 2369517 - RNA, 21 nt, Human
uuauuaacuaauaugggcauu

SEQ ID NO: 2369518 - RNA, 20 nt, Human
uuauguuugccacuuugcaa

SEQ ID NO: 2369519 - RNA, 11 nt, Human
uuauguuugcc

SEQ ID NO: 2369520 - RNA, 23 nt, Human
uuauuaaaaaucucaaauuucua

SEQ ID NO: 2369521 - RNA, 19 nt, Human
uuauuaaaugcccagcccc

SEQ ID NO: 2369522 - RNA, 21 nt, Human
uuauuaaaugcccagccccuu

SEQ ID NO: 2369523 - RNA, 14 nt, Human
uuauuacugcuaag

SEQ ID NO: 2369524 - RNA, 19 nt, Human
uuauuacugcuaaguauuu

SEQ ID NO: 2369525 - RNA, 15 nt, Human
uuauuaccucugaua

SEQ ID NO: 2369526 - RNA, 12 nt, Human
uuauuaccucug

SEQ ID NO: 2369527 - RNA, 13 nt, Human
uuauuaccucuga

SEQ ID NO: 2369528 - RNA, 22 nt, Human
uuauuacccccuccuucagaca

SEQ ID NO: 2369529 - RNA, 20 nt, Human
uuauuacccccuccuucaga

SEQ ID NO: 2369530 - RNA, 19 nt, Human
uuauuacccccuccuucag

SEQ ID NO: 2369531 - RNA, 18 nt, Human
uuauuacccagaguuuuu

SEQ ID NO: 2369532 - RNA, 18 nt, Human
uuauuacaucuuucacau

SEQ ID NO: 2369533 - RNA, 12 nt, Human
uuauuacaucuu

SEQ ID NO: 2369534 - RNA, 13 nt, Human
uuauuaaucacua

SEQ ID NO: 2369535 - RNA, 21 nt, Human
uuauuaagauggauucucaga

SEQ ID NO: 2369536 - RNA, 20 nt, Human
uuauuaagauggauucucag

SEQ ID NO: 2369537 - RNA, 19 nt, Human
uuauuaagauggauucuca

SEQ ID NO: 2369538 - RNA, 17 nt, Human
uuauuaagauggauucu

SEQ ID NO: 2369539 - RNA, 23 nt, Human
uuauuaagauggauucucagaua

SEQ ID NO: 2369540 - RNA, 14 nt, Human
uuauuaauaaacau

SEQ ID NO: 2369541 - RNA, 15 nt, Human
uuauuaauaaacauu

SEQ ID NO: 2369542 - RNA, 13 nt, Human
uuaugauuuaaua

SEQ ID NO: 2369543 - RNA, 15 nt, Human
uuaugauuuaauaaa

SEQ ID NO: 2369544 - RNA, 20 nt, Human
uuaugauuuaauaaaauaau

SEQ ID NO: 2369545 - RNA, 17 nt, Human
uuauggaacacucugag

SEQ ID NO: 2369546 - RNA, 19 nt, Human
uuaugauuuuuuuuucaua

SEQ ID NO: 2369547 - RNA, 18 nt, Human
uuaugauuuuuuuuucau

SEQ ID NO: 2369548 - RNA, 17 nt, Human
uuaugauuuaauaaaau

SEQ ID NO: 2369549 - RNA, 22 nt, Human
uuauggaagauuuuaaauucac

SEQ ID NO: 2369550 - RNA, 22 nt, Human
uuauggaaucuaccaacuguuu

SEQ ID NO: 2369551 - RNA, 19 nt, Human
uuauggaagauuuuaaauu

SEQ ID NO: 2369552 - RNA, 19 nt, Human
uuauggaauugauuugcau

SEQ ID NO: 2369553 - RNA, 14 nt, Human
uuauggaauugauu

SEQ ID NO: 2369554 - RNA, 21 nt, Human
uuauggacaaugacccagugg

SEQ ID NO: 2369555 - RNA, 18 nt, Human
uuauggaacacucugaga

SEQ ID NO: 2369556 - RNA, 20 nt, Human
uuauggaacacucugagacu

SEQ ID NO: 2369557 - RNA, 19 nt, Human
uuauguuuauauaaaugcu

SEQ ID NO: 2369558 - RNA, 17 nt, Human
uuauguugcauagaaua

SEQ ID NO: 2369559 - RNA, 17 nt, Human
uuauggcuuuugugcau

SEQ ID NO: 2369560 - RNA, 21 nt, Human
uuauggcucacuaugaaucua

SEQ ID NO: 2369561 - RNA, 18 nt, Human
uuauggcuuuugugcauu

SEQ ID NO: 2369562 - RNA, 14 nt, Human
uuauggcacaucag

SEQ ID NO: 2369563 - RNA, 23 nt, Human
uuauggaauugauuugcauugaa

SEQ ID NO: 2369564 - RNA, 21 nt, Human
uuauggaauugauuugcauug

SEQ ID NO: 2369565 - RNA, 20 nt, Human
uuauggaauugauuugcauu

SEQ ID NO: 2369566 - RNA, 16 nt, Human
uuauggcuuuugugca

SEQ ID NO: 2369567 - RNA, 18 nt, Human
uuauggcuauaggugcua

SEQ ID NO: 2369568 - RNA, 21 nt, Human
uuauaauuuuuuuauuacuga

SEQ ID NO: 2369569 - RNA, 16 nt, Human
uuauaauuuuuuucaa

SEQ ID NO: 2369570 - RNA, 16 nt, Human
uuauaauuuuccuaau

SEQ ID NO: 2369571 - RNA, 14 nt, Human
uuauaauuuuccua

SEQ ID NO: 2369572 - RNA, 18 nt, Human
uuauaauuuugugaagca

SEQ ID NO: 2369573 - RNA, 16 nt, Human
uuauaauuuugugaag

SEQ ID NO: 2369574 - RNA, 17 nt, Human
uuauaauuuugugaagc

SEQ ID NO: 2369575 - RNA, 15 nt, Human
uuauacaauaucauc

SEQ ID NO: 2369576 - RNA, 23 nt, Human
uuauacaacagugcuaaaaaugg

SEQ ID NO: 2369577 - RNA, 21 nt, Human
uuauacaacagugcuaaaaau

SEQ ID NO: 2369578 - RNA, 12 nt, Human
uuauacacauaa

SEQ ID NO: 2369579 - RNA, 13 nt, Human
uuauacacauaau

SEQ ID NO: 2369580 - RNA, 14 nt, Human
uuauacacauaauu

SEQ ID NO: 2369581 - RNA, 19 nt, Human
uuauacaaauuagaaaaug

SEQ ID NO: 2369582 - RNA, 12 nt, Human
uuauacaacagu

SEQ ID NO: 2369583 - RNA, 16 nt, Human
uuauacaacagugcua

SEQ ID NO: 2369584 - RNA, 17 nt, Human
uuauacaacagugcuaa

SEQ ID NO: 2369585 - RNA, 15 nt, Human
uuauacaaaugucuu

SEQ ID NO: 2369586 - RNA, 18 nt, Human
uuauacagcucagcuuuu

SEQ ID NO: 2369587 - RNA, 23 nt, Human
uuauacagaauugugucugcagg

SEQ ID NO: 2369588 - RNA, 22 nt, Human
uuauacagaccgaacuguugua

SEQ ID NO: 2369589 - RNA, 22 nt, Human
uuauacagaauugugucugcag

SEQ ID NO: 2369590 - RNA, 15 nt, Human
uuauacacuguaaug

SEQ ID NO: 2369591 - RNA, 18 nt, Human
uuauacacauaauuaaag

SEQ ID NO: 2369592 - RNA, 21 nt, Human
uuauacacauaauuaaagugu

SEQ ID NO: 2369593 - RNA, 19 nt, Human
uuauaucaguccucuuuca

SEQ ID NO: 2369594 - RNA, 16 nt, Human
uuauaucagccugagu

SEQ ID NO: 2369595 - RNA, 21 nt, Human
uuauaucaucagcauaccuuu

SEQ ID NO: 2369596 - RNA, 20 nt, Human
uuauauauuuauaacucauc

SEQ ID NO: 2369597 - RNA, 15 nt, Human
uuauauauuuauaac

SEQ ID NO: 2369598 - RNA, 14 nt, Human
uuauauauuuauaa

SEQ ID NO: 2369599 - RNA, 13 nt, Human
uuauauauuuaua

SEQ ID NO: 2369600 - RNA, 23 nt, Human
uuauauauuuauaacucaucaua

SEQ ID NO: 2369601 - RNA, 15 nt, Human
uuauaucagccugag

SEQ ID NO: 2369602 - RNA, 11 nt, Human
uuauacauaaa

SEQ ID NO: 2369603 - RNA, 23 nt, Human
uuauauaugugaacauuuaucaa

SEQ ID NO: 2369604 - RNA, 22 nt, Human
uuauauauugguaacauccuuu

SEQ ID NO: 2369605 - RNA, 13 nt, Human
uuauacauaaaca

SEQ ID NO: 2369606 - RNA, 19 nt, Human
uuauaugaagaaaaucacu

SEQ ID NO: 2369607 - RNA, 15 nt, Human
uuauaugaagaaaau

SEQ ID NO: 2369608 - RNA, 16 nt, Human
uuauaugaagauaagu

SEQ ID NO: 2369609 - RNA, 13 nt, Human
uuauaugcuuacu

SEQ ID NO: 2369610 - RNA, 19 nt, Human
uuauaugcuuacugauaua

SEQ ID NO: 2369611 - RNA, 16 nt, Human
uuauaugucaaagcag

SEQ ID NO: 2369612 - RNA, 15 nt, Human
uuauauuaaaauaug

SEQ ID NO: 2369613 - RNA, 19 nt, Human
uuauauguacaugagaagg

SEQ ID NO: 2369614 - RNA, 16 nt, Human
uuauauguacaugaga

SEQ ID NO: 2369615 - RNA, 20 nt, Human
uuauauggaugauucagaaa

SEQ ID NO: 2369616 - RNA, 22 nt, Human
uuauauggaugauucagaaauu

SEQ ID NO: 2369617 - RNA, 21 nt, Human
uuauauuccauauauuagcau

SEQ ID NO: 2369618 - RNA, 16 nt, Human
uuauauuccauauauu

SEQ ID NO: 2369619 - RNA, 14 nt, Human
uuauauuccauaua

SEQ ID NO: 2369620 - RNA, 16 nt, Human
uuauauuaugaagcuu

SEQ ID NO: 2369621 - RNA, 20 nt, Human
uuauauuaaaauauggcuau

SEQ ID NO: 2369622 - RNA, 15 nt, Human
ugugaaaagaaaaau

SEQ ID NO: 2369623 - RNA, 13 nt, Human
ugugaaaagaaaa

SEQ ID NO: 2369624 - RNA, 17 nt, Human
ugugaaaagaaaaauga

SEQ ID NO: 2369625 - RNA, 21 nt, Human
ugugaaaagaaaaaugagccu

SEQ ID NO: 2369626 - RNA, 14 nt, Human
uuagucuucucaua

SEQ ID NO: 2369627 - RNA, 13 nt, Human
uuagucuucucau

SEQ ID NO: 2369628 - RNA, 15 nt, Human
uuagucugcaaaaug

SEQ ID NO: 2369629 - RNA, 17 nt, Human
uuagucugcaaaaugag

SEQ ID NO: 2369630 - RNA, 19 nt, Human
uuagugaccucagcuuuga

SEQ ID NO: 2369631 - RNA, 18 nt, Human
uuagucuucucauagcau

SEQ ID NO: 2369632 - RNA, 19 nt, Human
uuagugcggacaaguuuua

SEQ ID NO: 2369633 - RNA, 17 nt, Human
uuagugcggacaaguuu

SEQ ID NO: 2369634 - RNA, 14 nt, Human
uuagugccugugug

SEQ ID NO: 2369635 - RNA, 12 nt, Human
uuagugcuaagu

SEQ ID NO: 2369636 - RNA, 15 nt, Human
uuagugcuaagugug

SEQ ID NO: 2369637 - RNA, 18 nt, Human
uuagugaugucaucuguc

SEQ ID NO: 2369638 - RNA, 23 nt, Human
uuagugucacuuaccuagauuua

SEQ ID NO: 2369639 - RNA, 14 nt, Human
uuagugucacuuac

SEQ ID NO: 2369640 - RNA, 16 nt, Human
uuaguguaugcuuuga

SEQ ID NO: 2369641 - RNA, 12 nt, Human
uuaguggcuuca

SEQ ID NO: 2369642 - RNA, 12 nt, Human
uuaguggcuuuu

SEQ ID NO: 2369643 - RNA, 23 nt, Human
uuaguggcucaacauuguguucc

SEQ ID NO: 2369644 - RNA, 20 nt, Human
uuaguggcucaacauugugu

SEQ ID NO: 2369645 - RNA, 16 nt, Human
uuaguggcucaacauu

SEQ ID NO: 2369646 - RNA, 21 nt, Human
uuagugcuaagugugaacugg

SEQ ID NO: 2369647 - RNA, 16 nt, Human
uuagugcuaaguguga

SEQ ID NO: 2369648 - RNA, 17 nt, Human
uuagugcuaagugugaa

SEQ ID NO: 2369649 - RNA, 19 nt, Human
uuagugcuaagugugaacu

SEQ ID NO: 2369650 - RNA, 20 nt, Human
uuagugcuaagugugaacug

SEQ ID NO: 2369651 - RNA, 18 nt, Human
uuauaaguagcaggccaa

SEQ ID NO: 2369652 - RNA, 18 nt, Human
uuauaaguaucuucaugu

SEQ ID NO: 2369653 - RNA, 16 nt, Human
uuauaagcagauuuaa

SEQ ID NO: 2369654 - RNA, 14 nt, Human
uuauaagcagauuu

SEQ ID NO: 2369655 - RNA, 15 nt, Human
uuauaaugaaugaaa

SEQ ID NO: 2369656 - RNA, 11 nt, Human
uuauaaucuuu

SEQ ID NO: 2369657 - RNA, 20 nt, Human
uuauaaucuuccauacuucu

SEQ ID NO: 2369658 - RNA, 13 nt, Human
uuauaaucacuuu

SEQ ID NO: 2369659 - RNA, 19 nt, Human
uuauaaugaggaugauuau

SEQ ID NO: 2369660 - RNA, 13 nt, Human
uuauaauggguaa

SEQ ID NO: 2369661 - RNA, 15 nt, Human
uuauaauaauguuaa

SEQ ID NO: 2369662 - RNA, 17 nt, Human
uuauaauaaaaggaaaa

SEQ ID NO: 2369663 - RNA, 21 nt, Human
uuauaauaaaaggaaaagcaa

SEQ ID NO: 2369664 - RNA, 22 nt, Human
uuauaauaaaaggaaaagcaaa

SEQ ID NO: 2369665 - RNA, 18 nt, Human
uuauaauaauguuaacau

SEQ ID NO: 2369666 - RNA, 13 nt, Human
uuauaauauacua

SEQ ID NO: 2369667 - RNA, 12 nt, Human
uuauaauuuaaa

SEQ ID NO: 2369668 - RNA, 14 nt, Human
uuauaauuguauca

SEQ ID NO: 2369669 - RNA, 22 nt, Human
uuauaauuguaucagaggccua

SEQ ID NO: 2369670 - RNA, 12 nt, Human
uuauaauuuuaa

SEQ ID NO: 2369671 - RNA, 17 nt, Human
uuauaauuuuaaauguu

SEQ ID NO: 2369672 - RNA, 21 nt, Human
uuauaauuuuaaauguuuuuu

SEQ ID NO: 2369673 - RNA, 14 nt, Human
uuauaauuuuguga

SEQ ID NO: 2369674 - RNA, 15 nt, Human
uuauaauuuugugaa

SEQ ID NO: 2369675 - RNA, 12 nt, Human
uucauaaaugaa

SEQ ID NO: 2369676 - RNA, 15 nt, Human
uucauaaaugaauuu

SEQ ID NO: 2369677 - RNA, 16 nt, Human
uucauaaaugaauuuu

SEQ ID NO: 2369678 - RNA, 15 nt, Human
uucauaaccuagccu

SEQ ID NO: 2369679 - RNA, 15 nt, Human
uucauccuccucaga

SEQ ID NO: 2369680 - RNA, 19 nt, Human
uucauccuccucagaucuu

SEQ ID NO: 2369681 - RNA, 18 nt, Human
uucaucgaaucuacuaau

SEQ ID NO: 2369682 - RNA, 18 nt, Human
uucauccggcagccugga

SEQ ID NO: 2369683 - RNA, 18 nt, Human
uucauccugacucugccc

SEQ ID NO: 2369684 - RNA, 14 nt, Human
uucauaacuuucau

SEQ ID NO: 2369685 - RNA, 20 nt, Human
uucaucgaaucuacuaauuc

SEQ ID NO: 2369686 - RNA, 23 nt, Human
uucaucgaaucuacuaauuccac

SEQ ID NO: 2369687 - RNA, 13 nt, Human
uucaucugcucuc

SEQ ID NO: 2369688 - RNA, 15 nt, Human
uucaucugcucuccu

SEQ ID NO: 2369689 - RNA, 16 nt, Human
uucaucugcucuccuu

SEQ ID NO: 2369690 - RNA, 19 nt, Human
uucaucugcucuccuuccu

SEQ ID NO: 2369691 - RNA, 18 nt, Human
uucaguugaucacuggca

SEQ ID NO: 2369692 - RNA, 16 nt, Human
uucaguugaucacugg

SEQ ID NO: 2369693 - RNA, 19 nt, Human
uucauaaacaacuuaaugu

SEQ ID NO: 2369694 - RNA, 20 nt, Human
uucauaaauaaaguuuguug

SEQ ID NO: 2369695 - RNA, 14 nt, Human
uucaguuacagaaa

SEQ ID NO: 2369696 - RNA, 15 nt, Human
uucaguuacagaaag

SEQ ID NO: 2369697 - RNA, 16 nt, Human
uucaguuacagaaagu

SEQ ID NO: 2369698 - RNA, 17 nt, Human
uucaguuacagaaagug

SEQ ID NO: 2369699 - RNA, 23 nt, Human
uucaguuccucuuugcauggaau

SEQ ID NO: 2369700 - RNA, 17 nt, Human
uucaguuccucuuugca

SEQ ID NO: 2369701 - RNA, 22 nt, Human
uucaguuccucuuugcauggaa

SEQ ID NO: 2369702 - RNA, 15 nt, Human
uucaguucccagaau

SEQ ID NO: 2369703 - RNA, 17 nt, Human
uucaguucccagaauca

SEQ ID NO: 2369704 - RNA, 19 nt, Human
uucaguucccagaaucaaa

SEQ ID NO: 2369705 - RNA, 11 nt, Human
uucaguuacag

SEQ ID NO: 2369706 - RNA, 13 nt, Human
uucaguuacagaa

SEQ ID NO: 2369707 - RNA, 18 nt, Human
uucagugucccgggcccg

SEQ ID NO: 2369708 - RNA, 22 nt, Human
uucaguguuaaaugugaugaau

SEQ ID NO: 2369709 - RNA, 18 nt, Human
uucaguguuaaaugugau

SEQ ID NO: 2369710 - RNA, 12 nt, Human
uucaguguuaaa

SEQ ID NO: 2369711 - RNA, 23 nt, Human
uucaguuauuauauuuacaaaug

SEQ ID NO: 2369712 - RNA, 22 nt, Human
uucagcuuguaaauagcucagg

SEQ ID NO: 2369713 - RNA, 22 nt, Human
uucagcuucguuuauuuucaag

SEQ ID NO: 2369714 - RNA, 23 nt, Human
uucagcugugaacauggacucuu

SEQ ID NO: 2369715 - RNA, 14 nt, Human
uucagcuucauuug

SEQ ID NO: 2369716 - RNA, 15 nt, Human
uucagcuucugcugg

SEQ ID NO: 2369717 - RNA, 16 nt, Human
uucagcuucugcuggg

SEQ ID NO: 2369718 - RNA, 17 nt, Human
uucagcuucugcugggc

SEQ ID NO: 2369719 - RNA, 18 nt, Human
uucagcuucugcugggcu

SEQ ID NO: 2369720 - RNA, 14 nt, Human
uucaguggcagcug

SEQ ID NO: 2369721 - RNA, 13 nt, Human
uucagcuugggga

SEQ ID NO: 2369722 - RNA, 22 nt, Human
uucagcuccagcucaccagccc

SEQ ID NO: 2369723 - RNA, 21 nt, Human
uucagcugguugagguuucaa

SEQ ID NO: 2369724 - RNA, 13 nt, Human
uucagcucacugu

SEQ ID NO: 2369725 - RNA, 20 nt, Human
uucagcugugaacauggacu

SEQ ID NO: 2369726 - RNA, 12 nt, Human
uucagcuccagc

SEQ ID NO: 2369727 - RNA, 15 nt, Human
uucagcuccagcuca

SEQ ID NO: 2369728 - RNA, 13 nt, Human
uucaguguacaug

SEQ ID NO: 2369729 - RNA, 20 nt, Human
uucaguguauggaaauaaau

SEQ ID NO: 2369730 - RNA, 21 nt, Human
uucaguguaauuucuuugccu

SEQ ID NO: 2369731 - RNA, 22 nt, Human
uucagugucaaauaaacacugu

SEQ ID NO: 2369732 - RNA, 23 nt, Human
uucagugucaaauaaacacugug

SEQ ID NO: 2369733 - RNA, 13 nt, Human
uucagugucccgg

SEQ ID NO: 2369734 - RNA, 12 nt, Human
uucaguguacau

SEQ ID NO: 2369735 - RNA, 13 nt, Human
uucaguguaaaua

SEQ ID NO: 2369736 - RNA, 12 nt, Human
uucaguguaauu

SEQ ID NO: 2369737 - RNA, 13 nt, Human
uucaguguaauuu

SEQ ID NO: 2369738 - RNA, 16 nt, Human
uucaguguaauuucuu

SEQ ID NO: 2369739 - RNA, 17 nt, Human
uucaguguaauuucuuu

SEQ ID NO: 2369740 - RNA, 19 nt, Human
uucaguguaauuucuuugc

SEQ ID NO: 2369741 - RNA, 20 nt, Human
uucaguguaauuucuuugcc

SEQ ID NO: 2369742 - RNA, 14 nt, Human
uucagugggagaaa

SEQ ID NO: 2369743 - RNA, 20 nt, Human
uucaguggcagggcucagga

SEQ ID NO: 2369744 - RNA, 14 nt, Human
uucaguggggcagu

SEQ ID NO: 2369745 - RNA, 20 nt, Human
uucagcuucugcugggcugg

SEQ ID NO: 2369746 - RNA, 22 nt, Human
uucagcuucugcugggcugggg

SEQ ID NO: 2369747 - RNA, 16 nt, Human
uucaguggcagggcuc

SEQ ID NO: 2369748 - RNA, 17 nt, Human
uucaguggcagggcuca

SEQ ID NO: 2369749 - RNA, 17 nt, Human
uucaguggcagcugcuu

SEQ ID NO: 2369750 - RNA, 15 nt, Human
uucaguggcagcugc

SEQ ID NO: 2369751 - RNA, 16 nt, Human
uucaguggcagcugcu

SEQ ID NO: 2369752 - RNA, 23 nt, Human
uuccaacaccacagacacacaca

SEQ ID NO: 2369753 - RNA, 23 nt, Human
uuccaacagcucaagucuucccu

SEQ ID NO: 2369754 - RNA, 14 nt, Human
uuccaacagugagu

SEQ ID NO: 2369755 - RNA, 12 nt, Human
uuccaacaccac

SEQ ID NO: 2369756 - RNA, 17 nt, Human
uuccaacaccacagaca

SEQ ID NO: 2369757 - RNA, 18 nt, Human
uuccaacaccacagacac

SEQ ID NO: 2369758 - RNA, 19 nt, Human
uuccaacaccacagacaca

SEQ ID NO: 2369759 - RNA, 20 nt, Human
uuccaacaccacagacacac

SEQ ID NO: 2369760 - RNA, 21 nt, Human
uuccaacaccacagacacaca

SEQ ID NO: 2369761 - RNA, 22 nt, Human
uuccaacaccacagacacacac

SEQ ID NO: 2369762 - RNA, 16 nt, Human
uuccaaaguacacugu

SEQ ID NO: 2369763 - RNA, 23 nt, Human
uuccaacaaaggguuuuaaugua

SEQ ID NO: 2369764 - RNA, 14 nt, Human
uuccaaaguuaaca

SEQ ID NO: 2369765 - RNA, 15 nt, Human
uuccaaauaaaauga

SEQ ID NO: 2369766 - RNA, 23 nt, Human
uuccaaaggccauggagagcugg

SEQ ID NO: 2369767 - RNA, 19 nt, Human
uuccaaagcacauugaaag

SEQ ID NO: 2369768 - RNA, 22 nt, Human
uuccaaagaguagaauugcauu

SEQ ID NO: 2369769 - RNA, 20 nt, Human
uuccaaagcacauugaaaga

SEQ ID NO: 2369770 - RNA, 22 nt, Human
uuccaaaaguggccucuuuguc

SEQ ID NO: 2369771 - RNA, 13 nt, Human
uuccaaaguacac

SEQ ID NO: 2369772 - RNA, 18 nt, Human
uucauuuuuuuccaggcu

SEQ ID NO: 2369773 - RNA, 13 nt, Human
uuccaaaaaaaua

SEQ ID NO: 2369774 - RNA, 15 nt, Human
uuccaaaaaaauacu

SEQ ID NO: 2369775 - RNA, 21 nt, Human
uuccaaaaagauuuucagaaa

SEQ ID NO: 2369776 - RNA, 21 nt, Human
uuccaaaaguggccucuuugu

SEQ ID NO: 2369777 - RNA, 18 nt, Human
uuccaaaaguggccucuu

SEQ ID NO: 2369778 - RNA, 17 nt, Human
uuccaaaaguggccucu

SEQ ID NO: 2369779 - RNA, 16 nt, Human
uuccaaaaguggccuc

SEQ ID NO: 2369780 - RNA, 23 nt, Human
uucauuuuuuucacuggaguuac

SEQ ID NO: 2369781 - RNA, 15 nt, Human
uucauuuuuccuaac

SEQ ID NO: 2369782 - RNA, 14 nt, Human
uucauuuuuuucca

SEQ ID NO: 2369783 - RNA, 17 nt, Human
uucauuuuuuuccaggc

SEQ ID NO: 2369784 - RNA, 13 nt, Human
uucauuuuuccua

SEQ ID NO: 2369785 - RNA, 17 nt, Human
uucauuuuuaaucauga

SEQ ID NO: 2369786 - RNA, 18 nt, Human
uucauuuuuaaucaugaa

SEQ ID NO: 2369787 - RNA, 22 nt, Human
uucaugccagcuacuuccuccu

SEQ ID NO: 2369788 - RNA, 22 nt, Human
uucaugccaccauggccagcca

SEQ ID NO: 2369789 - RNA, 21 nt, Human
uucaugccagcuacuuccucc

SEQ ID NO: 2369790 - RNA, 18 nt, Human
uucaugcuaucucugugu

SEQ ID NO: 2369791 - RNA, 17 nt, Human
uucaugcuaucucugug

SEQ ID NO: 2369792 - RNA, 16 nt, Human
uucaugccuggcuucg

SEQ ID NO: 2369793 - RNA, 14 nt, Human
uucaugcucagccc

SEQ ID NO: 2369794 - RNA, 17 nt, Human
uucaugcucagcccuga

SEQ ID NO: 2369795 - RNA, 19 nt, Human
uucaugccaccauggccag

SEQ ID NO: 2369796 - RNA, 21 nt, Human
uucaugccaauuagcaauuga

SEQ ID NO: 2369797 - RNA, 16 nt, Human
uucaugcauggaaauu

SEQ ID NO: 2369798 - RNA, 15 nt, Human
uucaugcauggaaau

SEQ ID NO: 2369799 - RNA, 14 nt, Human
uucaugcauggaaa

SEQ ID NO: 2369800 - RNA, 18 nt, Human
uucaucuguuguuuuguu

SEQ ID NO: 2369801 - RNA, 18 nt, Human
uucaucuguaacucuaaa

SEQ ID NO: 2369802 - RNA, 19 nt, Human
uucaucuguaacucuaaaa

SEQ ID NO: 2369803 - RNA, 21 nt, Human
uucaucuguaacucuaaaaga

SEQ ID NO: 2369804 - RNA, 23 nt, Human
uucaucuguaacucuaaaagauc

SEQ ID NO: 2369805 - RNA, 21 nt, Human
uucaucugcucuccuuccugg

SEQ ID NO: 2369806 - RNA, 12 nt, Human
uucaucuggaac

SEQ ID NO: 2369807 - RNA, 23 nt, Human
uucaucuggaaccaucagaaaca

SEQ ID NO: 2369808 - RNA, 17 nt, Human
uucaucuggaaccauca

SEQ ID NO: 2369809 - RNA, 19 nt, Human
uucaucuggcaacaucuuu

SEQ ID NO: 2369810 - RNA, 13 nt, Human
uucaucugggaaa

SEQ ID NO: 2369811 - RNA, 14 nt, Human
uucaucugggaaag

SEQ ID NO: 2369812 - RNA, 18 nt, Human
uucaucugggaaagacau

SEQ ID NO: 2369813 - RNA, 13 nt, Human
uucaucuguaacu

SEQ ID NO: 2369814 - RNA, 15 nt, Human
uuccagaaucccaag

SEQ ID NO: 2369815 - RNA, 16 nt, Human
uuccagaaucccaaga

SEQ ID NO: 2369816 - RNA, 15 nt, Human
uuccagaaugcugua

SEQ ID NO: 2369817 - RNA, 14 nt, Human
uuccagaaugcugu

SEQ ID NO: 2369818 - RNA, 18 nt, Human
uuccagaaugcuguacau

SEQ ID NO: 2369819 - RNA, 16 nt, Human
uuccagaaugcuguac

SEQ ID NO: 2369820 - RNA, 19 nt, Human
uuccagaaugcuguacauc

SEQ ID NO: 2369821 - RNA, 14 nt, Human
uuccagaccugaag

SEQ ID NO: 2369822 - RNA, 15 nt, Human
uuccaaccccaacuc

SEQ ID NO: 2369823 - RNA, 15 nt, Human
uuccagaagugugau

SEQ ID NO: 2369824 - RNA, 21 nt, Human
uuccagaagugugauugggaa

SEQ ID NO: 2369825 - RNA, 19 nt, Human
uuccagaauaucugggauu

SEQ ID NO: 2369826 - RNA, 19 nt, Human
uuccaacccucaucaccaa

SEQ ID NO: 2369827 - RNA, 20 nt, Human
uuccagacuuccuugagaca

SEQ ID NO: 2369828 - RNA, 23 nt, Human
uuccagacugcuuccaauuuucu

SEQ ID NO: 2369829 - RNA, 17 nt, Human
uuccagaccugaagaau

SEQ ID NO: 2369830 - RNA, 16 nt, Human
uuccagaccugaagaa

SEQ ID NO: 2369831 - RNA, 19 nt, Human
uuccagaggcuauuauuuu

SEQ ID NO: 2369832 - RNA, 20 nt, Human
uuccagaggcuauuauuuuc

SEQ ID NO: 2369833 - RNA, 16 nt, Human
uuccagagggguugag

SEQ ID NO: 2369834 - RNA, 18 nt, Human
uuccagauaaccagcugu

SEQ ID NO: 2369835 - RNA, 18 nt, Human
uuccagauccuggaaauc

SEQ ID NO: 2369836 - RNA, 11 nt, Human
uuccagagaag

SEQ ID NO: 2369837 - RNA, 18 nt, Human
uuccauauauuagcauuu

SEQ ID NO: 2369838 - RNA, 15 nt, Human
uuccauaugaccuca

SEQ ID NO: 2369839 - RNA, 20 nt, Human
uuccauaugaccucaugcau

SEQ ID NO: 2369840 - RNA, 23 nt, Human
uuccagauaaccagcuguaacac

SEQ ID NO: 2369841 - RNA, 12 nt, Human
uuccaucauguc

SEQ ID NO: 2369842 - RNA, 19 nt, Human
uuccaucagguuccauccc

SEQ ID NO: 2369843 - RNA, 14 nt, Human
uuccaucauguccc

SEQ ID NO: 2369844 - RNA, 16 nt, Human
uuccaucaugucccca

SEQ ID NO: 2369845 - RNA, 15 nt, Human
uuccauauucaugua

SEQ ID NO: 2369846 - RNA, 14 nt, Human
uuccauauucaugu

SEQ ID NO: 2369847 - RNA, 20 nt, Human
uuccauauggauuuucuauu

SEQ ID NO: 2369848 - RNA, 15 nt, Human
uuccauauggauuuu

SEQ ID NO: 2369849 - RNA, 14 nt, Human
uuccauggacuuug

SEQ ID NO: 2369850 - RNA, 15 nt, Human
uuccauggacuuugu

SEQ ID NO: 2369851 - RNA, 21 nt, Human
uuccaugcguguuucugacuc

SEQ ID NO: 2369852 - RNA, 18 nt, Human
uuccaugcguguuucuga

SEQ ID NO: 2369853 - RNA, 13 nt, Human
uuccaucccagag

SEQ ID NO: 2369854 - RNA, 16 nt, Human
uuccaugccugagggu

SEQ ID NO: 2369855 - RNA, 18 nt, Human
uuccaugccugagggugg

SEQ ID NO: 2369856 - RNA, 22 nt, Human
uuccaugccugaggguggagac

SEQ ID NO: 2369857 - RNA, 17 nt, Human
uuccaucauguccccaa

SEQ ID NO: 2369858 - RNA, 21 nt, Human
uucaacaucaauguucauugu

SEQ ID NO: 2369859 - RNA, 19 nt, Human
uucaaccacuguaaaauga

SEQ ID NO: 2369860 - RNA, 15 nt, Human
uucaaccauucccca

SEQ ID NO: 2369861 - RNA, 18 nt, Human
uucaauaaaugucuguug

SEQ ID NO: 2369862 - RNA, 19 nt, Human
uucaauaaaugucuguuga

SEQ ID NO: 2369863 - RNA, 16 nt, Human
uucaauaauaaauauu

SEQ ID NO: 2369864 - RNA, 18 nt, Human
uucaaauugagagaaugg

SEQ ID NO: 2369865 - RNA, 19 nt, Human
uucaaauucuucugaacuc

SEQ ID NO: 2369866 - RNA, 16 nt, Human
uucaaauucuucugaa

SEQ ID NO: 2369867 - RNA, 22 nt, Human
uucaacaucaauguucauugua

SEQ ID NO: 2369868 - RNA, 19 nt, Human
uucaacaucaauguucauu

SEQ ID NO: 2369869 - RNA, 16 nt, Human
uucaacaucaauguuc

SEQ ID NO: 2369870 - RNA, 15 nt, Human
uucaacaucaauguu

SEQ ID NO: 2369871 - RNA, 14 nt, Human
uucaacaucaaugu

SEQ ID NO: 2369872 - RNA, 21 nt, Human
uucaacagguuuuccugaaga

SEQ ID NO: 2369873 - RNA, 19 nt, Human
uucaaauuagaagacauuu

SEQ ID NO: 2369874 - RNA, 14 nt, Human
uucaaaugugcugu

SEQ ID NO: 2369875 - RNA, 22 nt, Human
uucaaaugauuuuuacaaguuu

SEQ ID NO: 2369876 - RNA, 18 nt, Human
uucaaaugcuguaacuuu

SEQ ID NO: 2369877 - RNA, 18 nt, Human
uuauuuuguaauuauugu

SEQ ID NO: 2369878 - RNA, 21 nt, Human
uuauuuuguaauuauugugau

SEQ ID NO: 2369879 - RNA, 18 nt, Human
uuauuuugguacuuuuau

SEQ ID NO: 2369880 - RNA, 13 nt, Human
uuauuuuguaauu

SEQ ID NO: 2369881 - RNA, 14 nt, Human
uuauuuuguaauua

SEQ ID NO: 2369882 - RNA, 15 nt, Human
uuauuuuguaauuau

SEQ ID NO: 2369883 - RNA, 13 nt, Human
uuauuuucaagaa

SEQ ID NO: 2369884 - RNA, 18 nt, Human
uuauuuucaagaaacuga

SEQ ID NO: 2369885 - RNA, 17 nt, Human
uuauuuuaaacaaaaua

SEQ ID NO: 2369886 - RNA, 22 nt, Human
uuauuuuggaaaauaaauuauu

SEQ ID NO: 2369887 - RNA, 13 nt, Human
uuauuuugguacu

SEQ ID NO: 2369888 - RNA, 12 nt, Human
uuauuuugcaac

SEQ ID NO: 2369889 - RNA, 23 nt, Human
uuauuuugccauggaugagaguc

SEQ ID NO: 2369890 - RNA, 19 nt, Human
uuauuucuuaaacaaaugu

SEQ ID NO: 2369891 - RNA, 20 nt, Human
uuauuaguaaaugcuuauca

SEQ ID NO: 2369892 - RNA, 20 nt, Human
uuauuagggagaaaauucaa

SEQ ID NO: 2369893 - RNA, 19 nt, Human
uuauuagggagaaaauuca

SEQ ID NO: 2369894 - RNA, 23 nt, Human
uuauuagggagaaaauucaauug

SEQ ID NO: 2369895 - RNA, 22 nt, Human
uuauuugaaaacauauaaagca

SEQ ID NO: 2369896 - RNA, 14 nt, Human
uuauuugacaaaau

SEQ ID NO: 2369897 - RNA, 22 nt, Human
uuauuagccagguaaugugaau

SEQ ID NO: 2369898 - RNA, 16 nt, Human
uuauuagggagaaaau

SEQ ID NO: 2369899 - RNA, 18 nt, Human
uuauuagggagaaaauuc

SEQ ID NO: 2369900 - RNA, 17 nt, Human
uuauuagggagaaaauu

SEQ ID NO: 2369901 - RNA, 17 nt, Human
uuauuagagugucuuuc

SEQ ID NO: 2369902 - RNA, 21 nt, Human
uuauuagagauuaccuccuga

SEQ ID NO: 2369903 - RNA, 18 nt, Human
uuauuugcagagacagga

SEQ ID NO: 2369904 - RNA, 15 nt, Human
uuauuugcagagaca

SEQ ID NO: 2369905 - RNA, 13 nt, Human
uuauuugcaugug

SEQ ID NO: 2369906 - RNA, 13 nt, Human
uuauuuguacagu

SEQ ID NO: 2369907 - RNA, 11 nt, Human
uuauuugcaua

SEQ ID NO: 2369908 - RNA, 18 nt, Human
uuauuuuauuaugcauga

SEQ ID NO: 2369909 - RNA, 20 nt, Human
uuauuuuaauaauguuucaa

SEQ ID NO: 2369910 - RNA, 14 nt, Human
uuauuuguacaguu

SEQ ID NO: 2369911 - RNA, 15 nt, Human
uuauuuguacaguuc

SEQ ID NO: 2369912 - RNA, 22 nt, Human
uuauuuguguuuuaauuuaaac

SEQ ID NO: 2369913 - RNA, 13 nt, Human
uuauuuguguaau

SEQ ID NO: 2369914 - RNA, 16 nt, Human
uuauuuguguaauaga

SEQ ID NO: 2369915 - RNA, 13 nt, Human
uuauuuuaaaaga

SEQ ID NO: 2369916 - RNA, 21 nt, Human
uuauuuguguaauagaaaacu

SEQ ID NO: 2369917 - RNA, 18 nt, Human
uuauuuguuauuuucagu

SEQ ID NO: 2369918 - RNA, 19 nt, Human
uuauuuuaauaauguuuca

SEQ ID NO: 2369919 - RNA, 15 nt, Human
uuauuuguuuucccg

SEQ ID NO: 2369920 - RNA, 14 nt, Human
uuauuuuaaacaaa

SEQ ID NO: 2369921 - RNA, 16 nt, Human
uuauuuuaaacaaaau

SEQ ID NO: 2369922 - RNA, 15 nt, Human
uucaauauccuuugc

SEQ ID NO: 2369923 - RNA, 11 nt, Human
uucaauauuua

SEQ ID NO: 2369924 - RNA, 17 nt, Human
uucacaaacuuuuauac

SEQ ID NO: 2369925 - RNA, 16 nt, Human
uucacaaacuuuuaua

SEQ ID NO: 2369926 - RNA, 11 nt, Human
uucacaaauaa

SEQ ID NO: 2369927 - RNA, 15 nt, Human
uucacaaagcccaag

SEQ ID NO: 2369928 - RNA, 22 nt, Human
uucacaaacuuuuauacucuuu

SEQ ID NO: 2369929 - RNA, 20 nt, Human
uucaauaagcaucaaacucu

SEQ ID NO: 2369930 - RNA, 21 nt, Human
uucaauaggaaaaacugauuu

SEQ ID NO: 2369931 - RNA, 22 nt, Human
uucaauaggaaaaacugauuuu

SEQ ID NO: 2369932 - RNA, 21 nt, Human
uucacaaccuucuguggcuca

SEQ ID NO: 2369933 - RNA, 15 nt, Human
uucaccccucccuuu

SEQ ID NO: 2369934 - RNA, 16 nt, Human
uucaccccucccuuuc

SEQ ID NO: 2369935 - RNA, 22 nt, Human
uucacaagacccaaaaggcaga

SEQ ID NO: 2369936 - RNA, 13 nt, Human
uucacccuuuucu

SEQ ID NO: 2369937 - RNA, 17 nt, Human
uucaccccucccuuucu

SEQ ID NO: 2369938 - RNA, 18 nt, Human
uucaccccucccuuucuc

SEQ ID NO: 2369939 - RNA, 20 nt, Human
uucaccccucccuuucuccc

SEQ ID NO: 2369940 - RNA, 22 nt, Human
uucaccccucccuuucuccccu

SEQ ID NO: 2369941 - RNA, 22 nt, Human
uucacccuguccaaacugccua

SEQ ID NO: 2369942 - RNA, 14 nt, Human
uucaccgaggacau

SEQ ID NO: 2369943 - RNA, 14 nt, Human
uucaccuuuguccc

SEQ ID NO: 2369944 - RNA, 19 nt, Human
uucaccuuuguccccaccg

SEQ ID NO: 2369945 - RNA, 20 nt, Human
uucaccuuuguccccaccgc

SEQ ID NO: 2369946 - RNA, 14 nt, Human
uucagcucacugca

SEQ ID NO: 2369947 - RNA, 14 nt, Human
uucagauauaaaag

SEQ ID NO: 2369948 - RNA, 15 nt, Human
uucagauauaaaaga

SEQ ID NO: 2369949 - RNA, 12 nt, Human
uucagauauaaa

SEQ ID NO: 2369950 - RNA, 12 nt, Human
uucagauacaug

SEQ ID NO: 2369951 - RNA, 17 nt, Human
uucagauacaaacugca

SEQ ID NO: 2369952 - RNA, 17 nt, Human
uucagacagcugccugg

SEQ ID NO: 2369953 - RNA, 17 nt, Human
uucacggaagagccuug

SEQ ID NO: 2369954 - RNA, 14 nt, Human
uucagacagcugcc

SEQ ID NO: 2369955 - RNA, 15 nt, Human
uucagacagcugccu

SEQ ID NO: 2369956 - RNA, 16 nt, Human
uucagacagcugccug

SEQ ID NO: 2369957 - RNA, 19 nt, Human
uucaccucacugaaaacau

SEQ ID NO: 2369958 - RNA, 17 nt, Human
uucacgaaguguugcau

SEQ ID NO: 2369959 - RNA, 20 nt, Human
uucacgaaguguugcaugga

SEQ ID NO: 2369960 - RNA, 15 nt, Human
uucacgagagcccgg

SEQ ID NO: 2369961 - RNA, 22 nt, Human
uucaccucacugaaaacaucug

SEQ ID NO: 2369962 - RNA, 22 nt, Human
uucaccuuuguccccaccgcag

SEQ ID NO: 2369963 - RNA, 23 nt, Human
uucacgccuguaaucccagcacu

SEQ ID NO: 2369964 - RNA, 21 nt, Human
uucacgccuguaaucccagca

SEQ ID NO: 2369965 - RNA, 13 nt, Human
uucacggaagagc

SEQ ID NO: 2369966 - RNA, 22 nt, Human
uugaacugauaguuacuguugu

SEQ ID NO: 2369967 - RNA, 20 nt, Human
uugaacugauaguuacuguu

SEQ ID NO: 2369968 - RNA, 21 nt, Human
uugaacugauaguuacuguug

SEQ ID NO: 2369969 - RNA, 13 nt, Human
uugaacuuugacc

SEQ ID NO: 2369970 - RNA, 18 nt, Human
uugaacuggguacuugug

SEQ ID NO: 2369971 - RNA, 15 nt, Human
uugaacuccugggcu

SEQ ID NO: 2369972 - RNA, 19 nt, Human
uugaacugauaguuacugu

SEQ ID NO: 2369973 - RNA, 17 nt, Human
uugaacuccugaccuca

SEQ ID NO: 2369974 - RNA, 22 nt, Human
uugaacuuaaauaaaugucauu

SEQ ID NO: 2369975 - RNA, 14 nt, Human
uugaauuguaagga

SEQ ID NO: 2369976 - RNA, 18 nt, Human
uugaacuuaaauaaaugu

SEQ ID NO: 2369977 - RNA, 18 nt, Human
uugaacuuccugcaggua

SEQ ID NO: 2369978 - RNA, 16 nt, Human
uugaauuuucccacug

SEQ ID NO: 2369979 - RNA, 17 nt, Human
uugaauuuucccacugc

SEQ ID NO: 2369980 - RNA, 18 nt, Human
uugaauuuugaugaacaa

SEQ ID NO: 2369981 - RNA, 18 nt, Human
uugaauuuucccacugca

SEQ ID NO: 2369982 - RNA, 14 nt, Human
uugaauuuucugug

SEQ ID NO: 2369983 - RNA, 14 nt, Human
uugacaacaaauua

SEQ ID NO: 2369984 - RNA, 13 nt, Human
uugacaaacucuc

SEQ ID NO: 2369985 - RNA, 13 nt, Human
uugacaacaucug

SEQ ID NO: 2369986 - RNA, 12 nt, Human
uugacaacaucu

SEQ ID NO: 2369987 - RNA, 16 nt, Human
uugacaaccaugagac

SEQ ID NO: 2369988 - RNA, 20 nt, Human
uugacaaagucaagccacau

SEQ ID NO: 2369989 - RNA, 18 nt, Human
uugacaaaggcaagcacu

SEQ ID NO: 2369990 - RNA, 19 nt, Human
uugacaaagucaagccaca

SEQ ID NO: 2369991 - RNA, 16 nt, Human
uugacaaaauuuguug

SEQ ID NO: 2369992 - RNA, 20 nt, Human
uugaccgcgacuaauuucaa

SEQ ID NO: 2369993 - RNA, 21 nt, Human
uugaccucaggugauccaccc

SEQ ID NO: 2369994 - RNA, 15 nt, Human
uugaccucugcagca

SEQ ID NO: 2369995 - RNA, 14 nt, Human
uugaccucugcagc

SEQ ID NO: 2369996 - RNA, 18 nt, Human
uugacaauaaaugugcuu

SEQ ID NO: 2369997 - RNA, 22 nt, Human
uugacaagucauuuuaacuuua

SEQ ID NO: 2369998 - RNA, 14 nt, Human
uugacccacaagaa

SEQ ID NO: 2369999 - RNA, 17 nt, Human
uugaccgugaggccaga

SEQ ID NO: 2370000 - RNA, 17 nt, Human
uugacccacaagaaaug

SEQ ID NO: 2370001 - RNA, 23 nt, Human
uugacuccuugugguuuauguca

SEQ ID NO: 2370002 - RNA, 19 nt, Human
uugacucuggcaaagcuuu

SEQ ID NO: 2370003 - RNA, 13 nt, Human
uugacucugggga

SEQ ID NO: 2370004 - RNA, 15 nt, Human
uugacucuuuugcca

SEQ ID NO: 2370005 - RNA, 21 nt, Human
uugacucuuuugccauuaaac

SEQ ID NO: 2370006 - RNA, 20 nt, Human
uugacugaagaugcagcuca

SEQ ID NO: 2370007 - RNA, 14 nt, Human
uugacucaccuguu

SEQ ID NO: 2370008 - RNA, 19 nt, Human
uugacucaccuguuacuug

SEQ ID NO: 2370009 - RNA, 16 nt, Human
uugaccucugcagcaa

SEQ ID NO: 2370010 - RNA, 17 nt, Human
uugacgccaucccagcc

SEQ ID NO: 2370011 - RNA, 18 nt, Human
uugacgccaucccagccc

SEQ ID NO: 2370012 - RNA, 19 nt, Human
uugacgccaucccagcccc

SEQ ID NO: 2370013 - RNA, 18 nt, Human
uugauauaaauaaaacau

SEQ ID NO: 2370014 - RNA, 20 nt, Human
uugauauacuuuuuucuuau

SEQ ID NO: 2370015 - RNA, 21 nt, Human
uugauauacuuuuuucuuauu

SEQ ID NO: 2370016 - RNA, 17 nt, Human
uugauauagaacagugc

SEQ ID NO: 2370017 - RNA, 22 nt, Human
uugauauagaacagugcuugcc

SEQ ID NO: 2370018 - RNA, 23 nt, Human
uugauauccucuuugagugaagc

SEQ ID NO: 2370019 - RNA, 17 nt, Human
uugaggucugcucggcc

SEQ ID NO: 2370020 - RNA, 14 nt, Human
uugauagcuuuauu

SEQ ID NO: 2370021 - RNA, 19 nt, Human
uugauagcuuuauuuuuua

SEQ ID NO: 2370022 - RNA, 23 nt, Human
uugauagcacagacccugcccug

SEQ ID NO: 2370023 - RNA, 20 nt, Human
uugaugaccaaaguccuuuu

SEQ ID NO: 2370024 - RNA, 15 nt, Human
uugauaucacagucu

SEQ ID NO: 2370025 - RNA, 23 nt, Human
uugaugaagaaguugauaugccu

SEQ ID NO: 2370026 - RNA, 13 nt, Human
uugaugaagaagu

SEQ ID NO: 2370027 - RNA, 14 nt, Human
uugaugaagaaguu

SEQ ID NO: 2370028 - RNA, 21 nt, Human
uugagguaggagaauugcuug

SEQ ID NO: 2370029 - RNA, 19 nt, Human
uugagguacucugcacaua

SEQ ID NO: 2370030 - RNA, 22 nt, Human
uugaggucaaguaagaagacau

SEQ ID NO: 2370031 - RNA, 16 nt, Human
uugaggucaaguaaga

SEQ ID NO: 2370032 - RNA, 21 nt, Human
uugagguccagcccuggcuga

SEQ ID NO: 2370033 - RNA, 16 nt, Human
uugaggguugggcugg

SEQ ID NO: 2370034 - RNA, 13 nt, Human
uugaggguugggc

SEQ ID NO: 2370035 - RNA, 20 nt, Human
uugagccgggccccugggcu

SEQ ID NO: 2370036 - RNA, 11 nt, Human
uugagccuggg

SEQ ID NO: 2370037 - RNA, 19 nt, Human
uugagccgggccccugggc

SEQ ID NO: 2370038 - RNA, 19 nt, Human
uugagccccaaguccugaa

SEQ ID NO: 2370039 - RNA, 14 nt, Human
uugagccccaaguc

SEQ ID NO: 2370040 - RNA, 18 nt, Human
uugagccccaaguccuga

SEQ ID NO: 2370041 - RNA, 23 nt, Human
uugagccccaaguccugaagagg

SEQ ID NO: 2370042 - RNA, 13 nt, Human
uugagcccaggag

SEQ ID NO: 2370043 - RNA, 22 nt, Human
uugagccaggccugggucugug

SEQ ID NO: 2370044 - RNA, 19 nt, Human
uugagcccacaaagccuua

SEQ ID NO: 2370045 - RNA, 17 nt, Human
uugagccaggccugggu

SEQ ID NO: 2370046 - RNA, 13 nt, Human
uugagccaggccu

SEQ ID NO: 2370047 - RNA, 19 nt, Human
uugagccagcagacauugu

SEQ ID NO: 2370048 - RNA, 20 nt, Human
uugagccagcagacauuguc

SEQ ID NO: 2370049 - RNA, 23 nt, Human
uugacuggguuucucuguauagu

SEQ ID NO: 2370050 - RNA, 17 nt, Human
uugacuggguuucucug

SEQ ID NO: 2370051 - RNA, 12 nt, Human
uugacuguuuuu

SEQ ID NO: 2370052 - RNA, 19 nt, Human
uugacuguuuuuacccaua

SEQ ID NO: 2370053 - RNA, 23 nt, Human
uugauuuuacaauugaaaugacu

SEQ ID NO: 2370054 - RNA, 13 nt, Human
uugauuuuacaau

SEQ ID NO: 2370055 - RNA, 20 nt, Human
uugauuuuagccuucucugu

SEQ ID NO: 2370056 - RNA, 18 nt, Human
uugauuugaagaacaugu

SEQ ID NO: 2370057 - RNA, 14 nt, Human
uugauuugcauuga

SEQ ID NO: 2370058 - RNA, 13 nt, Human
uugauuugcauug

SEQ ID NO: 2370059 - RNA, 19 nt, Human
uugauuugcauugaacaca

SEQ ID NO: 2370060 - RNA, 17 nt, Human
uugauuugcauugaaca

SEQ ID NO: 2370061 - RNA, 15 nt, Human
uugauuugcauugaa

SEQ ID NO: 2370062 - RNA, 12 nt, Human
uugcaaauaguc

SEQ ID NO: 2370063 - RNA, 22 nt, Human
uugcaaaggagcucacuguggu

SEQ ID NO: 2370064 - RNA, 21 nt, Human
uugcaaaguaucccuacugua

SEQ ID NO: 2370065 - RNA, 17 nt, Human
uugcaaaucuugaaauu

SEQ ID NO: 2370066 - RNA, 23 nt, Human
uugcaaaugcccuuacacuuacu

SEQ ID NO: 2370067 - RNA, 16 nt, Human
uugcaaaucuugaaau

SEQ ID NO: 2370068 - RNA, 15 nt, Human
uugcaaaucuugaaa

SEQ ID NO: 2370069 - RNA, 12 nt, Human
uugcaaaucuug

SEQ ID NO: 2370070 - RNA, 23 nt, Human
uugauugcuaaauguaacagucu

SEQ ID NO: 2370071 - RNA, 14 nt, Human
uugauuugaagaac

SEQ ID NO: 2370072 - RNA, 13 nt, Human
uugauuugaagaa

SEQ ID NO: 2370073 - RNA, 21 nt, Human
uugauugagaguaacuuaagu

SEQ ID NO: 2370074 - RNA, 12 nt, Human
uugauucuuccu

SEQ ID NO: 2370075 - RNA, 20 nt, Human
uugauucugcaguaaaucuu

SEQ ID NO: 2370076 - RNA, 12 nt, Human
uugauucugcag

SEQ ID NO: 2370077 - RNA, 14 nt, Human
uugauugauuugaa

SEQ ID NO: 2370078 - RNA, 13 nt, Human
uugauugauuuga

SEQ ID NO: 2370079 - RNA, 12 nt, Human
uugauugcuaaa

SEQ ID NO: 2370080 - RNA, 13 nt, Human
uugauugcuaaau

SEQ ID NO: 2370081 - RNA, 15 nt, Human
uugauugcuaaaugu

SEQ ID NO: 2370082 - RNA, 20 nt, Human
uugauugcuaaauguaacag

SEQ ID NO: 2370083 - RNA, 16 nt, Human
uugaugaucuuugcag

SEQ ID NO: 2370084 - RNA, 19 nt, Human
uugauaucacagucuaauu

SEQ ID NO: 2370085 - RNA, 14 nt, Human
uugaugaggccucu

SEQ ID NO: 2370086 - RNA, 17 nt, Human
uugaugacccccaacca

SEQ ID NO: 2370087 - RNA, 20 nt, Human
uugaugcauuaaaagaaaau

SEQ ID NO: 2370088 - RNA, 19 nt, Human
uugaugcauuaaaagaaaa

SEQ ID NO: 2370089 - RNA, 19 nt, Human
uucuucccaucacuggagc

SEQ ID NO: 2370090 - RNA, 21 nt, Human
uucuucccuuuuacauacugc

SEQ ID NO: 2370091 - RNA, 20 nt, Human
uucuucccuuuuacauacug

SEQ ID NO: 2370092 - RNA, 22 nt, Human
uucuucccuuuuacauacugcu

SEQ ID NO: 2370093 - RNA, 21 nt, Human
uucuuccuauuugccaugggc

SEQ ID NO: 2370094 - RNA, 13 nt, Human
uucuuccauccca

SEQ ID NO: 2370095 - RNA, 13 nt, Human
uucuuccaucuga

SEQ ID NO: 2370096 - RNA, 14 nt, Human
uucuuccaucccag

SEQ ID NO: 2370097 - RNA, 16 nt, Human
uucuuccaucccagga

SEQ ID NO: 2370098 - RNA, 17 nt, Human
uucuuccaucccaggac

SEQ ID NO: 2370099 - RNA, 14 nt, Human
uucuuccaucugau

SEQ ID NO: 2370100 - RNA, 21 nt, Human
uucuuauacauuugauaaagu

SEQ ID NO: 2370101 - RNA, 17 nt, Human
uucuuccaaaaagauuu

SEQ ID NO: 2370102 - RNA, 22 nt, Human
uucuuauaaauaugaagcucac

SEQ ID NO: 2370103 - RNA, 21 nt, Human
uucuucauucaauacaagugu

SEQ ID NO: 2370104 - RNA, 20 nt, Human
uucuuccaggugcccagcua

SEQ ID NO: 2370105 - RNA, 19 nt, Human
uucuuccaggugcccagcu

SEQ ID NO: 2370106 - RNA, 21 nt, Human
uucuuccacaagagcccaggc

SEQ ID NO: 2370107 - RNA, 14 nt, Human
uucuuuccaaagua

SEQ ID NO: 2370108 - RNA, 12 nt, Human
uucuuucagcca

SEQ ID NO: 2370109 - RNA, 23 nt, Human
uucuuuaaaaaacaacuauggau

SEQ ID NO: 2370110 - RNA, 13 nt, Human
uucuuuaaaagaa

SEQ ID NO: 2370111 - RNA, 16 nt, Human
uucuuuaaaagaaugg

SEQ ID NO: 2370112 - RNA, 19 nt, Human
uucuuuaaaagaaugggca

SEQ ID NO: 2370113 - RNA, 13 nt, Human
uucuuccucccuc

SEQ ID NO: 2370114 - RNA, 21 nt, Human
uucuuguguguuuauugucaa

SEQ ID NO: 2370115 - RNA, 22 nt, Human
uugaaaaaauagagccugaggg

SEQ ID NO: 2370116 - RNA, 16 nt, Human
uugaaaaccugacaaa

SEQ ID NO: 2370117 - RNA, 18 nt, Human
uugaaaacauaaucugca

SEQ ID NO: 2370118 - RNA, 23 nt, Human
uugaaaacacuguucucugcccu

SEQ ID NO: 2370119 - RNA, 18 nt, Human
uucuuuuuuuucauuaua

SEQ ID NO: 2370120 - RNA, 14 nt, Human
uucuuucauuuucu

SEQ ID NO: 2370121 - RNA, 21 nt, Human
uucuuuccaaaguacacuguu

SEQ ID NO: 2370122 - RNA, 20 nt, Human
uugaaaaaauagagccugag

SEQ ID NO: 2370123 - RNA, 20 nt, Human
uugaaaaaccauuuugcugu

SEQ ID NO: 2370124 - RNA, 12 nt, Human
uugaaaagcuau

SEQ ID NO: 2370125 - RNA, 21 nt, Human
uugaaaagaggugugcaagag

SEQ ID NO: 2370126 - RNA, 14 nt, Human
uugaaaagaggugu

SEQ ID NO: 2370127 - RNA, 13 nt, Human
uugaaaagacauc

SEQ ID NO: 2370128 - RNA, 17 nt, Human
uugaaaacuuuucucag

SEQ ID NO: 2370129 - RNA, 13 nt, Human
uugaaaagaggug

SEQ ID NO: 2370130 - RNA, 13 nt, Human
uugaaaacuuuuc

SEQ ID NO: 2370131 - RNA, 14 nt, Human
uugaaaacuuuucu

SEQ ID NO: 2370132 - RNA, 16 nt, Human
uugaaaacuuuucuca

SEQ ID NO: 2370133 - RNA, 15 nt, Human
uugaacuccuggccu

SEQ ID NO: 2370134 - RNA, 16 nt, Human
uugaacuccuggccuc

SEQ ID NO: 2370135 - RNA, 15 nt, Human
uugaaaagucaaacu

SEQ ID NO: 2370136 - RNA, 15 nt, Human
uugaacucagaucug

SEQ ID NO: 2370137 - RNA, 20 nt, Human
uugaacucagaucugucuga

SEQ ID NO: 2370138 - RNA, 13 nt, Human
uugaaaagcuauu

SEQ ID NO: 2370139 - RNA, 22 nt, Human
uugaaaagcuauuagccaggau

SEQ ID NO: 2370140 - RNA, 14 nt, Human
uugaaaagcuauua

SEQ ID NO: 2370141 - RNA, 16 nt, Human
uugaaaaggugaccuu

SEQ ID NO: 2370142 - RNA, 14 nt, Human
uucugcuuaggaga

SEQ ID NO: 2370143 - RNA, 20 nt, Human
uucugcugggcuggggccug

SEQ ID NO: 2370144 - RNA, 18 nt, Human
uucugcuuguguuaagua

SEQ ID NO: 2370145 - RNA, 19 nt, Human
uucugcuucagccucccga

SEQ ID NO: 2370146 - RNA, 15 nt, Human
uucugcuucagccuc

SEQ ID NO: 2370147 - RNA, 16 nt, Human
uucugcuucagccucc

SEQ ID NO: 2370148 - RNA, 18 nt, Human
uucugcuggaaacagacu

SEQ ID NO: 2370149 - RNA, 21 nt, Human
uucugcuggauaaaaugaggu

SEQ ID NO: 2370150 - RNA, 13 nt, Human
uucugcuggauaa

SEQ ID NO: 2370151 - RNA, 12 nt, Human
uucugcuggccu

SEQ ID NO: 2370152 - RNA, 14 nt, Human
uucugcugaauuuu

SEQ ID NO: 2370153 - RNA, 18 nt, Human
uucugcugaauuuucaca

SEQ ID NO: 2370154 - RNA, 20 nt, Human
uucugcugaauuuucacaug

SEQ ID NO: 2370155 - RNA, 14 nt, Human
uucugcuucagccu

SEQ ID NO: 2370156 - RNA, 13 nt, Human
uucugcuggccug

SEQ ID NO: 2370157 - RNA, 14 nt, Human
uucugcuggccugg

SEQ ID NO: 2370158 - RNA, 15 nt, Human
uucugcuggccugga

SEQ ID NO: 2370159 - RNA, 18 nt, Human
uucugcuggccuggaucu

SEQ ID NO: 2370160 - RNA, 19 nt, Human
uucugcuggccuggaucuc

SEQ ID NO: 2370161 - RNA, 13 nt, Human
uucugcugggcug

SEQ ID NO: 2370162 - RNA, 15 nt, Human
uucugcugggcuggg

SEQ ID NO: 2370163 - RNA, 15 nt, Human
uucuggagcccuugg

SEQ ID NO: 2370164 - RNA, 13 nt, Human
uucuggagcccuu

SEQ ID NO: 2370165 - RNA, 20 nt, Human
uucuggagguugauaacuuu

SEQ ID NO: 2370166 - RNA, 15 nt, Human
uucuggagucuccag

SEQ ID NO: 2370167 - RNA, 17 nt, Human
uucuggagucuccagug

SEQ ID NO: 2370168 - RNA, 10 nt, Human
uucuggaguu

SEQ ID NO: 2370169 - RNA, 10 nt, Human
uucuggagcc

SEQ ID NO: 2370170 - RNA, 21 nt, Human
uucuggaccuuguuguuguua

SEQ ID NO: 2370171 - RNA, 19 nt, Human
uucuggacccguucaacuu

SEQ ID NO: 2370172 - RNA, 22 nt, Human
uucuggaauguaaucaauguuu

SEQ ID NO: 2370173 - RNA, 15 nt, Human
uucuggaauguaauc

SEQ ID NO: 2370174 - RNA, 19 nt, Human
uucuggaauacaugaaaua

SEQ ID NO: 2370175 - RNA, 16 nt, Human
uucuggaauguaauca

SEQ ID NO: 2370176 - RNA, 20 nt, Human
uucuggaauguaaucaaugu

SEQ ID NO: 2370177 - RNA, 15 nt, Human
uucugcuuucaucuu

SEQ ID NO: 2370178 - RNA, 16 nt, Human
uucugcuuaggagaga

SEQ ID NO: 2370179 - RNA, 18 nt, Human
uucugcuuuccucuuccu

SEQ ID NO: 2370180 - RNA, 14 nt, Human
uucugcuuugcucu

SEQ ID NO: 2370181 - RNA, 21 nt, Human
uucugcuuuuaccaugccccu

SEQ ID NO: 2370182 - RNA, 17 nt, Human
uucuggaauacaugaaa

SEQ ID NO: 2370183 - RNA, 19 nt, Human
uucugcuuuugaaaucugu

SEQ ID NO: 2370184 - RNA, 18 nt, Human
uucuggaaaagaggaguu

SEQ ID NO: 2370185 - RNA, 13 nt, Human
uucugcuuuucug

SEQ ID NO: 2370186 - RNA, 17 nt, Human
uucugcuuuucugcccu

SEQ ID NO: 2370187 - RNA, 18 nt, Human
uucugcuuuucugcccug

SEQ ID NO: 2370188 - RNA, 19 nt, Human
uucugcuuuucugcccugg

SEQ ID NO: 2370189 - RNA, 14 nt, Human
uucuuaguugcugu

SEQ ID NO: 2370190 - RNA, 15 nt, Human
uucuuaguugcugua

SEQ ID NO: 2370191 - RNA, 23 nt, Human
uucuuaguugcuguaugucucgu

SEQ ID NO: 2370192 - RNA, 13 nt, Human
uucuuauaaauau

SEQ ID NO: 2370193 - RNA, 14 nt, Human
uucuuauaaauaug

SEQ ID NO: 2370194 - RNA, 15 nt, Human
uucuuauaaauauga

SEQ ID NO: 2370195 - RNA, 17 nt, Human
uucuuauaaauaugaag

SEQ ID NO: 2370196 - RNA, 20 nt, Human
uucuguguguuuucauaaua

SEQ ID NO: 2370197 - RNA, 22 nt, Human
uucugugugugaugugcauggg

SEQ ID NO: 2370198 - RNA, 23 nt, Human
uucugugugcaccuuaccaacuu

SEQ ID NO: 2370199 - RNA, 22 nt, Human
uucugugguuuuccccucccug

SEQ ID NO: 2370200 - RNA, 18 nt, Human
uucuuaguucucacuguu

SEQ ID NO: 2370201 - RNA, 19 nt, Human
uucuuaguucucacuguuc

SEQ ID NO: 2370202 - RNA, 13 nt, Human
uucugugugaaga

SEQ ID NO: 2370203 - RNA, 23 nt, Human
uucugugucuuucacagcuccuc

SEQ ID NO: 2370204 - RNA, 12 nt, Human
uucugugucuuu

SEQ ID NO: 2370205 - RNA, 22 nt, Human
uucugugucuuucacagcuccu

SEQ ID NO: 2370206 - RNA, 18 nt, Human
uucugugguuuuccccuc

SEQ ID NO: 2370207 - RNA, 20 nt, Human
uucugugguuuuccccuccc

SEQ ID NO: 2370208 - RNA, 23 nt, Human
uucugugguuuuccccucccugg

SEQ ID NO: 2370209 - RNA, 21 nt, Human
uucugucucugccucccucac

SEQ ID NO: 2370210 - RNA, 14 nt, Human
uucugucuuuagau

SEQ ID NO: 2370211 - RNA, 17 nt, Human
uucugucuucacaacag

SEQ ID NO: 2370212 - RNA, 18 nt, Human
uucuguauuuuguuuuug

SEQ ID NO: 2370213 - RNA, 20 nt, Human
uucuguauuuuuuuuucuaa

SEQ ID NO: 2370214 - RNA, 22 nt, Human
uucuguauuuuuuuuucuaaga

SEQ ID NO: 2370215 - RNA, 11 nt, Human
uucuguauuuu

SEQ ID NO: 2370216 - RNA, 20 nt, Human
uucuggauuuugucaagcag

SEQ ID NO: 2370217 - RNA, 15 nt, Human
uucuggauucuuggc

SEQ ID NO: 2370218 - RNA, 15 nt, Human
uucuggaugcauuuc

SEQ ID NO: 2370219 - RNA, 20 nt, Human
uucuggaugcauuucucugg

SEQ ID NO: 2370220 - RNA, 13 nt, Human
uucuggauaaagc

SEQ ID NO: 2370221 - RNA, 18 nt, Human
uucuggauaaagccacug

SEQ ID NO: 2370222 - RNA, 19 nt, Human
uucuggauaaagccacuga

SEQ ID NO: 2370223 - RNA, 23 nt, Human
uucuguccuuuuggcacugagau

SEQ ID NO: 2370224 - RNA, 18 nt, Human
uucugucgccuuagcaug

SEQ ID NO: 2370225 - RNA, 22 nt, Human
uucuguccuuuuggcacugaga

SEQ ID NO: 2370226 - RNA, 14 nt, Human
uucuguccuucaga

SEQ ID NO: 2370227 - RNA, 17 nt, Human
uucugucccuuggagcu

SEQ ID NO: 2370228 - RNA, 13 nt, Human
uucuguccugcug

SEQ ID NO: 2370229 - RNA, 18 nt, Human
uucuguccuggugucacu

SEQ ID NO: 2370230 - RNA, 16 nt, Human
uucugucucauaugau

SEQ ID NO: 2370231 - RNA, 21 nt, Human
uucugucgccuuagcauguuu

SEQ ID NO: 2370232 - RNA, 13 nt, Human
uucugucucugcc

SEQ ID NO: 2370233 - RNA, 14 nt, Human
uucugucucugccu

SEQ ID NO: 2370234 - RNA, 19 nt, Human
uucugucucugccucccuc

SEQ ID NO: 2370235 - RNA, 14 nt, Human
uucugucaagaaga

SEQ ID NO: 2370236 - RNA, 19 nt, Human
uucuguccuacucuguguc

SEQ ID NO: 2370237 - RNA, 14 nt, Human
uucugucccuucug

SEQ ID NO: 2370238 - RNA, 15 nt, Human
uucugucccucacag

SEQ ID NO: 2370239 - RNA, 17 nt, Human
uucggggaacuccugga

SEQ ID NO: 2370240 - RNA, 21 nt, Human
uucgggugugcaaugucugag

SEQ ID NO: 2370241 - RNA, 17 nt, Human
uucgggugugcaauguc

SEQ ID NO: 2370242 - RNA, 16 nt, Human
uuccuuucauuuacug

SEQ ID NO: 2370243 - RNA, 14 nt, Human
uuccuuuauauuua

SEQ ID NO: 2370244 - RNA, 13 nt, Human
uuccuuuauaaug

SEQ ID NO: 2370245 - RNA, 18 nt, Human
uucggugagcuacaaaug

SEQ ID NO: 2370246 - RNA, 20 nt, Human
uuccugauaugauuuaaaac

SEQ ID NO: 2370247 - RNA, 18 nt, Human
uuccuugcucugcacccc

SEQ ID NO: 2370248 - RNA, 17 nt, Human
uuccuuggacucauuuu

SEQ ID NO: 2370249 - RNA, 20 nt, Human
uuccuugcuguccuaggcca

SEQ ID NO: 2370250 - RNA, 18 nt, Human
uuccuugcuguccuaggc

SEQ ID NO: 2370251 - RNA, 18 nt, Human
uuccuuguauuuaaauau

SEQ ID NO: 2370252 - RNA, 15 nt, Human
uuccuuguauuuaaa

SEQ ID NO: 2370253 - RNA, 13 nt, Human
uuccuugucccca

SEQ ID NO: 2370254 - RNA, 16 nt, Human
uuccuugucacuggua

SEQ ID NO: 2370255 - RNA, 17 nt, Human
uuccuuuaaaaaaauuu

SEQ ID NO: 2370256 - RNA, 23 nt, Human
uuccuuuaaaaaaauuuaagugc

SEQ ID NO: 2370257 - RNA, 21 nt, Human
uuccuuguccccacacuccua

SEQ ID NO: 2370258 - RNA, 16 nt, Human
uuccuuguccccacac

SEQ ID NO: 2370259 - RNA, 17 nt, Human
uuccuuguccccacacu

SEQ ID NO: 2370260 - RNA, 20 nt, Human
uuccuuguccccacacuccu

SEQ ID NO: 2370261 - RNA, 16 nt, Human
uuccuuuaaaaaaauu

SEQ ID NO: 2370262 - RNA, 21 nt, Human
uuccuugaguugauucagcuc

SEQ ID NO: 2370263 - RNA, 15 nt, Human
uuccuggacacucag

SEQ ID NO: 2370264 - RNA, 13 nt, Human
uuccuugccugca

SEQ ID NO: 2370265 - RNA, 19 nt, Human
uuccuugccugcacaaacu

SEQ ID NO: 2370266 - RNA, 13 nt, Human
uuccuugcuaaug

SEQ ID NO: 2370267 - RNA, 13 nt, Human
uuccuugcucaac

SEQ ID NO: 2370268 - RNA, 15 nt, Human
uuccuugcucaacca

SEQ ID NO: 2370269 - RNA, 11 nt, Human
uuccuugcucu

SEQ ID NO: 2370270 - RNA, 13 nt, Human
uuccuugcucucc

SEQ ID NO: 2370271 - RNA, 14 nt, Human
uuccuugcucuccc

SEQ ID NO: 2370272 - RNA, 16 nt, Human
uuccuugcucugcacc

SEQ ID NO: 2370273 - RNA, 21 nt, Human
uuccugcgggcuuuuccccgg

SEQ ID NO: 2370274 - RNA, 15 nt, Human
uuccugcguccuccu

SEQ ID NO: 2370275 - RNA, 20 nt, Human
uuccugcggagugaagaggg

SEQ ID NO: 2370276 - RNA, 23 nt, Human
uuccugcggagugaagaggggca

SEQ ID NO: 2370277 - RNA, 23 nt, Human
uuccugccuucuucuuuuugcug

SEQ ID NO: 2370278 - RNA, 17 nt, Human
uuccugcggagugaaga

SEQ ID NO: 2370279 - RNA, 19 nt, Human
uuccugcggagugaagagg

SEQ ID NO: 2370280 - RNA, 18 nt, Human
uuccugccugucuccuuu

SEQ ID NO: 2370281 - RNA, 16 nt, Human
uuccugccugucuccu

SEQ ID NO: 2370282 - RNA, 18 nt, Human
uuccugcauucacccaga

SEQ ID NO: 2370283 - RNA, 18 nt, Human
uuccugcagccuggaggc

SEQ ID NO: 2370284 - RNA, 15 nt, Human
uuccugccugucucc

SEQ ID NO: 2370285 - RNA, 19 nt, Human
uuccugcguccuccucacc

SEQ ID NO: 2370286 - RNA, 16 nt, Human
uuccugcguccuccuc

SEQ ID NO: 2370287 - RNA, 17 nt, Human
uuccugcguccuccuca

SEQ ID NO: 2370288 - RNA, 17 nt, Human
uuccauggcccucauua

SEQ ID NO: 2370289 - RNA, 21 nt, Human
uuccauggugugaucgucuga

SEQ ID NO: 2370290 - RNA, 12 nt, Human
uuccauggggua

SEQ ID NO: 2370291 - RNA, 16 nt, Human
uuccauggccucuuca

SEQ ID NO: 2370292 - RNA, 14 nt, Human
uuccauggauuuug

SEQ ID NO: 2370293 - RNA, 23 nt, Human
uuccaugccugaggguggagacu

SEQ ID NO: 2370294 - RNA, 15 nt, Human
uuccauggcccucau

SEQ ID NO: 2370295 - RNA, 16 nt, Human
uuccauggcccucauu

SEQ ID NO: 2370296 - RNA, 12 nt, Human
uuccauggccuc

SEQ ID NO: 2370297 - RNA, 16 nt, Human
uuccugaaugaaauau

SEQ ID NO: 2370298 - RNA, 20 nt, Human
uuccugaauucuauuugcug

SEQ ID NO: 2370299 - RNA, 13 nt, Human
uuccugacacuuu

SEQ ID NO: 2370300 - RNA, 22 nt, Human
uuccugacacuuuaauuaccaa

SEQ ID NO: 2370301 - RNA, 22 nt, Human
uuccugaauucuauuugcuggg

SEQ ID NO: 2370302 - RNA, 13 nt, Human
uuccugacccagg

SEQ ID NO: 2370303 - RNA, 14 nt, Human
uuccugacccaggc

SEQ ID NO: 2370304 - RNA, 15 nt, Human
uuccugacccaggcc

SEQ ID NO: 2370305 - RNA, 16 nt, Human
uuccugacccaggccg

SEQ ID NO: 2370306 - RNA, 22 nt, Human
uuccugacccaggccgcagcuc

SEQ ID NO: 2370307 - RNA, 23 nt, Human
uuccugacccaggccgcagcucu

SEQ ID NO: 2370308 - RNA, 14 nt, Human
uuccugaaugaaau

SEQ ID NO: 2370309 - RNA, 14 nt, Human
uuccugaagcugag

SEQ ID NO: 2370310 - RNA, 18 nt, Human
uuccugaauccaaacuaa

SEQ ID NO: 2370311 - RNA, 11 nt, Human
uuccugaagcu

SEQ ID NO: 2370312 - RNA, 13 nt, Human
uuccugaauccaa

SEQ ID NO: 2370313 - RNA, 16 nt, Human
uuccugagcuuggcca

SEQ ID NO: 2370314 - RNA, 21 nt, Human
uuccugaggaagagggacugu

SEQ ID NO: 2370315 - RNA, 20 nt, Human
uuccugaggcugggcucccu

SEQ ID NO: 2370316 - RNA, 20 nt, Human
uuccugagcuuggccagaag

SEQ ID NO: 2370317 - RNA, 13 nt, Human
uuccugagcuugg

SEQ ID NO: 2370318 - RNA, 11 nt, Human
uuccugagcuu

SEQ ID NO: 2370319 - RNA, 15 nt, Human
uuccugaggcugggc

SEQ ID NO: 2370320 - RNA, 21 nt, Human
uuccugcaggccaggccagcu

SEQ ID NO: 2370321 - RNA, 14 nt, Human
uuccugcagccugg

SEQ ID NO: 2370322 - RNA, 15 nt, Human
uuccugcagccugga

SEQ ID NO: 2370323 - RNA, 21 nt, Human
uuccugcaaugaagucucuga

SEQ ID NO: 2370324 - RNA, 13 nt, Human
uuccugcaaugaa

SEQ ID NO: 2370325 - RNA, 20 nt, Human
uuccugcaacucaaggacuu

SEQ ID NO: 2370326 - RNA, 23 nt, Human
uuccugaugcuucuucagagacu

SEQ ID NO: 2370327 - RNA, 19 nt, Human
uuccugauaauaauugauc

SEQ ID NO: 2370328 - RNA, 17 nt, Human
uuccugauaauaauuga

SEQ ID NO: 2370329 - RNA, 21 nt, Human
uuccugauggcaggauggccu

SEQ ID NO: 2370330 - RNA, 19 nt, Human
uuccugaugguacaggaaa

SEQ ID NO: 2370331 - RNA, 22 nt, Human
uuccugaugguacaggaaagcu

SEQ ID NO: 2370332 - RNA, 19 nt, Human
uuccugcaacucaaggacu

SEQ ID NO: 2370333 - RNA, 15 nt, Human
uucuacuuuuaaaga

SEQ ID NO: 2370334 - RNA, 18 nt, Human
uucuacuuuaagcacuac

SEQ ID NO: 2370335 - RNA, 21 nt, Human
uucuacucuuaaguuucucag

SEQ ID NO: 2370336 - RNA, 13 nt, Human
uucuacugugacu

SEQ ID NO: 2370337 - RNA, 18 nt, Human
uucuacucauauauaucu

SEQ ID NO: 2370338 - RNA, 14 nt, Human
uucuacucucccau

SEQ ID NO: 2370339 - RNA, 19 nt, Human
uucuacucucccauggcuu

SEQ ID NO: 2370340 - RNA, 17 nt, Human
uucuacucuuaaguuuc

SEQ ID NO: 2370341 - RNA, 12 nt, Human
uucuacuguaug

SEQ ID NO: 2370342 - RNA, 22 nt, Human
uucuacucgaguuacagacaaa

SEQ ID NO: 2370343 - RNA, 20 nt, Human
uucuauaggaacauaugaaa

SEQ ID NO: 2370344 - RNA, 12 nt, Human
uucuauaugaau

SEQ ID NO: 2370345 - RNA, 20 nt, Human
uucuauaugaauuuaaauau

SEQ ID NO: 2370346 - RNA, 19 nt, Human
uucuaucauuuuuguacag

SEQ ID NO: 2370347 - RNA, 23 nt, Human
uucuauagcagauuguguaacaa

SEQ ID NO: 2370348 - RNA, 14 nt, Human
uucuauagcuuuuc

SEQ ID NO: 2370349 - RNA, 13 nt, Human
uucuacgccaggg

SEQ ID NO: 2370350 - RNA, 12 nt, Human
uucuaccuccca

SEQ ID NO: 2370351 - RNA, 13 nt, Human
uucuaccucccag

SEQ ID NO: 2370352 - RNA, 18 nt, Human
uucuacccuagccauucc

SEQ ID NO: 2370353 - RNA, 20 nt, Human
uucuacccuagccauuccug

SEQ ID NO: 2370354 - RNA, 21 nt, Human
uucuacccuagccauuccugg

SEQ ID NO: 2370355 - RNA, 19 nt, Human
uucuaccuugaggucuuuu

SEQ ID NO: 2370356 - RNA, 18 nt, Human
uucuaccuugaggucuuu

SEQ ID NO: 2370357 - RNA, 12 nt, Human
uucuaccugcca

SEQ ID NO: 2370358 - RNA, 14 nt, Human
uucuaccucccaga

SEQ ID NO: 2370359 - RNA, 11 nt, Human
uucuaccugcc

SEQ ID NO: 2370360 - RNA, 15 nt, Human
uucuacucauauaua

SEQ ID NO: 2370361 - RNA, 13 nt, Human
uucuacuauuuau

SEQ ID NO: 2370362 - RNA, 20 nt, Human
uucuacccagcgagcccugg

SEQ ID NO: 2370363 - RNA, 21 nt, Human
uucuacccagcgagcccuggu

SEQ ID NO: 2370364 - RNA, 14 nt, Human
uucuacccaggugc

SEQ ID NO: 2370365 - RNA, 18 nt, Human
uucuaccauuucagagag

SEQ ID NO: 2370366 - RNA, 15 nt, Human
uucuaccauuucaga

SEQ ID NO: 2370367 - RNA, 22 nt, Human
uucuaccaugaacagaaaacau

SEQ ID NO: 2370368 - RNA, 14 nt, Human
uucuacccuagcca

SEQ ID NO: 2370369 - RNA, 15 nt, Human
uucuacccuagccau

SEQ ID NO: 2370370 - RNA, 18 nt, Human
uucgugaaguauacugua

SEQ ID NO: 2370371 - RNA, 17 nt, Human
uucgugaaguauacugu

SEQ ID NO: 2370372 - RNA, 21 nt, Human
uucgugaaguauacuguauuu

SEQ ID NO: 2370373 - RNA, 14 nt, Human
uucgucuucuaauu

SEQ ID NO: 2370374 - RNA, 19 nt, Human
uucgucuguuuauaaacau

SEQ ID NO: 2370375 - RNA, 13 nt, Human
uucgucuucuaau

SEQ ID NO: 2370376 - RNA, 16 nt, Human
uucgucuucuaauuuc

SEQ ID NO: 2370377 - RNA, 23 nt, Human
uucguacaguucuucgggaagag

SEQ ID NO: 2370378 - RNA, 20 nt, Human
uucguacaguucuucgggaa

SEQ ID NO: 2370379 - RNA, 22 nt, Human
uucguacaguucuucgggaaga

SEQ ID NO: 2370380 - RNA, 19 nt, Human
uucguagcuuucccaaaua

SEQ ID NO: 2370381 - RNA, 22 nt, Human
uucgguggcuagucaagcuccu

SEQ ID NO: 2370382 - RNA, 14 nt, Human
uucgguuucuaacu

SEQ ID NO: 2370383 - RNA, 13 nt, Human
uucggugugcacc

SEQ ID NO: 2370384 - RNA, 20 nt, Human
uucgguuucuaacuuggagc

SEQ ID NO: 2370385 - RNA, 14 nt, Human
uucguacaguucuu

SEQ ID NO: 2370386 - RNA, 15 nt, Human
uucguacaguucuuc

SEQ ID NO: 2370387 - RNA, 14 nt, Human
uucuaaugucuuca

SEQ ID NO: 2370388 - RNA, 23 nt, Human
uucuaaugugugaaucagagcac

SEQ ID NO: 2370389 - RNA, 22 nt, Human
uucguggugaucaauuaaaugu

SEQ ID NO: 2370390 - RNA, 17 nt, Human
uucguggugaucaauua

SEQ ID NO: 2370391 - RNA, 13 nt, Human
uucguggggaggu

SEQ ID NO: 2370392 - RNA, 20 nt, Human
uucgugcggaaucagcuucu

SEQ ID NO: 2370393 - RNA, 17 nt, Human
uucuaauuggcaugaag

SEQ ID NO: 2370394 - RNA, 16 nt, Human
uucuaaugucuucauu

SEQ ID NO: 2370395 - RNA, 17 nt, Human
uucuaaugucuucauuu

SEQ ID NO: 2370396 - RNA, 20 nt, Human
uucuaauuaauaaauuauuu

SEQ ID NO: 2370397 - RNA, 15 nt, Human
uucuacagugguuuu

SEQ ID NO: 2370398 - RNA, 21 nt, Human
uucuacagugguuuuauacug

SEQ ID NO: 2370399 - RNA, 17 nt, Human
uucuacaguauuaugua

SEQ ID NO: 2370400 - RNA, 15 nt, Human
uucuacauacuaugg

SEQ ID NO: 2370401 - RNA, 18 nt, Human
uucuacaaaauccugaug

SEQ ID NO: 2370402 - RNA, 17 nt, Human
uucuaauuuuggaugga

SEQ ID NO: 2370403 - RNA, 21 nt, Human
uucuaauuucaaaaauauaac

SEQ ID NO: 2370404 - RNA, 19 nt, Human
uucuacaaugugaacuuua

SEQ ID NO: 2370405 - RNA, 15 nt, Human
uucuacacagagcag

SEQ ID NO: 2370406 - RNA, 18 nt, Human
uucuacaaugugaacuuu

SEQ ID NO: 2370407 - RNA, 16 nt, Human
uucuacaaugugaacu

SEQ ID NO: 2370408 - RNA, 15 nt, Human
uucuacaaugugaac

SEQ ID NO: 2370409 - RNA, 21 nt, Human
uucuaccacacagcagcaguu

SEQ ID NO: 2370410 - RNA, 14 nt, Human
uucuaccauuucag

SEQ ID NO: 2370411 - RNA, 17 nt, Human
uucuacauuucuuagac

SEQ ID NO: 2370412 - RNA, 16 nt, Human
uucuacauuucuuaga

SEQ ID NO: 2370413 - RNA, 15 nt, Human
uucuacauagaugcu

SEQ ID NO: 2370414 - RNA, 22 nt, Human
uucuacauaaguaauucaagaa

SEQ ID NO: 2370415 - RNA, 12 nt, Human
uucuacccagcg

SEQ ID NO: 2370416 - RNA, 19 nt, Human
uucuacccagcgagcccug

SEQ ID NO: 2370417 - RNA, 20 nt, Human
uucucauuccaacagugagu

SEQ ID NO: 2370418 - RNA, 18 nt, Human
uucucauuccaacaguga

SEQ ID NO: 2370419 - RNA, 20 nt, Human
uucucauuugccaauaauaa

SEQ ID NO: 2370420 - RNA, 15 nt, Human
uucucauuucacccc

SEQ ID NO: 2370421 - RNA, 16 nt, Human
uucucauuucaccccu

SEQ ID NO: 2370422 - RNA, 16 nt, Human
uucuccacccugcucu

SEQ ID NO: 2370423 - RNA, 19 nt, Human
uucucauuucaccccuccc

SEQ ID NO: 2370424 - RNA, 21 nt, Human
uucuccaccuagacuguaaac

SEQ ID NO: 2370425 - RNA, 23 nt, Human
uucuauccuacaacaagaguuua

SEQ ID NO: 2370426 - RNA, 20 nt, Human
uucuaucauuuuuguacagu

SEQ ID NO: 2370427 - RNA, 14 nt, Human
uucuauccucugua

SEQ ID NO: 2370428 - RNA, 15 nt, Human
uucuauccucuguaa

SEQ ID NO: 2370429 - RNA, 14 nt, Human
uucuaugaaauauu

SEQ ID NO: 2370430 - RNA, 17 nt, Human
uucucaugugauccuuu

SEQ ID NO: 2370431 - RNA, 18 nt, Human
uucucaugugauccuuuu

SEQ ID NO: 2370432 - RNA, 21 nt, Human
uucuaugaaauauuauguuaa

SEQ ID NO: 2370433 - RNA, 21 nt, Human
uucuccaccucccacaaagga

SEQ ID NO: 2370434 - RNA, 12 nt, Human
uucuccaccugc

SEQ ID NO: 2370435 - RNA, 14 nt, Human
uucuccaccugcca

SEQ ID NO: 2370436 - RNA, 15 nt, Human
uucuccaccugccag

SEQ ID NO: 2370437 - RNA, 12 nt, Human
uucuccacugga

SEQ ID NO: 2370438 - RNA, 14 nt, Human
uucuccacucaguu

SEQ ID NO: 2370439 - RNA, 20 nt, Human
uucuccaccugccagggaca

SEQ ID NO: 2370440 - RNA, 16 nt, Human
uucuccaccugccagg

SEQ ID NO: 2370441 - RNA, 18 nt, Human
uucuccaccugccaggga

SEQ ID NO: 2370442 - RNA, 18 nt, Human
uucucugagcugugcagg

SEQ ID NO: 2370443 - RNA, 17 nt, Human
uucucugagcugugcag

SEQ ID NO: 2370444 - RNA, 16 nt, Human
uucucugagcugugca

SEQ ID NO: 2370445 - RNA, 19 nt, Human
uucucuccuguaccucuug

SEQ ID NO: 2370446 - RNA, 20 nt, Human
uucuccagcugggcucugca

SEQ ID NO: 2370447 - RNA, 14 nt, Human
uucucugaggacac

SEQ ID NO: 2370448 - RNA, 20 nt, Human
uucucugaggacacuaacca

SEQ ID NO: 2370449 - RNA, 11 nt, Human
uucucugcccu

SEQ ID NO: 2370450 - RNA, 12 nt, Human
uucucugcccuc

SEQ ID NO: 2370451 - RNA, 19 nt, Human
uucuccagacccaccacac

SEQ ID NO: 2370452 - RNA, 17 nt, Human
uucuccacucaguugca

SEQ ID NO: 2370453 - RNA, 13 nt, Human
uucuccagccagc

SEQ ID NO: 2370454 - RNA, 17 nt, Human
uucuccagccuggaccc

SEQ ID NO: 2370455 - RNA, 14 nt, Human
uucuccagccagca

SEQ ID NO: 2370456 - RNA, 22 nt, Human
uucuccagccuggacccccagc

SEQ ID NO: 2370457 - RNA, 12 nt, Human
uucuccagcugg

SEQ ID NO: 2370458 - RNA, 23 nt, Human
uucuccagccuggacccccagcu

SEQ ID NO: 2370459 - RNA, 14 nt, Human
uucuccagcugggc

SEQ ID NO: 2370460 - RNA, 15 nt, Human
uucuccagcugggcu

SEQ ID NO: 2370461 - RNA, 13 nt, Human
uucucuccagccc

SEQ ID NO: 2370462 - RNA, 14 nt, Human
uucucuccagcccc

SEQ ID NO: 2370463 - RNA, 18 nt, Human
uucucuccuguaccucuu

SEQ ID NO: 2370464 - RNA, 14 nt, Human
uucucuccuguacc

SEQ ID NO: 2370465 - RNA, 15 nt, Human
uucucuccagccccu

SEQ ID NO: 2370466 - RNA, 16 nt, Human
uucucuccagccccug

SEQ ID NO: 2370467 - RNA, 18 nt, Human
uucugagaagguccuuaa

SEQ ID NO: 2370468 - RNA, 19 nt, Human
uucugagagcugugcauca

SEQ ID NO: 2370469 - RNA, 13 nt, Human
uucugagagcugu

SEQ ID NO: 2370470 - RNA, 14 nt, Human
uucugaguguuuuu

SEQ ID NO: 2370471 - RNA, 15 nt, Human
uucugaguuccugca

SEQ ID NO: 2370472 - RNA, 12 nt, Human
uucugaguuccu

SEQ ID NO: 2370473 - RNA, 21 nt, Human
uucugaggacauuccaagaca

SEQ ID NO: 2370474 - RNA, 20 nt, Human
uucugaggguccacuacuca

SEQ ID NO: 2370475 - RNA, 20 nt, Human
uucugaguguuuuuacuaca

SEQ ID NO: 2370476 - RNA, 16 nt, Human
uucugaguuucauucu

SEQ ID NO: 2370477 - RNA, 19 nt, Human
uucugaguuucauucuccu

SEQ ID NO: 2370478 - RNA, 20 nt, Human
uucugaguuucauucuccug

SEQ ID NO: 2370479 - RNA, 23 nt, Human
uucugaguuucauucuccugccu

SEQ ID NO: 2370480 - RNA, 23 nt, Human
uucugauaacuagauggugcuga

SEQ ID NO: 2370481 - RNA, 16 nt, Human
uucugauaaugaaaau

SEQ ID NO: 2370482 - RNA, 22 nt, Human
uucugauaacuagauggugcug

SEQ ID NO: 2370483 - RNA, 21 nt, Human
uucugacccugcuucaaauau

SEQ ID NO: 2370484 - RNA, 18 nt, Human
uucugacccugcuucaaa

SEQ ID NO: 2370485 - RNA, 21 nt, Human
uucugagaaagacuauucaaa

SEQ ID NO: 2370486 - RNA, 16 nt, Human
uucugagaaagacuau

SEQ ID NO: 2370487 - RNA, 16 nt, Human
uucucugcccuccaag

SEQ ID NO: 2370488 - RNA, 17 nt, Human
uucucugcccuccaaga

SEQ ID NO: 2370489 - RNA, 23 nt, Human
uucugacccaugcugcccuguga

SEQ ID NO: 2370490 - RNA, 22 nt, Human
uucugacccaugcugcccugug

SEQ ID NO: 2370491 - RNA, 20 nt, Human
uucugcuccacccuuggccu

SEQ ID NO: 2370492 - RNA, 18 nt, Human
uucugcuccacccuuggc

SEQ ID NO: 2370493 - RNA, 17 nt, Human
uucugcuccacccuugg

SEQ ID NO: 2370494 - RNA, 11 nt, Human
uucugcuccuc

SEQ ID NO: 2370495 - RNA, 13 nt, Human
uucugcuccucuc

SEQ ID NO: 2370496 - RNA, 14 nt, Human
uucugcuccucucc

SEQ ID NO: 2370497 - RNA, 15 nt, Human
uucugcuccucucca

SEQ ID NO: 2370498 - RNA, 16 nt, Human
uucugcuccucuccag

SEQ ID NO: 2370499 - RNA, 17 nt, Human
uucugcuccucuccagg

SEQ ID NO: 2370500 - RNA, 18 nt, Human
uucugcuccucuccaggc

SEQ ID NO: 2370501 - RNA, 12 nt, Human
uucugcucagcu

SEQ ID NO: 2370502 - RNA, 21 nt, Human
uucugcucaucauucucuguc

SEQ ID NO: 2370503 - RNA, 20 nt, Human
uucugcucaucauucucugu

SEQ ID NO: 2370504 - RNA, 19 nt, Human
uucugcucaucauucucug

SEQ ID NO: 2370505 - RNA, 16 nt, Human
uucugcuccacccuug

SEQ ID NO: 2370506 - RNA, 15 nt, Human
uucugcuccacccuu

SEQ ID NO: 2370507 - RNA, 13 nt, Human
uucugcuccaccc

SEQ ID NO: 2370508 - RNA, 9 nt, Human
uucugcucc

SEQ ID NO: 2370509 - RNA, 21 nt, Human
uucugcuaccucacugggguc

SEQ ID NO: 2370510 - RNA, 16 nt, Human
uucugcuaccucacug

SEQ ID NO: 2370511 - RNA, 14 nt, Human
uucugcucagcucu

SEQ ID NO: 2370512 - RNA, 19 nt, Human
uucugcuacuggcaaaagg

SEQ ID NO: 2370513 - RNA, 20 nt, Human
uucugcucagcucugggcca

SEQ ID NO: 2370514 - RNA, 15 nt, Human
uucugcucagcucug

SEQ ID NO: 2370515 - RNA, 14 nt, Human
uucugcucaucauu

SEQ ID NO: 2370516 - RNA, 13 nt, Human
uucugcucaucau

SEQ ID NO: 2370517 - RNA, 19 nt, Human
uucugcucacauaucuguc

SEQ ID NO: 2370518 - RNA, 15 nt, Human
uucugcuaccucacu

SEQ ID NO: 2370519 - RNA, 15 nt, Human
uucugccuuuuuuau

SEQ ID NO: 2370520 - RNA, 22 nt, Human
uucugccuuuggggacuuuucu

SEQ ID NO: 2370521 - RNA, 22 nt, Human
uucugauaugcaguuuuccuua

SEQ ID NO: 2370522 - RNA, 19 nt, Human
uucugauccuaguuccacc

SEQ ID NO: 2370523 - RNA, 15 nt, Human
uucugauuagaaaug

SEQ ID NO: 2370524 - RNA, 14 nt, Human
uucugauuagaaau

SEQ ID NO: 2370525 - RNA, 18 nt, Human
uucugaugaugugccugg

SEQ ID NO: 2370526 - RNA, 17 nt, Human
uucugauuacacaaaac

SEQ ID NO: 2370527 - RNA, 17 nt, Human
uucugauuagaaaugac

SEQ ID NO: 2370528 - RNA, 20 nt, Human
uucugccuguuauaacucug

SEQ ID NO: 2370529 - RNA, 21 nt, Human
uucugcaagcacaucugcauu

SEQ ID NO: 2370530 - RNA, 14 nt, Human
uucugccuucucau

SEQ ID NO: 2370531 - RNA, 21 nt, Human
uucugccuguuauaacucugc

SEQ ID NO: 2370532 - RNA, 24 nt, Human
uucugccuguuauaacucugcacu

SEQ ID NO: 2370533 - RNA, 11 nt, Human
uucugccuucc

SEQ ID NO: 2370534 - RNA, 16 nt, Human
uucugccuucucauga

SEQ ID NO: 2370535 - RNA, 19 nt, Human
uucugcaaaaauauuuaua

SEQ ID NO: 2370536 - RNA, 23 nt, Human
uucugauuguaacguugcugugg

SEQ ID NO: 2370537 - RNA, 12 nt, Human
uucugauuccac

SEQ ID NO: 2370538 - RNA, 11 nt, Human
uucugauugua

SEQ ID NO: 2370539 - RNA, 21 nt, Human
uucugauuguaacguugcugu

SEQ ID NO: 2370540 - RNA, 22 nt, Human
uucugauuguaacguugcugug

SEQ ID NO: 2370541 - RNA, 13 nt, Human
uuuccaagagcug

SEQ ID NO: 2370542 - RNA, 14 nt, Human
uuuccaagagcuga

SEQ ID NO: 2370543 - RNA, 16 nt, Human
uuuccaagagcugagg

SEQ ID NO: 2370544 - RNA, 23 nt, Human
uuuccaaauucacaaguuguguu

SEQ ID NO: 2370545 - RNA, 15 nt, Human
uuuccaacaccacag

SEQ ID NO: 2370546 - RNA, 18 nt, Human
uuuccaacaccacagaca

SEQ ID NO: 2370547 - RNA, 20 nt, Human
uuuccaacaccacagacaca

SEQ ID NO: 2370548 - RNA, 21 nt, Human
uuuccaacaccacagacacac

SEQ ID NO: 2370549 - RNA, 22 nt, Human
uuuccaacaccacagacacaca

SEQ ID NO: 2370550 - RNA, 23 nt, Human
uuuccaacaccacagacacacac

SEQ ID NO: 2370551 - RNA, 18 nt, Human
uuucauuuaggugaggaa

SEQ ID NO: 2370552 - RNA, 14 nt, Human
uuucauuuacugug

SEQ ID NO: 2370553 - RNA, 17 nt, Human
uuucauuuacuguggcu

SEQ ID NO: 2370554 - RNA, 19 nt, Human
uuucauuuagucaugugac

SEQ ID NO: 2370555 - RNA, 14 nt, Human
uuucauuuagguga

SEQ ID NO: 2370556 - RNA, 20 nt, Human
uuucauuguaugauguguug

SEQ ID NO: 2370557 - RNA, 23 nt, Human
uuucauuguaugauguguuguga

SEQ ID NO: 2370558 - RNA, 21 nt, Human
uuucagcagacuaugaauauu

SEQ ID NO: 2370559 - RNA, 14 nt, Human
uuucagcagacuau

SEQ ID NO: 2370560 - RNA, 23 nt, Human
uuucagcaccuacaguguacagu

SEQ ID NO: 2370561 - RNA, 20 nt, Human
uuucagauucccagagcaaa

SEQ ID NO: 2370562 - RNA, 21 nt, Human
uuucagaugucuucugccugu

SEQ ID NO: 2370563 - RNA, 22 nt, Human
uuucagaugucuucugccuguu

SEQ ID NO: 2370564 - RNA, 15 nt, Human
uuucagaugucuucu

SEQ ID NO: 2370565 - RNA, 17 nt, Human
uuucagaugucuucugc

SEQ ID NO: 2370566 - RNA, 19 nt, Human
uuucagaugucuucugccu

SEQ ID NO: 2370567 - RNA, 20 nt, Human
uuucagaugucuucugccug

SEQ ID NO: 2370568 - RNA, 14 nt, Human
uuucaguguacaug

SEQ ID NO: 2370569 - RNA, 13 nt, Human
uuucaguguacau

SEQ ID NO: 2370570 - RNA, 23 nt, Human
uuucagugucaaauaaacacugu

SEQ ID NO: 2370571 - RNA, 21 nt, Human
uuucaguggggcagucauuau

SEQ ID NO: 2370572 - RNA, 22 nt, Human
uuucaguggcacgucaucuagu

SEQ ID NO: 2370573 - RNA, 21 nt, Human
uuucagugucaaauaaacacu

SEQ ID NO: 2370574 - RNA, 22 nt, Human
uuucagugucaaauaaacacug

SEQ ID NO: 2370575 - RNA, 19 nt, Human
uuucaauuuccaagagcug

SEQ ID NO: 2370576 - RNA, 19 nt, Human
uuucaauaggaaaaacuga

SEQ ID NO: 2370577 - RNA, 17 nt, Human
uuucaauaggaaaaacu

SEQ ID NO: 2370578 - RNA, 12 nt, Human
uuucaauaggaa

SEQ ID NO: 2370579 - RNA, 14 nt, Human
uuucaauaggaaaa

SEQ ID NO: 2370580 - RNA, 21 nt, Human
uuucaagugaaucuaaaagcu

SEQ ID NO: 2370581 - RNA, 20 nt, Human
uuucaagucaaauuaauaau

SEQ ID NO: 2370582 - RNA, 18 nt, Human
uuucaagucaaauuaaua

SEQ ID NO: 2370583 - RNA, 18 nt, Human
uuucaaggcccucagcau

SEQ ID NO: 2370584 - RNA, 20 nt, Human
uuucaagguaauuucuugug

SEQ ID NO: 2370585 - RNA, 20 nt, Human
uuucaauaaagcauuuauaa

SEQ ID NO: 2370586 - RNA, 19 nt, Human
uuucaauaaagcauuuaua

SEQ ID NO: 2370587 - RNA, 23 nt, Human
uuucaagucaaauuaauaaucuu

SEQ ID NO: 2370588 - RNA, 22 nt, Human
uuucaaguuccaaguugcuaau

SEQ ID NO: 2370589 - RNA, 17 nt, Human
uuucaauuuugcaugcu

SEQ ID NO: 2370590 - RNA, 12 nt, Human
uuucacaaauaa

SEQ ID NO: 2370591 - RNA, 13 nt, Human
uuucacaaauaaa

SEQ ID NO: 2370592 - RNA, 22 nt, Human
uuucacaaccuucuguggcuca

SEQ ID NO: 2370593 - RNA, 16 nt, Human
uuucacaaccuucugu

SEQ ID NO: 2370594 - RNA, 14 nt, Human
uuucacaaauuugu

SEQ ID NO: 2370595 - RNA, 14 nt, Human
uuucagauauaaaa

SEQ ID NO: 2370596 - RNA, 16 nt, Human
uuucagauauaaaaga

SEQ ID NO: 2370597 - RNA, 18 nt, Human
uuucagauauaaaagacu

SEQ ID NO: 2370598 - RNA, 13 nt, Human
uuucacaacagau

SEQ ID NO: 2370599 - RNA, 15 nt, Human
uuucagauauauauc

SEQ ID NO: 2370600 - RNA, 16 nt, Human
uuucagauauauauca

SEQ ID NO: 2370601 - RNA, 20 nt, Human
uuucagaugcuucugggaga

SEQ ID NO: 2370602 - RNA, 12 nt, Human
uuucagaugucu

SEQ ID NO: 2370603 - RNA, 16 nt, Human
uuucagaugcuucugg

SEQ ID NO: 2370604 - RNA, 14 nt, Human
uuucagaugcuucu

SEQ ID NO: 2370605 - RNA, 12 nt, Human
uuucagaugcuu

SEQ ID NO: 2370606 - RNA, 16 nt, Human
uuuauucuuuuuaaag

SEQ ID NO: 2370607 - RNA, 12 nt, Human
uuuauugacaau

SEQ ID NO: 2370608 - RNA, 13 nt, Human
uuuauugacacag

SEQ ID NO: 2370609 - RNA, 12 nt, Human
uuuauugacaca

SEQ ID NO: 2370610 - RNA, 14 nt, Human
uuuauugagaauuu

SEQ ID NO: 2370611 - RNA, 16 nt, Human
uuuauugagaaagagc

SEQ ID NO: 2370612 - RNA, 14 nt, Human
uuuauugagaaaga

SEQ ID NO: 2370613 - RNA, 15 nt, Human
uuuauugacacagaa

SEQ ID NO: 2370614 - RNA, 14 nt, Human
uuuauugacacaga

SEQ ID NO: 2370615 - RNA, 16 nt, Human
uuuauuauuacuguuu

SEQ ID NO: 2370616 - RNA, 22 nt, Human
uuuauuccuauauaguuuauug

SEQ ID NO: 2370617 - RNA, 16 nt, Human
uuuauuauuuauuuau

SEQ ID NO: 2370618 - RNA, 14 nt, Human
uuuauuccuuguga

SEQ ID NO: 2370619 - RNA, 16 nt, Human
uuuauuccuguauguu

SEQ ID NO: 2370620 - RNA, 17 nt, Human
uuuauuuaauguuaugu

SEQ ID NO: 2370621 - RNA, 22 nt, Human
uuuauuuaaaagauucauuuuu

SEQ ID NO: 2370622 - RNA, 15 nt, Human
uuuauuuaaaugucu

SEQ ID NO: 2370623 - RNA, 21 nt, Human
uuuauuuaaaugucuaaugua

SEQ ID NO: 2370624 - RNA, 16 nt, Human
uuuauuuacugcuagu

SEQ ID NO: 2370625 - RNA, 20 nt, Human
uuuauuuacagaugaaugua

SEQ ID NO: 2370626 - RNA, 23 nt, Human
uuuauuguuuaaagcaacugucu

SEQ ID NO: 2370627 - RNA, 14 nt, Human
uuuauuuaaaagau

SEQ ID NO: 2370628 - RNA, 15 nt, Human
uuuauuuaaaagauu

SEQ ID NO: 2370629 - RNA, 17 nt, Human
uuuauuuaaaagauuca

SEQ ID NO: 2370630 - RNA, 21 nt, Human
uuucaacgcagcccugcuuug

SEQ ID NO: 2370631 - RNA, 16 nt, Human
uuucaacugccaaaau

SEQ ID NO: 2370632 - RNA, 19 nt, Human
uuucaagaaacugaggaau

SEQ ID NO: 2370633 - RNA, 15 nt, Human
uuucaacgcagcccu

SEQ ID NO: 2370634 - RNA, 11 nt, Human
uuuauuuacua

SEQ ID NO: 2370635 - RNA, 16 nt, Human
uuucaacgcagcccug

SEQ ID NO: 2370636 - RNA, 20 nt, Human
uuucaacgcagcccugcuuu

SEQ ID NO: 2370637 - RNA, 22 nt, Human
uuucaagcagucgugccugugu

SEQ ID NO: 2370638 - RNA, 23 nt, Human
uuucaagcagucgugccuguguc

SEQ ID NO: 2370639 - RNA, 22 nt, Human
uuucaacuuggcuuccuuucuu

SEQ ID NO: 2370640 - RNA, 17 nt, Human
uuucaagaaacugagga

SEQ ID NO: 2370641 - RNA, 20 nt, Human
uuucaagacauuaaaucuau

SEQ ID NO: 2370642 - RNA, 23 nt, Human
uuucaagaauaaucacgcuuucc

SEQ ID NO: 2370643 - RNA, 22 nt, Human
uuucaagccugccuaggaauuc

SEQ ID NO: 2370644 - RNA, 17 nt, Human
uuucaaggcccucagca

SEQ ID NO: 2370645 - RNA, 22 nt, Human
uuuauaacucaucauaaaauaa

SEQ ID NO: 2370646 - RNA, 20 nt, Human
uuuauaacucaucauaaaau

SEQ ID NO: 2370647 - RNA, 19 nt, Human
uuuauaacucaucauaaaa

SEQ ID NO: 2370648 - RNA, 18 nt, Human
uuuauaacucaucauaaa

SEQ ID NO: 2370649 - RNA, 16 nt, Human
uuuauaacucaucaua

SEQ ID NO: 2370650 - RNA, 19 nt, Human
uuuauaacuaguccuuuac

SEQ ID NO: 2370651 - RNA, 16 nt, Human
uuuaguuuuuguucuu

SEQ ID NO: 2370652 - RNA, 20 nt, Human
uuuauaagcagauuuaacaa

SEQ ID NO: 2370653 - RNA, 21 nt, Human
uuuauaacucaucauaaaaua

SEQ ID NO: 2370654 - RNA, 13 nt, Human
uuuauaaaacuuc

SEQ ID NO: 2370655 - RNA, 15 nt, Human
uuuauacaaauuaga

SEQ ID NO: 2370656 - RNA, 13 nt, Human
uuuauacaaauua

SEQ ID NO: 2370657 - RNA, 17 nt, Human
uuuauacaaaugucuua

SEQ ID NO: 2370658 - RNA, 22 nt, Human
uuuauaauuuugugaagcaaaa

SEQ ID NO: 2370659 - RNA, 13 nt, Human
uuuauaagguuuu

SEQ ID NO: 2370660 - RNA, 13 nt, Human
uuuauggccucag

SEQ ID NO: 2370661 - RNA, 12 nt, Human
uuuauggccuca

SEQ ID NO: 2370662 - RNA, 17 nt, Human
uuuauacaaauuagaaa

SEQ ID NO: 2370663 - RNA, 19 nt, Human
uuuauacaaauuagaaaau

SEQ ID NO: 2370664 - RNA, 17 nt, Human
uuuauggcacuaguauu

SEQ ID NO: 2370665 - RNA, 16 nt, Human
uuuauggcuuuugugc

SEQ ID NO: 2370666 - RNA, 14 nt, Human
uuuauggcuuuugu

SEQ ID NO: 2370667 - RNA, 22 nt, Human
uuuauggccucagcugccucac

SEQ ID NO: 2370668 - RNA, 13 nt, Human
uuuauuauggcac

SEQ ID NO: 2370669 - RNA, 13 nt, Human
uuuauuaugcaug

SEQ ID NO: 2370670 - RNA, 16 nt, Human
uuuacauuguugagcu

SEQ ID NO: 2370671 - RNA, 19 nt, Human
uuuacagugaaaauguaag

SEQ ID NO: 2370672 - RNA, 23 nt, Human
uuuacagugaaaauguaagcugu

SEQ ID NO: 2370673 - RNA, 12 nt, Human
uuuaccaaguuu

SEQ ID NO: 2370674 - RNA, 13 nt, Human
uuuaccaccccca

SEQ ID NO: 2370675 - RNA, 15 nt, Human
uuuaccacccccaca

SEQ ID NO: 2370676 - RNA, 13 nt, Human
uuuaccacuugug

SEQ ID NO: 2370677 - RNA, 23 nt, Human
uuuacagcuuucaugauuagcaa

SEQ ID NO: 2370678 - RNA, 20 nt, Human
uuuacagcuuucaugauuag

SEQ ID NO: 2370679 - RNA, 18 nt, Human
uuuacagggagccuccug

SEQ ID NO: 2370680 - RNA, 20 nt, Human
uuuacagggagccuccugcc

SEQ ID NO: 2370681 - RNA, 22 nt, Human
uuuacagggagccuccugccca

SEQ ID NO: 2370682 - RNA, 23 nt, Human
uuuacagggagccuccugcccag

SEQ ID NO: 2370683 - RNA, 15 nt, Human
uuuacaguaaauaaa

SEQ ID NO: 2370684 - RNA, 19 nt, Human
uuuacaguaaauaaauugu

SEQ ID NO: 2370685 - RNA, 20 nt, Human
uuuacaguaaauaaauuguu

SEQ ID NO: 2370686 - RNA, 15 nt, Human
uuuacagcugccugc

SEQ ID NO: 2370687 - RNA, 16 nt, Human
uuuacagcugccugca

SEQ ID NO: 2370688 - RNA, 21 nt, Human
uuuacaccaguuccuuucaau

SEQ ID NO: 2370689 - RNA, 21 nt, Human
uuuacacauucggcucccugg

SEQ ID NO: 2370690 - RNA, 14 nt, Human
uuuacacucaggcu

SEQ ID NO: 2370691 - RNA, 22 nt, Human
uuuacacucaggcuuucacuau

SEQ ID NO: 2370692 - RNA, 16 nt, Human
uuuacacucuuuguaa

SEQ ID NO: 2370693 - RNA, 21 nt, Human
uuuacacacgugcaauuuguu

SEQ ID NO: 2370694 - RNA, 21 nt, Human
uuuaauagaauauaauuaucg

SEQ ID NO: 2370695 - RNA, 19 nt, Human
uuuaauagaauauaauuau

SEQ ID NO: 2370696 - RNA, 14 nt, Human
uuuaauacagggua

SEQ ID NO: 2370697 - RNA, 17 nt, Human
uuuaauaauauacuugu

SEQ ID NO: 2370698 - RNA, 14 nt, Human
uuuaauacagcagu

SEQ ID NO: 2370699 - RNA, 17 nt, Human
uuuauaaaaaauggugc

SEQ ID NO: 2370700 - RNA, 11 nt, Human
uuuaguuuuug

SEQ ID NO: 2370701 - RNA, 15 nt, Human
uuuaguuuuuguucu

SEQ ID NO: 2370702 - RNA, 21 nt, Human
uuuauaaaaauaaaaaacacu

SEQ ID NO: 2370703 - RNA, 23 nt, Human
uuuauaaaaauaaaaaacacugg

SEQ ID NO: 2370704 - RNA, 22 nt, Human
uuuagacaagagaugggaauga

SEQ ID NO: 2370705 - RNA, 23 nt, Human
uuuagacaaauacucauguguau

SEQ ID NO: 2370706 - RNA, 14 nt, Human
uuuagacacuggcu

SEQ ID NO: 2370707 - RNA, 22 nt, Human
uuuaguuucuguucuguggaaa

SEQ ID NO: 2370708 - RNA, 12 nt, Human
uuuagacagagu

SEQ ID NO: 2370709 - RNA, 16 nt, Human
uuuagacaaauacuca

SEQ ID NO: 2370710 - RNA, 18 nt, Human
uuuagacaaauacucaug

SEQ ID NO: 2370711 - RNA, 19 nt, Human
uuuagacaaauacucaugu

SEQ ID NO: 2370712 - RNA, 20 nt, Human
uuuagacaaauacucaugug

SEQ ID NO: 2370713 - RNA, 21 nt, Human
uuuagacaaauacucaugugu

SEQ ID NO: 2370714 - RNA, 22 nt, Human
uuuagacaaauacucaugugua

SEQ ID NO: 2370715 - RNA, 21 nt, Human
uuuacuugcauugaauauauu

SEQ ID NO: 2370716 - RNA, 18 nt, Human
uuuacuugcauugaauau

SEQ ID NO: 2370717 - RNA, 18 nt, Human
uuuaccacccccacaccu

SEQ ID NO: 2370718 - RNA, 18 nt, Human
uuuacuugccauuacuca

SEQ ID NO: 2370719 - RNA, 22 nt, Human
uuuacuucuuauacauuugaua

SEQ ID NO: 2370720 - RNA, 19 nt, Human
uuuacuucuuauacauuug

SEQ ID NO: 2370721 - RNA, 13 nt, Human
uuuagaaagcauu

SEQ ID NO: 2370722 - RNA, 23 nt, Human
uuuagaaagaagcccaauauuau

SEQ ID NO: 2370723 - RNA, 15 nt, Human
uuuagaaagaauauu

SEQ ID NO: 2370724 - RNA, 14 nt, Human
uuuagaaagcauuu

SEQ ID NO: 2370725 - RNA, 16 nt, Human
uuuagaaagcauuuga

SEQ ID NO: 2370726 - RNA, 18 nt, Human
uuuagaaagcauuugaau

SEQ ID NO: 2370727 - RNA, 19 nt, Human
uuuagaaagcauuugaaug

SEQ ID NO: 2370728 - RNA, 14 nt, Human
uuuagaaauauaau

SEQ ID NO: 2370729 - RNA, 22 nt, Human
uuuagaaauacugcaagaaaau

SEQ ID NO: 2370730 - RNA, 20 nt, Human
uuuagaaauacugcaagaaa

SEQ ID NO: 2370731 - RNA, 19 nt, Human
uuuagaaauacugcaagaa

SEQ ID NO: 2370732 - RNA, 22 nt, Human
uuuagaaagcauuugaaugcau

SEQ ID NO: 2370733 - RNA, 24 nt, Human
uuuaacucaauauuuuccaugaaa

SEQ ID NO: 2370734 - RNA, 17 nt, Human
uuuaacuagaauuuauu

SEQ ID NO: 2370735 - RNA, 12 nt, Human
uuuaacucagau

SEQ ID NO: 2370736 - RNA, 15 nt, Human
uuuaacucagaucac

SEQ ID NO: 2370737 - RNA, 18 nt, Human
uuuaacucagaucacuac

SEQ ID NO: 2370738 - RNA, 21 nt, Human
uuuaacucagaucacuacugc

SEQ ID NO: 2370739 - RNA, 23 nt, Human
uuuaacucgagaccuuuucaacu

SEQ ID NO: 2370740 - RNA, 12 nt, Human
uuuaacucuguc

SEQ ID NO: 2370741 - RNA, 22 nt, Human
uuuaacucauaccuuuaaagga

SEQ ID NO: 2370742 - RNA, 23 nt, Human
uuuaacucagaucacuacugcag

SEQ ID NO: 2370743 - RNA, 17 nt, Human
uuuaacucugucuucac

SEQ ID NO: 2370744 - RNA, 14 nt, Human
uuuaacucugucuu

SEQ ID NO: 2370745 - RNA, 13 nt, Human
uuuaacucugucu

SEQ ID NO: 2370746 - RNA, 14 nt, Human
uuuaacugccuugu

SEQ ID NO: 2370747 - RNA, 22 nt, Human
uuuaacgaaugaagaugucuaa

SEQ ID NO: 2370748 - RNA, 15 nt, Human
uuuaacuagaauuua

SEQ ID NO: 2370749 - RNA, 21 nt, Human
uuuaacauauaauuucuuuaa

SEQ ID NO: 2370750 - RNA, 19 nt, Human
uuuaacucuauaauguguu

SEQ ID NO: 2370751 - RNA, 17 nt, Human
uuuaacagucauuuaaa

SEQ ID NO: 2370752 - RNA, 15 nt, Human
uuuaacagucauuua

SEQ ID NO: 2370753 - RNA, 16 nt, Human
uuuaacagucauuuaa

SEQ ID NO: 2370754 - RNA, 23 nt, Human
uuuaacagggucucuagugcugu

SEQ ID NO: 2370755 - RNA, 14 nt, Human
uuuaacagggucuc

SEQ ID NO: 2370756 - RNA, 20 nt, Human
uuuaacagcugaauuaucua

SEQ ID NO: 2370757 - RNA, 18 nt, Human
uuuaacaggaagaucuua

SEQ ID NO: 2370758 - RNA, 17 nt, Human
uuuaacagcugaauuau

SEQ ID NO: 2370759 - RNA, 23 nt, Human
uuuaacaauaacuacuguguucc

SEQ ID NO: 2370760 - RNA, 22 nt, Human
uuuaacaauaacuacuguguuc

SEQ ID NO: 2370761 - RNA, 21 nt, Human
uuuaacaauaacuacuguguu

SEQ ID NO: 2370762 - RNA, 20 nt, Human
uuuaacaauaacuacugugu

SEQ ID NO: 2370763 - RNA, 18 nt, Human
uuuaacaauaacuacugu

SEQ ID NO: 2370764 - RNA, 18 nt, Human
uuuaacagaaauguacag

SEQ ID NO: 2370765 - RNA, 23 nt, Human
uuuaacaacuaugauuuggaaaa

SEQ ID NO: 2370766 - RNA, 16 nt, Human
uuuaacaaaagcaaga

SEQ ID NO: 2370767 - RNA, 15 nt, Human
uuuaacaaaagcaag

SEQ ID NO: 2370768 - RNA, 15 nt, Human
uuuaacaaaaaccaa

SEQ ID NO: 2370769 - RNA, 22 nt, Human
uuuaaauuuuacccuuuagacu

SEQ ID NO: 2370770 - RNA, 18 nt, Human
uuuaaauuuuacccuuua

SEQ ID NO: 2370771 - RNA, 15 nt, Human
uuguuugcuuauugu

SEQ ID NO: 2370772 - RNA, 18 nt, Human
uuuaaauuuuuuuccuua

SEQ ID NO: 2370773 - RNA, 18 nt, Human
uuguuuggagacagaguc

SEQ ID NO: 2370774 - RNA, 18 nt, Human
uuuaaguuacacauuuuu

SEQ ID NO: 2370775 - RNA, 23 nt, Human
uuuaaguucuggaugcauuucuc

SEQ ID NO: 2370776 - RNA, 14 nt, Human
uuuaaguuguuugc

SEQ ID NO: 2370777 - RNA, 21 nt, Human
uuuaaguuguuugcaugugaa

SEQ ID NO: 2370778 - RNA, 15 nt, Human
uuuaaguuguuugca

SEQ ID NO: 2370779 - RNA, 14 nt, Human
uuuaaguguaacug

SEQ ID NO: 2370780 - RNA, 18 nt, Human
uuuaagugcuuuguaaug

SEQ ID NO: 2370781 - RNA, 18 nt, Human
uuuaagacagucuuuggg

SEQ ID NO: 2370782 - RNA, 22 nt, Human
uuuaaguguaacuggcaguuuu

SEQ ID NO: 2370783 - RNA, 20 nt, Human
uuuaagacgaaacauuuguu

SEQ ID NO: 2370784 - RNA, 12 nt, Human
uuuaauaacauu

SEQ ID NO: 2370785 - RNA, 14 nt, Human
uuuaauaacaauug

SEQ ID NO: 2370786 - RNA, 20 nt, Human
uuuaauaaaauaauucuaaa

SEQ ID NO: 2370787 - RNA, 13 nt, Human
uuuaauaaacuuu

SEQ ID NO: 2370788 - RNA, 20 nt, Human
uuuaauaaaaaggcaccuau

SEQ ID NO: 2370789 - RNA, 16 nt, Human
uuuaauaaaauaauuc

SEQ ID NO: 2370790 - RNA, 17 nt, Human
uuuaauaaaauaauucu

SEQ ID NO: 2370791 - RNA, 15 nt, Human
uuuaauaauauacuu

SEQ ID NO: 2370792 - RNA, 23 nt, Human
uuuaauaacauuaccuuacugug

SEQ ID NO: 2370793 - RNA, 15 nt, Human
uuuaauaacauuacc

SEQ ID NO: 2370794 - RNA, 18 nt, Human
uuuaauaacauuaccuua

SEQ ID NO: 2370795 - RNA, 20 nt, Human
uuuaauaacauuaccuuacu

SEQ ID NO: 2370796 - RNA, 22 nt, Human
uuuaauaacauuaccuuacugu

SEQ ID NO: 2370797 - RNA, 13 nt, Human
uuuaauaauguuu

SEQ ID NO: 2370798 - RNA, 19 nt, Human
uuuaacuuuaucacauuau

SEQ ID NO: 2370799 - RNA, 18 nt, Human
uuuaagaaaaaauaacac

SEQ ID NO: 2370800 - RNA, 22 nt, Human
uuuaagaaaaaauaacacacau

SEQ ID NO: 2370801 - RNA, 18 nt, Human
uuuaagaaaaaggaugca

SEQ ID NO: 2370802 - RNA, 21 nt, Human
uuuaacuuaaucaauuaauuu

SEQ ID NO: 2370803 - RNA, 14 nt, Human
uuuaacuuuaaguu

SEQ ID NO: 2370804 - RNA, 18 nt, Human
uuuaacuuuaaguuucag

SEQ ID NO: 2370805 - RNA, 13 nt, Human
uuuaacuucugcc

SEQ ID NO: 2370806 - RNA, 12 nt, Human
uuuaacuugagc

SEQ ID NO: 2370807 - RNA, 19 nt, Human
uuuaacuugaggguaauaa

SEQ ID NO: 2370808 - RNA, 22 nt, Human
uuuaagaaaaaggaugcacaga

SEQ ID NO: 2370809 - RNA, 22 nt, Human
uuuaagacagucccaucaaaac

SEQ ID NO: 2370810 - RNA, 19 nt, Human
uuuaagacauuuuuggaag

SEQ ID NO: 2370811 - RNA, 15 nt, Human
uuuaagacacuuuuu

SEQ ID NO: 2370812 - RNA, 15 nt, Human
uugugccuggcucag

SEQ ID NO: 2370813 - RNA, 17 nt, Human
uugugcccacugucucu

SEQ ID NO: 2370814 - RNA, 12 nt, Human
uugugccccugc

SEQ ID NO: 2370815 - RNA, 21 nt, Human
uugugccagaaugcuuuagga

SEQ ID NO: 2370816 - RNA, 16 nt, Human
uugugccagaaugcuu

SEQ ID NO: 2370817 - RNA, 22 nt, Human
uugugccauagucacauggccu

SEQ ID NO: 2370818 - RNA, 17 nt, Human
uugugccaauauguauu

SEQ ID NO: 2370819 - RNA, 22 nt, Human
uugugccaauauguauuguaaa

SEQ ID NO: 2370820 - RNA, 22 nt, Human
uugugcugaucgugcuaaauuu

SEQ ID NO: 2370821 - RNA, 18 nt, Human
uugugcuggauggagccc

SEQ ID NO: 2370822 - RNA, 23 nt, Human
uugugcuucuuucuuugggaaua

SEQ ID NO: 2370823 - RNA, 14 nt, Human
uugugcuuguuuac

SEQ ID NO: 2370824 - RNA, 11 nt, Human
uugugcuucua

SEQ ID NO: 2370825 - RNA, 16 nt, Human
uugugccuuuuauagc

SEQ ID NO: 2370826 - RNA, 16 nt, Human
uugugccaauauguau

SEQ ID NO: 2370827 - RNA, 12 nt, Human
uugugcauuugg

SEQ ID NO: 2370828 - RNA, 23 nt, Human
uugugcauuaucuagauacugua

SEQ ID NO: 2370829 - RNA, 22 nt, Human
uugugcauuaucuagauacugu

SEQ ID NO: 2370830 - RNA, 23 nt, Human
uugugaaaugaaaacauguaaua

SEQ ID NO: 2370831 - RNA, 11 nt, Human
uugugauuuga

SEQ ID NO: 2370832 - RNA, 15 nt, Human
uugugauuugacugu

SEQ ID NO: 2370833 - RNA, 16 nt, Human
uugugauuugacuguu

SEQ ID NO: 2370834 - RNA, 17 nt, Human
uugugauuugacuguuu

SEQ ID NO: 2370835 - RNA, 22 nt, Human
uugugauuugacuguuuuuacc

SEQ ID NO: 2370836 - RNA, 17 nt, Human
uugugcauuaucuagau

SEQ ID NO: 2370837 - RNA, 19 nt, Human
uugugcacccucuauccca

SEQ ID NO: 2370838 - RNA, 21 nt, Human
uugugcacccucuaucccaau

SEQ ID NO: 2370839 - RNA, 15 nt, Human
uugugcagaaaacau

SEQ ID NO: 2370840 - RNA, 16 nt, Human
uugugcagaaaacauu

SEQ ID NO: 2370841 - RNA, 18 nt, Human
uugugcagaaaacauugu

SEQ ID NO: 2370842 - RNA, 19 nt, Human
uugugcagaaaacauuguu

SEQ ID NO: 2370843 - RNA, 13 nt, Human
uuguguugugaau

SEQ ID NO: 2370844 - RNA, 11 nt, Human
uuguguuguca

SEQ ID NO: 2370845 - RNA, 21 nt, Human
uuguguuuauauauaagccaa

SEQ ID NO: 2370846 - RNA, 13 nt, Human
uuguguucaccuu

SEQ ID NO: 2370847 - RNA, 21 nt, Human
uuguggauguuuuaauuccau

SEQ ID NO: 2370848 - RNA, 23 nt, Human
uuguggauguuuuaauuccauga

SEQ ID NO: 2370849 - RNA, 13 nt, Human
uuguguucuaaua

SEQ ID NO: 2370850 - RNA, 20 nt, Human
uuguguucccauuucagcug

SEQ ID NO: 2370851 - RNA, 14 nt, Human
uuguggcacauucu

SEQ ID NO: 2370852 - RNA, 23 nt, Human
uuguggauuuaacagaaauguac

SEQ ID NO: 2370853 - RNA, 22 nt, Human
uuguggauuuaacagaaaugua

SEQ ID NO: 2370854 - RNA, 22 nt, Human
uuguggaggagcucaggacacu

SEQ ID NO: 2370855 - RNA, 15 nt, Human
uuguggacauuuaag

SEQ ID NO: 2370856 - RNA, 14 nt, Human
uuguggagccccac

SEQ ID NO: 2370857 - RNA, 14 nt, Human
uuguggaugucuuc

SEQ ID NO: 2370858 - RNA, 18 nt, Human
uuguggauguuuuaauuc

SEQ ID NO: 2370859 - RNA, 13 nt, Human
uuguggacuaaaa

SEQ ID NO: 2370860 - RNA, 16 nt, Human
uuguggacuaaaagau

SEQ ID NO: 2370861 - RNA, 18 nt, Human
uuguggacuaaaagauau

SEQ ID NO: 2370862 - RNA, 22 nt, Human
uuguggacuaaaagauauaagu

SEQ ID NO: 2370863 - RNA, 21 nt, Human
uuguggauuuaacagaaaugu

SEQ ID NO: 2370864 - RNA, 20 nt, Human
uuguggauuuaacagaaaug

SEQ ID NO: 2370865 - RNA, 17 nt, Human
uuguggacacagcucuu

SEQ ID NO: 2370866 - RNA, 22 nt, Human
uuguggaauggagauucaguuu

SEQ ID NO: 2370867 - RNA, 22 nt, Human
uuguggaagcaaaaaucugaaa

SEQ ID NO: 2370868 - RNA, 21 nt, Human
uuguggaauugggagcuuggg

SEQ ID NO: 2370869 - RNA, 16 nt, Human
uuguggacauuuaaga

SEQ ID NO: 2370870 - RNA, 16 nt, Human
uuguggacacagcucu

SEQ ID NO: 2370871 - RNA, 18 nt, Human
uuguggaaagccucugcu

SEQ ID NO: 2370872 - RNA, 16 nt, Human
uugugcuuuuccuauu

SEQ ID NO: 2370873 - RNA, 21 nt, Human
uuguggaaaaugaaaauuagg

SEQ ID NO: 2370874 - RNA, 13 nt, Human
uuguuaucaguaa

SEQ ID NO: 2370875 - RNA, 22 nt, Human
uuguuaucagucaauauuuuua

SEQ ID NO: 2370876 - RNA, 16 nt, Human
uuguuaucagucaaua

SEQ ID NO: 2370877 - RNA, 22 nt, Human
uuguuaguaugaggcauuuguu

SEQ ID NO: 2370878 - RNA, 20 nt, Human
uuguuagugugucuuagugu

SEQ ID NO: 2370879 - RNA, 14 nt, Human
uuguuauggcuuaa

SEQ ID NO: 2370880 - RNA, 19 nt, Human
uuguuauggcuuaaugaca

SEQ ID NO: 2370881 - RNA, 18 nt, Human
uuguuauguagauaacaa

SEQ ID NO: 2370882 - RNA, 21 nt, Human
uuguuguuaaugaaaauguca

SEQ ID NO: 2370883 - RNA, 20 nt, Human
uuguuguuauuuuuugagaa

SEQ ID NO: 2370884 - RNA, 14 nt, Human
uuguuguuugccau

SEQ ID NO: 2370885 - RNA, 15 nt, Human
uuguuguuuguaugu

SEQ ID NO: 2370886 - RNA, 21 nt, Human
uuguuguuugccauacuuugu

SEQ ID NO: 2370887 - RNA, 16 nt, Human
uuguuucucccccugg

SEQ ID NO: 2370888 - RNA, 17 nt, Human
uuguuucuaccucccag

SEQ ID NO: 2370889 - RNA, 14 nt, Human
uuguuucuaccucc

SEQ ID NO: 2370890 - RNA, 16 nt, Human
uuguuucuaccuccca

SEQ ID NO: 2370891 - RNA, 16 nt, Human
uuguuucguggggagg

SEQ ID NO: 2370892 - RNA, 13 nt, Human
uuguuugcuuauu

SEQ ID NO: 2370893 - RNA, 16 nt, Human
uuguuugcuaucuuaa

SEQ ID NO: 2370894 - RNA, 19 nt, Human
uuguuugcucaccuggggu

SEQ ID NO: 2370895 - RNA, 15 nt, Human
uuguuugccauacuu

SEQ ID NO: 2370896 - RNA, 16 nt, Human
uuguuugccauacuuu

SEQ ID NO: 2370897 - RNA, 12 nt, Human
uuguuugcuauc

SEQ ID NO: 2370898 - RNA, 21 nt, Human
uuguuugaaacaaagaagguu

SEQ ID NO: 2370899 - RNA, 15 nt, Human
uuguuugagaaauua

SEQ ID NO: 2370900 - RNA, 23 nt, Human
uuguuugaugcauuaaaagaaaa

SEQ ID NO: 2370901 - RNA, 21 nt, Human
uuguuugagaaauuaaguauc

SEQ ID NO: 2370902 - RNA, 18 nt, Human
uuguuucaaacacaaaug

SEQ ID NO: 2370903 - RNA, 20 nt, Human
uuguuuauuuaucagugaca

SEQ ID NO: 2370904 - RNA, 23 nt, Human
uuguuguuugccauacuuugucu

SEQ ID NO: 2370905 - RNA, 16 nt, Human
uuguuguuuuuaagau

SEQ ID NO: 2370906 - RNA, 14 nt, Human
uuguuuaaaaucau

SEQ ID NO: 2370907 - RNA, 20 nt, Human
uuguuucauugacuaucaaa

SEQ ID NO: 2370908 - RNA, 16 nt, Human
uuguuucaauugcauc

SEQ ID NO: 2370909 - RNA, 9 nt, Human
uuguuuaaa

SEQ ID NO: 2370910 - RNA, 15 nt, Human
uuguuuccuuucacu

SEQ ID NO: 2370911 - RNA, 19 nt, Human
uuguuaaugguuugaauau

SEQ ID NO: 2370912 - RNA, 17 nt, Human
uuguuaauggugcaaau

SEQ ID NO: 2370913 - RNA, 19 nt, Human
uuguuaaugaaaaugucag

SEQ ID NO: 2370914 - RNA, 14 nt, Human
uuguuacauuuuua

SEQ ID NO: 2370915 - RNA, 12 nt, Human
uuguuaccuuua

SEQ ID NO: 2370916 - RNA, 21 nt, Human
uuguuacaggcaccgagaaug

SEQ ID NO: 2370917 - RNA, 22 nt, Human
uuguuaauuuuuccuauauugc

SEQ ID NO: 2370918 - RNA, 22 nt, Human
uuguuacucugguucuuuguuu

SEQ ID NO: 2370919 - RNA, 17 nt, Human
uuguuacuaacuaaacu

SEQ ID NO: 2370920 - RNA, 18 nt, Human
uuguuacuaacuaaacuc

SEQ ID NO: 2370921 - RNA, 17 nt, Human
uuguuacucugguucuu

SEQ ID NO: 2370922 - RNA, 14 nt, Human
uuguuacuucugag

SEQ ID NO: 2370923 - RNA, 21 nt, Human
uuguuaguaugaggcauuugu

SEQ ID NO: 2370924 - RNA, 19 nt, Human
uuguuaguaugaggcauuu

SEQ ID NO: 2370925 - RNA, 18 nt, Human
uuguuaaugaaaauguca

SEQ ID NO: 2370926 - RNA, 17 nt, Human
uuguuaaugaaaauguc

SEQ ID NO: 2370927 - RNA, 21 nt, Human
uuguuaauaaaaguacauguu

SEQ ID NO: 2370928 - RNA, 22 nt, Human
uuguuaagucuaaauauuuccu

SEQ ID NO: 2370929 - RNA, 14 nt, Human
uuguuaauaaaagu

SEQ ID NO: 2370930 - RNA, 19 nt, Human
uuguuaauaaaaguacaug

SEQ ID NO: 2370931 - RNA, 17 nt, Human
uuguuaagauaugaugu

SEQ ID NO: 2370932 - RNA, 14 nt, Human
uuguuaaauauuua

SEQ ID NO: 2370933 - RNA, 22 nt, Human
uuguuaacucuugucuauuuuu

SEQ ID NO: 2370934 - RNA, 18 nt, Human
uuguguuuuuaauuuauu

SEQ ID NO: 2370935 - RNA, 18 nt, Human
uuguuaacucuugucuau

SEQ ID NO: 2370936 - RNA, 19 nt, Human
uuguguuucuuuaguuuuu

SEQ ID NO: 2370937 - RNA, 14 nt, Human
uuguguuugucauu

SEQ ID NO: 2370938 - RNA, 18 nt, Human
uuguguuuugcaagccag

SEQ ID NO: 2370939 - RNA, 16 nt, Human
uuguuaaaauaacuag

SEQ ID NO: 2370940 - RNA, 21 nt, Human
uuguguuuuuaauuuauuuau

SEQ ID NO: 2370941 - RNA, 17 nt, Human
uuguguuuuuaauuuau

SEQ ID NO: 2370942 - RNA, 17 nt, Human
uuguguuuguguauuua

SEQ ID NO: 2370943 - RNA, 15 nt, Human
uuguguuugucauua

SEQ ID NO: 2370944 - RNA, 20 nt, Human
uuguguuugucauuagccug

SEQ ID NO: 2370945 - RNA, 21 nt, Human
uuguaaaaccugucaaugaua

SEQ ID NO: 2370946 - RNA, 23 nt, Human
uuguaaaaccugucaaugauaca

SEQ ID NO: 2370947 - RNA, 20 nt, Human
uuguaaaaccugucaaugau

SEQ ID NO: 2370948 - RNA, 23 nt, Human
uuguaaaagaacaguaaacauug

SEQ ID NO: 2370949 - RNA, 14 nt, Human
uuguaaaacuacac

SEQ ID NO: 2370950 - RNA, 20 nt, Human
uuguaaaagaacaguaaaca

SEQ ID NO: 2370951 - RNA, 14 nt, Human
uuguaaauacacau

SEQ ID NO: 2370952 - RNA, 13 nt, Human
uuguaaauacacc

SEQ ID NO: 2370953 - RNA, 14 nt, Human
uuguaaauacacca

SEQ ID NO: 2370954 - RNA, 12 nt, Human
uuguaaauacac

SEQ ID NO: 2370955 - RNA, 11 nt, Human
uuguaaauaca

SEQ ID NO: 2370956 - RNA, 21 nt, Human
uuguaaaauagcuuguauagu

SEQ ID NO: 2370957 - RNA, 21 nt, Human
uuguaaaagaacaguaaacau

SEQ ID NO: 2370958 - RNA, 15 nt, Human
uuguaaaauagcuug

SEQ ID NO: 2370959 - RNA, 17 nt, Human
uuguaaauagcucaggu

SEQ ID NO: 2370960 - RNA, 17 nt, Human
uuguaaauaguauuuga

SEQ ID NO: 2370961 - RNA, 16 nt, Human
uuguaaaugugguaaa

SEQ ID NO: 2370962 - RNA, 21 nt, Human
uuguaaaugugguaaagaguu

SEQ ID NO: 2370963 - RNA, 12 nt, Human
uuguaaauauau

SEQ ID NO: 2370964 - RNA, 13 nt, Human
uuguaaauauaua

SEQ ID NO: 2370965 - RNA, 15 nt, Human
uuguaaauauauaaa

SEQ ID NO: 2370966 - RNA, 17 nt, Human
uuguaaauauauaaaua

SEQ ID NO: 2370967 - RNA, 21 nt, Human
uuguaaauauauaaauauaua

SEQ ID NO: 2370968 - RNA, 15 nt, Human
uuguaaauuaaucuu

SEQ ID NO: 2370969 - RNA, 18 nt, Human
uuguaaauauauaaauau

SEQ ID NO: 2370970 - RNA, 14 nt, Human
uuguaaauuaaucu

SEQ ID NO: 2370971 - RNA, 16 nt, Human
uuguaaauuaaucuuu

SEQ ID NO: 2370972 - RNA, 14 nt, Human
uuguacauaaugcg

SEQ ID NO: 2370973 - RNA, 18 nt, Human
uuguacauaaugcgugca

SEQ ID NO: 2370974 - RNA, 23 nt, Human
uuguaaauuaacuuuuauaaacu

SEQ ID NO: 2370975 - RNA, 18 nt, Human
uuguaaauuaacuuuuau

SEQ ID NO: 2370976 - RNA, 16 nt, Human
uuguaaauuaacuuuu

SEQ ID NO: 2370977 - RNA, 15 nt, Human
uuguaaauuaacuuu

SEQ ID NO: 2370978 - RNA, 22 nt, Human
uuguaaaaauuaaaaguuaugg

SEQ ID NO: 2370979 - RNA, 19 nt, Human
uuggucuuauuuauuauug

SEQ ID NO: 2370980 - RNA, 15 nt, Human
uuggucuuauuuauu

SEQ ID NO: 2370981 - RNA, 15 nt, Human
uugguccaggaaaug

SEQ ID NO: 2370982 - RNA, 13 nt, Human
uuggucuguguga

SEQ ID NO: 2370983 - RNA, 16 nt, Human
uuggucugugagaugc

SEQ ID NO: 2370984 - RNA, 22 nt, Human
uugguacuacuagaugucuuua

SEQ ID NO: 2370985 - RNA, 15 nt, Human
uugguagagauucau

SEQ ID NO: 2370986 - RNA, 13 nt, Human
uugguagagauuc

SEQ ID NO: 2370987 - RNA, 16 nt, Human
uugguaucaagaaagu

SEQ ID NO: 2370988 - RNA, 17 nt, Human
uugguaucaagaaaguc

SEQ ID NO: 2370989 - RNA, 12 nt, Human
uugguauuguau

SEQ ID NO: 2370990 - RNA, 18 nt, Human
uugguaucuguucuuuaa

SEQ ID NO: 2370991 - RNA, 13 nt, Human
uugguauuguauu

SEQ ID NO: 2370992 - RNA, 14 nt, Human
uugguauuguauuu

SEQ ID NO: 2370993 - RNA, 21 nt, Human
uugguauuguauuuauucaau

SEQ ID NO: 2370994 - RNA, 15 nt, Human
uugcacuaaaguaug

SEQ ID NO: 2370995 - RNA, 19 nt, Human
uugcacuaaaguauguaaa

SEQ ID NO: 2370996 - RNA, 23 nt, Human
uuggguguaacaggucuccucuu

SEQ ID NO: 2370997 - RNA, 21 nt, Human
uuggguguaacaggucuccuc

SEQ ID NO: 2370998 - RNA, 15 nt, Human
uugcacuccagccug

SEQ ID NO: 2370999 - RNA, 14 nt, Human
uugcacuccagccu

SEQ ID NO: 2371000 - RNA, 20 nt, Human
uugcacgcccaugugugagu

SEQ ID NO: 2371001 - RNA, 18 nt, Human
uugcacgcccauguguga

SEQ ID NO: 2371002 - RNA, 17 nt, Human
uugcacgcccaugugug

SEQ ID NO: 2371003 - RNA, 15 nt, Human
uugcacguggccucu

SEQ ID NO: 2371004 - RNA, 14 nt, Human
uugcacggcugcug

SEQ ID NO: 2371005 - RNA, 15 nt, Human
uugcacggcugcuga

SEQ ID NO: 2371006 - RNA, 22 nt, Human
uuggguucaagcgauucuucug

SEQ ID NO: 2371007 - RNA, 16 nt, Human
uuggguucaucugagc

SEQ ID NO: 2371008 - RNA, 19 nt, Human
uugucugugcauccggggg

SEQ ID NO: 2371009 - RNA, 17 nt, Human
uugugaaaugaaaacau

SEQ ID NO: 2371010 - RNA, 21 nt, Human
uugugaaauaaaacuggcuuu

SEQ ID NO: 2371011 - RNA, 20 nt, Human
uugugaaaggaaagaggcuc

SEQ ID NO: 2371012 - RNA, 14 nt, Human
uugugaaaugaugg

SEQ ID NO: 2371013 - RNA, 12 nt, Human
uugugauuuuug

SEQ ID NO: 2371014 - RNA, 17 nt, Human
uugugauuuuuguaauu

SEQ ID NO: 2371015 - RNA, 16 nt, Human
uugugauuuuuguaau

SEQ ID NO: 2371016 - RNA, 18 nt, Human
uugucucaaugcucauaa

SEQ ID NO: 2371017 - RNA, 16 nt, Human
uugucucaaugcucau

SEQ ID NO: 2371018 - RNA, 17 nt, Human
uugucucaaugcucaua

SEQ ID NO: 2371019 - RNA, 15 nt, Human
uugucuagugaaacu

SEQ ID NO: 2371020 - RNA, 15 nt, Human
uugucuuaaaaagug

SEQ ID NO: 2371021 - RNA, 21 nt, Human
uugucugaagucacugcacag

SEQ ID NO: 2371022 - RNA, 18 nt, Human
uugucucccuggcccuca

SEQ ID NO: 2371023 - RNA, 20 nt, Human
uugucugaagucacugcaca

SEQ ID NO: 2371024 - RNA, 14 nt, Human
uugucucccuggcc

SEQ ID NO: 2371025 - RNA, 15 nt, Human
uugucucccuggccc

SEQ ID NO: 2371026 - RNA, 16 nt, Human
uugucucccuggcccu

SEQ ID NO: 2371027 - RNA, 17 nt, Human
uugucucccuggcccuc

SEQ ID NO: 2371028 - RNA, 12 nt, Human
uugucucccugg

SEQ ID NO: 2371029 - RNA, 16 nt, Human
uuguauuaaagacaga

SEQ ID NO: 2371030 - RNA, 12 nt, Human
uuguauuaagaa

SEQ ID NO: 2371031 - RNA, 18 nt, Human
uuguauuaagaaugaaau

SEQ ID NO: 2371032 - RNA, 13 nt, Human
uuguauuaagaau

SEQ ID NO: 2371033 - RNA, 21 nt, Human
uuguauucagaguugaugguu

SEQ ID NO: 2371034 - RNA, 16 nt, Human
uuguauucucuccugu

SEQ ID NO: 2371035 - RNA, 15 nt, Human
uuguauucucuccug

SEQ ID NO: 2371036 - RNA, 11 nt, Human
uugucuaaaau

SEQ ID NO: 2371037 - RNA, 22 nt, Human
uugucuaaaaugccucagugua

SEQ ID NO: 2371038 - RNA, 19 nt, Human
uuguauucucuccuguacc

SEQ ID NO: 2371039 - RNA, 16 nt, Human
uuguauuaaacucuuc

SEQ ID NO: 2371040 - RNA, 18 nt, Human
uugucuaaaacaauaaaa

SEQ ID NO: 2371041 - RNA, 17 nt, Human
uugucuaaaacaauaaa

SEQ ID NO: 2371042 - RNA, 22 nt, Human
uugucguugacuuuagggacuc

SEQ ID NO: 2371043 - RNA, 14 nt, Human
uuguauuaaagaca

SEQ ID NO: 2371044 - RNA, 15 nt, Human
uuguauuaaacucuu

SEQ ID NO: 2371045 - RNA, 13 nt, Human
uuguauuaaacuc

SEQ ID NO: 2371046 - RNA, 18 nt, Human
uuguauguaaaugugcau

SEQ ID NO: 2371047 - RNA, 17 nt, Human
uuguauguguguagaca

SEQ ID NO: 2371048 - RNA, 19 nt, Human
uuguauguuaaguuacuuc

SEQ ID NO: 2371049 - RNA, 23 nt, Human
uuguaugccuuuaaaucugugau

SEQ ID NO: 2371050 - RNA, 13 nt, Human
uuguauguaaaug

SEQ ID NO: 2371051 - RNA, 16 nt, Human
uuguauguaaaugugc

SEQ ID NO: 2371052 - RNA, 12 nt, Human
uuguacuguaaa

SEQ ID NO: 2371053 - RNA, 14 nt, Human
uuguacuguaaaga

SEQ ID NO: 2371054 - RNA, 15 nt, Human
uuguacuguaaagag

SEQ ID NO: 2371055 - RNA, 21 nt, Human
uuguaugccuuuaaaucugug

SEQ ID NO: 2371056 - RNA, 22 nt, Human
uuguaugccuuuaaaucuguga

SEQ ID NO: 2371057 - RNA, 18 nt, Human
uuguacauauguaaaaua

SEQ ID NO: 2371058 - RNA, 15 nt, Human
uuguacauauuugug

SEQ ID NO: 2371059 - RNA, 20 nt, Human
uuguacauguguagccugug

SEQ ID NO: 2371060 - RNA, 21 nt, Human
uuguacauguguagccugugc

SEQ ID NO: 2371061 - RNA, 16 nt, Human
uuguacauaguuauuu

SEQ ID NO: 2371062 - RNA, 21 nt, Human
uuguacauauuuguggaauaa

SEQ ID NO: 2371063 - RNA, 17 nt, Human
uuguacauuuaugauuu

SEQ ID NO: 2371064 - RNA, 20 nt, Human
uuguacauuuaugauuuaau

SEQ ID NO: 2371065 - RNA, 19 nt, Human
uuuuucccagcuacaccuu

SEQ ID NO: 2371066 - RNA, 13 nt, Human
uuuuuccaucuuu

SEQ ID NO: 2371067 - RNA, 14 nt, Human
uuuuuccccaaagu

SEQ ID NO: 2371068 - RNA, 15 nt, Human
uuuuuccccaaaguc

SEQ ID NO: 2371069 - RNA, 16 nt, Human
uuuuuccccaaagucu

SEQ ID NO: 2371070 - RNA, 19 nt, Human
uuuuuuaaccaaaggugaa

SEQ ID NO: 2371071 - RNA, 11 nt, Human
uuuuuuaagau

SEQ ID NO: 2371072 - RNA, 17 nt, Human
uuuuuuaaguauuuaua

SEQ ID NO: 2371073 - RNA, 12 nt, Human
uuuuuuaagauu

SEQ ID NO: 2371074 - RNA, 12 nt, Human
uuuuuucaucuu

SEQ ID NO: 2371075 - RNA, 14 nt, Human
uuuuuucagaccga

SEQ ID NO: 2371076 - RNA, 20 nt, Human
uuuuuucauguuuuaacaaa

SEQ ID NO: 2371077 - RNA, 18 nt, Human
uuuuuucaauauuuauua

SEQ ID NO: 2371078 - RNA, 11 nt, Human
uuuuuucagac

SEQ ID NO: 2371079 - RNA, 12 nt, Human
uuuuuucagacc

SEQ ID NO: 2371080 - RNA, 16 nt, Human
uuuuuuauuguuuaaa

SEQ ID NO: 2371081 - RNA, 16 nt, Human
uuuuuuaaugugcugu

SEQ ID NO: 2371082 - RNA, 12 nt, Human
uuuuuuaauuuu

SEQ ID NO: 2371083 - RNA, 15 nt, Human
uuuuuuaaugugcug

SEQ ID NO: 2371084 - RNA, 13 nt, Human
uuuuuuccacuua

SEQ ID NO: 2371085 - RNA, 22 nt, Human
uuuuuuccaucuuuacaaaacu

SEQ ID NO: 2371086 - RNA, 13 nt, Human
uuuuuuccaucuu

SEQ ID NO: 2371087 - RNA, 13 nt, Human
uuuuuuuaaugug

SEQ ID NO: 2371088 - RNA, 11 nt, Human
uuuuuuuacua

SEQ ID NO: 2371089 - RNA, 12 nt, Human
uuuuuuuuaaga

SEQ ID NO: 2371090 - RNA, 10 nt, Human
uuuuuuucca

SEQ ID NO: 2371091 - RNA, 14 nt, Human
uuuuuuucuaagag

SEQ ID NO: 2371092 - RNA, 12 nt, Human
uuuuuuugagau

SEQ ID NO: 2371093 - RNA, 12 nt, Human
uuuuuuucuuua

SEQ ID NO: 2371094 - RNA, 22 nt, Human
uuuuuaacucaauauuuuccau

SEQ ID NO: 2371095 - RNA, 23 nt, Human
uuuuuaagaaaaaggaugcacag

SEQ ID NO: 2371096 - RNA, 12 nt, Human
uuuuuaagaaaa

SEQ ID NO: 2371097 - RNA, 17 nt, Human
uuuuuaagugcugcauu

SEQ ID NO: 2371098 - RNA, 16 nt, Human
uuuuuaagugcugcau

SEQ ID NO: 2371099 - RNA, 23 nt, Human
uuuuuaagugcugcauuuaaaag

SEQ ID NO: 2371100 - RNA, 22 nt, Human
uuuuuaagugcugcauuuaaaa

SEQ ID NO: 2371101 - RNA, 19 nt, Human
uuuuuaagugcugcauuua

SEQ ID NO: 2371102 - RNA, 18 nt, Human
uuuuuaagugcugcauuu

SEQ ID NO: 2371103 - RNA, 21 nt, Human
uuuugacucuggcaaagcuuu

SEQ ID NO: 2371104 - RNA, 20 nt, Human
uuuuuaaauguaaagauauu

SEQ ID NO: 2371105 - RNA, 12 nt, Human
uuuuuaaccaaa

SEQ ID NO: 2371106 - RNA, 20 nt, Human
uuuuuaaauuuuauuuccug

SEQ ID NO: 2371107 - RNA, 22 nt, Human
uuuugacuagggauucaggcug

SEQ ID NO: 2371108 - RNA, 15 nt, Human
uuuugacggaugauu

SEQ ID NO: 2371109 - RNA, 20 nt, Human
uuuugacggaugauuggauu

SEQ ID NO: 2371110 - RNA, 17 nt, Human
uuuugacuuaaagcaga

SEQ ID NO: 2371111 - RNA, 11 nt, Human
uuuugaagugu

SEQ ID NO: 2371112 - RNA, 18 nt, Human
uuuugaccuguggugcaa

SEQ ID NO: 2371113 - RNA, 24 nt, Human
uuuugacaguguugaaaauguuca

SEQ ID NO: 2371114 - RNA, 14 nt, Human
uuuugaaggcaaaa

SEQ ID NO: 2371115 - RNA, 13 nt, Human
uuuugaaggcaaa

SEQ ID NO: 2371116 - RNA, 22 nt, Human
uuuugaaguguaggcagacaca

SEQ ID NO: 2371117 - RNA, 19 nt, Human
uuuugaaguaguuuguaua

SEQ ID NO: 2371118 - RNA, 10 nt, Human
uuuugaagug

SEQ ID NO: 2371119 - RNA, 15 nt, Human
uuuugaauaaaaacu

SEQ ID NO: 2371120 - RNA, 23 nt, Human
uuuugacaguguugaaaauguuc

SEQ ID NO: 2371121 - RNA, 19 nt, Human
uuuugacaguguugaaaau

SEQ ID NO: 2371122 - RNA, 15 nt, Human
uuuuuaaucaugaaa

SEQ ID NO: 2371123 - RNA, 17 nt, Human
uuuuuaaugugcugugu

SEQ ID NO: 2371124 - RNA, 12 nt, Human
uuuuuaaugugc

SEQ ID NO: 2371125 - RNA, 19 nt, Human
uuuuuaaugugcuguguaa

SEQ ID NO: 2371126 - RNA, 20 nt, Human
uuuuuaaugugcuguguaaa

SEQ ID NO: 2371127 - RNA, 13 nt, Human
uuuuucaauuaaa

SEQ ID NO: 2371128 - RNA, 14 nt, Human
uuuuucaauuaaac

SEQ ID NO: 2371129 - RNA, 15 nt, Human
uuuuucaauuaaacg

SEQ ID NO: 2371130 - RNA, 21 nt, Human
uuuuucagcagacuaugaaua

SEQ ID NO: 2371131 - RNA, 11 nt, Human
uuuuucagacc

SEQ ID NO: 2371132 - RNA, 12 nt, Human
uuuuucagaccg

SEQ ID NO: 2371133 - RNA, 14 nt, Human
uuuuucagaaauau

SEQ ID NO: 2371134 - RNA, 10 nt, Human
uuuuucagac

SEQ ID NO: 2371135 - RNA, 19 nt, Human
uuuuucacggaaguuuuca

SEQ ID NO: 2371136 - RNA, 22 nt, Human
uuuuucacggaaguuuucaaug

SEQ ID NO: 2371137 - RNA, 13 nt, Human
uuuuucacauuuu

SEQ ID NO: 2371138 - RNA, 21 nt, Human
uuuuucaauuaaacggauuau

SEQ ID NO: 2371139 - RNA, 16 nt, Human
uuuuucacggaaguuu

SEQ ID NO: 2371140 - RNA, 17 nt, Human
uuuuucaauuaaacgga

SEQ ID NO: 2371141 - RNA, 18 nt, Human
uuuuucaauuaaacggau

SEQ ID NO: 2371142 - RNA, 19 nt, Human
uuuuucaauuaaacggauu

SEQ ID NO: 2371143 - RNA, 20 nt, Human
uuuuucaauuaaacggauua

SEQ ID NO: 2371144 - RNA, 18 nt, Human
uuuuuaaguuacacauuu

SEQ ID NO: 2371145 - RNA, 18 nt, Human
uuuuuaauaaaaaggcac

SEQ ID NO: 2371146 - RNA, 17 nt, Human
uuuuuaauaaagacagg

SEQ ID NO: 2371147 - RNA, 20 nt, Human
uuuuuaauaaagacaggguu

SEQ ID NO: 2371148 - RNA, 13 nt, Human
uuuuuaaucauga

SEQ ID NO: 2371149 - RNA, 17 nt, Human
uuuuuaaucaugaaauu

SEQ ID NO: 2371150 - RNA, 13 nt, Human
uuuuuaaucuuua

SEQ ID NO: 2371151 - RNA, 21 nt, Human
uuuuucauugauaugaaaaau

SEQ ID NO: 2371152 - RNA, 20 nt, Human
uuuuucauguuuuaacaaaa

SEQ ID NO: 2371153 - RNA, 12 nt, Human
uuuuuccaggcu

SEQ ID NO: 2371154 - RNA, 14 nt, Human
uuuuuccacuuugu

SEQ ID NO: 2371155 - RNA, 20 nt, Human
uuuuuccacuuuguucuuua

SEQ ID NO: 2371156 - RNA, 21 nt, Human
uuuuuccacauaaggaaacug

SEQ ID NO: 2371157 - RNA, 14 nt, Human
uuuuuccaacugug

SEQ ID NO: 2371158 - RNA, 19 nt, Human
uuuuuccaaaaaaauacug

SEQ ID NO: 2371159 - RNA, 13 nt, Human
uuuuuccaaaaaa

SEQ ID NO: 2371160 - RNA, 16 nt, Human
uuuuuccaaaaaaaua

SEQ ID NO: 2371161 - RNA, 12 nt, Human
uuuuucaguuuu

SEQ ID NO: 2371162 - RNA, 15 nt, Human
uuuuucaguuuucag

SEQ ID NO: 2371163 - RNA, 14 nt, Human
uuuuucagaccgaa

SEQ ID NO: 2371164 - RNA, 13 nt, Human
uuuuucauauugu

SEQ ID NO: 2371165 - RNA, 18 nt, Human
uuuuucauguuuuaacaa

SEQ ID NO: 2371166 - RNA, 11 nt, Human
uuuuucauguu

SEQ ID NO: 2371167 - RNA, 10 nt, Human
uuuuucaugu

SEQ ID NO: 2371168 - RNA, 11 nt, Human
uuuuucaugau

SEQ ID NO: 2371169 - RNA, 18 nt, Human
uuuuucaugauuuugaaa

SEQ ID NO: 2371170 - RNA, 12 nt, Human
uuugcacugagg

SEQ ID NO: 2371171 - RNA, 14 nt, Human
uuugcacugagggc

SEQ ID NO: 2371172 - RNA, 18 nt, Human
uuugcacugauauaucau

SEQ ID NO: 2371173 - RNA, 16 nt, Human
uuugcacugagggcca

SEQ ID NO: 2371174 - RNA, 17 nt, Human
uuugcacugagggccac

SEQ ID NO: 2371175 - RNA, 19 nt, Human
uuugaguuauuuuaauuau

SEQ ID NO: 2371176 - RNA, 17 nt, Human
uuugcaccccaugcugu

SEQ ID NO: 2371177 - RNA, 18 nt, Human
uuugcaccccaugcuguu

SEQ ID NO: 2371178 - RNA, 20 nt, Human
uuugcaccccaugcuguuga

SEQ ID NO: 2371179 - RNA, 12 nt, Human
uuugcaccccuc

SEQ ID NO: 2371180 - RNA, 13 nt, Human
uuugcaccccucc

SEQ ID NO: 2371181 - RNA, 15 nt, Human
uuugcaccccuccca

SEQ ID NO: 2371182 - RNA, 16 nt, Human
uuugcaccccucccau

SEQ ID NO: 2371183 - RNA, 16 nt, Human
uuugcaccugcucucu

SEQ ID NO: 2371184 - RNA, 20 nt, Human
uuugaguggaugauguuucg

SEQ ID NO: 2371185 - RNA, 16 nt, Human
uuugaguggaugaugu

SEQ ID NO: 2371186 - RNA, 14 nt, Human
uuugagugcucuga

SEQ ID NO: 2371187 - RNA, 21 nt, Human
uuugaguggaugauguuucgu

SEQ ID NO: 2371188 - RNA, 14 nt, Human
uuugaguguuuuaa

SEQ ID NO: 2371189 - RNA, 12 nt, Human
uuugaguucuac

SEQ ID NO: 2371190 - RNA, 16 nt, Human
uuuccguggcacugca

SEQ ID NO: 2371191 - RNA, 13 nt, Human
uuugagugcucug

SEQ ID NO: 2371192 - RNA, 21 nt, Human
uuugagugccuuacacaaugg

SEQ ID NO: 2371193 - RNA, 15 nt, Human
uuuccguuaaaauac

SEQ ID NO: 2371194 - RNA, 13 nt, Human
uuugagugccuua

SEQ ID NO: 2371195 - RNA, 17 nt, Human
uuuccguuaaaauacca

SEQ ID NO: 2371196 - RNA, 20 nt, Human
uuuccacaagauucccagag

SEQ ID NO: 2371197 - RNA, 15 nt, Human
uuuccacaaaucagu

SEQ ID NO: 2371198 - RNA, 19 nt, Human
uuuccacaaaaucugucca

SEQ ID NO: 2371199 - RNA, 22 nt, Human
uuuccacaagauucccagagac

SEQ ID NO: 2371200 - RNA, 17 nt, Human
uuuccacaccuggcacu

SEQ ID NO: 2371201 - RNA, 20 nt, Human
uuuccacauaaggaaacugg

SEQ ID NO: 2371202 - RNA, 23 nt, Human
uuuccacauaaggaaacuggguu

SEQ ID NO: 2371203 - RNA, 19 nt, Human
uuuccaccacagccagcac

SEQ ID NO: 2371204 - RNA, 16 nt, Human
uuuccaagugugcaua

SEQ ID NO: 2371205 - RNA, 15 nt, Human
uuuccacagaagcuc

SEQ ID NO: 2371206 - RNA, 14 nt, Human
uuugcauuccuaca

SEQ ID NO: 2371207 - RNA, 15 nt, Human
uuugcauucaaauua

SEQ ID NO: 2371208 - RNA, 17 nt, Human
uuugcauucaaauuaag

SEQ ID NO: 2371209 - RNA, 19 nt, Human
uuugcauugaacacaaacu

SEQ ID NO: 2371210 - RNA, 21 nt, Human
uuugcauuuaaaacagacacu

SEQ ID NO: 2371211 - RNA, 19 nt, Human
uuugcauuuaaaacagaca

SEQ ID NO: 2371212 - RNA, 17 nt, Human
uuugcauuuaaaacaga

SEQ ID NO: 2371213 - RNA, 16 nt, Human
uuugcauuuaaaacag

SEQ ID NO: 2371214 - RNA, 22 nt, Human
uuugcauuaaauucacaaacuu

SEQ ID NO: 2371215 - RNA, 21 nt, Human
uuugcauuaaauucacaaacu

SEQ ID NO: 2371216 - RNA, 12 nt, Human
uuugcauucaaa

SEQ ID NO: 2371217 - RNA, 13 nt, Human
uuugcauucaaau

SEQ ID NO: 2371218 - RNA, 14 nt, Human
uuugcauucaaauu

SEQ ID NO: 2371219 - RNA, 18 nt, Human
uuugcauuaaauucacaa

SEQ ID NO: 2371220 - RNA, 17 nt, Human
uuugcauuaaauucaca

SEQ ID NO: 2371221 - RNA, 22 nt, Human
uuugcauaacaauuccucuacu

SEQ ID NO: 2371222 - RNA, 20 nt, Human
uuugcauaacaauuccucua

SEQ ID NO: 2371223 - RNA, 12 nt, Human
uuugcaggcuca

SEQ ID NO: 2371224 - RNA, 22 nt, Human
uuugcacugagggccacacuau

SEQ ID NO: 2371225 - RNA, 16 nt, Human
uuugcaggcaugcaug

SEQ ID NO: 2371226 - RNA, 20 nt, Human
uuugcacuggaguucuaugc

SEQ ID NO: 2371227 - RNA, 14 nt, Human
uuugcagguugcuu

SEQ ID NO: 2371228 - RNA, 21 nt, Human
uuugcaguagagucaucucca

SEQ ID NO: 2371229 - RNA, 16 nt, Human
uuugcauaacaauucc

SEQ ID NO: 2371230 - RNA, 18 nt, Human
uuugcauaacaauuccuc

SEQ ID NO: 2371231 - RNA, 17 nt, Human
uuugcauaacaauuccu

SEQ ID NO: 2371232 - RNA, 18 nt, Human
uuugcauaacguauaaaa

SEQ ID NO: 2371233 - RNA, 13 nt, Human
uuuggacccugag

SEQ ID NO: 2371234 - RNA, 12 nt, Human
uuuggaaaauaa

SEQ ID NO: 2371235 - RNA, 23 nt, Human
uuugcauuuaaaacagacacugg

SEQ ID NO: 2371236 - RNA, 15 nt, Human
uuuggaaaaugcauu

SEQ ID NO: 2371237 - RNA, 19 nt, Human
uuugguaucuguucuuuaa

SEQ ID NO: 2371238 - RNA, 16 nt, Human
uuuggaccccagcugg

SEQ ID NO: 2371239 - RNA, 13 nt, Human
uuugguauuguau

SEQ ID NO: 2371240 - RNA, 17 nt, Human
uuuggaccccagcuggg

SEQ ID NO: 2371241 - RNA, 22 nt, Human
uuugguauuacacuguauuugu

SEQ ID NO: 2371242 - RNA, 14 nt, Human
uuugguauuguauu

SEQ ID NO: 2371243 - RNA, 23 nt, Human
uuuggucccgugcagcuucuguc

SEQ ID NO: 2371244 - RNA, 13 nt, Human
uuuggucccuggg

SEQ ID NO: 2371245 - RNA, 15 nt, Human
uuuggucaacacuaa

SEQ ID NO: 2371246 - RNA, 17 nt, Human
uuuggucuacacugugc

SEQ ID NO: 2371247 - RNA, 17 nt, Human
uuuguauaaaauaauuu

SEQ ID NO: 2371248 - RNA, 18 nt, Human
uuuguauaaaauaauuuu

SEQ ID NO: 2371249 - RNA, 19 nt, Human
uuuguauaaaauaauuuuu

SEQ ID NO: 2371250 - RNA, 13 nt, Human
uuuguguauuuaa

SEQ ID NO: 2371251 - RNA, 14 nt, Human
uuuguauuuuuaau

SEQ ID NO: 2371252 - RNA, 17 nt, Human
uuuguauuuuuuugcaa

SEQ ID NO: 2371253 - RNA, 14 nt, Human
uuuguauuuuuagu

SEQ ID NO: 2371254 - RNA, 20 nt, Human
uuuguguauuuaacagggag

SEQ ID NO: 2371255 - RNA, 21 nt, Human
uuugugucauguuuaagaaau

SEQ ID NO: 2371256 - RNA, 13 nt, Human
uuugugugucuua

SEQ ID NO: 2371257 - RNA, 14 nt, Human
uuuguguguagucu

SEQ ID NO: 2371258 - RNA, 14 nt, Human
uuugugugagagac

SEQ ID NO: 2371259 - RNA, 13 nt, Human
uuugugugauuga

SEQ ID NO: 2371260 - RNA, 12 nt, Human
uuugugugagag

SEQ ID NO: 2371261 - RNA, 22 nt, Human
uuugugucaaugggcaaugaca

SEQ ID NO: 2371262 - RNA, 14 nt, Human
uuugugugauugaa

SEQ ID NO: 2371263 - RNA, 10 nt, Human
uuuguauuuu

SEQ ID NO: 2371264 - RNA, 15 nt, Human
uuuguauuuuccaag

SEQ ID NO: 2371265 - RNA, 17 nt, Human
uuuguauuuuguuuaaa

SEQ ID NO: 2371266 - RNA, 23 nt, Human
uuuguauuuuccaagugugcaua

SEQ ID NO: 2371267 - RNA, 21 nt, Human
uuuguauuguuucaauugcau

SEQ ID NO: 2371268 - RNA, 16 nt, Human
uuuguauucucugagc

SEQ ID NO: 2371269 - RNA, 14 nt, Human
uuuguauucucuga

SEQ ID NO: 2371270 - RNA, 20 nt, Human
uuuuaaaauaucuuuugacc

SEQ ID NO: 2371271 - RNA, 14 nt, Human
uuuuaaaauaucuu

SEQ ID NO: 2371272 - RNA, 14 nt, Human
uuuuaaaauccacu

SEQ ID NO: 2371273 - RNA, 12 nt, Human
uuuguuguaaaa

SEQ ID NO: 2371274 - RNA, 19 nt, Human
uuuuaaaaguuucaaugug

SEQ ID NO: 2371275 - RNA, 21 nt, Human
uuuuaaaaguuucaaugugau

SEQ ID NO: 2371276 - RNA, 22 nt, Human
uuuuaaaaguuucaaugugauu

SEQ ID NO: 2371277 - RNA, 20 nt, Human
uuuuaaacccuauugguaaa

SEQ ID NO: 2371278 - RNA, 19 nt, Human
uuuuaaacagugagccuga

SEQ ID NO: 2371279 - RNA, 21 nt, Human
uuuuaaaccauaaaaagcuga

SEQ ID NO: 2371280 - RNA, 23 nt, Human
uuuuaaacaaaauagaagcugua

SEQ ID NO: 2371281 - RNA, 13 nt, Human
uuuuaaacaguga

SEQ ID NO: 2371282 - RNA, 23 nt, Human
uuuuaaaauccacuuuaucuuga

SEQ ID NO: 2371283 - RNA, 12 nt, Human
uuuguuauuugu

SEQ ID NO: 2371284 - RNA, 13 nt, Human
uuuguuaccuuua

SEQ ID NO: 2371285 - RNA, 22 nt, Human
uuuguuaguaugaggcauuugu

SEQ ID NO: 2371286 - RNA, 17 nt, Human
uuuguguguugucucuu

SEQ ID NO: 2371287 - RNA, 19 nt, Human
uuuguguguugucuugaaa

SEQ ID NO: 2371288 - RNA, 18 nt, Human
uuuguguguugucuugaa

SEQ ID NO: 2371289 - RNA, 15 nt, Human
uuuguguguugucuu

SEQ ID NO: 2371290 - RNA, 17 nt, Human
uuuguguguugucuuga

SEQ ID NO: 2371291 - RNA, 15 nt, Human
uuuguugucagcuga

SEQ ID NO: 2371292 - RNA, 23 nt, Human
uuuguuggaagguuuggugugug

SEQ ID NO: 2371293 - RNA, 14 nt, Human
uuuguugcuguuuu

SEQ ID NO: 2371294 - RNA, 19 nt, Human
uuuguuauuuguacaguuc

SEQ ID NO: 2371295 - RNA, 17 nt, Human
uuuguuauuuguacagu

SEQ ID NO: 2371296 - RNA, 18 nt, Human
uuuguuauuuguacaguu

SEQ ID NO: 2371297 - RNA, 20 nt, Human
uuuguuauuuucaguauuuu

SEQ ID NO: 2371298 - RNA, 13 nt, Human
uuuuacuaaagaa

SEQ ID NO: 2371299 - RNA, 22 nt, Human
uuuuacuaaagaaagauuacuu

SEQ ID NO: 2371300 - RNA, 21 nt, Human
uuuuaccuaccacagugucug

SEQ ID NO: 2371301 - RNA, 19 nt, Human
uuuuacguccaucucuugu

SEQ ID NO: 2371302 - RNA, 16 nt, Human
uuuuacaauugaaaug

SEQ ID NO: 2371303 - RNA, 20 nt, Human
uuuuaccuaccacagugucu

SEQ ID NO: 2371304 - RNA, 19 nt, Human
uuuuaccuaccacaguguc

SEQ ID NO: 2371305 - RNA, 18 nt, Human
uuuuaccuaccacagugu

SEQ ID NO: 2371306 - RNA, 18 nt, Human
uuuuaccguuucuucccu

SEQ ID NO: 2371307 - RNA, 17 nt, Human
uuuuaccguuucuuccc

SEQ ID NO: 2371308 - RNA, 13 nt, Human
uuuuauacacaua

SEQ ID NO: 2371309 - RNA, 15 nt, Human
uuuuauacacauaau

SEQ ID NO: 2371310 - RNA, 14 nt, Human
uuuuacuacugugg

SEQ ID NO: 2371311 - RNA, 23 nt, Human
uuuuauaauuuugugaagcaaaa

SEQ ID NO: 2371312 - RNA, 15 nt, Human
uuuuacuaauagaca

SEQ ID NO: 2371313 - RNA, 21 nt, Human
uuuuauaauuuugugaagcaa

SEQ ID NO: 2371314 - RNA, 14 nt, Human
uuuuaaagugauua

SEQ ID NO: 2371315 - RNA, 22 nt, Human
uuuuaaaguauguuauugcaua

SEQ ID NO: 2371316 - RNA, 16 nt, Human
uuuuaaaguauauauu

SEQ ID NO: 2371317 - RNA, 23 nt, Human
uuuuaaacuguguacauaacuga

SEQ ID NO: 2371318 - RNA, 20 nt, Human
uuuuaaacuguguacauaac

SEQ ID NO: 2371319 - RNA, 13 nt, Human
uuuuaaacugugu

SEQ ID NO: 2371320 - RNA, 21 nt, Human
uuuuaaaguaacccuacaaaa

SEQ ID NO: 2371321 - RNA, 17 nt, Human
uuuuaaauaaaagugau

SEQ ID NO: 2371322 - RNA, 15 nt, Human
uuuuaaauaaaagca

SEQ ID NO: 2371323 - RNA, 19 nt, Human
uuuuaaagugauuaaacgu

SEQ ID NO: 2371324 - RNA, 19 nt, Human
uuuuacaaaaaagaaaaga

SEQ ID NO: 2371325 - RNA, 17 nt, Human
uuuuaaauaaaagcagc

SEQ ID NO: 2371326 - RNA, 14 nt, Human
uuuuacaauugaaa

SEQ ID NO: 2371327 - RNA, 18 nt, Human
uuuuacaauaaauaaucu

SEQ ID NO: 2371328 - RNA, 17 nt, Human
uuuuacaauaaaaucuu

SEQ ID NO: 2371329 - RNA, 12 nt, Human
uuuuacaauaaa

SEQ ID NO: 2371330 - RNA, 15 nt, Human
uuuuauacuguacuu

SEQ ID NO: 2371331 - RNA, 12 nt, Human
uuuuauacugua

SEQ ID NO: 2371332 - RNA, 19 nt, Human
uuuuauacucuuucuguau

SEQ ID NO: 2371333 - RNA, 16 nt, Human
uuuuauagauuugacc

SEQ ID NO: 2371334 - RNA, 19 nt, Human
uuuuauacacauaauuaaa

SEQ ID NO: 2371335 - RNA, 18 nt, Human
uuuuauacucuuucugua

SEQ ID NO: 2371336 - RNA, 13 nt, Human
uuuuauacucuuu

SEQ ID NO: 2371337 - RNA, 21 nt, Human
uuuuauacauaaacaagacca

SEQ ID NO: 2371338 - RNA, 13 nt, Human
uuuuauacauaaa

SEQ ID NO: 2371339 - RNA, 13 nt, Human
uuuuauauuuagu

SEQ ID NO: 2371340 - RNA, 23 nt, Human
uuuuauauuuaguuauaguuuca

SEQ ID NO: 2371341 - RNA, 13 nt, Human
uuuuauauuugaa

SEQ ID NO: 2371342 - RNA, 18 nt, Human
uuuuauauuugaaauauu

SEQ ID NO: 2371343 - RNA, 17 nt, Human
uuuucaaaauaaaaaug

SEQ ID NO: 2371344 - RNA, 17 nt, Human
uuuuauuuuuuucuacc

SEQ ID NO: 2371345 - RNA, 13 nt, Human
uuuuauuuuucua

SEQ ID NO: 2371346 - RNA, 18 nt, Human
uuuuauuuuucuaaaaaa

SEQ ID NO: 2371347 - RNA, 18 nt, Human
uuuuauuuuuagacagag

SEQ ID NO: 2371348 - RNA, 21 nt, Human
uuuuauuuuucucaugaugag

SEQ ID NO: 2371349 - RNA, 15 nt, Human
uuuuauuuuguaauu

SEQ ID NO: 2371350 - RNA, 16 nt, Human
uuuuauuuuguaauua

SEQ ID NO: 2371351 - RNA, 20 nt, Human
uuuuauuuuguaauuauugu

SEQ ID NO: 2371352 - RNA, 23 nt, Human
uuuuaucuccccuucacaugcau

SEQ ID NO: 2371353 - RNA, 19 nt, Human
uuuuaucgucacugcuuaa

SEQ ID NO: 2371354 - RNA, 23 nt, Human
uuuuaugaagaaaaaauacauuu

SEQ ID NO: 2371355 - RNA, 19 nt, Human
uuuuaucuuucgugauaaa

SEQ ID NO: 2371356 - RNA, 21 nt, Human
uuuuaugacuucauuaauaau

SEQ ID NO: 2371357 - RNA, 20 nt, Human
uuuuaugacuucauuaauaa

SEQ ID NO: 2371358 - RNA, 15 nt, Human
uuuucuucacugucc

SEQ ID NO: 2371359 - RNA, 22 nt, Human
uuuucuucaacaucaauguuca

SEQ ID NO: 2371360 - RNA, 21 nt, Human
uuuucuucaacaucaauguuc

SEQ ID NO: 2371361 - RNA, 17 nt, Human
uuuucuuaaccaucuuu

SEQ ID NO: 2371362 - RNA, 13 nt, Human
uuuucuuacauaa

SEQ ID NO: 2371363 - RNA, 13 nt, Human
uuuucuucucccu

SEQ ID NO: 2371364 - RNA, 12 nt, Human
uuuucuuuaaaa

SEQ ID NO: 2371365 - RNA, 16 nt, Human
uuuucuucaugcaaug

SEQ ID NO: 2371366 - RNA, 22 nt, Human
uuuucuuguguguuuauuguca

SEQ ID NO: 2371367 - RNA, 21 nt, Human
uuuugaacuaauaaaagcaua

SEQ ID NO: 2371368 - RNA, 20 nt, Human
uuuugaacuaauaaaagcau

SEQ ID NO: 2371369 - RNA, 17 nt, Human
uuuugaaauuaaccucu

SEQ ID NO: 2371370 - RNA, 16 nt, Human
uuuucuuuaaugcuuu

SEQ ID NO: 2371371 - RNA, 15 nt, Human
uuuucuuuaaaagaa

SEQ ID NO: 2371372 - RNA, 16 nt, Human
uuuucuuuaaaagaau

SEQ ID NO: 2371373 - RNA, 16 nt, Human
uuuucuuucagccaag

SEQ ID NO: 2371374 - RNA, 14 nt, Human
uuuuccuaaaugca

SEQ ID NO: 2371375 - RNA, 13 nt, Human
uuuuccuaaguga

SEQ ID NO: 2371376 - RNA, 20 nt, Human
uuuuccuaauaaaguucugu

SEQ ID NO: 2371377 - RNA, 20 nt, Human
uuuuccuaagugauuguaug

SEQ ID NO: 2371378 - RNA, 13 nt, Human
uuuucuacucgag

SEQ ID NO: 2371379 - RNA, 15 nt, Human
uuuucccuguacagu

SEQ ID NO: 2371380 - RNA, 23 nt, Human
uuuucccgagcaaagucuaaagu

SEQ ID NO: 2371381 - RNA, 22 nt, Human
uuuucccucuuuggcuccccug

SEQ ID NO: 2371382 - RNA, 12 nt, Human
uuuuccccuccc

SEQ ID NO: 2371383 - RNA, 16 nt, Human
uuuuccccuguccuga

SEQ ID NO: 2371384 - RNA, 20 nt, Human
uuuucuacucgaguuacaga

SEQ ID NO: 2371385 - RNA, 22 nt, Human
uuuucuacucgaguuacagaca

SEQ ID NO: 2371386 - RNA, 23 nt, Human
uuuucuacucgaguuacagacaa

SEQ ID NO: 2371387 - RNA, 17 nt, Human
uuuuccuagcccucuca

SEQ ID NO: 2371388 - RNA, 13 nt, Human
uuuucuuauuuca

SEQ ID NO: 2371389 - RNA, 19 nt, Human
uuuucccagcuacaccuuu

SEQ ID NO: 2371390 - RNA, 18 nt, Human
uuuuccccccacucuccc

SEQ ID NO: 2371391 - RNA, 23 nt, Human
uuuuccccggucccuugagaccu

SEQ ID NO: 2371392 - RNA, 19 nt, Human
uuuuccccggucccuugag

SEQ ID NO: 2371393 - RNA, 16 nt, Human
uuuuccccccuagaaa

SEQ ID NO: 2371394 - RNA, 19 nt, Human
uuuuccccccacucucccc

SEQ ID NO: 2371395 - RNA, 19 nt, Human
uuuucccccuuuucugcau

SEQ ID NO: 2371396 - RNA, 22 nt, Human
uuuucccuauuagagaagagau

SEQ ID NO: 2371397 - RNA, 18 nt, Human
uuuucccuauuagagaag

SEQ ID NO: 2371398 - RNA, 18 nt, Human
uuuucccagcuacaccuu

SEQ ID NO: 2371399 - RNA, 20 nt, Human
uuuucccagauacuucccau

SEQ ID NO: 2371400 - RNA, 22 nt, Human
uuuucccacugcacccccuccu

SEQ ID NO: 2371401 - RNA, 16 nt, Human
uuuucagacucagacu

SEQ ID NO: 2371402 - RNA, 20 nt, Human
uuuucccacugcacccccuc

SEQ ID NO: 2371403 - RNA, 13 nt, Human
uuuucccacugca

SEQ ID NO: 2371404 - RNA, 15 nt, Human
uuuucagauauaaaa

SEQ ID NO: 2371405 - RNA, 14 nt, Human
uuuucagacucaga

SEQ ID NO: 2371406 - RNA, 13 nt, Human
uuuucagaccgaa

SEQ ID NO: 2371407 - RNA, 15 nt, Human
uuuucagaaauaugu

SEQ ID NO: 2371408 - RNA, 11 nt, Human
uuuucagaccg

SEQ ID NO: 2371409 - RNA, 22 nt, Human
uuuucagaaccucuuccccaga

SEQ ID NO: 2371410 - RNA, 11 nt, Human
uuuucagaccc

SEQ ID NO: 2371411 - RNA, 18 nt, Human
uuuucagaaccucuuccc

SEQ ID NO: 2371412 - RNA, 17 nt, Human
uuuucagaaccucuucc

SEQ ID NO: 2371413 - RNA, 23 nt, Human
uuuucagaaaauauuauguguuu

SEQ ID NO: 2371414 - RNA, 20 nt, Human
uuuucaccccacccuucccc

SEQ ID NO: 2371415 - RNA, 13 nt, Human
uuuucaccccacc

SEQ ID NO: 2371416 - RNA, 23 nt, Human
uuuucaccuguuuuuaagcuguu

SEQ ID NO: 2371417 - RNA, 15 nt, Human
uuuucacggaaguuu

SEQ ID NO: 2371418 - RNA, 17 nt, Human
uuuucacggaaguuuuc

SEQ ID NO: 2371419 - RNA, 18 nt, Human
uuuucacggaaguuuuca

SEQ ID NO: 2371420 - RNA, 22 nt, Human
uuuucagaaaauauuauguguu

SEQ ID NO: 2371421 - RNA, 23 nt, Human
uuuucacauucuuauaaauauga

SEQ ID NO: 2371422 - RNA, 19 nt, Human
uuuucaccagauuugcuaa

SEQ ID NO: 2371423 - RNA, 12 nt, Human
uuuucacauuuu

SEQ ID NO: 2371424 - RNA, 23 nt, Human
uuuucacaugaacauacuggcug

SEQ ID NO: 2371425 - RNA, 22 nt, Human
uuuucacauucuuauaaauaug

SEQ ID NO: 2371426 - RNA, 18 nt, Human
uuuucacauucuuauaaa

SEQ ID NO: 2371427 - RNA, 13 nt, Human
uuuucacaugaac

SEQ ID NO: 2371428 - RNA, 14 nt, Human
uuuucacaugaaca

SEQ ID NO: 2371429 - RNA, 19 nt, Human
uuuucaaauuguaucuagu

SEQ ID NO: 2371430 - RNA, 14 nt, Human
uuuucaaauuguau

SEQ ID NO: 2371431 - RNA, 21 nt, Human
uuuucaaaauuguuacaaauu

SEQ ID NO: 2371432 - RNA, 14 nt, Human
uuuucaaaauggag

SEQ ID NO: 2371433 - RNA, 11 nt, Human
uuuuuuuucau

SEQ ID NO: 2371434 - RNA, 14 nt, Human
uuuuuuuuaaacua

SEQ ID NO: 2371435 - RNA, 13 nt, Human
uuuuuuuuaaugu

SEQ ID NO: 2371436 - RNA, 13 nt, Human
uuuuuuuugacaa

SEQ ID NO: 2371437 - RNA, 22 nt, Human
ugccuccgcgugaucaaagcca

SEQ ID NO: 2371438 - RNA, 19 nt, Human
ugccuccgccucaguaaga

SEQ ID NO: 2371439 - RNA, 12 nt, Human
ugccuccucacc

SEQ ID NO: 2371440 - RNA, 16 nt, Human
ugccucccuucaugca

SEQ ID NO: 2371441 - RNA, 22 nt, Human
ugccucccucacccugagcccc

SEQ ID NO: 2371442 - RNA, 17 nt, Human
ugccucccucacccuga

SEQ ID NO: 2371443 - RNA, 21 nt, Human
ugccucccucacccugagccc

SEQ ID NO: 2371444 - RNA, 17 nt, Human
ugcccuggcccugaggu

SEQ ID NO: 2371445 - RNA, 13 nt, Human
ugccuccccugug

SEQ ID NO: 2371446 - RNA, 16 nt, Human
ugccucccucacccug

SEQ ID NO: 2371447 - RNA, 22 nt, Human
ugccguuacucuccaaccugga

SEQ ID NO: 2371448 - RNA, 19 nt, Human
ugccguuacucuccaaccu

SEQ ID NO: 2371449 - RNA, 16 nt, Human
ugccguuacucuccaa

SEQ ID NO: 2371450 - RNA, 20 nt, Human
ugccgugugcccucgggcga

SEQ ID NO: 2371451 - RNA, 13 nt, Human
ugccuaagcccuc

SEQ ID NO: 2371452 - RNA, 13 nt, Human
ugccucugggacu

SEQ ID NO: 2371453 - RNA, 21 nt, Human
ugccucugugcugugugugac

SEQ ID NO: 2371454 - RNA, 17 nt, Human
ugccucugugcugugug

SEQ ID NO: 2371455 - RNA, 16 nt, Human
ugccucugccugcauu

SEQ ID NO: 2371456 - RNA, 21 nt, Human
ugccucgaaacacagaaaccu

SEQ ID NO: 2371457 - RNA, 18 nt, Human
ugccucugccugucuccc

SEQ ID NO: 2371458 - RNA, 13 nt, Human
ugccucugccugu

SEQ ID NO: 2371459 - RNA, 14 nt, Human
ugccucugccuguc

SEQ ID NO: 2371460 - RNA, 22 nt, Human
ugccuccuuugugaggaagccg

SEQ ID NO: 2371461 - RNA, 17 nt, Human
ugccucgaaacacagaa

SEQ ID NO: 2371462 - RNA, 13 nt, Human
ugccucgaaacac

SEQ ID NO: 2371463 - RNA, 24 nt, Human
ugccuccucacccccagcuuugcu

SEQ ID NO: 2371464 - RNA, 19 nt, Human
ugccuccucacccccagcu

SEQ ID NO: 2371465 - RNA, 21 nt, Human
ugccuccuuugugaggaagcc

SEQ ID NO: 2371466 - RNA, 20 nt, Human
ugccuccuuugugaggaagc

SEQ ID NO: 2371467 - RNA, 11 nt, Human
ugccugcagcc

SEQ ID NO: 2371468 - RNA, 19 nt, Human
ugccugcagaggucugugc

SEQ ID NO: 2371469 - RNA, 20 nt, Human
ugccugcagaggucugugcu

SEQ ID NO: 2371470 - RNA, 18 nt, Human
ugccugcagagagaagcc

SEQ ID NO: 2371471 - RNA, 17 nt, Human
ugccucuuccuugaaga

SEQ ID NO: 2371472 - RNA, 21 nt, Human
ugccucuucucuacucuaggg

SEQ ID NO: 2371473 - RNA, 13 nt, Human
ugccucuuccucc

SEQ ID NO: 2371474 - RNA, 23 nt, Human
ugccucuucccccugcuuccacc

SEQ ID NO: 2371475 - RNA, 16 nt, Human
ugccucuguuugacaa

SEQ ID NO: 2371476 - RNA, 23 nt, Human
ugccucuguuugacaaaccucua

SEQ ID NO: 2371477 - RNA, 15 nt, Human
ugccucuuagacuuc

SEQ ID NO: 2371478 - RNA, 23 nt, Human
ugccucuuccagucuuccugaca

SEQ ID NO: 2371479 - RNA, 21 nt, Human
ugccucuuccagucuuccuga

SEQ ID NO: 2371480 - RNA, 22 nt, Human
ugccugcagccccgcgccuccu

SEQ ID NO: 2371481 - RNA, 15 nt, Human
ugccugcagccccgc

SEQ ID NO: 2371482 - RNA, 15 nt, Human
ugccugcauguauuu

SEQ ID NO: 2371483 - RNA, 13 nt, Human
ugccugcauucug

SEQ ID NO: 2371484 - RNA, 21 nt, Human
ugccugcagaggucugugcug

SEQ ID NO: 2371485 - RNA, 15 nt, Human
ugccugccagcugca

SEQ ID NO: 2371486 - RNA, 19 nt, Human
ugccugccagcugcacuga

SEQ ID NO: 2371487 - RNA, 16 nt, Human
ugccugcccacccgug

SEQ ID NO: 2371488 - RNA, 15 nt, Human
ugccugcccacccgu

SEQ ID NO: 2371489 - RNA, 12 nt, Human
ugccugggcugu

SEQ ID NO: 2371490 - RNA, 16 nt, Human
ugccugggcuguuggc

SEQ ID NO: 2371491 - RNA, 17 nt, Human
ugccugggcuguuggca

SEQ ID NO: 2371492 - RNA, 21 nt, Human
ugccuggguggacauggcccc

SEQ ID NO: 2371493 - RNA, 14 nt, Human
ugccugcccacccg

SEQ ID NO: 2371494 - RNA, 13 nt, Human
ugccugcccaccc

SEQ ID NO: 2371495 - RNA, 16 nt, Human
ugccugccagcugcac

SEQ ID NO: 2371496 - RNA, 24 nt, Human
ugccuggguggggcugcuccucca

SEQ ID NO: 2371497 - RNA, 23 nt, Human
ugccuggguggggcugcuccucc

SEQ ID NO: 2371498 - RNA, 22 nt, Human
ugccuggguggggcugcuccuc

SEQ ID NO: 2371499 - RNA, 21 nt, Human
ugccuggguggggcugcuccu

SEQ ID NO: 2371500 - RNA, 19 nt, Human
ugccuggguggggcugcuc

SEQ ID NO: 2371501 - RNA, 17 nt, Human
ugccuggguggggcugc

SEQ ID NO: 2371502 - RNA, 16 nt, Human
ugccuggguggggcug

SEQ ID NO: 2371503 - RNA, 22 nt, Human
ugccuggguuuaaggggagagg

SEQ ID NO: 2371504 - RNA, 23 nt, Human
ugccugguauauccaaaagcuuu

SEQ ID NO: 2371505 - RNA, 20 nt, Human
ugccugguauauccaaaagc

SEQ ID NO: 2371506 - RNA, 17 nt, Human
ugccugguggcagcugc

SEQ ID NO: 2371507 - RNA, 18 nt, Human
ugccugguggcagcugcg

SEQ ID NO: 2371508 - RNA, 22 nt, Human
ugccuguaguuaggaaauaaaa

SEQ ID NO: 2371509 - RNA, 21 nt, Human
ugccuguaguuaggaaauaaa

SEQ ID NO: 2371510 - RNA, 20 nt, Human
ugccuguaguuaggaaauaa

SEQ ID NO: 2371511 - RNA, 19 nt, Human
ugccuguaguuaggaaaua

SEQ ID NO: 2371512 - RNA, 18 nt, Human
ugccuguaguuaggaaau

SEQ ID NO: 2371513 - RNA, 17 nt, Human
ugccuguaguuaggaaa

SEQ ID NO: 2371514 - RNA, 16 nt, Human
ugccuguaguuaggaa

SEQ ID NO: 2371515 - RNA, 13 nt, Human
ugccuguaaacau

SEQ ID NO: 2371516 - RNA, 15 nt, Human
ugccuguaguuagga

SEQ ID NO: 2371517 - RNA, 19 nt, Human
ugccugguggcagcugcgg

SEQ ID NO: 2371518 - RNA, 17 nt, Human
ugccugguccucacacu

SEQ ID NO: 2371519 - RNA, 16 nt, Human
ugccuggucacagggc

SEQ ID NO: 2371520 - RNA, 17 nt, Human
ugccuggucacagggca

SEQ ID NO: 2371521 - RNA, 22 nt, Human
ugccuggucacagggcaugccc

SEQ ID NO: 2371522 - RNA, 14 nt, Human
ugccugguuuugau

SEQ ID NO: 2371523 - RNA, 19 nt, Human
ugcccgucuucagccuagc

SEQ ID NO: 2371524 - RNA, 23 nt, Human
ugcccgucucucucccauggagc

SEQ ID NO: 2371525 - RNA, 18 nt, Human
ugcccgucuucagccuag

SEQ ID NO: 2371526 - RNA, 17 nt, Human
ugcccgucuucagccua

SEQ ID NO: 2371527 - RNA, 16 nt, Human
ugcccgucuucagccu

SEQ ID NO: 2371528 - RNA, 13 nt, Human
ugcccgucuucag

SEQ ID NO: 2371529 - RNA, 18 nt, Human
ugcccgucucucucccau

SEQ ID NO: 2371530 - RNA, 19 nt, Human
ugcccgucucucucccaug

SEQ ID NO: 2371531 - RNA, 20 nt, Human
ugcccgucucucucccaugg

SEQ ID NO: 2371532 - RNA, 21 nt, Human
ugcccgucucucucccaugga

SEQ ID NO: 2371533 - RNA, 23 nt, Human
ugcccggggcagcugccagagaa

SEQ ID NO: 2371534 - RNA, 20 nt, Human
ugcccguaaacacgccugca

SEQ ID NO: 2371535 - RNA, 20 nt, Human
ugcccggggcagcugccaga

SEQ ID NO: 2371536 - RNA, 17 nt, Human
ugcccgucucucuccca

SEQ ID NO: 2371537 - RNA, 23 nt, Human
ugcccguaaacacgccugcaaac

SEQ ID NO: 2371538 - RNA, 18 nt, Human
ugcccggggcagcugcca

SEQ ID NO: 2371539 - RNA, 22 nt, Human
ugcccgggcgcggccagccccg

SEQ ID NO: 2371540 - RNA, 19 nt, Human
ugcccgggcgcggccagcc

SEQ ID NO: 2371541 - RNA, 20 nt, Human
ugcccgggcgcggccagccc

SEQ ID NO: 2371542 - RNA, 21 nt, Human
ugcccggggaaaggcaagguc

SEQ ID NO: 2371543 - RNA, 18 nt, Human
ugcccggggaaaggcaag

SEQ ID NO: 2371544 - RNA, 21 nt, Human
ugcccagaauaaguuauugca

SEQ ID NO: 2371545 - RNA, 17 nt, Human
ugcccagaauaaguuau

SEQ ID NO: 2371546 - RNA, 19 nt, Human
ugcccagaauaaguuauug

SEQ ID NO: 2371547 - RNA, 18 nt, Human
ugcccagaaugaggcugc

SEQ ID NO: 2371548 - RNA, 17 nt, Human
ugcccagaaugaggcug

SEQ ID NO: 2371549 - RNA, 16 nt, Human
ugcccugcccuagcuc

SEQ ID NO: 2371550 - RNA, 14 nt, Human
ugcccugccugagg

SEQ ID NO: 2371551 - RNA, 12 nt, Human
ugcccugccuga

SEQ ID NO: 2371552 - RNA, 11 nt, Human
ugcccugcccc

SEQ ID NO: 2371553 - RNA, 16 nt, Human
ugcccugcccccacga

SEQ ID NO: 2371554 - RNA, 21 nt, Human
ugcccugcccaccuggccucu

SEQ ID NO: 2371555 - RNA, 23 nt, Human
ugcccugcugagucccaggcuga

SEQ ID NO: 2371556 - RNA, 22 nt, Human
ugcccugcugagucccaggcug

SEQ ID NO: 2371557 - RNA, 18 nt, Human
ugcccugcugagucccag

SEQ ID NO: 2371558 - RNA, 19 nt, Human
ugcccugcgggucacagga

SEQ ID NO: 2371559 - RNA, 19 nt, Human
ugcccuaaaguguauuuuu

SEQ ID NO: 2371560 - RNA, 17 nt, Human
ugcccuaaaguguauuu

SEQ ID NO: 2371561 - RNA, 22 nt, Human
ugcccugcccaccuggccucug

SEQ ID NO: 2371562 - RNA, 23 nt, Human
ugcccugcccaccuggccucugc

SEQ ID NO: 2371563 - RNA, 18 nt, Human
ugccggguuuuauauuuu

SEQ ID NO: 2371564 - RNA, 20 nt, Human
ugccgguaaacacgccugca

SEQ ID NO: 2371565 - RNA, 14 nt, Human
ugccggguuuuaua

SEQ ID NO: 2371566 - RNA, 22 nt, Human
ugcccugguuucacuggcccaa

SEQ ID NO: 2371567 - RNA, 15 nt, Human
ugcccugguuuccug

SEQ ID NO: 2371568 - RNA, 15 nt, Human
ugccgucuaccugag

SEQ ID NO: 2371569 - RNA, 16 nt, Human
ugccgucuaccugagg

SEQ ID NO: 2371570 - RNA, 16 nt, Human
ugccggugagaauaag

SEQ ID NO: 2371571 - RNA, 20 nt, Human
ugccguggauugcacguggc

SEQ ID NO: 2371572 - RNA, 22 nt, Human
ugccguggauugcacguggccu

SEQ ID NO: 2371573 - RNA, 23 nt, Human
ugccguggggccgccgccucuuu

SEQ ID NO: 2371574 - RNA, 17 nt, Human
ugccgucuaccugaggg

SEQ ID NO: 2371575 - RNA, 19 nt, Human
ugccgucuaccugaggggc

SEQ ID NO: 2371576 - RNA, 20 nt, Human
ugcccuggugcugccacacu

SEQ ID NO: 2371577 - RNA, 18 nt, Human
ugcccuggugcugccaca

SEQ ID NO: 2371578 - RNA, 16 nt, Human
ugcccuggagguggcu

SEQ ID NO: 2371579 - RNA, 12 nt, Human
ugcccuggcccu

SEQ ID NO: 2371580 - RNA, 13 nt, Human
ugcccuggcccug

SEQ ID NO: 2371581 - RNA, 14 nt, Human
ugcccuggcccuga

SEQ ID NO: 2371582 - RNA, 17 nt, Human
ugcccugguuucacugg

SEQ ID NO: 2371583 - RNA, 15 nt, Human
ugcccugguuucacu

SEQ ID NO: 2371584 - RNA, 22 nt, Human
ugcccugguggagaaagcacug

SEQ ID NO: 2371585 - RNA, 23 nt, Human
ugcccugguggagaaagcacuga

SEQ ID NO: 2371586 - RNA, 21 nt, Human
ugcccuggugcugccacacuu

SEQ ID NO: 2371587 - RNA, 16 nt, Human
ugcccuggcccugagg

SEQ ID NO: 2371588 - RNA, 13 nt, Human
ugcccugguggag

SEQ ID NO: 2371589 - RNA, 14 nt, Human
ugcccugguggaga

SEQ ID NO: 2371590 - RNA, 15 nt, Human
ugcccugguggagaa

SEQ ID NO: 2371591 - RNA, 18 nt, Human
ugcccuggauccaucagg

SEQ ID NO: 2371592 - RNA, 11 nt, Human
ugcccugcugc

SEQ ID NO: 2371593 - RNA, 17 nt, Human
ugcccugccugagggcc

SEQ ID NO: 2371594 - RNA, 19 nt, Human
ugcccugcggccccgucug

SEQ ID NO: 2371595 - RNA, 21 nt, Human
ugcccugcugccgccucccag

SEQ ID NO: 2371596 - RNA, 23 nt, Human
ugcccugcugccgccucccagcc

SEQ ID NO: 2371597 - RNA, 19 nt, Human
ugcauguuuuccagcuccu

SEQ ID NO: 2371598 - RNA, 18 nt, Human
ugcauguuccacuaaccc

SEQ ID NO: 2371599 - RNA, 16 nt, Human
ugcauguuccacuaac

SEQ ID NO: 2371600 - RNA, 17 nt, Human
ugcauguuccacuaacc

SEQ ID NO: 2371601 - RNA, 15 nt, Human
ugcauguuugugauu

SEQ ID NO: 2371602 - RNA, 22 nt, Human
ugcauguuaggaaaauuucaca

SEQ ID NO: 2371603 - RNA, 16 nt, Human
ugcauguaugucuugg

SEQ ID NO: 2371604 - RNA, 14 nt, Human
ugcauguuccacua

SEQ ID NO: 2371605 - RNA, 13 nt, Human
ugcauguaugucu

SEQ ID NO: 2371606 - RNA, 14 nt, Human
ugcauguaugucuu

SEQ ID NO: 2371607 - RNA, 15 nt, Human
ugcauguaugucuug

SEQ ID NO: 2371608 - RNA, 20 nt, Human
ugcauguaaacacgccugca

SEQ ID NO: 2371609 - RNA, 15 nt, Human
ugcauccuccgccuc

SEQ ID NO: 2371610 - RNA, 15 nt, Human
ugcauccuccaagaa

SEQ ID NO: 2371611 - RNA, 22 nt, Human
ugcauccuccaagaaucuaucu

SEQ ID NO: 2371612 - RNA, 17 nt, Human
ugcaugguuuagaaagc

SEQ ID NO: 2371613 - RNA, 15 nt, Human
ugcaucccccccacc

SEQ ID NO: 2371614 - RNA, 17 nt, Human
ugcaucccccccaccuc

SEQ ID NO: 2371615 - RNA, 19 nt, Human
ugcauccgggggcagcucu

SEQ ID NO: 2371616 - RNA, 16 nt, Human
ugcauccccuuggcug

SEQ ID NO: 2371617 - RNA, 14 nt, Human
ugcauccuccaaga

SEQ ID NO: 2371618 - RNA, 20 nt, Human
ugcauccguaguucccugaa

SEQ ID NO: 2371619 - RNA, 19 nt, Human
ugcauccguaguucccuga

SEQ ID NO: 2371620 - RNA, 14 nt, Human
ugcauccuccgccu

SEQ ID NO: 2371621 - RNA, 13 nt, Human
ugcagauucauuu

SEQ ID NO: 2371622 - RNA, 22 nt, Human
ugcagauggggcucccgcccgu

SEQ ID NO: 2371623 - RNA, 16 nt, Human
ugcagauuugggcugg

SEQ ID NO: 2371624 - RNA, 17 nt, Human
ugcagauuugggcugga

SEQ ID NO: 2371625 - RNA, 20 nt, Human
ugcauccauuccucagggac

SEQ ID NO: 2371626 - RNA, 19 nt, Human
ugcauccauuccucaggga

SEQ ID NO: 2371627 - RNA, 21 nt, Human
ugcauccauuccucagggaca

SEQ ID NO: 2371628 - RNA, 14 nt, Human
ugcagaugacaaaa

SEQ ID NO: 2371629 - RNA, 15 nt, Human
ugcagaugacaaaaa

SEQ ID NO: 2371630 - RNA, 18 nt, Human
ugcagauggggcucccgc

SEQ ID NO: 2371631 - RNA, 21 nt, Human
ugcagaggucugugcugaggc

SEQ ID NO: 2371632 - RNA, 18 nt, Human
ugcagaggucugugcuga

SEQ ID NO: 2371633 - RNA, 19 nt, Human
ugcagaggucugugcugag

SEQ ID NO: 2371634 - RNA, 22 nt, Human
ugcagaggucugugcugaggcc

SEQ ID NO: 2371635 - RNA, 19 nt, Human
ugcagauaaacaguaguga

SEQ ID NO: 2371636 - RNA, 21 nt, Human
ugccacaucuugaucugcuca

SEQ ID NO: 2371637 - RNA, 23 nt, Human
ugccacaggccucccuguuugaa

SEQ ID NO: 2371638 - RNA, 22 nt, Human
ugccacauuuauuuuuauaucu

SEQ ID NO: 2371639 - RNA, 18 nt, Human
ugccaccaaaggccaggg

SEQ ID NO: 2371640 - RNA, 15 nt, Human
ugccaccacgcccgg

SEQ ID NO: 2371641 - RNA, 23 nt, Human
ugcauuuuggagaguuuccugaa

SEQ ID NO: 2371642 - RNA, 18 nt, Human
ugcauuuuguuugguauu

SEQ ID NO: 2371643 - RNA, 22 nt, Human
ugcauuuuguuugguauuguau

SEQ ID NO: 2371644 - RNA, 15 nt, Human
ugccacaggccuccc

SEQ ID NO: 2371645 - RNA, 22 nt, Human
ugcauuuugcuauuguaaauau

SEQ ID NO: 2371646 - RNA, 17 nt, Human
ugccacaggccucccug

SEQ ID NO: 2371647 - RNA, 18 nt, Human
ugccacaggccucccugu

SEQ ID NO: 2371648 - RNA, 22 nt, Human
ugccacaggccucccuguuuga

SEQ ID NO: 2371649 - RNA, 18 nt, Human
ugcauuuugcagcaguga

SEQ ID NO: 2371650 - RNA, 17 nt, Human
ugcauuuucaccccacc

SEQ ID NO: 2371651 - RNA, 17 nt, Human
ugcauuuuaauuuuaac

SEQ ID NO: 2371652 - RNA, 19 nt, Human
ugcauuuuaauuuuaacca

SEQ ID NO: 2371653 - RNA, 21 nt, Human
ugcauuuuaauuuuaaccaaa

SEQ ID NO: 2371654 - RNA, 13 nt, Human
ugcauuuugcuau

SEQ ID NO: 2371655 - RNA, 15 nt, Human
ugcauuuugcuauug

SEQ ID NO: 2371656 - RNA, 16 nt, Human
ugcauuuugcuauugu

SEQ ID NO: 2371657 - RNA, 17 nt, Human
ugcauuuugcuauugua

SEQ ID NO: 2371658 - RNA, 18 nt, Human
ugcauuuugcuauuguaa

SEQ ID NO: 2371659 - RNA, 19 nt, Human
ugcauuuugcuauuguaaa

SEQ ID NO: 2371660 - RNA, 20 nt, Human
ugcauuuugcuauuguaaau

SEQ ID NO: 2371661 - RNA, 21 nt, Human
ugcauuuuaaaaaugaaauuu

SEQ ID NO: 2371662 - RNA, 16 nt, Human
ugcauuuuaaaaauga

SEQ ID NO: 2371663 - RNA, 19 nt, Human
ugcauuugucuauucucca

SEQ ID NO: 2371664 - RNA, 20 nt, Human
ugcauuugucuauucuccag

SEQ ID NO: 2371665 - RNA, 23 nt, Human
ugcauuagaaauuagcuguguga

SEQ ID NO: 2371666 - RNA, 14 nt, Human
ugcauuagaaauua

SEQ ID NO: 2371667 - RNA, 13 nt, Human
ugcauuagaaauu

SEQ ID NO: 2371668 - RNA, 22 nt, Human
ugcauuagaaauagacaguaua

SEQ ID NO: 2371669 - RNA, 21 nt, Human
ugcauuagagcccauuucaau

SEQ ID NO: 2371670 - RNA, 20 nt, Human
ugcauuagaaauagacagua

SEQ ID NO: 2371671 - RNA, 19 nt, Human
ugcauuagaaauagacagu

SEQ ID NO: 2371672 - RNA, 18 nt, Human
ugcauuacugcaugcacu

SEQ ID NO: 2371673 - RNA, 17 nt, Human
ugcauuacugcaugcac

SEQ ID NO: 2371674 - RNA, 15 nt, Human
ugcauuacugcaugc

SEQ ID NO: 2371675 - RNA, 19 nt, Human
ugcauuaccgcguuguaaa

SEQ ID NO: 2371676 - RNA, 23 nt, Human
ugcauuacagagaggagaaacac

SEQ ID NO: 2371677 - RNA, 22 nt, Human
ugcauuaccgcguuguaaaaua

SEQ ID NO: 2371678 - RNA, 23 nt, Human
ugcauuaccgcguuguaaaauau

SEQ ID NO: 2371679 - RNA, 19 nt, Human
ugcauuaaaagaaaauaaa

SEQ ID NO: 2371680 - RNA, 22 nt, Human
ugcauuacagagaggagaaaca

SEQ ID NO: 2371681 - RNA, 17 nt, Human
ugcauuaaaagaaaaua

SEQ ID NO: 2371682 - RNA, 16 nt, Human
ugcauuaaaagaaaau

SEQ ID NO: 2371683 - RNA, 15 nt, Human
ugcauuaaaagaaaa

SEQ ID NO: 2371684 - RNA, 14 nt, Human
ugcauuaaaagaaa

SEQ ID NO: 2371685 - RNA, 21 nt, Human
ugcauguuuuccagcuccuca

SEQ ID NO: 2371686 - RNA, 21 nt, Human
ugcauuauauuuguaaauuua

SEQ ID NO: 2371687 - RNA, 17 nt, Human
ugcauuaucuagauacu

SEQ ID NO: 2371688 - RNA, 12 nt, Human
ugcauuaucuag

SEQ ID NO: 2371689 - RNA, 14 nt, Human
ugcauuauauuuau

SEQ ID NO: 2371690 - RNA, 15 nt, Human
ugccaucuucccagc

SEQ ID NO: 2371691 - RNA, 16 nt, Human
ugccaucuucccagca

SEQ ID NO: 2371692 - RNA, 20 nt, Human
ugccaugaggaacaaggcaa

SEQ ID NO: 2371693 - RNA, 23 nt, Human
ugccaugaggaacaaggcaaggc

SEQ ID NO: 2371694 - RNA, 14 nt, Human
ugccaugugccagg

SEQ ID NO: 2371695 - RNA, 20 nt, Human
ugccauguaggguucccuua

SEQ ID NO: 2371696 - RNA, 15 nt, Human
ugccaugugccaggu

SEQ ID NO: 2371697 - RNA, 16 nt, Human
ugccaugugaagaggg

SEQ ID NO: 2371698 - RNA, 15 nt, Human
ugccaugugaagagg

SEQ ID NO: 2371699 - RNA, 17 nt, Human
ugccaugugugcugaac

SEQ ID NO: 2371700 - RNA, 21 nt, Human
ugcccagaacuggacucagga

SEQ ID NO: 2371701 - RNA, 17 nt, Human
ugcccacugucucuccu

SEQ ID NO: 2371702 - RNA, 13 nt, Human
ugcccacucccug

SEQ ID NO: 2371703 - RNA, 11 nt, Human
ugcccaccugu

SEQ ID NO: 2371704 - RNA, 19 nt, Human
ugcccacggagucgugggg

SEQ ID NO: 2371705 - RNA, 19 nt, Human
ugcccaccuggccucugca

SEQ ID NO: 2371706 - RNA, 18 nt, Human
ugcccacgcuggagugca

SEQ ID NO: 2371707 - RNA, 12 nt, Human
ugccauguuggc

SEQ ID NO: 2371708 - RNA, 15 nt, Human
ugccauguuggccag

SEQ ID NO: 2371709 - RNA, 16 nt, Human
ugccauguuggccagg

SEQ ID NO: 2371710 - RNA, 20 nt, Human
ugcccaccuggccucugcac

SEQ ID NO: 2371711 - RNA, 19 nt, Human
ugccacugcccgagcuggu

SEQ ID NO: 2371712 - RNA, 18 nt, Human
ugccacugcccgagcugg

SEQ ID NO: 2371713 - RNA, 15 nt, Human
ugccagggcagggcc

SEQ ID NO: 2371714 - RNA, 16 nt, Human
ugccagggcagggccc

SEQ ID NO: 2371715 - RNA, 20 nt, Human
ugccaggguuucgagaagcu

SEQ ID NO: 2371716 - RNA, 23 nt, Human
ugccaggguuucgagaagcugcu

SEQ ID NO: 2371717 - RNA, 17 nt, Human
ugccagguuuuuggucu

SEQ ID NO: 2371718 - RNA, 16 nt, Human
ugccagguccuugccc

SEQ ID NO: 2371719 - RNA, 20 nt, Human
ugccagguccuugcccuuug

SEQ ID NO: 2371720 - RNA, 19 nt, Human
ugccagguucuauuuggaa

SEQ ID NO: 2371721 - RNA, 15 nt, Human
ugccauccagguuca

SEQ ID NO: 2371722 - RNA, 14 nt, Human
ugccaucuucccag

SEQ ID NO: 2371723 - RNA, 12 nt, Human
ugccauccaggu

SEQ ID NO: 2371724 - RNA, 22 nt, Human
ugccaucauguuuacagaggac

SEQ ID NO: 2371725 - RNA, 20 nt, Human
ugccagguucuauuuggaau

SEQ ID NO: 2371726 - RNA, 14 nt, Human
ugccagguuuucug

SEQ ID NO: 2371727 - RNA, 18 nt, Human
ugccagguuuucugggug

SEQ ID NO: 2371728 - RNA, 19 nt, Human
ugccagguuuucugggugu

SEQ ID NO: 2371729 - RNA, 17 nt, Human
ugccacugcccgagcug

SEQ ID NO: 2371730 - RNA, 23 nt, Human
ugccacucacacagccaggugcc

SEQ ID NO: 2371731 - RNA, 17 nt, Human
ugccacucauuccugua

SEQ ID NO: 2371732 - RNA, 18 nt, Human
ugccacucauuccuguag

SEQ ID NO: 2371733 - RNA, 19 nt, Human
ugccacucacuaggccccc

SEQ ID NO: 2371734 - RNA, 20 nt, Human
ugccacucacuaggccccca

SEQ ID NO: 2371735 - RNA, 21 nt, Human
ugccacucacuaggcccccac

SEQ ID NO: 2371736 - RNA, 22 nt, Human
ugccacucacuaggcccccacu

SEQ ID NO: 2371737 - RNA, 13 nt, Human
ugccaccagagac

SEQ ID NO: 2371738 - RNA, 13 nt, Human
ugccacucacuag

SEQ ID NO: 2371739 - RNA, 14 nt, Human
ugccaccagagacc

SEQ ID NO: 2371740 - RNA, 22 nt, Human
ugccacucacacagccaggugc

SEQ ID NO: 2371741 - RNA, 14 nt, Human
ugccacucacuagg

SEQ ID NO: 2371742 - RNA, 15 nt, Human
ugccacucacuaggc

SEQ ID NO: 2371743 - RNA, 17 nt, Human
ugccacucacuaggccc

SEQ ID NO: 2371744 - RNA, 18 nt, Human
ugccacucacuaggcccc

SEQ ID NO: 2371745 - RNA, 12 nt, Human
ugccaggaagcc

SEQ ID NO: 2371746 - RNA, 16 nt, Human
ugccaggaagccagca

SEQ ID NO: 2371747 - RNA, 18 nt, Human
ugccaggaagccagcagg

SEQ ID NO: 2371748 - RNA, 19 nt, Human
ugccaggaagccagcaggc

SEQ ID NO: 2371749 - RNA, 16 nt, Human
ugcaacccaaggacug

SEQ ID NO: 2371750 - RNA, 20 nt, Human
ugcaacccaaggacugaggg

SEQ ID NO: 2371751 - RNA, 17 nt, Human
ugcaacccuuaccccuu

SEQ ID NO: 2371752 - RNA, 15 nt, Human
ugcaacccuuacccc

SEQ ID NO: 2371753 - RNA, 16 nt, Human
ugcaaccgucuguuau

SEQ ID NO: 2371754 - RNA, 13 nt, Human
ugcaaccuccgcc

SEQ ID NO: 2371755 - RNA, 14 nt, Human
ugcaaccuccgccu

SEQ ID NO: 2371756 - RNA, 19 nt, Human
ugcaacaggcugggcuuca

SEQ ID NO: 2371757 - RNA, 20 nt, Human
ugcaacaggcugggcuucag

SEQ ID NO: 2371758 - RNA, 14 nt, Human
ugcaacaguagcau

SEQ ID NO: 2371759 - RNA, 13 nt, Human
ugcaacaguagca

SEQ ID NO: 2371760 - RNA, 14 nt, Human
ugcaacaggcuugu

SEQ ID NO: 2371761 - RNA, 24 nt, Human
ugcaacaggguauggacuaucugu

SEQ ID NO: 2371762 - RNA, 11 nt, Human
ugcaaccacug

SEQ ID NO: 2371763 - RNA, 17 nt, Human
ugcaaccaacuacaacc

SEQ ID NO: 2371764 - RNA, 13 nt, Human
ugcaaccacugca

SEQ ID NO: 2371765 - RNA, 15 nt, Human
ugcaaccacugcaac

SEQ ID NO: 2371766 - RNA, 14 nt, Human
ugcaacaggcuggg

SEQ ID NO: 2371767 - RNA, 15 nt, Human
ugcaacaggcugggc

SEQ ID NO: 2371768 - RNA, 16 nt, Human
ugcaacaggcugggcu

SEQ ID NO: 2371769 - RNA, 17 nt, Human
ugcaacaggcugggcuu

SEQ ID NO: 2371770 - RNA, 22 nt, Human
ugcaaaagguucacuaaagcag

SEQ ID NO: 2371771 - RNA, 22 nt, Human
ugcaaaaggacucucaggacca

SEQ ID NO: 2371772 - RNA, 23 nt, Human
ugcaaaagguucacuaaagcagu

SEQ ID NO: 2371773 - RNA, 20 nt, Human
ugcaaaaguucugacuugac

SEQ ID NO: 2371774 - RNA, 17 nt, Human
ugcaaaaugagacccuc

SEQ ID NO: 2371775 - RNA, 18 nt, Human
ugcaaaaugaggaaugua

SEQ ID NO: 2371776 - RNA, 21 nt, Human
ugcaaaaugaggaauguauau

SEQ ID NO: 2371777 - RNA, 20 nt, Human
ugcaaaagacuaauuuaaaa

SEQ ID NO: 2371778 - RNA, 21 nt, Human
ugcaaaauuuccaguaccuuu

SEQ ID NO: 2371779 - RNA, 21 nt, Human
ugcaaaauuugaugccaggac

SEQ ID NO: 2371780 - RNA, 22 nt, Human
ugcaaaauuugaugccaggaca

SEQ ID NO: 2371781 - RNA, 16 nt, Human
ugcaaaauuuccagua

SEQ ID NO: 2371782 - RNA, 15 nt, Human
ugcaaaauuuccagu

SEQ ID NO: 2371783 - RNA, 14 nt, Human
ugcaaaauuuccag

SEQ ID NO: 2371784 - RNA, 23 nt, Human
ugcaaacacacaaagguauaauu

SEQ ID NO: 2371785 - RNA, 22 nt, Human
ugcaaacaugggguuggcuggg

SEQ ID NO: 2371786 - RNA, 13 nt, Human
ugcaacuucugcc

SEQ ID NO: 2371787 - RNA, 14 nt, Human
ugcaacuucugccu

SEQ ID NO: 2371788 - RNA, 21 nt, Human
ugcaacuucuuuuuauuuucu

SEQ ID NO: 2371789 - RNA, 17 nt, Human
ugcaacuucuuuuuauu

SEQ ID NO: 2371790 - RNA, 16 nt, Human
ugcaacuuguaaaugu

SEQ ID NO: 2371791 - RNA, 18 nt, Human
ugcaacuuguaaaugugg

SEQ ID NO: 2371792 - RNA, 14 nt, Human
ugcaacuuggacuu

SEQ ID NO: 2371793 - RNA, 19 nt, Human
ugcaacuuuaagcagcucu

SEQ ID NO: 2371794 - RNA, 20 nt, Human
ugcaacuuuaagcagcucuu

SEQ ID NO: 2371795 - RNA, 23 nt, Human
ugcaacuuuaagcagcucuugcu

SEQ ID NO: 2371796 - RNA, 18 nt, Human
ugcaacuuuguauaaaag

SEQ ID NO: 2371797 - RNA, 14 nt, Human
ugcaaccuguugau

SEQ ID NO: 2371798 - RNA, 16 nt, Human
ugcaacggcuuagacu

SEQ ID NO: 2371799 - RNA, 16 nt, Human
ugcaacucaaggacuu

SEQ ID NO: 2371800 - RNA, 17 nt, Human
ugcaacucaaggacuuu

SEQ ID NO: 2371801 - RNA, 15 nt, Human
ugcaacuucauguca

SEQ ID NO: 2371802 - RNA, 22 nt, Human
ugcaacuucaugucaacuucug

SEQ ID NO: 2371803 - RNA, 21 nt, Human
ugcaaccuucgccaccugggu

SEQ ID NO: 2371804 - RNA, 18 nt, Human
ugcaaccuucgccaccug

SEQ ID NO: 2371805 - RNA, 22 nt, Human
ugcaaccugauugugucucuug

SEQ ID NO: 2371806 - RNA, 18 nt, Human
ugcaaccuccgccucuug

SEQ ID NO: 2371807 - RNA, 21 nt, Human
ugcaacccaaggacugaggga

SEQ ID NO: 2371808 - RNA, 20 nt, Human
ugcaaccuccgccucccggg

SEQ ID NO: 2371809 - RNA, 20 nt, Human
ugcaaccuccgccucuuggg

SEQ ID NO: 2371810 - RNA, 21 nt, Human
ugcaaccuccgccucuugggu

SEQ ID NO: 2371811 - RNA, 19 nt, Human
ugcaaccugauugugucuc

SEQ ID NO: 2371812 - RNA, 20 nt, Human
ugcaaccugauugugucucu

SEQ ID NO: 2371813 - RNA, 18 nt, Human
ugcaaccucuuggccuga

SEQ ID NO: 2371814 - RNA, 22 nt, Human
ugcaaccucgcuggacucucag

SEQ ID NO: 2371815 - RNA, 20 nt, Human
ugcaaccucgcuggacucuc

SEQ ID NO: 2371816 - RNA, 19 nt, Human
ugcaaccucgcuggacucu

SEQ ID NO: 2371817 - RNA, 14 nt, Human
ugcaaccucgcugg

SEQ ID NO: 2371818 - RNA, 21 nt, Human
ugcaaccuccgccucccgggu

SEQ ID NO: 2371819 - RNA, 21 nt, Human
ugauuuuuaccguuucuuccc

SEQ ID NO: 2371820 - RNA, 13 nt, Human
ugauuuugcaaau

SEQ ID NO: 2371821 - RNA, 22 nt, Human
ugauuuuuaccguuucuucccu

SEQ ID NO: 2371822 - RNA, 17 nt, Human
ugauuuugcuguagaag

SEQ ID NO: 2371823 - RNA, 19 nt, Human
ugauuuugcuguagaagau

SEQ ID NO: 2371824 - RNA, 14 nt, Human
ugauuuugcuguag

SEQ ID NO: 2371825 - RNA, 16 nt, Human
ugauuuugcuguagaa

SEQ ID NO: 2371826 - RNA, 15 nt, Human
ugauuuugaaaucau

SEQ ID NO: 2371827 - RNA, 13 nt, Human
ugauuuucuguug

SEQ ID NO: 2371828 - RNA, 15 nt, Human
ugauuuugaaaccau

SEQ ID NO: 2371829 - RNA, 12 nt, Human
ugauuuucuguu

SEQ ID NO: 2371830 - RNA, 13 nt, Human
ugauuuucauugc

SEQ ID NO: 2371831 - RNA, 15 nt, Human
ugauuuuaucuguga

SEQ ID NO: 2371832 - RNA, 16 nt, Human
ugauuuuaucugugaa

SEQ ID NO: 2371833 - RNA, 15 nt, Human
ugauuuucauugcug

SEQ ID NO: 2371834 - RNA, 20 nt, Human
ugauuuucaaagcuuuuucc

SEQ ID NO: 2371835 - RNA, 16 nt, Human
ugaugucccuauggaa

SEQ ID NO: 2371836 - RNA, 14 nt, Human
ugaugugaagccaa

SEQ ID NO: 2371837 - RNA, 22 nt, Human
ugaugugaagccaauucagaca

SEQ ID NO: 2371838 - RNA, 21 nt, Human
ugaugugccauuuuaaaaaaa

SEQ ID NO: 2371839 - RNA, 13 nt, Human
ugaugugccuggg

SEQ ID NO: 2371840 - RNA, 19 nt, Human
ugauuuuacaauugaaaug

SEQ ID NO: 2371841 - RNA, 15 nt, Human
ugauuuuagccuucu

SEQ ID NO: 2371842 - RNA, 18 nt, Human
ugauuuuagcugcagaac

SEQ ID NO: 2371843 - RNA, 19 nt, Human
ugauuuuagccuucucugu

SEQ ID NO: 2371844 - RNA, 17 nt, Human
ugauuuuaacucugucu

SEQ ID NO: 2371845 - RNA, 15 nt, Human
ugauuuuaacucugu

SEQ ID NO: 2371846 - RNA, 16 nt, Human
ugauuuuaauaauaua

SEQ ID NO: 2371847 - RNA, 17 nt, Human
ugauuuuaacaauaacu

SEQ ID NO: 2371848 - RNA, 16 nt, Human
ugauuuuaacaauaac

SEQ ID NO: 2371849 - RNA, 14 nt, Human
ugauuuuaacaaua

SEQ ID NO: 2371850 - RNA, 13 nt, Human
ugauuuuaacaau

SEQ ID NO: 2371851 - RNA, 19 nt, Human
ugauuuuaacaauaacuac

SEQ ID NO: 2371852 - RNA, 18 nt, Human
ugauuuuaacaauaacua

SEQ ID NO: 2371853 - RNA, 22 nt, Human
ugauuuuaacaauaacuacugu

SEQ ID NO: 2371854 - RNA, 14 nt, Human
ugauuuuaacucug

SEQ ID NO: 2371855 - RNA, 18 nt, Human
ugauguggaguggggcag

SEQ ID NO: 2371856 - RNA, 17 nt, Human
ugauguggaguggggca

SEQ ID NO: 2371857 - RNA, 12 nt, Human
ugauuuuaacaa

SEQ ID NO: 2371858 - RNA, 13 nt, Human
ugauuuuuuucca

SEQ ID NO: 2371859 - RNA, 18 nt, Human
ugauuuuuguaagacaau

SEQ ID NO: 2371860 - RNA, 16 nt, Human
ugauuuuuuuuccuuu

SEQ ID NO: 2371861 - RNA, 13 nt, Human
ugauuuuuugcau

SEQ ID NO: 2371862 - RNA, 22 nt, Human
ugauuuuugccucuuccagucu

SEQ ID NO: 2371863 - RNA, 20 nt, Human
ugauuuuuagaugagauugu

SEQ ID NO: 2371864 - RNA, 13 nt, Human
ugauuuuucugga

SEQ ID NO: 2371865 - RNA, 19 nt, Human
ugauuuuucuggagguuga

SEQ ID NO: 2371866 - RNA, 21 nt, Human
ugauuuuugccucuuccaguc

SEQ ID NO: 2371867 - RNA, 16 nt, Human
ugauuuuuuuuuccuu

SEQ ID NO: 2371868 - RNA, 17 nt, Human
ugauuuuuuuuuccuuc

SEQ ID NO: 2371869 - RNA, 19 nt, Human
ugauuuuuuuuuccuucag

SEQ ID NO: 2371870 - RNA, 20 nt, Human
ugauuuuuuuuuccuucagu

SEQ ID NO: 2371871 - RNA, 23 nt, Human
ugcaaaacagcguuuaagacugu

SEQ ID NO: 2371872 - RNA, 19 nt, Human
ugcaaaaggacucucagga

SEQ ID NO: 2371873 - RNA, 23 nt, Human
ugcaaaagacuaauuuaaaaaau

SEQ ID NO: 2371874 - RNA, 19 nt, Human
ugcaaaacagcguuuaaga

SEQ ID NO: 2371875 - RNA, 23 nt, Human
ugcaaaaauauuuauaaaacuuc

SEQ ID NO: 2371876 - RNA, 22 nt, Human
ugcaaaaauauuuauaaaacuu

SEQ ID NO: 2371877 - RNA, 12 nt, Human
ugcaaaaaauag

SEQ ID NO: 2371878 - RNA, 18 nt, Human
ugcaaaaauauuuauaaa

SEQ ID NO: 2371879 - RNA, 14 nt, Human
ugcaaaaaggguca

SEQ ID NO: 2371880 - RNA, 16 nt, Human
ugauuuuuuuuuuuca

SEQ ID NO: 2371881 - RNA, 22 nt, Human
ugauuuuuuuuucauacacuua

SEQ ID NO: 2371882 - RNA, 18 nt, Human
ugauuuuuuuuucauaca

SEQ ID NO: 2371883 - RNA, 22 nt, Human
ugauuuuuuuuuccuucagugc

SEQ ID NO: 2371884 - RNA, 23 nt, Human
ugauuuuuuuuuccuucagugcc

SEQ ID NO: 2371885 - RNA, 20 nt, Human
ugcacagaguuguuacauuu

SEQ ID NO: 2371886 - RNA, 20 nt, Human
ugcacagggcagcugggccc

SEQ ID NO: 2371887 - RNA, 21 nt, Human
ugcacaaauauuuauuuucuu

SEQ ID NO: 2371888 - RNA, 14 nt, Human
ugcacaacauuaca

SEQ ID NO: 2371889 - RNA, 21 nt, Human
ugcacagagcucuccagcucc

SEQ ID NO: 2371890 - RNA, 19 nt, Human
ugcacagggcagcugggcc

SEQ ID NO: 2371891 - RNA, 15 nt, Human
ugcacagugcaucuc

SEQ ID NO: 2371892 - RNA, 13 nt, Human
ugcacagugauuu

SEQ ID NO: 2371893 - RNA, 16 nt, Human
ugcacagugcaucuca

SEQ ID NO: 2371894 - RNA, 17 nt, Human
ugcacagugcaucucag

SEQ ID NO: 2371895 - RNA, 18 nt, Human
ugcaccggcuggccuggc

SEQ ID NO: 2371896 - RNA, 19 nt, Human
ugcaccggcuggccuggcc

SEQ ID NO: 2371897 - RNA, 20 nt, Human
ugcaccggcuggccuggccc

SEQ ID NO: 2371898 - RNA, 15 nt, Human
ugcacgaccuuggga

SEQ ID NO: 2371899 - RNA, 14 nt, Human
ugcaccuugugucu

SEQ ID NO: 2371900 - RNA, 20 nt, Human
ugcaccuuaccaacuuucug

SEQ ID NO: 2371901 - RNA, 21 nt, Human
ugcaccuuaccaacuuucugu

SEQ ID NO: 2371902 - RNA, 15 nt, Human
ugcaccuugugucug

SEQ ID NO: 2371903 - RNA, 16 nt, Human
ugcaccuugugucugu

SEQ ID NO: 2371904 - RNA, 20 nt, Human
ugcaccuguacucaggaggc

SEQ ID NO: 2371905 - RNA, 12 nt, Human
ugcaccugugca

SEQ ID NO: 2371906 - RNA, 13 nt, Human
ugcaccuuaccaa

SEQ ID NO: 2371907 - RNA, 18 nt, Human
ugcaccuuaccaacuuuc

SEQ ID NO: 2371908 - RNA, 19 nt, Human
ugcaccuuaccaacuuucu

SEQ ID NO: 2371909 - RNA, 17 nt, Human
ugcaccuguacucagga

SEQ ID NO: 2371910 - RNA, 16 nt, Human
ugcaccuguacucagg

SEQ ID NO: 2371911 - RNA, 19 nt, Human
ugcacagugauuuuuuucu

SEQ ID NO: 2371912 - RNA, 22 nt, Human
ugcaccuggaauauauaaccag

SEQ ID NO: 2371913 - RNA, 20 nt, Human
ugcaccuggaauauauaacc

SEQ ID NO: 2371914 - RNA, 17 nt, Human
ugcaccuggaauauaua

SEQ ID NO: 2371915 - RNA, 21 nt, Human
ugcaccggcuggccuggcccc

SEQ ID NO: 2371916 - RNA, 21 nt, Human
ugcacucugugcccaugggca

SEQ ID NO: 2371917 - RNA, 15 nt, Human
ugcacucugugccca

SEQ ID NO: 2371918 - RNA, 16 nt, Human
ugcacucugugcccau

SEQ ID NO: 2371919 - RNA, 12 nt, Human
ugcacucugugc

SEQ ID NO: 2371920 - RNA, 13 nt, Human
ugcacucugugcc

SEQ ID NO: 2371921 - RNA, 18 nt, Human
ugcacugacauuguuggc

SEQ ID NO: 2371922 - RNA, 21 nt, Human
ugcacugacauuguuggccaa

SEQ ID NO: 2371923 - RNA, 15 nt, Human
ugcacugucacuuug

SEQ ID NO: 2371924 - RNA, 19 nt, Human
ugcacugucacuuugcucu

SEQ ID NO: 2371925 - RNA, 21 nt, Human
ugcacugucacuuugcucugg

SEQ ID NO: 2371926 - RNA, 16 nt, Human
ugcacugucaagauga

SEQ ID NO: 2371927 - RNA, 15 nt, Human
ugcacugugaaggac

SEQ ID NO: 2371928 - RNA, 23 nt, Human
ugcacuguccugcuccacagugu

SEQ ID NO: 2371929 - RNA, 19 nt, Human
ugcacugucgauaaucaga

SEQ ID NO: 2371930 - RNA, 18 nt, Human
ugcacuguccugcuccac

SEQ ID NO: 2371931 - RNA, 20 nt, Human
ugcacuguccugcuccacag

SEQ ID NO: 2371932 - RNA, 21 nt, Human
ugcacuguccugcuccacagu

SEQ ID NO: 2371933 - RNA, 22 nt, Human
ugcacuguccugcuccacagug

SEQ ID NO: 2371934 - RNA, 22 nt, Human
ugcacugucacuuugcucuggg

SEQ ID NO: 2371935 - RNA, 23 nt, Human
ugcacugucacuuugcucugggu

SEQ ID NO: 2371936 - RNA, 12 nt, Human
ugcacuguccug

SEQ ID NO: 2371937 - RNA, 13 nt, Human
ugcacuguccugc

SEQ ID NO: 2371938 - RNA, 14 nt, Human
ugcacuguccugcu

SEQ ID NO: 2371939 - RNA, 15 nt, Human
ugcacuguccugcuc

SEQ ID NO: 2371940 - RNA, 16 nt, Human
ugcacuguccugcucc

SEQ ID NO: 2371941 - RNA, 17 nt, Human
ugcacuguccugcucca

SEQ ID NO: 2371942 - RNA, 18 nt, Human
ugcacuuaacaagcuccc

SEQ ID NO: 2371943 - RNA, 23 nt, Human
ugcacuuaacaagcucccaggcc

SEQ ID NO: 2371944 - RNA, 16 nt, Human
ugcacuuaaggcacuc

SEQ ID NO: 2371945 - RNA, 15 nt, Human
ugcacuuacuugcuu

SEQ ID NO: 2371946 - RNA, 21 nt, Human
ugcacuuaaggcacucuguua

SEQ ID NO: 2371947 - RNA, 20 nt, Human
ugcacuuaugauuucaugug

SEQ ID NO: 2371948 - RNA, 19 nt, Human
ugcacuuaugauuucaugu

SEQ ID NO: 2371949 - RNA, 18 nt, Human
ugcacuuaugauuucaug

SEQ ID NO: 2371950 - RNA, 16 nt, Human
ugcacuuacuugcuua

SEQ ID NO: 2371951 - RNA, 18 nt, Human
ugcacuuacuugcuuauu

SEQ ID NO: 2371952 - RNA, 18 nt, Human
ugcacugugaaggacccu

SEQ ID NO: 2371953 - RNA, 13 nt, Human
ugcacuguucccc

SEQ ID NO: 2371954 - RNA, 19 nt, Human
ugcacuguucccccugugc

SEQ ID NO: 2371955 - RNA, 14 nt, Human
ugcacuguuccccc

SEQ ID NO: 2371956 - RNA, 23 nt, Human
ugcacuguucccccugugcagcc

SEQ ID NO: 2371957 - RNA, 21 nt, Human
ugcacuguucccccugugcag

SEQ ID NO: 2371958 - RNA, 20 nt, Human
ugcacuguucccccugugca

SEQ ID NO: 2371959 - RNA, 20 nt, Human
ugcagaggggcuuucuggag

SEQ ID NO: 2371960 - RNA, 21 nt, Human
ugcagaggggcaggcccugca

SEQ ID NO: 2371961 - RNA, 22 nt, Human
ugcagaggggcaggcccugcac

SEQ ID NO: 2371962 - RNA, 17 nt, Human
ugcagaggggcaggccc

SEQ ID NO: 2371963 - RNA, 18 nt, Human
ugcagaggggcaggcccu

SEQ ID NO: 2371964 - RNA, 20 nt, Human
ugcagaggggcaggcccugc

SEQ ID NO: 2371965 - RNA, 14 nt, Human
ugcacuucuuacaa

SEQ ID NO: 2371966 - RNA, 15 nt, Human
ugcagaggggcaggc

SEQ ID NO: 2371967 - RNA, 19 nt, Human
ugcagaggguacuuuaaga

SEQ ID NO: 2371968 - RNA, 20 nt, Human
ugcagagguaaaagugugag

SEQ ID NO: 2371969 - RNA, 22 nt, Human
ugcagaggggcuuucuggagag

SEQ ID NO: 2371970 - RNA, 21 nt, Human
ugcagaggggcuuucuggaga

SEQ ID NO: 2371971 - RNA, 19 nt, Human
ugcagagguccacaacaca

SEQ ID NO: 2371972 - RNA, 14 nt, Human
ugcagaggucugug

SEQ ID NO: 2371973 - RNA, 15 nt, Human
ugcagaggucugugc

SEQ ID NO: 2371974 - RNA, 16 nt, Human
ugcagaggucugugcu

SEQ ID NO: 2371975 - RNA, 17 nt, Human
ugcagaggucugugcug

SEQ ID NO: 2371976 - RNA, 16 nt, Human
ugcaaugacucaggac

SEQ ID NO: 2371977 - RNA, 17 nt, Human
ugcaaugacaucuucaa

SEQ ID NO: 2371978 - RNA, 16 nt, Human
ugcaaugacaucuuca

SEQ ID NO: 2371979 - RNA, 18 nt, Human
ugcaauggcuauauggca

SEQ ID NO: 2371980 - RNA, 20 nt, Human
ugcaauggcgugaucucggc

SEQ ID NO: 2371981 - RNA, 15 nt, Human
ugcaaugggcacugg

SEQ ID NO: 2371982 - RNA, 17 nt, Human
ugcaaugguuaacaucu

SEQ ID NO: 2371983 - RNA, 22 nt, Human
ugcaauguagaggggaaaagag

SEQ ID NO: 2371984 - RNA, 16 nt, Human
ugcaaugugcuacuga

SEQ ID NO: 2371985 - RNA, 19 nt, Human
ugcaaugucugagugaacc

SEQ ID NO: 2371986 - RNA, 22 nt, Human
ugcaaugucugagugaaccugu

SEQ ID NO: 2371987 - RNA, 15 nt, Human
ugcaauguuuuccuu

SEQ ID NO: 2371988 - RNA, 13 nt, Human
ugcaauggcagcc

SEQ ID NO: 2371989 - RNA, 14 nt, Human
ugcaauggcagccu

SEQ ID NO: 2371990 - RNA, 15 nt, Human
ugcaauggcagccuu

SEQ ID NO: 2371991 - RNA, 16 nt, Human
ugcaauggcagccuug

SEQ ID NO: 2371992 - RNA, 21 nt, Human
ugcaaugacacagucuuggcu

SEQ ID NO: 2371993 - RNA, 22 nt, Human
ugcaaugaagucucugaaguga

SEQ ID NO: 2371994 - RNA, 18 nt, Human
ugcaaugaagucucugaa

SEQ ID NO: 2371995 - RNA, 20 nt, Human
ugcaagaaaaugauguguac

SEQ ID NO: 2371996 - RNA, 17 nt, Human
ugcaagagacucuggcc

SEQ ID NO: 2371997 - RNA, 15 nt, Human
ugcaaugaagucucu

SEQ ID NO: 2371998 - RNA, 11 nt, Human
ugcaaugaaca

SEQ ID NO: 2371999 - RNA, 18 nt, Human
ugcaagagacucuggccu

SEQ ID NO: 2372000 - RNA, 13 nt, Human
ugcaaugaccuuu

SEQ ID NO: 2372001 - RNA, 16 nt, Human
ugcaaugaccuuucaa

SEQ ID NO: 2372002 - RNA, 17 nt, Human
ugcaaugaccuuucaau

SEQ ID NO: 2372003 - RNA, 19 nt, Human
ugcaaugaccuuucaauag

SEQ ID NO: 2372004 - RNA, 22 nt, Human
ugcaaugaccuuucaauaggaa

SEQ ID NO: 2372005 - RNA, 23 nt, Human
ugcaaugaccuuucaauaggaaa

SEQ ID NO: 2372006 - RNA, 15 nt, Human
ugcacaaagcccuuc

SEQ ID NO: 2372007 - RNA, 17 nt, Human
ugcacaaagcccuucca

SEQ ID NO: 2372008 - RNA, 17 nt, Human
ugcacagaguuguuaca

SEQ ID NO: 2372009 - RNA, 19 nt, Human
ugcacagaguuguuacauu

SEQ ID NO: 2372010 - RNA, 18 nt, Human
ugcacagaguuguuacau

SEQ ID NO: 2372011 - RNA, 20 nt, Human
ugcacaaacagaggccgcca

SEQ ID NO: 2372012 - RNA, 18 nt, Human
ugcacaaaacccagaccu

SEQ ID NO: 2372013 - RNA, 19 nt, Human
ugcacaaaacccagaccug

SEQ ID NO: 2372014 - RNA, 21 nt, Human
ugcacaaaauucgaccugauu

SEQ ID NO: 2372015 - RNA, 15 nt, Human
ugcacaaacucacca

SEQ ID NO: 2372016 - RNA, 17 nt, Human
ugcacaaacagaggccg

SEQ ID NO: 2372017 - RNA, 19 nt, Human
ugcacaaacagaggccgcc

SEQ ID NO: 2372018 - RNA, 22 nt, Human
ugcaauuguaggggugugugug

SEQ ID NO: 2372019 - RNA, 14 nt, Human
ugcaauuuauuaaa

SEQ ID NO: 2372020 - RNA, 15 nt, Human
ugcaauuuauuaaaa

SEQ ID NO: 2372021 - RNA, 21 nt, Human
ugcaauuguaggggugugugu

SEQ ID NO: 2372022 - RNA, 15 nt, Human
ugcaauugcuuagga

SEQ ID NO: 2372023 - RNA, 18 nt, Human
ugcaauuuauuaaaauga

SEQ ID NO: 2372024 - RNA, 22 nt, Human
ugcaauuuauuaaaaugauugu

SEQ ID NO: 2372025 - RNA, 15 nt, Human
ugcaauuaaagugau

SEQ ID NO: 2372026 - RNA, 16 nt, Human
ugcaauuaaagugaua

SEQ ID NO: 2372027 - RNA, 13 nt, Human
ugcaauuccccuc

SEQ ID NO: 2372028 - RNA, 14 nt, Human
ugcaauuccccucu

SEQ ID NO: 2372029 - RNA, 18 nt, Human
ugcaauuccccucugcug

SEQ ID NO: 2372030 - RNA, 20 nt, Human
ugcaauuuuaauugauuauu

SEQ ID NO: 2372031 - RNA, 20 nt, Human
ugcaauuuguuugugcuucu

SEQ ID NO: 2372032 - RNA, 21 nt, Human
ugcaauuuguuugugcuucua

SEQ ID NO: 2372033 - RNA, 19 nt, Human
ugcaauuugggagauauau

SEQ ID NO: 2372034 - RNA, 17 nt, Human
ugcaauuuguuugugcu

SEQ ID NO: 2372035 - RNA, 19 nt, Human
ugcaauuuguuugugcuuc

SEQ ID NO: 2372036 - RNA, 14 nt, Human
ugcaauuucauaug

SEQ ID NO: 2372037 - RNA, 20 nt, Human
ugcaauuucauaugcuguau

SEQ ID NO: 2372038 - RNA, 15 nt, Human
ugcacaaacagaggc

SEQ ID NO: 2372039 - RNA, 16 nt, Human
ugcacaaacagaggcc

SEQ ID NO: 2372040 - RNA, 20 nt, Human
ugagcuccagacccccagca

SEQ ID NO: 2372041 - RNA, 19 nt, Human
ugagcuccagacccccagc

SEQ ID NO: 2372042 - RNA, 18 nt, Human
ugagcuccagacccccag

SEQ ID NO: 2372043 - RNA, 21 nt, Human
ugagcuccagacccccagcaa

SEQ ID NO: 2372044 - RNA, 16 nt, Human
ugagcuccaugugccc

SEQ ID NO: 2372045 - RNA, 16 nt, Human
ugagcuccccaaaaac

SEQ ID NO: 2372046 - RNA, 15 nt, Human
ugagcuccccaaaaa

SEQ ID NO: 2372047 - RNA, 22 nt, Human
ugagcuccccaccaccccagcu

SEQ ID NO: 2372048 - RNA, 20 nt, Human
ugagcuccccaccaccccag

SEQ ID NO: 2372049 - RNA, 15 nt, Human
ugagcuccccaccac

SEQ ID NO: 2372050 - RNA, 21 nt, Human
ugagcuccccaaaaaccucac

SEQ ID NO: 2372051 - RNA, 15 nt, Human
ugagcuccucugggc

SEQ ID NO: 2372052 - RNA, 14 nt, Human
ugagcuccucuggg

SEQ ID NO: 2372053 - RNA, 13 nt, Human
ugagcuccucugg

SEQ ID NO: 2372054 - RNA, 23 nt, Human
ugagcuccccaccaccccagcug

SEQ ID NO: 2372055 - RNA, 18 nt, Human
ugagcuccucugggcagg

SEQ ID NO: 2372056 - RNA, 16 nt, Human
ugagcuccucugggca

SEQ ID NO: 2372057 - RNA, 21 nt, Human
ugagcucucggaacugcaugc

SEQ ID NO: 2372058 - RNA, 20 nt, Human
ugagcucucggaacugcaug

SEQ ID NO: 2372059 - RNA, 18 nt, Human
ugagcucuugugaggaaa

SEQ ID NO: 2372060 - RNA, 22 nt, Human
ugagcucuugugaggaaaguca

SEQ ID NO: 2372061 - RNA, 13 nt, Human
ugagcucuuguga

SEQ ID NO: 2372062 - RNA, 18 nt, Human
ugagcucuucauguuuca

SEQ ID NO: 2372063 - RNA, 16 nt, Human
ugagcucuucauguuu

SEQ ID NO: 2372064 - RNA, 15 nt, Human
ugagcucuucauguu

SEQ ID NO: 2372065 - RNA, 12 nt, Human
ugagcucuucau

SEQ ID NO: 2372066 - RNA, 22 nt, Human
ugagcucugcauuugucuauuc

SEQ ID NO: 2372067 - RNA, 23 nt, Human
ugagcucugcauuugucuauucu

SEQ ID NO: 2372068 - RNA, 12 nt, Human
ugagcucucugu

SEQ ID NO: 2372069 - RNA, 18 nt, Human
ugagcucugcagcccagg

SEQ ID NO: 2372070 - RNA, 21 nt, Human
ugagcucugcagcccagggac

SEQ ID NO: 2372071 - RNA, 17 nt, Human
ugagcccggaugcuucu

SEQ ID NO: 2372072 - RNA, 13 nt, Human
ugagccccuuccu

SEQ ID NO: 2372073 - RNA, 14 nt, Human
ugagccccuuccuu

SEQ ID NO: 2372074 - RNA, 13 nt, Human
ugagcccgggcug

SEQ ID NO: 2372075 - RNA, 14 nt, Human
ugagcccgggcugc

SEQ ID NO: 2372076 - RNA, 15 nt, Human
ugagcccgggcugcc

SEQ ID NO: 2372077 - RNA, 16 nt, Human
ugagcccgggcugccu

SEQ ID NO: 2372078 - RNA, 15 nt, Human
ugagccccugggacu

SEQ ID NO: 2372079 - RNA, 15 nt, Human
ugagccccugguccu

SEQ ID NO: 2372080 - RNA, 14 nt, Human
ugagccccugggac

SEQ ID NO: 2372081 - RNA, 13 nt, Human
ugagccccuggga

SEQ ID NO: 2372082 - RNA, 22 nt, Human
ugagccccugucuagagaggga

SEQ ID NO: 2372083 - RNA, 12 nt, Human
ugagccccuucc

SEQ ID NO: 2372084 - RNA, 21 nt, Human
ugagccccugucuagagaggg

SEQ ID NO: 2372085 - RNA, 17 nt, Human
ugagccccugucuagag

SEQ ID NO: 2372086 - RNA, 17 nt, Human
ugagcccucagaacccu

SEQ ID NO: 2372087 - RNA, 14 nt, Human
ugagcccucagaac

SEQ ID NO: 2372088 - RNA, 12 nt, Human
ugagcccucaga

SEQ ID NO: 2372089 - RNA, 16 nt, Human
ugagcccucaaaguga

SEQ ID NO: 2372090 - RNA, 17 nt, Human
ugagcccgggcugccug

SEQ ID NO: 2372091 - RNA, 18 nt, Human
ugagcccgggcugccugg

SEQ ID NO: 2372092 - RNA, 19 nt, Human
ugagcccgggcugccuggg

SEQ ID NO: 2372093 - RNA, 20 nt, Human
ugagcccgggcugccugggc

SEQ ID NO: 2372094 - RNA, 22 nt, Human
ugagcccgggcugccugggcug

SEQ ID NO: 2372095 - RNA, 21 nt, Human
ugagcccgggcugccugggcu

SEQ ID NO: 2372096 - RNA, 13 nt, Human
ugagccucagcau

SEQ ID NO: 2372097 - RNA, 15 nt, Human
ugagccucagcaucc

SEQ ID NO: 2372098 - RNA, 16 nt, Human
ugagccuacgcugaag

SEQ ID NO: 2372099 - RNA, 15 nt, Human
ugagccgggccccug

SEQ ID NO: 2372100 - RNA, 16 nt, Human
ugagccgggccccugg

SEQ ID NO: 2372101 - RNA, 17 nt, Human
ugagccgggccccuggg

SEQ ID NO: 2372102 - RNA, 20 nt, Human
ugagccgggccccugggcuu

SEQ ID NO: 2372103 - RNA, 19 nt, Human
ugagccgggccccugggcu

SEQ ID NO: 2372104 - RNA, 13 nt, Human
ugagcccaggagu

SEQ ID NO: 2372105 - RNA, 12 nt, Human
ugagcccaggag

SEQ ID NO: 2372106 - RNA, 21 nt, Human
ugagcccagcugggucaggca

SEQ ID NO: 2372107 - RNA, 17 nt, Human
ugagcccagcuggguca

SEQ ID NO: 2372108 - RNA, 17 nt, Human
ugagcccauggcccucc

SEQ ID NO: 2372109 - RNA, 13 nt, Human
ugagccccaaaag

SEQ ID NO: 2372110 - RNA, 14 nt, Human
ugagcaucaggcca

SEQ ID NO: 2372111 - RNA, 15 nt, Human
ugagcaucaggccag

SEQ ID NO: 2372112 - RNA, 16 nt, Human
ugagcccacaaagccu

SEQ ID NO: 2372113 - RNA, 16 nt, Human
ugagcaucacaguuuu

SEQ ID NO: 2372114 - RNA, 17 nt, Human
ugagcaucacaguuuug

SEQ ID NO: 2372115 - RNA, 17 nt, Human
ugagcccacaaagccuu

SEQ ID NO: 2372116 - RNA, 19 nt, Human
ugagcccacugcccacccc

SEQ ID NO: 2372117 - RNA, 20 nt, Human
ugagcccacugcccaccccc

SEQ ID NO: 2372118 - RNA, 21 nt, Human
ugagcccacugcccacccccu

SEQ ID NO: 2372119 - RNA, 22 nt, Human
ugagcccacugcccacccccuc

SEQ ID NO: 2372120 - RNA, 23 nt, Human
ugagcccacugcccacccccuca

SEQ ID NO: 2372121 - RNA, 20 nt, Human
ugagaugcuagaacucccuu

SEQ ID NO: 2372122 - RNA, 16 nt, Human
ugagaugcuagaacuc

SEQ ID NO: 2372123 - RNA, 14 nt, Human
ugagaugcuagaac

SEQ ID NO: 2372124 - RNA, 18 nt, Human
ugagaugauucagaaggg

SEQ ID NO: 2372125 - RNA, 19 nt, Human
ugagaugauucagaagggg

SEQ ID NO: 2372126 - RNA, 14 nt, Human
ugagaugcagcugg

SEQ ID NO: 2372127 - RNA, 15 nt, Human
ugagaugcagcugga

SEQ ID NO: 2372128 - RNA, 16 nt, Human
ugagaugcagcuggaa

SEQ ID NO: 2372129 - RNA, 18 nt, Human
ugagaugcagcuggaaaa

SEQ ID NO: 2372130 - RNA, 13 nt, Human
ugagcaucaggcc

SEQ ID NO: 2372131 - RNA, 20 nt, Human
ugagcagucaggaaagagaa

SEQ ID NO: 2372132 - RNA, 17 nt, Human
ugagcagucaggaaaga

SEQ ID NO: 2372133 - RNA, 15 nt, Human
ugagcagucaggaaa

SEQ ID NO: 2372134 - RNA, 18 nt, Human
ugagauccuuccuuuuga

SEQ ID NO: 2372135 - RNA, 23 nt, Human
ugagaguauuuaggcagauugaa

SEQ ID NO: 2372136 - RNA, 13 nt, Human
ugagaucaggcuc

SEQ ID NO: 2372137 - RNA, 17 nt, Human
ugagaguaucaggucuc

SEQ ID NO: 2372138 - RNA, 19 nt, Human
ugagaguaucaggucuccc

SEQ ID NO: 2372139 - RNA, 22 nt, Human
ugagagguuugacuagaugaug

SEQ ID NO: 2372140 - RNA, 18 nt, Human
ugagaguaacuuaaguua

SEQ ID NO: 2372141 - RNA, 19 nt, Human
ugagaguauauuauguauu

SEQ ID NO: 2372142 - RNA, 22 nt, Human
ugagaucuaagccuuuccauaa

SEQ ID NO: 2372143 - RNA, 21 nt, Human
ugagaucuaagccuuuccaua

SEQ ID NO: 2372144 - RNA, 20 nt, Human
ugagaucuaagccuuuccau

SEQ ID NO: 2372145 - RNA, 16 nt, Human
ugagaucuaagccuuu

SEQ ID NO: 2372146 - RNA, 23 nt, Human
ugagaucuaagccuuuccauaag

SEQ ID NO: 2372147 - RNA, 20 nt, Human
ugagaugauacauccaaagc

SEQ ID NO: 2372148 - RNA, 14 nt, Human
ugagaucaggcucu

SEQ ID NO: 2372149 - RNA, 19 nt, Human
ugagaggggaacagacugg

SEQ ID NO: 2372150 - RNA, 17 nt, Human
ugagaguagagucacug

SEQ ID NO: 2372151 - RNA, 14 nt, Human
ugagagguuugacu

SEQ ID NO: 2372152 - RNA, 18 nt, Human
ugagaggggcuguccagu

SEQ ID NO: 2372153 - RNA, 16 nt, Human
ugagaggcaggcauag

SEQ ID NO: 2372154 - RNA, 12 nt, Human
ugagaggcaggc

SEQ ID NO: 2372155 - RNA, 13 nt, Human
ugagaggcaggca

SEQ ID NO: 2372156 - RNA, 14 nt, Human
ugagaggcaggcau

SEQ ID NO: 2372157 - RNA, 23 nt, Human
ugagaggcauccaguaucuugaa

SEQ ID NO: 2372158 - RNA, 18 nt, Human
ugagaggcagacuucccu

SEQ ID NO: 2372159 - RNA, 19 nt, Human
ugagacucucuuaggagca

SEQ ID NO: 2372160 - RNA, 23 nt, Human
ugagacucucuuaggagcagagc

SEQ ID NO: 2372161 - RNA, 14 nt, Human
ugagaccucagcca

SEQ ID NO: 2372162 - RNA, 22 nt, Human
ugagaggcauccaguaucuuga

SEQ ID NO: 2372163 - RNA, 12 nt, Human
ugagacucuguc

SEQ ID NO: 2372164 - RNA, 13 nt, Human
ugagaccucagcc

SEQ ID NO: 2372165 - RNA, 12 nt, Human
ugagaccucagc

SEQ ID NO: 2372166 - RNA, 13 nt, Human
ugagacucugucu

SEQ ID NO: 2372167 - RNA, 14 nt, Human
ugagacucugucuc

SEQ ID NO: 2372168 - RNA, 12 nt, Human
ugagaaaugcau

SEQ ID NO: 2372169 - RNA, 14 nt, Human
ugagaaauuaagua

SEQ ID NO: 2372170 - RNA, 22 nt, Human
ugagaaaugaauaauuucccaa

SEQ ID NO: 2372171 - RNA, 11 nt, Human
ugagaaaugca

SEQ ID NO: 2372172 - RNA, 20 nt, Human
ugagaaaugaauaauuuccc

SEQ ID NO: 2372173 - RNA, 15 nt, Human
ugagaaaugaauaau

SEQ ID NO: 2372174 - RNA, 13 nt, Human
ugagaaauuaagu

SEQ ID NO: 2372175 - RNA, 13 nt, Human
ugagaaaugcaua

SEQ ID NO: 2372176 - RNA, 16 nt, Human
ugagacagcucugcau

SEQ ID NO: 2372177 - RNA, 14 nt, Human
ugagacagcucugc

SEQ ID NO: 2372178 - RNA, 22 nt, Human
ugagacccccacaccucaguuc

SEQ ID NO: 2372179 - RNA, 19 nt, Human
ugagacaguccagccugga

SEQ ID NO: 2372180 - RNA, 13 nt, Human
ugagaccccuggc

SEQ ID NO: 2372181 - RNA, 14 nt, Human
ugagaccccuggcc

SEQ ID NO: 2372182 - RNA, 15 nt, Human
ugagaccccuggccu

SEQ ID NO: 2372183 - RNA, 15 nt, Human
ugagacaggagaauc

SEQ ID NO: 2372184 - RNA, 16 nt, Human
ugagacaguccagccu

SEQ ID NO: 2372185 - RNA, 18 nt, Human
ugagacaguccagccugg

SEQ ID NO: 2372186 - RNA, 15 nt, Human
ugagacccugucucu

SEQ ID NO: 2372187 - RNA, 14 nt, Human
ugagacccugucuc

SEQ ID NO: 2372188 - RNA, 22 nt, Human
ugagaccccuggccuccggcgu

SEQ ID NO: 2372189 - RNA, 16 nt, Human
ugagaccccuggccuc

SEQ ID NO: 2372190 - RNA, 18 nt, Human
ugagaccccuggccuccg

SEQ ID NO: 2372191 - RNA, 12 nt, Human
ugagacccuguc

SEQ ID NO: 2372192 - RNA, 23 nt, Human
ugacuggguuucucuguauagua

SEQ ID NO: 2372193 - RNA, 14 nt, Human
ugacuguauauaaa

SEQ ID NO: 2372194 - RNA, 20 nt, Human
ugagaaagacuauucaaaca

SEQ ID NO: 2372195 - RNA, 18 nt, Human
ugagaaagacuauucaaa

SEQ ID NO: 2372196 - RNA, 13 nt, Human
ugagaaaucuaaa

SEQ ID NO: 2372197 - RNA, 17 nt, Human
ugagaaaucuaaaaaac

SEQ ID NO: 2372198 - RNA, 16 nt, Human
ugacuguacuccuccc

SEQ ID NO: 2372199 - RNA, 17 nt, Human
ugacuguacuccuccca

SEQ ID NO: 2372200 - RNA, 18 nt, Human
ugacuguacuccucccag

SEQ ID NO: 2372201 - RNA, 22 nt, Human
ugacuguacuccucccaggcgc

SEQ ID NO: 2372202 - RNA, 17 nt, Human
ugagaaagacuauucaa

SEQ ID NO: 2372203 - RNA, 16 nt, Human
ugagaaagacuauuca

SEQ ID NO: 2372204 - RNA, 13 nt, Human
ucuugaaucccau

SEQ ID NO: 2372205 - RNA, 16 nt, Human
ucuugaaugucuuuug

SEQ ID NO: 2372206 - RNA, 16 nt, Human
ucuugaauaauguaag

SEQ ID NO: 2372207 - RNA, 15 nt, Human
ucuugaacuccuggc

SEQ ID NO: 2372208 - RNA, 13 nt, Human
ucuugaaggugcu

SEQ ID NO: 2372209 - RNA, 17 nt, Human
ucuugaauuguaaggaa

SEQ ID NO: 2372210 - RNA, 20 nt, Human
ugaccauucuccaccugcca

SEQ ID NO: 2372211 - RNA, 21 nt, Human
ugaccauucuccaccugccag

SEQ ID NO: 2372212 - RNA, 22 nt, Human
ugaccauucuccaccugccagg

SEQ ID NO: 2372213 - RNA, 13 nt, Human
ugacccuccuguu

SEQ ID NO: 2372214 - RNA, 14 nt, Human
ucuugaaugucuuu

SEQ ID NO: 2372215 - RNA, 18 nt, Human
ugacccucuccaccccau

SEQ ID NO: 2372216 - RNA, 15 nt, Human
ugacccucuccaccc

SEQ ID NO: 2372217 - RNA, 22 nt, Human
ugacccucugaaugguccaggg

SEQ ID NO: 2372218 - RNA, 23 nt, Human
ugacccucugaaugguccagggu

SEQ ID NO: 2372219 - RNA, 16 nt, Human
ugacccuccuguugca

SEQ ID NO: 2372220 - RNA, 21 nt, Human
ugacccuccuguugcacccag

SEQ ID NO: 2372221 - RNA, 22 nt, Human
ugacccuccuguugcacccagc

SEQ ID NO: 2372222 - RNA, 16 nt, Human
ugacccugaucagucu

SEQ ID NO: 2372223 - RNA, 15 nt, Human
ugacccugaagugag

SEQ ID NO: 2372224 - RNA, 20 nt, Human
ugaccgugggcggggccuug

SEQ ID NO: 2372225 - RNA, 23 nt, Human
ugaccgugggcggggccuugcgg

SEQ ID NO: 2372226 - RNA, 20 nt, Human
ugacccugcgaaggggcccu

SEQ ID NO: 2372227 - RNA, 13 nt, Human
ugaccuacucuca

SEQ ID NO: 2372228 - RNA, 16 nt, Human
ugaccuacaaaucaau

SEQ ID NO: 2372229 - RNA, 17 nt, Human
ugaccuacucgagggac

SEQ ID NO: 2372230 - RNA, 21 nt, Human
ugaccucaagauguccuccuu

SEQ ID NO: 2372231 - RNA, 18 nt, Human
ugaccucaaccugugaug

SEQ ID NO: 2372232 - RNA, 17 nt, Human
ugaccucaaccugugau

SEQ ID NO: 2372233 - RNA, 22 nt, Human
ugaccuaguuuuccaugcgugu

SEQ ID NO: 2372234 - RNA, 17 nt, Human
ugaccuaguuuuccaug

SEQ ID NO: 2372235 - RNA, 18 nt, Human
ugaccuacucgagggacu

SEQ ID NO: 2372236 - RNA, 16 nt, Human
ugaccuaucacuucca

SEQ ID NO: 2372237 - RNA, 22 nt, Human
ugaccucccucuaauuuaucuu

SEQ ID NO: 2372238 - RNA, 18 nt, Human
ugaccucgugauccaccc

SEQ ID NO: 2372239 - RNA, 22 nt, Human
ugaccucccagcccuauggaug

SEQ ID NO: 2372240 - RNA, 23 nt, Human
ugaccucccagcccuauggaugu

SEQ ID NO: 2372241 - RNA, 13 nt, Human
ugaccucccucua

SEQ ID NO: 2372242 - RNA, 14 nt, Human
ugaccucccucuaa

SEQ ID NO: 2372243 - RNA, 16 nt, Human
ugaccucugcagcaau

SEQ ID NO: 2372244 - RNA, 13 nt, Human
ugaccucugcagc

SEQ ID NO: 2372245 - RNA, 15 nt, Human
ugaccuccacagcuu

SEQ ID NO: 2372246 - RNA, 14 nt, Human
ugaccuccacagcu

SEQ ID NO: 2372247 - RNA, 17 nt, Human
ugaccuccacagcuucc

SEQ ID NO: 2372248 - RNA, 16 nt, Human
ugaccucaugcaucuc

SEQ ID NO: 2372249 - RNA, 19 nt, Human
ugaccucaugcaucuccac

SEQ ID NO: 2372250 - RNA, 22 nt, Human
ugaccucaugcaucuccaccug

SEQ ID NO: 2372251 - RNA, 22 nt, Human
ugaccuccaugacugcacagua

SEQ ID NO: 2372252 - RNA, 11 nt, Human
ugaccucccag

SEQ ID NO: 2372253 - RNA, 12 nt, Human
ugaccucccagc

SEQ ID NO: 2372254 - RNA, 14 nt, Human
ugaccucccagccc

SEQ ID NO: 2372255 - RNA, 15 nt, Human
ugaccucccagcccu

SEQ ID NO: 2372256 - RNA, 16 nt, Human
ugaccucccagcccua

SEQ ID NO: 2372257 - RNA, 22 nt, Human
ugaccucaggugauccacccac

SEQ ID NO: 2372258 - RNA, 13 nt, Human
ugaccucaugcau

SEQ ID NO: 2372259 - RNA, 14 nt, Human
ugaccuuucaauag

SEQ ID NO: 2372260 - RNA, 15 nt, Human
ugaccuuucaauagg

SEQ ID NO: 2372261 - RNA, 16 nt, Human
ugaccuuucaauagga

SEQ ID NO: 2372262 - RNA, 12 nt, Human
ugaccucugccu

SEQ ID NO: 2372263 - RNA, 23 nt, Human
ugaccucugcagcaauaaagcag

SEQ ID NO: 2372264 - RNA, 21 nt, Human
ugaccucugcagcaauaaagc

SEQ ID NO: 2372265 - RNA, 18 nt, Human
ugaccucugcagcaauaa

SEQ ID NO: 2372266 - RNA, 14 nt, Human
ugacgaagucucuu

SEQ ID NO: 2372267 - RNA, 15 nt, Human
ugacgacaagugcug

SEQ ID NO: 2372268 - RNA, 20 nt, Human
ugaccuuuugacuuaaagca

SEQ ID NO: 2372269 - RNA, 19 nt, Human
ugacgaacuuccauggccc

SEQ ID NO: 2372270 - RNA, 23 nt, Human
ugaccuuuuauguaguaauugac

SEQ ID NO: 2372271 - RNA, 18 nt, Human
ugaccuuuuauguaguaa

SEQ ID NO: 2372272 - RNA, 17 nt, Human
ugaccuuuuauguagua

SEQ ID NO: 2372273 - RNA, 18 nt, Human
ugaccuuucaauaggaaa

SEQ ID NO: 2372274 - RNA, 22 nt, Human
ugaccuuucaauaggaaaaacu

SEQ ID NO: 2372275 - RNA, 13 nt, Human
ugacgccauccca

SEQ ID NO: 2372276 - RNA, 14 nt, Human
ugacgccaucccag

SEQ ID NO: 2372277 - RNA, 15 nt, Human
ugacgccaucccagc

SEQ ID NO: 2372278 - RNA, 16 nt, Human
ugacgccaucccagcc

SEQ ID NO: 2372279 - RNA, 14 nt, Human
ugacggaagaacau

SEQ ID NO: 2372280 - RNA, 22 nt, Human
ugacgcugaauaaaugucuuuu

SEQ ID NO: 2372281 - RNA, 15 nt, Human
ugacgcugaauaaau

SEQ ID NO: 2372282 - RNA, 17 nt, Human
ugacgcugaauaaaugu

SEQ ID NO: 2372283 - RNA, 18 nt, Human
ugacgcugaauaaauguc

SEQ ID NO: 2372284 - RNA, 20 nt, Human
ugacgcugaauaaaugucuu

SEQ ID NO: 2372285 - RNA, 20 nt, Human
ugacgacaagugcugaacag

SEQ ID NO: 2372286 - RNA, 19 nt, Human
ugacgcaacccacguguaa

SEQ ID NO: 2372287 - RNA, 19 nt, Human
ugacgccugcccuccccag

SEQ ID NO: 2372288 - RNA, 14 nt, Human
ugacgcugaauaaa

SEQ ID NO: 2372289 - RNA, 18 nt, Human
ugacgguauuaugcuucu

SEQ ID NO: 2372290 - RNA, 19 nt, Human
ugacgguauuaugcuucuu

SEQ ID NO: 2372291 - RNA, 19 nt, Human
ugacggucccacacuggug

SEQ ID NO: 2372292 - RNA, 21 nt, Human
ugacggucccacacuggugac

SEQ ID NO: 2372293 - RNA, 23 nt, Human
ugacggucccacacuggugacug

SEQ ID NO: 2372294 - RNA, 17 nt, Human
ugacggugcagucuggg

SEQ ID NO: 2372295 - RNA, 19 nt, Human
ugacggaugauuggauuau

SEQ ID NO: 2372296 - RNA, 18 nt, Human
ugacggaagaacauagaa

SEQ ID NO: 2372297 - RNA, 20 nt, Human
ugacggaagccaacuuggcu

SEQ ID NO: 2372298 - RNA, 19 nt, Human
ugacggccagggagaagcu

SEQ ID NO: 2372299 - RNA, 17 nt, Human
ugacgccaucccagccc

SEQ ID NO: 2372300 - RNA, 18 nt, Human
ugacgccaucccagcccc

SEQ ID NO: 2372301 - RNA, 19 nt, Human
ugacgccaucccagcccca

SEQ ID NO: 2372302 - RNA, 20 nt, Human
ugacgccaucccagccccaa

SEQ ID NO: 2372303 - RNA, 19 nt, Human
ugacgugcaccuguacuca

SEQ ID NO: 2372304 - RNA, 18 nt, Human
ugacgugcaccuguacuc

SEQ ID NO: 2372305 - RNA, 22 nt, Human
ugacgugaccggacuuuucugc

SEQ ID NO: 2372306 - RNA, 24 nt, Human
ugacgugaccggacuuuucugcaa

SEQ ID NO: 2372307 - RNA, 23 nt, Human
ugacgugcaccuguacucaggag

SEQ ID NO: 2372308 - RNA, 16 nt, Human
ugacgugccuuuugca

SEQ ID NO: 2372309 - RNA, 18 nt, Human
ugacgugccuuuugcacc

SEQ ID NO: 2372310 - RNA, 19 nt, Human
ugacgugccuuuugcaccc

SEQ ID NO: 2372311 - RNA, 22 nt, Human
ugacgugccuuuugcaccccuc

SEQ ID NO: 2372312 - RNA, 22 nt, Human
ugacucugaaaucugaagaccu

SEQ ID NO: 2372313 - RNA, 13 nt, Human
ugacucugccccc

SEQ ID NO: 2372314 - RNA, 19 nt, Human
ugacgucaagucuccuucc

SEQ ID NO: 2372315 - RNA, 17 nt, Human
ugacgugaccggacuuu

SEQ ID NO: 2372316 - RNA, 18 nt, Human
ugacggugcagucugggu

SEQ ID NO: 2372317 - RNA, 13 nt, Human
ugacugaauuucu

SEQ ID NO: 2372318 - RNA, 12 nt, Human
ugacucuuaaga

SEQ ID NO: 2372319 - RNA, 22 nt, Human
ugacucuggcaaagcuuuuaga

SEQ ID NO: 2372320 - RNA, 14 nt, Human
ugacucugcccccu

SEQ ID NO: 2372321 - RNA, 15 nt, Human
ugacucugcccccug

SEQ ID NO: 2372322 - RNA, 18 nt, Human
ugacucugcccccugcug

SEQ ID NO: 2372323 - RNA, 19 nt, Human
ugacucugcccccugcugg

SEQ ID NO: 2372324 - RNA, 17 nt, Human
ugacucuggcaaagcuu

SEQ ID NO: 2372325 - RNA, 23 nt, Human
ugacugguguuaucaccgugggc

SEQ ID NO: 2372326 - RNA, 15 nt, Human
ugacugagcagacug

SEQ ID NO: 2372327 - RNA, 19 nt, Human
ugacugagcagacugguga

SEQ ID NO: 2372328 - RNA, 20 nt, Human
ugacugaugcuuucagauua

SEQ ID NO: 2372329 - RNA, 11 nt, Human
ugacugagcuu

SEQ ID NO: 2372330 - RNA, 15 nt, Human
ugacugagcuucccu

SEQ ID NO: 2372331 - RNA, 15 nt, Human
ugacugaauuucuuu

SEQ ID NO: 2372332 - RNA, 14 nt, Human
ugacugaauuucuu

SEQ ID NO: 2372333 - RNA, 21 nt, Human
ugagguuuccuucagacagau

SEQ ID NO: 2372334 - RNA, 11 nt, Human
ugaguccuggc

SEQ ID NO: 2372335 - RNA, 18 nt, Human
ugaguccuggcaugggaa

SEQ ID NO: 2372336 - RNA, 14 nt, Human
ugagucgaggacag

SEQ ID NO: 2372337 - RNA, 14 nt, Human
ugaguccuuaaaca

SEQ ID NO: 2372338 - RNA, 18 nt, Human
ugaguccuuaaacagggc

SEQ ID NO: 2372339 - RNA, 15 nt, Human
ugaguccuugaaaau

SEQ ID NO: 2372340 - RNA, 19 nt, Human
ugaguccuggcaugggaau

SEQ ID NO: 2372341 - RNA, 22 nt, Human
ugaguccuggcaugggaaugaa

SEQ ID NO: 2372342 - RNA, 22 nt, Human
ugagguggaagcccuccuucca

SEQ ID NO: 2372343 - RNA, 21 nt, Human
ugagguggaagcccuccuucc

SEQ ID NO: 2372344 - RNA, 14 nt, Human
ugagguggcacuuu

SEQ ID NO: 2372345 - RNA, 16 nt, Human
ugagguggcacuuuuu

SEQ ID NO: 2372346 - RNA, 20 nt, Human
ugagguggaagcccuccuuc

SEQ ID NO: 2372347 - RNA, 17 nt, Human
ugagguggaagcccucc

SEQ ID NO: 2372348 - RNA, 16 nt, Human
ugagguggaagcccuc

SEQ ID NO: 2372349 - RNA, 15 nt, Human
ugagguggaagcccu

SEQ ID NO: 2372350 - RNA, 17 nt, Human
ugaggugcugggaggga

SEQ ID NO: 2372351 - RNA, 16 nt, Human
ugaggugcugggaggg

SEQ ID NO: 2372352 - RNA, 15 nt, Human
ugaggugcugggagg

SEQ ID NO: 2372353 - RNA, 20 nt, Human
ugaggucuuuugacaugugg

SEQ ID NO: 2372354 - RNA, 19 nt, Human
ugagguggaagagggcugc

SEQ ID NO: 2372355 - RNA, 15 nt, Human
ugaggugcuauguuc

SEQ ID NO: 2372356 - RNA, 16 nt, Human
ugaggugcuauguucu

SEQ ID NO: 2372357 - RNA, 12 nt, Human
ugagguuaggag

SEQ ID NO: 2372358 - RNA, 14 nt, Human
ugagguuccucugc

SEQ ID NO: 2372359 - RNA, 15 nt, Human
ugagguuccucugcc

SEQ ID NO: 2372360 - RNA, 21 nt, Human
ugaggugugggggcugcagca

SEQ ID NO: 2372361 - RNA, 23 nt, Human
ugaggugugggggcugcagcaug

SEQ ID NO: 2372362 - RNA, 16 nt, Human
ugagguuccucugccu

SEQ ID NO: 2372363 - RNA, 17 nt, Human
ugagguuccucugccug

SEQ ID NO: 2372364 - RNA, 18 nt, Human
ugagguuccucugccugc

SEQ ID NO: 2372365 - RNA, 19 nt, Human
ugagguuccucugccugcc

SEQ ID NO: 2372366 - RNA, 20 nt, Human
ugagguuccucugccugccc

SEQ ID NO: 2372367 - RNA, 21 nt, Human
ugagguuccucugccugcccc

SEQ ID NO: 2372368 - RNA, 16 nt, Human
ugagguugcuagagaa

SEQ ID NO: 2372369 - RNA, 15 nt, Human
ugagguugcuuacua

SEQ ID NO: 2372370 - RNA, 19 nt, Human
ugagguuucaaaccucccu

SEQ ID NO: 2372371 - RNA, 21 nt, Human
ugaguccccuguuuguuucug

SEQ ID NO: 2372372 - RNA, 21 nt, Human
ugaggcuguggucacagcgga

SEQ ID NO: 2372373 - RNA, 18 nt, Human
ugaggcuguccuguacau

SEQ ID NO: 2372374 - RNA, 11 nt, Human
ugaggcugugg

SEQ ID NO: 2372375 - RNA, 23 nt, Human
ugaggcuuagcuuugcucugcca

SEQ ID NO: 2372376 - RNA, 15 nt, Human
ugaggcuuccagaga

SEQ ID NO: 2372377 - RNA, 16 nt, Human
ugaggcuuccagagag

SEQ ID NO: 2372378 - RNA, 13 nt, Human
ugaggcuugcuga

SEQ ID NO: 2372379 - RNA, 14 nt, Human
ugaggcuugcugag

SEQ ID NO: 2372380 - RNA, 15 nt, Human
ugaggcuugcugaga

SEQ ID NO: 2372381 - RNA, 16 nt, Human
ugaggcuugcugagag

SEQ ID NO: 2372382 - RNA, 17 nt, Human
ugaggcuugcugagagg

SEQ ID NO: 2372383 - RNA, 18 nt, Human
ugaggcuuuggauuugac

SEQ ID NO: 2372384 - RNA, 13 nt, Human
ugaggcuuuggau

SEQ ID NO: 2372385 - RNA, 18 nt, Human
ugaggcuuucagguuuua

SEQ ID NO: 2372386 - RNA, 20 nt, Human
ugaggcuugcugagaggggc

SEQ ID NO: 2372387 - RNA, 21 nt, Human
ugaggcuugcugagaggggcu

SEQ ID NO: 2372388 - RNA, 23 nt, Human
ugaggcuuuggauuugacauugc

SEQ ID NO: 2372389 - RNA, 19 nt, Human
ugaggucuuuugacaugug

SEQ ID NO: 2372390 - RNA, 17 nt, Human
ugaggucuuuugacaug

SEQ ID NO: 2372391 - RNA, 16 nt, Human
ugagggaacagacagg

SEQ ID NO: 2372392 - RNA, 20 nt, Human
ugaggucuguucuuuccaaa

SEQ ID NO: 2372393 - RNA, 15 nt, Human
ugaggucuguucuuu

SEQ ID NO: 2372394 - RNA, 14 nt, Human
ugaggucuguucuu

SEQ ID NO: 2372395 - RNA, 11 nt, Human
ugaggcuggca

SEQ ID NO: 2372396 - RNA, 23 nt, Human
ugaggcugcuuuccaaagccaau

SEQ ID NO: 2372397 - RNA, 20 nt, Human
ugaggcugcuuuccaaagcc

SEQ ID NO: 2372398 - RNA, 16 nt, Human
ugaggcugcuuuccaa

SEQ ID NO: 2372399 - RNA, 12 nt, Human
ugaggcugggaa

SEQ ID NO: 2372400 - RNA, 17 nt, Human
ugaggcuggcacaggac

SEQ ID NO: 2372401 - RNA, 15 nt, Human
ugaggcuggcacagg

SEQ ID NO: 2372402 - RNA, 14 nt, Human
ugaggcuggcacag

SEQ ID NO: 2372403 - RNA, 11 nt, Human
ugaggcugggc

SEQ ID NO: 2372404 - RNA, 13 nt, Human
ugaggcugcagcg

SEQ ID NO: 2372405 - RNA, 12 nt, Human
ugaggagcugcu

SEQ ID NO: 2372406 - RNA, 11 nt, Human
ugaggagcugc

SEQ ID NO: 2372407 - RNA, 16 nt, Human
ugaggagccccagcua

SEQ ID NO: 2372408 - RNA, 11 nt, Human
ugaggagcccc

SEQ ID NO: 2372409 - RNA, 14 nt, Human
ugaggagccccagc

SEQ ID NO: 2372410 - RNA, 20 nt, Human
ugaggagcagcuucaguugu

SEQ ID NO: 2372411 - RNA, 15 nt, Human
ugaggagccaggccg

SEQ ID NO: 2372412 - RNA, 23 nt, Human
ugaggacuuaaaauauuccugca

SEQ ID NO: 2372413 - RNA, 23 nt, Human
ugagcucuugugaggaaagucau

SEQ ID NO: 2372414 - RNA, 21 nt, Human
ugaggacauguuuuuguuuuc

SEQ ID NO: 2372415 - RNA, 20 nt, Human
ugaggacauuccaagacagu

SEQ ID NO: 2372416 - RNA, 16 nt, Human
ugaggagcagcuucag

SEQ ID NO: 2372417 - RNA, 16 nt, Human
ugaggacuauggaaau

SEQ ID NO: 2372418 - RNA, 20 nt, Human
ugaguugguguugacaugug

SEQ ID NO: 2372419 - RNA, 18 nt, Human
ugaguuguugcccugggu

SEQ ID NO: 2372420 - RNA, 21 nt, Human
ugaguuggggucuggcagccu

SEQ ID NO: 2372421 - RNA, 19 nt, Human
ugaguuggggucuggcagc

SEQ ID NO: 2372422 - RNA, 17 nt, Human
ugaguuggggucuggca

SEQ ID NO: 2372423 - RNA, 17 nt, Human
ugaguuggcugggaaua

SEQ ID NO: 2372424 - RNA, 14 nt, Human
ugaguuuaaagcaa

SEQ ID NO: 2372425 - RNA, 23 nt, Human
ugaguuguuuucagacucagacu

SEQ ID NO: 2372426 - RNA, 16 nt, Human
ugaguuuaccuuguau

SEQ ID NO: 2372427 - RNA, 23 nt, Human
ugaguuuaccuuguauacuguag

SEQ ID NO: 2372428 - RNA, 19 nt, Human
ugaguuuccucaggcugcu

SEQ ID NO: 2372429 - RNA, 17 nt, Human
ugaguuuccucaggcug

SEQ ID NO: 2372430 - RNA, 16 nt, Human
ugaguuuccucaggcu

SEQ ID NO: 2372431 - RNA, 22 nt, Human
ugaguuuccucaggcugcugga

SEQ ID NO: 2372432 - RNA, 16 nt, Human
ugauaaaaccauguag

SEQ ID NO: 2372433 - RNA, 21 nt, Human
ugaguuuagugaucugaacag

SEQ ID NO: 2372434 - RNA, 17 nt, Human
ugaguuuauaucucuca

SEQ ID NO: 2372435 - RNA, 19 nt, Human
ugaguuuaguaaggcugug

SEQ ID NO: 2372436 - RNA, 14 nt, Human
ugaguuucauagcu

SEQ ID NO: 2372437 - RNA, 15 nt, Human
ugaguuucauagcua

SEQ ID NO: 2372438 - RNA, 18 nt, Human
ugaguuucauucuccugc

SEQ ID NO: 2372439 - RNA, 19 nt, Human
ugaguuucauucuccugcc

SEQ ID NO: 2372440 - RNA, 14 nt, Human
ugauaaacauuuaa

SEQ ID NO: 2372441 - RNA, 14 nt, Human
ugauaaacuuugcu

SEQ ID NO: 2372442 - RNA, 19 nt, Human
ugauaaaguaguaaaaauu

SEQ ID NO: 2372443 - RNA, 13 nt, Human
ugauaaaguuucu

SEQ ID NO: 2372444 - RNA, 16 nt, Human
ugauaaaguuucucag

SEQ ID NO: 2372445 - RNA, 15 nt, Human
ugagucgaggacagg

SEQ ID NO: 2372446 - RNA, 16 nt, Human
ugagucgaggacaggg

SEQ ID NO: 2372447 - RNA, 21 nt, Human
ugaguugauagcacagacccu

SEQ ID NO: 2372448 - RNA, 23 nt, Human
ugaguugauagcacagacccugc

SEQ ID NO: 2372449 - RNA, 19 nt, Human
ugaguugauucagcucugc

SEQ ID NO: 2372450 - RNA, 16 nt, Human
ugaguugauucagcuc

SEQ ID NO: 2372451 - RNA, 18 nt, Human
ugagucgaggacagggag

SEQ ID NO: 2372452 - RNA, 16 nt, Human
ugaguccuugaaaaua

SEQ ID NO: 2372453 - RNA, 18 nt, Human
ugaguccuugaaaauauu

SEQ ID NO: 2372454 - RNA, 16 nt, Human
ugaguuggcugggaau

SEQ ID NO: 2372455 - RNA, 14 nt, Human
ugaguuggcuggga

SEQ ID NO: 2372456 - RNA, 12 nt, Human
ugauaguuacug

SEQ ID NO: 2372457 - RNA, 13 nt, Human
ugauaguuacugu

SEQ ID NO: 2372458 - RNA, 14 nt, Human
ugauaguuacuguu

SEQ ID NO: 2372459 - RNA, 16 nt, Human
ugauaguuacuguugu

SEQ ID NO: 2372460 - RNA, 17 nt, Human
ugauaguuacuguugug

SEQ ID NO: 2372461 - RNA, 21 nt, Human
ugauaguuacuguugugaccu

SEQ ID NO: 2372462 - RNA, 20 nt, Human
ugauagggauacaugcucuu

SEQ ID NO: 2372463 - RNA, 16 nt, Human
ugauagucuuuugcuu

SEQ ID NO: 2372464 - RNA, 17 nt, Human
ugauagucuuuugcuuu

SEQ ID NO: 2372465 - RNA, 23 nt, Human
ugauagcuuuauuuuuuaaguau

SEQ ID NO: 2372466 - RNA, 14 nt, Human
ugauagcuuuauuu

SEQ ID NO: 2372467 - RNA, 13 nt, Human
ugauagcuuuauu

SEQ ID NO: 2372468 - RNA, 11 nt, Human
ugauagcuuua

SEQ ID NO: 2372469 - RNA, 18 nt, Human
ugauagguauaaguggug

SEQ ID NO: 2372470 - RNA, 21 nt, Human
ugauaggaaugugaaagcacg

SEQ ID NO: 2372471 - RNA, 17 nt, Human
ugauagggauacaugcu

SEQ ID NO: 2372472 - RNA, 16 nt, Human
ugauagcuaacauuuu

SEQ ID NO: 2372473 - RNA, 18 nt, Human
ugauagcuaacauuuuaa

SEQ ID NO: 2372474 - RNA, 21 nt, Human
ugauagcuaacauuuuaaaua

SEQ ID NO: 2372475 - RNA, 22 nt, Human
ugauagcucuuuggcagucuau

SEQ ID NO: 2372476 - RNA, 12 nt, Human
ugauagcacuuu

SEQ ID NO: 2372477 - RNA, 14 nt, Human
ugauagcacuuucu

SEQ ID NO: 2372478 - RNA, 13 nt, Human
ugauagcacuuuc

SEQ ID NO: 2372479 - RNA, 21 nt, Human
ugauagcacuuucuacaaugu

SEQ ID NO: 2372480 - RNA, 15 nt, Human
ugauagcacuuucua

SEQ ID NO: 2372481 - RNA, 22 nt, Human
ugauagcacagacccugcccug

SEQ ID NO: 2372482 - RNA, 23 nt, Human
ugauagcacagacccugcccugu

SEQ ID NO: 2372483 - RNA, 19 nt, Human
ugauaaauuccacuggacu

SEQ ID NO: 2372484 - RNA, 22 nt, Human
ugauaaaguuucucagauccuu

SEQ ID NO: 2372485 - RNA, 18 nt, Human
ugauaaaguuucucagau

SEQ ID NO: 2372486 - RNA, 21 nt, Human
ugauaaaguuucucagauccu

SEQ ID NO: 2372487 - RNA, 15 nt, Human
ugauagcacagaccc

SEQ ID NO: 2372488 - RNA, 16 nt, Human
ugauagcacagacccu

SEQ ID NO: 2372489 - RNA, 17 nt, Human
ugauagcacagacccug

SEQ ID NO: 2372490 - RNA, 18 nt, Human
ugauagcacagacccugc

SEQ ID NO: 2372491 - RNA, 20 nt, Human
ugauagcacagacccugccc

SEQ ID NO: 2372492 - RNA, 21 nt, Human
ugauagcacagacccugcccu

SEQ ID NO: 2372493 - RNA, 14 nt, Human
ugaugcucaggcuu

SEQ ID NO: 2372494 - RNA, 19 nt, Human
ugaugccagguucuauuug

SEQ ID NO: 2372495 - RNA, 23 nt, Human
ugaugccacaccaagcugugcca

SEQ ID NO: 2372496 - RNA, 14 nt, Human
ugaugccaggacac

SEQ ID NO: 2372497 - RNA, 15 nt, Human
ugaugcucaggcuug

SEQ ID NO: 2372498 - RNA, 14 nt, Human
ugaugcucccuccc

SEQ ID NO: 2372499 - RNA, 16 nt, Human
ugaugcucccuccccu

SEQ ID NO: 2372500 - RNA, 15 nt, Human
ugaugcucccucccc

SEQ ID NO: 2372501 - RNA, 22 nt, Human
ugaugcucccuccccugcccug

SEQ ID NO: 2372502 - RNA, 21 nt, Human
ugaugcucccuccccugcccu

SEQ ID NO: 2372503 - RNA, 20 nt, Human
ugaugcucccuccccugccc

SEQ ID NO: 2372504 - RNA, 17 nt, Human
ugaugcucccuccccug

SEQ ID NO: 2372505 - RNA, 23 nt, Human
ugaugcucccuccccugcccugg

SEQ ID NO: 2372506 - RNA, 15 nt, Human
ugaugcugccccuca

SEQ ID NO: 2372507 - RNA, 20 nt, Human
ugaugcuggaugcuccuucc

SEQ ID NO: 2372508 - RNA, 14 nt, Human
ugaugcuggagagg

SEQ ID NO: 2372509 - RNA, 15 nt, Human
ugaugcuggagaggu

SEQ ID NO: 2372510 - RNA, 19 nt, Human
ugaugcuucuucagagacu

SEQ ID NO: 2372511 - RNA, 21 nt, Human
ugaugcuucuucagagacucc

SEQ ID NO: 2372512 - RNA, 22 nt, Human
ugaugcuucuucagagacuccu

SEQ ID NO: 2372513 - RNA, 21 nt, Human
ugauguaaccgauucaucucu

SEQ ID NO: 2372514 - RNA, 15 nt, Human
ugaugcuggaugcuc

SEQ ID NO: 2372515 - RNA, 16 nt, Human
ugaugcuggagagguu

SEQ ID NO: 2372516 - RNA, 17 nt, Human
ugaugcuggagagguua

SEQ ID NO: 2372517 - RNA, 21 nt, Human
ugaugguuguacauauaagug

SEQ ID NO: 2372518 - RNA, 19 nt, Human
ugauguaaguuuaccuaug

SEQ ID NO: 2372519 - RNA, 22 nt, Human
ugauguaaucuugaauuguaac

SEQ ID NO: 2372520 - RNA, 13 nt, Human
ugauguacaugua

SEQ ID NO: 2372521 - RNA, 15 nt, Human
ugaugucccuaugga

SEQ ID NO: 2372522 - RNA, 12 nt, Human
ugauguauauuu

SEQ ID NO: 2372523 - RNA, 17 nt, Human
ugauguagugccucuuu

SEQ ID NO: 2372524 - RNA, 18 nt, Human
ugauguagugccucuuuc

SEQ ID NO: 2372525 - RNA, 21 nt, Human
ugauguauucuagcuaaugua

SEQ ID NO: 2372526 - RNA, 14 nt, Human
ugauguauucuagc

SEQ ID NO: 2372527 - RNA, 20 nt, Human
ugauguauucuagcuaaugu

SEQ ID NO: 2372528 - RNA, 18 nt, Human
ugauguaccaugaaacaa

SEQ ID NO: 2372529 - RNA, 20 nt, Human
ugauguaccaugaaacaaag

SEQ ID NO: 2372530 - RNA, 16 nt, Human
ugauguacagucuguc

SEQ ID NO: 2372531 - RNA, 17 nt, Human
ugauguacagucuguca

SEQ ID NO: 2372532 - RNA, 18 nt, Human
ugauguacagucugucau

SEQ ID NO: 2372533 - RNA, 19 nt, Human
ugauguacagucugucaug

SEQ ID NO: 2372534 - RNA, 20 nt, Human
ugauguaggguaaggugccu

SEQ ID NO: 2372535 - RNA, 13 nt, Human
ugauguauucuag

SEQ ID NO: 2372536 - RNA, 15 nt, Human
ugaugaaaaauagca

SEQ ID NO: 2372537 - RNA, 14 nt, Human
ugaucuggaaccca

SEQ ID NO: 2372538 - RNA, 21 nt, Human
ugaucuuugcagacaggcaag

SEQ ID NO: 2372539 - RNA, 23 nt, Human
ugaucuuugcagacaggcaagca

SEQ ID NO: 2372540 - RNA, 21 nt, Human
ugaucugaugcaagcaagaaa

SEQ ID NO: 2372541 - RNA, 14 nt, Human
ugaucugcucagcc

SEQ ID NO: 2372542 - RNA, 15 nt, Human
ugaucugcucagccc

SEQ ID NO: 2372543 - RNA, 13 nt, Human
ugaucuggaaccc

SEQ ID NO: 2372544 - RNA, 20 nt, Human
ugaucugcucagcccuggag

SEQ ID NO: 2372545 - RNA, 21 nt, Human
ugaucugcucagcccuggagg

SEQ ID NO: 2372546 - RNA, 16 nt, Human
ugaucugcucagcccu

SEQ ID NO: 2372547 - RNA, 17 nt, Human
ugaucugcucagcccug

SEQ ID NO: 2372548 - RNA, 18 nt, Human
ugaucugcucagcccugg

SEQ ID NO: 2372549 - RNA, 19 nt, Human
ugaucugcucagcccugga

SEQ ID NO: 2372550 - RNA, 19 nt, Human
ugaucuuugcagacaggca

SEQ ID NO: 2372551 - RNA, 20 nt, Human
ugaucuuugcagacaggcaa

SEQ ID NO: 2372552 - RNA, 18 nt, Human
ugaugaugggaauugugu

SEQ ID NO: 2372553 - RNA, 15 nt, Human
ugaugaaaauauuua

SEQ ID NO: 2372554 - RNA, 21 nt, Human
ugaugaugggaauugugugau

SEQ ID NO: 2372555 - RNA, 21 nt, Human
ugaugccaaguuguuugagaa

SEQ ID NO: 2372556 - RNA, 15 nt, Human
ugaugccaaguuguu

SEQ ID NO: 2372557 - RNA, 15 nt, Human
ugaugccaaccucug

SEQ ID NO: 2372558 - RNA, 18 nt, Human
ugaugccacacagagugg

SEQ ID NO: 2372559 - RNA, 15 nt, Human
ugaugccacaccaag

SEQ ID NO: 2372560 - RNA, 19 nt, Human
ugaugccaaguuguuugag

SEQ ID NO: 2372561 - RNA, 17 nt, Human
ugaugccacaccaagcu

SEQ ID NO: 2372562 - RNA, 18 nt, Human
ugaugccacaccaagcug

SEQ ID NO: 2372563 - RNA, 20 nt, Human
ugaugccacaccaagcugug

SEQ ID NO: 2372564 - RNA, 22 nt, Human
ugaugccacaccaagcugugcc

SEQ ID NO: 2372565 - RNA, 14 nt, Human
ugaugccaugagga

SEQ ID NO: 2372566 - RNA, 22 nt, Human
ugaugaucuuugcagacaggca

SEQ ID NO: 2372567 - RNA, 14 nt, Human
ugaugaaaauauuu

SEQ ID NO: 2372568 - RNA, 23 nt, Human
ugaugaucuuugcagacaggcaa

SEQ ID NO: 2372569 - RNA, 20 nt, Human
ugaugaugaaaugaggucag

SEQ ID NO: 2372570 - RNA, 17 nt, Human
ugaucugacauccccac

SEQ ID NO: 2372571 - RNA, 23 nt, Human
ugaucucuucuuuuggcuuccau

SEQ ID NO: 2372572 - RNA, 17 nt, Human
ugaucugagucccagga

SEQ ID NO: 2372573 - RNA, 20 nt, Human
ugaucugaugcaagcaagaa

SEQ ID NO: 2372574 - RNA, 22 nt, Human
ugaucuagguuuaacucagauc

SEQ ID NO: 2372575 - RNA, 13 nt, Human
ugaucuagguuua

SEQ ID NO: 2372576 - RNA, 20 nt, Human
ugaucauagguauuucaaaa

SEQ ID NO: 2372577 - RNA, 14 nt, Human
ugaucuagguuuaa

SEQ ID NO: 2372578 - RNA, 15 nt, Human
ugaucuagguuuaac

SEQ ID NO: 2372579 - RNA, 16 nt, Human
ugaucuagguuuaacu

SEQ ID NO: 2372580 - RNA, 17 nt, Human
ugaucuagguuuaacuc

SEQ ID NO: 2372581 - RNA, 18 nt, Human
ugaucuagguuuaacuca

SEQ ID NO: 2372582 - RNA, 19 nt, Human
ugaucuagguuuaacucag

SEQ ID NO: 2372583 - RNA, 20 nt, Human
ugaucuagguuuaacucaga

SEQ ID NO: 2372584 - RNA, 21 nt, Human
ugaucuagguuuaacucagau

SEQ ID NO: 2372585 - RNA, 21 nt, Human
ugauccacccaccucagccuc

SEQ ID NO: 2372586 - RNA, 22 nt, Human
ugauccacccaccucagccucc

SEQ ID NO: 2372587 - RNA, 19 nt, Human
ugaucuaggaagacuuugg

SEQ ID NO: 2372588 - RNA, 21 nt, Human
ugaucuaggaagacuuuggaa

SEQ ID NO: 2372589 - RNA, 13 nt, Human
ugaucauccacug

SEQ ID NO: 2372590 - RNA, 24 nt, Human
ugaucauccacugugccaugugcc

SEQ ID NO: 2372591 - RNA, 17 nt, Human
ugauccaagcugguccc

SEQ ID NO: 2372592 - RNA, 21 nt, Human
ugaucauaagucuaaauaaau

SEQ ID NO: 2372593 - RNA, 15 nt, Human
ugaucauaagucuaa

SEQ ID NO: 2372594 - RNA, 19 nt, Human
ugaucauagguauuucaaa

SEQ ID NO: 2372595 - RNA, 21 nt, Human
ugauccaagcuggucccacuc

SEQ ID NO: 2372596 - RNA, 15 nt, Human
ugauccacccaccuc

SEQ ID NO: 2372597 - RNA, 20 nt, Human
ugauccacccaccucagccu

SEQ ID NO: 2372598 - RNA, 14 nt, Human
ugauauaaauaaaa

SEQ ID NO: 2372599 - RNA, 19 nt, Human
ugauauaaaucagauucuu

SEQ ID NO: 2372600 - RNA, 20 nt, Human
ugauaguuacuguugugacc

SEQ ID NO: 2372601 - RNA, 24 nt, Human
ugauaguuguaccgcaaugugacu

SEQ ID NO: 2372602 - RNA, 17 nt, Human
ugauauaaguguguguu

SEQ ID NO: 2372603 - RNA, 23 nt, Human
ugauauaaguguguguuuuucau

SEQ ID NO: 2372604 - RNA, 22 nt, Human
ugauauacuuuuuucuuauuua

SEQ ID NO: 2372605 - RNA, 13 nt, Human
ugauauaaaugca

SEQ ID NO: 2372606 - RNA, 16 nt, Human
ugauauaaaugcaaua

SEQ ID NO: 2372607 - RNA, 22 nt, Human
ugauauagaacagugcuugcca

SEQ ID NO: 2372608 - RNA, 18 nt, Human
ugauauauaaguguacau

SEQ ID NO: 2372609 - RNA, 19 nt, Human
ugauauauaaguguacaua

SEQ ID NO: 2372610 - RNA, 21 nt, Human
ugauauauguguuuuucacau

SEQ ID NO: 2372611 - RNA, 14 nt, Human
ugauauauuuaaaa

SEQ ID NO: 2372612 - RNA, 14 nt, Human
ugauauauuuuaca

SEQ ID NO: 2372613 - RNA, 13 nt, Human
ugauauauuuuac

SEQ ID NO: 2372614 - RNA, 13 nt, Human
ugauauauguguu

SEQ ID NO: 2372615 - RNA, 16 nt, Human
ugauauauggauaaug

SEQ ID NO: 2372616 - RNA, 22 nt, Human
ugauauauaaguguacauaugu

SEQ ID NO: 2372617 - RNA, 11 nt, Human
ugauaugaaaa

SEQ ID NO: 2372618 - RNA, 21 nt, Human
ugauauccauucuuucugaua

SEQ ID NO: 2372619 - RNA, 16 nt, Human
ugauaucccccagccu

SEQ ID NO: 2372620 - RNA, 21 nt, Human
ugauaucaugccccuguacuc

SEQ ID NO: 2372621 - RNA, 19 nt, Human
ugauauccauucuuucuga

SEQ ID NO: 2372622 - RNA, 19 nt, Human
ugauaucacagucuaauuu

SEQ ID NO: 2372623 - RNA, 19 nt, Human
ugauauauuuaaaaauauu

SEQ ID NO: 2372624 - RNA, 17 nt, Human
ugauaucacagucuaau

SEQ ID NO: 2372625 - RNA, 15 nt, Human
ugauauauuuuacaa

SEQ ID NO: 2372626 - RNA, 19 nt, Human
ugauaugcaguuuuccuua

SEQ ID NO: 2372627 - RNA, 15 nt, Human
ugauaugaaaaauau

SEQ ID NO: 2372628 - RNA, 12 nt, Human
ugauaugaaaaa

SEQ ID NO: 2372629 - RNA, 15 nt, Human
ugauaugauuuaaaa

SEQ ID NO: 2372630 - RNA, 19 nt, Human
ugauaugauuuaaaacaug

SEQ ID NO: 2372631 - RNA, 19 nt, Human
ugauaugaaaaauaugaua

SEQ ID NO: 2372632 - RNA, 22 nt, Human
ugaucacggcucacugcagccu

SEQ ID NO: 2372633 - RNA, 15 nt, Human
ugauauggcagaaga

SEQ ID NO: 2372634 - RNA, 17 nt, Human
ugauauggagcccugua

SEQ ID NO: 2372635 - RNA, 20 nt, Human
ugauauggagcccuguaauu

SEQ ID NO: 2372636 - RNA, 16 nt, Human
ugauauggcagaagac

SEQ ID NO: 2372637 - RNA, 18 nt, Human
ugaucacuggcaaugaaa

SEQ ID NO: 2372638 - RNA, 18 nt, Human
ugaucagaccauaauguu

SEQ ID NO: 2372639 - RNA, 21 nt, Human
ugaucagagccgugguccuuu

SEQ ID NO: 2372640 - RNA, 23 nt, Human
ugaucagaucugacaugauuccu

SEQ ID NO: 2372641 - RNA, 17 nt, Human
ugaucagaucugacaug

SEQ ID NO: 2372642 - RNA, 16 nt, Human
ugaucagaucugacau

SEQ ID NO: 2372643 - RNA, 15 nt, Human
ugaucagaucugaca

SEQ ID NO: 2372644 - RNA, 23 nt, Human
ugaucagagccgugguccuuugg

SEQ ID NO: 2372645 - RNA, 22 nt, Human
ugaucagagccgugguccuuug

SEQ ID NO: 2372646 - RNA, 17 nt, Human
uggauuuaacagaaaug

SEQ ID NO: 2372647 - RNA, 14 nt, Human
uggaugcagugcuc

SEQ ID NO: 2372648 - RNA, 15 nt, Human
uggauuuaacagaaa

SEQ ID NO: 2372649 - RNA, 15 nt, Human
uggcaagaaagcugg

SEQ ID NO: 2372650 - RNA, 22 nt, Human
uggcaaccuugucucuaugcca

SEQ ID NO: 2372651 - RNA, 19 nt, Human
uggcaagaaagcugguaaa

SEQ ID NO: 2372652 - RNA, 13 nt, Human
uggcaagagcccc

SEQ ID NO: 2372653 - RNA, 16 nt, Human
uggcaaggaaaaacag

SEQ ID NO: 2372654 - RNA, 13 nt, Human
uggcaagcuguga

SEQ ID NO: 2372655 - RNA, 15 nt, Human
uggcaagccccugcc

SEQ ID NO: 2372656 - RNA, 16 nt, Human
uggcaagccccugccc

SEQ ID NO: 2372657 - RNA, 21 nt, Human
uggcaagccccugcccaucug

SEQ ID NO: 2372658 - RNA, 21 nt, Human
uggcaagcuagaaccuggagg

SEQ ID NO: 2372659 - RNA, 21 nt, Human
uggcacuauaauguaagcucu

SEQ ID NO: 2372660 - RNA, 19 nt, Human
uggcaaggacacagaugaa

SEQ ID NO: 2372661 - RNA, 20 nt, Human
uggcaaggcagcccugucug

SEQ ID NO: 2372662 - RNA, 12 nt, Human
uggcaaggcugu

SEQ ID NO: 2372663 - RNA, 18 nt, Human
uggcacuggaugcagaaa

SEQ ID NO: 2372664 - RNA, 20 nt, Human
uggcacuggcauugucccug

SEQ ID NO: 2372665 - RNA, 17 nt, Human
uggcacuggggcacuug

SEQ ID NO: 2372666 - RNA, 20 nt, Human
uggcacuggggcacuuggca

SEQ ID NO: 2372667 - RNA, 12 nt, Human
uggcagcucucc

SEQ ID NO: 2372668 - RNA, 13 nt, Human
uggcagcucucca

SEQ ID NO: 2372669 - RNA, 14 nt, Human
uggcagcucuccag

SEQ ID NO: 2372670 - RNA, 15 nt, Human
uggcagcucuccagu

SEQ ID NO: 2372671 - RNA, 15 nt, Human
uggcacuggaugcag

SEQ ID NO: 2372672 - RNA, 13 nt, Human
uggcacuggaugc

SEQ ID NO: 2372673 - RNA, 14 nt, Human
uggcacugagcccc

SEQ ID NO: 2372674 - RNA, 15 nt, Human
uggcacugagccccc

SEQ ID NO: 2372675 - RNA, 22 nt, Human
uggcacugcuuccagugaggcu

SEQ ID NO: 2372676 - RNA, 22 nt, Human
uggcacuauaauguaagcucua

SEQ ID NO: 2372677 - RNA, 14 nt, Human
uggcaaggcugugc

SEQ ID NO: 2372678 - RNA, 15 nt, Human
uggcaaggcugugcu

SEQ ID NO: 2372679 - RNA, 16 nt, Human
uggcaaggcugugcuc

SEQ ID NO: 2372680 - RNA, 15 nt, Human
uggcacucaacauga

SEQ ID NO: 2372681 - RNA, 22 nt, Human
uggcacucacagaccuggagcc

SEQ ID NO: 2372682 - RNA, 22 nt, Human
uggcacugagauauuuauuguu

SEQ ID NO: 2372683 - RNA, 13 nt, Human
uggcacugagccc

SEQ ID NO: 2372684 - RNA, 19 nt, Human
uggcacugacugggcauag

SEQ ID NO: 2372685 - RNA, 17 nt, Human
uggcacucacagaccug

SEQ ID NO: 2372686 - RNA, 18 nt, Human
uggcacucacagaccugg

SEQ ID NO: 2372687 - RNA, 19 nt, Human
uggcacucacagaccugga

SEQ ID NO: 2372688 - RNA, 19 nt, Human
uggcacugcuuccagugag

SEQ ID NO: 2372689 - RNA, 14 nt, Human
uggagauccuccug

SEQ ID NO: 2372690 - RNA, 16 nt, Human
uggagauccuccugca

SEQ ID NO: 2372691 - RNA, 18 nt, Human
uggagauccuccugcaga

SEQ ID NO: 2372692 - RNA, 20 nt, Human
uggagauaaagauuucuuga

SEQ ID NO: 2372693 - RNA, 17 nt, Human
uggagaguuuccugaaa

SEQ ID NO: 2372694 - RNA, 23 nt, Human
uggagauauuuauggggggagaa

SEQ ID NO: 2372695 - RNA, 19 nt, Human
uggagauauuuaugggggg

SEQ ID NO: 2372696 - RNA, 16 nt, Human
uggagauagggaaaga

SEQ ID NO: 2372697 - RNA, 21 nt, Human
uggagggcuagaaccuggagg

SEQ ID NO: 2372698 - RNA, 20 nt, Human
uggagggcuagaacuggaga

SEQ ID NO: 2372699 - RNA, 21 nt, Human
uggagggcuagaacuggagag

SEQ ID NO: 2372700 - RNA, 20 nt, Human
uggagauccuccugcagacc

SEQ ID NO: 2372701 - RNA, 21 nt, Human
uggagauccuccugcagacca

SEQ ID NO: 2372702 - RNA, 14 nt, Human
uggaggggccccug

SEQ ID NO: 2372703 - RNA, 20 nt, Human
uggaggggcauggccagcag

SEQ ID NO: 2372704 - RNA, 23 nt, Human
uggaggggggaggugggauccuc

SEQ ID NO: 2372705 - RNA, 21 nt, Human
uggagggcuggaaucuggaga

SEQ ID NO: 2372706 - RNA, 22 nt, Human
uggagggcuggaaucuggagag

SEQ ID NO: 2372707 - RNA, 21 nt, Human
uggagggcuagaaucuggaga

SEQ ID NO: 2372708 - RNA, 22 nt, Human
uggagggcuagaaucuggagag

SEQ ID NO: 2372709 - RNA, 23 nt, Human
uggagggcuagaaucuggagagc

SEQ ID NO: 2372710 - RNA, 12 nt, Human
uggagggcugga

SEQ ID NO: 2372711 - RNA, 23 nt, Human
uggauauuuucaaauuguaucua

SEQ ID NO: 2372712 - RNA, 22 nt, Human
uggauauuuucaaauuguaucu

SEQ ID NO: 2372713 - RNA, 18 nt, Human
uggauauuuucaaauugu

SEQ ID NO: 2372714 - RNA, 23 nt, Human
uggaucacagaggcuucuucaga

SEQ ID NO: 2372715 - RNA, 19 nt, Human
uggaucaaauccagccugc

SEQ ID NO: 2372716 - RNA, 13 nt, Human
uggauauuuucaa

SEQ ID NO: 2372717 - RNA, 18 nt, Human
uggauauauguuuuugaa

SEQ ID NO: 2372718 - RNA, 17 nt, Human
uggauauaguuuuacuu

SEQ ID NO: 2372719 - RNA, 17 nt, Human
uggaugauguuucguga

SEQ ID NO: 2372720 - RNA, 14 nt, Human
uggaugauguuucg

SEQ ID NO: 2372721 - RNA, 15 nt, Human
uggaugcagugcucg

SEQ ID NO: 2372722 - RNA, 22 nt, Human
uggaugcagccucacaguccuu

SEQ ID NO: 2372723 - RNA, 13 nt, Human
uggaugcagccuc

SEQ ID NO: 2372724 - RNA, 21 nt, Human
uggaugcagccucacaguccu

SEQ ID NO: 2372725 - RNA, 22 nt, Human
uggacauuguuggcagcauaaa

SEQ ID NO: 2372726 - RNA, 15 nt, Human
uggacauugucugcg

SEQ ID NO: 2372727 - RNA, 17 nt, Human
uggacauggccccugug

SEQ ID NO: 2372728 - RNA, 17 nt, Human
uggacaggcauguucuc

SEQ ID NO: 2372729 - RNA, 23 nt, Human
uggacaggcauguucucugagga

SEQ ID NO: 2372730 - RNA, 17 nt, Human
uggacauuugccuugcu

SEQ ID NO: 2372731 - RNA, 18 nt, Human
uggacauuugccuugcug

SEQ ID NO: 2372732 - RNA, 19 nt, Human
uggacauuugccuugcugg

SEQ ID NO: 2372733 - RNA, 22 nt, Human
uggacauuugccuugcuggacg

SEQ ID NO: 2372734 - RNA, 18 nt, Human
uggacaggcauguucucu

SEQ ID NO: 2372735 - RNA, 22 nt, Human
uggacaggcauguucucugagg

SEQ ID NO: 2372736 - RNA, 17 nt, Human
uggaagaaauuccugua

SEQ ID NO: 2372737 - RNA, 20 nt, Human
uggaagaaauuccuguagca

SEQ ID NO: 2372738 - RNA, 15 nt, Human
uggaagaagagggag

SEQ ID NO: 2372739 - RNA, 12 nt, Human
uggaagaaggga

SEQ ID NO: 2372740 - RNA, 21 nt, Human
uggaagaagggagaagaaagg

SEQ ID NO: 2372741 - RNA, 11 nt, Human
uggaagacaca

SEQ ID NO: 2372742 - RNA, 15 nt, Human
uggaagacacauuga

SEQ ID NO: 2372743 - RNA, 13 nt, Human
uggaagaagggag

SEQ ID NO: 2372744 - RNA, 15 nt, Human
uggaagaagggagaa

SEQ ID NO: 2372745 - RNA, 17 nt, Human
uggaagaagggagaaga

SEQ ID NO: 2372746 - RNA, 19 nt, Human
uggaagaagggagaagaaa

SEQ ID NO: 2372747 - RNA, 15 nt, Human
uggacggcugggcac

SEQ ID NO: 2372748 - RNA, 22 nt, Human
uggacggcaggcucacugccag

SEQ ID NO: 2372749 - RNA, 23 nt, Human
uggacggcaggcucacugccagg

SEQ ID NO: 2372750 - RNA, 17 nt, Human
uggacauuuuuucaguc

SEQ ID NO: 2372751 - RNA, 21 nt, Human
uggacggcaggcucacugcca

SEQ ID NO: 2372752 - RNA, 16 nt, Human
uggacggggacugggg

SEQ ID NO: 2372753 - RNA, 14 nt, Human
uggacggugcucca

SEQ ID NO: 2372754 - RNA, 16 nt, Human
uggacggugcuccagg

SEQ ID NO: 2372755 - RNA, 17 nt, Human
uggacggugcuccaggc

SEQ ID NO: 2372756 - RNA, 18 nt, Human
uggacggugcuccaggca

SEQ ID NO: 2372757 - RNA, 19 nt, Human
uggacggugcuccaggcag

SEQ ID NO: 2372758 - RNA, 22 nt, Human
uggacggugcuccaggcaggcu

SEQ ID NO: 2372759 - RNA, 19 nt, Human
uggacguguuaugacucca

SEQ ID NO: 2372760 - RNA, 23 nt, Human
uggacguguuaugacuccagaau

SEQ ID NO: 2372761 - RNA, 17 nt, Human
uggacguucggggcaug

SEQ ID NO: 2372762 - RNA, 13 nt, Human
uggacuaaaagau

SEQ ID NO: 2372763 - RNA, 14 nt, Human
uggacuaaaagaua

SEQ ID NO: 2372764 - RNA, 15 nt, Human
uggacuaaaagauau

SEQ ID NO: 2372765 - RNA, 21 nt, Human
uggacuaaaagauauaagugc

SEQ ID NO: 2372766 - RNA, 22 nt, Human
uggacuaaaagauauaagugcu

SEQ ID NO: 2372767 - RNA, 23 nt, Human
uggacuaaaagauauaagugcug

SEQ ID NO: 2372768 - RNA, 19 nt, Human
uggacuaacuugucuuugg

SEQ ID NO: 2372769 - RNA, 20 nt, Human
uggacuaacuugucuuugga

SEQ ID NO: 2372770 - RNA, 13 nt, Human
uggacugggaggu

SEQ ID NO: 2372771 - RNA, 22 nt, Human
uggacuggcuagaguccucacu

SEQ ID NO: 2372772 - RNA, 20 nt, Human
uggacuggcuagaguccuca

SEQ ID NO: 2372773 - RNA, 19 nt, Human
uggacuggcuagaguccuc

SEQ ID NO: 2372774 - RNA, 13 nt, Human
uggacuggcuaga

SEQ ID NO: 2372775 - RNA, 17 nt, Human
uggacuggccccugggu

SEQ ID NO: 2372776 - RNA, 20 nt, Human
uggacuggccccugggucag

SEQ ID NO: 2372777 - RNA, 17 nt, Human
uggacuggaguggagca

SEQ ID NO: 2372778 - RNA, 14 nt, Human
uggacuggccccug

SEQ ID NO: 2372779 - RNA, 15 nt, Human
uggacuggccccugg

SEQ ID NO: 2372780 - RNA, 16 nt, Human
uggacuggccccuggg

SEQ ID NO: 2372781 - RNA, 20 nt, Human
uggacugugaugccacacag

SEQ ID NO: 2372782 - RNA, 21 nt, Human
uggacugugaugccacacaga

SEQ ID NO: 2372783 - RNA, 15 nt, Human
uggacugucauagaa

SEQ ID NO: 2372784 - RNA, 15 nt, Human
uggacugugaugcca

SEQ ID NO: 2372785 - RNA, 21 nt, Human
uggacugucauagaaauuaca

SEQ ID NO: 2372786 - RNA, 15 nt, Human
uggacugaagccugc

SEQ ID NO: 2372787 - RNA, 19 nt, Human
uggacucuuugguggcuuu

SEQ ID NO: 2372788 - RNA, 15 nt, Human
uggacucuugcucuu

SEQ ID NO: 2372789 - RNA, 18 nt, Human
uggacucuugcucuuucu

SEQ ID NO: 2372790 - RNA, 12 nt, Human
uggacucuugcu

SEQ ID NO: 2372791 - RNA, 14 nt, Human
uggacucuugcucu

SEQ ID NO: 2372792 - RNA, 19 nt, Human
uggacucugcacaugucuu

SEQ ID NO: 2372793 - RNA, 15 nt, Human
uggacucugcacaug

SEQ ID NO: 2372794 - RNA, 20 nt, Human
uggacggugcuccaggcagg

SEQ ID NO: 2372795 - RNA, 16 nt, Human
uggacucugcacauga

SEQ ID NO: 2372796 - RNA, 17 nt, Human
uggacucugcacaugaa

SEQ ID NO: 2372797 - RNA, 17 nt, Human
uggacucugcacauguc

SEQ ID NO: 2372798 - RNA, 18 nt, Human
uggacucugcacaugucu

SEQ ID NO: 2372799 - RNA, 22 nt, Human
uggacucugcacaugucuugua

SEQ ID NO: 2372800 - RNA, 11 nt, Human
uggagagcugg

SEQ ID NO: 2372801 - RNA, 13 nt, Human
uggagagcuggag

SEQ ID NO: 2372802 - RNA, 15 nt, Human
uggagagcuggagcc

SEQ ID NO: 2372803 - RNA, 17 nt, Human
uggagagcuggagccug

SEQ ID NO: 2372804 - RNA, 19 nt, Human
uggagagcuagaaccugga

SEQ ID NO: 2372805 - RNA, 20 nt, Human
uggagagcuagaaccuggag

SEQ ID NO: 2372806 - RNA, 21 nt, Human
uggagagcuagaaccuggaga

SEQ ID NO: 2372807 - RNA, 21 nt, Human
uggagagcuagaaccuggagg

SEQ ID NO: 2372808 - RNA, 22 nt, Human
uggagagcuagaaccuggagag

SEQ ID NO: 2372809 - RNA, 23 nt, Human
uggagagcuagaaccuggagagc

SEQ ID NO: 2372810 - RNA, 19 nt, Human
uggagagcuggugcccgga

SEQ ID NO: 2372811 - RNA, 16 nt, Human
uggagagcuggugccc

SEQ ID NO: 2372812 - RNA, 14 nt, Human
uggagagcuggugc

SEQ ID NO: 2372813 - RNA, 18 nt, Human
uggagagcuggagccugg

SEQ ID NO: 2372814 - RNA, 20 nt, Human
uggagagcuggagccuggug

SEQ ID NO: 2372815 - RNA, 16 nt, Human
uggagaguuuccugaa

SEQ ID NO: 2372816 - RNA, 15 nt, Human
uggagaguuuccuga

SEQ ID NO: 2372817 - RNA, 19 nt, Human
uggagaccagggagccuuu

SEQ ID NO: 2372818 - RNA, 18 nt, Human
uggagaccagggagccuu

SEQ ID NO: 2372819 - RNA, 18 nt, Human
uggagaccaugcagagcg

SEQ ID NO: 2372820 - RNA, 19 nt, Human
uggagaccaugcagagcgc

SEQ ID NO: 2372821 - RNA, 20 nt, Human
uggagaccaugcagagcgcc

SEQ ID NO: 2372822 - RNA, 18 nt, Human
uggagagcuagaaccugg

SEQ ID NO: 2372823 - RNA, 17 nt, Human
uggagacacaacuauuu

SEQ ID NO: 2372824 - RNA, 12 nt, Human
uggagacagccc

SEQ ID NO: 2372825 - RNA, 13 nt, Human
uggagacagcccc

SEQ ID NO: 2372826 - RNA, 17 nt, Human
uggagacagccccagag

SEQ ID NO: 2372827 - RNA, 19 nt, Human
uggagacagccccagagca

SEQ ID NO: 2372828 - RNA, 20 nt, Human
uggagacagccccagagcag

SEQ ID NO: 2372829 - RNA, 21 nt, Human
uggagacagccccagagcagg

SEQ ID NO: 2372830 - RNA, 22 nt, Human
uggagacagccccagagcaggg

SEQ ID NO: 2372831 - RNA, 15 nt, Human
uggagacauuccugg

SEQ ID NO: 2372832 - RNA, 20 nt, Human
uggagacauuccugggcaca

SEQ ID NO: 2372833 - RNA, 21 nt, Human
uggagacauuccugggcacag

SEQ ID NO: 2372834 - RNA, 22 nt, Human
uggagacauuccugggcacagu

SEQ ID NO: 2372835 - RNA, 23 nt, Human
ugcuuccagugaggcucugcccu

SEQ ID NO: 2372836 - RNA, 14 nt, Human
ugcuucccauccua

SEQ ID NO: 2372837 - RNA, 15 nt, Human
ugcuucccauccuac

SEQ ID NO: 2372838 - RNA, 16 nt, Human
ugcuucccauccuacc

SEQ ID NO: 2372839 - RNA, 18 nt, Human
ugcuucccauccuacccu

SEQ ID NO: 2372840 - RNA, 23 nt, Human
ugcuucccauccuacccucgggc

SEQ ID NO: 2372841 - RNA, 17 nt, Human
ugcuucccauuguggcu

SEQ ID NO: 2372842 - RNA, 20 nt, Human
ugcuucccucugccuguccc

SEQ ID NO: 2372843 - RNA, 15 nt, Human
ugcuucccucugccu

SEQ ID NO: 2372844 - RNA, 13 nt, Human
ugcuucccucugc

SEQ ID NO: 2372845 - RNA, 20 nt, Human
ugcuucccauuguggcuccu

SEQ ID NO: 2372846 - RNA, 15 nt, Human
ugcuucccuaaucua

SEQ ID NO: 2372847 - RNA, 23 nt, Human
ugcuucccauuguggcuccuauc

SEQ ID NO: 2372848 - RNA, 22 nt, Human
ugcuuccagugaggcucugccc

SEQ ID NO: 2372849 - RNA, 18 nt, Human
ugcuuacauuuuuacaau

SEQ ID NO: 2372850 - RNA, 15 nt, Human
ugcuuacauuuuuac

SEQ ID NO: 2372851 - RNA, 17 nt, Human
ugcuuacauuuuuacaa

SEQ ID NO: 2372852 - RNA, 20 nt, Human
ugcuuacauuuuuacaauaa

SEQ ID NO: 2372853 - RNA, 18 nt, Human
ugcuuacaauucccugcu

SEQ ID NO: 2372854 - RNA, 20 nt, Human
ugcuuacaauucccugcugu

SEQ ID NO: 2372855 - RNA, 21 nt, Human
ugcuuacaauucccugcuguc

SEQ ID NO: 2372856 - RNA, 22 nt, Human
ugcuuacaauucccugcugucg

SEQ ID NO: 2372857 - RNA, 13 nt, Human
ugcuuacaauuuu

SEQ ID NO: 2372858 - RNA, 14 nt, Human
ugcuuacaauuuuu

SEQ ID NO: 2372859 - RNA, 22 nt, Human
ugcuuacaauuuuuuuaauuuu

SEQ ID NO: 2372860 - RNA, 23 nt, Human
ugcuuacaauuuuuuuaauuuug

SEQ ID NO: 2372861 - RNA, 15 nt, Human
ugcuuacacaucuca

SEQ ID NO: 2372862 - RNA, 16 nt, Human
ugcuuacacaucucag

SEQ ID NO: 2372863 - RNA, 17 nt, Human
ugcuuacacaucucaga

SEQ ID NO: 2372864 - RNA, 20 nt, Human
ugcuuacacaucucagaccc

SEQ ID NO: 2372865 - RNA, 12 nt, Human
ugcuuacauuuu

SEQ ID NO: 2372866 - RNA, 14 nt, Human
ugcuuacauuuuua

SEQ ID NO: 2372867 - RNA, 16 nt, Human
ugcuucucuacagacu

SEQ ID NO: 2372868 - RNA, 14 nt, Human
ugcuucucuacaga

SEQ ID NO: 2372869 - RNA, 12 nt, Human
ugcuucucugac

SEQ ID NO: 2372870 - RNA, 13 nt, Human
ugcuucucugacu

SEQ ID NO: 2372871 - RNA, 17 nt, Human
ugcuucuguuuuauaau

SEQ ID NO: 2372872 - RNA, 17 nt, Human
ugcuucuccaugagaca

SEQ ID NO: 2372873 - RNA, 13 nt, Human
ugcuucuccagcc

SEQ ID NO: 2372874 - RNA, 15 nt, Human
ugcuucuccagccug

SEQ ID NO: 2372875 - RNA, 21 nt, Human
ugcuucccucugccugucccu

SEQ ID NO: 2372876 - RNA, 12 nt, Human
ugcuuccuagaa

SEQ ID NO: 2372877 - RNA, 20 nt, Human
ugcuuccuagaaguuacuga

SEQ ID NO: 2372878 - RNA, 21 nt, Human
ugcuuccuagaaguuacugaa

SEQ ID NO: 2372879 - RNA, 22 nt, Human
ugcuuccuagaaguuacugaau

SEQ ID NO: 2372880 - RNA, 12 nt, Human
ugcuuccuccug

SEQ ID NO: 2372881 - RNA, 13 nt, Human
ugcuuccuccugg

SEQ ID NO: 2372882 - RNA, 13 nt, Human
ugcuucgggcccu

SEQ ID NO: 2372883 - RNA, 14 nt, Human
ugcuuccuccugga

SEQ ID NO: 2372884 - RNA, 15 nt, Human
ugcuuccuccuggaa

SEQ ID NO: 2372885 - RNA, 14 nt, Human
ugcuuaaugaaaag

SEQ ID NO: 2372886 - RNA, 12 nt, Human
ugcuuaaugaaa

SEQ ID NO: 2372887 - RNA, 19 nt, Human
ugcuuaacuucacauauug

SEQ ID NO: 2372888 - RNA, 16 nt, Human
ugcuuaagcagaagca

SEQ ID NO: 2372889 - RNA, 18 nt, Human
ugcuuaacuucacauauu

SEQ ID NO: 2372890 - RNA, 17 nt, Human
ugcuuaacuucacauau

SEQ ID NO: 2372891 - RNA, 14 nt, Human
ugcuuaacuucaca

SEQ ID NO: 2372892 - RNA, 13 nt, Human
ugcuuaacuucac

SEQ ID NO: 2372893 - RNA, 18 nt, Human
ugccuguccagccugggc

SEQ ID NO: 2372894 - RNA, 16 nt, Human
ugccuguccagccugg

SEQ ID NO: 2372895 - RNA, 15 nt, Human
ugccuguccagccug

SEQ ID NO: 2372896 - RNA, 23 nt, Human
ugccuguaguuaggaaauaaaac

SEQ ID NO: 2372897 - RNA, 20 nt, Human
ugccuguccagccugggcag

SEQ ID NO: 2372898 - RNA, 19 nt, Human
ugccuguccagccugggca

SEQ ID NO: 2372899 - RNA, 16 nt, Human
ugccugucccaccccc

SEQ ID NO: 2372900 - RNA, 19 nt, Human
ugccugucccacccccacc

SEQ ID NO: 2372901 - RNA, 11 nt, Human
ugccugucucc

SEQ ID NO: 2372902 - RNA, 11 nt, Human
ugccugucccu

SEQ ID NO: 2372903 - RNA, 14 nt, Human
ugccugucccucuc

SEQ ID NO: 2372904 - RNA, 19 nt, Human
ugcuguuuguuugacaaag

SEQ ID NO: 2372905 - RNA, 15 nt, Human
ugcuguuuuccuccc

SEQ ID NO: 2372906 - RNA, 14 nt, Human
ugcuguuuuccucc

SEQ ID NO: 2372907 - RNA, 22 nt, Human
ugcuguuuuccucccuucugcu

SEQ ID NO: 2372908 - RNA, 18 nt, Human
ugcuguuuugauuuguac

SEQ ID NO: 2372909 - RNA, 21 nt, Human
ugcuguuuuccucccuucugc

SEQ ID NO: 2372910 - RNA, 19 nt, Human
ugcuguuuuccucccuucu

SEQ ID NO: 2372911 - RNA, 17 nt, Human
ugcuguuuuccucccuu

SEQ ID NO: 2372912 - RNA, 16 nt, Human
ugcuguuuuccucccu

SEQ ID NO: 2372913 - RNA, 19 nt, Human
ugcuuaaaaaucauugauu

SEQ ID NO: 2372914 - RNA, 17 nt, Human
ugcuuaaaaaucauuga

SEQ ID NO: 2372915 - RNA, 18 nt, Human
ugcuguuuuguucugugg

SEQ ID NO: 2372916 - RNA, 18 nt, Human
ugcuuaaaaaucauugau

SEQ ID NO: 2372917 - RNA, 15 nt, Human
ugcuguuuuguucug

SEQ ID NO: 2372918 - RNA, 16 nt, Human
ugcuguuuuguucugu

SEQ ID NO: 2372919 - RNA, 13 nt, Human
ugcuuucugaaau

SEQ ID NO: 2372920 - RNA, 12 nt, Human
ugcuuucugaaa

SEQ ID NO: 2372921 - RNA, 18 nt, Human
ugcuuucgaacugcuagu

SEQ ID NO: 2372922 - RNA, 12 nt, Human
ugcuuucuauug

SEQ ID NO: 2372923 - RNA, 13 nt, Human
ugcuuucuauugu

SEQ ID NO: 2372924 - RNA, 18 nt, Human
ugcuuucuauuguacaga

SEQ ID NO: 2372925 - RNA, 18 nt, Human
ugcuuucuccauuguaaa

SEQ ID NO: 2372926 - RNA, 15 nt, Human
ugcuuugccccugag

SEQ ID NO: 2372927 - RNA, 13 nt, Human
ugcuuugcccagc

SEQ ID NO: 2372928 - RNA, 22 nt, Human
ugcuuugacugagcagacuggu

SEQ ID NO: 2372929 - RNA, 20 nt, Human
ugcuuugacugagcagacug

SEQ ID NO: 2372930 - RNA, 19 nt, Human
uggaaaagaauacagaaag

SEQ ID NO: 2372931 - RNA, 14 nt, Human
uggaaaagaauaca

SEQ ID NO: 2372932 - RNA, 14 nt, Human
ugcuuugcuuucug

SEQ ID NO: 2372933 - RNA, 19 nt, Human
ugcuuugcuuucugcucag

SEQ ID NO: 2372934 - RNA, 19 nt, Human
uggaaaagccaagaggcug

SEQ ID NO: 2372935 - RNA, 16 nt, Human
uggaaaagccaagagg

SEQ ID NO: 2372936 - RNA, 13 nt, Human
ugcuuuggaaauc

SEQ ID NO: 2372937 - RNA, 13 nt, Human
ugcuuugcuuucu

SEQ ID NO: 2372938 - RNA, 14 nt, Human
ugcuuugcccagca

SEQ ID NO: 2372939 - RNA, 17 nt, Human
ugcuuuggaaaacccag

SEQ ID NO: 2372940 - RNA, 17 nt, Human
ugcuucuuaaccccagu

SEQ ID NO: 2372941 - RNA, 19 nt, Human
ugcuucuuaaccccaguaa

SEQ ID NO: 2372942 - RNA, 12 nt, Human
ugcuuguguuaa

SEQ ID NO: 2372943 - RNA, 18 nt, Human
ugcuugugaaaggaaaga

SEQ ID NO: 2372944 - RNA, 13 nt, Human
ugcuucuucagag

SEQ ID NO: 2372945 - RNA, 22 nt, Human
ugcuucuguuuuauaauuuugu

SEQ ID NO: 2372946 - RNA, 17 nt, Human
ugcuuuccguggcacug

SEQ ID NO: 2372947 - RNA, 20 nt, Human
ugcuuuccccuguggggauc

SEQ ID NO: 2372948 - RNA, 16 nt, Human
ugcuuucccugaacug

SEQ ID NO: 2372949 - RNA, 13 nt, Human
ugcuuuccccugu

SEQ ID NO: 2372950 - RNA, 14 nt, Human
ugcuuuccccugug

SEQ ID NO: 2372951 - RNA, 15 nt, Human
ugcuuuccccugugg

SEQ ID NO: 2372952 - RNA, 21 nt, Human
ugcuuuccguggcacugcaua

SEQ ID NO: 2372953 - RNA, 20 nt, Human
ugcuuuccguggcacugcau

SEQ ID NO: 2372954 - RNA, 20 nt, Human
ugcuuucgucuccagccccu

SEQ ID NO: 2372955 - RNA, 14 nt, Human
ugcuuguuaacuga

SEQ ID NO: 2372956 - RNA, 15 nt, Human
ugcuuguguuaagua

SEQ ID NO: 2372957 - RNA, 16 nt, Human
ugcuuguuaacugagu

SEQ ID NO: 2372958 - RNA, 12 nt, Human
ugcuuguguuau

SEQ ID NO: 2372959 - RNA, 15 nt, Human
uggaaaccugaaaaa

SEQ ID NO: 2372960 - RNA, 21 nt, Human
uggaaacccuuaggacagggu

SEQ ID NO: 2372961 - RNA, 21 nt, Human
uggaaaagggucuugggaaau

SEQ ID NO: 2372962 - RNA, 22 nt, Human
uggaaaagggucuugggaaaua

SEQ ID NO: 2372963 - RNA, 12 nt, Human
uggaaaccacag

SEQ ID NO: 2372964 - RNA, 17 nt, Human
uggaaaccugaaaaaaa

SEQ ID NO: 2372965 - RNA, 14 nt, Human
uggaaaccugcccu

SEQ ID NO: 2372966 - RNA, 15 nt, Human
uggaaaccugcccug

SEQ ID NO: 2372967 - RNA, 16 nt, Human
uggaaaccugcccugc

SEQ ID NO: 2372968 - RNA, 17 nt, Human
uggaaaccugcccugcc

SEQ ID NO: 2372969 - RNA, 19 nt, Human
uggaaaccugcccugccug

SEQ ID NO: 2372970 - RNA, 20 nt, Human
uggaaaccugcccugccuga

SEQ ID NO: 2372971 - RNA, 21 nt, Human
uggaaaccugcccugccugag

SEQ ID NO: 2372972 - RNA, 18 nt, Human
uggaaaaggaagacuaga

SEQ ID NO: 2372973 - RNA, 16 nt, Human
uggaaaaggaagacua

SEQ ID NO: 2372974 - RNA, 15 nt, Human
uggaaaaggaagacu

SEQ ID NO: 2372975 - RNA, 16 nt, Human
uggaaaagaggaguuu

SEQ ID NO: 2372976 - RNA, 22 nt, Human
uggaaaaggaagacuagaggcu

SEQ ID NO: 2372977 - RNA, 20 nt, Human
uggaaaaggaagacuagagg

SEQ ID NO: 2372978 - RNA, 19 nt, Human
uggaaaagggucuugggaa

SEQ ID NO: 2372979 - RNA, 22 nt, Human
uggaaaaguauguuagugcaaa

SEQ ID NO: 2372980 - RNA, 18 nt, Human
uggaaacucuuuaacuuc

SEQ ID NO: 2372981 - RNA, 19 nt, Human
uggaaacucuuuaacuucu

SEQ ID NO: 2372982 - RNA, 12 nt, Human
uggaaacugaau

SEQ ID NO: 2372983 - RNA, 22 nt, Human
uggaaaccugcccugccugagg

SEQ ID NO: 2372984 - RNA, 24 nt, Human
uggaaaccugcccugccugagggc

SEQ ID NO: 2372985 - RNA, 15 nt, Human
uggaacacucugaga

SEQ ID NO: 2372986 - RNA, 17 nt, Human
uggaacacucugagacu

SEQ ID NO: 2372987 - RNA, 21 nt, Human
uggaaacuggaugaggucaua

SEQ ID NO: 2372988 - RNA, 16 nt, Human
uggaacagaauguuuu

SEQ ID NO: 2372989 - RNA, 14 nt, Human
uggaaacugaaugc

SEQ ID NO: 2372990 - RNA, 15 nt, Human
uggaaacugaaugcu

SEQ ID NO: 2372991 - RNA, 23 nt, Human
uggaacagauucacacugucugg

SEQ ID NO: 2372992 - RNA, 16 nt, Human
uggaaacugaaugcuc

SEQ ID NO: 2372993 - RNA, 21 nt, Human
uggaacagaauguuuuacugu

SEQ ID NO: 2372994 - RNA, 19 nt, Human
uggaacagauucacacugu

SEQ ID NO: 2372995 - RNA, 20 nt, Human
uggaacagauucacacuguc

SEQ ID NO: 2372996 - RNA, 12 nt, Human
uggaaccuccuu

SEQ ID NO: 2372997 - RNA, 23 nt, Human
uggaaccucagccuggccagaca

SEQ ID NO: 2372998 - RNA, 21 nt, Human
uggaaccuccuuucucuucuc

SEQ ID NO: 2372999 - RNA, 19 nt, Human
uggaaccucagccuggcca

SEQ ID NO: 2373000 - RNA, 18 nt, Human
uggaaccucagccuggcc

SEQ ID NO: 2373001 - RNA, 17 nt, Human
uggaaccucagccuggc

SEQ ID NO: 2373002 - RNA, 21 nt, Human
uggaacuucuaauauauuuuu

SEQ ID NO: 2373003 - RNA, 13 nt, Human
uggaacuucuaau

SEQ ID NO: 2373004 - RNA, 13 nt, Human
uggaaccuccuuu

SEQ ID NO: 2373005 - RNA, 15 nt, Human
uggaaccuccuuucu

SEQ ID NO: 2373006 - RNA, 14 nt, Human
uggaacuucuaaua

SEQ ID NO: 2373007 - RNA, 15 nt, Human
uggaacuucuaauau

SEQ ID NO: 2373008 - RNA, 16 nt, Human
uggaacuucuaauaua

SEQ ID NO: 2373009 - RNA, 18 nt, Human
uggaacuucuaauauauu

SEQ ID NO: 2373010 - RNA, 16 nt, Human
uggcagcugccacgcc

SEQ ID NO: 2373011 - RNA, 22 nt, Human
uggcagcucuggacagccccac

SEQ ID NO: 2373012 - RNA, 21 nt, Human
uggcagcucuggacagcccca

SEQ ID NO: 2373013 - RNA, 11 nt, Human
uggcagcucug

SEQ ID NO: 2373014 - RNA, 17 nt, Human
uggcagcugcgguccac

SEQ ID NO: 2373015 - RNA, 19 nt, Human
uggcagcugcgguccaccc

SEQ ID NO: 2373016 - RNA, 13 nt, Human
uggccccagcaca

SEQ ID NO: 2373017 - RNA, 14 nt, Human
uggccccagcacag

SEQ ID NO: 2373018 - RNA, 17 nt, Human
uggccccagcacagcuu

SEQ ID NO: 2373019 - RNA, 18 nt, Human
uggccccagcacagcuug

SEQ ID NO: 2373020 - RNA, 19 nt, Human
uggccccagcacagcuuga

SEQ ID NO: 2373021 - RNA, 13 nt, Human
uggccccucaggg

SEQ ID NO: 2373022 - RNA, 20 nt, Human
uggccccucagggucccugg

SEQ ID NO: 2373023 - RNA, 20 nt, Human
uggccccaggaccuggcugc

SEQ ID NO: 2373024 - RNA, 15 nt, Human
uggccccaggaccug

SEQ ID NO: 2373025 - RNA, 12 nt, Human
uggccccaggac

SEQ ID NO: 2373026 - RNA, 21 nt, Human
uggccccagccuggcccagcu

SEQ ID NO: 2373027 - RNA, 22 nt, Human
uggccccagccuggcccagcuc

SEQ ID NO: 2373028 - RNA, 17 nt, Human
uggcagcucuccaguca

SEQ ID NO: 2373029 - RNA, 12 nt, Human
uggccccagccu

SEQ ID NO: 2373030 - RNA, 13 nt, Human
uggccccagccug

SEQ ID NO: 2373031 - RNA, 16 nt, Human
uggccccagccuggcc

SEQ ID NO: 2373032 - RNA, 17 nt, Human
uggccccagccuggccc

SEQ ID NO: 2373033 - RNA, 18 nt, Human
uggccccagccuggccca

SEQ ID NO: 2373034 - RNA, 19 nt, Human
uggccccagccuggcccag

SEQ ID NO: 2373035 - RNA, 20 nt, Human
uggccccagccuggcccagc

SEQ ID NO: 2373036 - RNA, 21 nt, Human
uggccccucaccugggcaccu

SEQ ID NO: 2373037 - RNA, 16 nt, Human
uggccccucaccuggg

SEQ ID NO: 2373038 - RNA, 19 nt, Human
uggccccucccccugccag

SEQ ID NO: 2373039 - RNA, 21 nt, Human
uggccccaugucucucagaau

SEQ ID NO: 2373040 - RNA, 19 nt, Human
uggccccaugucucucaga

SEQ ID NO: 2373041 - RNA, 23 nt, Human
uggccccaugucucucagaauuc

SEQ ID NO: 2373042 - RNA, 13 nt, Human
uggccccucaccu

SEQ ID NO: 2373043 - RNA, 10 nt, Human
uggccccucu

SEQ ID NO: 2373044 - RNA, 12 nt, Human
uggccccucuga

SEQ ID NO: 2373045 - RNA, 13 nt, Human
uggccccucugac

SEQ ID NO: 2373046 - RNA, 14 nt, Human
uggccccucugacc

SEQ ID NO: 2373047 - RNA, 21 nt, Human
uggccccucagggucccuggu

SEQ ID NO: 2373048 - RNA, 22 nt, Human
uggccccucagggucccuggug

SEQ ID NO: 2373049 - RNA, 20 nt, Human
uggccuagcauacguacaca

SEQ ID NO: 2373050 - RNA, 14 nt, Human
uggccccugagauc

SEQ ID NO: 2373051 - RNA, 20 nt, Human
uggccccugaacaagaauug

SEQ ID NO: 2373052 - RNA, 14 nt, Human
uggccccugaacaa

SEQ ID NO: 2373053 - RNA, 16 nt, Human
uggccccucugaccug

SEQ ID NO: 2373054 - RNA, 18 nt, Human
uggccccucugaccugca

SEQ ID NO: 2373055 - RNA, 21 nt, Human
uggccuccacaguucgaccug

SEQ ID NO: 2373056 - RNA, 17 nt, Human
uggccucagaauucaca

SEQ ID NO: 2373057 - RNA, 23 nt, Human
uggccucaacccucccucagccc

SEQ ID NO: 2373058 - RNA, 21 nt, Human
uggccucaagaucaaugaaau

SEQ ID NO: 2373059 - RNA, 22 nt, Human
uggccucaagaucaaugaaaug

SEQ ID NO: 2373060 - RNA, 11 nt, Human
uggccucccaa

SEQ ID NO: 2373061 - RNA, 14 nt, Human
uggccucccaacuc

SEQ ID NO: 2373062 - RNA, 18 nt, Human
uggccucaagugauucuc

SEQ ID NO: 2373063 - RNA, 23 nt, Human
uggccucaagugauucuccugcc

SEQ ID NO: 2373064 - RNA, 22 nt, Human
uggccucaacccucccucagcc

SEQ ID NO: 2373065 - RNA, 21 nt, Human
uggccucaacccucccucagc

SEQ ID NO: 2373066 - RNA, 13 nt, Human
uggccucaagauc

SEQ ID NO: 2373067 - RNA, 23 nt, Human
uggccuagcauacguacacauuu

SEQ ID NO: 2373068 - RNA, 19 nt, Human
uggccucccaacucacccc

SEQ ID NO: 2373069 - RNA, 20 nt, Human
uggccucccaacucacccca

SEQ ID NO: 2373070 - RNA, 21 nt, Human
uggccucccaacucaccccag

SEQ ID NO: 2373071 - RNA, 22 nt, Human
uggccucccaacucaccccagc

SEQ ID NO: 2373072 - RNA, 19 nt, Human
uggccucgggacaccugcc

SEQ ID NO: 2373073 - RNA, 21 nt, Human
uggccucuccuuguggccugg

SEQ ID NO: 2373074 - RNA, 14 nt, Human
uggccucgccuggc

SEQ ID NO: 2373075 - RNA, 15 nt, Human
uggccucgccuggcc

SEQ ID NO: 2373076 - RNA, 16 nt, Human
uggccucgccuggccu

SEQ ID NO: 2373077 - RNA, 17 nt, Human
uggccucgccuggccug

SEQ ID NO: 2373078 - RNA, 23 nt, Human
uggccucgggacaccugcccugc

SEQ ID NO: 2373079 - RNA, 12 nt, Human
uggccuccggcc

SEQ ID NO: 2373080 - RNA, 15 nt, Human
uggccuccggccucc

SEQ ID NO: 2373081 - RNA, 18 nt, Human
uggccuccggccuccccu

SEQ ID NO: 2373082 - RNA, 20 nt, Human
uggccucccaaaugagccau

SEQ ID NO: 2373083 - RNA, 19 nt, Human
uggccuccucccuuagcuc

SEQ ID NO: 2373084 - RNA, 19 nt, Human
uggccuccggcgucagccu

SEQ ID NO: 2373085 - RNA, 20 nt, Human
uggccuccggcgucagccuc

SEQ ID NO: 2373086 - RNA, 21 nt, Human
uggccuccggcgucagccucc

SEQ ID NO: 2373087 - RNA, 18 nt, Human
uggccuccucccuuagcu

SEQ ID NO: 2373088 - RNA, 12 nt, Human
ugggaaugaagc

SEQ ID NO: 2373089 - RNA, 13 nt, Human
ugggaaugaagcu

SEQ ID NO: 2373090 - RNA, 14 nt, Human
ugggaaugaagcuu

SEQ ID NO: 2373091 - RNA, 14 nt, Human
ugggaaugaagcaa

SEQ ID NO: 2373092 - RNA, 18 nt, Human
uggcuuuucacugcuggc

SEQ ID NO: 2373093 - RNA, 19 nt, Human
uggcuuuucacugcuggcu

SEQ ID NO: 2373094 - RNA, 21 nt, Human
uggcuuuucacugcuggcugc

SEQ ID NO: 2373095 - RNA, 22 nt, Human
uggcuuuucacugcuggcugcc

SEQ ID NO: 2373096 - RNA, 14 nt, Human
uggcuuguguguuu

SEQ ID NO: 2373097 - RNA, 16 nt, Human
uggcuuguguguuuca

SEQ ID NO: 2373098 - RNA, 18 nt, Human
uggcuuguguguuucacu

SEQ ID NO: 2373099 - RNA, 24 nt, Human
uggcuuguaucaacacuguuacuu

SEQ ID NO: 2373100 - RNA, 16 nt, Human
uggcuuuucacugcug

SEQ ID NO: 2373101 - RNA, 20 nt, Human
uggcuuguguguuucacuuu

SEQ ID NO: 2373102 - RNA, 19 nt, Human
uggcuuguguguuucacuu

SEQ ID NO: 2373103 - RNA, 17 nt, Human
uggcuuguaacuccacc

SEQ ID NO: 2373104 - RNA, 14 nt, Human
uggcuccucaaaca

SEQ ID NO: 2373105 - RNA, 14 nt, Human
uggcuggcugcagu

SEQ ID NO: 2373106 - RNA, 13 nt, Human
uggcuggcugcag

SEQ ID NO: 2373107 - RNA, 17 nt, Human
uggcuggcccgucaugu

SEQ ID NO: 2373108 - RNA, 15 nt, Human
uggcuggccacugca

SEQ ID NO: 2373109 - RNA, 22 nt, Human
uggcugcugaagcugccugcuu

SEQ ID NO: 2373110 - RNA, 22 nt, Human
uggcuggcuaacuggaagcaug

SEQ ID NO: 2373111 - RNA, 21 nt, Human
uggcuggccuuccacuuggcu

SEQ ID NO: 2373112 - RNA, 12 nt, Human
uggcugggcaug

SEQ ID NO: 2373113 - RNA, 12 nt, Human
uggcugggccca

SEQ ID NO: 2373114 - RNA, 21 nt, Human
uggcugggaacugcagaccug

SEQ ID NO: 2373115 - RNA, 23 nt, Human
uggcugggacguggcucagccag

SEQ ID NO: 2373116 - RNA, 19 nt, Human
uggcugggacguggcucag

SEQ ID NO: 2373117 - RNA, 15 nt, Human
uggcugggacguggc

SEQ ID NO: 2373118 - RNA, 15 nt, Human
uggcugggaacucac

SEQ ID NO: 2373119 - RNA, 23 nt, Human
uggcugggaacucaccuggggcu

SEQ ID NO: 2373120 - RNA, 17 nt, Human
uggcugggaacugcaga

SEQ ID NO: 2373121 - RNA, 22 nt, Human
uggcuuccuaaaauucagugga

SEQ ID NO: 2373122 - RNA, 22 nt, Human
uggcuucccgcucagcccuccc

SEQ ID NO: 2373123 - RNA, 17 nt, Human
uggcuugccacagcucu

SEQ ID NO: 2373124 - RNA, 15 nt, Human
uggcugggcccagaa

SEQ ID NO: 2373125 - RNA, 18 nt, Human
uggcuucccgcucagccc

SEQ ID NO: 2373126 - RNA, 19 nt, Human
uggcuucccgcucagcccu

SEQ ID NO: 2373127 - RNA, 20 nt, Human
uggcuucccgcucagcccuc

SEQ ID NO: 2373128 - RNA, 21 nt, Human
uggcuucccgcucagcccucc

SEQ ID NO: 2373129 - RNA, 18 nt, Human
uggccuugaaaccaccuu

SEQ ID NO: 2373130 - RNA, 18 nt, Human
uggccucugcaaaggaaa

SEQ ID NO: 2373131 - RNA, 13 nt, Human
uggccucugcacu

SEQ ID NO: 2373132 - RNA, 23 nt, Human
uggccuucggccuccauccugag

SEQ ID NO: 2373133 - RNA, 20 nt, Human
uggccuucggccuccauccu

SEQ ID NO: 2373134 - RNA, 22 nt, Human
uggccuucggccuccauccuga

SEQ ID NO: 2373135 - RNA, 15 nt, Human
uggcuccagucugcu

SEQ ID NO: 2373136 - RNA, 15 nt, Human
uggcuccaggccagg

SEQ ID NO: 2373137 - RNA, 23 nt, Human
uggcuccagucugcugcccucca

SEQ ID NO: 2373138 - RNA, 20 nt, Human
uggcuccagucugcugcccu

SEQ ID NO: 2373139 - RNA, 19 nt, Human
uggcuccagucugcugccc

SEQ ID NO: 2373140 - RNA, 20 nt, Human
uggcuccauugguguugaca

SEQ ID NO: 2373141 - RNA, 17 nt, Human
uggcuccagcuggccgg

SEQ ID NO: 2373142 - RNA, 23 nt, Human
uggcuccagaugcagggcaguca

SEQ ID NO: 2373143 - RNA, 13 nt, Human
uggcuccagcacc

SEQ ID NO: 2373144 - RNA, 21 nt, Human
uggcuccagcaccauccgcca

SEQ ID NO: 2373145 - RNA, 15 nt, Human
uggcuccagaaaugu

SEQ ID NO: 2373146 - RNA, 20 nt, Human
uggcuccagaaaugucuaaa

SEQ ID NO: 2373147 - RNA, 21 nt, Human
uggcuccagaugcagggcagu

SEQ ID NO: 2373148 - RNA, 20 nt, Human
uggcuccagaugcagggcag

SEQ ID NO: 2373149 - RNA, 23 nt, Human
uggcuccccucuauuuagcauga

SEQ ID NO: 2373150 - RNA, 23 nt, Human
uggcucccaugaccauacugagg

SEQ ID NO: 2373151 - RNA, 17 nt, Human
uggcucccauucacucu

SEQ ID NO: 2373152 - RNA, 18 nt, Human
uggcucccauucacucuu

SEQ ID NO: 2373153 - RNA, 14 nt, Human
uggcuccccucuau

SEQ ID NO: 2373154 - RNA, 13 nt, Human
uggcuccccucua

SEQ ID NO: 2373155 - RNA, 14 nt, Human
uggcucccucuugg

SEQ ID NO: 2373156 - RNA, 16 nt, Human
uggcuccuaucugugu

SEQ ID NO: 2373157 - RNA, 19 nt, Human
uggcuccgaacacccucga

SEQ ID NO: 2373158 - RNA, 21 nt, Human
uggcuccccucuauuuagcau

SEQ ID NO: 2373159 - RNA, 20 nt, Human
uggcucccggagggcccuga

SEQ ID NO: 2373160 - RNA, 11 nt, Human
uggcugcugaa

SEQ ID NO: 2373161 - RNA, 18 nt, Human
uggcuccuaucuguguuu

SEQ ID NO: 2373162 - RNA, 12 nt, Human
uggcugcugaag

SEQ ID NO: 2373163 - RNA, 15 nt, Human
uggcugcugaagcug

SEQ ID NO: 2373164 - RNA, 21 nt, Human
uggcugcugaagcugccugcu

SEQ ID NO: 2373165 - RNA, 13 nt, Human
uggcugcugaagg

SEQ ID NO: 2373166 - RNA, 14 nt, Human
uggcugcugaaggc

SEQ ID NO: 2373167 - RNA, 16 nt, Human
uggcugcugaaggcuc

SEQ ID NO: 2373168 - RNA, 13 nt, Human
uggggcagcacag

SEQ ID NO: 2373169 - RNA, 14 nt, Human
uggggcagcacaga

SEQ ID NO: 2373170 - RNA, 19 nt, Human
uggggcaagucccugacuc

SEQ ID NO: 2373171 - RNA, 18 nt, Human
uggggcaagauuuuccuu

SEQ ID NO: 2373172 - RNA, 12 nt, Human
uggggcaaggcu

SEQ ID NO: 2373173 - RNA, 22 nt, Human
uggggcagcacagagagggggc

SEQ ID NO: 2373174 - RNA, 16 nt, Human
uggggcagcacagaga

SEQ ID NO: 2373175 - RNA, 18 nt, Human
uggggcagcacagagagg

SEQ ID NO: 2373176 - RNA, 13 nt, Human
uggggcagcuuga

SEQ ID NO: 2373177 - RNA, 17 nt, Human
uggggauuucucccagc

SEQ ID NO: 2373178 - RNA, 15 nt, Human
uggggauuucuccca

SEQ ID NO: 2373179 - RNA, 17 nt, Human
ugggccugcuuccuguc

SEQ ID NO: 2373180 - RNA, 22 nt, Human
ugggcuuggggaccagagcugc

SEQ ID NO: 2373181 - RNA, 21 nt, Human
ugggcuugucuguagauuuua

SEQ ID NO: 2373182 - RNA, 17 nt, Human
ugggcuugucuguagau

SEQ ID NO: 2373183 - RNA, 23 nt, Human
ugggcuuggggaccagagcugcc

SEQ ID NO: 2373184 - RNA, 23 nt, Human
ugggccucaaggacuugaaagca

SEQ ID NO: 2373185 - RNA, 20 nt, Human
ugggccuccucacaacaugg

SEQ ID NO: 2373186 - RNA, 13 nt, Human
ugggccuccucac

SEQ ID NO: 2373187 - RNA, 16 nt, Human
ugggccucugguuugg

SEQ ID NO: 2373188 - RNA, 21 nt, Human
ugggccucugguuuggggcga

SEQ ID NO: 2373189 - RNA, 21 nt, Human
ugggccucuuggaaaaaguga

SEQ ID NO: 2373190 - RNA, 13 nt, Human
ugggccugcagaa

SEQ ID NO: 2373191 - RNA, 15 nt, Human
ugggccugcuccaga

SEQ ID NO: 2373192 - RNA, 14 nt, Human
ugggccugcuccag

SEQ ID NO: 2373193 - RNA, 20 nt, Human
ugggccugcuccagaccuga

SEQ ID NO: 2373194 - RNA, 19 nt, Human
ugggccugcuccagaccug

SEQ ID NO: 2373195 - RNA, 18 nt, Human
ugggccugcuccagaccu

SEQ ID NO: 2373196 - RNA, 16 nt, Human
ugggccugcuccagac

SEQ ID NO: 2373197 - RNA, 22 nt, Human
ugggcuucaguggcagcugcuu

SEQ ID NO: 2373198 - RNA, 21 nt, Human
ugggcuucaguggcagcugcu

SEQ ID NO: 2373199 - RNA, 22 nt, Human
ugggcuucauccuccucagauc

SEQ ID NO: 2373200 - RNA, 13 nt, Human
ugggccugcuucc

SEQ ID NO: 2373201 - RNA, 14 nt, Human
ugggccugcuuccu

SEQ ID NO: 2373202 - RNA, 15 nt, Human
ugggccugcuuccug

SEQ ID NO: 2373203 - RNA, 15 nt, Human
ugggcuucauccucc

SEQ ID NO: 2373204 - RNA, 14 nt, Human
uggggccacacaga

SEQ ID NO: 2373205 - RNA, 13 nt, Human
uggggccagaucc

SEQ ID NO: 2373206 - RNA, 17 nt, Human
uggggccacacagaaac

SEQ ID NO: 2373207 - RNA, 18 nt, Human
uggggccagauccagccu

SEQ ID NO: 2373208 - RNA, 16 nt, Human
uggggccagauccagc

SEQ ID NO: 2373209 - RNA, 15 nt, Human
uggggccagauccag

SEQ ID NO: 2373210 - RNA, 14 nt, Human
uggggccagaucca

SEQ ID NO: 2373211 - RNA, 17 nt, Human
uggggccaggcuggguc

SEQ ID NO: 2373212 - RNA, 20 nt, Human
uggggccagauccagccugg

SEQ ID NO: 2373213 - RNA, 19 nt, Human
uggggccagauccagccug

SEQ ID NO: 2373214 - RNA, 17 nt, Human
ugggggcagagggcaga

SEQ ID NO: 2373215 - RNA, 22 nt, Human
ugggggcaggagggcccuaccu

SEQ ID NO: 2373216 - RNA, 17 nt, Human
ugggggcagggcaugac

SEQ ID NO: 2373217 - RNA, 18 nt, Human
ugggggcagagggcagag

SEQ ID NO: 2373218 - RNA, 21 nt, Human
uggggccagauccagccuggg

SEQ ID NO: 2373219 - RNA, 16 nt, Human
ugggggccaugagcuc

SEQ ID NO: 2373220 - RNA, 13 nt, Human
ugggggccaugag

SEQ ID NO: 2373221 - RNA, 16 nt, Human
ugggggccucagugcc

SEQ ID NO: 2373222 - RNA, 14 nt, Human
ugggggccuggauu

SEQ ID NO: 2373223 - RNA, 17 nt, Human
uggggggccaacaccag

SEQ ID NO: 2373224 - RNA, 15 nt, Human
uggggggccaacacc

SEQ ID NO: 2373225 - RNA, 17 nt, Human
uggggggcuucauacac

SEQ ID NO: 2373226 - RNA, 19 nt, Human
uggggggcugaggugggag

SEQ ID NO: 2373227 - RNA, 16 nt, Human
ugggggcuggugccag

SEQ ID NO: 2373228 - RNA, 13 nt, Human
ugggggcuggugc

SEQ ID NO: 2373229 - RNA, 15 nt, Human
ugggggcuggugcca

SEQ ID NO: 2373230 - RNA, 20 nt, Human
ugggguucguggaaagggug

SEQ ID NO: 2373231 - RNA, 16 nt, Human
ugggguugcaaccacu

SEQ ID NO: 2373232 - RNA, 14 nt, Human
ugggguucguggaa

SEQ ID NO: 2373233 - RNA, 22 nt, Human
ugggguucagccccuccucugc

SEQ ID NO: 2373234 - RNA, 21 nt, Human
ugggguucagccccuccucug

SEQ ID NO: 2373235 - RNA, 19 nt, Human
ugggguucagccccuccuc

SEQ ID NO: 2373236 - RNA, 17 nt, Human
ugggguucagccccucc

SEQ ID NO: 2373237 - RNA, 15 nt, Human
ugggguucagccccu

SEQ ID NO: 2373238 - RNA, 14 nt, Human
ugggguucagcccc

SEQ ID NO: 2373239 - RNA, 21 nt, Human
ugggguguguuccaacugccc

SEQ ID NO: 2373240 - RNA, 19 nt, Human
ugggguuaucucuguguua

SEQ ID NO: 2373241 - RNA, 15 nt, Human
uggggugugggaggc

SEQ ID NO: 2373242 - RNA, 18 nt, Human
ugggguuaucucuguguu

SEQ ID NO: 2373243 - RNA, 13 nt, Human
uggggugugcugg

SEQ ID NO: 2373244 - RNA, 15 nt, Human
uggggugugcuggga

SEQ ID NO: 2373245 - RNA, 21 nt, Human
uggggggccaacaccagggau

SEQ ID NO: 2373246 - RNA, 15 nt, Human
ugggguggguauaaa

SEQ ID NO: 2373247 - RNA, 19 nt, Human
ugggguggguauaaaagau

SEQ ID NO: 2373248 - RNA, 16 nt, Human
ugggcaggaccucaga

SEQ ID NO: 2373249 - RNA, 17 nt, Human
ugggcaggacucagcuc

SEQ ID NO: 2373250 - RNA, 18 nt, Human
ugggcaggacucagcucc

SEQ ID NO: 2373251 - RNA, 21 nt, Human
ugggcaggacucagcucccca

SEQ ID NO: 2373252 - RNA, 13 nt, Human
ugggcaggaccuc

SEQ ID NO: 2373253 - RNA, 23 nt, Human
ugggcaggaagugaagagauccu

SEQ ID NO: 2373254 - RNA, 13 nt, Human
ugggcaggaaaag

SEQ ID NO: 2373255 - RNA, 10 nt, Human
ugggcagcuc

SEQ ID NO: 2373256 - RNA, 19 nt, Human
ugggcagcucaucucuguc

SEQ ID NO: 2373257 - RNA, 19 nt, Human
ugggcagcgcccuuccucu

SEQ ID NO: 2373258 - RNA, 20 nt, Human
ugggcagcgcccuuccucuc

SEQ ID NO: 2373259 - RNA, 21 nt, Human
ugggcagcgcccuuccucucc

SEQ ID NO: 2373260 - RNA, 22 nt, Human
ugggcagcuaccauuucccuuu

SEQ ID NO: 2373261 - RNA, 16 nt, Human
ugggccucaaggacuu

SEQ ID NO: 2373262 - RNA, 14 nt, Human
ugggccgcugccac

SEQ ID NO: 2373263 - RNA, 21 nt, Human
ugggccggcuucaugccagcu

SEQ ID NO: 2373264 - RNA, 13 nt, Human
ugggcccuuugag

SEQ ID NO: 2373265 - RNA, 13 nt, Human
ugggccgcugcca

SEQ ID NO: 2373266 - RNA, 14 nt, Human
ugggcccugggcug

SEQ ID NO: 2373267 - RNA, 16 nt, Human
ugggcccugggcugga

SEQ ID NO: 2373268 - RNA, 17 nt, Human
ugggcccugggcuggaa

SEQ ID NO: 2373269 - RNA, 22 nt, Human
ugggcaggacucagcuccccag

SEQ ID NO: 2373270 - RNA, 16 nt, Human
ugggcagccaggcugc

SEQ ID NO: 2373271 - RNA, 13 nt, Human
ugggcagcgcccu

SEQ ID NO: 2373272 - RNA, 17 nt, Human
ugggcagcgcccuuccu

SEQ ID NO: 2373273 - RNA, 15 nt, Human
ugggcagccaggcug

SEQ ID NO: 2373274 - RNA, 14 nt, Human
ugggcagccaggcu

SEQ ID NO: 2373275 - RNA, 18 nt, Human
ugggcagcauagcaagac

SEQ ID NO: 2373276 - RNA, 16 nt, Human
ugggcagcauagcaag

SEQ ID NO: 2373277 - RNA, 14 nt, Human
ugggauggaggaga

SEQ ID NO: 2373278 - RNA, 16 nt, Human
ugggauggaggagaag

SEQ ID NO: 2373279 - RNA, 13 nt, Human
ugggauggaggag

SEQ ID NO: 2373280 - RNA, 20 nt, Human
ugggaugcuugccuagggcc

SEQ ID NO: 2373281 - RNA, 17 nt, Human
ugggaugguggagggcc

SEQ ID NO: 2373282 - RNA, 16 nt, Human
ugggaugguggagggc

SEQ ID NO: 2373283 - RNA, 14 nt, Human
ugggcagagcagag

SEQ ID NO: 2373284 - RNA, 15 nt, Human
ugggcagagcagaga

SEQ ID NO: 2373285 - RNA, 17 nt, Human
ugggcagagcagagacc

SEQ ID NO: 2373286 - RNA, 16 nt, Human
ugggaggaucucuuga

SEQ ID NO: 2373287 - RNA, 21 nt, Human
ugggaaugaagcuuguguauc

SEQ ID NO: 2373288 - RNA, 15 nt, Human
ugggaaugaagcuug

SEQ ID NO: 2373289 - RNA, 18 nt, Human
ugggaaugaagcuugugu

SEQ ID NO: 2373290 - RNA, 19 nt, Human
ugggaaugaagcuugugua

SEQ ID NO: 2373291 - RNA, 20 nt, Human
ugggaaugaagcuuguguau

SEQ ID NO: 2373292 - RNA, 14 nt, Human
ugggacagggagga

SEQ ID NO: 2373293 - RNA, 16 nt, Human
ugggaaugaaugucag

SEQ ID NO: 2373294 - RNA, 21 nt, Human
ugggaaugaaugucaguguga

SEQ ID NO: 2373295 - RNA, 14 nt, Human
ugggacacccugug

SEQ ID NO: 2373296 - RNA, 15 nt, Human
ugggacacccuguga

SEQ ID NO: 2373297 - RNA, 23 nt, Human
ugggauaaagaugcaaggaccag

SEQ ID NO: 2373298 - RNA, 20 nt, Human
ugggaguuuuguauucaucu

SEQ ID NO: 2373299 - RNA, 15 nt, Human
ugggaggagggagag

SEQ ID NO: 2373300 - RNA, 18 nt, Human
ugggaggagggagaggga

SEQ ID NO: 2373301 - RNA, 22 nt, Human
ugggaguugaucgccuuuccca

SEQ ID NO: 2373302 - RNA, 19 nt, Human
ugggaggagggagagggag

SEQ ID NO: 2373303 - RNA, 19 nt, Human
ugggaugcuugccuagggc

SEQ ID NO: 2373304 - RNA, 14 nt, Human
ugggaugcuugccu

SEQ ID NO: 2373305 - RNA, 16 nt, Human
ugggaugagccgcugu

SEQ ID NO: 2373306 - RNA, 18 nt, Human
ugggaugauuggaggggg

SEQ ID NO: 2373307 - RNA, 16 nt, Human
ugggauacugcagggc

SEQ ID NO: 2373308 - RNA, 21 nt, Human
ugggauaggaaaaaugaguaa

SEQ ID NO: 2373309 - RNA, 13 nt, Human
ugggauaggaaaa

SEQ ID NO: 2373310 - RNA, 19 nt, Human
ugggaugagaguuuuggau

SEQ ID NO: 2373311 - RNA, 23 nt, Human
ugggaucugccccucccugcuuc

SEQ ID NO: 2373312 - RNA, 19 nt, Human
ugggaucugccccucccug

SEQ ID NO: 2373313 - RNA, 20 nt, Human
ugggauauaagaggcagcgu

SEQ ID NO: 2373314 - RNA, 17 nt, Human
ugucacagggacugaaa

SEQ ID NO: 2373315 - RNA, 13 nt, Human
ugucacaggcagg

SEQ ID NO: 2373316 - RNA, 20 nt, Human
ugucacaugaaacauuugca

SEQ ID NO: 2373317 - RNA, 11 nt, Human
ugucacagggc

SEQ ID NO: 2373318 - RNA, 12 nt, Human
ugucacagggcc

SEQ ID NO: 2373319 - RNA, 13 nt, Human
ugucacagggcca

SEQ ID NO: 2373320 - RNA, 14 nt, Human
ugucacagggccaa

SEQ ID NO: 2373321 - RNA, 21 nt, Human
ugucacugguagaccaaaaua

SEQ ID NO: 2373322 - RNA, 12 nt, Human
ugucacuguggu

SEQ ID NO: 2373323 - RNA, 15 nt, Human
ugucacugugguccu

SEQ ID NO: 2373324 - RNA, 23 nt, Human
ugucacugguagaccaaaauaaa

SEQ ID NO: 2373325 - RNA, 13 nt, Human
ugucacuggcugc

SEQ ID NO: 2373326 - RNA, 14 nt, Human
ugucacuggcugcc

SEQ ID NO: 2373327 - RNA, 16 nt, Human
ugucacuggcugccuc

SEQ ID NO: 2373328 - RNA, 17 nt, Human
ugucacuggcugccucc

SEQ ID NO: 2373329 - RNA, 18 nt, Human
ugucacuggcugccucca

SEQ ID NO: 2373330 - RNA, 19 nt, Human
ugucacuggcugccuccac

SEQ ID NO: 2373331 - RNA, 21 nt, Human
ugucacuggcugccuccacuc

SEQ ID NO: 2373332 - RNA, 22 nt, Human
ugucacuggcugccuccacucc

SEQ ID NO: 2373333 - RNA, 15 nt, Human
ugucacaggcagguc

SEQ ID NO: 2373334 - RNA, 16 nt, Human
ugucacaggcaggucc

SEQ ID NO: 2373335 - RNA, 17 nt, Human
ugucacaggcaggucca

SEQ ID NO: 2373336 - RNA, 21 nt, Human
ugucacaggcagguccagggu

SEQ ID NO: 2373337 - RNA, 18 nt, Human
ugucacuguuucucugcu

SEQ ID NO: 2373338 - RNA, 14 nt, Human
ugucacuuacuguu

SEQ ID NO: 2373339 - RNA, 21 nt, Human
ugucacuuacuguuucuguca

SEQ ID NO: 2373340 - RNA, 17 nt, Human
ugucacuguuucucugc

SEQ ID NO: 2373341 - RNA, 13 nt, Human
ugucacuguuucu

SEQ ID NO: 2373342 - RNA, 22 nt, Human
ugucacuucgcgugcccucgcu

SEQ ID NO: 2373343 - RNA, 14 nt, Human
ugucacuuugcucu

SEQ ID NO: 2373344 - RNA, 15 nt, Human
ugucacuuugcucug

SEQ ID NO: 2373345 - RNA, 15 nt, Human
ugucagugugacuga

SEQ ID NO: 2373346 - RNA, 14 nt, Human
ugucagugugacug

SEQ ID NO: 2373347 - RNA, 16 nt, Human
ugucagugugacugau

SEQ ID NO: 2373348 - RNA, 19 nt, Human
ugucagugugacugaucuc

SEQ ID NO: 2373349 - RNA, 21 nt, Human
ugucaucagccaccauccuau

SEQ ID NO: 2373350 - RNA, 15 nt, Human
ugucaucagccacca

SEQ ID NO: 2373351 - RNA, 18 nt, Human
ugucaucagccaccaucc

SEQ ID NO: 2373352 - RNA, 16 nt, Human
ugucacuuugcucugg

SEQ ID NO: 2373353 - RNA, 17 nt, Human
ugucacuuugcucuggg

SEQ ID NO: 2373354 - RNA, 18 nt, Human
ugucaucauuguauauau

SEQ ID NO: 2373355 - RNA, 19 nt, Human
ugucaucauuguauauaug

SEQ ID NO: 2373356 - RNA, 22 nt, Human
ugucaucauuguauauaugugu

SEQ ID NO: 2373357 - RNA, 12 nt, Human
uguaugcuggac

SEQ ID NO: 2373358 - RNA, 18 nt, Human
uguauggaaauaaaugua

SEQ ID NO: 2373359 - RNA, 17 nt, Human
uguauggaauacagugu

SEQ ID NO: 2373360 - RNA, 16 nt, Human
uguauggaauacagug

SEQ ID NO: 2373361 - RNA, 23 nt, Human
uguauggaaauaaauguaucaua

SEQ ID NO: 2373362 - RNA, 19 nt, Human
uguauggaauacaguguua

SEQ ID NO: 2373363 - RNA, 18 nt, Human
uguauggaauacaguguu

SEQ ID NO: 2373364 - RNA, 17 nt, Human
uguauggagagaaaaca

SEQ ID NO: 2373365 - RNA, 14 nt, Human
uguaugggcaaaaa

SEQ ID NO: 2373366 - RNA, 16 nt, Human
uguauggauaguaaaa

SEQ ID NO: 2373367 - RNA, 21 nt, Human
uguauggauaguaaaauucua

SEQ ID NO: 2373368 - RNA, 14 nt, Human
uguauguaaaugug

SEQ ID NO: 2373369 - RNA, 15 nt, Human
uguauguaaaugugc

SEQ ID NO: 2373370 - RNA, 22 nt, Human
uguauguaaaugugcauucuuu

SEQ ID NO: 2373371 - RNA, 10 nt, Human
uguauguaaa

SEQ ID NO: 2373372 - RNA, 23 nt, Human
uguauggguguguguuuguguga

SEQ ID NO: 2373373 - RNA, 15 nt, Human
uguaugguucugugc

SEQ ID NO: 2373374 - RNA, 15 nt, Human
uguaugggcaaaaaa

SEQ ID NO: 2373375 - RNA, 20 nt, Human
uguaugccaagugagaagau

SEQ ID NO: 2373376 - RNA, 12 nt, Human
uguaugccuuua

SEQ ID NO: 2373377 - RNA, 21 nt, Human
uguaugccuuuaaaucuguga

SEQ ID NO: 2373378 - RNA, 18 nt, Human
uguaugccaagugagaag

SEQ ID NO: 2373379 - RNA, 16 nt, Human
uguaugccaagugaga

SEQ ID NO: 2373380 - RNA, 13 nt, Human
uguaugcgugugu

SEQ ID NO: 2373381 - RNA, 22 nt, Human
uguaugccuuuaaaucugugau

SEQ ID NO: 2373382 - RNA, 23 nt, Human
uguaugccuuuaaaucugugaug

SEQ ID NO: 2373383 - RNA, 19 nt, Human
uguaugcuucauacaggga

SEQ ID NO: 2373384 - RNA, 16 nt, Human
uguaugcuucauacag

SEQ ID NO: 2373385 - RNA, 14 nt, Human
uguaugcuucauac

SEQ ID NO: 2373386 - RNA, 13 nt, Human
uguaugcuucaua

SEQ ID NO: 2373387 - RNA, 21 nt, Human
ugucacaauccuaacacauua

SEQ ID NO: 2373388 - RNA, 19 nt, Human
ugucacaauccuaacacau

SEQ ID NO: 2373389 - RNA, 14 nt, Human
ugucacaauccuaa

SEQ ID NO: 2373390 - RNA, 13 nt, Human
ugucacacacuuu

SEQ ID NO: 2373391 - RNA, 14 nt, Human
ugucacaggcaggu

SEQ ID NO: 2373392 - RNA, 21 nt, Human
ugucaauuacaggaaguacug

SEQ ID NO: 2373393 - RNA, 19 nt, Human
ugucaauuucccugacucc

SEQ ID NO: 2373394 - RNA, 23 nt, Human
ugucaauuucccugacuccucua

SEQ ID NO: 2373395 - RNA, 15 nt, Human
ugucaauuucugugu

SEQ ID NO: 2373396 - RNA, 16 nt, Human
ugucaauuucuguguu

SEQ ID NO: 2373397 - RNA, 12 nt, Human
uguauguauaau

SEQ ID NO: 2373398 - RNA, 14 nt, Human
uguauuuguuugca

SEQ ID NO: 2373399 - RNA, 15 nt, Human
uguauuuguuugcau

SEQ ID NO: 2373400 - RNA, 14 nt, Human
uguauuuuaacuca

SEQ ID NO: 2373401 - RNA, 15 nt, Human
uguauuuuaacucau

SEQ ID NO: 2373402 - RNA, 19 nt, Human
uguauuuuacuaauaaaau

SEQ ID NO: 2373403 - RNA, 18 nt, Human
uguauuuuaaaagaauga

SEQ ID NO: 2373404 - RNA, 19 nt, Human
uguauuuuaaaagaaugau

SEQ ID NO: 2373405 - RNA, 21 nt, Human
uguauaguacuggcaugguac

SEQ ID NO: 2373406 - RNA, 19 nt, Human
uguaucuaugcauuuucug

SEQ ID NO: 2373407 - RNA, 17 nt, Human
uguaucucugaagcaug

SEQ ID NO: 2373408 - RNA, 18 nt, Human
uguaucucugaagcaugu

SEQ ID NO: 2373409 - RNA, 19 nt, Human
uguaucucugaagcauguu

SEQ ID NO: 2373410 - RNA, 21 nt, Human
uguaucucugaagcauguuuc

SEQ ID NO: 2373411 - RNA, 22 nt, Human
uguaucucugaagcauguuuca

SEQ ID NO: 2373412 - RNA, 13 nt, Human
uguaucugagcag

SEQ ID NO: 2373413 - RNA, 17 nt, Human
uguaucugcaggcagac

SEQ ID NO: 2373414 - RNA, 18 nt, Human
uguaucugcaggcagaca

SEQ ID NO: 2373415 - RNA, 19 nt, Human
uguaucugcaggcagacac

SEQ ID NO: 2373416 - RNA, 20 nt, Human
uguaucugcaggcagacacg

SEQ ID NO: 2373417 - RNA, 18 nt, Human
uguaucugaaggagauuu

SEQ ID NO: 2373418 - RNA, 23 nt, Human
uguaucucugaagcauguuucau

SEQ ID NO: 2373419 - RNA, 22 nt, Human
uguaucugaaggagauuuuccu

SEQ ID NO: 2373420 - RNA, 20 nt, Human
uguaucugauagcucuuugg

SEQ ID NO: 2373421 - RNA, 21 nt, Human
uguaucuugggggacagggcu

SEQ ID NO: 2373422 - RNA, 21 nt, Human
uguaucugcaggcagacacgg

SEQ ID NO: 2373423 - RNA, 22 nt, Human
uguaucugcaggcagacacgga

SEQ ID NO: 2373424 - RNA, 22 nt, Human
uguaugaaagauggcugugccu

SEQ ID NO: 2373425 - RNA, 21 nt, Human
uguaugacuaaagagagaaug

SEQ ID NO: 2373426 - RNA, 17 nt, Human
uguaugacugcacauga

SEQ ID NO: 2373427 - RNA, 20 nt, Human
uguaugacuaaagagagaau

SEQ ID NO: 2373428 - RNA, 16 nt, Human
uguaugacuaaagaga

SEQ ID NO: 2373429 - RNA, 16 nt, Human
uguaugacugcacaug

SEQ ID NO: 2373430 - RNA, 15 nt, Human
uguaugacuaaagag

SEQ ID NO: 2373431 - RNA, 14 nt, Human
uguaugacuaaaga

SEQ ID NO: 2373432 - RNA, 22 nt, Human
uguaucuugggggacagggcug

SEQ ID NO: 2373433 - RNA, 19 nt, Human
uguauagaugcaagauauu

SEQ ID NO: 2373434 - RNA, 20 nt, Human
uguauagaugcaagauauuu

SEQ ID NO: 2373435 - RNA, 23 nt, Human
uguauaguaaagugauaauuucu

SEQ ID NO: 2373436 - RNA, 15 nt, Human
uguauaguacuggca

SEQ ID NO: 2373437 - RNA, 16 nt, Human
uguauagguagauguu

SEQ ID NO: 2373438 - RNA, 14 nt, Human
uguauaaguaagaa

SEQ ID NO: 2373439 - RNA, 18 nt, Human
uguauagaugcaagauau

SEQ ID NO: 2373440 - RNA, 18 nt, Human
uguauaaauaggagagga

SEQ ID NO: 2373441 - RNA, 21 nt, Human
uguauaaaucuuucuuuugau

SEQ ID NO: 2373442 - RNA, 13 nt, Human
uguauaaagaaca

SEQ ID NO: 2373443 - RNA, 14 nt, Human
uguauaaauaggag

SEQ ID NO: 2373444 - RNA, 19 nt, Human
uguauaaagcaacuguuau

SEQ ID NO: 2373445 - RNA, 23 nt, Human
uguauaaagcaacuguuaugaaa

SEQ ID NO: 2373446 - RNA, 14 nt, Human
uguauaaauuuauu

SEQ ID NO: 2373447 - RNA, 14 nt, Human
uguauaacagguua

SEQ ID NO: 2373448 - RNA, 15 nt, Human
uguauaacagguuau

SEQ ID NO: 2373449 - RNA, 17 nt, Human
uguauaacagguuauuu

SEQ ID NO: 2373450 - RNA, 21 nt, Human
uguauaacagguuauuuuagu

SEQ ID NO: 2373451 - RNA, 18 nt, Human
uguauaacuucuuaaaag

SEQ ID NO: 2373452 - RNA, 21 nt, Human
uguauaacuucuuaaaaguug

SEQ ID NO: 2373453 - RNA, 22 nt, Human
uguauaagauuagaaugaaaau

SEQ ID NO: 2373454 - RNA, 19 nt, Human
uguacagaugaaugauaaa

SEQ ID NO: 2373455 - RNA, 23 nt, Human
uguacagcaaggagauuuacaac

SEQ ID NO: 2373456 - RNA, 15 nt, Human
uguagcuuugcucuu

SEQ ID NO: 2373457 - RNA, 13 nt, Human
uguagcuuugcuc

SEQ ID NO: 2373458 - RNA, 12 nt, Human
uguagcuuugcu

SEQ ID NO: 2373459 - RNA, 22 nt, Human
uguacagcaaggagauuuacaa

SEQ ID NO: 2373460 - RNA, 21 nt, Human
uguacagagcccacgccccca

SEQ ID NO: 2373461 - RNA, 12 nt, Human
uguacagagccc

SEQ ID NO: 2373462 - RNA, 19 nt, Human
uguaggaagaguagcauuu

SEQ ID NO: 2373463 - RNA, 21 nt, Human
uguaggaagaguagcauuuca

SEQ ID NO: 2373464 - RNA, 23 nt, Human
uguaggaagaguagcauuucauu

SEQ ID NO: 2373465 - RNA, 19 nt, Human
uguaguguuggagaagaac

SEQ ID NO: 2373466 - RNA, 20 nt, Human
uguaguguuggagaagaacu

SEQ ID NO: 2373467 - RNA, 21 nt, Human
uguaguguuggagaagaacug

SEQ ID NO: 2373468 - RNA, 14 nt, Human
uguauaaaaucagc

SEQ ID NO: 2373469 - RNA, 16 nt, Human
uguauaaaaucagcca

SEQ ID NO: 2373470 - RNA, 14 nt, Human
uguauaaaauaauu

SEQ ID NO: 2373471 - RNA, 13 nt, Human
uguauaaaauaau

SEQ ID NO: 2373472 - RNA, 17 nt, Human
uguccuccaagccagcg

SEQ ID NO: 2373473 - RNA, 23 nt, Human
uguccuccaacaccaagcacagc

SEQ ID NO: 2373474 - RNA, 17 nt, Human
uguccuccagaagccuc

SEQ ID NO: 2373475 - RNA, 16 nt, Human
uguccuccagaagccu

SEQ ID NO: 2373476 - RNA, 21 nt, Human
uguccuccagaagccucuggc

SEQ ID NO: 2373477 - RNA, 20 nt, Human
uguccuccagaagccucugg

SEQ ID NO: 2373478 - RNA, 19 nt, Human
uguccuccagaagccucug

SEQ ID NO: 2373479 - RNA, 18 nt, Human
uguccuccagaagccucu

SEQ ID NO: 2373480 - RNA, 14 nt, Human
uguccucaccacau

SEQ ID NO: 2373481 - RNA, 20 nt, Human
uguccucacggugccuuuuu

SEQ ID NO: 2373482 - RNA, 22 nt, Human
uguccucacggugccuuuuuuc

SEQ ID NO: 2373483 - RNA, 14 nt, Human
uguccucacugcuc

SEQ ID NO: 2373484 - RNA, 15 nt, Human
uguccucacugcucc

SEQ ID NO: 2373485 - RNA, 14 nt, Human
uguccucagcagcu

SEQ ID NO: 2373486 - RNA, 19 nt, Human
uguccucacugcucccuga

SEQ ID NO: 2373487 - RNA, 22 nt, Human
uguccucacugcucccugaagc

SEQ ID NO: 2373488 - RNA, 13 nt, Human
uguccucccaucc

SEQ ID NO: 2373489 - RNA, 23 nt, Human
uguccuccagaagccucuggcua

SEQ ID NO: 2373490 - RNA, 22 nt, Human
uguccuccagaagccucuggcu

SEQ ID NO: 2373491 - RNA, 14 nt, Human
uguccuccccuugg

SEQ ID NO: 2373492 - RNA, 23 nt, Human
uguccucccauccccuggacugg

SEQ ID NO: 2373493 - RNA, 17 nt, Human
uguccucccauccccug

SEQ ID NO: 2373494 - RNA, 18 nt, Human
uguccucccauccccugg

SEQ ID NO: 2373495 - RNA, 19 nt, Human
uguccucccauccccugga

SEQ ID NO: 2373496 - RNA, 22 nt, Human
uguccucccauccccuggacug

SEQ ID NO: 2373497 - RNA, 17 nt, Human
uguccugaccugucuca

SEQ ID NO: 2373498 - RNA, 21 nt, Human
uguccugacuucaggggcugc

SEQ ID NO: 2373499 - RNA, 22 nt, Human
uguccugacuucaggggcugcc

SEQ ID NO: 2373500 - RNA, 16 nt, Human
uguccugaccacccuc

SEQ ID NO: 2373501 - RNA, 17 nt, Human
uguccugaccacccucc

SEQ ID NO: 2373502 - RNA, 19 nt, Human
uguccugaccacccucccc

SEQ ID NO: 2373503 - RNA, 20 nt, Human
uguccugaccacccuccccu

SEQ ID NO: 2373504 - RNA, 21 nt, Human
uguccugaccacccuccccuc

SEQ ID NO: 2373505 - RNA, 22 nt, Human
uguccugaccacccuccccucu

SEQ ID NO: 2373506 - RNA, 23 nt, Human
uguccugaccacccuccccucuc

SEQ ID NO: 2373507 - RNA, 13 nt, Human
ugucaucucagcu

SEQ ID NO: 2373508 - RNA, 17 nt, Human
uguccccgcacugggcu

SEQ ID NO: 2373509 - RNA, 19 nt, Human
uguccccgcacugggcuug

SEQ ID NO: 2373510 - RNA, 23 nt, Human
uguccccuauggggaugguccac

SEQ ID NO: 2373511 - RNA, 16 nt, Human
uguccccggccucagc

SEQ ID NO: 2373512 - RNA, 13 nt, Human
uguccccuauccu

SEQ ID NO: 2373513 - RNA, 15 nt, Human
ugucaucucagugcu

SEQ ID NO: 2373514 - RNA, 20 nt, Human
uguccuaggaguauccucau

SEQ ID NO: 2373515 - RNA, 18 nt, Human
uguccccuccacugucac

SEQ ID NO: 2373516 - RNA, 13 nt, Human
uguccccucagcu

SEQ ID NO: 2373517 - RNA, 14 nt, Human
uguccccucagcuc

SEQ ID NO: 2373518 - RNA, 22 nt, Human
uguccuaugggagucaagugug

SEQ ID NO: 2373519 - RNA, 12 nt, Human
ugucuacagaga

SEQ ID NO: 2373520 - RNA, 19 nt, Human
ugucuacagagaaccugga

SEQ ID NO: 2373521 - RNA, 22 nt, Human
ugucuacacuaagagagaauga

SEQ ID NO: 2373522 - RNA, 19 nt, Human
ugucuaauguauuuuauug

SEQ ID NO: 2373523 - RNA, 17 nt, Human
ugucuacacuaagagag

SEQ ID NO: 2373524 - RNA, 14 nt, Human
ugucuaaugaaacc

SEQ ID NO: 2373525 - RNA, 20 nt, Human
uguccuggugcucucugcca

SEQ ID NO: 2373526 - RNA, 22 nt, Human
ugucuaaggucacacaguauua

SEQ ID NO: 2373527 - RNA, 13 nt, Human
ugucuaauguauu

SEQ ID NO: 2373528 - RNA, 17 nt, Human
ugucuaauguauuuuau

SEQ ID NO: 2373529 - RNA, 18 nt, Human
ugucuaauguauuuuauu

SEQ ID NO: 2373530 - RNA, 17 nt, Human
uguccugggccugcaga

SEQ ID NO: 2373531 - RNA, 10 nt, Human
uguccugggc

SEQ ID NO: 2373532 - RNA, 11 nt, Human
uguccugggcg

SEQ ID NO: 2373533 - RNA, 15 nt, Human
uguccugggccugca

SEQ ID NO: 2373534 - RNA, 14 nt, Human
uguccugggccugc

SEQ ID NO: 2373535 - RNA, 16 nt, Human
uguccugggcgcccug

SEQ ID NO: 2373536 - RNA, 17 nt, Human
uguccugggcgcccugg

SEQ ID NO: 2373537 - RNA, 18 nt, Human
uguccugggcgcccugga

SEQ ID NO: 2373538 - RNA, 13 nt, Human
uguccugggcugg

SEQ ID NO: 2373539 - RNA, 17 nt, Human
uguccugggcugguggc

SEQ ID NO: 2373540 - RNA, 13 nt, Human
uguccuggugcuc

SEQ ID NO: 2373541 - RNA, 16 nt, Human
uguccuggugcucucu

SEQ ID NO: 2373542 - RNA, 19 nt, Human
uguccuggugcucucugcc

SEQ ID NO: 2373543 - RNA, 12 nt, Human
uguccugggagu

SEQ ID NO: 2373544 - RNA, 14 nt, Human
uguccugcuccaca

SEQ ID NO: 2373545 - RNA, 15 nt, Human
uguccugcuccacag

SEQ ID NO: 2373546 - RNA, 16 nt, Human
uguccugcuccacagu

SEQ ID NO: 2373547 - RNA, 17 nt, Human
uguccugcuccacagug

SEQ ID NO: 2373548 - RNA, 18 nt, Human
uguccugcuccacagugu

SEQ ID NO: 2373549 - RNA, 12 nt, Human
uguccugcuggu

SEQ ID NO: 2373550 - RNA, 19 nt, Human
uguccugggagugagcugg

SEQ ID NO: 2373551 - RNA, 20 nt, Human
uguccugggagugagcuggu

SEQ ID NO: 2373552 - RNA, 22 nt, Human
uguccugccuaaggcugaacuu

SEQ ID NO: 2373553 - RNA, 19 nt, Human
uguccugccugucugaagc

SEQ ID NO: 2373554 - RNA, 19 nt, Human
uguccugauggucagcucc

SEQ ID NO: 2373555 - RNA, 20 nt, Human
uguccugauggucagcuccc

SEQ ID NO: 2373556 - RNA, 21 nt, Human
uguccugauggucagcucccu

SEQ ID NO: 2373557 - RNA, 18 nt, Human
uguccugauggucagcuc

SEQ ID NO: 2373558 - RNA, 21 nt, Human
ugucugagugaaccuguauaa

SEQ ID NO: 2373559 - RNA, 20 nt, Human
ugucugagugaaccuguaua

SEQ ID NO: 2373560 - RNA, 17 nt, Human
ugucugagugaaccugu

SEQ ID NO: 2373561 - RNA, 16 nt, Human
ugucugaucugugcuu

SEQ ID NO: 2373562 - RNA, 15 nt, Human
ugucugaucugugcu

SEQ ID NO: 2373563 - RNA, 20 nt, Human
ugucugaucugugcuuucca

SEQ ID NO: 2373564 - RNA, 23 nt, Human
ugucugaucugugcuuuccagcu

SEQ ID NO: 2373565 - RNA, 19 nt, Human
ugucugauuggcucaccca

SEQ ID NO: 2373566 - RNA, 16 nt, Human
ugucugcacccagggg

SEQ ID NO: 2373567 - RNA, 20 nt, Human
ugucugaagucacugcacag

SEQ ID NO: 2373568 - RNA, 15 nt, Human
ugucugagugaaccu

SEQ ID NO: 2373569 - RNA, 14 nt, Human
ugucugagugaacc

SEQ ID NO: 2373570 - RNA, 18 nt, Human
ugucugagcccucaaagu

SEQ ID NO: 2373571 - RNA, 20 nt, Human
ugucugagcccucaaaguga

SEQ ID NO: 2373572 - RNA, 18 nt, Human
ugucugagaguuuaguug

SEQ ID NO: 2373573 - RNA, 16 nt, Human
ugucugagaugcuggu

SEQ ID NO: 2373574 - RNA, 17 nt, Human
ugucugagcccucaaag

SEQ ID NO: 2373575 - RNA, 12 nt, Human
ugucugugugca

SEQ ID NO: 2373576 - RNA, 21 nt, Human
ugucugugugcaagugugugc

SEQ ID NO: 2373577 - RNA, 11 nt, Human
ugucugugcua

SEQ ID NO: 2373578 - RNA, 21 nt, Human
ugucugugcuagggaaacuuc

SEQ ID NO: 2373579 - RNA, 13 nt, Human
ugucuguucuaca

SEQ ID NO: 2373580 - RNA, 19 nt, Human
ugucuguuaccaugucacu

SEQ ID NO: 2373581 - RNA, 22 nt, Human
ugucuguuaccaugucacugug

SEQ ID NO: 2373582 - RNA, 11 nt, Human
ugucuguuaca

SEQ ID NO: 2373583 - RNA, 12 nt, Human
ugucuguuacac

SEQ ID NO: 2373584 - RNA, 17 nt, Human
ugucuguuacacuggag

SEQ ID NO: 2373585 - RNA, 14 nt, Human
ugucugcacccagg

SEQ ID NO: 2373586 - RNA, 15 nt, Human
ugucugcacccaggg

SEQ ID NO: 2373587 - RNA, 12 nt, Human
ugucuuaauuaa

SEQ ID NO: 2373588 - RNA, 23 nt, Human
ugucuuuggacccugaggcccag

SEQ ID NO: 2373589 - RNA, 19 nt, Human
ugucuuuguuggaaaagaa

SEQ ID NO: 2373590 - RNA, 16 nt, Human
ugucuuuucuugcaug

SEQ ID NO: 2373591 - RNA, 14 nt, Human
ugucuuaaugaagu

SEQ ID NO: 2373592 - RNA, 15 nt, Human
ugucuuaaugaaguu

SEQ ID NO: 2373593 - RNA, 18 nt, Human
ugucuuaaugaaguuuga

SEQ ID NO: 2373594 - RNA, 19 nt, Human
ugucuuaaugaaguuugaa

SEQ ID NO: 2373595 - RNA, 20 nt, Human
ugucuuaaugaaguuugaau

SEQ ID NO: 2373596 - RNA, 21 nt, Human
ugucuuaaugaaguuugaaug

SEQ ID NO: 2373597 - RNA, 22 nt, Human
ugucuuaaugaaguuugaaugu

SEQ ID NO: 2373598 - RNA, 21 nt, Human
ugucuguucuacauagaugcu

SEQ ID NO: 2373599 - RNA, 15 nt, Human
ugucuguucuacaua

SEQ ID NO: 2373600 - RNA, 23 nt, Human
ugucuguuaccaugucacugugg

SEQ ID NO: 2373601 - RNA, 16 nt, Human
ugucuguuuguucucu

SEQ ID NO: 2373602 - RNA, 17 nt, Human
ugucuaggcaggaccug

SEQ ID NO: 2373603 - RNA, 19 nt, Human
ugucuaggcaggaccugug

SEQ ID NO: 2373604 - RNA, 14 nt, Human
ugucuagagaggga

SEQ ID NO: 2373605 - RNA, 14 nt, Human
ugucuagaguagcu

SEQ ID NO: 2373606 - RNA, 15 nt, Human
ugucuaguuguuuga

SEQ ID NO: 2373607 - RNA, 23 nt, Human
ugucuaguuguuugauucagaca

SEQ ID NO: 2373608 - RNA, 22 nt, Human
ugucuauaaucccagcacuuug

SEQ ID NO: 2373609 - RNA, 14 nt, Human
ugucuaugggacuc

SEQ ID NO: 2373610 - RNA, 15 nt, Human
ugucuaugggacuca

SEQ ID NO: 2373611 - RNA, 16 nt, Human
ugucuaugggacucaa

SEQ ID NO: 2373612 - RNA, 15 nt, Human
ugucucagccuccca

SEQ ID NO: 2373613 - RNA, 14 nt, Human
ugucucagccuccc

SEQ ID NO: 2373614 - RNA, 16 nt, Human
ugucucagccuccuga

SEQ ID NO: 2373615 - RNA, 13 nt, Human
ugucucagccucc

SEQ ID NO: 2373616 - RNA, 17 nt, Human
ugucucacugaaacauu

SEQ ID NO: 2373617 - RNA, 15 nt, Human
ugucuauuucugcug

SEQ ID NO: 2373618 - RNA, 18 nt, Human
ugucuauuucugcugaau

SEQ ID NO: 2373619 - RNA, 14 nt, Human
ugucuauucuccag

SEQ ID NO: 2373620 - RNA, 13 nt, Human
ugucuauuucugc

SEQ ID NO: 2373621 - RNA, 14 nt, Human
ugucuauuucugcu

SEQ ID NO: 2373622 - RNA, 14 nt, Human
ugucuauucagcuu

SEQ ID NO: 2373623 - RNA, 13 nt, Human
ugucuauucagcu

SEQ ID NO: 2373624 - RNA, 18 nt, Human
ugucuauuaccuguuagu

SEQ ID NO: 2373625 - RNA, 19 nt, Human
ugucuauucaaaauaucaa

SEQ ID NO: 2373626 - RNA, 21 nt, Human
ugucucaaaaaaagaaaaaga

SEQ ID NO: 2373627 - RNA, 17 nt, Human
ugucucaagagggcacu

SEQ ID NO: 2373628 - RNA, 18 nt, Human
ugucucaagagggcacug

SEQ ID NO: 2373629 - RNA, 23 nt, Human
uggugggaggggcgcccaccucc

SEQ ID NO: 2373630 - RNA, 21 nt, Human
uggugggaggggcgcccaccu

SEQ ID NO: 2373631 - RNA, 22 nt, Human
uggugggaggggcgcccaccuc

SEQ ID NO: 2373632 - RNA, 23 nt, Human
uggugggccaacaaagaacacua

SEQ ID NO: 2373633 - RNA, 20 nt, Human
uggugggccaacaaagaaca

SEQ ID NO: 2373634 - RNA, 13 nt, Human
ugguggggagggg

SEQ ID NO: 2373635 - RNA, 15 nt, Human
ugguggggaggggcg

SEQ ID NO: 2373636 - RNA, 20 nt, Human
ugguggggaggggcgcuggc

SEQ ID NO: 2373637 - RNA, 21 nt, Human
ugguggggaggggcgcuggcc

SEQ ID NO: 2373638 - RNA, 22 nt, Human
ugguggggaggggcgcuggccc

SEQ ID NO: 2373639 - RNA, 23 nt, Human
ugguggggaggggcgcuggccca

SEQ ID NO: 2373640 - RNA, 18 nt, Human
uggugggggccucggugu

SEQ ID NO: 2373641 - RNA, 16 nt, Human
uggugggggccucggu

SEQ ID NO: 2373642 - RNA, 21 nt, Human
uggugggaagcgucuguccgu

SEQ ID NO: 2373643 - RNA, 12 nt, Human
uggugggagggg

SEQ ID NO: 2373644 - RNA, 21 nt, Human
ugguggcucccggagggcccu

SEQ ID NO: 2373645 - RNA, 13 nt, Human
ugguggcuuugca

SEQ ID NO: 2373646 - RNA, 17 nt, Human
ugguggcgcaagccugu

SEQ ID NO: 2373647 - RNA, 13 nt, Human
ugguggcuggguu

SEQ ID NO: 2373648 - RNA, 16 nt, Human
ugguggcgcaagccug

SEQ ID NO: 2373649 - RNA, 21 nt, Human
ugguggccucugccccgucuc

SEQ ID NO: 2373650 - RNA, 21 nt, Human
ugguggcccgacagccuggca

SEQ ID NO: 2373651 - RNA, 15 nt, Human
uggugguaucugagu

SEQ ID NO: 2373652 - RNA, 17 nt, Human
uggugguaacccuggug

SEQ ID NO: 2373653 - RNA, 15 nt, Human
ugguggucuguuggc

SEQ ID NO: 2373654 - RNA, 21 nt, Human
ugguggguucaggggacucag

SEQ ID NO: 2373655 - RNA, 19 nt, Human
ugguggguucaggggacuc

SEQ ID NO: 2373656 - RNA, 16 nt, Human
uggugguaacccuggu

SEQ ID NO: 2373657 - RNA, 21 nt, Human
ugguggggguagagcugaucc

SEQ ID NO: 2373658 - RNA, 17 nt, Human
ugguggggguagagcug

SEQ ID NO: 2373659 - RNA, 18 nt, Human
ugguggggguagagcuga

SEQ ID NO: 2373660 - RNA, 23 nt, Human
uggugggguguguuccaacugcc

SEQ ID NO: 2373661 - RNA, 16 nt, Human
ugguggguccaugggc

SEQ ID NO: 2373662 - RNA, 18 nt, Human
ugguggguccaugggcag

SEQ ID NO: 2373663 - RNA, 17 nt, Human
ugguggguccaugggca

SEQ ID NO: 2373664 - RNA, 13 nt, Human
ugguguaauaaga

SEQ ID NO: 2373665 - RNA, 17 nt, Human
uggugguuucacggugc

SEQ ID NO: 2373666 - RNA, 14 nt, Human
uggugguugcuguu

SEQ ID NO: 2373667 - RNA, 19 nt, Human
uggugguuuucuguucuuu

SEQ ID NO: 2373668 - RNA, 18 nt, Human
uggugguuucagaaaugu

SEQ ID NO: 2373669 - RNA, 17 nt, Human
uggugguuucagaaaug

SEQ ID NO: 2373670 - RNA, 14 nt, Human
uggugcaaauccua

SEQ ID NO: 2373671 - RNA, 14 nt, Human
uggugcaaugaccu

SEQ ID NO: 2373672 - RNA, 19 nt, Human
uggugcaaugaccuuucaa

SEQ ID NO: 2373673 - RNA, 20 nt, Human
uggugcaaugaccuuucaau

SEQ ID NO: 2373674 - RNA, 20 nt, Human
ugguggcagugggagcugcc

SEQ ID NO: 2373675 - RNA, 19 nt, Human
ugguggcccgacagccugg

SEQ ID NO: 2373676 - RNA, 13 nt, Human
ugguggcaguggg

SEQ ID NO: 2373677 - RNA, 18 nt, Human
ugguggcagugggagcug

SEQ ID NO: 2373678 - RNA, 23 nt, Human
uggugagaacuacucagggaaug

SEQ ID NO: 2373679 - RNA, 22 nt, Human
uggugagaacuacucagggaau

SEQ ID NO: 2373680 - RNA, 14 nt, Human
uggugagaggcauc

SEQ ID NO: 2373681 - RNA, 18 nt, Human
ugggguuggcugggccca

SEQ ID NO: 2373682 - RNA, 14 nt, Human
uggguagacacaca

SEQ ID NO: 2373683 - RNA, 20 nt, Human
uggguacuuguggacacagc

SEQ ID NO: 2373684 - RNA, 23 nt, Human
uggguacuuguggacacagcucu

SEQ ID NO: 2373685 - RNA, 20 nt, Human
ugguuccggaauccuguccu

SEQ ID NO: 2373686 - RNA, 12 nt, Human
ugguuccucccc

SEQ ID NO: 2373687 - RNA, 23 nt, Human
ugguuccuccccuccuccuggac

SEQ ID NO: 2373688 - RNA, 18 nt, Human
ugguuccuccccuccucc

SEQ ID NO: 2373689 - RNA, 14 nt, Human
ugguucuauuuaau

SEQ ID NO: 2373690 - RNA, 16 nt, Human
ugguucuauuuaaugg

SEQ ID NO: 2373691 - RNA, 15 nt, Human
ugguucuaauagaac

SEQ ID NO: 2373692 - RNA, 17 nt, Human
ugguuccuuucucagcc

SEQ ID NO: 2373693 - RNA, 23 nt, Human
ugguuccccuguucacucuacuu

SEQ ID NO: 2373694 - RNA, 18 nt, Human
ugguucccguuucuccac

SEQ ID NO: 2373695 - RNA, 20 nt, Human
ugguucccguuucuccaccu

SEQ ID NO: 2373696 - RNA, 16 nt, Human
ugguucccuugaugaa

SEQ ID NO: 2373697 - RNA, 17 nt, Human
ugguucccuugaugaag

SEQ ID NO: 2373698 - RNA, 20 nt, Human
ugguucccuugaugaagaag

SEQ ID NO: 2373699 - RNA, 18 nt, Human
ugguucugugucuguguu

SEQ ID NO: 2373700 - RNA, 19 nt, Human
ugguucuuaguucucacug

SEQ ID NO: 2373701 - RNA, 21 nt, Human
ugguucuugguagagauucau

SEQ ID NO: 2373702 - RNA, 12 nt, Human
ugguucuggggc

SEQ ID NO: 2373703 - RNA, 13 nt, Human
ugguucugugcca

SEQ ID NO: 2373704 - RNA, 12 nt, Human
ugguucuggcca

SEQ ID NO: 2373705 - RNA, 20 nt, Human
ugguucugaugaugugccug

SEQ ID NO: 2373706 - RNA, 11 nt, Human
ugguucucauc

SEQ ID NO: 2373707 - RNA, 13 nt, Human
ugguucucaucuu

SEQ ID NO: 2373708 - RNA, 17 nt, Human
ugguucucaucuuucuu

SEQ ID NO: 2373709 - RNA, 14 nt, Human
ugguucucaucuuu

SEQ ID NO: 2373710 - RNA, 15 nt, Human
ugguucucaucuuuc

SEQ ID NO: 2373711 - RNA, 18 nt, Human
ugguugaugaucuuugca

SEQ ID NO: 2373712 - RNA, 15 nt, Human
ugguugacuggguuu

SEQ ID NO: 2373713 - RNA, 12 nt, Human
ugguugaggaaa

SEQ ID NO: 2373714 - RNA, 15 nt, Human
ugguugagguggaag

SEQ ID NO: 2373715 - RNA, 17 nt, Human
ugguugagaaaugaaua

SEQ ID NO: 2373716 - RNA, 22 nt, Human
ugguugagguggaagcccuccu

SEQ ID NO: 2373717 - RNA, 19 nt, Human
ugguucuuguauuaagaau

SEQ ID NO: 2373718 - RNA, 18 nt, Human
ugguucuuguauuaagaa

SEQ ID NO: 2373719 - RNA, 14 nt, Human
ugguucuuguauua

SEQ ID NO: 2373720 - RNA, 18 nt, Human
ugguugaauaaacuagau

SEQ ID NO: 2373721 - RNA, 12 nt, Human
ugguugaauaaa

SEQ ID NO: 2373722 - RNA, 16 nt, Human
ugguugaaaauaaaaa

SEQ ID NO: 2373723 - RNA, 16 nt, Human
ugguucauaaaugaau

SEQ ID NO: 2373724 - RNA, 13 nt, Human
ugguucauaaaug

SEQ ID NO: 2373725 - RNA, 15 nt, Human
ugguucauaaaugaa

SEQ ID NO: 2373726 - RNA, 13 nt, Human
ugguuccaagccc

SEQ ID NO: 2373727 - RNA, 16 nt, Human
ugguucauuaauucua

SEQ ID NO: 2373728 - RNA, 16 nt, Human
ugguuccagccugcca

SEQ ID NO: 2373729 - RNA, 15 nt, Human
ugguuccagccugcc

SEQ ID NO: 2373730 - RNA, 18 nt, Human
uggugucgggcaugacac

SEQ ID NO: 2373731 - RNA, 19 nt, Human
uggugucgggcaugacacg

SEQ ID NO: 2373732 - RNA, 11 nt, Human
ugguuccccug

SEQ ID NO: 2373733 - RNA, 18 nt, Human
ugguuccccuguucacuc

SEQ ID NO: 2373734 - RNA, 19 nt, Human
ugguuccccuguucacucu

SEQ ID NO: 2373735 - RNA, 20 nt, Human
ugguuccccuguucacucua

SEQ ID NO: 2373736 - RNA, 13 nt, Human
ugguuccaugccu

SEQ ID NO: 2373737 - RNA, 15 nt, Human
ugguuccaugccuga

SEQ ID NO: 2373738 - RNA, 17 nt, Human
ugguuccaugccugagg

SEQ ID NO: 2373739 - RNA, 19 nt, Human
ugguuccaugccugagggu

SEQ ID NO: 2373740 - RNA, 22 nt, Human
ugguuccaugccugagggugga

SEQ ID NO: 2373741 - RNA, 21 nt, Human
ugguuccauuguuuggagaca

SEQ ID NO: 2373742 - RNA, 23 nt, Human
ugguuccauuguuuggagacauu

SEQ ID NO: 2373743 - RNA, 12 nt, Human
ugguuccagggu

SEQ ID NO: 2373744 - RNA, 16 nt, Human
ugguuccaagcccugg

SEQ ID NO: 2373745 - RNA, 17 nt, Human
ugguuccaagcccugga

SEQ ID NO: 2373746 - RNA, 21 nt, Human
ugguuccagggucccucugug

SEQ ID NO: 2373747 - RNA, 22 nt, Human
ugguuccagggucccucugugu

SEQ ID NO: 2373748 - RNA, 19 nt, Human
ugguguccuuucccuccac

SEQ ID NO: 2373749 - RNA, 21 nt, Human
ugguguccugaccacccuccc

SEQ ID NO: 2373750 - RNA, 18 nt, Human
uggugucgcgccuucucc

SEQ ID NO: 2373751 - RNA, 21 nt, Human
uggugucgcgccuucuccccc

SEQ ID NO: 2373752 - RNA, 15 nt, Human
ugguguccugaccac

SEQ ID NO: 2373753 - RNA, 17 nt, Human
ugguguccugaccaccc

SEQ ID NO: 2373754 - RNA, 19 nt, Human
ugguguccugaccacccuc

SEQ ID NO: 2373755 - RNA, 20 nt, Human
ugguguccugaccacccucc

SEQ ID NO: 2373756 - RNA, 15 nt, Human
uggugucgggcauga

SEQ ID NO: 2373757 - RNA, 17 nt, Human
ugguguccaccuggccc

SEQ ID NO: 2373758 - RNA, 15 nt, Human
ugguguccaccuggc

SEQ ID NO: 2373759 - RNA, 14 nt, Human
ugguguccaccugg

SEQ ID NO: 2373760 - RNA, 13 nt, Human
ugguguccaccug

SEQ ID NO: 2373761 - RNA, 14 nt, Human
ugguguccugacca

SEQ ID NO: 2373762 - RNA, 18 nt, Human
ugguguccaccuggcccc

SEQ ID NO: 2373763 - RNA, 16 nt, Human
uggugucacuuacugu

SEQ ID NO: 2373764 - RNA, 17 nt, Human
uggugucacuuacuguu

SEQ ID NO: 2373765 - RNA, 18 nt, Human
uggugucacuuacuguuu

SEQ ID NO: 2373766 - RNA, 20 nt, Human
uggugucacuuacuguuucu

SEQ ID NO: 2373767 - RNA, 16 nt, Human
uggugucaccugaaga

SEQ ID NO: 2373768 - RNA, 19 nt, Human
ugguguaguugaacugaua

SEQ ID NO: 2373769 - RNA, 23 nt, Human
ugguguauccccccccuguauag

SEQ ID NO: 2373770 - RNA, 19 nt, Human
ugguguaauaagacauaac

SEQ ID NO: 2373771 - RNA, 14 nt, Human
ugguguaauaagac

SEQ ID NO: 2373772 - RNA, 15 nt, Human
ugguguaauaagaca

SEQ ID NO: 2373773 - RNA, 16 nt, Human
ugguguaauaagacau

SEQ ID NO: 2373774 - RNA, 17 nt, Human
ugguguaauaagacaua

SEQ ID NO: 2373775 - RNA, 17 nt, Human
uguaaauuuaugugaug

SEQ ID NO: 2373776 - RNA, 14 nt, Human
uguaacaagccacc

SEQ ID NO: 2373777 - RNA, 23 nt, Human
uguaaacucaaaauauuuguaca

SEQ ID NO: 2373778 - RNA, 15 nt, Human
uguaaacugugcacc

SEQ ID NO: 2373779 - RNA, 14 nt, Human
uguaaacugugcac

SEQ ID NO: 2373780 - RNA, 18 nt, Human
uguaaacuguguauucca

SEQ ID NO: 2373781 - RNA, 22 nt, Human
uguaaacucaaaacuuaacaua

SEQ ID NO: 2373782 - RNA, 14 nt, Human
uguaaacuguguau

SEQ ID NO: 2373783 - RNA, 13 nt, Human
uguaaacugugua

SEQ ID NO: 2373784 - RNA, 23 nt, Human
uguaacacagcugagagacuuuu

SEQ ID NO: 2373785 - RNA, 20 nt, Human
uguaacacagcugagagacu

SEQ ID NO: 2373786 - RNA, 21 nt, Human
uguaacacagcugagagacuu

SEQ ID NO: 2373787 - RNA, 16 nt, Human
uguaacacaagccaca

SEQ ID NO: 2373788 - RNA, 20 nt, Human
uguaacacaagccacagaag

SEQ ID NO: 2373789 - RNA, 21 nt, Human
uguaacacaagccacagaagc

SEQ ID NO: 2373790 - RNA, 24 nt, Human
uguaacacaagccacagaagccag

SEQ ID NO: 2373791 - RNA, 15 nt, Human
uguaacacaagccac

SEQ ID NO: 2373792 - RNA, 17 nt, Human
uguaacaagccacccca

SEQ ID NO: 2373793 - RNA, 20 nt, Human
uguaaauuuuguaugaaaaa

SEQ ID NO: 2373794 - RNA, 16 nt, Human
uguaacacuuuacaau

SEQ ID NO: 2373795 - RNA, 18 nt, Human
uguaacacuuuacaaugu

SEQ ID NO: 2373796 - RNA, 20 nt, Human
uguaacacuuuacaauguuc

SEQ ID NO: 2373797 - RNA, 13 nt, Human
uguaacagaaagg

SEQ ID NO: 2373798 - RNA, 17 nt, Human
uguaacagaaagggcaa

SEQ ID NO: 2373799 - RNA, 22 nt, Human
uguaacagaaagggcaacaaua

SEQ ID NO: 2373800 - RNA, 23 nt, Human
uguaacagaaagggcaacaauaa

SEQ ID NO: 2373801 - RNA, 13 nt, Human
uguaacagacauu

SEQ ID NO: 2373802 - RNA, 15 nt, Human
uguaacagacauugu

SEQ ID NO: 2373803 - RNA, 16 nt, Human
uguaacagacauuguu

SEQ ID NO: 2373804 - RNA, 18 nt, Human
uguaacagccaggagugu

SEQ ID NO: 2373805 - RNA, 12 nt, Human
uguaacagcucc

SEQ ID NO: 2373806 - RNA, 13 nt, Human
uguaacagcuccu

SEQ ID NO: 2373807 - RNA, 14 nt, Human
uguaacagcuccuu

SEQ ID NO: 2373808 - RNA, 16 nt, Human
uguaacagcuccuugg

SEQ ID NO: 2373809 - RNA, 17 nt, Human
uguaacagcuccuuggg

SEQ ID NO: 2373810 - RNA, 21 nt, Human
uguaacaggucuccucuuaaa

SEQ ID NO: 2373811 - RNA, 20 nt, Human
uguaacaggucuccucuuaa

SEQ ID NO: 2373812 - RNA, 18 nt, Human
uguaacaggucuccucuu

SEQ ID NO: 2373813 - RNA, 15 nt, Human
uguaacagcugaggu

SEQ ID NO: 2373814 - RNA, 14 nt, Human
uguaacagcugagg

SEQ ID NO: 2373815 - RNA, 11 nt, Human
uguaacagcug

SEQ ID NO: 2373816 - RNA, 18 nt, Human
uguaacagcuccuuggga

SEQ ID NO: 2373817 - RNA, 22 nt, Human
uguaacagcuccuugggaggaa

SEQ ID NO: 2373818 - RNA, 22 nt, Human
uguaacaggucuccucuuaaaa

SEQ ID NO: 2373819 - RNA, 14 nt, Human
uguaacagucugau

SEQ ID NO: 2373820 - RNA, 17 nt, Human
uguaacauacuggccug

SEQ ID NO: 2373821 - RNA, 11 nt, Human
uguaacaugua

SEQ ID NO: 2373822 - RNA, 16 nt, Human
uguaacagucugaucg

SEQ ID NO: 2373823 - RNA, 20 nt, Human
uguaaccgauucaucucuca

SEQ ID NO: 2373824 - RNA, 22 nt, Human
uguaaccgauucaucucucaga

SEQ ID NO: 2373825 - RNA, 12 nt, Human
uguaaccucagc

SEQ ID NO: 2373826 - RNA, 14 nt, Human
uguaaccucagcuc

SEQ ID NO: 2373827 - RNA, 15 nt, Human
uguaaccucagcucu

SEQ ID NO: 2373828 - RNA, 16 nt, Human
uguaaccucagcucug

SEQ ID NO: 2373829 - RNA, 18 nt, Human
uguaaccucagcucuggg

SEQ ID NO: 2373830 - RNA, 19 nt, Human
uguaaccucagcucuggga

SEQ ID NO: 2373831 - RNA, 23 nt, Human
uguaaccucagcucugggagagg

SEQ ID NO: 2373832 - RNA, 15 nt, Human
uguaauaaauaugag

SEQ ID NO: 2373833 - RNA, 14 nt, Human
uguaauaacuguga

SEQ ID NO: 2373834 - RNA, 22 nt, Human
uguaauaacugugaaguuuaca

SEQ ID NO: 2373835 - RNA, 14 nt, Human
uguaauaaauauga

SEQ ID NO: 2373836 - RNA, 12 nt, Human
uguaauaagaca

SEQ ID NO: 2373837 - RNA, 13 nt, Human
uguaauaagacau

SEQ ID NO: 2373838 - RNA, 14 nt, Human
uguaauaagacaua

SEQ ID NO: 2373839 - RNA, 18 nt, Human
uguaauaagacauaacgu

SEQ ID NO: 2373840 - RNA, 13 nt, Human
uguaauaauguga

SEQ ID NO: 2373841 - RNA, 15 nt, Human
uguaauaagacauaa

SEQ ID NO: 2373842 - RNA, 11 nt, Human
uguaaugaaaa

SEQ ID NO: 2373843 - RNA, 12 nt, Human
uguaaugaaaac

SEQ ID NO: 2373844 - RNA, 13 nt, Human
uguaaugaaaacc

SEQ ID NO: 2373845 - RNA, 17 nt, Human
uguaaugaaaaccacau

SEQ ID NO: 2373846 - RNA, 20 nt, Human
uguacacugaauauuuauau

SEQ ID NO: 2373847 - RNA, 12 nt, Human
uguacacuuuuu

SEQ ID NO: 2373848 - RNA, 21 nt, Human
uguacacugaauauuuauauu

SEQ ID NO: 2373849 - RNA, 19 nt, Human
uguacacugaauauuuaua

SEQ ID NO: 2373850 - RNA, 17 nt, Human
uguacacugaauauuua

SEQ ID NO: 2373851 - RNA, 16 nt, Human
uguacacugaauauuu

SEQ ID NO: 2373852 - RNA, 15 nt, Human
uguacacugaauauu

SEQ ID NO: 2373853 - RNA, 14 nt, Human
uguacacugaauau

SEQ ID NO: 2373854 - RNA, 12 nt, Human
uguacacugaau

SEQ ID NO: 2373855 - RNA, 17 nt, Human
uguacacguguccugua

SEQ ID NO: 2373856 - RNA, 16 nt, Human
uguacacguguccugu

SEQ ID NO: 2373857 - RNA, 15 nt, Human
uguacacgggacuga

SEQ ID NO: 2373858 - RNA, 20 nt, Human
uguacacgggacugacgcaa

SEQ ID NO: 2373859 - RNA, 15 nt, Human
uguacaacuuaaguu

SEQ ID NO: 2373860 - RNA, 21 nt, Human
uguacaaauauaagaauaaaa

SEQ ID NO: 2373861 - RNA, 15 nt, Human
uguacaaauauaaga

SEQ ID NO: 2373862 - RNA, 18 nt, Human
uguacaaauauaagaaua

SEQ ID NO: 2373863 - RNA, 13 nt, Human
uguacacgggacu

SEQ ID NO: 2373864 - RNA, 14 nt, Human
uguacacgggacug

SEQ ID NO: 2373865 - RNA, 16 nt, Human
uguacaagaugaagga

SEQ ID NO: 2373866 - RNA, 16 nt, Human
uguaaugaaacaccuu

SEQ ID NO: 2373867 - RNA, 17 nt, Human
uguaaugaaacaccuuc

SEQ ID NO: 2373868 - RNA, 19 nt, Human
uguacaaauaaagucccag

SEQ ID NO: 2373869 - RNA, 20 nt, Human
uguacagacguaugcuuauu

SEQ ID NO: 2373870 - RNA, 19 nt, Human
uguacagacguaugcuuau

SEQ ID NO: 2373871 - RNA, 21 nt, Human
uguacagagaacuaacacuau

SEQ ID NO: 2373872 - RNA, 22 nt, Human
uguacagagaacuaacacuauu

SEQ ID NO: 2373873 - RNA, 18 nt, Human
uguacagacguaugcuua

SEQ ID NO: 2373874 - RNA, 17 nt, Human
uguacagacguaugcuu

SEQ ID NO: 2373875 - RNA, 11 nt, Human
uguacagagcc

SEQ ID NO: 2373876 - RNA, 21 nt, Human
uguacagaauucugcuaccuc

SEQ ID NO: 2373877 - RNA, 13 nt, Human
uguacacuuuuuu

SEQ ID NO: 2373878 - RNA, 18 nt, Human
uguacagaauucugcuac

SEQ ID NO: 2373879 - RNA, 14 nt, Human
uguacagacaacaa

SEQ ID NO: 2373880 - RNA, 23 nt, Human
uguaaaacaaaaauguaaugauc

SEQ ID NO: 2373881 - RNA, 20 nt, Human
uguaaaaauuggucacccua

SEQ ID NO: 2373882 - RNA, 22 nt, Human
uguaaaaagagagaaaacuuau

SEQ ID NO: 2373883 - RNA, 14 nt, Human
uguaaaaacugugg

SEQ ID NO: 2373884 - RNA, 24 nt, Human
uguaaaaacagcauugcuuucuga

SEQ ID NO: 2373885 - RNA, 23 nt, Human
uguaaaaacagcauugcuuucug

SEQ ID NO: 2373886 - RNA, 22 nt, Human
uguaaaaacagcauugcuuucu

SEQ ID NO: 2373887 - RNA, 20 nt, Human
uguaaaaacagcauugcuuu

SEQ ID NO: 2373888 - RNA, 19 nt, Human
uguaaaaacagcauugcuu

SEQ ID NO: 2373889 - RNA, 19 nt, Human
uguaaaaaaaaaugccuuu

SEQ ID NO: 2373890 - RNA, 16 nt, Human
uguaaaaccugucaau

SEQ ID NO: 2373891 - RNA, 18 nt, Human
uguaaaaccugucaauga

SEQ ID NO: 2373892 - RNA, 22 nt, Human
uguaaaacgagaauccacccau

SEQ ID NO: 2373893 - RNA, 16 nt, Human
uguaaaacugaggcac

SEQ ID NO: 2373894 - RNA, 15 nt, Human
uguaaaacugaggca

SEQ ID NO: 2373895 - RNA, 19 nt, Human
uguaaaagaacaguaaaca

SEQ ID NO: 2373896 - RNA, 14 nt, Human
uguaaaauaaaauu

SEQ ID NO: 2373897 - RNA, 23 nt, Human
uguaaaaggccaaaccucuguuc

SEQ ID NO: 2373898 - RNA, 22 nt, Human
uguaaaaggccaaaccucuguu

SEQ ID NO: 2373899 - RNA, 21 nt, Human
uguaaaaggccaaaccucugu

SEQ ID NO: 2373900 - RNA, 18 nt, Human
uguaaaauaagaaugauu

SEQ ID NO: 2373901 - RNA, 12 nt, Human
uguaaaauagcu

SEQ ID NO: 2373902 - RNA, 14 nt, Human
uguaaaauagcuug

SEQ ID NO: 2373903 - RNA, 17 nt, Human
uguaaaauagcuuguau

SEQ ID NO: 2373904 - RNA, 20 nt, Human
uguaaaauagcuuguauagu

SEQ ID NO: 2373905 - RNA, 21 nt, Human
uguaaaauagcuuguauagug

SEQ ID NO: 2373906 - RNA, 19 nt, Human
uguaaaauauuuugaauca

SEQ ID NO: 2373907 - RNA, 20 nt, Human
uguaaaauauuuugaaucaa

SEQ ID NO: 2373908 - RNA, 11 nt, Human
uguaaaauaua

SEQ ID NO: 2373909 - RNA, 18 nt, Human
uguaaaauauacuuaaau

SEQ ID NO: 2373910 - RNA, 19 nt, Human
uguaaaauauagcuguaca

SEQ ID NO: 2373911 - RNA, 21 nt, Human
uguaaaauauagcuguacaaa

SEQ ID NO: 2373912 - RNA, 18 nt, Human
uguaaacugcauuagaaa

SEQ ID NO: 2373913 - RNA, 20 nt, Human
uguaaacucaaaauauuugu

SEQ ID NO: 2373914 - RNA, 15 nt, Human
uguaaacucaaaaua

SEQ ID NO: 2373915 - RNA, 23 nt, Human
uguaaaccacaaggcuguugcau

SEQ ID NO: 2373916 - RNA, 19 nt, Human
uguaaaccugagucguaca

SEQ ID NO: 2373917 - RNA, 16 nt, Human
uguaaacucaaaacuu

SEQ ID NO: 2373918 - RNA, 21 nt, Human
uguaaacucaaaacuuaacau

SEQ ID NO: 2373919 - RNA, 12 nt, Human
uguaaaauggug

SEQ ID NO: 2373920 - RNA, 21 nt, Human
uguaaaaucuuggcacagaaa

SEQ ID NO: 2373921 - RNA, 21 nt, Human
uguaaaauauuuugaaucaau

SEQ ID NO: 2373922 - RNA, 22 nt, Human
uguaaaaucuuggcacagaaac

SEQ ID NO: 2373923 - RNA, 14 nt, Human
uguaaaaucuuucu

SEQ ID NO: 2373924 - RNA, 21 nt, Human
uguaaaaucuuucuuucuuag

SEQ ID NO: 2373925 - RNA, 13 nt, Human
uguaaaaucuuuc

SEQ ID NO: 2373926 - RNA, 15 nt, Human
uguaaaaugaaauua

SEQ ID NO: 2373927 - RNA, 14 nt, Human
uguaaaaugaaauu

SEQ ID NO: 2373928 - RNA, 22 nt, Human
uguaaaaucuuucuuucuuaga

SEQ ID NO: 2373929 - RNA, 23 nt, Human
uguaaaaucuuucuuucuuagaa

SEQ ID NO: 2373930 - RNA, 11 nt, Human
uguaaaauggu

SEQ ID NO: 2373931 - RNA, 16 nt, Human
ugguuuuucaguuuuc

SEQ ID NO: 2373932 - RNA, 17 nt, Human
ugguuuuuguagccuuc

SEQ ID NO: 2373933 - RNA, 22 nt, Human
ugguuuuuguagccuuccucca

SEQ ID NO: 2373934 - RNA, 15 nt, Human
ugguuuuuuuucuaa

SEQ ID NO: 2373935 - RNA, 13 nt, Human
uguaaaaaaaaaa

SEQ ID NO: 2373936 - RNA, 20 nt, Human
uguaaaaaaaaaaaaguuau

SEQ ID NO: 2373937 - RNA, 22 nt, Human
uguaaaaaaaaaaaaguuauau

SEQ ID NO: 2373938 - RNA, 18 nt, Human
uguaaaaaaaaaugccuu

SEQ ID NO: 2373939 - RNA, 23 nt, Human
ugguuuuuaaaaaacugcugacu

SEQ ID NO: 2373940 - RNA, 17 nt, Human
ugguuuuguuccccucc

SEQ ID NO: 2373941 - RNA, 20 nt, Human
ugguuuuguuccccuccucc

SEQ ID NO: 2373942 - RNA, 18 nt, Human
ugguuuuguaagaugcug

SEQ ID NO: 2373943 - RNA, 16 nt, Human
ugguuuuguuccccuc

SEQ ID NO: 2373944 - RNA, 19 nt, Human
ugguuuuguaagaugcugg

SEQ ID NO: 2373945 - RNA, 21 nt, Human
ugguuuuuaaaaaacugcuga

SEQ ID NO: 2373946 - RNA, 23 nt, Human
ugguugucauuuuugcaguagag

SEQ ID NO: 2373947 - RNA, 21 nt, Human
ugguuguuaguuauagauguc

SEQ ID NO: 2373948 - RNA, 22 nt, Human
ugguuguuaguuauagaugucu

SEQ ID NO: 2373949 - RNA, 19 nt, Human
ugguuuucuuguguguuua

SEQ ID NO: 2373950 - RNA, 15 nt, Human
ugguuggguccucac

SEQ ID NO: 2373951 - RNA, 22 nt, Human
ugguugguaacacaaauuuuca

SEQ ID NO: 2373952 - RNA, 16 nt, Human
ugguuggcuggccuuc

SEQ ID NO: 2373953 - RNA, 16 nt, Human
ugguuggagaauuuag

SEQ ID NO: 2373954 - RNA, 16 nt, Human
ugguuggagagcuaga

SEQ ID NO: 2373955 - RNA, 18 nt, Human
ugguugcuuuaauaucau

SEQ ID NO: 2373956 - RNA, 22 nt, Human
ugguugaguucagguagcugcc

SEQ ID NO: 2373957 - RNA, 15 nt, Human
ugguugauggguucu

SEQ ID NO: 2373958 - RNA, 13 nt, Human
ugguugcauccua

SEQ ID NO: 2373959 - RNA, 20 nt, Human
ugguugcacuuaugauuuca

SEQ ID NO: 2373960 - RNA, 17 nt, Human
ugguugccuuaaagaaa

SEQ ID NO: 2373961 - RNA, 18 nt, Human
ugguugccuuaaagaaag

SEQ ID NO: 2373962 - RNA, 19 nt, Human
ugguugcuguuuuccuccc

SEQ ID NO: 2373963 - RNA, 13 nt, Human
ugguugcugugug

SEQ ID NO: 2373964 - RNA, 14 nt, Human
ugguugcuuuaaua

SEQ ID NO: 2373965 - RNA, 16 nt, Human
ugguuuucuguucuuu

SEQ ID NO: 2373966 - RNA, 18 nt, Human
ugguuguauuagauguuc

SEQ ID NO: 2373967 - RNA, 11 nt, Human
ugguuguauuc

SEQ ID NO: 2373968 - RNA, 15 nt, Human
ugguuguauucuuug

SEQ ID NO: 2373969 - RNA, 16 nt, Human
ugguuguauucuuuga

SEQ ID NO: 2373970 - RNA, 17 nt, Human
ugguuguauucuuugau

SEQ ID NO: 2373971 - RNA, 15 nt, Human
ugguugucaauauua

SEQ ID NO: 2373972 - RNA, 17 nt, Human
ugguugucaauauuaaa

SEQ ID NO: 2373973 - RNA, 12 nt, Human
ugguuguauuag

SEQ ID NO: 2373974 - RNA, 14 nt, Human
ugguuguauuagau

SEQ ID NO: 2373975 - RNA, 16 nt, Human
ugguuguauuagaugu

SEQ ID NO: 2373976 - RNA, 20 nt, Human
ugguuguacauauaagugau

SEQ ID NO: 2373977 - RNA, 14 nt, Human
uccuauugcaaagg

SEQ ID NO: 2373978 - RNA, 20 nt, Human
uccuauucucaccaggaagg

SEQ ID NO: 2373979 - RNA, 16 nt, Human
uccuauucucgggcug

SEQ ID NO: 2373980 - RNA, 15 nt, Human
uccuauucucaccag

SEQ ID NO: 2373981 - RNA, 16 nt, Human
uccuauucucaccagg

SEQ ID NO: 2373982 - RNA, 17 nt, Human
uccuauucucaccagga

SEQ ID NO: 2373983 - RNA, 18 nt, Human
uccuauucucaccaggaa

SEQ ID NO: 2373984 - RNA, 20 nt, Human
uccucaucucuaacagcuca

SEQ ID NO: 2373985 - RNA, 12 nt, Human
uccucaucucua

SEQ ID NO: 2373986 - RNA, 22 nt, Human
uccucaucccguguucuccuuu

SEQ ID NO: 2373987 - RNA, 14 nt, Human
uccucaucccgugu

SEQ ID NO: 2373988 - RNA, 17 nt, Human
uccuauugucauuaaag

SEQ ID NO: 2373989 - RNA, 18 nt, Human
uccucauccagggcucug

SEQ ID NO: 2373990 - RNA, 17 nt, Human
uccucauuagcauuuug

SEQ ID NO: 2373991 - RNA, 23 nt, Human
uccucaucucuaacagcucagga

SEQ ID NO: 2373992 - RNA, 22 nt, Human
uccucaucucuaacagcucagg

SEQ ID NO: 2373993 - RNA, 19 nt, Human
uccucaucugggggagugg

SEQ ID NO: 2373994 - RNA, 20 nt, Human
uccucaucugggggagugga

SEQ ID NO: 2373995 - RNA, 21 nt, Human
uccucaucugggggaguggaa

SEQ ID NO: 2373996 - RNA, 18 nt, Human
uccuauauaguuuauuga

SEQ ID NO: 2373997 - RNA, 21 nt, Human
uccuaugugauuuuaacucug

SEQ ID NO: 2373998 - RNA, 13 nt, Human
uccuauaugcacu

SEQ ID NO: 2373999 - RNA, 22 nt, Human
uccuaugugauuuuaacucugu

SEQ ID NO: 2374000 - RNA, 23 nt, Human
uccuaugugauuuuaacucuguc

SEQ ID NO: 2374001 - RNA, 12 nt, Human
uccuauguguaa

SEQ ID NO: 2374002 - RNA, 18 nt, Human
uccuauguuuuuguucaa

SEQ ID NO: 2374003 - RNA, 19 nt, Human
uccuauguuuuuguucaaa

SEQ ID NO: 2374004 - RNA, 14 nt, Human
uccuauucaguucc

SEQ ID NO: 2374005 - RNA, 22 nt, Human
uccuauucaguucccagaauca

SEQ ID NO: 2374006 - RNA, 23 nt, Human
uccuauucaguucccagaaucaa

SEQ ID NO: 2374007 - RNA, 14 nt, Human
uccuauucuauugc

SEQ ID NO: 2374008 - RNA, 14 nt, Human
uccuauucucacca

SEQ ID NO: 2374009 - RNA, 18 nt, Human
uccuaguucuguagaaau

SEQ ID NO: 2374010 - RNA, 19 nt, Human
uccuaguucuguagaaaug

SEQ ID NO: 2374011 - RNA, 16 nt, Human
uccuaguucuguagaa

SEQ ID NO: 2374012 - RNA, 17 nt, Human
uccuaguucuguagaaa

SEQ ID NO: 2374013 - RNA, 22 nt, Human
uccuaguuccaccaucaagcca

SEQ ID NO: 2374014 - RNA, 19 nt, Human
uccuaccccaauuccuugu

SEQ ID NO: 2374015 - RNA, 16 nt, Human
uccuaccccaauuccu

SEQ ID NO: 2374016 - RNA, 18 nt, Human
uccuaccccaauuccuug

SEQ ID NO: 2374017 - RNA, 15 nt, Human
uccuacccauccccg

SEQ ID NO: 2374018 - RNA, 14 nt, Human
uccuacccaucccc

SEQ ID NO: 2374019 - RNA, 21 nt, Human
uccuacccacaccucugccag

SEQ ID NO: 2374020 - RNA, 22 nt, Human
uccuacccacaccucugccaga

SEQ ID NO: 2374021 - RNA, 16 nt, Human
uccuacccaaccacuc

SEQ ID NO: 2374022 - RNA, 15 nt, Human
uccuacccacaccuc

SEQ ID NO: 2374023 - RNA, 16 nt, Human
uccuacccacaccucu

SEQ ID NO: 2374024 - RNA, 20 nt, Human
uccuacccacaccucugcca

SEQ ID NO: 2374025 - RNA, 18 nt, Human
uccuauauuguuuucagu

SEQ ID NO: 2374026 - RNA, 15 nt, Human
uccuauauaguuuau

SEQ ID NO: 2374027 - RNA, 19 nt, Human
uccuauacgcagcgugcuu

SEQ ID NO: 2374028 - RNA, 18 nt, Human
uccuauacgcagcgugcu

SEQ ID NO: 2374029 - RNA, 20 nt, Human
uccuauaauauaauaaauau

SEQ ID NO: 2374030 - RNA, 20 nt, Human
uccuauaauucccuaucuuu

SEQ ID NO: 2374031 - RNA, 13 nt, Human
uccuaguuuucuc

SEQ ID NO: 2374032 - RNA, 23 nt, Human
uccuaguucuguagaaaugguug

SEQ ID NO: 2374033 - RNA, 20 nt, Human
uccuaguuuucuccucccag

SEQ ID NO: 2374034 - RNA, 13 nt, Human
uccgaccagacac

SEQ ID NO: 2374035 - RNA, 17 nt, Human
uccgaccagacaccuug

SEQ ID NO: 2374036 - RNA, 16 nt, Human
uccuaaucuucugaac

SEQ ID NO: 2374037 - RNA, 20 nt, Human
uccuaauaaucauuggauuc

SEQ ID NO: 2374038 - RNA, 18 nt, Human
uccuaauaaaguucugua

SEQ ID NO: 2374039 - RNA, 18 nt, Human
uccuacccacccuccuuu

SEQ ID NO: 2374040 - RNA, 15 nt, Human
uccuacccaaccacu

SEQ ID NO: 2374041 - RNA, 17 nt, Human
uccuaccaaugcaugca

SEQ ID NO: 2374042 - RNA, 21 nt, Human
uccuaccaaugcaugcagcca

SEQ ID NO: 2374043 - RNA, 13 nt, Human
uccuaccaaugca

SEQ ID NO: 2374044 - RNA, 14 nt, Human
uccuaccaaugcau

SEQ ID NO: 2374045 - RNA, 15 nt, Human
uccuaccaaugcaug

SEQ ID NO: 2374046 - RNA, 16 nt, Human
uccuaccaaugcaugc

SEQ ID NO: 2374047 - RNA, 18 nt, Human
uccuacaagagcagccug

SEQ ID NO: 2374048 - RNA, 14 nt, Human
uccuacaaagaugu

SEQ ID NO: 2374049 - RNA, 19 nt, Human
uccuaauuucuccucccuu

SEQ ID NO: 2374050 - RNA, 15 nt, Human
uccuacaaagauguu

SEQ ID NO: 2374051 - RNA, 20 nt, Human
uccuaccaauagauucccca

SEQ ID NO: 2374052 - RNA, 15 nt, Human
uccuacaagacacag

SEQ ID NO: 2374053 - RNA, 16 nt, Human
uccuaauuuugagaaa

SEQ ID NO: 2374054 - RNA, 15 nt, Human
uccuaauuucuccuc

SEQ ID NO: 2374055 - RNA, 16 nt, Human
uccuaauuucuccucc

SEQ ID NO: 2374056 - RNA, 22 nt, Human
uccuaaugaaugcauaaaaugu

SEQ ID NO: 2374057 - RNA, 15 nt, Human
uccuaaucauccaau

SEQ ID NO: 2374058 - RNA, 14 nt, Human
uccuaaucauccaa

SEQ ID NO: 2374059 - RNA, 15 nt, Human
uccuaauuccacagc

SEQ ID NO: 2374060 - RNA, 18 nt, Human
uccuaauuccacagcugc

SEQ ID NO: 2374061 - RNA, 17 nt, Human
uccuaauuccacagcug

SEQ ID NO: 2374062 - RNA, 16 nt, Human
uccuaauuccacagcu

SEQ ID NO: 2374063 - RNA, 15 nt, Human
uccucuggacggcag

SEQ ID NO: 2374064 - RNA, 17 nt, Human
uccucuggacggcaggc

SEQ ID NO: 2374065 - RNA, 21 nt, Human
uccucuagcugugggggugag

SEQ ID NO: 2374066 - RNA, 22 nt, Human
uccucuagaagccaagggaaag

SEQ ID NO: 2374067 - RNA, 15 nt, Human
uccucuagcuguggg

SEQ ID NO: 2374068 - RNA, 18 nt, Human
uccucuagaagccaaggg

SEQ ID NO: 2374069 - RNA, 19 nt, Human
uccucuagaagccaaggga

SEQ ID NO: 2374070 - RNA, 12 nt, Human
uccucugcugcu

SEQ ID NO: 2374071 - RNA, 14 nt, Human
uccucugcugcugg

SEQ ID NO: 2374072 - RNA, 15 nt, Human
uccucugcugcuggc

SEQ ID NO: 2374073 - RNA, 16 nt, Human
uccucugcugcuggcu

SEQ ID NO: 2374074 - RNA, 21 nt, Human
uccucuuccugaauuuuauuu

SEQ ID NO: 2374075 - RNA, 14 nt, Human
uccucuuccucuga

SEQ ID NO: 2374076 - RNA, 15 nt, Human
uccucuuccucugag

SEQ ID NO: 2374077 - RNA, 16 nt, Human
uccucuuccucugagg

SEQ ID NO: 2374078 - RNA, 19 nt, Human
uccucuucuauuuuguaaa

SEQ ID NO: 2374079 - RNA, 15 nt, Human
uccucuucugacgug

SEQ ID NO: 2374080 - RNA, 17 nt, Human
uccucuucugacgugcc

SEQ ID NO: 2374081 - RNA, 17 nt, Human
uccucuucugcaucuug

SEQ ID NO: 2374082 - RNA, 22 nt, Human
uccucuggacggcaggcucacu

SEQ ID NO: 2374083 - RNA, 18 nt, Human
uccucuggacggcaggcu

SEQ ID NO: 2374084 - RNA, 20 nt, Human
uccucuggacggcaggcuca

SEQ ID NO: 2374085 - RNA, 15 nt, Human
uccucuuccccuugc

SEQ ID NO: 2374086 - RNA, 16 nt, Human
uccucuuccccuugcc

SEQ ID NO: 2374087 - RNA, 18 nt, Human
uccucuuccccuugcccu

SEQ ID NO: 2374088 - RNA, 19 nt, Human
uccucuuccccuugcccuu

SEQ ID NO: 2374089 - RNA, 12 nt, Human
uccucuuccucu

SEQ ID NO: 2374090 - RNA, 13 nt, Human
uccucuuccucug

SEQ ID NO: 2374091 - RNA, 16 nt, Human
uccucuguacagagcc

SEQ ID NO: 2374092 - RNA, 17 nt, Human
uccucuguacagagccc

SEQ ID NO: 2374093 - RNA, 18 nt, Human
uccucuguacagagccca

SEQ ID NO: 2374094 - RNA, 24 nt, Human
uccucuggacggcaggcucacugc

SEQ ID NO: 2374095 - RNA, 17 nt, Human
uccucauguucugcuuu

SEQ ID NO: 2374096 - RNA, 21 nt, Human
uccuccacguucugcucauca

SEQ ID NO: 2374097 - RNA, 16 nt, Human
uccuccacucuccccc

SEQ ID NO: 2374098 - RNA, 19 nt, Human
uccuccacucucccccacc

SEQ ID NO: 2374099 - RNA, 23 nt, Human
uccuccacguucugcucaucauu

SEQ ID NO: 2374100 - RNA, 22 nt, Human
uccuccacguucugcucaucau

SEQ ID NO: 2374101 - RNA, 18 nt, Human
uccuccagaagccucugg

SEQ ID NO: 2374102 - RNA, 16 nt, Human
uccuccagaagccucu

SEQ ID NO: 2374103 - RNA, 14 nt, Human
uccuccagaagccu

SEQ ID NO: 2374104 - RNA, 23 nt, Human
uccuccacucucccccacccccu

SEQ ID NO: 2374105 - RNA, 22 nt, Human
uccuccagaagccucuggcuag

SEQ ID NO: 2374106 - RNA, 21 nt, Human
uccuccagaagccucuggcua

SEQ ID NO: 2374107 - RNA, 20 nt, Human
uccuccagaagccucuggcu

SEQ ID NO: 2374108 - RNA, 19 nt, Human
uccuccagaagccucuggc

SEQ ID NO: 2374109 - RNA, 14 nt, Human
uccuccagcaggga

SEQ ID NO: 2374110 - RNA, 12 nt, Human
uccuccagcagg

SEQ ID NO: 2374111 - RNA, 20 nt, Human
uccuccugggcccucucugc

SEQ ID NO: 2374112 - RNA, 20 nt, Human
uccuccagcagggaaaaugc

SEQ ID NO: 2374113 - RNA, 13 nt, Human
uccuccugguggg

SEQ ID NO: 2374114 - RNA, 22 nt, Human
uccuccugggcccucucugcuc

SEQ ID NO: 2374115 - RNA, 15 nt, Human
uccuccuuccaugga

SEQ ID NO: 2374116 - RNA, 13 nt, Human
uccuccuucccaa

SEQ ID NO: 2374117 - RNA, 13 nt, Human
uccuccuuccaug

SEQ ID NO: 2374118 - RNA, 22 nt, Human
uccuccugguggguccaggggc

SEQ ID NO: 2374119 - RNA, 16 nt, Human
uccuccuguguacagg

SEQ ID NO: 2374120 - RNA, 20 nt, Human
uccuccugguggguccaggg

SEQ ID NO: 2374121 - RNA, 21 nt, Human
uccuccugguggguccagggg

SEQ ID NO: 2374122 - RNA, 16 nt, Human
uccuccuuggugccug

SEQ ID NO: 2374123 - RNA, 17 nt, Human
uccuccuuggugccugg

SEQ ID NO: 2374124 - RNA, 19 nt, Human
uccuccuuggugccuggcc

SEQ ID NO: 2374125 - RNA, 16 nt, Human
uccucgguacucccau

SEQ ID NO: 2374126 - RNA, 20 nt, Human
uccucuaagccacucuucca

SEQ ID NO: 2374127 - RNA, 18 nt, Human
uccucuacuaacaaucag

SEQ ID NO: 2374128 - RNA, 17 nt, Human
uccucuacuaacaauca

SEQ ID NO: 2374129 - RNA, 19 nt, Human
uccucuacuuaaugagaua

SEQ ID NO: 2374130 - RNA, 14 nt, Human
uccucuagaagcca

SEQ ID NO: 2374131 - RNA, 16 nt, Human
uccucuagaagccaag

SEQ ID NO: 2374132 - RNA, 17 nt, Human
uccucuagaagccaagg

SEQ ID NO: 2374133 - RNA, 18 nt, Human
uccucuacuuaaugagau

SEQ ID NO: 2374134 - RNA, 21 nt, Human
uccucuaagccacucuuccaa

SEQ ID NO: 2374135 - RNA, 19 nt, Human
uccucuacuaacaaucagc

SEQ ID NO: 2374136 - RNA, 14 nt, Human
uccucuaggagguc

SEQ ID NO: 2374137 - RNA, 14 nt, Human
uccucgcccugggu

SEQ ID NO: 2374138 - RNA, 13 nt, Human
uccucgcccuggg

SEQ ID NO: 2374139 - RNA, 13 nt, Human
uccucgccugaca

SEQ ID NO: 2374140 - RNA, 24 nt, Human
uccucgcagagaggccaggugcag

SEQ ID NO: 2374141 - RNA, 19 nt, Human
uccuccuuuucacaguucu

SEQ ID NO: 2374142 - RNA, 19 nt, Human
uccucggaucaccgagagu

SEQ ID NO: 2374143 - RNA, 14 nt, Human
uccucggcccccuc

SEQ ID NO: 2374144 - RNA, 16 nt, Human
uccucggaucaccgag

SEQ ID NO: 2374145 - RNA, 15 nt, Human
uccucgccugacaac

SEQ ID NO: 2374146 - RNA, 24 nt, Human
uccucgccugacaaccacuggucu

SEQ ID NO: 2374147 - RNA, 15 nt, Human
uccucgguacuccca

SEQ ID NO: 2374148 - RNA, 17 nt, Human
uccucgguacucccaua

SEQ ID NO: 2374149 - RNA, 15 nt, Human
uccucggcccccucc

SEQ ID NO: 2374150 - RNA, 19 nt, Human
uccucggcccccuccaucg

SEQ ID NO: 2374151 - RNA, 14 nt, Human
uccucggccuggcu

SEQ ID NO: 2374152 - RNA, 15 nt, Human
uccucggccuggcuc

SEQ ID NO: 2374153 - RNA, 14 nt, Human
ucccugccgccuca

SEQ ID NO: 2374154 - RNA, 17 nt, Human
ucccugcccucaucucu

SEQ ID NO: 2374155 - RNA, 15 nt, Human
ucccugcccucaucu

SEQ ID NO: 2374156 - RNA, 16 nt, Human
ucccugcccucaucuc

SEQ ID NO: 2374157 - RNA, 20 nt, Human
ucccugccccucccuucaac

SEQ ID NO: 2374158 - RNA, 23 nt, Human
ucccugccugguccucacacuca

SEQ ID NO: 2374159 - RNA, 11 nt, Human
ucccugccugg

SEQ ID NO: 2374160 - RNA, 23 nt, Human
ucccugccucucaucaacugaau

SEQ ID NO: 2374161 - RNA, 17 nt, Human
ucccugccucucaucaa

SEQ ID NO: 2374162 - RNA, 17 nt, Human
ucccuggagccagacuc

SEQ ID NO: 2374163 - RNA, 13 nt, Human
ucccuggaaggug

SEQ ID NO: 2374164 - RNA, 12 nt, Human
ucccugcuucca

SEQ ID NO: 2374165 - RNA, 14 nt, Human
ucccugcuuccagg

SEQ ID NO: 2374166 - RNA, 18 nt, Human
ucccugcuuccaggaaac

SEQ ID NO: 2374167 - RNA, 13 nt, Human
ucccugcuguccc

SEQ ID NO: 2374168 - RNA, 14 nt, Human
ucccugcugucccc

SEQ ID NO: 2374169 - RNA, 17 nt, Human
ucccugcuguccccucu

SEQ ID NO: 2374170 - RNA, 21 nt, Human
ucccugcuguccccucuugcc

SEQ ID NO: 2374171 - RNA, 22 nt, Human
ucccugcuguccccucuugccc

SEQ ID NO: 2374172 - RNA, 19 nt, Human
ucccugcugucgucuuagc

SEQ ID NO: 2374173 - RNA, 16 nt, Human
ucccugcuguguuccc

SEQ ID NO: 2374174 - RNA, 17 nt, Human
ucccugcuccacgucug

SEQ ID NO: 2374175 - RNA, 23 nt, Human
ucccugcuagggguuuuaggucu

SEQ ID NO: 2374176 - RNA, 15 nt, Human
ucccugccuggucac

SEQ ID NO: 2374177 - RNA, 20 nt, Human
ucccucucucuucugcucca

SEQ ID NO: 2374178 - RNA, 22 nt, Human
ucccucucucugacucucaaau

SEQ ID NO: 2374179 - RNA, 19 nt, Human
ucccucucucuucugcucc

SEQ ID NO: 2374180 - RNA, 18 nt, Human
ucccucucucuucugcuc

SEQ ID NO: 2374181 - RNA, 16 nt, Human
ucccucucucuucugc

SEQ ID NO: 2374182 - RNA, 12 nt, Human
ucccucucucuu

SEQ ID NO: 2374183 - RNA, 15 nt, Human
ucccucucucugacu

SEQ ID NO: 2374184 - RNA, 17 nt, Human
ucccucucucugacucu

SEQ ID NO: 2374185 - RNA, 16 nt, Human
ucccucuccugccuac

SEQ ID NO: 2374186 - RNA, 13 nt, Human
ucccucucucuga

SEQ ID NO: 2374187 - RNA, 12 nt, Human
ucccucucggaa

SEQ ID NO: 2374188 - RNA, 15 nt, Human
ucccucuccugccua

SEQ ID NO: 2374189 - RNA, 14 nt, Human
ucccucuccugccu

SEQ ID NO: 2374190 - RNA, 13 nt, Human
ucccucuccugcc

SEQ ID NO: 2374191 - RNA, 12 nt, Human
ucccucucccug

SEQ ID NO: 2374192 - RNA, 23 nt, Human
ucccucucggaaggcuggcuggg

SEQ ID NO: 2374193 - RNA, 22 nt, Human
ucccucucggaaggcuggcugg

SEQ ID NO: 2374194 - RNA, 12 nt, Human
ucccucucucug

SEQ ID NO: 2374195 - RNA, 14 nt, Human
ucccugcacuugca

SEQ ID NO: 2374196 - RNA, 19 nt, Human
ucccugccccucccuucaa

SEQ ID NO: 2374197 - RNA, 13 nt, Human
ucccugcacuugc

SEQ ID NO: 2374198 - RNA, 23 nt, Human
ucccuugaggaaacaacagcuuu

SEQ ID NO: 2374199 - RNA, 14 nt, Human
ucccuugagcccuc

SEQ ID NO: 2374200 - RNA, 16 nt, Human
ucccuugaugaagaag

SEQ ID NO: 2374201 - RNA, 19 nt, Human
ucccuugagaccucagcca

SEQ ID NO: 2374202 - RNA, 18 nt, Human
uccgaaccuccucuguga

SEQ ID NO: 2374203 - RNA, 22 nt, Human
uccgaaccuccucugugaagca

SEQ ID NO: 2374204 - RNA, 21 nt, Human
uccgaaguaugagggaaaaug

SEQ ID NO: 2374205 - RNA, 20 nt, Human
uccgacaaccgaugcuccag

SEQ ID NO: 2374206 - RNA, 19 nt, Human
uccgaaccuccucugugaa

SEQ ID NO: 2374207 - RNA, 23 nt, Human
uccgacaaccgaugcuccagcca

SEQ ID NO: 2374208 - RNA, 17 nt, Human
uccgacagcccccucug

SEQ ID NO: 2374209 - RNA, 22 nt, Human
uccgacaaccgaugcuccagcc

SEQ ID NO: 2374210 - RNA, 21 nt, Human
uccgacaaccgaugcuccagc

SEQ ID NO: 2374211 - RNA, 20 nt, Human
uccgaccacuaauugccaag

SEQ ID NO: 2374212 - RNA, 20 nt, Human
uccgacagcccccucugccg

SEQ ID NO: 2374213 - RNA, 17 nt, Human
ucccuuccuuuucccug

SEQ ID NO: 2374214 - RNA, 18 nt, Human
ucccuuccuuuucccugc

SEQ ID NO: 2374215 - RNA, 19 nt, Human
ucccuuccuuuucccugcu

SEQ ID NO: 2374216 - RNA, 20 nt, Human
ucccuuccuuuucccugcuu

SEQ ID NO: 2374217 - RNA, 15 nt, Human
ucccuucuaccugcc

SEQ ID NO: 2374218 - RNA, 20 nt, Human
ucccuucuaccugccacuca

SEQ ID NO: 2374219 - RNA, 11 nt, Human
ucccuucucca

SEQ ID NO: 2374220 - RNA, 22 nt, Human
ucccuucuaggguuauugcauu

SEQ ID NO: 2374221 - RNA, 18 nt, Human
ucccuugagaccucagcc

SEQ ID NO: 2374222 - RNA, 23 nt, Human
ucccuucucuguagggaacucug

SEQ ID NO: 2374223 - RNA, 20 nt, Human
ucccuucucuguagggaacu

SEQ ID NO: 2374224 - RNA, 16 nt, Human
ucccuucuccaucucu

SEQ ID NO: 2374225 - RNA, 21 nt, Human
ucccuucuccaucucucuggc

SEQ ID NO: 2374226 - RNA, 22 nt, Human
ucccuucuccaucucucuggcc

SEQ ID NO: 2374227 - RNA, 15 nt, Human
ucccuugaugaagaa

SEQ ID NO: 2374228 - RNA, 10 nt, Human
ucccuggagu

SEQ ID NO: 2374229 - RNA, 11 nt, Human
ucccuggagug

SEQ ID NO: 2374230 - RNA, 21 nt, Human
ucccuggaguguggcugagga

SEQ ID NO: 2374231 - RNA, 19 nt, Human
ucccuggagccagacucug

SEQ ID NO: 2374232 - RNA, 22 nt, Human
ucccuggagccagacucugguc

SEQ ID NO: 2374233 - RNA, 22 nt, Human
ucccuggaguguggcugaggag

SEQ ID NO: 2374234 - RNA, 13 nt, Human
ucccuggccuguu

SEQ ID NO: 2374235 - RNA, 18 nt, Human
ucccuggccuguucuguu

SEQ ID NO: 2374236 - RNA, 14 nt, Human
ucccuggccuguuc

SEQ ID NO: 2374237 - RNA, 11 nt, Human
ucccuggccuu

SEQ ID NO: 2374238 - RNA, 21 nt, Human
ucccuucaucuggaaccauca

SEQ ID NO: 2374239 - RNA, 18 nt, Human
ucccuucaugcauggaaa

SEQ ID NO: 2374240 - RNA, 17 nt, Human
ucccuucaugcauggaa

SEQ ID NO: 2374241 - RNA, 16 nt, Human
ucccuuccacaccccc

SEQ ID NO: 2374242 - RNA, 18 nt, Human
ucccuuccacacccccac

SEQ ID NO: 2374243 - RNA, 13 nt, Human
ucccuucccaccu

SEQ ID NO: 2374244 - RNA, 16 nt, Human
ucccuaguaaaaauac

SEQ ID NO: 2374245 - RNA, 18 nt, Human
ucccuaggggacacuucc

SEQ ID NO: 2374246 - RNA, 24 nt, Human
ucccuacauguauugcacauugua

SEQ ID NO: 2374247 - RNA, 13 nt, Human
ucccuacauguau

SEQ ID NO: 2374248 - RNA, 15 nt, Human
ucccuaggagaccaa

SEQ ID NO: 2374249 - RNA, 18 nt, Human
ucccuaaaaacacagaca

SEQ ID NO: 2374250 - RNA, 16 nt, Human
ucccuaaucuaugguc

SEQ ID NO: 2374251 - RNA, 23 nt, Human
ucccuaaucuauggucgggagac

SEQ ID NO: 2374252 - RNA, 14 nt, Human
ucccuaaugcugca

SEQ ID NO: 2374253 - RNA, 20 nt, Human
ucccuaaugcugcagauuug

SEQ ID NO: 2374254 - RNA, 16 nt, Human
ucccuaauaaagcugu

SEQ ID NO: 2374255 - RNA, 19 nt, Human
ucccuaucuuugccacccu

SEQ ID NO: 2374256 - RNA, 13 nt, Human
ucccuauguauuu

SEQ ID NO: 2374257 - RNA, 15 nt, Human
ucccuauguauuugc

SEQ ID NO: 2374258 - RNA, 18 nt, Human
ucccuagucuucaagcag

SEQ ID NO: 2374259 - RNA, 22 nt, Human
ucccuagucuauucauuauauu

SEQ ID NO: 2374260 - RNA, 17 nt, Human
ucccuagucuauucauu

SEQ ID NO: 2374261 - RNA, 20 nt, Human
ucccuagugacccggaggcc

SEQ ID NO: 2374262 - RNA, 18 nt, Human
ucccuccucaccucugga

SEQ ID NO: 2374263 - RNA, 17 nt, Human
ucccuccucaccucugg

SEQ ID NO: 2374264 - RNA, 16 nt, Human
ucccuccucaccucug

SEQ ID NO: 2374265 - RNA, 14 nt, Human
ucccuccucaccuc

SEQ ID NO: 2374266 - RNA, 16 nt, Human
ucccuauuagagaaga

SEQ ID NO: 2374267 - RNA, 19 nt, Human
ucccucgcugcacaaauac

SEQ ID NO: 2374268 - RNA, 22 nt, Human
ucccucgcugcacaaauacucc

SEQ ID NO: 2374269 - RNA, 14 nt, Human
ucccucuaauuuau

SEQ ID NO: 2374270 - RNA, 16 nt, Human
ucccucuaauuuaucu

SEQ ID NO: 2374271 - RNA, 15 nt, Human
ucccucuacugggag

SEQ ID NO: 2374272 - RNA, 22 nt, Human
ucccucuacagagcuucccuga

SEQ ID NO: 2374273 - RNA, 21 nt, Human
ucccucuacagagcuucccug

SEQ ID NO: 2374274 - RNA, 17 nt, Human
ucccucuacugggagcc

SEQ ID NO: 2374275 - RNA, 14 nt, Human
ucccuccugcuacu

SEQ ID NO: 2374276 - RNA, 18 nt, Human
ucccuauguauuugcagu

SEQ ID NO: 2374277 - RNA, 16 nt, Human
ucccuccugccgacuc

SEQ ID NO: 2374278 - RNA, 21 nt, Human
ucccuccugccgacuccuggg

SEQ ID NO: 2374279 - RNA, 18 nt, Human
ucccuccugggaucugcu

SEQ ID NO: 2374280 - RNA, 19 nt, Human
ucccuccugggaucugcuc

SEQ ID NO: 2374281 - RNA, 19 nt, Human
ucccuccugggaaugaagc

SEQ ID NO: 2374282 - RNA, 15 nt, Human
ucccuccucuguccc

SEQ ID NO: 2374283 - RNA, 11 nt, Human
ucccuccuggg

SEQ ID NO: 2374284 - RNA, 16 nt, Human
ucccguggaacguuuu

SEQ ID NO: 2374285 - RNA, 22 nt, Human
ucccguggaacguuuuuccugu

SEQ ID NO: 2374286 - RNA, 23 nt, Human
ucccguggaacguuuuuccuguu

SEQ ID NO: 2374287 - RNA, 13 nt, Human
ucccgugcagcuu

SEQ ID NO: 2374288 - RNA, 12 nt, Human
ucccguggcccc

SEQ ID NO: 2374289 - RNA, 21 nt, Human
ucccgucccauauccugccuc

SEQ ID NO: 2374290 - RNA, 17 nt, Human
ucccgucuacucauucc

SEQ ID NO: 2374291 - RNA, 14 nt, Human
ucccggggcuccac

SEQ ID NO: 2374292 - RNA, 19 nt, Human
ucccgggguccuguggcag

SEQ ID NO: 2374293 - RNA, 18 nt, Human
ucccgggcccucccuugg

SEQ ID NO: 2374294 - RNA, 16 nt, Human
ucccgucagggcccaa

SEQ ID NO: 2374295 - RNA, 16 nt, Human
ucccgguucuuccagu

SEQ ID NO: 2374296 - RNA, 20 nt, Human
ucccgucagggcccaagucc

SEQ ID NO: 2374297 - RNA, 23 nt, Human
ucccgucagggcccaagucccug

SEQ ID NO: 2374298 - RNA, 18 nt, Human
ucccgucccauauccugc

SEQ ID NO: 2374299 - RNA, 20 nt, Human
ucccgucccauauccugccu

SEQ ID NO: 2374300 - RNA, 14 nt, Human
ucccuaauaaagcu

SEQ ID NO: 2374301 - RNA, 23 nt, Human
ucccguuuagaguuauuuaggcu

SEQ ID NO: 2374302 - RNA, 15 nt, Human
ucccuaauaaagcug

SEQ ID NO: 2374303 - RNA, 15 nt, Human
ucccguguucuccuu

SEQ ID NO: 2374304 - RNA, 20 nt, Human
ucccguuucuccaccuagac

SEQ ID NO: 2374305 - RNA, 21 nt, Human
ucccguggccccagccuggcc

SEQ ID NO: 2374306 - RNA, 22 nt, Human
ucccguggccccagccuggccc

SEQ ID NO: 2374307 - RNA, 23 nt, Human
ucccguggccccagccuggccca

SEQ ID NO: 2374308 - RNA, 24 nt, Human
ucccguggccccagccuggcccag

SEQ ID NO: 2374309 - RNA, 13 nt, Human
ucccguggcccca

SEQ ID NO: 2374310 - RNA, 14 nt, Human
ucccguggccccag

SEQ ID NO: 2374311 - RNA, 15 nt, Human
ucccguggccccagc

SEQ ID NO: 2374312 - RNA, 16 nt, Human
ucccguggccccagcc

SEQ ID NO: 2374313 - RNA, 17 nt, Human
ucccguggccccagccu

SEQ ID NO: 2374314 - RNA, 18 nt, Human
ucccguggccccagccug

SEQ ID NO: 2374315 - RNA, 19 nt, Human
ucccguggccccagccugg

SEQ ID NO: 2374316 - RNA, 20 nt, Human
ucccguggccccagccuggc

SEQ ID NO: 2374317 - RNA, 18 nt, Human
uccagguuuaagcuguua

SEQ ID NO: 2374318 - RNA, 18 nt, Human
uccccuguuuguuucuga

SEQ ID NO: 2374319 - RNA, 20 nt, Human
uccccuguuuguuucugaaa

SEQ ID NO: 2374320 - RNA, 17 nt, Human
uccagguuuaagcuguu

SEQ ID NO: 2374321 - RNA, 18 nt, Human
uccagguguuacuguaau

SEQ ID NO: 2374322 - RNA, 21 nt, Human
ucccgggcccguugaggauga

SEQ ID NO: 2374323 - RNA, 13 nt, Human
ucccgggcccucc

SEQ ID NO: 2374324 - RNA, 14 nt, Human
ucccgggcccuccc

SEQ ID NO: 2374325 - RNA, 15 nt, Human
ucccgggcccucccu

SEQ ID NO: 2374326 - RNA, 15 nt, Human
ucccgggacgcagca

SEQ ID NO: 2374327 - RNA, 21 nt, Human
uccccuguuuguuucugaaag

SEQ ID NO: 2374328 - RNA, 17 nt, Human
uccaggugugcacgugg

SEQ ID NO: 2374329 - RNA, 14 nt, Human
uccuuuucagaagu

SEQ ID NO: 2374330 - RNA, 14 nt, Human
uccuuuuauguuau

SEQ ID NO: 2374331 - RNA, 15 nt, Human
uccuuuuauguuauu

SEQ ID NO: 2374332 - RNA, 14 nt, Human
uccuuuuagccuag

SEQ ID NO: 2374333 - RNA, 12 nt, Human
uccuuuuauguu

SEQ ID NO: 2374334 - RNA, 15 nt, Human
uccuuuuagccuagu

SEQ ID NO: 2374335 - RNA, 13 nt, Human
uccuuuucccugc

SEQ ID NO: 2374336 - RNA, 15 nt, Human
uccuuuuccucucuc

SEQ ID NO: 2374337 - RNA, 14 nt, Human
uccuuuucccugcu

SEQ ID NO: 2374338 - RNA, 15 nt, Human
uccuuuucccugcuu

SEQ ID NO: 2374339 - RNA, 19 nt, Human
ucgaaaccugggauucagg

SEQ ID NO: 2374340 - RNA, 13 nt, Human
ucgaaacacagaa

SEQ ID NO: 2374341 - RNA, 18 nt, Human
ucgaaacacagaaaccuu

SEQ ID NO: 2374342 - RNA, 15 nt, Human
ucgagggcagggacu

SEQ ID NO: 2374343 - RNA, 20 nt, Human
ucgaggcugcagucagucau

SEQ ID NO: 2374344 - RNA, 16 nt, Human
ucgaggcugcagucag

SEQ ID NO: 2374345 - RNA, 22 nt, Human
ucgaggcggaucuuuggacaga

SEQ ID NO: 2374346 - RNA, 17 nt, Human
ucgaggcggaucuuugg

SEQ ID NO: 2374347 - RNA, 12 nt, Human
ucgaaauaacaa

SEQ ID NO: 2374348 - RNA, 14 nt, Human
ucgaaauaacaaug

SEQ ID NO: 2374349 - RNA, 16 nt, Human
ucgaaauaacaauguu

SEQ ID NO: 2374350 - RNA, 18 nt, Human
ucgaaauaacaauguuaa

SEQ ID NO: 2374351 - RNA, 19 nt, Human
ucgaaauaacaauguuaag

SEQ ID NO: 2374352 - RNA, 20 nt, Human
ucgaaauaacaauguuaagg

SEQ ID NO: 2374353 - RNA, 15 nt, Human
ucgaacuccugaccu

SEQ ID NO: 2374354 - RNA, 18 nt, Human
ucgaaccguuuugaagcu

SEQ ID NO: 2374355 - RNA, 15 nt, Human
ucgaaccguuuugaa

SEQ ID NO: 2374356 - RNA, 20 nt, Human
uccuuuuaaaucuugauacc

SEQ ID NO: 2374357 - RNA, 13 nt, Human
uccuuuuagccua

SEQ ID NO: 2374358 - RNA, 17 nt, Human
uccuuuuaauuuuccug

SEQ ID NO: 2374359 - RNA, 23 nt, Human
uccuuuucacaguucucuccuuc

SEQ ID NO: 2374360 - RNA, 19 nt, Human
uccuuuguuuuuuuuuccu

SEQ ID NO: 2374361 - RNA, 23 nt, Human
uccuuuguuuuuuuuuccugucc

SEQ ID NO: 2374362 - RNA, 19 nt, Human
uccuuuuaaaacacuucca

SEQ ID NO: 2374363 - RNA, 15 nt, Human
uccuuuguuuuuaug

SEQ ID NO: 2374364 - RNA, 24 nt, Human
uccuuuguucuuaccuguaugucu

SEQ ID NO: 2374365 - RNA, 16 nt, Human
uccuuuguucuuaccu

SEQ ID NO: 2374366 - RNA, 20 nt, Human
uccuuggcaugccuuccagc

SEQ ID NO: 2374367 - RNA, 10 nt, Human
uccuuuguuc

SEQ ID NO: 2374368 - RNA, 18 nt, Human
uccuuggcaugccuucca

SEQ ID NO: 2374369 - RNA, 17 nt, Human
uccuuggcaugccuucc

SEQ ID NO: 2374370 - RNA, 15 nt, Human
uccuuggcaugccuu

SEQ ID NO: 2374371 - RNA, 20 nt, Human
uccuuggcaucacagggcag

SEQ ID NO: 2374372 - RNA, 12 nt, Human
uccuuggaaauc

SEQ ID NO: 2374373 - RNA, 16 nt, Human
uccuuggaaguuucau

SEQ ID NO: 2374374 - RNA, 19 nt, Human
uccuuggauaggcuuuuua

SEQ ID NO: 2374375 - RNA, 16 nt, Human
uccuuggacucauuuu

SEQ ID NO: 2374376 - RNA, 20 nt, Human
uccuucacauccuguguuuc

SEQ ID NO: 2374377 - RNA, 14 nt, Human
uccuucacauccug

SEQ ID NO: 2374378 - RNA, 19 nt, Human
uccuucacagaugggugcu

SEQ ID NO: 2374379 - RNA, 18 nt, Human
uccuucaccuuugucccc

SEQ ID NO: 2374380 - RNA, 20 nt, Human
uccuucaccuuuguccccac

SEQ ID NO: 2374381 - RNA, 16 nt, Human
uccuuaccagcagagc

SEQ ID NO: 2374382 - RNA, 17 nt, Human
uccuuaccagcagagca

SEQ ID NO: 2374383 - RNA, 18 nt, Human
uccuuaccagcagagcac

SEQ ID NO: 2374384 - RNA, 18 nt, Human
uccuucacagaugggugc

SEQ ID NO: 2374385 - RNA, 21 nt, Human
uccuugaccagcagaucccag

SEQ ID NO: 2374386 - RNA, 13 nt, Human
uccuugaccagca

SEQ ID NO: 2374387 - RNA, 23 nt, Human
uccuucagacacccucaaccucu

SEQ ID NO: 2374388 - RNA, 12 nt, Human
uccuugaagccg

SEQ ID NO: 2374389 - RNA, 23 nt, Human
uccuugagacacggagcccagcc

SEQ ID NO: 2374390 - RNA, 21 nt, Human
uccuugagacacggagcccag

SEQ ID NO: 2374391 - RNA, 17 nt, Human
uccuugagacacggagc

SEQ ID NO: 2374392 - RNA, 16 nt, Human
uccuugagagaccagg

SEQ ID NO: 2374393 - RNA, 20 nt, Human
uccuugagagaccaggcaaa

SEQ ID NO: 2374394 - RNA, 22 nt, Human
uccuugcuuaugacaucacuug

SEQ ID NO: 2374395 - RNA, 13 nt, Human
uccuugcuuggcu

SEQ ID NO: 2374396 - RNA, 21 nt, Human
uccuucaccuuuguccccacc

SEQ ID NO: 2374397 - RNA, 22 nt, Human
uccuucaccuuuguccccaccg

SEQ ID NO: 2374398 - RNA, 13 nt, Human
uccuucagacacc

SEQ ID NO: 2374399 - RNA, 20 nt, Human
uccuugaagaacugcaggcc

SEQ ID NO: 2374400 - RNA, 21 nt, Human
uccuugaagaacugcaggccc

SEQ ID NO: 2374401 - RNA, 23 nt, Human
uccuugaagaacugcaggcccug

SEQ ID NO: 2374402 - RNA, 12 nt, Human
uccuucagacac

SEQ ID NO: 2374403 - RNA, 17 nt, Human
uccuucaccucacugaa

SEQ ID NO: 2374404 - RNA, 19 nt, Human
uccuucaccucacugaaaa

SEQ ID NO: 2374405 - RNA, 13 nt, Human
uccuucaccucug

SEQ ID NO: 2374406 - RNA, 14 nt, Human
uccugccucagccu

SEQ ID NO: 2374407 - RNA, 14 nt, Human
uccugagccagauu

SEQ ID NO: 2374408 - RNA, 20 nt, Human
uccugccuaagugcagcccc

SEQ ID NO: 2374409 - RNA, 14 nt, Human
uccugagaccccug

SEQ ID NO: 2374410 - RNA, 16 nt, Human
uccugagaccccuggc

SEQ ID NO: 2374411 - RNA, 17 nt, Human
uccugagaccccuggcc

SEQ ID NO: 2374412 - RNA, 23 nt, Human
uccucuucugcuuaggagagacc

SEQ ID NO: 2374413 - RNA, 13 nt, Human
uccucuucuuuau

SEQ ID NO: 2374414 - RNA, 20 nt, Human
uccugagaccccuggccucc

SEQ ID NO: 2374415 - RNA, 18 nt, Human
uccugagaccccuggccu

SEQ ID NO: 2374416 - RNA, 19 nt, Human
uccugagaccccuggccuc

SEQ ID NO: 2374417 - RNA, 21 nt, Human
uccugagaccccuggccuccg

SEQ ID NO: 2374418 - RNA, 13 nt, Human
uccugagccagau

SEQ ID NO: 2374419 - RNA, 17 nt, Human
uccugccucagccuccc

SEQ ID NO: 2374420 - RNA, 16 nt, Human
uccugccucagccucc

SEQ ID NO: 2374421 - RNA, 13 nt, Human
uccugccucagcc

SEQ ID NO: 2374422 - RNA, 15 nt, Human
uccugccucagccuc

SEQ ID NO: 2374423 - RNA, 14 nt, Human
uccuggcacccggc

SEQ ID NO: 2374424 - RNA, 16 nt, Human
uccuggcacccggccc

SEQ ID NO: 2374425 - RNA, 19 nt, Human
uccuggcacccggccccug

SEQ ID NO: 2374426 - RNA, 16 nt, Human
uccuguccucagcuuc

SEQ ID NO: 2374427 - RNA, 21 nt, Human
uccuguacacugaauauuuau

SEQ ID NO: 2374428 - RNA, 11 nt, Human
uccuguccucc

SEQ ID NO: 2374429 - RNA, 21 nt, Human
uccuguccucccauccccugg

SEQ ID NO: 2374430 - RNA, 22 nt, Human
uccuguccuucucucaccuccu

SEQ ID NO: 2374431 - RNA, 23 nt, Human
uccuguccuuuacacauucggcu

SEQ ID NO: 2374432 - RNA, 17 nt, Human
uccuguacacugaauau

SEQ ID NO: 2374433 - RNA, 16 nt, Human
uccuguacacugaaua

SEQ ID NO: 2374434 - RNA, 14 nt, Human
uccuguacauugug

SEQ ID NO: 2374435 - RNA, 13 nt, Human
uccuguaauuccu

SEQ ID NO: 2374436 - RNA, 15 nt, Human
uccuguaauuccuac

SEQ ID NO: 2374437 - RNA, 16 nt, Human
uccuguaauuccuacc

SEQ ID NO: 2374438 - RNA, 21 nt, Human
uccuguaauuccuaccucccu

SEQ ID NO: 2374439 - RNA, 20 nt, Human
uccuguaaaugguguacaua

SEQ ID NO: 2374440 - RNA, 20 nt, Human
uccuguaacacaagccacag

SEQ ID NO: 2374441 - RNA, 21 nt, Human
uccuguaacacaagccacaga

SEQ ID NO: 2374442 - RNA, 23 nt, Human
uccuguaacacaagccacagaag

SEQ ID NO: 2374443 - RNA, 20 nt, Human
uccuguacauugugggaugu

SEQ ID NO: 2374444 - RNA, 22 nt, Human
uccuguaccucuugagccuuga

SEQ ID NO: 2374445 - RNA, 20 nt, Human
uccuguaccucuugagccuu

SEQ ID NO: 2374446 - RNA, 20 nt, Human
uccuggcaauaguguguucu

SEQ ID NO: 2374447 - RNA, 11 nt, Human
uccugccuacu

SEQ ID NO: 2374448 - RNA, 22 nt, Human
uccuggcaauaguguguucuga

SEQ ID NO: 2374449 - RNA, 21 nt, Human
uccuggcaauaguguguucug

SEQ ID NO: 2374450 - RNA, 23 nt, Human
uccuggcaauaguguguucugau

SEQ ID NO: 2374451 - RNA, 15 nt, Human
uccuggcagaaugcu

SEQ ID NO: 2374452 - RNA, 18 nt, Human
uccuggcacugcuuccag

SEQ ID NO: 2374453 - RNA, 22 nt, Human
uccuggcacugcuuccagugag

SEQ ID NO: 2374454 - RNA, 20 nt, Human
uccuggcacccggccccugc

SEQ ID NO: 2374455 - RNA, 21 nt, Human
uccuggcacccggccccugcu

SEQ ID NO: 2374456 - RNA, 22 nt, Human
uccuggcacccggccccugcug

SEQ ID NO: 2374457 - RNA, 17 nt, Human
uccuggcacugcuucca

SEQ ID NO: 2374458 - RNA, 16 nt, Human
ucuacuuuaagcacua

SEQ ID NO: 2374459 - RNA, 22 nt, Human
ucuaauucccauuuugcaaaau

SEQ ID NO: 2374460 - RNA, 21 nt, Human
ucuaauucccauuuugcaaaa

SEQ ID NO: 2374461 - RNA, 19 nt, Human
ucuaauucccauuuugcaa

SEQ ID NO: 2374462 - RNA, 18 nt, Human
ucuaauucccauuuugca

SEQ ID NO: 2374463 - RNA, 20 nt, Human
ucuaauucuaaggaauauga

SEQ ID NO: 2374464 - RNA, 22 nt, Human
ucuacuuuagaaugagagugug

SEQ ID NO: 2374465 - RNA, 14 nt, Human
ucuacuuuauuaau

SEQ ID NO: 2374466 - RNA, 12 nt, Human
ucuacuuugaag

SEQ ID NO: 2374467 - RNA, 20 nt, Human
ucuacuuugaagucauacca

SEQ ID NO: 2374468 - RNA, 21 nt, Human
ucuacuuuauuaauuguuuug

SEQ ID NO: 2374469 - RNA, 16 nt, Human
ucuacuuugaggaaac

SEQ ID NO: 2374470 - RNA, 14 nt, Human
ucuacuuuuaaaga

SEQ ID NO: 2374471 - RNA, 14 nt, Human
ucuaauauguaaca

SEQ ID NO: 2374472 - RNA, 14 nt, Human
ucuaaugugugaau

SEQ ID NO: 2374473 - RNA, 16 nt, Human
ucuaggagcugggagg

SEQ ID NO: 2374474 - RNA, 18 nt, Human
ucuaggacgccacccagc

SEQ ID NO: 2374475 - RNA, 22 nt, Human
ucuagaaagccuguuccccuca

SEQ ID NO: 2374476 - RNA, 16 nt, Human
ucuagaacacaggcaa

SEQ ID NO: 2374477 - RNA, 15 nt, Human
ucuagaacacaggca

SEQ ID NO: 2374478 - RNA, 13 nt, Human
ucuagaacacagg

SEQ ID NO: 2374479 - RNA, 21 nt, Human
ucuaggagcugggaggaaaag

SEQ ID NO: 2374480 - RNA, 20 nt, Human
ucuaggagcugggaggaaaa

SEQ ID NO: 2374481 - RNA, 18 nt, Human
ucuaggagcugggaggaa

SEQ ID NO: 2374482 - RNA, 17 nt, Human
ucuaggagcugggagga

SEQ ID NO: 2374483 - RNA, 20 nt, Human
ucuagucuccuuugcacuga

SEQ ID NO: 2374484 - RNA, 19 nt, Human
ucuagugagcagucaggaa

SEQ ID NO: 2374485 - RNA, 14 nt, Human
ucuagugcagcuga

SEQ ID NO: 2374486 - RNA, 18 nt, Human
ucuagucucucuggggcc

SEQ ID NO: 2374487 - RNA, 19 nt, Human
ucuaggagggagacacugg

SEQ ID NO: 2374488 - RNA, 22 nt, Human
ucuagucuccuuugcacugagg

SEQ ID NO: 2374489 - RNA, 14 nt, Human
ucuagucucucugg

SEQ ID NO: 2374490 - RNA, 22 nt, Human
ucuagugagcagucaggaaaga

SEQ ID NO: 2374491 - RNA, 16 nt, Human
ucuagugcagcugauu

SEQ ID NO: 2374492 - RNA, 15 nt, Human
ucuaucaaguauuau

SEQ ID NO: 2374493 - RNA, 22 nt, Human
ucuaucaaguauuauaccuuuu

SEQ ID NO: 2374494 - RNA, 21 nt, Human
ucuaucaaguauuauaccuuu

SEQ ID NO: 2374495 - RNA, 13 nt, Human
ucuaugaaauauu

SEQ ID NO: 2374496 - RNA, 14 nt, Human
ucuaugaaauauua

SEQ ID NO: 2374497 - RNA, 17 nt, Human
ucuaugaaauauuaugu

SEQ ID NO: 2374498 - RNA, 16 nt, Human
ucucaaaguuuugaaa

SEQ ID NO: 2374499 - RNA, 17 nt, Human
ucucaaauaacuaaaag

SEQ ID NO: 2374500 - RNA, 15 nt, Human
ucucaacuccaaacu

SEQ ID NO: 2374501 - RNA, 14 nt, Human
ucuaugccagcuca

SEQ ID NO: 2374502 - RNA, 16 nt, Human
ucuaugccaaagauca

SEQ ID NO: 2374503 - RNA, 17 nt, Human
ucuaugccaaagaucac

SEQ ID NO: 2374504 - RNA, 15 nt, Human
ucuaugcauuuucug

SEQ ID NO: 2374505 - RNA, 15 nt, Human
ucuaugccaaagauc

SEQ ID NO: 2374506 - RNA, 22 nt, Human
ucuaugauuccagguggcauca

SEQ ID NO: 2374507 - RNA, 14 nt, Human
ucuaugcauuuucu

SEQ ID NO: 2374508 - RNA, 15 nt, Human
ucuaugaugcuguug

SEQ ID NO: 2374509 - RNA, 12 nt, Human
ucuaugcucucg

SEQ ID NO: 2374510 - RNA, 21 nt, Human
ucuaugccaaagaucacuugu

SEQ ID NO: 2374511 - RNA, 12 nt, Human
ucuaacaaguca

SEQ ID NO: 2374512 - RNA, 23 nt, Human
ucuaacaagucauagguuaauau

SEQ ID NO: 2374513 - RNA, 13 nt, Human
ucuaacaaugaca

SEQ ID NO: 2374514 - RNA, 17 nt, Human
ucuaacagcucaggauc

SEQ ID NO: 2374515 - RNA, 15 nt, Human
ucuaacagcucagga

SEQ ID NO: 2374516 - RNA, 21 nt, Human
ucuaauagcggguuacuuuca

SEQ ID NO: 2374517 - RNA, 22 nt, Human
ucuaauagaacucaguuuuaac

SEQ ID NO: 2374518 - RNA, 19 nt, Human
ucuaacagcucaggaucuc

SEQ ID NO: 2374519 - RNA, 17 nt, Human
ucuaaccacaucaauau

SEQ ID NO: 2374520 - RNA, 13 nt, Human
ucuaauagugcuu

SEQ ID NO: 2374521 - RNA, 15 nt, Human
ucuaauauauuuuua

SEQ ID NO: 2374522 - RNA, 14 nt, Human
ucuaauaucagcaa

SEQ ID NO: 2374523 - RNA, 14 nt, Human
ucuaauauggccac

SEQ ID NO: 2374524 - RNA, 20 nt, Human
ucuaauauggcaaaaauggc

SEQ ID NO: 2374525 - RNA, 19 nt, Human
ucguggccuuccccagccu

SEQ ID NO: 2374526 - RNA, 23 nt, Human
ucgugggagagagacguguacau

SEQ ID NO: 2374527 - RNA, 12 nt, Human
ucguggggaggu

SEQ ID NO: 2374528 - RNA, 15 nt, Human
ucguggggugugcug

SEQ ID NO: 2374529 - RNA, 18 nt, Human
ucguggggugugcuggga

SEQ ID NO: 2374530 - RNA, 20 nt, Human
ucgugggaucugccccuccc

SEQ ID NO: 2374531 - RNA, 19 nt, Human
ucgugggucuguuuuccuu

SEQ ID NO: 2374532 - RNA, 13 nt, Human
ucguuaauuugua

SEQ ID NO: 2374533 - RNA, 23 nt, Human
ucuaaauauuuccuuaaacugug

SEQ ID NO: 2374534 - RNA, 21 nt, Human
ucuaaaucuccaaaauaaaac

SEQ ID NO: 2374535 - RNA, 13 nt, Human
ucuaaauauuucc

SEQ ID NO: 2374536 - RNA, 17 nt, Human
ucuaaauaccugcccug

SEQ ID NO: 2374537 - RNA, 13 nt, Human
ucuaaauagccaa

SEQ ID NO: 2374538 - RNA, 21 nt, Human
ucuaaauagccaacacccauc

SEQ ID NO: 2374539 - RNA, 18 nt, Human
ucggccuccauccugagg

SEQ ID NO: 2374540 - RNA, 23 nt, Human
ucgagguagguggaucaccugag

SEQ ID NO: 2374541 - RNA, 14 nt, Human
ucgaggggcucuca

SEQ ID NO: 2374542 - RNA, 16 nt, Human
ucgaggggcucucagc

SEQ ID NO: 2374543 - RNA, 18 nt, Human
ucgaggggcucucagcuc

SEQ ID NO: 2374544 - RNA, 20 nt, Human
ucgaggggcucucagcucag

SEQ ID NO: 2374545 - RNA, 22 nt, Human
ucggccucccaaagugcuggga

SEQ ID NO: 2374546 - RNA, 17 nt, Human
ucggccucuaaccccag

SEQ ID NO: 2374547 - RNA, 21 nt, Human
ucgagguagaguuugaaggag

SEQ ID NO: 2374548 - RNA, 22 nt, Human
ucggccucuaaccccaggcccc

SEQ ID NO: 2374549 - RNA, 23 nt, Human
ucggccucuaaccccaggccccg

SEQ ID NO: 2374550 - RNA, 18 nt, Human
ucggccucuaaccccagg

SEQ ID NO: 2374551 - RNA, 19 nt, Human
ucggccucuaaccccaggc

SEQ ID NO: 2374552 - RNA, 20 nt, Human
ucggccucuaaccccaggcc

SEQ ID NO: 2374553 - RNA, 21 nt, Human
ucggccucuaaccccaggccc

SEQ ID NO: 2374554 - RNA, 16 nt, Human
ucgugauugauaagaa

SEQ ID NO: 2374555 - RNA, 15 nt, Human
ucgugagcucuugug

SEQ ID NO: 2374556 - RNA, 21 nt, Human
ucgugacgcugaauaaauguc

SEQ ID NO: 2374557 - RNA, 16 nt, Human
ucgugagcucuuguga

SEQ ID NO: 2374558 - RNA, 22 nt, Human
ucgugagcucuugugaggaaag

SEQ ID NO: 2374559 - RNA, 20 nt, Human
ucguggccuuccccagccuc

SEQ ID NO: 2374560 - RNA, 17 nt, Human
ucguggccagcccggcu

SEQ ID NO: 2374561 - RNA, 18 nt, Human
ucguggccagcccggcug

SEQ ID NO: 2374562 - RNA, 12 nt, Human
ucguggccagcc

SEQ ID NO: 2374563 - RNA, 13 nt, Human
ucguggccagccc

SEQ ID NO: 2374564 - RNA, 14 nt, Human
ucguggccagcccg

SEQ ID NO: 2374565 - RNA, 15 nt, Human
ucguggccagcccgg

SEQ ID NO: 2374566 - RNA, 22 nt, Human
ucgugggacagucaccucaugg

SEQ ID NO: 2374567 - RNA, 24 nt, Human
ucguggaaagggugcugcuucccu

SEQ ID NO: 2374568 - RNA, 23 nt, Human
ucgugccuccuuccaccucccuc

SEQ ID NO: 2374569 - RNA, 23 nt, Human
ucguggaaagggugcugcuuccc

SEQ ID NO: 2374570 - RNA, 23 nt, Human
ucguggcagauaaucagccucuu

SEQ ID NO: 2374571 - RNA, 22 nt, Human
ucguggcagauaaucagccucu

SEQ ID NO: 2374572 - RNA, 21 nt, Human
ucguggaacaguuaccucugc

SEQ ID NO: 2374573 - RNA, 23 nt, Human
ucgugccguuacucuccaaccug

SEQ ID NO: 2374574 - RNA, 20 nt, Human
ucgugccuccuuccaccucc

SEQ ID NO: 2374575 - RNA, 12 nt, Human
ucgugccugugu

SEQ ID NO: 2374576 - RNA, 13 nt, Human
ucgugccuguguc

SEQ ID NO: 2374577 - RNA, 14 nt, Human
ucgugccugugucc

SEQ ID NO: 2374578 - RNA, 18 nt, Human
ucgugcuaaauuuucagu

SEQ ID NO: 2374579 - RNA, 18 nt, Human
ucgugcggaaucagcuuc

SEQ ID NO: 2374580 - RNA, 15 nt, Human
ucgugccugugucca

SEQ ID NO: 2374581 - RNA, 21 nt, Human
ucgugccuguguccaugcgcu

SEQ ID NO: 2374582 - RNA, 20 nt, Human
ucgugccguuacucuccaac

SEQ ID NO: 2374583 - RNA, 23 nt, Human
ucgugccagucgcgcugccugug

SEQ ID NO: 2374584 - RNA, 21 nt, Human
ucgugccagucgcgcugccug

SEQ ID NO: 2374585 - RNA, 22 nt, Human
ucgugccagucgcgcugccugu

SEQ ID NO: 2374586 - RNA, 19 nt, Human
ucgugcagcauaugaggau

SEQ ID NO: 2374587 - RNA, 20 nt, Human
ucgugcauuggaagacccca

SEQ ID NO: 2374588 - RNA, 22 nt, Human
ucgugcauuggaagaccccacc

SEQ ID NO: 2374589 - RNA, 20 nt, Human
ucgugccagucgcgcugccu

SEQ ID NO: 2374590 - RNA, 22 nt, Human
ucgugacgcugaauaaaugucu

SEQ ID NO: 2374591 - RNA, 15 nt, Human
ucgugauaaacuuug

SEQ ID NO: 2374592 - RNA, 19 nt, Human
ucgugccagucgcgcugcc

SEQ ID NO: 2374593 - RNA, 11 nt, Human
ucucugaaccc

SEQ ID NO: 2374594 - RNA, 22 nt, Human
ucucugaagaguggguuucaca

SEQ ID NO: 2374595 - RNA, 23 nt, Human
ucucugaagaguggguuucacaa

SEQ ID NO: 2374596 - RNA, 21 nt, Human
ucucucuggcccucuaccccu

SEQ ID NO: 2374597 - RNA, 13 nt, Human
ucucugaagauga

SEQ ID NO: 2374598 - RNA, 12 nt, Human
ucucucuggccc

SEQ ID NO: 2374599 - RNA, 13 nt, Human
ucucucuggcccu

SEQ ID NO: 2374600 - RNA, 19 nt, Human
ucucucuggcccucuaccc

SEQ ID NO: 2374601 - RNA, 16 nt, Human
ucucucugcccaaccc

SEQ ID NO: 2374602 - RNA, 14 nt, Human
ucucucugcccaac

SEQ ID NO: 2374603 - RNA, 13 nt, Human
ucucucuccuguc

SEQ ID NO: 2374604 - RNA, 13 nt, Human
ucucucucuacaa

SEQ ID NO: 2374605 - RNA, 12 nt, Human
ucucucuccugu

SEQ ID NO: 2374606 - RNA, 14 nt, Human
ucucucucucuccc

SEQ ID NO: 2374607 - RNA, 14 nt, Human
ucucucucuacaaa

SEQ ID NO: 2374608 - RNA, 15 nt, Human
ucucucucuuagcau

SEQ ID NO: 2374609 - RNA, 14 nt, Human
ucucucucucucuc

SEQ ID NO: 2374610 - RNA, 14 nt, Human
ucucucugacucuc

SEQ ID NO: 2374611 - RNA, 20 nt, Human
ucucucugacucucaaaucu

SEQ ID NO: 2374612 - RNA, 12 nt, Human
ucucucugccca

SEQ ID NO: 2374613 - RNA, 21 nt, Human
ucucucugacucucaaaucuu

SEQ ID NO: 2374614 - RNA, 22 nt, Human
ucucucuccuguacuuuuucca

SEQ ID NO: 2374615 - RNA, 11 nt, Human
ucucucuccug

SEQ ID NO: 2374616 - RNA, 23 nt, Human
ucucucucccauggagccccagc

SEQ ID NO: 2374617 - RNA, 18 nt, Human
ucucucucccauggagcc

SEQ ID NO: 2374618 - RNA, 19 nt, Human
ucucuagugcugugaaaaa

SEQ ID NO: 2374619 - RNA, 17 nt, Human
ucucuagugcugugaaa

SEQ ID NO: 2374620 - RNA, 16 nt, Human
ucucuagugcugugaa

SEQ ID NO: 2374621 - RNA, 16 nt, Human
ucucuaguuugauuaa

SEQ ID NO: 2374622 - RNA, 14 nt, Human
ucucuagugcugug

SEQ ID NO: 2374623 - RNA, 14 nt, Human
ucucuaggcugggg

SEQ ID NO: 2374624 - RNA, 15 nt, Human
ucucuaggcugggga

SEQ ID NO: 2374625 - RNA, 15 nt, Human
ucucuaguuugauua

SEQ ID NO: 2374626 - RNA, 17 nt, Human
ucucugaggacacuaac

SEQ ID NO: 2374627 - RNA, 13 nt, Human
ucucugcaggucc

SEQ ID NO: 2374628 - RNA, 14 nt, Human
ucucugcagguccc

SEQ ID NO: 2374629 - RNA, 14 nt, Human
ucucugaauccuaa

SEQ ID NO: 2374630 - RNA, 16 nt, Human
ucucugaagugaaacu

SEQ ID NO: 2374631 - RNA, 16 nt, Human
ucucugaagggaggug

SEQ ID NO: 2374632 - RNA, 12 nt, Human
ucucugaccuac

SEQ ID NO: 2374633 - RNA, 21 nt, Human
ucucugaccuacucgagggac

SEQ ID NO: 2374634 - RNA, 17 nt, Human
ucucugacucucaaauc

SEQ ID NO: 2374635 - RNA, 14 nt, Human
ucucugaggacacu

SEQ ID NO: 2374636 - RNA, 11 nt, Human
ucucugaaggg

SEQ ID NO: 2374637 - RNA, 13 nt, Human
ucucugaagggag

SEQ ID NO: 2374638 - RNA, 14 nt, Human
ucucugaagggagg

SEQ ID NO: 2374639 - RNA, 22 nt, Human
ucucugaagcauguuucauguu

SEQ ID NO: 2374640 - RNA, 19 nt, Human
ucucugaagcauguuucau

SEQ ID NO: 2374641 - RNA, 21 nt, Human
ucucugaagcauguuucaugu

SEQ ID NO: 2374642 - RNA, 12 nt, Human
ucucugaagcau

SEQ ID NO: 2374643 - RNA, 13 nt, Human
ucucugaagcaug

SEQ ID NO: 2374644 - RNA, 14 nt, Human
ucucugaagcaugu

SEQ ID NO: 2374645 - RNA, 16 nt, Human
ucucugaagcauguuu

SEQ ID NO: 2374646 - RNA, 16 nt, Human
ucucugugaacgauuu

SEQ ID NO: 2374647 - RNA, 18 nt, Human
ucucuguagggaacucug

SEQ ID NO: 2374648 - RNA, 16 nt, Human
ucucugucucaugugu

SEQ ID NO: 2374649 - RNA, 23 nt, Human
ucucugucucauccaucaucaug

SEQ ID NO: 2374650 - RNA, 21 nt, Human
ucucugucucauccaucauca

SEQ ID NO: 2374651 - RNA, 18 nt, Human
ucucugugaccugccccg

SEQ ID NO: 2374652 - RNA, 14 nt, Human
ucucugugagacuc

SEQ ID NO: 2374653 - RNA, 22 nt, Human
ucucugugaacgauuuagaaag

SEQ ID NO: 2374654 - RNA, 23 nt, Human
ucucugugaacgauuuagaaaga

SEQ ID NO: 2374655 - RNA, 19 nt, Human
ucucugugagacucgagaa

SEQ ID NO: 2374656 - RNA, 22 nt, Human
ucucugugagacucgagaacuu

SEQ ID NO: 2374657 - RNA, 12 nt, Human
ucucugugccuu

SEQ ID NO: 2374658 - RNA, 17 nt, Human
ucucugugccuucgucu

SEQ ID NO: 2374659 - RNA, 11 nt, Human
ucucugugcuu

SEQ ID NO: 2374660 - RNA, 15 nt, Human
ucucugugcugugga

SEQ ID NO: 2374661 - RNA, 19 nt, Human
ucucugugcuucaauuaau

SEQ ID NO: 2374662 - RNA, 16 nt, Human
ucucugugcuuugacu

SEQ ID NO: 2374663 - RNA, 21 nt, Human
ucucugugcuuugacucaccu

SEQ ID NO: 2374664 - RNA, 22 nt, Human
ucucugugcuuugacucaccug

SEQ ID NO: 2374665 - RNA, 19 nt, Human
ucucuguagggaacucugg

SEQ ID NO: 2374666 - RNA, 16 nt, Human
ucucugucucauccau

SEQ ID NO: 2374667 - RNA, 15 nt, Human
ucucugucucaucca

SEQ ID NO: 2374668 - RNA, 14 nt, Human
ucucugucucaucc

SEQ ID NO: 2374669 - RNA, 12 nt, Human
ucucugucucau

SEQ ID NO: 2374670 - RNA, 13 nt, Human
ucucugguccgga

SEQ ID NO: 2374671 - RNA, 20 nt, Human
ucucugguccggacacuccu

SEQ ID NO: 2374672 - RNA, 17 nt, Human
ucucuggugagcgagga

SEQ ID NO: 2374673 - RNA, 12 nt, Human
ucucuggcuggg

SEQ ID NO: 2374674 - RNA, 13 nt, Human
ucucuggcugggg

SEQ ID NO: 2374675 - RNA, 22 nt, Human
ucucuggcgacaguuuuccuuc

SEQ ID NO: 2374676 - RNA, 17 nt, Human
ucucuggcgacaguuuu

SEQ ID NO: 2374677 - RNA, 16 nt, Human
ucucuggcgacaguuu

SEQ ID NO: 2374678 - RNA, 14 nt, Human
ucucuggcugggga

SEQ ID NO: 2374679 - RNA, 21 nt, Human
ucucugggcuuggggcuuccu

SEQ ID NO: 2374680 - RNA, 18 nt, Human
ucucuggggccacacaga

SEQ ID NO: 2374681 - RNA, 17 nt, Human
ucucugguaauauugac

SEQ ID NO: 2374682 - RNA, 15 nt, Human
ucucugcaggucccu

SEQ ID NO: 2374683 - RNA, 16 nt, Human
ucucugcaggucccua

SEQ ID NO: 2374684 - RNA, 20 nt, Human
ucucugagggcuuccuuugg

SEQ ID NO: 2374685 - RNA, 20 nt, Human
ucucugaugugauauccacu

SEQ ID NO: 2374686 - RNA, 17 nt, Human
ucucuggccuuuuccua

SEQ ID NO: 2374687 - RNA, 19 nt, Human
ucucuaaagaguuuauuuu

SEQ ID NO: 2374688 - RNA, 21 nt, Human
ucucuaaagaguuuauuuuaa

SEQ ID NO: 2374689 - RNA, 15 nt, Human
ucucguuucaaaaac

SEQ ID NO: 2374690 - RNA, 14 nt, Human
ucucguuucaaaaa

SEQ ID NO: 2374691 - RNA, 12 nt, Human
ucucguuuuucu

SEQ ID NO: 2374692 - RNA, 22 nt, Human
ucucuaaagaguuuauuuuaag

SEQ ID NO: 2374693 - RNA, 23 nt, Human
ucucuaaaugaggggccucaggu

SEQ ID NO: 2374694 - RNA, 18 nt, Human
ucucuaacagcucaggau

SEQ ID NO: 2374695 - RNA, 17 nt, Human
ucucuaacagcucagga

SEQ ID NO: 2374696 - RNA, 21 nt, Human
ucucuaacucagaaacaucag

SEQ ID NO: 2374697 - RNA, 20 nt, Human
ucucuaacucagaaacauca

SEQ ID NO: 2374698 - RNA, 18 nt, Human
ucucuaacucagaaacau

SEQ ID NO: 2374699 - RNA, 12 nt, Human
ucucuaacuuca

SEQ ID NO: 2374700 - RNA, 22 nt, Human
ucucuaacuucaaggcccauau

SEQ ID NO: 2374701 - RNA, 22 nt, Human
ucucuaacucagaaacaucagu

SEQ ID NO: 2374702 - RNA, 16 nt, Human
ucucuaaguuccacug

SEQ ID NO: 2374703 - RNA, 19 nt, Human
ucucuaacuucaccauauu

SEQ ID NO: 2374704 - RNA, 21 nt, Human
ucucuaaguuccacugagcuc

SEQ ID NO: 2374705 - RNA, 11 nt, Human
ucucuaauaug

SEQ ID NO: 2374706 - RNA, 18 nt, Human
ucucuaaguuccacugag

SEQ ID NO: 2374707 - RNA, 21 nt, Human
ucucgugguaggacuguagaa

SEQ ID NO: 2374708 - RNA, 18 nt, Human
ucucgugggagagccauc

SEQ ID NO: 2374709 - RNA, 19 nt, Human
ucucgugguaggacuguag

SEQ ID NO: 2374710 - RNA, 14 nt, Human
ucucgugauugaua

SEQ ID NO: 2374711 - RNA, 22 nt, Human
ucucgugauugauaagaaccuu

SEQ ID NO: 2374712 - RNA, 17 nt, Human
ucuccuguaccucuuga

SEQ ID NO: 2374713 - RNA, 16 nt, Human
ucuccuguaccucuug

SEQ ID NO: 2374714 - RNA, 17 nt, Human
ucucgguuccacguccc

SEQ ID NO: 2374715 - RNA, 14 nt, Human
ucucggugguacca

SEQ ID NO: 2374716 - RNA, 21 nt, Human
ucucggcuccccauguguccu

SEQ ID NO: 2374717 - RNA, 19 nt, Human
ucuccuguaccucuugagc

SEQ ID NO: 2374718 - RNA, 21 nt, Human
ucuccuggaaauauuaagaaa

SEQ ID NO: 2374719 - RNA, 21 nt, Human
ucuccuggaagugcuaauuuu

SEQ ID NO: 2374720 - RNA, 15 nt, Human
ucuccuguaccucuu

SEQ ID NO: 2374721 - RNA, 11 nt, Human
ucuccuggagg

SEQ ID NO: 2374722 - RNA, 12 nt, Human
ucuccuggagga

SEQ ID NO: 2374723 - RNA, 13 nt, Human
ucuccuggaggau

SEQ ID NO: 2374724 - RNA, 17 nt, Human
ucuccuggaggauugca

SEQ ID NO: 2374725 - RNA, 17 nt, Human
ucuccugccucagccuc

SEQ ID NO: 2374726 - RNA, 15 nt, Human
ucuccugccucagcc

SEQ ID NO: 2374727 - RNA, 20 nt, Human
ucucaaggugggccuugcua

SEQ ID NO: 2374728 - RNA, 23 nt, Human
ucucaagggcuagcaucccugag

SEQ ID NO: 2374729 - RNA, 13 nt, Human
ucucaagcccugc

SEQ ID NO: 2374730 - RNA, 19 nt, Human
ucucaagagggcacuggug

SEQ ID NO: 2374731 - RNA, 17 nt, Human
ucucaagagggcacugg

SEQ ID NO: 2374732 - RNA, 18 nt, Human
ucucaagagggcacuggu

SEQ ID NO: 2374733 - RNA, 17 nt, Human
ucucaaauucucaaccu

SEQ ID NO: 2374734 - RNA, 17 nt, Human
ucucaaaguuuugaaaa

SEQ ID NO: 2374735 - RNA, 18 nt, Human
ucucaaaguuuugaaaag

SEQ ID NO: 2374736 - RNA, 20 nt, Human
ucucaaaguuuugaaaagcu

SEQ ID NO: 2374737 - RNA, 23 nt, Human
ucucaaaguuuugaaaagcuauu

SEQ ID NO: 2374738 - RNA, 14 nt, Human
ucucaauaugcuua

SEQ ID NO: 2374739 - RNA, 22 nt, Human
ucucaauccuaauuucuccucc

SEQ ID NO: 2374740 - RNA, 12 nt, Human
ucuccugccuca

SEQ ID NO: 2374741 - RNA, 13 nt, Human
ucucaaugcucau

SEQ ID NO: 2374742 - RNA, 23 nt, Human
ucucaauccuaauuucuccuccc

SEQ ID NO: 2374743 - RNA, 16 nt, Human
ucugcauuuugcuauu

SEQ ID NO: 2374744 - RNA, 18 nt, Human
ucugcauuuugcuauugu

SEQ ID NO: 2374745 - RNA, 19 nt, Human
ucugcauuuugcuauugua

SEQ ID NO: 2374746 - RNA, 19 nt, Human
ucugccaaaggaugugaua

SEQ ID NO: 2374747 - RNA, 21 nt, Human
ucugcauuuucaccccacccu

SEQ ID NO: 2374748 - RNA, 17 nt, Human
ucugcauuuucacccca

SEQ ID NO: 2374749 - RNA, 19 nt, Human
ucugcauuucgguggcuag

SEQ ID NO: 2374750 - RNA, 14 nt, Human
ucugcauuugucua

SEQ ID NO: 2374751 - RNA, 15 nt, Human
ucugcauuugucuau

SEQ ID NO: 2374752 - RNA, 10 nt, Human
ucugcauuuu

SEQ ID NO: 2374753 - RNA, 18 nt, Human
ucugcauuucgguggcua

SEQ ID NO: 2374754 - RNA, 15 nt, Human
ucugcauuucggugg

SEQ ID NO: 2374755 - RNA, 16 nt, Human
ucugcauucuaguacu

SEQ ID NO: 2374756 - RNA, 17 nt, Human
ucugcauucaggaucaa

SEQ ID NO: 2374757 - RNA, 20 nt, Human
ucugcaugcggcccagcccg

SEQ ID NO: 2374758 - RNA, 21 nt, Human
ucugcaugcggcccagcccgg

SEQ ID NO: 2374759 - RNA, 22 nt, Human
ucugcaugcggcccagcccggc

SEQ ID NO: 2374760 - RNA, 23 nt, Human
ucugccaccuccccuauccaccc

SEQ ID NO: 2374761 - RNA, 20 nt, Human
ucugccaccuccccuaucca

SEQ ID NO: 2374762 - RNA, 15 nt, Human
ucugccaccuccccu

SEQ ID NO: 2374763 - RNA, 14 nt, Human
ucugccaccucccc

SEQ ID NO: 2374764 - RNA, 21 nt, Human
ucugccacccuaccuguucag

SEQ ID NO: 2374765 - RNA, 17 nt, Human
ucugccacccuaccugu

SEQ ID NO: 2374766 - RNA, 18 nt, Human
ucugccacccuaccuguu

SEQ ID NO: 2374767 - RNA, 14 nt, Human
ucugccacuggaag

SEQ ID NO: 2374768 - RNA, 15 nt, Human
ucugccacuucccag

SEQ ID NO: 2374769 - RNA, 16 nt, Human
ucugccacuucccagg

SEQ ID NO: 2374770 - RNA, 17 nt, Human
ucugccacuucccaggu

SEQ ID NO: 2374771 - RNA, 20 nt, Human
ucugccagaagauccccuca

SEQ ID NO: 2374772 - RNA, 21 nt, Human
ucugccagaagauccccucag

SEQ ID NO: 2374773 - RNA, 22 nt, Human
ucugccagaagauccccucagg

SEQ ID NO: 2374774 - RNA, 23 nt, Human
ucugccagaagauccccucagga

SEQ ID NO: 2374775 - RNA, 22 nt, Human
ucugccaauuuuugccuucauu

SEQ ID NO: 2374776 - RNA, 22 nt, Human
ucugcauuuugcuauuguaaau

SEQ ID NO: 2374777 - RNA, 19 nt, Human
ucugccaauuuuugccuuc

SEQ ID NO: 2374778 - RNA, 14 nt, Human
ucugccacccuacc

SEQ ID NO: 2374779 - RNA, 17 nt, Human
ucugccaccauccugcu

SEQ ID NO: 2374780 - RNA, 10 nt, Human
ucugccacca

SEQ ID NO: 2374781 - RNA, 16 nt, Human
ucugccaccaaaggcc

SEQ ID NO: 2374782 - RNA, 19 nt, Human
ucugccaccaaaggccagg

SEQ ID NO: 2374783 - RNA, 15 nt, Human
ucugccaccagagac

SEQ ID NO: 2374784 - RNA, 19 nt, Human
ucugcacaugucuuguaca

SEQ ID NO: 2374785 - RNA, 16 nt, Human
ucugcacaugucuugu

SEQ ID NO: 2374786 - RNA, 17 nt, Human
ucugcacaugucuugua

SEQ ID NO: 2374787 - RNA, 23 nt, Human
ucugcacaugcagcugcacccuc

SEQ ID NO: 2374788 - RNA, 17 nt, Human
ucugcaucuacucccaa

SEQ ID NO: 2374789 - RNA, 13 nt, Human
ucugcaucugacc

SEQ ID NO: 2374790 - RNA, 15 nt, Human
ucugcaucugaccac

SEQ ID NO: 2374791 - RNA, 20 nt, Human
ucugcaucugaccacgugcu

SEQ ID NO: 2374792 - RNA, 19 nt, Human
ucugcaucuacucccaagu

SEQ ID NO: 2374793 - RNA, 17 nt, Human
ucugcaucuuggggaca

SEQ ID NO: 2374794 - RNA, 22 nt, Human
ucugcaucuuggggacaucucu

SEQ ID NO: 2374795 - RNA, 14 nt, Human
ucugcaugcggccc

SEQ ID NO: 2374796 - RNA, 15 nt, Human
ucugcaugcggccca

SEQ ID NO: 2374797 - RNA, 16 nt, Human
ucugcaugcggcccag

SEQ ID NO: 2374798 - RNA, 17 nt, Human
ucugcaugcggcccagc

SEQ ID NO: 2374799 - RNA, 18 nt, Human
ucugcaugcggcccagcc

SEQ ID NO: 2374800 - RNA, 19 nt, Human
ucugcaugcggcccagccc

SEQ ID NO: 2374801 - RNA, 20 nt, Human
ucugcacaugcagcugcacc

SEQ ID NO: 2374802 - RNA, 21 nt, Human
ucugcacaugcagcugcaccc

SEQ ID NO: 2374803 - RNA, 22 nt, Human
ucugcacaugcagcugcacccu

SEQ ID NO: 2374804 - RNA, 12 nt, Human
ucugcacauguc

SEQ ID NO: 2374805 - RNA, 15 nt, Human
ucugcacaugucuug

SEQ ID NO: 2374806 - RNA, 14 nt, Human
ucugcaucagcugc

SEQ ID NO: 2374807 - RNA, 21 nt, Human
ucugcaucagcugcugaaaca

SEQ ID NO: 2374808 - RNA, 19 nt, Human
ucugcaucagcugcugaaa

SEQ ID NO: 2374809 - RNA, 14 nt, Human
ucugacccacugcu

SEQ ID NO: 2374810 - RNA, 15 nt, Human
ucugacccacugcuu

SEQ ID NO: 2374811 - RNA, 23 nt, Human
ucugaggaauccagacccggcug

SEQ ID NO: 2374812 - RNA, 14 nt, Human
ucugaccauuucag

SEQ ID NO: 2374813 - RNA, 23 nt, Human
ucugaccaguuuaaccugaugca

SEQ ID NO: 2374814 - RNA, 18 nt, Human
ucugaccauuucaggggu

SEQ ID NO: 2374815 - RNA, 22 nt, Human
ucugaggagaaacaaauaagac

SEQ ID NO: 2374816 - RNA, 20 nt, Human
ucugaggacauuccaagaca

SEQ ID NO: 2374817 - RNA, 12 nt, Human
ucugaggacauu

SEQ ID NO: 2374818 - RNA, 21 nt, Human
ucugaggcucuuucugggcca

SEQ ID NO: 2374819 - RNA, 21 nt, Human
ucugaggcuggauccuagccu

SEQ ID NO: 2374820 - RNA, 22 nt, Human
ucugaggcuggauccuagccuu

SEQ ID NO: 2374821 - RNA, 14 nt, Human
ucugcaacuuuaag

SEQ ID NO: 2374822 - RNA, 21 nt, Human
ucugcaacuuuaagcagcucu

SEQ ID NO: 2374823 - RNA, 23 nt, Human
ucugaggccuccucucucaguuu

SEQ ID NO: 2374824 - RNA, 19 nt, Human
ucugaggcucuuucugggc

SEQ ID NO: 2374825 - RNA, 23 nt, Human
ucugaggcugaaauucagaauau

SEQ ID NO: 2374826 - RNA, 11 nt, Human
ucugaggcuga

SEQ ID NO: 2374827 - RNA, 21 nt, Human
ucugcaagaauugaagcagga

SEQ ID NO: 2374828 - RNA, 20 nt, Human
ucugcaagaauugaagcagg

SEQ ID NO: 2374829 - RNA, 15 nt, Human
ucugcacagauggau

SEQ ID NO: 2374830 - RNA, 15 nt, Human
ucugcacagcuggcc

SEQ ID NO: 2374831 - RNA, 17 nt, Human
ucugcacagcuggccuc

SEQ ID NO: 2374832 - RNA, 12 nt, Human
ucugcacaugaa

SEQ ID NO: 2374833 - RNA, 23 nt, Human
ucugcacaugaaucccacccaca

SEQ ID NO: 2374834 - RNA, 13 nt, Human
ucugcacagaugg

SEQ ID NO: 2374835 - RNA, 10 nt, Human
ucugcacaga

SEQ ID NO: 2374836 - RNA, 22 nt, Human
ucugcaacuuuaagcagcucuu

SEQ ID NO: 2374837 - RNA, 14 nt, Human
ucugcacacagcac

SEQ ID NO: 2374838 - RNA, 15 nt, Human
ucugaacaauucucu

SEQ ID NO: 2374839 - RNA, 16 nt, Human
ucugaaccauuaaagu

SEQ ID NO: 2374840 - RNA, 12 nt, Human
ucugaaagccac

SEQ ID NO: 2374841 - RNA, 16 nt, Human
ucugacacacagcucu

SEQ ID NO: 2374842 - RNA, 17 nt, Human
ucugacacacagcucug

SEQ ID NO: 2374843 - RNA, 18 nt, Human
ucugacacacagcucugu

SEQ ID NO: 2374844 - RNA, 19 nt, Human
ucugacacacagcucuguc

SEQ ID NO: 2374845 - RNA, 16 nt, Human
ucugacagaaagcaga

SEQ ID NO: 2374846 - RNA, 12 nt, Human
ucugacaggcaa

SEQ ID NO: 2374847 - RNA, 21 nt, Human
ucugacaggcaaugcuggcug

SEQ ID NO: 2374848 - RNA, 22 nt, Human
ucugacaggcaaugcuggcugu

SEQ ID NO: 2374849 - RNA, 13 nt, Human
ucugacccacugc

SEQ ID NO: 2374850 - RNA, 18 nt, Human
ucugaccagcagcgccuu

SEQ ID NO: 2374851 - RNA, 17 nt, Human
ucugaccagcagcgccu

SEQ ID NO: 2374852 - RNA, 15 nt, Human
ucugacaucucugca

SEQ ID NO: 2374853 - RNA, 14 nt, Human
ucugacaucucugc

SEQ ID NO: 2374854 - RNA, 12 nt, Human
ucugacaucucu

SEQ ID NO: 2374855 - RNA, 15 nt, Human
ucugacauaaguauu

SEQ ID NO: 2374856 - RNA, 17 nt, Human
ucucuuauagaauauuu

SEQ ID NO: 2374857 - RNA, 18 nt, Human
ucucuuauagaauauuua

SEQ ID NO: 2374858 - RNA, 20 nt, Human
ucucuuauagaauauuuauu

SEQ ID NO: 2374859 - RNA, 21 nt, Human
ucucuuauagaauauuuauua

SEQ ID NO: 2374860 - RNA, 19 nt, Human
ucucuuuuuggaggugcuu

SEQ ID NO: 2374861 - RNA, 20 nt, Human
ucucuuuuuggaggugcuua

SEQ ID NO: 2374862 - RNA, 15 nt, Human
ucucuuauagaauau

SEQ ID NO: 2374863 - RNA, 19 nt, Human
ucucuuagcuccccuccaa

SEQ ID NO: 2374864 - RNA, 17 nt, Human
ucucuuagcuccccucc

SEQ ID NO: 2374865 - RNA, 18 nt, Human
ucucuuagcuccccucca

SEQ ID NO: 2374866 - RNA, 16 nt, Human
ucucuuagcuccccuc

SEQ ID NO: 2374867 - RNA, 13 nt, Human
ucucuuacugcaa

SEQ ID NO: 2374868 - RNA, 15 nt, Human
ucucuuacugcaaau

SEQ ID NO: 2374869 - RNA, 19 nt, Human
ucucuuacugcaaauguca

SEQ ID NO: 2374870 - RNA, 22 nt, Human
ucucuuacgcccaacccuuccc

SEQ ID NO: 2374871 - RNA, 18 nt, Human
ucucuuaauuuaaucuuu

SEQ ID NO: 2374872 - RNA, 21 nt, Human
ucucuguuccauugaaucugu

SEQ ID NO: 2374873 - RNA, 18 nt, Human
ucucuguucauuuccuca

SEQ ID NO: 2374874 - RNA, 17 nt, Human
ucucuguucauuuccuc

SEQ ID NO: 2374875 - RNA, 16 nt, Human
ucucuguucauuuccu

SEQ ID NO: 2374876 - RNA, 14 nt, Human
ucucuguucauuuc

SEQ ID NO: 2374877 - RNA, 13 nt, Human
ucucuguucauuu

SEQ ID NO: 2374878 - RNA, 10 nt, Human
ucucuguguu

SEQ ID NO: 2374879 - RNA, 20 nt, Human
ucucuguguuuguuccuaca

SEQ ID NO: 2374880 - RNA, 18 nt, Human
ucucugugugcacaaaua

SEQ ID NO: 2374881 - RNA, 18 nt, Human
ucugaaaauauaaccagc

SEQ ID NO: 2374882 - RNA, 22 nt, Human
ucugaaaauugaugggauuugg

SEQ ID NO: 2374883 - RNA, 23 nt, Human
ucugaaacccuggaccagugguc

SEQ ID NO: 2374884 - RNA, 20 nt, Human
ucugaaaccaguguuaggga

SEQ ID NO: 2374885 - RNA, 15 nt, Human
ucugaaaccaguguu

SEQ ID NO: 2374886 - RNA, 13 nt, Human
ucugaaaauguau

SEQ ID NO: 2374887 - RNA, 14 nt, Human
ucugaaaauugaug

SEQ ID NO: 2374888 - RNA, 15 nt, Human
ucugaaaacggcccu

SEQ ID NO: 2374889 - RNA, 17 nt, Human
ucugaaaacggcccucu

SEQ ID NO: 2374890 - RNA, 23 nt, Human
ucugaaaaauuccuuuguguuuc

SEQ ID NO: 2374891 - RNA, 13 nt, Human
ucugaaaauauaa

SEQ ID NO: 2374892 - RNA, 14 nt, Human
ucugaaaauauaac

SEQ ID NO: 2374893 - RNA, 12 nt, Human
ucugguuccagg

SEQ ID NO: 2374894 - RNA, 13 nt, Human
ucugguuccaggg

SEQ ID NO: 2374895 - RNA, 14 nt, Human
ucugguuccagggu

SEQ ID NO: 2374896 - RNA, 13 nt, Human
ucugguuccuccc

SEQ ID NO: 2374897 - RNA, 21 nt, Human
ucugguuccagggucccucug

SEQ ID NO: 2374898 - RNA, 23 nt, Human
ucugguuccagggucccucugug

SEQ ID NO: 2374899 - RNA, 14 nt, Human
ucuguccuacucug

SEQ ID NO: 2374900 - RNA, 21 nt, Human
ucugguuccuccccuccuccu

SEQ ID NO: 2374901 - RNA, 20 nt, Human
ucugguuccuccccuccucc

SEQ ID NO: 2374902 - RNA, 13 nt, Human
ucuggugucugcu

SEQ ID NO: 2374903 - RNA, 16 nt, Human
ucugguggucucugcu

SEQ ID NO: 2374904 - RNA, 21 nt, Human
ucugguggccgaucggggcac

SEQ ID NO: 2374905 - RNA, 16 nt, Human
ucugguggucuguugg

SEQ ID NO: 2374906 - RNA, 12 nt, Human
ucugguggcccc

SEQ ID NO: 2374907 - RNA, 14 nt, Human
ucugguggccccgu

SEQ ID NO: 2374908 - RNA, 23 nt, Human
ucuggugggguguguuccaacug

SEQ ID NO: 2374909 - RNA, 13 nt, Human
ucugggagaggau

SEQ ID NO: 2374910 - RNA, 15 nt, Human
ucugggagaggauuu

SEQ ID NO: 2374911 - RNA, 22 nt, Human
ucuggugagcgaggacauucuc

SEQ ID NO: 2374912 - RNA, 13 nt, Human
ucugggacuuccu

SEQ ID NO: 2374913 - RNA, 15 nt, Human
ucugggacuuccuug

SEQ ID NO: 2374914 - RNA, 17 nt, Human
ucugggacuuccuugcu

SEQ ID NO: 2374915 - RNA, 21 nt, Human
ucugggacuuccuugcucucc

SEQ ID NO: 2374916 - RNA, 17 nt, Human
ucuggugaggccuugcu

SEQ ID NO: 2374917 - RNA, 18 nt, Human
ucuggugaggccuugcuc

SEQ ID NO: 2374918 - RNA, 21 nt, Human
ucuguccuuuuggcacugaga

SEQ ID NO: 2374919 - RNA, 22 nt, Human
ucugucuccuuaacacugagcu

SEQ ID NO: 2374920 - RNA, 19 nt, Human
ucuguccuuuuggcacuga

SEQ ID NO: 2374921 - RNA, 12 nt, Human
ucugucucugcc

SEQ ID NO: 2374922 - RNA, 22 nt, Human
ucugucucuggauuauauuaug

SEQ ID NO: 2374923 - RNA, 16 nt, Human
ucugucgcccagucug

SEQ ID NO: 2374924 - RNA, 20 nt, Human
ucuguccuucagauggaaac

SEQ ID NO: 2374925 - RNA, 14 nt, Human
ucuguccugguguc

SEQ ID NO: 2374926 - RNA, 14 nt, Human
ucuguccuucagau

SEQ ID NO: 2374927 - RNA, 14 nt, Human
ucugucgcccaguc

SEQ ID NO: 2374928 - RNA, 21 nt, Human
ucuguccugggagugagcugg

SEQ ID NO: 2374929 - RNA, 20 nt, Human
ucuguccuacucugugucag

SEQ ID NO: 2374930 - RNA, 17 nt, Human
ucuguccuggugucacu

SEQ ID NO: 2374931 - RNA, 15 nt, Human
ucuguccuacucugu

SEQ ID NO: 2374932 - RNA, 19 nt, Human
ucuguccuacucuguguca

SEQ ID NO: 2374933 - RNA, 18 nt, Human
ucuggcugaacacuggca

SEQ ID NO: 2374934 - RNA, 13 nt, Human
ucuggcugaaccc

SEQ ID NO: 2374935 - RNA, 14 nt, Human
ucuggcugaacccu

SEQ ID NO: 2374936 - RNA, 16 nt, Human
ucuggcugaacccugu

SEQ ID NO: 2374937 - RNA, 17 nt, Human
ucuggcugaacccugug

SEQ ID NO: 2374938 - RNA, 18 nt, Human
ucuggcugaacccugugc

SEQ ID NO: 2374939 - RNA, 19 nt, Human
ucuggcugaacccugugcu

SEQ ID NO: 2374940 - RNA, 21 nt, Human
ucuggcugaacccugugcugg

SEQ ID NO: 2374941 - RNA, 20 nt, Human
ucuggcugaacccugugcug

SEQ ID NO: 2374942 - RNA, 15 nt, Human
ucuggcugagcccug

SEQ ID NO: 2374943 - RNA, 16 nt, Human
ucuggcugagcccugc

SEQ ID NO: 2374944 - RNA, 14 nt, Human
ucuggcugagcuga

SEQ ID NO: 2374945 - RNA, 18 nt, Human
ucuggcucuuccaggcug

SEQ ID NO: 2374946 - RNA, 23 nt, Human
ucuggcucuuccaggcugggaga

SEQ ID NO: 2374947 - RNA, 16 nt, Human
ucugggacccuuuccu

SEQ ID NO: 2374948 - RNA, 15 nt, Human
ucugggacccuuucc

SEQ ID NO: 2374949 - RNA, 15 nt, Human
ucuggcugagcugaa

SEQ ID NO: 2374950 - RNA, 21 nt, Human
ucuggcugagcugaacccauu

SEQ ID NO: 2374951 - RNA, 14 nt, Human
ucugggacacaguu

SEQ ID NO: 2374952 - RNA, 19 nt, Human
ucugggacccuuuccuucc

SEQ ID NO: 2374953 - RNA, 20 nt, Human
ucugggaccugccaggcagg

SEQ ID NO: 2374954 - RNA, 21 nt, Human
ucugggaccugccaggcaggg

SEQ ID NO: 2374955 - RNA, 22 nt, Human
ucugggaccugccaggcagggg

SEQ ID NO: 2374956 - RNA, 13 nt, Human
ucugggaccucag

SEQ ID NO: 2374957 - RNA, 16 nt, Human
ucugggaccucaguuu

SEQ ID NO: 2374958 - RNA, 23 nt, Human
ucuggugacuuuccucuuugguc

SEQ ID NO: 2374959 - RNA, 20 nt, Human
ucuggaccccaucugugaau

SEQ ID NO: 2374960 - RNA, 23 nt, Human
ucuggaccaacccuguuuccuga

SEQ ID NO: 2374961 - RNA, 19 nt, Human
ucuggcuccucaaacagua

SEQ ID NO: 2374962 - RNA, 15 nt, Human
ucuggcuccagcugg

SEQ ID NO: 2374963 - RNA, 22 nt, Human
ucuggcuaugcauuugaaaauu

SEQ ID NO: 2374964 - RNA, 19 nt, Human
ucuggcuaugcauuugaaa

SEQ ID NO: 2374965 - RNA, 23 nt, Human
ucuggccuucggccuccauccug

SEQ ID NO: 2374966 - RNA, 18 nt, Human
ucuggccuucggccucca

SEQ ID NO: 2374967 - RNA, 19 nt, Human
ucuggaccccaucugugaa

SEQ ID NO: 2374968 - RNA, 18 nt, Human
ucuggaccccaucuguga

SEQ ID NO: 2374969 - RNA, 17 nt, Human
ucuggaccccaucugug

SEQ ID NO: 2374970 - RNA, 14 nt, Human
ucuggaccccaucu

SEQ ID NO: 2374971 - RNA, 17 nt, Human
ucuggccuucggccucc

SEQ ID NO: 2374972 - RNA, 19 nt, Human
ucuggaaucuggagaccag

SEQ ID NO: 2374973 - RNA, 22 nt, Human
ucuggaccaacccuguuuccug

SEQ ID NO: 2374974 - RNA, 21 nt, Human
ucuggacaggcauguucucug

SEQ ID NO: 2374975 - RNA, 16 nt, Human
ucuggaaugcaguggu

SEQ ID NO: 2374976 - RNA, 14 nt, Human
ucuggacaggcaug

SEQ ID NO: 2374977 - RNA, 15 nt, Human
ucuggaaugcagugg

SEQ ID NO: 2374978 - RNA, 22 nt, Human
ucuggaauacaugaaauauaga

SEQ ID NO: 2374979 - RNA, 14 nt, Human
ucuggaauacauga

SEQ ID NO: 2374980 - RNA, 19 nt, Human
ucuggaauaaggagaauga

SEQ ID NO: 2374981 - RNA, 22 nt, Human
ucugcugggcuggggccugaug

SEQ ID NO: 2374982 - RNA, 24 nt, Human
ucugcugggcuggggccugauggg

SEQ ID NO: 2374983 - RNA, 12 nt, Human
ucugcugggcug

SEQ ID NO: 2374984 - RNA, 13 nt, Human
ucugcugggcugg

SEQ ID NO: 2374985 - RNA, 14 nt, Human
ucugcugggcuggg

SEQ ID NO: 2374986 - RNA, 17 nt, Human
ucugcugggcuggggcc

SEQ ID NO: 2374987 - RNA, 19 nt, Human
ucugcugacagacacaggc

SEQ ID NO: 2374988 - RNA, 20 nt, Human
ucugcugacagacacaggcc

SEQ ID NO: 2374989 - RNA, 21 nt, Human
ucugcugacagacacaggccc

SEQ ID NO: 2374990 - RNA, 22 nt, Human
ucugcugacagacacaggcccg

SEQ ID NO: 2374991 - RNA, 14 nt, Human
ucugcuggcccagc

SEQ ID NO: 2374992 - RNA, 12 nt, Human
ucugcuggccca

SEQ ID NO: 2374993 - RNA, 22 nt, Human
ucugcuggauaaaaugagguuc

SEQ ID NO: 2374994 - RNA, 18 nt, Human
ucugcuggauaaaaugag

SEQ ID NO: 2374995 - RNA, 16 nt, Human
ucugcuggauaaaaug

SEQ ID NO: 2374996 - RNA, 22 nt, Human
ucugcugauccucccaggcuuc

SEQ ID NO: 2374997 - RNA, 20 nt, Human
ucugcuggcccagccaaacc

SEQ ID NO: 2374998 - RNA, 14 nt, Human
ucugcuggccugga

SEQ ID NO: 2374999 - RNA, 15 nt, Human
ucugcuggccuggau

SEQ ID NO: 2375000 - RNA, 16 nt, Human
ucugcuggccuggauc

SEQ ID NO: 2375001 - RNA, 17 nt, Human
ucugcuggccuggaucu

SEQ ID NO: 2375002 - RNA, 18 nt, Human
ucugcuggccuggaucuc

SEQ ID NO: 2375003 - RNA, 15 nt, Human
ucugcuggccuggcc

SEQ ID NO: 2375004 - RNA, 16 nt, Human
ucugcuggccuggccg

SEQ ID NO: 2375005 - RNA, 14 nt, Human
ucugccugcccagg

SEQ ID NO: 2375006 - RNA, 13 nt, Human
ucugccugcccag

SEQ ID NO: 2375007 - RNA, 19 nt, Human
ucugccagugacagacagg

SEQ ID NO: 2375008 - RNA, 21 nt, Human
ucugccagugacagacaggcu

SEQ ID NO: 2375009 - RNA, 13 nt, Human
ucugccagugaca

SEQ ID NO: 2375010 - RNA, 19 nt, Human
ucugccagggagcuugaaa

SEQ ID NO: 2375011 - RNA, 14 nt, Human
ucugccagggagcu

SEQ ID NO: 2375012 - RNA, 13 nt, Human
ucugccagggagc

SEQ ID NO: 2375013 - RNA, 12 nt, Human
ucugccagggag

SEQ ID NO: 2375014 - RNA, 23 nt, Human
ucugccaggcccccaagccugca

SEQ ID NO: 2375015 - RNA, 19 nt, Human
ucugccagccagcagccag

SEQ ID NO: 2375016 - RNA, 14 nt, Human
ucugccaggccccc

SEQ ID NO: 2375017 - RNA, 17 nt, Human
ucugccagccagcagcc

SEQ ID NO: 2375018 - RNA, 16 nt, Human
ucugccagccagcagc

SEQ ID NO: 2375019 - RNA, 15 nt, Human
ucugccagccagcag

SEQ ID NO: 2375020 - RNA, 13 nt, Human
ucugccagccagc

SEQ ID NO: 2375021 - RNA, 13 nt, Human
ucugccagccaca

SEQ ID NO: 2375022 - RNA, 15 nt, Human
ucugccugcccaggc

SEQ ID NO: 2375023 - RNA, 16 nt, Human
ucugccugcccaggcc

SEQ ID NO: 2375024 - RNA, 12 nt, Human
ucugcuccucuc

SEQ ID NO: 2375025 - RNA, 13 nt, Human
ucugcuccucucc

SEQ ID NO: 2375026 - RNA, 14 nt, Human
ucugcuccucucca

SEQ ID NO: 2375027 - RNA, 15 nt, Human
ucugcuccucuccag

SEQ ID NO: 2375028 - RNA, 16 nt, Human
ucugcuccccagggga

SEQ ID NO: 2375029 - RNA, 23 nt, Human
ucugccagugacagacaggcucu

SEQ ID NO: 2375030 - RNA, 18 nt, Human
ucugcuccucuccccagc

SEQ ID NO: 2375031 - RNA, 21 nt, Human
ucugcuccucuccccagcaag

SEQ ID NO: 2375032 - RNA, 16 nt, Human
ucugcuccucuccagg

SEQ ID NO: 2375033 - RNA, 17 nt, Human
ucugcuccucuccaggc

SEQ ID NO: 2375034 - RNA, 18 nt, Human
ucugcuccucuccaggca

SEQ ID NO: 2375035 - RNA, 20 nt, Human
ucugcuccucuccaggcacc

SEQ ID NO: 2375036 - RNA, 18 nt, Human
ucugcugacagacacagg

SEQ ID NO: 2375037 - RNA, 17 nt, Human
ucugcugacagacacag

SEQ ID NO: 2375038 - RNA, 17 nt, Human
ucuuaaacaaauguaug

SEQ ID NO: 2375039 - RNA, 16 nt, Human
ucuuaaaccuucaguu

SEQ ID NO: 2375040 - RNA, 18 nt, Human
ucuuaaaaaauaaaaacu

SEQ ID NO: 2375041 - RNA, 14 nt, Human
ucuguuuuucuuuu

SEQ ID NO: 2375042 - RNA, 16 nt, Human
ucuguuuuuaaaaauc

SEQ ID NO: 2375043 - RNA, 19 nt, Human
ucuuaaagcugccuguagu

SEQ ID NO: 2375044 - RNA, 16 nt, Human
ucuuaaagcugccugu

SEQ ID NO: 2375045 - RNA, 20 nt, Human
ucuuaaagaaaacccacccc

SEQ ID NO: 2375046 - RNA, 21 nt, Human
ucuuaaagcugccuguaguua

SEQ ID NO: 2375047 - RNA, 20 nt, Human
ucuuaaagcugccuguaguu

SEQ ID NO: 2375048 - RNA, 23 nt, Human
ucuuaaagcugccuguaguuagg

SEQ ID NO: 2375049 - RNA, 18 nt, Human
ucuuaaaguauucuucuc

SEQ ID NO: 2375050 - RNA, 22 nt, Human
ucuuaaaguauucuucucuucc

SEQ ID NO: 2375051 - RNA, 19 nt, Human
ucuuaaagaaaacccaccc

SEQ ID NO: 2375052 - RNA, 16 nt, Human
ucuguuuugccugaag

SEQ ID NO: 2375053 - RNA, 17 nt, Human
ucuguuuugaaggcaaa

SEQ ID NO: 2375054 - RNA, 23 nt, Human
ucuguuuucuuucuaaugagaua

SEQ ID NO: 2375055 - RNA, 20 nt, Human
ucuguuuuccuuucucaccg

SEQ ID NO: 2375056 - RNA, 12 nt, Human
ucuguuuucugu

SEQ ID NO: 2375057 - RNA, 15 nt, Human
ucugucuucaccuga

SEQ ID NO: 2375058 - RNA, 12 nt, Human
ucugucuugaag

SEQ ID NO: 2375059 - RNA, 19 nt, Human
ucugucuuggcuuucaugu

SEQ ID NO: 2375060 - RNA, 22 nt, Human
ucugucuucacagcucuguguu

SEQ ID NO: 2375061 - RNA, 15 nt, Human
ucugucuucacagcu

SEQ ID NO: 2375062 - RNA, 14 nt, Human
ucugucuucacagc

SEQ ID NO: 2375063 - RNA, 12 nt, Human
ucugucuucaca

SEQ ID NO: 2375064 - RNA, 15 nt, Human
ucugucuucacaaca

SEQ ID NO: 2375065 - RNA, 17 nt, Human
ucugucuucaagggcuu

SEQ ID NO: 2375066 - RNA, 16 nt, Human
ucugucugguggcccc

SEQ ID NO: 2375067 - RNA, 17 nt, Human
ucugucugguggccccg

SEQ ID NO: 2375068 - RNA, 13 nt, Human
ucugucugguggc

SEQ ID NO: 2375069 - RNA, 18 nt, Human
ucugucuggagugacaga

SEQ ID NO: 2375070 - RNA, 22 nt, Human
ucugucugcccuucaccccagu

SEQ ID NO: 2375071 - RNA, 13 nt, Human
ucugucugcccuu

SEQ ID NO: 2375072 - RNA, 14 nt, Human
ucugucucugccuc

SEQ ID NO: 2375073 - RNA, 17 nt, Human
ucugucucugccucccu

SEQ ID NO: 2375074 - RNA, 15 nt, Human
ucuuaaauaauaaag

SEQ ID NO: 2375075 - RNA, 11 nt, Human
ucuuaaauuuu

SEQ ID NO: 2375076 - RNA, 13 nt, Human
ucuuaaauuuugu

SEQ ID NO: 2375077 - RNA, 14 nt, Human
ucuuaaauuuugug

SEQ ID NO: 2375078 - RNA, 19 nt, Human
ucuuaaauaauaaagauca

SEQ ID NO: 2375079 - RNA, 22 nt, Human
ucuuaaauauguggaguucauc

SEQ ID NO: 2375080 - RNA, 16 nt, Human
ucuuaaccagaucauu

SEQ ID NO: 2375081 - RNA, 17 nt, Human
ucuuaaccagaucauug

SEQ ID NO: 2375082 - RNA, 15 nt, Human
ucuuaagacuuuugg

SEQ ID NO: 2375083 - RNA, 12 nt, Human
ucuuaagccauc

SEQ ID NO: 2375084 - RNA, 13 nt, Human
ucuuaagccaucu

SEQ ID NO: 2375085 - RNA, 16 nt, Human
ucuuaagccaucuugg

SEQ ID NO: 2375086 - RNA, 17 nt, Human
ucuuaagccaucuuggu

SEQ ID NO: 2375087 - RNA, 19 nt, Human
ucuuaagccaucuugguaa

SEQ ID NO: 2375088 - RNA, 18 nt, Human
ucuuaagaagacugcauu

SEQ ID NO: 2375089 - RNA, 12 nt, Human
ucuuaagcuucc

SEQ ID NO: 2375090 - RNA, 21 nt, Human
ucuuaagccuuuugcucacaa

SEQ ID NO: 2375091 - RNA, 17 nt, Human
ucuuagcuccccuccaa

SEQ ID NO: 2375092 - RNA, 20 nt, Human
ucuuaagccaucuugguaaa

SEQ ID NO: 2375093 - RNA, 22 nt, Human
ucuuaagccaucuugguaaauu

SEQ ID NO: 2375094 - RNA, 23 nt, Human
ucuuaagccaucuugguaaauuu

SEQ ID NO: 2375095 - RNA, 23 nt, Human
ucuuagcugucugcucagacaga

SEQ ID NO: 2375096 - RNA, 12 nt, Human
ucuuagcugagu

SEQ ID NO: 2375097 - RNA, 14 nt, Human
ucuuagcuuuuuaa

SEQ ID NO: 2375098 - RNA, 18 nt, Human
ucuuagcugucugcucag

SEQ ID NO: 2375099 - RNA, 15 nt, Human
ucuuagcugucugcu

SEQ ID NO: 2375100 - RNA, 12 nt, Human
ucuuaagaagac

SEQ ID NO: 2375101 - RNA, 12 nt, Human
ucuuaaccaucu

SEQ ID NO: 2375102 - RNA, 22 nt, Human
ucuuaacguuagaccacaaaua

SEQ ID NO: 2375103 - RNA, 18 nt, Human
ucuuaaauuuugugauau

SEQ ID NO: 2375104 - RNA, 15 nt, Human
ucuuaacaauuucug

SEQ ID NO: 2375105 - RNA, 19 nt, Human
ucuuaacaauuucuguccu

SEQ ID NO: 2375106 - RNA, 23 nt, Human
ucuuaacacauguccuugugugu

SEQ ID NO: 2375107 - RNA, 22 nt, Human
ucuuaaccagaucauugugaaa

SEQ ID NO: 2375108 - RNA, 22 nt, Human
ucuuccuugaagaacugcaggc

SEQ ID NO: 2375109 - RNA, 16 nt, Human
ucuucucauagcauua

SEQ ID NO: 2375110 - RNA, 21 nt, Human
ucuucucaggcucugcccugc

SEQ ID NO: 2375111 - RNA, 20 nt, Human
ucuucucaggcucugcccug

SEQ ID NO: 2375112 - RNA, 14 nt, Human
ucuucucaggcucu

SEQ ID NO: 2375113 - RNA, 20 nt, Human
ucuucucauagcauuaacua

SEQ ID NO: 2375114 - RNA, 19 nt, Human
ucuucucauagcauuaacu

SEQ ID NO: 2375115 - RNA, 18 nt, Human
ucuucucauagcauuaac

SEQ ID NO: 2375116 - RNA, 17 nt, Human
ucuucucauagcauuaa

SEQ ID NO: 2375117 - RNA, 10 nt, Human
ucuucucauu

SEQ ID NO: 2375118 - RNA, 19 nt, Human
ucuuccugugggggaagag

SEQ ID NO: 2375119 - RNA, 12 nt, Human
ucuuccuguggg

SEQ ID NO: 2375120 - RNA, 13 nt, Human
ucuuccugugggg

SEQ ID NO: 2375121 - RNA, 13 nt, Human
ucuuccuucugcc

SEQ ID NO: 2375122 - RNA, 21 nt, Human
ucuuccuugaagaacugcagg

SEQ ID NO: 2375123 - RNA, 12 nt, Human
ucuucuccacug

SEQ ID NO: 2375124 - RNA, 22 nt, Human
ucuucucauuucaccccucccu

SEQ ID NO: 2375125 - RNA, 23 nt, Human
ucuucucauuucaccccucccuu

SEQ ID NO: 2375126 - RNA, 15 nt, Human
ucuucucauuucacc

SEQ ID NO: 2375127 - RNA, 18 nt, Human
ucuucucauuucaccccu

SEQ ID NO: 2375128 - RNA, 19 nt, Human
ucuucucauuucaccccuc

SEQ ID NO: 2375129 - RNA, 20 nt, Human
ucuucucauuucaccccucc

SEQ ID NO: 2375130 - RNA, 12 nt, Human
ucuucuccacca

SEQ ID NO: 2375131 - RNA, 14 nt, Human
ucuucuccaucugg

SEQ ID NO: 2375132 - RNA, 12 nt, Human
ucuucuccccag

SEQ ID NO: 2375133 - RNA, 12 nt, Human
ucuucuccaucu

SEQ ID NO: 2375134 - RNA, 14 nt, Human
ucuucuccccaggu

SEQ ID NO: 2375135 - RNA, 19 nt, Human
ucuucuuuuugcuucaaaa

SEQ ID NO: 2375136 - RNA, 16 nt, Human
ucuucuuuuuuuguga

SEQ ID NO: 2375137 - RNA, 17 nt, Human
ucuucuuuuuuugugau

SEQ ID NO: 2375138 - RNA, 18 nt, Human
ucuucuuuuuuugugaug

SEQ ID NO: 2375139 - RNA, 14 nt, Human
ucuucuccuuucac

SEQ ID NO: 2375140 - RNA, 13 nt, Human
ucuucucuagcug

SEQ ID NO: 2375141 - RNA, 17 nt, Human
ucuucuccuauguguaa

SEQ ID NO: 2375142 - RNA, 15 nt, Human
ucuucucuagcuggu

SEQ ID NO: 2375143 - RNA, 13 nt, Human
ucuucuccuuuca

SEQ ID NO: 2375144 - RNA, 16 nt, Human
ucuucuccuaugugua

SEQ ID NO: 2375145 - RNA, 12 nt, Human
ucuugaacuccu

SEQ ID NO: 2375146 - RNA, 19 nt, Human
ucuugaacuccugaccuca

SEQ ID NO: 2375147 - RNA, 17 nt, Human
ucuugaacuccugaccu

SEQ ID NO: 2375148 - RNA, 13 nt, Human
ucuugaaaaaugc

SEQ ID NO: 2375149 - RNA, 19 nt, Human
ucuugaacacucaugcuga

SEQ ID NO: 2375150 - RNA, 20 nt, Human
ucuugaacacucaugcugaa

SEQ ID NO: 2375151 - RNA, 21 nt, Human
ucuugaacacucaugcugaaa

SEQ ID NO: 2375152 - RNA, 20 nt, Human
ucuucucuagcuggugguuu

SEQ ID NO: 2375153 - RNA, 18 nt, Human
ucuucuuuuugcuguugu

SEQ ID NO: 2375154 - RNA, 20 nt, Human
ucuucuuuuugcuguuguuu

SEQ ID NO: 2375155 - RNA, 23 nt, Human
ucuugaaagauucagguauguug

SEQ ID NO: 2375156 - RNA, 15 nt, Human
ucuuaggaagagaaa

SEQ ID NO: 2375157 - RNA, 19 nt, Human
ucuuaggaagagaaaccag

SEQ ID NO: 2375158 - RNA, 16 nt, Human
ucuuagcuuuuuaauu

SEQ ID NO: 2375159 - RNA, 17 nt, Human
ucuuagcuuuuuaauug

SEQ ID NO: 2375160 - RNA, 18 nt, Human
ucuuagcuuuuuaauugu

SEQ ID NO: 2375161 - RNA, 21 nt, Human
ucuuagcuuuuuaauuguugu

SEQ ID NO: 2375162 - RNA, 23 nt, Human
ucuucagaucucuaacuucacca

SEQ ID NO: 2375163 - RNA, 18 nt, Human
ucuucagaucucuaacuu

SEQ ID NO: 2375164 - RNA, 12 nt, Human
ucuucagccuag

SEQ ID NO: 2375165 - RNA, 11 nt, Human
ucuucagccua

SEQ ID NO: 2375166 - RNA, 19 nt, Human
ucuucagccaccucucuuu

SEQ ID NO: 2375167 - RNA, 13 nt, Human
ucuucagccauca

SEQ ID NO: 2375168 - RNA, 16 nt, Human
ucuucagccaucaaca

SEQ ID NO: 2375169 - RNA, 16 nt, Human
ucuucagccaccucuc

SEQ ID NO: 2375170 - RNA, 19 nt, Human
ucuuaggagcagagcucug

SEQ ID NO: 2375171 - RNA, 22 nt, Human
ucuuagcuuuuuaauuguuguu

SEQ ID NO: 2375172 - RNA, 14 nt, Human
ucuuaggagcagag

SEQ ID NO: 2375173 - RNA, 19 nt, Human
ucuuaggggagagcuuucu

SEQ ID NO: 2375174 - RNA, 17 nt, Human
ucuuaggggagagcuuu

SEQ ID NO: 2375175 - RNA, 19 nt, Human
ucuucauccggcagccugg

SEQ ID NO: 2375176 - RNA, 18 nt, Human
ucuucauccggcagccug

SEQ ID NO: 2375177 - RNA, 13 nt, Human
ucuucauacuuuu

SEQ ID NO: 2375178 - RNA, 15 nt, Human
ucuucauacuuuuuu

SEQ ID NO: 2375179 - RNA, 22 nt, Human
ucuucauacuuuuuuucacagu

SEQ ID NO: 2375180 - RNA, 18 nt, Human
ucuucaggccucccucuc

SEQ ID NO: 2375181 - RNA, 20 nt, Human
ucuucagcuugugcacaauu

SEQ ID NO: 2375182 - RNA, 15 nt, Human
ucuucauaauucuaa

SEQ ID NO: 2375183 - RNA, 21 nt, Human
ucuucauaccuacauguauuu

SEQ ID NO: 2375184 - RNA, 18 nt, Human
ucuucauaccuacaugua

SEQ ID NO: 2375185 - RNA, 15 nt, Human
ucuucaggccucccu

SEQ ID NO: 2375186 - RNA, 14 nt, Human
ucuucaggccuccc

SEQ ID NO: 2375187 - RNA, 13 nt, Human
ucuucaggccucc

SEQ ID NO: 2375188 - RNA, 13 nt, Human
ucuucagcuucuu

SEQ ID NO: 2375189 - RNA, 16 nt, Human
ucuucagcuucuucau

SEQ ID NO: 2375190 - RNA, 22 nt, Human
ucuucagccuagccgaccucag

SEQ ID NO: 2375191 - RNA, 21 nt, Human
ucuucagccuagccgaccuca

SEQ ID NO: 2375192 - RNA, 23 nt, Human
ucuucagccuagccgaccucagc

SEQ ID NO: 2375193 - RNA, 22 nt, Human
ucuucagccucuuucugucccu

SEQ ID NO: 2375194 - RNA, 20 nt, Human
ucuucauccggcagccugga

SEQ ID NO: 2375195 - RNA, 13 nt, Human
ucuucaucuucac

SEQ ID NO: 2375196 - RNA, 14 nt, Human
ucuucaugcaauga

SEQ ID NO: 2375197 - RNA, 17 nt, Human
ucuucaugcaaugacau

SEQ ID NO: 2375198 - RNA, 18 nt, Human
ucuucaucuucaccagag

SEQ ID NO: 2375199 - RNA, 22 nt, Human
ucuuccuguaacacaagccaca

SEQ ID NO: 2375200 - RNA, 17 nt, Human
ucuuccuggauuauuca

SEQ ID NO: 2375201 - RNA, 14 nt, Human
ucaaaaauauaacu

SEQ ID NO: 2375202 - RNA, 14 nt, Human
ucaaaaaaacacua

SEQ ID NO: 2375203 - RNA, 16 nt, Human
ucaaaaaaacacuagu

SEQ ID NO: 2375204 - RNA, 15 nt, Human
ucaaaaauauaacuu

SEQ ID NO: 2375205 - RNA, 16 nt, Human
ucaaaaauauaacuua

SEQ ID NO: 2375206 - RNA, 15 nt, Human
ucaaaaaacuuguaa

SEQ ID NO: 2375207 - RNA, 14 nt, Human
ucaaaaaacuugua

SEQ ID NO: 2375208 - RNA, 15 nt, Human
ucaaaacagagaugu

SEQ ID NO: 2375209 - RNA, 12 nt, Human
ucaaagaaaugc

SEQ ID NO: 2375210 - RNA, 16 nt, Human
ucaaagaaaugcugau

SEQ ID NO: 2375211 - RNA, 19 nt, Human
ucaaagaaaugcugaugga

SEQ ID NO: 2375212 - RNA, 21 nt, Human
ucaaaacacaucuuuccuguc

SEQ ID NO: 2375213 - RNA, 12 nt, Human
ucaaagaaggaa

SEQ ID NO: 2375214 - RNA, 16 nt, Human
ucaaagaaggauggca

SEQ ID NO: 2375215 - RNA, 23 nt, Human
ucaaagaagguuuguguuuuucu

SEQ ID NO: 2375216 - RNA, 17 nt, Human
ucaaagacauucugaca

SEQ ID NO: 2375217 - RNA, 22 nt, Human
ucaaagaaggauggcaccuaaa

SEQ ID NO: 2375218 - RNA, 17 nt, Human
ucaaagaccuugugugu

SEQ ID NO: 2375219 - RNA, 19 nt, Human
ucaaagaccuuguguguau

SEQ ID NO: 2375220 - RNA, 21 nt, Human
ucaaagaccuuguguguaugu

SEQ ID NO: 2375221 - RNA, 21 nt, Human
ucaaauauauucagccuggcu

SEQ ID NO: 2375222 - RNA, 22 nt, Human
ucaaauauauucagccuggcuu

SEQ ID NO: 2375223 - RNA, 23 nt, Human
ucaaauauauucagccuggcuuc

SEQ ID NO: 2375224 - RNA, 16 nt, Human
ucaaagagaaaacuua

SEQ ID NO: 2375225 - RNA, 15 nt, Human
ucaaauauuagaugu

SEQ ID NO: 2375226 - RNA, 16 nt, Human
ucaaauauuagaugug

SEQ ID NO: 2375227 - RNA, 15 nt, Human
ucaaaucagucagug

SEQ ID NO: 2375228 - RNA, 24 nt, Human
ucaaaucagucagugcaaauguca

SEQ ID NO: 2375229 - RNA, 19 nt, Human
ucaaauauuagaugugauu

SEQ ID NO: 2375230 - RNA, 14 nt, Human
ucaaaucagucagu

SEQ ID NO: 2375231 - RNA, 20 nt, Human
ucaaaucaagaaacuuaagg

SEQ ID NO: 2375232 - RNA, 14 nt, Human
ucaaauaugcaaag

SEQ ID NO: 2375233 - RNA, 23 nt, Human
ucaacccuaaaaagcagagcuuu

SEQ ID NO: 2375234 - RNA, 22 nt, Human
ucaacccuaaaaagcagagcuu

SEQ ID NO: 2375235 - RNA, 18 nt, Human
ucaacccuaaaaagcaga

SEQ ID NO: 2375236 - RNA, 13 nt, Human
ucaaauuguaucu

SEQ ID NO: 2375237 - RNA, 23 nt, Human
ucaacccucccucagccccucuu

SEQ ID NO: 2375238 - RNA, 21 nt, Human
ucaacccucccucagccccuc

SEQ ID NO: 2375239 - RNA, 20 nt, Human
ucaacccucccucagccccu

SEQ ID NO: 2375240 - RNA, 19 nt, Human
ucaacccucccucagcccc

SEQ ID NO: 2375241 - RNA, 18 nt, Human
ucaacccucccucagccc

SEQ ID NO: 2375242 - RNA, 17 nt, Human
ucaacccucccucagcc

SEQ ID NO: 2375243 - RNA, 15 nt, Human
ucaacccucccucag

SEQ ID NO: 2375244 - RNA, 14 nt, Human
ucaacccucccuca

SEQ ID NO: 2375245 - RNA, 23 nt, Human
ucaaccccuucgcuccugugucu

SEQ ID NO: 2375246 - RNA, 14 nt, Human
ucaaauuguaucua

SEQ ID NO: 2375247 - RNA, 12 nt, Human
ucaaauuguauc

SEQ ID NO: 2375248 - RNA, 16 nt, Human
ucaaauugagagaaug

SEQ ID NO: 2375249 - RNA, 16 nt, Human
ucaaauucucaaccua

SEQ ID NO: 2375250 - RNA, 21 nt, Human
ucaaauucuucugaacucaaa

SEQ ID NO: 2375251 - RNA, 16 nt, Human
ucaaauucuucugaac

SEQ ID NO: 2375252 - RNA, 14 nt, Human
ucaaauugugugaa

SEQ ID NO: 2375253 - RNA, 17 nt, Human
ucaaauuguaagcaugc

SEQ ID NO: 2375254 - RNA, 20 nt, Human
ucaaauuguaagcaugcaca

SEQ ID NO: 2375255 - RNA, 21 nt, Human
ucaaaugcucagaccagcucu

SEQ ID NO: 2375256 - RNA, 21 nt, Human
ucaaaugcuuggcuucucaua

SEQ ID NO: 2375257 - RNA, 15 nt, Human
ucaaauggaaaggag

SEQ ID NO: 2375258 - RNA, 20 nt, Human
ucaaauggaagacacauuga

SEQ ID NO: 2375259 - RNA, 23 nt, Human
ucaaauggaaaggagaggaaaga

SEQ ID NO: 2375260 - RNA, 17 nt, Human
ucaaauggaagacacau

SEQ ID NO: 2375261 - RNA, 12 nt, Human
ucaaauuaauaa

SEQ ID NO: 2375262 - RNA, 22 nt, Human
ucaaauuaauaaucuuauuagg

SEQ ID NO: 2375263 - RNA, 17 nt, Human
ucaaauuaauaaucuua

SEQ ID NO: 2375264 - RNA, 18 nt, Human
ucaaauggggccagaucc

SEQ ID NO: 2375265 - RNA, 15 nt, Human
ucaaauuagaagaca

SEQ ID NO: 2375266 - RNA, 16 nt, Human
ucaaauuagaagacau

SEQ ID NO: 2375267 - RNA, 23 nt, Human
ucaaauuaaucuuucuuuaccug

SEQ ID NO: 2375268 - RNA, 15 nt, Human
ucaaauucuucugaa

SEQ ID NO: 2375269 - RNA, 14 nt, Human
ucaaauucuucuga

SEQ ID NO: 2375270 - RNA, 20 nt, Human
ucaaauucauuuuuuucacu

SEQ ID NO: 2375271 - RNA, 17 nt, Human
ucaaauuagaagacauu

SEQ ID NO: 2375272 - RNA, 22 nt, Human
ucaaauuagaagacauuuauac

SEQ ID NO: 2375273 - RNA, 19 nt, Human
ucaaaugcucagaccagcu

SEQ ID NO: 2375274 - RNA, 14 nt, Human
ucaaaugcucagac

SEQ ID NO: 2375275 - RNA, 21 nt, Human
ucaaaugacccaaagaccaau

SEQ ID NO: 2375276 - RNA, 17 nt, Human
ucaaaugacccaaagac

SEQ ID NO: 2375277 - RNA, 19 nt, Human
ucaaaugacccaaagacca

SEQ ID NO: 2375278 - RNA, 16 nt, Human
ucaaaugacccaaaga

SEQ ID NO: 2375279 - RNA, 15 nt, Human
ucaaauccauccaga

SEQ ID NO: 2375280 - RNA, 15 nt, Human
ucaaaugacccaaag

SEQ ID NO: 2375281 - RNA, 20 nt, Human
uauuuuccaugaaaaugcaa

SEQ ID NO: 2375282 - RNA, 22 nt, Human
uauuuuccaagugugcauauug

SEQ ID NO: 2375283 - RNA, 24 nt, Human
uauuuuccaagugugcauauugua

SEQ ID NO: 2375284 - RNA, 18 nt, Human
uauuuucccccuuuucug

SEQ ID NO: 2375285 - RNA, 16 nt, Human
uauuuuccaugaaaau

SEQ ID NO: 2375286 - RNA, 22 nt, Human
uauuuuccaaaaguggccucuu

SEQ ID NO: 2375287 - RNA, 14 nt, Human
uauuuuccaagugu

SEQ ID NO: 2375288 - RNA, 15 nt, Human
uauuuuccaagugug

SEQ ID NO: 2375289 - RNA, 19 nt, Human
uauuuuccaagugugcaua

SEQ ID NO: 2375290 - RNA, 22 nt, Human
uauuuucaaauuguaucuagug

SEQ ID NO: 2375291 - RNA, 17 nt, Human
uauuuuauuuuuuucua

SEQ ID NO: 2375292 - RNA, 19 nt, Human
uauuuucaacgcagcccug

SEQ ID NO: 2375293 - RNA, 13 nt, Human
uauuuucauugua

SEQ ID NO: 2375294 - RNA, 15 nt, Human
uauuuucauuguaaa

SEQ ID NO: 2375295 - RNA, 16 nt, Human
uauuuucauuguaaaa

SEQ ID NO: 2375296 - RNA, 19 nt, Human
uauuuuauucccuuucaca

SEQ ID NO: 2375297 - RNA, 16 nt, Human
uauuuuauuguaacag

SEQ ID NO: 2375298 - RNA, 17 nt, Human
uauuuuauuguaacaga

SEQ ID NO: 2375299 - RNA, 13 nt, Human
uauuuuauucccu

SEQ ID NO: 2375300 - RNA, 20 nt, Human
uauuuuauuuagacaagaga

SEQ ID NO: 2375301 - RNA, 18 nt, Human
uauuuuauuguaacagac

SEQ ID NO: 2375302 - RNA, 19 nt, Human
uauuuuauuguaacagaca

SEQ ID NO: 2375303 - RNA, 23 nt, Human
uauuuuauuguaacagacauugu

SEQ ID NO: 2375304 - RNA, 17 nt, Human
uauuuuauuuagacaag

SEQ ID NO: 2375305 - RNA, 17 nt, Human
uauuuuauuaugcauga

SEQ ID NO: 2375306 - RNA, 14 nt, Human
uauuuuauuaugca

SEQ ID NO: 2375307 - RNA, 13 nt, Human
uauuuauauaaau

SEQ ID NO: 2375308 - RNA, 18 nt, Human
uauuuauagcaauccaug

SEQ ID NO: 2375309 - RNA, 17 nt, Human
uauuuauaauacauuuc

SEQ ID NO: 2375310 - RNA, 17 nt, Human
uauuuauaagcagauuu

SEQ ID NO: 2375311 - RNA, 14 nt, Human
uauuuauaagcaga

SEQ ID NO: 2375312 - RNA, 17 nt, Human
uauuuauaaucacuuuu

SEQ ID NO: 2375313 - RNA, 20 nt, Human
uauuuauaacucaucauaaa

SEQ ID NO: 2375314 - RNA, 13 nt, Human
uauuuauaacuca

SEQ ID NO: 2375315 - RNA, 19 nt, Human
uauuuauaacaaccuaaau

SEQ ID NO: 2375316 - RNA, 20 nt, Human
uauuuauaacaaccuaaauu

SEQ ID NO: 2375317 - RNA, 22 nt, Human
uauuuauaacucaucauaaaau

SEQ ID NO: 2375318 - RNA, 21 nt, Human
uauuuauaacucaucauaaaa

SEQ ID NO: 2375319 - RNA, 23 nt, Human
uauuuauaacucaucauaaaaua

SEQ ID NO: 2375320 - RNA, 15 nt, Human
uauuuauaaaacuuc

SEQ ID NO: 2375321 - RNA, 21 nt, Human
uauuuuauuacaucuuucaca

SEQ ID NO: 2375322 - RNA, 13 nt, Human
uauuuauauauuu

SEQ ID NO: 2375323 - RNA, 20 nt, Human
uauuuauauauugguaacau

SEQ ID NO: 2375324 - RNA, 23 nt, Human
uauuuauauauguauuuauaaau

SEQ ID NO: 2375325 - RNA, 14 nt, Human
uauuuauauauauu

SEQ ID NO: 2375326 - RNA, 16 nt, Human
uauuuauauauguauu

SEQ ID NO: 2375327 - RNA, 17 nt, Human
uauuuuauguugcauag

SEQ ID NO: 2375328 - RNA, 15 nt, Human
ucaaaaaaagaaaaa

SEQ ID NO: 2375329 - RNA, 14 nt, Human
ucaaaaaaagaaaa

SEQ ID NO: 2375330 - RNA, 17 nt, Human
uauuuuuuugcaaguga

SEQ ID NO: 2375331 - RNA, 19 nt, Human
uauuuuuuugcaagugaag

SEQ ID NO: 2375332 - RNA, 14 nt, Human
uauuuuuuuucugu

SEQ ID NO: 2375333 - RNA, 16 nt, Human
uauuuuuuuuucuaag

SEQ ID NO: 2375334 - RNA, 19 nt, Human
uauuuuuuuuucuaagaga

SEQ ID NO: 2375335 - RNA, 19 nt, Human
ucaaaaaaaaaaaaaugca

SEQ ID NO: 2375336 - RNA, 20 nt, Human
ucaaaaaaaaaaaaaugcac

SEQ ID NO: 2375337 - RNA, 18 nt, Human
uauuuuuuucugauugua

SEQ ID NO: 2375338 - RNA, 13 nt, Human
uauuuuuuugcaa

SEQ ID NO: 2375339 - RNA, 16 nt, Human
uauuuuuuugcaagug

SEQ ID NO: 2375340 - RNA, 17 nt, Human
uauuuuuuuuaaguauu

SEQ ID NO: 2375341 - RNA, 17 nt, Human
uauuuuuuucuuuucuu

SEQ ID NO: 2375342 - RNA, 14 nt, Human
uauuuuuuuacuaa

SEQ ID NO: 2375343 - RNA, 22 nt, Human
uauuuuuuucugaauuauuuuc

SEQ ID NO: 2375344 - RNA, 20 nt, Human
uauuuuuuuaagcuguaaaa

SEQ ID NO: 2375345 - RNA, 15 nt, Human
uauuuuuuucugauu

SEQ ID NO: 2375346 - RNA, 17 nt, Human
uauuuuuuucugauugu

SEQ ID NO: 2375347 - RNA, 22 nt, Human
uauuuucccuauuagagaagag

SEQ ID NO: 2375348 - RNA, 12 nt, Human
uauuuuccuccc

SEQ ID NO: 2375349 - RNA, 16 nt, Human
uauuuuccuccccagc

SEQ ID NO: 2375350 - RNA, 15 nt, Human
uauuuuccuccccag

SEQ ID NO: 2375351 - RNA, 20 nt, Human
uauuuucugguagauagaaa

SEQ ID NO: 2375352 - RNA, 14 nt, Human
uauuuucuacagug

SEQ ID NO: 2375353 - RNA, 14 nt, Human
uauuuuccuguaaa

SEQ ID NO: 2375354 - RNA, 15 nt, Human
uauuuucuacagugg

SEQ ID NO: 2375355 - RNA, 15 nt, Human
uauuuuuuuaagcgu

SEQ ID NO: 2375356 - RNA, 19 nt, Human
uauuuuuuuaagcuguaaa

SEQ ID NO: 2375357 - RNA, 22 nt, Human
uauuuuuugaggcuaugaauau

SEQ ID NO: 2375358 - RNA, 22 nt, Human
uauuuucugguagauagaaaua

SEQ ID NO: 2375359 - RNA, 21 nt, Human
uauuuucugugccugaauauu

SEQ ID NO: 2375360 - RNA, 13 nt, Human
uauuuuuucccaa

SEQ ID NO: 2375361 - RNA, 15 nt, Human
uauuuuuucagaccg

SEQ ID NO: 2375362 - RNA, 14 nt, Human
uauuuuuucccaaa

SEQ ID NO: 2375363 - RNA, 12 nt, Human
ucacaccugacu

SEQ ID NO: 2375364 - RNA, 20 nt, Human
ucacaccuagcgucaguauu

SEQ ID NO: 2375365 - RNA, 15 nt, Human
ucacaccuagcguca

SEQ ID NO: 2375366 - RNA, 23 nt, Human
ucacaccccagacgaugucuuca

SEQ ID NO: 2375367 - RNA, 24 nt, Human
ucacacccaccguccgcccugcuc

SEQ ID NO: 2375368 - RNA, 22 nt, Human
ucacacccaccguccgcccugc

SEQ ID NO: 2375369 - RNA, 23 nt, Human
ucacacccaccguccgcccugcu

SEQ ID NO: 2375370 - RNA, 23 nt, Human
ucacaccaggcuugccugcaggc

SEQ ID NO: 2375371 - RNA, 15 nt, Human
ucacacccaccgucc

SEQ ID NO: 2375372 - RNA, 20 nt, Human
ucacacccaccguccgcccu

SEQ ID NO: 2375373 - RNA, 21 nt, Human
ucacacccaccguccgcccug

SEQ ID NO: 2375374 - RNA, 11 nt, Human
ucacacccacc

SEQ ID NO: 2375375 - RNA, 20 nt, Human
ucaauuacugguccaaaaga

SEQ ID NO: 2375376 - RNA, 15 nt, Human
ucacaagaagaccag

SEQ ID NO: 2375377 - RNA, 16 nt, Human
ucaauuacugguccaa

SEQ ID NO: 2375378 - RNA, 13 nt, Human
ucaauuacugguc

SEQ ID NO: 2375379 - RNA, 20 nt, Human
ucaauuacaggaaguacugg

SEQ ID NO: 2375380 - RNA, 13 nt, Human
ucacaagacccaa

SEQ ID NO: 2375381 - RNA, 18 nt, Human
ucacaagacccaaaaggc

SEQ ID NO: 2375382 - RNA, 17 nt, Human
ucacaagacccaaaagg

SEQ ID NO: 2375383 - RNA, 16 nt, Human
ucacaggcagguccag

SEQ ID NO: 2375384 - RNA, 17 nt, Human
ucacaggcagguccagg

SEQ ID NO: 2375385 - RNA, 18 nt, Human
ucacaggcagguccaggg

SEQ ID NO: 2375386 - RNA, 13 nt, Human
ucacaccugacuc

SEQ ID NO: 2375387 - RNA, 17 nt, Human
ucacaccugacucugaa

SEQ ID NO: 2375388 - RNA, 18 nt, Human
ucacaccugacucugaaa

SEQ ID NO: 2375389 - RNA, 22 nt, Human
ucacaguccuuaccagcagagc

SEQ ID NO: 2375390 - RNA, 23 nt, Human
ucacaguccuuaccagcagagca

SEQ ID NO: 2375391 - RNA, 19 nt, Human
ucacaguccuuaccagcag

SEQ ID NO: 2375392 - RNA, 16 nt, Human
ucacagucacauucca

SEQ ID NO: 2375393 - RNA, 18 nt, Human
ucacauuuauucugcuca

SEQ ID NO: 2375394 - RNA, 19 nt, Human
ucacauuuauucugcucac

SEQ ID NO: 2375395 - RNA, 17 nt, Human
ucacagugggagccagg

SEQ ID NO: 2375396 - RNA, 18 nt, Human
ucacagugggagccaggg

SEQ ID NO: 2375397 - RNA, 11 nt, Human
ucacauuuucc

SEQ ID NO: 2375398 - RNA, 18 nt, Human
ucacauuuuccuuuucaa

SEQ ID NO: 2375399 - RNA, 17 nt, Human
ucacauuuuccuuuuca

SEQ ID NO: 2375400 - RNA, 16 nt, Human
ucacauuuuccuuuuc

SEQ ID NO: 2375401 - RNA, 14 nt, Human
ucacauuuuccuuu

SEQ ID NO: 2375402 - RNA, 23 nt, Human
ucacagucucuuuaaucuucagu

SEQ ID NO: 2375403 - RNA, 21 nt, Human
ucacagucucuuuaaucuuca

SEQ ID NO: 2375404 - RNA, 19 nt, Human
ucacagucucuuuaaucuu

SEQ ID NO: 2375405 - RNA, 18 nt, Human
ucacagucucuuuaaucu

SEQ ID NO: 2375406 - RNA, 19 nt, Human
ucacaccugacucugaaau

SEQ ID NO: 2375407 - RNA, 20 nt, Human
ucacaccugacucugaaauc

SEQ ID NO: 2375408 - RNA, 15 nt, Human
ucacagucuaauuuu

SEQ ID NO: 2375409 - RNA, 16 nt, Human
ucacagucuaauuuuu

SEQ ID NO: 2375410 - RNA, 21 nt, Human
ucacagucuaauuuuuauuca

SEQ ID NO: 2375411 - RNA, 13 nt, Human
ucacagucucaca

SEQ ID NO: 2375412 - RNA, 17 nt, Human
ucacauuuauucugcuc

SEQ ID NO: 2375413 - RNA, 13 nt, Human
ucacagugcugag

SEQ ID NO: 2375414 - RNA, 22 nt, Human
ucaccaagcucacaguuccucg

SEQ ID NO: 2375415 - RNA, 21 nt, Human
ucaccaagcucacaguuccuc

SEQ ID NO: 2375416 - RNA, 20 nt, Human
ucaccaagcucacaguuccu

SEQ ID NO: 2375417 - RNA, 16 nt, Human
ucaccaagcucacagu

SEQ ID NO: 2375418 - RNA, 12 nt, Human
ucaccaagcuca

SEQ ID NO: 2375419 - RNA, 18 nt, Human
ucaccacaguaaguuccu

SEQ ID NO: 2375420 - RNA, 19 nt, Human
ucaccacaguaaguuccua

SEQ ID NO: 2375421 - RNA, 21 nt, Human
ucaccacaguaaguuccuacu

SEQ ID NO: 2375422 - RNA, 23 nt, Human
ucaccacaccaaaccucucuuau

SEQ ID NO: 2375423 - RNA, 20 nt, Human
ucaccacaugcggagaacaa

SEQ ID NO: 2375424 - RNA, 16 nt, Human
ucaccagagagggacu

SEQ ID NO: 2375425 - RNA, 18 nt, Human
ucaccagaggaaucacuc

SEQ ID NO: 2375426 - RNA, 21 nt, Human
ucaccagauuugcuaauuuau

SEQ ID NO: 2375427 - RNA, 13 nt, Human
ucaccagcaccaa

SEQ ID NO: 2375428 - RNA, 19 nt, Human
ucaccagcaccaacaccac

SEQ ID NO: 2375429 - RNA, 15 nt, Human
ucaccagauuugcua

SEQ ID NO: 2375430 - RNA, 19 nt, Human
ucaccagaggaaucacucu

SEQ ID NO: 2375431 - RNA, 20 nt, Human
ucaccaaaucagcugcuacu

SEQ ID NO: 2375432 - RNA, 19 nt, Human
ucaccaaaucagcugcuac

SEQ ID NO: 2375433 - RNA, 13 nt, Human
ucacaguguguuu

SEQ ID NO: 2375434 - RNA, 17 nt, Human
ucaccaaaguauuuuuu

SEQ ID NO: 2375435 - RNA, 14 nt, Human
ucaccaaggcugau

SEQ ID NO: 2375436 - RNA, 15 nt, Human
ucaaugugaaucaga

SEQ ID NO: 2375437 - RNA, 15 nt, Human
ucaaugugauucuaa

SEQ ID NO: 2375438 - RNA, 15 nt, Human
ucaaugucaaguacc

SEQ ID NO: 2375439 - RNA, 11 nt, Human
ucaaugucacu

SEQ ID NO: 2375440 - RNA, 18 nt, Human
ucaaugguuugcaaggaa

SEQ ID NO: 2375441 - RNA, 19 nt, Human
ucaaugguuugcaaggaag

SEQ ID NO: 2375442 - RNA, 16 nt, Human
ucaauguucauuguaa

SEQ ID NO: 2375443 - RNA, 14 nt, Human
ucaauguucauugu

SEQ ID NO: 2375444 - RNA, 13 nt, Human
ucaauguucauug

SEQ ID NO: 2375445 - RNA, 12 nt, Human
ucaauguucauu

SEQ ID NO: 2375446 - RNA, 11 nt, Human
ucaauguucau

SEQ ID NO: 2375447 - RNA, 22 nt, Human
ucaaugugauucuaaugucuuc

SEQ ID NO: 2375448 - RNA, 13 nt, Human
ucaaugugcagug

SEQ ID NO: 2375449 - RNA, 16 nt, Human
ucaaugugauucuaau

SEQ ID NO: 2375450 - RNA, 17 nt, Human
ucaaugugauucuaaug

SEQ ID NO: 2375451 - RNA, 18 nt, Human
ucaaugugauucuaaugu

SEQ ID NO: 2375452 - RNA, 21 nt, Human
ucaaugugauucuaaugucuu

SEQ ID NO: 2375453 - RNA, 18 nt, Human
ucaauguggugaugaaau

SEQ ID NO: 2375454 - RNA, 21 nt, Human
ucaauuacaggaaguacugga

SEQ ID NO: 2375455 - RNA, 23 nt, Human
ucaauuacaggaaguacuggaga

SEQ ID NO: 2375456 - RNA, 20 nt, Human
ucaauaagcaucaaacucuu

SEQ ID NO: 2375457 - RNA, 14 nt, Human
ucaauacacuaguu

SEQ ID NO: 2375458 - RNA, 18 nt, Human
ucaauacacuaguuguuu

SEQ ID NO: 2375459 - RNA, 19 nt, Human
ucaauaauauauuuucugu

SEQ ID NO: 2375460 - RNA, 20 nt, Human
ucaauaauauauuuucuguu

SEQ ID NO: 2375461 - RNA, 13 nt, Human
ucaaugcagcccc

SEQ ID NO: 2375462 - RNA, 14 nt, Human
ucaauaagccuugu

SEQ ID NO: 2375463 - RNA, 15 nt, Human
ucaauaauauauuuu

SEQ ID NO: 2375464 - RNA, 18 nt, Human
ucaauaauauauuuucug

SEQ ID NO: 2375465 - RNA, 16 nt, Human
ucaauaaaugucuguu

SEQ ID NO: 2375466 - RNA, 13 nt, Human
ucaauaaaguauc

SEQ ID NO: 2375467 - RNA, 12 nt, Human
ucaauaaaguau

SEQ ID NO: 2375468 - RNA, 14 nt, Human
ucaauaaaguauuu

SEQ ID NO: 2375469 - RNA, 19 nt, Human
ucaauaaagcauuuauaaa

SEQ ID NO: 2375470 - RNA, 15 nt, Human
ucaauaaagcauuua

SEQ ID NO: 2375471 - RNA, 11 nt, Human
ucaauaaagua

SEQ ID NO: 2375472 - RNA, 15 nt, Human
ucaauaaaguauuua

SEQ ID NO: 2375473 - RNA, 16 nt, Human
ucaauaaaguauuuaa

SEQ ID NO: 2375474 - RNA, 17 nt, Human
ucaauaaaguauuuaau

SEQ ID NO: 2375475 - RNA, 18 nt, Human
ucaauaaaguauuuaauu

SEQ ID NO: 2375476 - RNA, 17 nt, Human
ucaauaaaguaucuaca

SEQ ID NO: 2375477 - RNA, 20 nt, Human
ucaauaaaguauuuaauuag

SEQ ID NO: 2375478 - RNA, 22 nt, Human
ucaauaaaguauuuaauuagug

SEQ ID NO: 2375479 - RNA, 15 nt, Human
ucaauaaaugucugu

SEQ ID NO: 2375480 - RNA, 15 nt, Human
ucaauaaaugguaua

SEQ ID NO: 2375481 - RNA, 13 nt, Human
ucaauaaaaugug

SEQ ID NO: 2375482 - RNA, 17 nt, Human
ucaaguugugcuuguuu

SEQ ID NO: 2375483 - RNA, 22 nt, Human
ucaaguugugcuuguuuacagc

SEQ ID NO: 2375484 - RNA, 16 nt, Human
ucaaguuuuucagaaa

SEQ ID NO: 2375485 - RNA, 18 nt, Human
ucaauaaaaugugauuuu

SEQ ID NO: 2375486 - RNA, 16 nt, Human
ucaauaaaaugugauu

SEQ ID NO: 2375487 - RNA, 15 nt, Human
ucaauaaaaugugau

SEQ ID NO: 2375488 - RNA, 14 nt, Human
ucaauaaaauguga

SEQ ID NO: 2375489 - RNA, 22 nt, Human
ucaauaaaaugugauuuuucug

SEQ ID NO: 2375490 - RNA, 19 nt, Human
ucaauaaaaugugauuuuu

SEQ ID NO: 2375491 - RNA, 23 nt, Human
ucaauaaaaugugauuuuucuga

SEQ ID NO: 2375492 - RNA, 15 nt, Human
ucaauaaacgauuua

SEQ ID NO: 2375493 - RNA, 13 nt, Human
ucaauaaacgauu

SEQ ID NO: 2375494 - RNA, 12 nt, Human
ucaauaaagcau

SEQ ID NO: 2375495 - RNA, 17 nt, Human
ucaauaaacgauuuaau

SEQ ID NO: 2375496 - RNA, 18 nt, Human
ucaauaaacgauuuaauu

SEQ ID NO: 2375497 - RNA, 22 nt, Human
ucaauaaacgauuuaauucucu

SEQ ID NO: 2375498 - RNA, 23 nt, Human
ucaauaaacgauuuaauucucuu

SEQ ID NO: 2375499 - RNA, 13 nt, Human
ucaaguugugcuu

SEQ ID NO: 2375500 - RNA, 14 nt, Human
ucaaguugugcuug

SEQ ID NO: 2375501 - RNA, 21 nt, Human
ucaauaaaauccauacauuug

SEQ ID NO: 2375502 - RNA, 14 nt, Human
ucaaguuccuuugg

SEQ ID NO: 2375503 - RNA, 16 nt, Human
ucaaguuccuuugggu

SEQ ID NO: 2375504 - RNA, 19 nt, Human
ucaagugauucuccugccu

SEQ ID NO: 2375505 - RNA, 22 nt, Human
ucaacgcuuaaaggugucuucc

SEQ ID NO: 2375506 - RNA, 13 nt, Human
ucaaguuauugua

SEQ ID NO: 2375507 - RNA, 17 nt, Human
ucaaguuauuguacagc

SEQ ID NO: 2375508 - RNA, 21 nt, Human
ucaagugauucuccugccuca

SEQ ID NO: 2375509 - RNA, 18 nt, Human
ucaagugauucuccugcc

SEQ ID NO: 2375510 - RNA, 20 nt, Human
ucaagugauucuccugccuc

SEQ ID NO: 2375511 - RNA, 20 nt, Human
ucaaccugugaugaggggag

SEQ ID NO: 2375512 - RNA, 16 nt, Human
ucaaccuugagacagc

SEQ ID NO: 2375513 - RNA, 17 nt, Human
ucaaccuugagacagcu

SEQ ID NO: 2375514 - RNA, 18 nt, Human
ucaaccugggcaaagccu

SEQ ID NO: 2375515 - RNA, 15 nt, Human
ucaaccugugaugag

SEQ ID NO: 2375516 - RNA, 14 nt, Human
ucaacccuggagag

SEQ ID NO: 2375517 - RNA, 18 nt, Human
ucaacccucucaggugac

SEQ ID NO: 2375518 - RNA, 13 nt, Human
ucaacccuggaga

SEQ ID NO: 2375519 - RNA, 14 nt, Human
ucaacgcagcccug

SEQ ID NO: 2375520 - RNA, 15 nt, Human
ucaacgcagcccugc

SEQ ID NO: 2375521 - RNA, 18 nt, Human
ucaacgcagcccugcuuu

SEQ ID NO: 2375522 - RNA, 18 nt, Human
ucaaccuugagacagcuu

SEQ ID NO: 2375523 - RNA, 19 nt, Human
ucaacgcuuaaaggugucu

SEQ ID NO: 2375524 - RNA, 20 nt, Human
ucaacgcuuaaaggugucuu

SEQ ID NO: 2375525 - RNA, 17 nt, Human
uauuaauagcugccuua

SEQ ID NO: 2375526 - RNA, 18 nt, Human
uauuaauauauaucugcu

SEQ ID NO: 2375527 - RNA, 20 nt, Human
uauuaauauauaucugcugu

SEQ ID NO: 2375528 - RNA, 21 nt, Human
uauuaagauggauucucagau

SEQ ID NO: 2375529 - RNA, 20 nt, Human
uauuaagauggauucucaga

SEQ ID NO: 2375530 - RNA, 19 nt, Human
uauuaagauggauucucag

SEQ ID NO: 2375531 - RNA, 18 nt, Human
uauuaagauggauucuca

SEQ ID NO: 2375532 - RNA, 16 nt, Human
uauuaagauggauucu

SEQ ID NO: 2375533 - RNA, 20 nt, Human
uauuaauauucauuguauaa

SEQ ID NO: 2375534 - RNA, 17 nt, Human
uauuaauauucauugua

SEQ ID NO: 2375535 - RNA, 15 nt, Human
uauuaauauuuuaau

SEQ ID NO: 2375536 - RNA, 23 nt, Human
uauuaaugccuuuaaaguaugaa

SEQ ID NO: 2375537 - RNA, 13 nt, Human
uauuaaugccuuu

SEQ ID NO: 2375538 - RNA, 14 nt, Human
uauuaaugccuuua

SEQ ID NO: 2375539 - RNA, 22 nt, Human
uauuaaugccuuuaaaguauga

SEQ ID NO: 2375540 - RNA, 13 nt, Human
uauuaaugcacuu

SEQ ID NO: 2375541 - RNA, 14 nt, Human
uauuaaugcacuuu

SEQ ID NO: 2375542 - RNA, 17 nt, Human
uauuaaugcacuuucua

SEQ ID NO: 2375543 - RNA, 20 nt, Human
uauuaaugcacuuucuaucc

SEQ ID NO: 2375544 - RNA, 13 nt, Human
uauuaaugaaaau

SEQ ID NO: 2375545 - RNA, 12 nt, Human
uauuaaugcacu

SEQ ID NO: 2375546 - RNA, 22 nt, Human
uauguuuguauaaugaaugaga

SEQ ID NO: 2375547 - RNA, 19 nt, Human
uauuaaauuaaauuuugug

SEQ ID NO: 2375548 - RNA, 21 nt, Human
uauuaaauuaaauuuuguguc

SEQ ID NO: 2375549 - RNA, 19 nt, Human
uauguuugcacacuugugu

SEQ ID NO: 2375550 - RNA, 14 nt, Human
uauguuugcacacu

SEQ ID NO: 2375551 - RNA, 22 nt, Human
uauguuugccacuuugcaaagg

SEQ ID NO: 2375552 - RNA, 12 nt, Human
uauuaaauuaug

SEQ ID NO: 2375553 - RNA, 15 nt, Human
uauuaagauggauuc

SEQ ID NO: 2375554 - RNA, 13 nt, Human
uauuaagauggau

SEQ ID NO: 2375555 - RNA, 14 nt, Human
uauuaagagugaaa

SEQ ID NO: 2375556 - RNA, 13 nt, Human
uauuaagaaugaa

SEQ ID NO: 2375557 - RNA, 22 nt, Human
uauuaagaggcagaaaauugca

SEQ ID NO: 2375558 - RNA, 16 nt, Human
uauuaagaaugaaaua

SEQ ID NO: 2375559 - RNA, 24 nt, Human
uauuaagaaagacuaucuaaaugu

SEQ ID NO: 2375560 - RNA, 14 nt, Human
uauguugauaaaag

SEQ ID NO: 2375561 - RNA, 12 nt, Human
uauguugcauag

SEQ ID NO: 2375562 - RNA, 19 nt, Human
uaugucaucauacaugacu

SEQ ID NO: 2375563 - RNA, 15 nt, Human
uaugucaucauacau

SEQ ID NO: 2375564 - RNA, 23 nt, Human
uaugucauuuccuucaaggcauc

SEQ ID NO: 2375565 - RNA, 16 nt, Human
uaugucauuucauuuc

SEQ ID NO: 2375566 - RNA, 18 nt, Human
uauguugaauacuuuuua

SEQ ID NO: 2375567 - RNA, 14 nt, Human
uaugucaaagcagg

SEQ ID NO: 2375568 - RNA, 12 nt, Human
uauguauuuaua

SEQ ID NO: 2375569 - RNA, 18 nt, Human
uauguauuguaaacaugu

SEQ ID NO: 2375570 - RNA, 20 nt, Human
uauguauuguaaacaugugu

SEQ ID NO: 2375571 - RNA, 22 nt, Human
uauguauuguaaacauguguuu

SEQ ID NO: 2375572 - RNA, 19 nt, Human
uauguauuaauauucauug

SEQ ID NO: 2375573 - RNA, 16 nt, Human
uauguauguuuacaua

SEQ ID NO: 2375574 - RNA, 17 nt, Human
uauguauguuuacauau

SEQ ID NO: 2375575 - RNA, 13 nt, Human
uauguugcccagg

SEQ ID NO: 2375576 - RNA, 16 nt, Human
uauguugcauagaaua

SEQ ID NO: 2375577 - RNA, 16 nt, Human
uauguugcccaggcag

SEQ ID NO: 2375578 - RNA, 19 nt, Human
uauguugcccaggcagguc

SEQ ID NO: 2375579 - RNA, 14 nt, Human
uauguuuacauauc

SEQ ID NO: 2375580 - RNA, 12 nt, Human
uauguuuacaaa

SEQ ID NO: 2375581 - RNA, 15 nt, Human
uauguugaugaaaaa

SEQ ID NO: 2375582 - RNA, 20 nt, Human
uauguugcccaggcaggucu

SEQ ID NO: 2375583 - RNA, 18 nt, Human
uauguuuaccuuuuaauu

SEQ ID NO: 2375584 - RNA, 18 nt, Human
uauguuuauauaaaugcu

SEQ ID NO: 2375585 - RNA, 18 nt, Human
uauguuuauuuacuaauu

SEQ ID NO: 2375586 - RNA, 14 nt, Human
uauguacaaguguu

SEQ ID NO: 2375587 - RNA, 15 nt, Human
uauguacaugagaag

SEQ ID NO: 2375588 - RNA, 16 nt, Human
uauguaauaaugugaa

SEQ ID NO: 2375589 - RNA, 15 nt, Human
uauguaauaauguga

SEQ ID NO: 2375590 - RNA, 15 nt, Human
uauguaagagcaccu

SEQ ID NO: 2375591 - RNA, 16 nt, Human
uauguaagagcaccuu

SEQ ID NO: 2375592 - RNA, 13 nt, Human
uauguaaucuaug

SEQ ID NO: 2375593 - RNA, 24 nt, Human
uauguaacugcauugagaacugca

SEQ ID NO: 2375594 - RNA, 14 nt, Human
uauguaacugcauu

SEQ ID NO: 2375595 - RNA, 12 nt, Human
uauguaacaugu

SEQ ID NO: 2375596 - RNA, 11 nt, Human
uauguaacaug

SEQ ID NO: 2375597 - RNA, 20 nt, Human
uauguacuccucuuuacacu

SEQ ID NO: 2375598 - RNA, 18 nt, Human
uauguacguuuguaugug

SEQ ID NO: 2375599 - RNA, 19 nt, Human
uauguacguuuguaugugu

SEQ ID NO: 2375600 - RNA, 21 nt, Human
uauguacguuuguaugugugu

SEQ ID NO: 2375601 - RNA, 22 nt, Human
uauguacguuuguaugugugua

SEQ ID NO: 2375602 - RNA, 16 nt, Human
uauguacguuuguaug

SEQ ID NO: 2375603 - RNA, 16 nt, Human
uauguaccauguacau

SEQ ID NO: 2375604 - RNA, 13 nt, Human
uauguacuucaug

SEQ ID NO: 2375605 - RNA, 17 nt, Human
uauguacuucaugcugu

SEQ ID NO: 2375606 - RNA, 20 nt, Human
uauguauggaauacaguguu

SEQ ID NO: 2375607 - RNA, 19 nt, Human
uauguauauuuaaaagaaa

SEQ ID NO: 2375608 - RNA, 15 nt, Human
uauguauaauucaaa

SEQ ID NO: 2375609 - RNA, 18 nt, Human
uauguaguccgugcugac

SEQ ID NO: 2375610 - RNA, 16 nt, Human
uauguaugugaaaguu

SEQ ID NO: 2375611 - RNA, 17 nt, Human
uauguauguguguaugg

SEQ ID NO: 2375612 - RNA, 14 nt, Human
uauguaugugugua

SEQ ID NO: 2375613 - RNA, 13 nt, Human
uauguaugugugu

SEQ ID NO: 2375614 - RNA, 13 nt, Human
uauguauguuuac

SEQ ID NO: 2375615 - RNA, 16 nt, Human
uauguagaugugcauu

SEQ ID NO: 2375616 - RNA, 12 nt, Human
uauguagaugug

SEQ ID NO: 2375617 - RNA, 15 nt, Human
uauguagcaaaauac

SEQ ID NO: 2375618 - RNA, 17 nt, Human
uauguagaugugcauuu

SEQ ID NO: 2375619 - RNA, 21 nt, Human
uauguagcaggaaauaaagua

SEQ ID NO: 2375620 - RNA, 19 nt, Human
uauguagcagggaaaauau

SEQ ID NO: 2375621 - RNA, 20 nt, Human
uauguaguaauugacaugug

SEQ ID NO: 2375622 - RNA, 17 nt, Human
uauguaguaauugacau

SEQ ID NO: 2375623 - RNA, 14 nt, Human
uauguaguaauuga

SEQ ID NO: 2375624 - RNA, 21 nt, Human
uauguacuccucuuuacacug

SEQ ID NO: 2375625 - RNA, 15 nt, Human
uauguacuugucaaa

SEQ ID NO: 2375626 - RNA, 23 nt, Human
uauguagaaaaaaguaaauguga

SEQ ID NO: 2375627 - RNA, 19 nt, Human
uauguacuugucaaagaag

SEQ ID NO: 2375628 - RNA, 16 nt, Human
uauguacuugucaaag

SEQ ID NO: 2375629 - RNA, 14 nt, Human
uauguagauaacaa

SEQ ID NO: 2375630 - RNA, 18 nt, Human
gggagugggacagagucu

SEQ ID NO: 2375631 - RNA, 17 nt, Human
gggaguggaguggaaga

SEQ ID NO: 2375632 - RNA, 21 nt, Human
gggaguggaauaguauccucc

SEQ ID NO: 2375633 - RNA, 15 nt, Human
gggaguggaguggaa

SEQ ID NO: 2375634 - RNA, 20 nt, Human
gggagugggacagagucugg

SEQ ID NO: 2375635 - RNA, 19 nt, Human
uauggaugauucagaaauu

SEQ ID NO: 2375636 - RNA, 11 nt, Human
uauggaugugg

SEQ ID NO: 2375637 - RNA, 20 nt, Human
uauggaugauucagaaauug

SEQ ID NO: 2375638 - RNA, 13 nt, Human
gggaguggccaca

SEQ ID NO: 2375639 - RNA, 15 nt, Human
gggaguggccacaga

SEQ ID NO: 2375640 - RNA, 21 nt, Human
uauggauuuucuauuguuacu

SEQ ID NO: 2375641 - RNA, 14 nt, Human
uauggcaaaaaugg

SEQ ID NO: 2375642 - RNA, 12 nt, Human
uauggcagaaga

SEQ ID NO: 2375643 - RNA, 13 nt, Human
uauggcagaagac

SEQ ID NO: 2375644 - RNA, 14 nt, Human
uauggcagaagaca

SEQ ID NO: 2375645 - RNA, 15 nt, Human
uauggcagaagacac

SEQ ID NO: 2375646 - RNA, 16 nt, Human
uauggcagaagacacc

SEQ ID NO: 2375647 - RNA, 22 nt, Human
uauggcagaagacaccagagca

SEQ ID NO: 2375648 - RNA, 23 nt, Human
uauggcagaagacaccagagcag

SEQ ID NO: 2375649 - RNA, 17 nt, Human
uauggcagaguuguaaa

SEQ ID NO: 2375650 - RNA, 18 nt, Human
uauggcagaguuguaaau

SEQ ID NO: 2375651 - RNA, 22 nt, Human
uaugguugauaguuuaccugaa

SEQ ID NO: 2375652 - RNA, 20 nt, Human
uaugguugauaguuuaccug

SEQ ID NO: 2375653 - RNA, 21 nt, Human
uaugguugauaguuuaccuga

SEQ ID NO: 2375654 - RNA, 21 nt, Human
uauggcagaguuguaaauaua

SEQ ID NO: 2375655 - RNA, 19 nt, Human
uauggcagaguuguaaaua

SEQ ID NO: 2375656 - RNA, 20 nt, Human
uauggcagaguuguaaauau

SEQ ID NO: 2375657 - RNA, 19 nt, Human
uaugguguuucucccucuc

SEQ ID NO: 2375658 - RNA, 13 nt, Human
uauguaaaugugc

SEQ ID NO: 2375659 - RNA, 21 nt, Human
uauguaacaaaccugcacuua

SEQ ID NO: 2375660 - RNA, 13 nt, Human
uauguaaauguau

SEQ ID NO: 2375661 - RNA, 14 nt, Human
uauguaaauguaua

SEQ ID NO: 2375662 - RNA, 10 nt, Human
uauguaaaug

SEQ ID NO: 2375663 - RNA, 19 nt, Human
uauguaaaauaaaauuaug

SEQ ID NO: 2375664 - RNA, 12 nt, Human
uauguaaaauaa

SEQ ID NO: 2375665 - RNA, 23 nt, Human
uauguaaaaggccaaaccucugu

SEQ ID NO: 2375666 - RNA, 22 nt, Human
uauguaaaaggccaaaccucug

SEQ ID NO: 2375667 - RNA, 21 nt, Human
uauguaaaaggccaaaccucu

SEQ ID NO: 2375668 - RNA, 14 nt, Human
uauguaaacauaau

SEQ ID NO: 2375669 - RNA, 15 nt, Human
uauguaaacaggaga

SEQ ID NO: 2375670 - RNA, 15 nt, Human
uauguaaaauguuuu

SEQ ID NO: 2375671 - RNA, 17 nt, Human
uauguaaaauguuuuag

SEQ ID NO: 2375672 - RNA, 23 nt, Human
uauguaaacugcauuagaaauua

SEQ ID NO: 2375673 - RNA, 14 nt, Human
uauguaaaguaugu

SEQ ID NO: 2375674 - RNA, 19 nt, Human
uauguaaacugcauuagaa

SEQ ID NO: 2375675 - RNA, 18 nt, Human
uauguaaacauaauucuu

SEQ ID NO: 2375676 - RNA, 17 nt, Human
uauguaaaguauguaaa

SEQ ID NO: 2375677 - RNA, 18 nt, Human
uauguaaaguauguaaac

SEQ ID NO: 2375678 - RNA, 19 nt, Human
uauguaaaguauguaaaca

SEQ ID NO: 2375679 - RNA, 20 nt, Human
uauguaaaguauguaaacag

SEQ ID NO: 2375680 - RNA, 21 nt, Human
uauuccuuuuguguacagugu

SEQ ID NO: 2375681 - RNA, 19 nt, Human
uauuccuuuuguguacagu

SEQ ID NO: 2375682 - RNA, 20 nt, Human
uauuccuuuuguguacagug

SEQ ID NO: 2375683 - RNA, 22 nt, Human
uauucgauacugcgacuuucug

SEQ ID NO: 2375684 - RNA, 20 nt, Human
uauuccugaaugaaauauca

SEQ ID NO: 2375685 - RNA, 14 nt, Human
uauuccugaaugaa

SEQ ID NO: 2375686 - RNA, 22 nt, Human
uauuccuguggauguaaaguga

SEQ ID NO: 2375687 - RNA, 22 nt, Human
uauuccuugauacuaaaaguuc

SEQ ID NO: 2375688 - RNA, 11 nt, Human
uauuccugccu

SEQ ID NO: 2375689 - RNA, 14 nt, Human
uauuccuguauguu

SEQ ID NO: 2375690 - RNA, 17 nt, Human
uauuccuguauguuguc

SEQ ID NO: 2375691 - RNA, 16 nt, Human
uauuccuuucuaucau

SEQ ID NO: 2375692 - RNA, 17 nt, Human
uauuccugcauuuguga

SEQ ID NO: 2375693 - RNA, 19 nt, Human
uauuccugcauuugugaaa

SEQ ID NO: 2375694 - RNA, 20 nt, Human
uauuccugcauuugugaaau

SEQ ID NO: 2375695 - RNA, 21 nt, Human
uauuccugcauuugugaaaug

SEQ ID NO: 2375696 - RNA, 21 nt, Human
uauuccuauauaguuuauuga

SEQ ID NO: 2375697 - RNA, 20 nt, Human
uauuccuauauaguuuauug

SEQ ID NO: 2375698 - RNA, 21 nt, Human
uauucccuguacaauauuuaa

SEQ ID NO: 2375699 - RNA, 21 nt, Human
uauucccuagaaacuuccaaa

SEQ ID NO: 2375700 - RNA, 22 nt, Human
uauuccuauauaguuuauugac

SEQ ID NO: 2375701 - RNA, 13 nt, Human
uauuccuccuggg

SEQ ID NO: 2375702 - RNA, 18 nt, Human
uauuccuccugcucauau

SEQ ID NO: 2375703 - RNA, 10 nt, Human
uauucuaguc

SEQ ID NO: 2375704 - RNA, 14 nt, Human
uauucuauaugaau

SEQ ID NO: 2375705 - RNA, 15 nt, Human
uauucuauaugaauu

SEQ ID NO: 2375706 - RNA, 12 nt, Human
uauucuauugca

SEQ ID NO: 2375707 - RNA, 17 nt, Human
uauucuauaugaauuua

SEQ ID NO: 2375708 - RNA, 19 nt, Human
uauucuauaugaauuuaaa

SEQ ID NO: 2375709 - RNA, 13 nt, Human
uauucuauuaacu

SEQ ID NO: 2375710 - RNA, 19 nt, Human
uauucuauuaacuuuaauu

SEQ ID NO: 2375711 - RNA, 22 nt, Human
uauucucacuccaccacccaaa

SEQ ID NO: 2375712 - RNA, 15 nt, Human
uauucucacuccacc

SEQ ID NO: 2375713 - RNA, 14 nt, Human
uauucucacuccac

SEQ ID NO: 2375714 - RNA, 13 nt, Human
uauucucacucca

SEQ ID NO: 2375715 - RNA, 15 nt, Human
uauucucaccaggaa

SEQ ID NO: 2375716 - RNA, 14 nt, Human
uauucucaccagga

SEQ ID NO: 2375717 - RNA, 17 nt, Human
uauucucaaacacaguu

SEQ ID NO: 2375718 - RNA, 22 nt, Human
uauucucaaacacaguuacacu

SEQ ID NO: 2375719 - RNA, 14 nt, Human
uauucuauuuucau

SEQ ID NO: 2375720 - RNA, 22 nt, Human
uauucuauuuucauuuucugca

SEQ ID NO: 2375721 - RNA, 19 nt, Human
uauucuagcuaauguaaua

SEQ ID NO: 2375722 - RNA, 22 nt, Human
uauuccccuaucucuagaauuu

SEQ ID NO: 2375723 - RNA, 20 nt, Human
uauuccccuaucucuagaau

SEQ ID NO: 2375724 - RNA, 17 nt, Human
uauuccccauucuuccu

SEQ ID NO: 2375725 - RNA, 23 nt, Human
uauuccccagcagggucuuuuca

SEQ ID NO: 2375726 - RNA, 23 nt, Human
uauucccaagcucuagugggaag

SEQ ID NO: 2375727 - RNA, 12 nt, Human
uauucccaugag

SEQ ID NO: 2375728 - RNA, 20 nt, Human
uauucccaagcccaugaguc

SEQ ID NO: 2375729 - RNA, 22 nt, Human
uauucccaagcccaugaguccu

SEQ ID NO: 2375730 - RNA, 22 nt, Human
uauuccaugaauguaucaggaa

SEQ ID NO: 2375731 - RNA, 17 nt, Human
uauuccaugaauguauc

SEQ ID NO: 2375732 - RNA, 16 nt, Human
uauuccaugaauguau

SEQ ID NO: 2375733 - RNA, 19 nt, Human
uauuccauccauauacuuu

SEQ ID NO: 2375734 - RNA, 23 nt, Human
uauuccaugaauguaucaggaaa

SEQ ID NO: 2375735 - RNA, 18 nt, Human
uauuccauauauuagcau

SEQ ID NO: 2375736 - RNA, 15 nt, Human
uauuccauauuuauu

SEQ ID NO: 2375737 - RNA, 17 nt, Human
uauuccauauuuauuca

SEQ ID NO: 2375738 - RNA, 18 nt, Human
uauuccauccauauacuu

SEQ ID NO: 2375739 - RNA, 15 nt, Human
uauuauucugcagca

SEQ ID NO: 2375740 - RNA, 13 nt, Human
uauuauucugcag

SEQ ID NO: 2375741 - RNA, 14 nt, Human
uauuauugaaauug

SEQ ID NO: 2375742 - RNA, 15 nt, Human
uauuauugaaauugu

SEQ ID NO: 2375743 - RNA, 13 nt, Human
uauuccacaucua

SEQ ID NO: 2375744 - RNA, 16 nt, Human
uauuauugaaauugua

SEQ ID NO: 2375745 - RNA, 17 nt, Human
uauuccaagacaugucu

SEQ ID NO: 2375746 - RNA, 19 nt, Human
uauuccaagacaugucugu

SEQ ID NO: 2375747 - RNA, 16 nt, Human
uauuccagaaugcugu

SEQ ID NO: 2375748 - RNA, 20 nt, Human
uauuccagaaugcuguacau

SEQ ID NO: 2375749 - RNA, 17 nt, Human
uauuccagaaugcugua

SEQ ID NO: 2375750 - RNA, 14 nt, Human
uauuccauauauua

SEQ ID NO: 2375751 - RNA, 23 nt, Human
uauuccagaaugcuguacaucua

SEQ ID NO: 2375752 - RNA, 21 nt, Human
uauuccagaaugcuguacauc

SEQ ID NO: 2375753 - RNA, 13 nt, Human
uauuacacuguau

SEQ ID NO: 2375754 - RNA, 17 nt, Human
uauuacacuguauuugu

SEQ ID NO: 2375755 - RNA, 19 nt, Human
uauuacacuguauuuguau

SEQ ID NO: 2375756 - RNA, 14 nt, Human
uauuaauugcuuug

SEQ ID NO: 2375757 - RNA, 13 nt, Human
uauuaauugcuuu

SEQ ID NO: 2375758 - RNA, 21 nt, Human
uauuaauuguuuugcacuuuu

SEQ ID NO: 2375759 - RNA, 19 nt, Human
uauuauuaguuuugauuua

SEQ ID NO: 2375760 - RNA, 16 nt, Human
uauuauucccauucua

SEQ ID NO: 2375761 - RNA, 13 nt, Human
uauuauuacuguu

SEQ ID NO: 2375762 - RNA, 19 nt, Human
uauuauuacuuauuuuuga

SEQ ID NO: 2375763 - RNA, 14 nt, Human
uauuauuacuguuu

SEQ ID NO: 2375764 - RNA, 21 nt, Human
uauuacacuguauuuguaucu

SEQ ID NO: 2375765 - RNA, 19 nt, Human
uauugcuuguuggauuuuu

SEQ ID NO: 2375766 - RNA, 21 nt, Human
uauugcuugcacaaaccaauu

SEQ ID NO: 2375767 - RNA, 22 nt, Human
uauuggaaauuuguuauaauga

SEQ ID NO: 2375768 - RNA, 17 nt, Human
uauugcugauggugcaa

SEQ ID NO: 2375769 - RNA, 15 nt, Human
uauugcugagagaaa

SEQ ID NO: 2375770 - RNA, 16 nt, Human
uauuggaauuaaccug

SEQ ID NO: 2375771 - RNA, 15 nt, Human
uauuggaauuaaccu

SEQ ID NO: 2375772 - RNA, 19 nt, Human
uauugcugagagaaauaug

SEQ ID NO: 2375773 - RNA, 16 nt, Human
uauugcugagagaaau

SEQ ID NO: 2375774 - RNA, 16 nt, Human
uauugcuuuauaaaua

SEQ ID NO: 2375775 - RNA, 23 nt, Human
uauuggaauuaaccuggugcugg

SEQ ID NO: 2375776 - RNA, 21 nt, Human
uauuggaauuaaccuggugcu

SEQ ID NO: 2375777 - RNA, 21 nt, Human
uauuggaggguaaaugaugug

SEQ ID NO: 2375778 - RNA, 16 nt, Human
uauuguguuuguguau

SEQ ID NO: 2375779 - RNA, 21 nt, Human
uauuguguuugucauuagccu

SEQ ID NO: 2375780 - RNA, 17 nt, Human
uauuguguuugucauua

SEQ ID NO: 2375781 - RNA, 18 nt, Human
uauuguguuugucauuag

SEQ ID NO: 2375782 - RNA, 14 nt, Human
uauuguguuuguca

SEQ ID NO: 2375783 - RNA, 16 nt, Human
uauuguguuugucauu

SEQ ID NO: 2375784 - RNA, 12 nt, Human
uauuggccugga

SEQ ID NO: 2375785 - RNA, 21 nt, Human
uauugauaugcuuauacacuu

SEQ ID NO: 2375786 - RNA, 18 nt, Human
uauucucuccaaaaaugc

SEQ ID NO: 2375787 - RNA, 18 nt, Human
uauucucuccuguaccuc

SEQ ID NO: 2375788 - RNA, 19 nt, Human
uauucucacuccaccaccc

SEQ ID NO: 2375789 - RNA, 16 nt, Human
uauucucacuccacca

SEQ ID NO: 2375790 - RNA, 17 nt, Human
uauucucuccuguaccu

SEQ ID NO: 2375791 - RNA, 22 nt, Human
uauugcaaagguuccaacugua

SEQ ID NO: 2375792 - RNA, 20 nt, Human
uauugcaaaauagcauuugu

SEQ ID NO: 2375793 - RNA, 21 nt, Human
uauugcaaagguuccaacugu

SEQ ID NO: 2375794 - RNA, 23 nt, Human
uauugcaaagguuccaacuguau

SEQ ID NO: 2375795 - RNA, 22 nt, Human
uauugauguacagucugucaug

SEQ ID NO: 2375796 - RNA, 20 nt, Human
uauugauguacagucuguca

SEQ ID NO: 2375797 - RNA, 23 nt, Human
uauuguuccaagacauugucaau

SEQ ID NO: 2375798 - RNA, 21 nt, Human
uauuguuccaagacauuguca

SEQ ID NO: 2375799 - RNA, 20 nt, Human
uauuguuccaagacauuguc

SEQ ID NO: 2375800 - RNA, 19 nt, Human
uauuguuccaagacauugu

SEQ ID NO: 2375801 - RNA, 18 nt, Human
uauuguuccaagacauug

SEQ ID NO: 2375802 - RNA, 17 nt, Human
uauuguuccaagacauu

SEQ ID NO: 2375803 - RNA, 13 nt, Human
uauuguuccaaga

SEQ ID NO: 2375804 - RNA, 17 nt, Human
uauuguuaacucuuguc

SEQ ID NO: 2375805 - RNA, 21 nt, Human
uauuguuaacucuugucuauu

SEQ ID NO: 2375806 - RNA, 15 nt, Human
uauuguuacucuggu

SEQ ID NO: 2375807 - RNA, 12 nt, Human
uauuguuuucag

SEQ ID NO: 2375808 - RNA, 17 nt, Human
uauuguuccagcaguuu

SEQ ID NO: 2375809 - RNA, 21 nt, Human
uauuguuucuggucacuauau

SEQ ID NO: 2375810 - RNA, 20 nt, Human
uauuguuucuuuaagaaagu

SEQ ID NO: 2375811 - RNA, 20 nt, Human
uauuguuuucaguguacaug

SEQ ID NO: 2375812 - RNA, 18 nt, Human
uauuguuuucaguguaca

SEQ ID NO: 2375813 - RNA, 22 nt, Human
uauuguuuuuccuuguauuuaa

SEQ ID NO: 2375814 - RNA, 22 nt, Human
uauuguuuucaguguacaugga

SEQ ID NO: 2375815 - RNA, 23 nt, Human
uauuuaaaagaaagccucagaga

SEQ ID NO: 2375816 - RNA, 12 nt, Human
uauuuaaaagau

SEQ ID NO: 2375817 - RNA, 13 nt, Human
uauuuaaaagauu

SEQ ID NO: 2375818 - RNA, 15 nt, Human
uauuuaaaagauuca

SEQ ID NO: 2375819 - RNA, 12 nt, Human
uauuuaaaacuu

SEQ ID NO: 2375820 - RNA, 13 nt, Human
uauuuaaaacuug

SEQ ID NO: 2375821 - RNA, 16 nt, Human
uauuuaaaagauucau

SEQ ID NO: 2375822 - RNA, 16 nt, Human
uauuguuuugguuugc

SEQ ID NO: 2375823 - RNA, 18 nt, Human
uauuuaaaaauauuuuug

SEQ ID NO: 2375824 - RNA, 19 nt, Human
uauuuaaaauuuauugcuu

SEQ ID NO: 2375825 - RNA, 14 nt, Human
uauuuaaacauggu

SEQ ID NO: 2375826 - RNA, 24 nt, Human
uauuuaaacucuguugcaagugca

SEQ ID NO: 2375827 - RNA, 24 nt, Human
uauuuauaaaaauaaaaaacacug

SEQ ID NO: 2375828 - RNA, 20 nt, Human
uauuuaaagaagaaacgucu

SEQ ID NO: 2375829 - RNA, 14 nt, Human
uauuuauaaaacuu

SEQ ID NO: 2375830 - RNA, 20 nt, Human
uauuuaguuauaguuucaga

SEQ ID NO: 2375831 - RNA, 17 nt, Human
uauuuauaaaacuucuc

SEQ ID NO: 2375832 - RNA, 16 nt, Human
uauuuauaaauauauu

SEQ ID NO: 2375833 - RNA, 17 nt, Human
uauuuauaaauauauuu

SEQ ID NO: 2375834 - RNA, 19 nt, Human
uauuuauaaauauauuuaa

SEQ ID NO: 2375835 - RNA, 13 nt, Human
uccacacacagag

SEQ ID NO: 2375836 - RNA, 12 nt, Human
uccacacacaga

SEQ ID NO: 2375837 - RNA, 22 nt, Human
uccacacacagaggaagagcag

SEQ ID NO: 2375838 - RNA, 19 nt, Human
uccacacacagaggaagag

SEQ ID NO: 2375839 - RNA, 15 nt, Human
uccacacacagagga

SEQ ID NO: 2375840 - RNA, 14 nt, Human
uccacacacagagg

SEQ ID NO: 2375841 - RNA, 23 nt, Human
uccacacacagaggaagagcagg

SEQ ID NO: 2375842 - RNA, 20 nt, Human
uccacagaaacauuuucauu

SEQ ID NO: 2375843 - RNA, 18 nt, Human
uccacaaguuaaauaaau

SEQ ID NO: 2375844 - RNA, 17 nt, Human
uccacaaguuaaauaaa

SEQ ID NO: 2375845 - RNA, 16 nt, Human
uccacaagagcccagg

SEQ ID NO: 2375846 - RNA, 17 nt, Human
uccacaagagcccaggc

SEQ ID NO: 2375847 - RNA, 15 nt, Human
uccacaagagcccag

SEQ ID NO: 2375848 - RNA, 18 nt, Human
uccacaagagcccaggcc

SEQ ID NO: 2375849 - RNA, 18 nt, Human
uccaauuuacauacucug

SEQ ID NO: 2375850 - RNA, 17 nt, Human
uccaauuuacauacucu

SEQ ID NO: 2375851 - RNA, 22 nt, Human
uccaauuuguaaaaacagcauu

SEQ ID NO: 2375852 - RNA, 16 nt, Human
uccaauuguugacagu

SEQ ID NO: 2375853 - RNA, 21 nt, Human
uccaauuguugacaguucuga

SEQ ID NO: 2375854 - RNA, 22 nt, Human
uccaauuguugacaguucugaa

SEQ ID NO: 2375855 - RNA, 18 nt, Human
uccaauuuucuggaauac

SEQ ID NO: 2375856 - RNA, 14 nt, Human
uccaauuuucugga

SEQ ID NO: 2375857 - RNA, 18 nt, Human
uccaaaauaaaacuuuuu

SEQ ID NO: 2375858 - RNA, 20 nt, Human
uccaaaauaaaacuuuuuaa

SEQ ID NO: 2375859 - RNA, 21 nt, Human
ucauuucuauuucuccuccau

SEQ ID NO: 2375860 - RNA, 17 nt, Human
ucauuucuauuucuccu

SEQ ID NO: 2375861 - RNA, 15 nt, Human
uccaaaauaauuuua

SEQ ID NO: 2375862 - RNA, 19 nt, Human
uccaaaauaauuuuaagaa

SEQ ID NO: 2375863 - RNA, 22 nt, Human
uccaaaauguuggucauuuuau

SEQ ID NO: 2375864 - RNA, 13 nt, Human
uccaccuggcccc

SEQ ID NO: 2375865 - RNA, 17 nt, Human
uccaccuggccccaugu

SEQ ID NO: 2375866 - RNA, 23 nt, Human
uccaccugggcauauccaccacc

SEQ ID NO: 2375867 - RNA, 13 nt, Human
uccaccugcuccc

SEQ ID NO: 2375868 - RNA, 16 nt, Human
uccaccugcucccagg

SEQ ID NO: 2375869 - RNA, 17 nt, Human
uccaccugcucccaggc

SEQ ID NO: 2375870 - RNA, 18 nt, Human
uccaccugcucccaggcc

SEQ ID NO: 2375871 - RNA, 18 nt, Human
uccaccugccagggacag

SEQ ID NO: 2375872 - RNA, 21 nt, Human
uccaccugccagggacagagg

SEQ ID NO: 2375873 - RNA, 17 nt, Human
uccaccugccagggaca

SEQ ID NO: 2375874 - RNA, 15 nt, Human
uccaccugccaggga

SEQ ID NO: 2375875 - RNA, 16 nt, Human
uccacccucugagcuu

SEQ ID NO: 2375876 - RNA, 12 nt, Human
uccacccucuga

SEQ ID NO: 2375877 - RNA, 14 nt, Human
uccacccucugagc

SEQ ID NO: 2375878 - RNA, 12 nt, Human
uccacccccucc

SEQ ID NO: 2375879 - RNA, 22 nt, Human
uccaccccccagaaccuguccu

SEQ ID NO: 2375880 - RNA, 16 nt, Human
uccacccccagcugcu

SEQ ID NO: 2375881 - RNA, 17 nt, Human
uccacagcaaccccagg

SEQ ID NO: 2375882 - RNA, 21 nt, Human
uccacagagagucccacugcc

SEQ ID NO: 2375883 - RNA, 17 nt, Human
uccacagaugccuccac

SEQ ID NO: 2375884 - RNA, 18 nt, Human
uccacagagagucccacu

SEQ ID NO: 2375885 - RNA, 19 nt, Human
uccacagaagcuccaggua

SEQ ID NO: 2375886 - RNA, 18 nt, Human
uccacccccucccuggcc

SEQ ID NO: 2375887 - RNA, 15 nt, Human
uccacccccucccug

SEQ ID NO: 2375888 - RNA, 13 nt, Human
uccacccccuccc

SEQ ID NO: 2375889 - RNA, 23 nt, Human
uccaccccccagaaccuguccuu

SEQ ID NO: 2375890 - RNA, 20 nt, Human
uccacccccucccuggccug

SEQ ID NO: 2375891 - RNA, 19 nt, Human
uccacccccucccuggccu

SEQ ID NO: 2375892 - RNA, 21 nt, Human
uccacccccucccuggccugu

SEQ ID NO: 2375893 - RNA, 12 nt, Human
uccacccugcuc

SEQ ID NO: 2375894 - RNA, 16 nt, Human
uccacccucccagacc

SEQ ID NO: 2375895 - RNA, 22 nt, Human
uccacccucccagaccugccuc

SEQ ID NO: 2375896 - RNA, 15 nt, Human
uccagguucagcuug

SEQ ID NO: 2375897 - RNA, 16 nt, Human
uccagguucagcuugu

SEQ ID NO: 2375898 - RNA, 11 nt, Human
uccaggguggu

SEQ ID NO: 2375899 - RNA, 13 nt, Human
uccaggugcccag

SEQ ID NO: 2375900 - RNA, 14 nt, Human
uccagguggcauca

SEQ ID NO: 2375901 - RNA, 16 nt, Human
uccagguguuacugua

SEQ ID NO: 2375902 - RNA, 16 nt, Human
uccagguggggugagg

SEQ ID NO: 2375903 - RNA, 21 nt, Human
uccagguggggugaggcagug

SEQ ID NO: 2375904 - RNA, 18 nt, Human
uccaggugcacaagcucc

SEQ ID NO: 2375905 - RNA, 20 nt, Human
uccaggugcacaagcuccaa

SEQ ID NO: 2375906 - RNA, 21 nt, Human
uccaggugcacaagcuccaag

SEQ ID NO: 2375907 - RNA, 22 nt, Human
uccaggugcacaagcuccaagc

SEQ ID NO: 2375908 - RNA, 15 nt, Human
uccaggugcacaagc

SEQ ID NO: 2375909 - RNA, 23 nt, Human
uccaggggugggacacccuguga

SEQ ID NO: 2375910 - RNA, 21 nt, Human
uccagcuuuguucuucuuaaa

SEQ ID NO: 2375911 - RNA, 16 nt, Human
uccagggucccucugu

SEQ ID NO: 2375912 - RNA, 17 nt, Human
uccagggucccucugug

SEQ ID NO: 2375913 - RNA, 18 nt, Human
uccagggucccucugugu

SEQ ID NO: 2375914 - RNA, 22 nt, Human
uccaggagcagccacauuccug

SEQ ID NO: 2375915 - RNA, 23 nt, Human
uccagcuuguggagccccacacu

SEQ ID NO: 2375916 - RNA, 18 nt, Human
uccagcuuguggagcccc

SEQ ID NO: 2375917 - RNA, 19 nt, Human
uccagcuuguggagcccca

SEQ ID NO: 2375918 - RNA, 17 nt, Human
uccaggagcagccacau

SEQ ID NO: 2375919 - RNA, 18 nt, Human
uccaggagcagccacauu

SEQ ID NO: 2375920 - RNA, 13 nt, Human
uccagcuggugag

SEQ ID NO: 2375921 - RNA, 18 nt, Human
uccagcucaccagcccca

SEQ ID NO: 2375922 - RNA, 16 nt, Human
uccagcucaccagccc

SEQ ID NO: 2375923 - RNA, 17 nt, Human
uccagcucaccagcccc

SEQ ID NO: 2375924 - RNA, 19 nt, Human
uccagcuugcucuucagug

SEQ ID NO: 2375925 - RNA, 17 nt, Human
uccagcuugcucuucag

SEQ ID NO: 2375926 - RNA, 16 nt, Human
uccagcuuguggagcc

SEQ ID NO: 2375927 - RNA, 17 nt, Human
uccagcuuguggagccc

SEQ ID NO: 2375928 - RNA, 16 nt, Human
uccagcuugcucuuca

SEQ ID NO: 2375929 - RNA, 15 nt, Human
uccagcuugcucuuc

SEQ ID NO: 2375930 - RNA, 23 nt, Human
uccagcuucugguacucuccuag

SEQ ID NO: 2375931 - RNA, 16 nt, Human
uccaggagcagccaca

SEQ ID NO: 2375932 - RNA, 19 nt, Human
uccagcuucugguacucuc

SEQ ID NO: 2375933 - RNA, 20 nt, Human
uccagcuucugguacucucc

SEQ ID NO: 2375934 - RNA, 21 nt, Human
uccagcuucugguacucuccu

SEQ ID NO: 2375935 - RNA, 17 nt, Human
uccagcuguucagcugg

SEQ ID NO: 2375936 - RNA, 20 nt, Human
uccagccaaccccuguggag

SEQ ID NO: 2375937 - RNA, 16 nt, Human
uccagccaaccccugu

SEQ ID NO: 2375938 - RNA, 14 nt, Human
uccagccaaccccu

SEQ ID NO: 2375939 - RNA, 13 nt, Human
uccagccaacccc

SEQ ID NO: 2375940 - RNA, 23 nt, Human
uccagccaaccccuguggagccc

SEQ ID NO: 2375941 - RNA, 23 nt, Human
uccagccagcaaugauguccaga

SEQ ID NO: 2375942 - RNA, 13 nt, Human
uccagccagggcu

SEQ ID NO: 2375943 - RNA, 14 nt, Human
uccagccagggcug

SEQ ID NO: 2375944 - RNA, 15 nt, Human
uccagccagggcugc

SEQ ID NO: 2375945 - RNA, 17 nt, Human
uccagccagggcugcua

SEQ ID NO: 2375946 - RNA, 20 nt, Human
uccaccugucucagccuccc

SEQ ID NO: 2375947 - RNA, 17 nt, Human
uccaccugucucagccu

SEQ ID NO: 2375948 - RNA, 16 nt, Human
uccaccugucucagcc

SEQ ID NO: 2375949 - RNA, 13 nt, Human
uccaccugucuca

SEQ ID NO: 2375950 - RNA, 15 nt, Human
uccaccuucccaugc

SEQ ID NO: 2375951 - RNA, 16 nt, Human
uccacuuggucuguga

SEQ ID NO: 2375952 - RNA, 15 nt, Human
uccacuuggucugug

SEQ ID NO: 2375953 - RNA, 17 nt, Human
ucauagcugagauuccu

SEQ ID NO: 2375954 - RNA, 12 nt, Human
ucauagcugaga

SEQ ID NO: 2375955 - RNA, 13 nt, Human
ucauagcuaagaa

SEQ ID NO: 2375956 - RNA, 16 nt, Human
ucauagcuaagaaaua

SEQ ID NO: 2375957 - RNA, 20 nt, Human
ucauaggaaaaguacauuua

SEQ ID NO: 2375958 - RNA, 20 nt, Human
ucauaggaagggaccaaggc

SEQ ID NO: 2375959 - RNA, 21 nt, Human
ucauaggaagggaccaaggca

SEQ ID NO: 2375960 - RNA, 19 nt, Human
ucaucaccaacgucugugc

SEQ ID NO: 2375961 - RNA, 20 nt, Human
ucaucaccaacgucugugcc

SEQ ID NO: 2375962 - RNA, 21 nt, Human
ucaucaccaacgucugugcca

SEQ ID NO: 2375963 - RNA, 21 nt, Human
ucauagcauuaacuaaucuau

SEQ ID NO: 2375964 - RNA, 14 nt, Human
ucauagcauuaacu

SEQ ID NO: 2375965 - RNA, 20 nt, Human
ucauacuaucuacucuccuc

SEQ ID NO: 2375966 - RNA, 14 nt, Human
ucauacguccacca

SEQ ID NO: 2375967 - RNA, 15 nt, Human
ucauacguccaccau

SEQ ID NO: 2375968 - RNA, 15 nt, Human
ucauacucaccucac

SEQ ID NO: 2375969 - RNA, 19 nt, Human
ucauagcauuaacuaaucu

SEQ ID NO: 2375970 - RNA, 14 nt, Human
ucauagcccaguag

SEQ ID NO: 2375971 - RNA, 18 nt, Human
ucauagcccagaucagcu

SEQ ID NO: 2375972 - RNA, 21 nt, Human
ucauagcccagaucagcuccu

SEQ ID NO: 2375973 - RNA, 21 nt, Human
ucauagcccucacccuggggc

SEQ ID NO: 2375974 - RNA, 12 nt, Human
ucauagcuaaga

SEQ ID NO: 2375975 - RNA, 22 nt, Human
ucauagcccaguagaccuuguu

SEQ ID NO: 2375976 - RNA, 21 nt, Human
ucaggugagaagcagaggaag

SEQ ID NO: 2375977 - RNA, 23 nt, Human
ucaggugccucaagagaaggcaa

SEQ ID NO: 2375978 - RNA, 13 nt, Human
ucaggugcugcca

SEQ ID NO: 2375979 - RNA, 14 nt, Human
ucaggugcugccau

SEQ ID NO: 2375980 - RNA, 15 nt, Human
ucaggugcugccauc

SEQ ID NO: 2375981 - RNA, 21 nt, Human
ucagggcuccugccuucuguc

SEQ ID NO: 2375982 - RNA, 23 nt, Human
ucagggcuccugccuucuguccu

SEQ ID NO: 2375983 - RNA, 16 nt, Human
ucauaccuacauguau

SEQ ID NO: 2375984 - RNA, 15 nt, Human
ucauaccuacaugua

SEQ ID NO: 2375985 - RNA, 21 nt, Human
ucaggugacaugugaaaccuu

SEQ ID NO: 2375986 - RNA, 22 nt, Human
ucaggugaccaaaauccccuuc

SEQ ID NO: 2375987 - RNA, 18 nt, Human
ucauaccuaucaucuuaa

SEQ ID NO: 2375988 - RNA, 19 nt, Human
ucauagggaagaccugcug

SEQ ID NO: 2375989 - RNA, 14 nt, Human
ucaucacuccccuc

SEQ ID NO: 2375990 - RNA, 15 nt, Human
ucaucacuccccucc

SEQ ID NO: 2375991 - RNA, 16 nt, Human
ucaucacuccccucca

SEQ ID NO: 2375992 - RNA, 15 nt, Human
ucaucacuuuucagu

SEQ ID NO: 2375993 - RNA, 17 nt, Human
ucaucacuuuucaguga

SEQ ID NO: 2375994 - RNA, 15 nt, Human
ucaucacuggaugaa

SEQ ID NO: 2375995 - RNA, 22 nt, Human
ucaucacuggaugaagauucuc

SEQ ID NO: 2375996 - RNA, 14 nt, Human
ucaucagcauaccu

SEQ ID NO: 2375997 - RNA, 18 nt, Human
ucaucagccaccauccua

SEQ ID NO: 2375998 - RNA, 21 nt, Human
ucaucagcauaccuuuauugu

SEQ ID NO: 2375999 - RNA, 16 nt, Human
ucaucagccaccaucc

SEQ ID NO: 2376000 - RNA, 15 nt, Human
ucaucagaagauaac

SEQ ID NO: 2376001 - RNA, 14 nt, Human
ucaucaguauugaa

SEQ ID NO: 2376002 - RNA, 11 nt, Human
ucaucaggaug

SEQ ID NO: 2376003 - RNA, 13 nt, Human
ucaucaggaugaa

SEQ ID NO: 2376004 - RNA, 14 nt, Human
ucaucaggaugaac

SEQ ID NO: 2376005 - RNA, 22 nt, Human
ucaucaggaugaacccaggacg

SEQ ID NO: 2376006 - RNA, 17 nt, Human
ucaucaggggccugcag

SEQ ID NO: 2376007 - RNA, 13 nt, Human
ucaucugccgugc

SEQ ID NO: 2376008 - RNA, 17 nt, Human
ucaucugcucagcagcu

SEQ ID NO: 2376009 - RNA, 13 nt, Human
ucaucuucucugg

SEQ ID NO: 2376010 - RNA, 15 nt, Human
ucaucuucucagcuc

SEQ ID NO: 2376011 - RNA, 18 nt, Human
ucaucuucucagcuccca

SEQ ID NO: 2376012 - RNA, 19 nt, Human
ucaucuugaauuguaagga

SEQ ID NO: 2376013 - RNA, 11 nt, Human
ucaugcugaaa

SEQ ID NO: 2376014 - RNA, 13 nt, Human
ucaugcugaaagc

SEQ ID NO: 2376015 - RNA, 19 nt, Human
ucaucuucucagcucccau

SEQ ID NO: 2376016 - RNA, 16 nt, Human
ucaucuucuucaccau

SEQ ID NO: 2376017 - RNA, 14 nt, Human
ucaugcugaaagcc

SEQ ID NO: 2376018 - RNA, 23 nt, Human
ucaucuuagguuggcaaaaaggc

SEQ ID NO: 2376019 - RNA, 12 nt, Human
ucaucugcucuc

SEQ ID NO: 2376020 - RNA, 14 nt, Human
ucaucugcucuccu

SEQ ID NO: 2376021 - RNA, 15 nt, Human
ucaucugcucuccuu

SEQ ID NO: 2376022 - RNA, 16 nt, Human
ucaucugcucuccuuc

SEQ ID NO: 2376023 - RNA, 19 nt, Human
ucaucuucaccagaggaau

SEQ ID NO: 2376024 - RNA, 17 nt, Human
ucaucugcucuccuucc

SEQ ID NO: 2376025 - RNA, 18 nt, Human
ucaucugcucuccuuccu

SEQ ID NO: 2376026 - RNA, 13 nt, Human
ucaucuucucagc

SEQ ID NO: 2376027 - RNA, 16 nt, Human
ucaucuuacuguaccu

SEQ ID NO: 2376028 - RNA, 14 nt, Human
ucaucuucucagcu

SEQ ID NO: 2376029 - RNA, 12 nt, Human
ucauuucaggau

SEQ ID NO: 2376030 - RNA, 15 nt, Human
ucauuucaggagcag

SEQ ID NO: 2376031 - RNA, 16 nt, Human
ucauuucaggagcagc

SEQ ID NO: 2376032 - RNA, 23 nt, Human
ucauuucaccccucccuuucucc

SEQ ID NO: 2376033 - RNA, 16 nt, Human
ucauuccauucuggaa

SEQ ID NO: 2376034 - RNA, 14 nt, Human
ucauuucaccccuc

SEQ ID NO: 2376035 - RNA, 15 nt, Human
ucauuucaccccucc

SEQ ID NO: 2376036 - RNA, 16 nt, Human
ucauuucaccccuccc

SEQ ID NO: 2376037 - RNA, 21 nt, Human
ucauuucaccccucccuuucu

SEQ ID NO: 2376038 - RNA, 12 nt, Human
ucauugugaaau

SEQ ID NO: 2376039 - RNA, 15 nt, Human
ucauugugaaauuau

SEQ ID NO: 2376040 - RNA, 17 nt, Human
ucauugugaaauuauuc

SEQ ID NO: 2376041 - RNA, 18 nt, Human
ucauugugaaauuauuca

SEQ ID NO: 2376042 - RNA, 22 nt, Human
ucauuuccuauguaacugcauu

SEQ ID NO: 2376043 - RNA, 13 nt, Human
ucauuuccucaaa

SEQ ID NO: 2376044 - RNA, 12 nt, Human
ucauuuccugcc

SEQ ID NO: 2376045 - RNA, 13 nt, Human
ucauuuccugccc

SEQ ID NO: 2376046 - RNA, 14 nt, Human
ucauuuccugcccu

SEQ ID NO: 2376047 - RNA, 15 nt, Human
ucauuuccugcccuu

SEQ ID NO: 2376048 - RNA, 13 nt, Human
ucauuuccugugu

SEQ ID NO: 2376049 - RNA, 16 nt, Human
ucauuuccugugucuu

SEQ ID NO: 2376050 - RNA, 13 nt, Human
ucauuucuauuuc

SEQ ID NO: 2376051 - RNA, 18 nt, Human
ucauuucuacugugacug

SEQ ID NO: 2376052 - RNA, 19 nt, Human
ucauuucuacugugacuga

SEQ ID NO: 2376053 - RNA, 21 nt, Human
ucauuuccuucaaggcaucau

SEQ ID NO: 2376054 - RNA, 23 nt, Human
ucauuuccugcccuuccucaguu

SEQ ID NO: 2376055 - RNA, 15 nt, Human
ucauuucuacuguga

SEQ ID NO: 2376056 - RNA, 16 nt, Human
ucauuucauuccuaac

SEQ ID NO: 2376057 - RNA, 14 nt, Human
ucauuucauuguau

SEQ ID NO: 2376058 - RNA, 13 nt, Human
ucauuuccaagca

SEQ ID NO: 2376059 - RNA, 19 nt, Human
ucauuucauuguaugaugu

SEQ ID NO: 2376060 - RNA, 15 nt, Human
ucauuucauuuccua

SEQ ID NO: 2376061 - RNA, 16 nt, Human
ucauuuccaagcaagu

SEQ ID NO: 2376062 - RNA, 18 nt, Human
ucauuauuggaauuaacc

SEQ ID NO: 2376063 - RNA, 17 nt, Human
ucauuauuggaauuaac

SEQ ID NO: 2376064 - RNA, 14 nt, Human
ucauuauuggaauu

SEQ ID NO: 2376065 - RNA, 18 nt, Human
ucauuauagaucccccag

SEQ ID NO: 2376066 - RNA, 21 nt, Human
ucauuauuggaauuaaccugg

SEQ ID NO: 2376067 - RNA, 19 nt, Human
ucauuauuggaauuaaccu

SEQ ID NO: 2376068 - RNA, 14 nt, Human
ucauuauuggaggg

SEQ ID NO: 2376069 - RNA, 17 nt, Human
ucauuauuuuuccacuu

SEQ ID NO: 2376070 - RNA, 18 nt, Human
ucauucaaaaguugaaau

SEQ ID NO: 2376071 - RNA, 16 nt, Human
ucauucaaaaguugaa

SEQ ID NO: 2376072 - RNA, 22 nt, Human
ucauucaaaaguugaaauuaac

SEQ ID NO: 2376073 - RNA, 22 nt, Human
ucauucaaguguaaaauauuuu

SEQ ID NO: 2376074 - RNA, 21 nt, Human
ucauucaacccaccugcgucu

SEQ ID NO: 2376075 - RNA, 15 nt, Human
ucauuccauucugga

SEQ ID NO: 2376076 - RNA, 14 nt, Human
ucauuccauucugg

SEQ ID NO: 2376077 - RNA, 21 nt, Human
ucauuccaacuucccaguuca

SEQ ID NO: 2376078 - RNA, 14 nt, Human
ucauuccagaggaa

SEQ ID NO: 2376079 - RNA, 16 nt, Human
ucauucaauacaagug

SEQ ID NO: 2376080 - RNA, 13 nt, Human
ucauucaauaaau

SEQ ID NO: 2376081 - RNA, 23 nt, Human
ucauuccaccuucccaugcccug

SEQ ID NO: 2376082 - RNA, 17 nt, Human
ucauuccaacagugagu

SEQ ID NO: 2376083 - RNA, 17 nt, Human
ucauuauagauccccca

SEQ ID NO: 2376084 - RNA, 23 nt, Human
ucauuauaaacgugaugaucagc

SEQ ID NO: 2376085 - RNA, 15 nt, Human
ucauuauaaacguga

SEQ ID NO: 2376086 - RNA, 13 nt, Human
ucauuauaaacgu

SEQ ID NO: 2376087 - RNA, 13 nt, Human
ucauuauguaaaa

SEQ ID NO: 2376088 - RNA, 20 nt, Human
ucauuauguaaaauguuuua

SEQ ID NO: 2376089 - RNA, 20 nt, Human
ucauuaucucaaaacugcac

SEQ ID NO: 2376090 - RNA, 19 nt, Human
ucauuaucucaaaacugca

SEQ ID NO: 2376091 - RNA, 13 nt, Human
ucauuaucucaaa

SEQ ID NO: 2376092 - RNA, 18 nt, Human
ucagaaacacuggggcug

SEQ ID NO: 2376093 - RNA, 22 nt, Human
ucagaaacaucaguuacucuga

SEQ ID NO: 2376094 - RNA, 18 nt, Human
ucagaaacaucaguuacu

SEQ ID NO: 2376095 - RNA, 13 nt, Human
ucagaaaccaguu

SEQ ID NO: 2376096 - RNA, 21 nt, Human
ucagaaacacuggggcuggca

SEQ ID NO: 2376097 - RNA, 18 nt, Human
ucagaaaccaaacaguuu

SEQ ID NO: 2376098 - RNA, 22 nt, Human
ucagaaaccaguuaugugaaug

SEQ ID NO: 2376099 - RNA, 12 nt, Human
ucagaaacuguu

SEQ ID NO: 2376100 - RNA, 18 nt, Human
ucagaaacuugugaagug

SEQ ID NO: 2376101 - RNA, 17 nt, Human
ucagaaacuugugaagu

SEQ ID NO: 2376102 - RNA, 16 nt, Human
ucagaaacuugugaag

SEQ ID NO: 2376103 - RNA, 15 nt, Human
ucagaaacuugugaa

SEQ ID NO: 2376104 - RNA, 10 nt, Human
ucagaaaugu

SEQ ID NO: 2376105 - RNA, 19 nt, Human
ucacuuucacauagauguc

SEQ ID NO: 2376106 - RNA, 19 nt, Human
ucagaaacacccucacacu

SEQ ID NO: 2376107 - RNA, 22 nt, Human
ucagaaacacccucacacuggg

SEQ ID NO: 2376108 - RNA, 21 nt, Human
ucagaaacacccucacacugg

SEQ ID NO: 2376109 - RNA, 18 nt, Human
ucacuuucacauagaugu

SEQ ID NO: 2376110 - RNA, 17 nt, Human
ucacuuucacauagaug

SEQ ID NO: 2376111 - RNA, 22 nt, Human
ucacuuuaauucucaugugauc

SEQ ID NO: 2376112 - RNA, 15 nt, Human
ucacuuuagaugcug

SEQ ID NO: 2376113 - RNA, 16 nt, Human
ucacuuuagaugcuga

SEQ ID NO: 2376114 - RNA, 17 nt, Human
ucacuuuagaugcugau

SEQ ID NO: 2376115 - RNA, 15 nt, Human
ucacuuguuguuuua

SEQ ID NO: 2376116 - RNA, 20 nt, Human
ucacuuguuguuuuacuaaa

SEQ ID NO: 2376117 - RNA, 21 nt, Human
ucacuuguuguuuuacuaaag

SEQ ID NO: 2376118 - RNA, 22 nt, Human
ucacuuguuguuuuacuaaaga

SEQ ID NO: 2376119 - RNA, 14 nt, Human
ucacuuuagaugcu

SEQ ID NO: 2376120 - RNA, 18 nt, Human
ucacuuuaauucucaugu

SEQ ID NO: 2376121 - RNA, 20 nt, Human
ucacuuuaauucucauguga

SEQ ID NO: 2376122 - RNA, 23 nt, Human
ucacuuguuguuuuacuaaagaa

SEQ ID NO: 2376123 - RNA, 23 nt, Human
ucacaccugacucugaaaucuga

SEQ ID NO: 2376124 - RNA, 15 nt, Human
ucacuuuaauucuca

SEQ ID NO: 2376125 - RNA, 16 nt, Human
ucacuuuaauucucau

SEQ ID NO: 2376126 - RNA, 18 nt, Human
ucagaaauguacaacuuu

SEQ ID NO: 2376127 - RNA, 16 nt, Human
ucagaaauuggaacag

SEQ ID NO: 2376128 - RNA, 18 nt, Human
ucagaaauuggaacagaa

SEQ ID NO: 2376129 - RNA, 16 nt, Human
ucagaaaugcugccug

SEQ ID NO: 2376130 - RNA, 17 nt, Human
ucagaaaugcugccugc

SEQ ID NO: 2376131 - RNA, 19 nt, Human
ucagaaaugcugccugccu

SEQ ID NO: 2376132 - RNA, 21 nt, Human
ucagaaaugcugccugccugu

SEQ ID NO: 2376133 - RNA, 15 nt, Human
ucagaaauguguuau

SEQ ID NO: 2376134 - RNA, 23 nt, Human
ucagaaauuuaauucauguuucu

SEQ ID NO: 2376135 - RNA, 21 nt, Human
ucagaaauuggaacagaaugu

SEQ ID NO: 2376136 - RNA, 21 nt, Human
ucagaaauuuaauucauguuu

SEQ ID NO: 2376137 - RNA, 14 nt, Human
ucagaaauuuaauu

SEQ ID NO: 2376138 - RNA, 23 nt, Human
ucagaauucucuaguuugauuaa

SEQ ID NO: 2376139 - RNA, 15 nt, Human
ucagacacccucaac

SEQ ID NO: 2376140 - RNA, 22 nt, Human
ucagacacccucaaccucuucu

SEQ ID NO: 2376141 - RNA, 17 nt, Human
ucagacacccucaaccu

SEQ ID NO: 2376142 - RNA, 23 nt, Human
ucagacacccucaaccucuucug

SEQ ID NO: 2376143 - RNA, 14 nt, Human
ucagacacucuggc

SEQ ID NO: 2376144 - RNA, 15 nt, Human
ucagacacucuggcu

SEQ ID NO: 2376145 - RNA, 18 nt, Human
ucagacagaaccccuaca

SEQ ID NO: 2376146 - RNA, 17 nt, Human
ucagacacucuggcugg

SEQ ID NO: 2376147 - RNA, 18 nt, Human
ucagacacucuggcuggu

SEQ ID NO: 2376148 - RNA, 21 nt, Human
ucagaauugaucauuuucccc

SEQ ID NO: 2376149 - RNA, 16 nt, Human
ucagaauucucuaguu

SEQ ID NO: 2376150 - RNA, 11 nt, Human
ucagacaagca

SEQ ID NO: 2376151 - RNA, 21 nt, Human
ucagaccuuggaucagaugaa

SEQ ID NO: 2376152 - RNA, 17 nt, Human
ucagacgccugaggaac

SEQ ID NO: 2376153 - RNA, 18 nt, Human
ucagacccuaccccacca

SEQ ID NO: 2376154 - RNA, 16 nt, Human
ucagacccuaccccac

SEQ ID NO: 2376155 - RNA, 14 nt, Human
ucagacccuacccc

SEQ ID NO: 2376156 - RNA, 13 nt, Human
ucagacccuaccc

SEQ ID NO: 2376157 - RNA, 13 nt, Human
ucagacccuuuag

SEQ ID NO: 2376158 - RNA, 20 nt, Human
ucagaccuuggaucagauga

SEQ ID NO: 2376159 - RNA, 21 nt, Human
ucagacuggcuggcugcagug

SEQ ID NO: 2376160 - RNA, 20 nt, Human
ucagacuggcuggcugcagu

SEQ ID NO: 2376161 - RNA, 15 nt, Human
ucagacuuaccagga

SEQ ID NO: 2376162 - RNA, 14 nt, Human
ucagacuggcuggc

SEQ ID NO: 2376163 - RNA, 13 nt, Human
ucagacuggcugg

SEQ ID NO: 2376164 - RNA, 23 nt, Human
ucagacugcugggacuggccagg

SEQ ID NO: 2376165 - RNA, 16 nt, Human
ucagacgccugaggaa

SEQ ID NO: 2376166 - RNA, 17 nt, Human
ucagacagagaggacug

SEQ ID NO: 2376167 - RNA, 22 nt, Human
ucagacagagaggacuguaggg

SEQ ID NO: 2376168 - RNA, 13 nt, Human
ucagacagcugcc

SEQ ID NO: 2376169 - RNA, 22 nt, Human
ucagacccccacucucauuccc

SEQ ID NO: 2376170 - RNA, 18 nt, Human
ucagacccccacucucau

SEQ ID NO: 2376171 - RNA, 14 nt, Human
ucagacccccacuc

SEQ ID NO: 2376172 - RNA, 12 nt, Human
ucagacccccac

SEQ ID NO: 2376173 - RNA, 17 nt, Human
ucagaccccagcggcug

SEQ ID NO: 2376174 - RNA, 13 nt, Human
ucagaccccagcg

SEQ ID NO: 2376175 - RNA, 12 nt, Human
ucagaccccagc

SEQ ID NO: 2376176 - RNA, 14 nt, Human
ucagacagcugccu

SEQ ID NO: 2376177 - RNA, 15 nt, Human
ucagaccauaauguu

SEQ ID NO: 2376178 - RNA, 23 nt, Human
ucagaccauaauguuacauuauu

SEQ ID NO: 2376179 - RNA, 23 nt, Human
ucagacuuuaaagaauaauaugc

SEQ ID NO: 2376180 - RNA, 17 nt, Human
ucagacuuuaaagaaua

SEQ ID NO: 2376181 - RNA, 15 nt, Human
ucagacuuuggaaaa

SEQ ID NO: 2376182 - RNA, 13 nt, Human
ucagacuuugcuu

SEQ ID NO: 2376183 - RNA, 16 nt, Human
ucagacuuuaaagaau

SEQ ID NO: 2376184 - RNA, 20 nt, Human
ucagacuuuggaaaaugcau

SEQ ID NO: 2376185 - RNA, 21 nt, Human
ucagacuuuggaaaaugcauu

SEQ ID NO: 2376186 - RNA, 19 nt, Human
ucagacuuuggaaaaugca

SEQ ID NO: 2376187 - RNA, 16 nt, Human
ucagacuuuggaaaau

SEQ ID NO: 2376188 - RNA, 21 nt, Human
ucagaguaauccaagcaaaug

SEQ ID NO: 2376189 - RNA, 22 nt, Human
ucagaguaauccaagcaaaugu

SEQ ID NO: 2376190 - RNA, 12 nt, Human
ucagagaauuuc

SEQ ID NO: 2376191 - RNA, 21 nt, Human
ucagaggggaauaaacuguug

SEQ ID NO: 2376192 - RNA, 18 nt, Human
ucacugcauccuccgccu

SEQ ID NO: 2376193 - RNA, 20 nt, Human
ucacucuuauugcccacgcu

SEQ ID NO: 2376194 - RNA, 19 nt, Human
ucacugcauccuccgccuc

SEQ ID NO: 2376195 - RNA, 13 nt, Human
ucacugcauccuc

SEQ ID NO: 2376196 - RNA, 11 nt, Human
ucacugccagg

SEQ ID NO: 2376197 - RNA, 14 nt, Human
ucacugccaggcca

SEQ ID NO: 2376198 - RNA, 21 nt, Human
ucacugccucucccuggcccu

SEQ ID NO: 2376199 - RNA, 14 nt, Human
ucacugccugcaga

SEQ ID NO: 2376200 - RNA, 19 nt, Human
ucacugccucucccuggcc

SEQ ID NO: 2376201 - RNA, 12 nt, Human
ucacugccucuc

SEQ ID NO: 2376202 - RNA, 11 nt, Human
ucacugccucu

SEQ ID NO: 2376203 - RNA, 19 nt, Human
ucacugcuaagaauauuug

SEQ ID NO: 2376204 - RNA, 15 nt, Human
ucacugccugcagag

SEQ ID NO: 2376205 - RNA, 22 nt, Human
ucacugccugcagaggucugug

SEQ ID NO: 2376206 - RNA, 14 nt, Human
ucacugccuuugcu

SEQ ID NO: 2376207 - RNA, 18 nt, Human
ucacugccaugccagcuu

SEQ ID NO: 2376208 - RNA, 13 nt, Human
ucacugccauaua

SEQ ID NO: 2376209 - RNA, 20 nt, Human
ucacugccaggccagccucc

SEQ ID NO: 2376210 - RNA, 23 nt, Human
ucacugccaggccagccuccgag

SEQ ID NO: 2376211 - RNA, 15 nt, Human
ucacugccaggccag

SEQ ID NO: 2376212 - RNA, 16 nt, Human
ucacugccaggccagc

SEQ ID NO: 2376213 - RNA, 18 nt, Human
ucacugccaggccagccu

SEQ ID NO: 2376214 - RNA, 19 nt, Human
ucacugccaggccagccuc

SEQ ID NO: 2376215 - RNA, 12 nt, Human
ucaccccuccac

SEQ ID NO: 2376216 - RNA, 17 nt, Human
ucaccccuccacccuug

SEQ ID NO: 2376217 - RNA, 13 nt, Human
ucaccccuccagg

SEQ ID NO: 2376218 - RNA, 14 nt, Human
ucaccccuccagga

SEQ ID NO: 2376219 - RNA, 14 nt, Human
ucaccccgucuggg

SEQ ID NO: 2376220 - RNA, 22 nt, Human
ucaccccggccaccugcggugc

SEQ ID NO: 2376221 - RNA, 13 nt, Human
ucaccagccccag

SEQ ID NO: 2376222 - RNA, 16 nt, Human
ucaccagccccagugc

SEQ ID NO: 2376223 - RNA, 17 nt, Human
ucaccccugcccuggga

SEQ ID NO: 2376224 - RNA, 16 nt, Human
ucaccccugcccuggg

SEQ ID NO: 2376225 - RNA, 14 nt, Human
ucaccccugcccug

SEQ ID NO: 2376226 - RNA, 13 nt, Human
ucaccccugcccu

SEQ ID NO: 2376227 - RNA, 15 nt, Human
ucaccccugguucuc

SEQ ID NO: 2376228 - RNA, 18 nt, Human
ucaccccugguucucauc

SEQ ID NO: 2376229 - RNA, 14 nt, Human
ucaccccucccuuu

SEQ ID NO: 2376230 - RNA, 17 nt, Human
ucaccccucccuuucuc

SEQ ID NO: 2376231 - RNA, 18 nt, Human
ucaccccucccuuucucc

SEQ ID NO: 2376232 - RNA, 20 nt, Human
ucaccccucccuuucucccc

SEQ ID NO: 2376233 - RNA, 17 nt, Human
ucacucuuauugcccac

SEQ ID NO: 2376234 - RNA, 19 nt, Human
ucaccccugguucucaucu

SEQ ID NO: 2376235 - RNA, 20 nt, Human
ucacuggguggggugaggac

SEQ ID NO: 2376236 - RNA, 11 nt, Human
ucacugggugg

SEQ ID NO: 2376237 - RNA, 21 nt, Human
ucacugggguccuggggccuc

SEQ ID NO: 2376238 - RNA, 20 nt, Human
ucacugggguccuggggccu

SEQ ID NO: 2376239 - RNA, 19 nt, Human
ucacugggguccuggggcc

SEQ ID NO: 2376240 - RNA, 17 nt, Human
ucacugggguccugggg

SEQ ID NO: 2376241 - RNA, 16 nt, Human
ucacugggguccuggg

SEQ ID NO: 2376242 - RNA, 18 nt, Human
ucacuggguggggugagg

SEQ ID NO: 2376243 - RNA, 23 nt, Human
ucacuguaagacucauucccuag

SEQ ID NO: 2376244 - RNA, 20 nt, Human
ucacugguagaccaaaauaa

SEQ ID NO: 2376245 - RNA, 19 nt, Human
ucacugguagaccaaaaua

SEQ ID NO: 2376246 - RNA, 18 nt, Human
ucacugguagaccaaaau

SEQ ID NO: 2376247 - RNA, 20 nt, Human
ucacuguagaaugauuucau

SEQ ID NO: 2376248 - RNA, 19 nt, Human
ucacuugugccaacacuca

SEQ ID NO: 2376249 - RNA, 12 nt, Human
ucacuugugggg

SEQ ID NO: 2376250 - RNA, 21 nt, Human
ucacuugugccaacacucaag

SEQ ID NO: 2376251 - RNA, 13 nt, Human
ucacuggagccca

SEQ ID NO: 2376252 - RNA, 12 nt, Human
ucacuggagccc

SEQ ID NO: 2376253 - RNA, 11 nt, Human
ucacuggagcc

SEQ ID NO: 2376254 - RNA, 22 nt, Human
ucacuggagcaccaggcacgaa

SEQ ID NO: 2376255 - RNA, 18 nt, Human
ucacuggagcaccaggca

SEQ ID NO: 2376256 - RNA, 15 nt, Human
ucacuggagcccagg

SEQ ID NO: 2376257 - RNA, 14 nt, Human
ucacuggagcccag

SEQ ID NO: 2376258 - RNA, 21 nt, Human
ucacuggcugccuccacuccc

SEQ ID NO: 2376259 - RNA, 17 nt, Human
ucacuggggccuacagc

SEQ ID NO: 2376260 - RNA, 17 nt, Human
ucacuggagcaccaggc

SEQ ID NO: 2376261 - RNA, 18 nt, Human
ucacuggaccacugggca

SEQ ID NO: 2376262 - RNA, 15 nt, Human
ucacuggaaagggga

SEQ ID NO: 2376263 - RNA, 17 nt, Human
ucacuggaaaggggaga

SEQ ID NO: 2376264 - RNA, 18 nt, Human
ucacuggaaaggggagag

SEQ ID NO: 2376265 - RNA, 21 nt, Human
ucacuggaaaggggagagccu

SEQ ID NO: 2376266 - RNA, 23 nt, Human
ucacuggaaaggggagagccugc

SEQ ID NO: 2376267 - RNA, 14 nt, Human
ucacuggaacucag

SEQ ID NO: 2376268 - RNA, 17 nt, Human
ucacugcuggcugccuu

SEQ ID NO: 2376269 - RNA, 18 nt, Human
ucacugcuggcugccuua

SEQ ID NO: 2376270 - RNA, 22 nt, Human
ucacugcuggcugccuuagaac

SEQ ID NO: 2376271 - RNA, 10 nt, Human
ucacugcugu

SEQ ID NO: 2376272 - RNA, 11 nt, Human
ucacugcuguc

SEQ ID NO: 2376273 - RNA, 12 nt, Human
ucacugcuguca

SEQ ID NO: 2376274 - RNA, 13 nt, Human
ucacugcugucau

SEQ ID NO: 2376275 - RNA, 14 nt, Human
ucacugcuuaacuu

SEQ ID NO: 2376276 - RNA, 15 nt, Human
ucacugcugucauca

SEQ ID NO: 2376277 - RNA, 16 nt, Human
ucacugcugucaucaa

SEQ ID NO: 2376278 - RNA, 13 nt, Human
ucacugcuggcug

SEQ ID NO: 2376279 - RNA, 14 nt, Human
ucacugcuggcugc

SEQ ID NO: 2376280 - RNA, 15 nt, Human
ucacugcuggcugcc

SEQ ID NO: 2376281 - RNA, 16 nt, Human
ucacugcuggcugccu

SEQ ID NO: 2376282 - RNA, 14 nt, Human
ucacugcucccuga

SEQ ID NO: 2376283 - RNA, 18 nt, Human
ucacugcucccugaagcc

SEQ ID NO: 2376284 - RNA, 19 nt, Human
ucacugcucccugaagcca

SEQ ID NO: 2376285 - RNA, 20 nt, Human
ucacugcucccugaagccag

SEQ ID NO: 2376286 - RNA, 21 nt, Human
ucacugcucccugaagccagc

SEQ ID NO: 2376287 - RNA, 23 nt, Human
ucacugcucccugaagccagccu

SEQ ID NO: 2376288 - RNA, 24 nt, Human
ucacugcucccugaagccagccuu

SEQ ID NO: 2376289 - RNA, 12 nt, Human
ucacugcuggcu

SEQ ID NO: 2376290 - RNA, 12 nt, Human
ucacugcugcaa

SEQ ID NO: 2376291 - RNA, 17 nt, Human
ucacugcugcaaggccu

SEQ ID NO: 2376292 - RNA, 18 nt, Human
ucacugcugcaaggccuu

SEQ ID NO: 2376293 - RNA, 22 nt, Human
ucacugcugcaaggccuuucug

SEQ ID NO: 2376294 - RNA, 23 nt, Human
ucagggaaaagcagcucuccccu

SEQ ID NO: 2376295 - RNA, 19 nt, Human
ucagggaaaagcagcucuc

SEQ ID NO: 2376296 - RNA, 18 nt, Human
ucagggaaaagcagcucu

SEQ ID NO: 2376297 - RNA, 16 nt, Human
ucagggaaaagcagcu

SEQ ID NO: 2376298 - RNA, 18 nt, Human
ucaggcuugaaaugcauu

SEQ ID NO: 2376299 - RNA, 21 nt, Human
ucaggcuuucacuauuuccuu

SEQ ID NO: 2376300 - RNA, 20 nt, Human
ucaggcuuucacuauuuccu

SEQ ID NO: 2376301 - RNA, 16 nt, Human
ucaggcuugaaaugca

SEQ ID NO: 2376302 - RNA, 21 nt, Human
ucagggagugggcuaagcacg

SEQ ID NO: 2376303 - RNA, 15 nt, Human
ucagggaggucauuu

SEQ ID NO: 2376304 - RNA, 16 nt, Human
ucagggaaaggccagu

SEQ ID NO: 2376305 - RNA, 22 nt, Human
ucagggaaccguuauuauaauu

SEQ ID NO: 2376306 - RNA, 16 nt, Human
ucagggcagggcucug

SEQ ID NO: 2376307 - RNA, 19 nt, Human
ucagggcagcgccaggcug

SEQ ID NO: 2376308 - RNA, 15 nt, Human
ucagggcagcgccag

SEQ ID NO: 2376309 - RNA, 14 nt, Human
ucagggccaugccu

SEQ ID NO: 2376310 - RNA, 13 nt, Human
ucagggccaugcu

SEQ ID NO: 2376311 - RNA, 14 nt, Human
ucagggccaugcug

SEQ ID NO: 2376312 - RNA, 17 nt, Human
ucagggccaugcugagg

SEQ ID NO: 2376313 - RNA, 23 nt, Human
ucagggauagcacugagcaaagc

SEQ ID NO: 2376314 - RNA, 20 nt, Human
ucagggauuuuuuuuuuaaa

SEQ ID NO: 2376315 - RNA, 15 nt, Human
ucagggaucuugcau

SEQ ID NO: 2376316 - RNA, 21 nt, Human
ucagggauggccguuggccac

SEQ ID NO: 2376317 - RNA, 22 nt, Human
ucagggcacugcugcugccuuu

SEQ ID NO: 2376318 - RNA, 23 nt, Human
ucagggccccagcacuaaagcag

SEQ ID NO: 2376319 - RNA, 16 nt, Human
ucagggccccagcacu

SEQ ID NO: 2376320 - RNA, 14 nt, Human
ucagggccccagca

SEQ ID NO: 2376321 - RNA, 23 nt, Human
ucagggcgcacagcaugagaggc

SEQ ID NO: 2376322 - RNA, 23 nt, Human
ucagggcuaaacgggcauugccu

SEQ ID NO: 2376323 - RNA, 13 nt, Human
ucagggcuccugc

SEQ ID NO: 2376324 - RNA, 14 nt, Human
ucagggcuccugcc

SEQ ID NO: 2376325 - RNA, 15 nt, Human
ucagggcuccugccu

SEQ ID NO: 2376326 - RNA, 20 nt, Human
ucagggcuccugccuucugu

SEQ ID NO: 2376327 - RNA, 16 nt, Human
ucaggugagaagcaga

SEQ ID NO: 2376328 - RNA, 15 nt, Human
ucaggugagaagcag

SEQ ID NO: 2376329 - RNA, 14 nt, Human
ucagggccuggcuc

SEQ ID NO: 2376330 - RNA, 16 nt, Human
ucagggccuggcucag

SEQ ID NO: 2376331 - RNA, 18 nt, Human
ucagggccaugcugaggc

SEQ ID NO: 2376332 - RNA, 19 nt, Human
ucagggccaugcugaggcc

SEQ ID NO: 2376333 - RNA, 21 nt, Human
ucagggccaugcugaggccug

SEQ ID NO: 2376334 - RNA, 23 nt, Human
ucagggccaugcugaggccuggg

SEQ ID NO: 2376335 - RNA, 17 nt, Human
ucagggccaugccugcc

SEQ ID NO: 2376336 - RNA, 14 nt, Human
ucagggcccaaguc

SEQ ID NO: 2376337 - RNA, 15 nt, Human
ucagggcccaagucc

SEQ ID NO: 2376338 - RNA, 18 nt, Human
ucagggcccaagucccug

SEQ ID NO: 2376339 - RNA, 19 nt, Human
ucagggcccaagucccugu

SEQ ID NO: 2376340 - RNA, 16 nt, Human
ucaggaugcccagggc

SEQ ID NO: 2376341 - RNA, 15 nt, Human
ucaggaugcccaggg

SEQ ID NO: 2376342 - RNA, 14 nt, Human
ucaggaugcccagg

SEQ ID NO: 2376343 - RNA, 13 nt, Human
ucaggaugcccag

SEQ ID NO: 2376344 - RNA, 17 nt, Human
ucaggauucuguuccuu

SEQ ID NO: 2376345 - RNA, 22 nt, Human
ucaggaugcccagggccacucu

SEQ ID NO: 2376346 - RNA, 20 nt, Human
ucaggaugauacacuaugaa

SEQ ID NO: 2376347 - RNA, 20 nt, Human
ucaggagcccugggaggcuc

SEQ ID NO: 2376348 - RNA, 23 nt, Human
ucaggagcccugggaggcucugg

SEQ ID NO: 2376349 - RNA, 16 nt, Human
ucagcugccccacagg

SEQ ID NO: 2376350 - RNA, 22 nt, Human
ucagcucccccuguccccucag

SEQ ID NO: 2376351 - RNA, 23 nt, Human
ucagcucccccuguccccucagc

SEQ ID NO: 2376352 - RNA, 19 nt, Human
ucaggagcccugggaggcu

SEQ ID NO: 2376353 - RNA, 18 nt, Human
ucaggagcccugggaggc

SEQ ID NO: 2376354 - RNA, 23 nt, Human
ucaggcuuccuuggcaucacagg

SEQ ID NO: 2376355 - RNA, 15 nt, Human
ucaggcuuccuuggc

SEQ ID NO: 2376356 - RNA, 14 nt, Human
ucaggcuuccuugg

SEQ ID NO: 2376357 - RNA, 16 nt, Human
ucaggcuggugggagg

SEQ ID NO: 2376358 - RNA, 17 nt, Human
ucaggcuggugggaggg

SEQ ID NO: 2376359 - RNA, 15 nt, Human
ucaggcugcuuggga

SEQ ID NO: 2376360 - RNA, 22 nt, Human
ucaggcugcuggcgccucugca

SEQ ID NO: 2376361 - RNA, 14 nt, Human
ucaggcugguggga

SEQ ID NO: 2376362 - RNA, 19 nt, Human
ucaggcucugcccugcccu

SEQ ID NO: 2376363 - RNA, 14 nt, Human
ucaggcucugcccu

SEQ ID NO: 2376364 - RNA, 15 nt, Human
ucaggcucugccuca

SEQ ID NO: 2376365 - RNA, 13 nt, Human
ucaggcucugccc

SEQ ID NO: 2376366 - RNA, 16 nt, Human
ucaggcuccauuagga

SEQ ID NO: 2376367 - RNA, 20 nt, Human
ucaggcuccauuaggauuug

SEQ ID NO: 2376368 - RNA, 15 nt, Human
ucaggcacuagccuu

SEQ ID NO: 2376369 - RNA, 16 nt, Human
ucaggcacuagccuuu

SEQ ID NO: 2376370 - RNA, 21 nt, Human
ucaggcacuagccuuuggcuc

SEQ ID NO: 2376371 - RNA, 22 nt, Human
ucaggcacuagccuuuggcucu

SEQ ID NO: 2376372 - RNA, 11 nt, Human
ucaggcuccau

SEQ ID NO: 2376373 - RNA, 15 nt, Human
ucaggcuccauuagg

SEQ ID NO: 2376374 - RNA, 17 nt, Human
ucaggcaaggucuggcc

SEQ ID NO: 2376375 - RNA, 18 nt, Human
ucaggcaaggucuggccu

SEQ ID NO: 2376376 - RNA, 13 nt, Human
ucaggcuagaugu

SEQ ID NO: 2376377 - RNA, 17 nt, Human
ucaggcuagauguaugu

SEQ ID NO: 2376378 - RNA, 20 nt, Human
ucagccuccugaguagcugg

SEQ ID NO: 2376379 - RNA, 20 nt, Human
ucagccuccggaguagcugg

SEQ ID NO: 2376380 - RNA, 21 nt, Human
ucagccucccgaguagcugag

SEQ ID NO: 2376381 - RNA, 13 nt, Human
ucagccuccucau

SEQ ID NO: 2376382 - RNA, 21 nt, Human
ucagccucccgaguagcuggg

SEQ ID NO: 2376383 - RNA, 22 nt, Human
ucagccucccgaguagcuggga

SEQ ID NO: 2376384 - RNA, 13 nt, Human
ucagccuccugag

SEQ ID NO: 2376385 - RNA, 21 nt, Human
ucagccuccugaguagcugga

SEQ ID NO: 2376386 - RNA, 16 nt, Human
ucagccuccuguguag

SEQ ID NO: 2376387 - RNA, 14 nt, Human
ucagccuccugugu

SEQ ID NO: 2376388 - RNA, 13 nt, Human
ucagccuccugug

SEQ ID NO: 2376389 - RNA, 19 nt, Human
ucagccuccucaucugggg

SEQ ID NO: 2376390 - RNA, 22 nt, Human
ucagccuccugaguagcuggga

SEQ ID NO: 2376391 - RNA, 19 nt, Human
ucagccugcuccagcuguu

SEQ ID NO: 2376392 - RNA, 18 nt, Human
ucagccugcuccagcugu

SEQ ID NO: 2376393 - RNA, 20 nt, Human
ucagccuccuguguagcugg

SEQ ID NO: 2376394 - RNA, 14 nt, Human
ucagccuggccaga

SEQ ID NO: 2376395 - RNA, 12 nt, Human
ucagccuggcca

SEQ ID NO: 2376396 - RNA, 18 nt, Human
ucagccuggccagacaca

SEQ ID NO: 2376397 - RNA, 17 nt, Human
ucagccuggccagacac

SEQ ID NO: 2376398 - RNA, 16 nt, Human
ucagccuggccagaca

SEQ ID NO: 2376399 - RNA, 15 nt, Human
ucagccuggccagac

SEQ ID NO: 2376400 - RNA, 17 nt, Human
ucagcuccccucggaga

SEQ ID NO: 2376401 - RNA, 15 nt, Human
ucagcucccauuucu

SEQ ID NO: 2376402 - RNA, 16 nt, Human
ucagcucccauuucua

SEQ ID NO: 2376403 - RNA, 19 nt, Human
ucagcucccauuucuacuc

SEQ ID NO: 2376404 - RNA, 20 nt, Human
ucagcucccauuucuacucu

SEQ ID NO: 2376405 - RNA, 13 nt, Human
ucagcuccccaga

SEQ ID NO: 2376406 - RNA, 15 nt, Human
ucagcuccccagagu

SEQ ID NO: 2376407 - RNA, 17 nt, Human
ucagcuccccagagucc

SEQ ID NO: 2376408 - RNA, 16 nt, Human
ucagcugaaccugggu

SEQ ID NO: 2376409 - RNA, 15 nt, Human
ucagcugaaccuggg

SEQ ID NO: 2376410 - RNA, 18 nt, Human
ucagcuccccucggagaa

SEQ ID NO: 2376411 - RNA, 19 nt, Human
ucagcucuuggcuccacug

SEQ ID NO: 2376412 - RNA, 13 nt, Human
ucagcucccccug

SEQ ID NO: 2376413 - RNA, 15 nt, Human
ucagcucccccuguc

SEQ ID NO: 2376414 - RNA, 18 nt, Human
ucagcucccccugucccc

SEQ ID NO: 2376415 - RNA, 20 nt, Human
ucagcucccccuguccccuc

SEQ ID NO: 2376416 - RNA, 18 nt, Human
ucagauauaaaagacuga

SEQ ID NO: 2376417 - RNA, 20 nt, Human
ucagauauaaaagacugacc

SEQ ID NO: 2376418 - RNA, 16 nt, Human
ucagauauauuuuuca

SEQ ID NO: 2376419 - RNA, 18 nt, Human
ucagauauauaucauauu

SEQ ID NO: 2376420 - RNA, 15 nt, Human
ucagaguauggagcu

SEQ ID NO: 2376421 - RNA, 23 nt, Human
ucagauauauuuuucacaguuuu

SEQ ID NO: 2376422 - RNA, 18 nt, Human
ucagauauauuuuucaca

SEQ ID NO: 2376423 - RNA, 14 nt, Human
ucagauauaaaaga

SEQ ID NO: 2376424 - RNA, 17 nt, Human
ucagauauaaaagacug

SEQ ID NO: 2376425 - RNA, 18 nt, Human
ucagagguagggcugcca

SEQ ID NO: 2376426 - RNA, 23 nt, Human
ucagaggugaaagcuauaucaau

SEQ ID NO: 2376427 - RNA, 12 nt, Human
ucagcaugucua

SEQ ID NO: 2376428 - RNA, 17 nt, Human
ucagcauucucacuccu

SEQ ID NO: 2376429 - RNA, 20 nt, Human
ucagcauucucacuccuacc

SEQ ID NO: 2376430 - RNA, 21 nt, Human
ucagcaugucuauucagcuuc

SEQ ID NO: 2376431 - RNA, 19 nt, Human
ucagcaugucuauucagcu

SEQ ID NO: 2376432 - RNA, 16 nt, Human
ucagcaugucuauuca

SEQ ID NO: 2376433 - RNA, 20 nt, Human
ucagccucccgaguagcugg

SEQ ID NO: 2376434 - RNA, 18 nt, Human
ucagccucccgaguagcu

SEQ ID NO: 2376435 - RNA, 21 nt, Human
ucagccucccgaauagcuggg

SEQ ID NO: 2376436 - RNA, 22 nt, Human
ucagccucccgaauagcuggga

SEQ ID NO: 2376437 - RNA, 14 nt, Human
ucagccucccaaag

SEQ ID NO: 2376438 - RNA, 23 nt, Human
ucagcauucucacuccuaccugg

SEQ ID NO: 2376439 - RNA, 19 nt, Human
ucagccucccaaagugcug

SEQ ID NO: 2376440 - RNA, 21 nt, Human
ucagccucccaaagugcuggg

SEQ ID NO: 2376441 - RNA, 11 nt, Human
gggagccuccu

SEQ ID NO: 2376442 - RNA, 12 nt, Human
gggagccuccug

SEQ ID NO: 2376443 - RNA, 13 nt, Human
gggagccuccugc

SEQ ID NO: 2376444 - RNA, 14 nt, Human
gggagccuccugcc

SEQ ID NO: 2376445 - RNA, 17 nt, Human
gggagccuccugcccag

SEQ ID NO: 2376446 - RNA, 21 nt, Human
gggagccugaucaccugcccu

SEQ ID NO: 2376447 - RNA, 21 nt, Human
gggagccuuugguucuggcca

SEQ ID NO: 2376448 - RNA, 21 nt, Human
gggagccuccugcccaguccc

SEQ ID NO: 2376449 - RNA, 12 nt, Human
gggagcccccgc

SEQ ID NO: 2376450 - RNA, 22 nt, Human
gggagcccccgccccgccccac

SEQ ID NO: 2376451 - RNA, 16 nt, Human
gggagcccccgccccg

SEQ ID NO: 2376452 - RNA, 19 nt, Human
gggagccccuucugcucag

SEQ ID NO: 2376453 - RNA, 23 nt, Human
gggagcccucaggcaccugcacu

SEQ ID NO: 2376454 - RNA, 16 nt, Human
gggagccgcuggcaga

SEQ ID NO: 2376455 - RNA, 19 nt, Human
gggagcuccacucugcuuc

SEQ ID NO: 2376456 - RNA, 12 nt, Human
gggagcucugca

SEQ ID NO: 2376457 - RNA, 23 nt, Human
gggagcuccacucugcuucucug

SEQ ID NO: 2376458 - RNA, 18 nt, Human
gggagcuccucuccugga

SEQ ID NO: 2376459 - RNA, 17 nt, Human
gggagcgugggaggcgg

SEQ ID NO: 2376460 - RNA, 22 nt, Human
gggagccuuugguucuggccag

SEQ ID NO: 2376461 - RNA, 12 nt, Human
gggagcugaggc

SEQ ID NO: 2376462 - RNA, 22 nt, Human
gggagcuccucuccuggaggau

SEQ ID NO: 2376463 - RNA, 20 nt, Human
gggagcuccucuccuggagg

SEQ ID NO: 2376464 - RNA, 21 nt, Human
gggagcuccucuccuggagga

SEQ ID NO: 2376465 - RNA, 13 nt, Human
gggagcugccugu

SEQ ID NO: 2376466 - RNA, 21 nt, Human
gggagcugccuguucagcucc

SEQ ID NO: 2376467 - RNA, 22 nt, Human
gggagcugccuguucagcucca

SEQ ID NO: 2376468 - RNA, 19 nt, Human
gggaggaaucgaggaacca

SEQ ID NO: 2376469 - RNA, 23 nt, Human
gggaggaagcagguugaggggcu

SEQ ID NO: 2376470 - RNA, 12 nt, Human
gggaggaagcag

SEQ ID NO: 2376471 - RNA, 13 nt, Human
gggaggaagcaga

SEQ ID NO: 2376472 - RNA, 14 nt, Human
gggaggaagcagaa

SEQ ID NO: 2376473 - RNA, 15 nt, Human
gggaggaagcagaau

SEQ ID NO: 2376474 - RNA, 16 nt, Human
gggaggaagcagaaua

SEQ ID NO: 2376475 - RNA, 18 nt, Human
gggaggaagcagaauaaa

SEQ ID NO: 2376476 - RNA, 20 nt, Human
gggaggaagcagaauaaagc

SEQ ID NO: 2376477 - RNA, 21 nt, Human
gggaggaagcagaauaaagca

SEQ ID NO: 2376478 - RNA, 24 nt, Human
gggaggaaauuugaauggguccau

SEQ ID NO: 2376479 - RNA, 23 nt, Human
gggaggaagaagcuuaggcaggg

SEQ ID NO: 2376480 - RNA, 16 nt, Human
gggaggaaaagaaaag

SEQ ID NO: 2376481 - RNA, 19 nt, Human
gggagcugguuagaaaugc

SEQ ID NO: 2376482 - RNA, 15 nt, Human
gggagcugcugcccu

SEQ ID NO: 2376483 - RNA, 23 nt, Human
gggaggaucacuggagcccagga

SEQ ID NO: 2376484 - RNA, 18 nt, Human
gggaggagggagagggag

SEQ ID NO: 2376485 - RNA, 18 nt, Human
gggaggcaagaggggugg

SEQ ID NO: 2376486 - RNA, 22 nt, Human
gggaggaucacuggagcccagg

SEQ ID NO: 2376487 - RNA, 19 nt, Human
gggaggaucacuggagccc

SEQ ID NO: 2376488 - RNA, 23 nt, Human
gggaggauugcuugagcucagga

SEQ ID NO: 2376489 - RNA, 20 nt, Human
gggagguguuuaaagagagg

SEQ ID NO: 2376490 - RNA, 22 nt, Human
gggagguguuuaaagagagguu

SEQ ID NO: 2376491 - RNA, 20 nt, Human
gggaggugggauccuccagg

SEQ ID NO: 2376492 - RNA, 23 nt, Human
gggagucugaagcagaugcaaag

SEQ ID NO: 2376493 - RNA, 17 nt, Human
gggagucugaagcagau

SEQ ID NO: 2376494 - RNA, 15 nt, Human
gggagucccgucagg

SEQ ID NO: 2376495 - RNA, 17 nt, Human
gggaguccccuuuucuu

SEQ ID NO: 2376496 - RNA, 21 nt, Human
gggagugaguugauagcacag

SEQ ID NO: 2376497 - RNA, 21 nt, Human
gggagucaucucaaccauccc

SEQ ID NO: 2376498 - RNA, 21 nt, Human
gggaguaugcaaaaguucuga

SEQ ID NO: 2376499 - RNA, 16 nt, Human
gggaguccccuccccg

SEQ ID NO: 2376500 - RNA, 16 nt, Human
gggaguaugcaaaagu

SEQ ID NO: 2376501 - RNA, 18 nt, Human
gggagguugaucagaucu

SEQ ID NO: 2376502 - RNA, 17 nt, Human
gggagugacagaggcag

SEQ ID NO: 2376503 - RNA, 17 nt, Human
gggaggaucacuggagc

SEQ ID NO: 2376504 - RNA, 20 nt, Human
gggaggagguggcagcccug

SEQ ID NO: 2376505 - RNA, 23 nt, Human
gggaggaucucuugagccuggga

SEQ ID NO: 2376506 - RNA, 21 nt, Human
gggaggauugcuugagcucag

SEQ ID NO: 2376507 - RNA, 22 nt, Human
gggaggauguucugggacacag

SEQ ID NO: 2376508 - RNA, 23 nt, Human
gggaggaagcagaauaaagcaau

SEQ ID NO: 2376509 - RNA, 21 nt, Human
gggaggaccagggcagggcca

SEQ ID NO: 2376510 - RNA, 17 nt, Human
gggaggaggccaccucu

SEQ ID NO: 2376511 - RNA, 14 nt, Human
gggaggagaaugag

SEQ ID NO: 2376512 - RNA, 21 nt, Human
gggaggagaggggaagggcca

SEQ ID NO: 2376513 - RNA, 13 nt, Human
gggaggagggaga

SEQ ID NO: 2376514 - RNA, 14 nt, Human
gggaggagggagag

SEQ ID NO: 2376515 - RNA, 17 nt, Human
gggaggagggagaggga

SEQ ID NO: 2376516 - RNA, 20 nt, Human
gggaggacgcucucuggccu

SEQ ID NO: 2376517 - RNA, 17 nt, Human
gggaggacgcucucugg

SEQ ID NO: 2376518 - RNA, 20 nt, Human
ggcuuuuacugaagccuuuc

SEQ ID NO: 2376519 - RNA, 19 nt, Human
ggcuuuuauuaaugcacuu

SEQ ID NO: 2376520 - RNA, 18 nt, Human
ggcuuuuacugaagccuu

SEQ ID NO: 2376521 - RNA, 23 nt, Human
gggaagugaagacuggaagcuaa

SEQ ID NO: 2376522 - RNA, 20 nt, Human
ggcuuuuauuaaugcacuuu

SEQ ID NO: 2376523 - RNA, 14 nt, Human
ggcuuugccagcuu

SEQ ID NO: 2376524 - RNA, 13 nt, Human
ggcuuuggcuucu

SEQ ID NO: 2376525 - RNA, 12 nt, Human
ggcuuuggauuu

SEQ ID NO: 2376526 - RNA, 11 nt, Human
gggaauguuug

SEQ ID NO: 2376527 - RNA, 19 nt, Human
gggaauccccgaaggugcu

SEQ ID NO: 2376528 - RNA, 22 nt, Human
gggaauccccgaaggugcugga

SEQ ID NO: 2376529 - RNA, 23 nt, Human
gggaauagucuagauggcuccuc

SEQ ID NO: 2376530 - RNA, 12 nt, Human
gggaauauuuua

SEQ ID NO: 2376531 - RNA, 18 nt, Human
gggaauauuugaaucuug

SEQ ID NO: 2376532 - RNA, 14 nt, Human
gggaaucagaacuc

SEQ ID NO: 2376533 - RNA, 12 nt, Human
gggaaucaagau

SEQ ID NO: 2376534 - RNA, 21 nt, Human
gggaagugacaaggccccaga

SEQ ID NO: 2376535 - RNA, 23 nt, Human
gggaagugacuuagcagaugcug

SEQ ID NO: 2376536 - RNA, 17 nt, Human
gggaagugaggaagcca

SEQ ID NO: 2376537 - RNA, 14 nt, Human
gggaauaaauaugc

SEQ ID NO: 2376538 - RNA, 13 nt, Human
gggaauauuugaa

SEQ ID NO: 2376539 - RNA, 14 nt, Human
gggaauauuugaau

SEQ ID NO: 2376540 - RNA, 19 nt, Human
gggaauaaauaugccucuc

SEQ ID NO: 2376541 - RNA, 19 nt, Human
gggaauacuagggagaagg

SEQ ID NO: 2376542 - RNA, 23 nt, Human
gggaauguuugggcagaagggag

SEQ ID NO: 2376543 - RNA, 22 nt, Human
gggaauguuugggcagaaggga

SEQ ID NO: 2376544 - RNA, 22 nt, Human
gggacaaguggacucagggcag

SEQ ID NO: 2376545 - RNA, 14 nt, Human
gggaauugaggaca

SEQ ID NO: 2376546 - RNA, 19 nt, Human
gggaauguuugccucugcc

SEQ ID NO: 2376547 - RNA, 21 nt, Human
gggaauguuugccucugccuc

SEQ ID NO: 2376548 - RNA, 14 nt, Human
gggacacccuguga

SEQ ID NO: 2376549 - RNA, 20 nt, Human
gggacaccaagccuuggcuc

SEQ ID NO: 2376550 - RNA, 19 nt, Human
gggacaaguggacucaggg

SEQ ID NO: 2376551 - RNA, 23 nt, Human
gggacacauucaacccuggagag

SEQ ID NO: 2376552 - RNA, 14 nt, Human
gggacaccagccag

SEQ ID NO: 2376553 - RNA, 21 nt, Human
gggacccaauguaggagcugc

SEQ ID NO: 2376554 - RNA, 18 nt, Human
gggacccaggcaccugca

SEQ ID NO: 2376555 - RNA, 18 nt, Human
gggacaccagccaggcuc

SEQ ID NO: 2376556 - RNA, 19 nt, Human
gggacaccagccaggcucu

SEQ ID NO: 2376557 - RNA, 20 nt, Human
gggacaccagccaggcucug

SEQ ID NO: 2376558 - RNA, 22 nt, Human
gggacaccagccaggcucugug

SEQ ID NO: 2376559 - RNA, 21 nt, Human
gggacccccgcccccugcccu

SEQ ID NO: 2376560 - RNA, 24 nt, Human
gggacccccgcccccugcccuccc

SEQ ID NO: 2376561 - RNA, 16 nt, Human
gggaccccgagccugg

SEQ ID NO: 2376562 - RNA, 17 nt, Human
gggaccugccaggcagg

SEQ ID NO: 2376563 - RNA, 18 nt, Human
gggaccugguacccuccu

SEQ ID NO: 2376564 - RNA, 18 nt, Human
gggaccugccaggcaggg

SEQ ID NO: 2376565 - RNA, 19 nt, Human
gggaccugccaggcagggg

SEQ ID NO: 2376566 - RNA, 21 nt, Human
gggaccugguacccuccuggc

SEQ ID NO: 2376567 - RNA, 15 nt, Human
gggaccuuuaguggu

SEQ ID NO: 2376568 - RNA, 14 nt, Human
gggacccccgcccc

SEQ ID NO: 2376569 - RNA, 17 nt, Human
gggacccccgcccccug

SEQ ID NO: 2376570 - RNA, 18 nt, Human
gggacccccgcccccugc

SEQ ID NO: 2376571 - RNA, 19 nt, Human
gggacccccgcccccugcc

SEQ ID NO: 2376572 - RNA, 13 nt, Human
gggacccccgccc

SEQ ID NO: 2376573 - RNA, 22 nt, Human
gggacgccugggggugccagga

SEQ ID NO: 2376574 - RNA, 21 nt, Human
gggacgccugggggugccagg

SEQ ID NO: 2376575 - RNA, 21 nt, Human
gggacggggggccccagucag

SEQ ID NO: 2376576 - RNA, 23 nt, Human
gggacguccugccaccuggggca

SEQ ID NO: 2376577 - RNA, 16 nt, Human
gggacgucccugccca

SEQ ID NO: 2376578 - RNA, 17 nt, Human
gggacggugcccaagcc

SEQ ID NO: 2376579 - RNA, 17 nt, Human
gggacucaaugcacuga

SEQ ID NO: 2376580 - RNA, 19 nt, Human
gggacucaaugcacugaca

SEQ ID NO: 2376581 - RNA, 16 nt, Human
gggagccccagggucu

SEQ ID NO: 2376582 - RNA, 14 nt, Human
gggagccccagggu

SEQ ID NO: 2376583 - RNA, 21 nt, Human
gggagccccagggucuucccu

SEQ ID NO: 2376584 - RNA, 13 nt, Human
gggagccccaggg

SEQ ID NO: 2376585 - RNA, 12 nt, Human
gggagccccagg

SEQ ID NO: 2376586 - RNA, 21 nt, Human
gggagcccacuguccugggcc

SEQ ID NO: 2376587 - RNA, 20 nt, Human
gggagcccacuguccugggc

SEQ ID NO: 2376588 - RNA, 23 nt, Human
gggacugccagucccccugcccc

SEQ ID NO: 2376589 - RNA, 10 nt, Human
gggagcccac

SEQ ID NO: 2376590 - RNA, 19 nt, Human
gggagcccacuguccuggg

SEQ ID NO: 2376591 - RNA, 17 nt, Human
gggacugagccaguccc

SEQ ID NO: 2376592 - RNA, 19 nt, Human
gggacugagccagucccag

SEQ ID NO: 2376593 - RNA, 14 nt, Human
gggacugagccagu

SEQ ID NO: 2376594 - RNA, 13 nt, Human
gggacugagccag

SEQ ID NO: 2376595 - RNA, 23 nt, Human
gggacucaaugcacugacauugu

SEQ ID NO: 2376596 - RNA, 15 nt, Human
gggacugagaaauuu

SEQ ID NO: 2376597 - RNA, 21 nt, Human
gggacugaggggaggggagca

SEQ ID NO: 2376598 - RNA, 18 nt, Human
gggacguggcucagccag

SEQ ID NO: 2376599 - RNA, 14 nt, Human
gggacguggcucag

SEQ ID NO: 2376600 - RNA, 20 nt, Human
gggacucaauuucuccccag

SEQ ID NO: 2376601 - RNA, 14 nt, Human
ggcuugccugcagg

SEQ ID NO: 2376602 - RNA, 15 nt, Human
ggcuugccugcaggc

SEQ ID NO: 2376603 - RNA, 11 nt, Human
ggcuugcugcc

SEQ ID NO: 2376604 - RNA, 13 nt, Human
ggcuugcugagag

SEQ ID NO: 2376605 - RNA, 12 nt, Human
ggcuuggccugc

SEQ ID NO: 2376606 - RNA, 13 nt, Human
ggcuuggccugcu

SEQ ID NO: 2376607 - RNA, 14 nt, Human
ggcuuggccugcug

SEQ ID NO: 2376608 - RNA, 16 nt, Human
ggcuuggccugcugug

SEQ ID NO: 2376609 - RNA, 14 nt, Human
ggcuugcaugccaa

SEQ ID NO: 2376610 - RNA, 15 nt, Human
ggcuugcugagaggg

SEQ ID NO: 2376611 - RNA, 14 nt, Human
ggcuuucuggagag

SEQ ID NO: 2376612 - RNA, 13 nt, Human
ggcuuucuggaga

SEQ ID NO: 2376613 - RNA, 18 nt, Human
ggcuuggggaccagagcu

SEQ ID NO: 2376614 - RNA, 23 nt, Human
ggcuugggcuuccauuugugugu

SEQ ID NO: 2376615 - RNA, 15 nt, Human
ggcuuggccugcugu

SEQ ID NO: 2376616 - RNA, 14 nt, Human
ggcuugggaccgcc

SEQ ID NO: 2376617 - RNA, 17 nt, Human
ggcuuggggaccagagc

SEQ ID NO: 2376618 - RNA, 18 nt, Human
ggcuuagcuuugcucugc

SEQ ID NO: 2376619 - RNA, 12 nt, Human
ggcuucacagau

SEQ ID NO: 2376620 - RNA, 21 nt, Human
ggcuucacggaagagccuugc

SEQ ID NO: 2376621 - RNA, 15 nt, Human
ggcuucacuguauaa

SEQ ID NO: 2376622 - RNA, 18 nt, Human
ggcuucacuguauaaaua

SEQ ID NO: 2376623 - RNA, 19 nt, Human
ggcuucacuguauaaauag

SEQ ID NO: 2376624 - RNA, 17 nt, Human
ggcuucagcauauuuau

SEQ ID NO: 2376625 - RNA, 21 nt, Human
ggcuucacuguauaaauagga

SEQ ID NO: 2376626 - RNA, 22 nt, Human
ggcuucacuguauaaauaggag

SEQ ID NO: 2376627 - RNA, 13 nt, Human
ggcuugccugcag

SEQ ID NO: 2376628 - RNA, 16 nt, Human
ggcuugccacagcucu

SEQ ID NO: 2376629 - RNA, 20 nt, Human
ggcuucacggaagagccuug

SEQ ID NO: 2376630 - RNA, 14 nt, Human
ggcuguuugaggau

SEQ ID NO: 2376631 - RNA, 21 nt, Human
ggcuuagacuucgacucagga

SEQ ID NO: 2376632 - RNA, 15 nt, Human
ggcuuagucacugag

SEQ ID NO: 2376633 - RNA, 14 nt, Human
ggcuuagucacuga

SEQ ID NO: 2376634 - RNA, 22 nt, Human
ggcugugggccucaaggacuug

SEQ ID NO: 2376635 - RNA, 14 nt, Human
ggcugugucuaaac

SEQ ID NO: 2376636 - RNA, 20 nt, Human
ggcuguguucuggugaggcc

SEQ ID NO: 2376637 - RNA, 15 nt, Human
ggcugugucuaaacu

SEQ ID NO: 2376638 - RNA, 16 nt, Human
ggcugugucuaaacug

SEQ ID NO: 2376639 - RNA, 14 nt, Human
ggcuguucuggaag

SEQ ID NO: 2376640 - RNA, 13 nt, Human
ggcuguugcaugg

SEQ ID NO: 2376641 - RNA, 12 nt, Human
ggcuguuggcac

SEQ ID NO: 2376642 - RNA, 14 nt, Human
ggcuguuggcuggg

SEQ ID NO: 2376643 - RNA, 15 nt, Human
ggcuguuggcugggg

SEQ ID NO: 2376644 - RNA, 16 nt, Human
ggcuguuggcuggggg

SEQ ID NO: 2376645 - RNA, 20 nt, Human
ggcuguuggcugggggccuc

SEQ ID NO: 2376646 - RNA, 17 nt, Human
ggcuguuggcacucaca

SEQ ID NO: 2376647 - RNA, 23 nt, Human
ggcuguuggcacucacagaccug

SEQ ID NO: 2376648 - RNA, 15 nt, Human
ggcuguuggcaguga

SEQ ID NO: 2376649 - RNA, 17 nt, Human
ggcuguuggcagugagu

SEQ ID NO: 2376650 - RNA, 17 nt, Human
ggcugggggcaggaggg

SEQ ID NO: 2376651 - RNA, 16 nt, Human
ggcugggggcaggagg

SEQ ID NO: 2376652 - RNA, 18 nt, Human
ggcugggggcaggagggc

SEQ ID NO: 2376653 - RNA, 23 nt, Human
ggcuguccaguucccagaaggca

SEQ ID NO: 2376654 - RNA, 13 nt, Human
ggcuguccuguac

SEQ ID NO: 2376655 - RNA, 22 nt, Human
ggcuguccuguacauuguggga

SEQ ID NO: 2376656 - RNA, 13 nt, Human
ggcugugccucug

SEQ ID NO: 2376657 - RNA, 16 nt, Human
ggcugugccucugccu

SEQ ID NO: 2376658 - RNA, 23 nt, Human
ggcugucuucucaggcucugccc

SEQ ID NO: 2376659 - RNA, 13 nt, Human
ggcugugaggccc

SEQ ID NO: 2376660 - RNA, 22 nt, Human
ggcugucuucucaggcucugcc

SEQ ID NO: 2376661 - RNA, 19 nt, Human
ggcugucuucucaggcucu

SEQ ID NO: 2376662 - RNA, 18 nt, Human
ggcugucuucucaggcuc

SEQ ID NO: 2376663 - RNA, 19 nt, Human
ggcugugcgcugacaacca

SEQ ID NO: 2376664 - RNA, 20 nt, Human
ggcugugcucccugguucug

SEQ ID NO: 2376665 - RNA, 11 nt, Human
ggcugugagug

SEQ ID NO: 2376666 - RNA, 18 nt, Human
ggcugugcagccuguccu

SEQ ID NO: 2376667 - RNA, 10 nt, Human
ggcugugcua

SEQ ID NO: 2376668 - RNA, 24 nt, Human
ggcugugguagggggugucucagg

SEQ ID NO: 2376669 - RNA, 15 nt, Human
ggcuguggucacagc

SEQ ID NO: 2376670 - RNA, 21 nt, Human
ggcugugggccucaaggacuu

SEQ ID NO: 2376671 - RNA, 14 nt, Human
ggcuggagugagga

SEQ ID NO: 2376672 - RNA, 16 nt, Human
ggcuggagugaggaaa

SEQ ID NO: 2376673 - RNA, 19 nt, Human
ggcuggaggcagggccuug

SEQ ID NO: 2376674 - RNA, 17 nt, Human
ggcuggaggcagggccu

SEQ ID NO: 2376675 - RNA, 23 nt, Human
ggcuggaggcagggccuugccca

SEQ ID NO: 2376676 - RNA, 15 nt, Human
ggcuggaggcagggc

SEQ ID NO: 2376677 - RNA, 13 nt, Human
ggcuggaggcagg

SEQ ID NO: 2376678 - RNA, 23 nt, Human
ggcuggagcccagggagcggaaa

SEQ ID NO: 2376679 - RNA, 19 nt, Human
ggcuggagacgggugggcg

SEQ ID NO: 2376680 - RNA, 19 nt, Human
ggcuggagaccaugcagag

SEQ ID NO: 2376681 - RNA, 18 nt, Human
ggcuggacuuggagguag

SEQ ID NO: 2376682 - RNA, 13 nt, Human
ggcuggagcuggc

SEQ ID NO: 2376683 - RNA, 13 nt, Human
ggcuggacugagg

SEQ ID NO: 2376684 - RNA, 14 nt, Human
ggcuggacugaggc

SEQ ID NO: 2376685 - RNA, 16 nt, Human
ggcuggacugaggccu

SEQ ID NO: 2376686 - RNA, 13 nt, Human
ggcuggacuugga

SEQ ID NO: 2376687 - RNA, 17 nt, Human
ggcuggacugaggccug

SEQ ID NO: 2376688 - RNA, 18 nt, Human
ggcuggacugaggccuga

SEQ ID NO: 2376689 - RNA, 21 nt, Human
ggcugcuucaaggauccugag

SEQ ID NO: 2376690 - RNA, 15 nt, Human
ggcugagggagccug

SEQ ID NO: 2376691 - RNA, 20 nt, Human
ggcugcuucaaggauccuga

SEQ ID NO: 2376692 - RNA, 17 nt, Human
ggcugaggcagaagaau

SEQ ID NO: 2376693 - RNA, 14 nt, Human
ggcugaggcaggag

SEQ ID NO: 2376694 - RNA, 14 nt, Human
ggcugaggccugga

SEQ ID NO: 2376695 - RNA, 18 nt, Human
ggcugaggcuggcacagg

SEQ ID NO: 2376696 - RNA, 17 nt, Human
ggcugaggcuggcacag

SEQ ID NO: 2376697 - RNA, 14 nt, Human
ggcugaggcuggca

SEQ ID NO: 2376698 - RNA, 16 nt, Human
ggcugaggccuggacu

SEQ ID NO: 2376699 - RNA, 15 nt, Human
ggcugcuucaaggau

SEQ ID NO: 2376700 - RNA, 19 nt, Human
ggcugcuucaaggauccug

SEQ ID NO: 2376701 - RNA, 14 nt, Human
ggcugaggcagaag

SEQ ID NO: 2376702 - RNA, 13 nt, Human
ggcugaggcagaa

SEQ ID NO: 2376703 - RNA, 21 nt, Human
ggcugaggauuucaagccugc

SEQ ID NO: 2376704 - RNA, 20 nt, Human
ggcugaggaggccuccaucu

SEQ ID NO: 2376705 - RNA, 15 nt, Human
ggcugaggaggccuc

SEQ ID NO: 2376706 - RNA, 16 nt, Human
ggcugaggaggccucc

SEQ ID NO: 2376707 - RNA, 19 nt, Human
ggcugaggaggccuccauc

SEQ ID NO: 2376708 - RNA, 22 nt, Human
ggcugaggaaaggccagcuggc

SEQ ID NO: 2376709 - RNA, 21 nt, Human
ggcugaggaagcacagcagca

SEQ ID NO: 2376710 - RNA, 17 nt, Human
ggcugaggaaaggccag

SEQ ID NO: 2376711 - RNA, 13 nt, Human
ggcucugcccugc

SEQ ID NO: 2376712 - RNA, 23 nt, Human
ggcucugccccagcucuggcuuc

SEQ ID NO: 2376713 - RNA, 23 nt, Human
ggcucugggauagcugacccagc

SEQ ID NO: 2376714 - RNA, 23 nt, Human
ggcucuggagcccacuguacuug

SEQ ID NO: 2376715 - RNA, 19 nt, Human
ggcuggaguggaguggcgu

SEQ ID NO: 2376716 - RNA, 20 nt, Human
ggcuggagugcaguggugug

SEQ ID NO: 2376717 - RNA, 19 nt, Human
ggcuggagugcaguggcgu

SEQ ID NO: 2376718 - RNA, 20 nt, Human
ggcuggaguucaguggugug

SEQ ID NO: 2376719 - RNA, 15 nt, Human
ggcugggagcucugc

SEQ ID NO: 2376720 - RNA, 13 nt, Human
ggcugggaguggu

SEQ ID NO: 2376721 - RNA, 23 nt, Human
ggcugggaguaguugucuuuccu

SEQ ID NO: 2376722 - RNA, 14 nt, Human
ggcugggaguggug

SEQ ID NO: 2376723 - RNA, 15 nt, Human
ggcugggaguggugg

SEQ ID NO: 2376724 - RNA, 16 nt, Human
ggcugggaugggccug

SEQ ID NO: 2376725 - RNA, 17 nt, Human
ggcugggcaaggaggcc

SEQ ID NO: 2376726 - RNA, 20 nt, Human
ggcugggcucccuucccacc

SEQ ID NO: 2376727 - RNA, 21 nt, Human
ggcugggcucccuucccaccu

SEQ ID NO: 2376728 - RNA, 11 nt, Human
ggcugggcuuc

SEQ ID NO: 2376729 - RNA, 21 nt, Human
ggcugggcuucaguggcagcu

SEQ ID NO: 2376730 - RNA, 22 nt, Human
ggcugggcuucaguggcagcug

SEQ ID NO: 2376731 - RNA, 18 nt, Human
ggcugggcuucaguggca

SEQ ID NO: 2376732 - RNA, 17 nt, Human
ggcuggggaaguccucu

SEQ ID NO: 2376733 - RNA, 16 nt, Human
ggcugggggaagaagc

SEQ ID NO: 2376734 - RNA, 20 nt, Human
ggcuggggccuaucagugug

SEQ ID NO: 2376735 - RNA, 18 nt, Human
ggcuggggaaguccucug

SEQ ID NO: 2376736 - RNA, 21 nt, Human
ggcuggggaaguccucugggu

SEQ ID NO: 2376737 - RNA, 14 nt, Human
ggcugggggccuca

SEQ ID NO: 2376738 - RNA, 14 nt, Human
ggcugggggcagga

SEQ ID NO: 2376739 - RNA, 16 nt, Human
ggcuggggcugaccuu

SEQ ID NO: 2376740 - RNA, 21 nt, Human
ggcuggggccuaucagugugc

SEQ ID NO: 2376741 - RNA, 22 nt, Human
ggcuggggccuaucagugugcc

SEQ ID NO: 2376742 - RNA, 19 nt, Human
ggcgccgcaaaccacacug

SEQ ID NO: 2376743 - RNA, 11 nt, Human
ggcgcugcccc

SEQ ID NO: 2376744 - RNA, 16 nt, Human
ggcgggagcaucucuu

SEQ ID NO: 2376745 - RNA, 16 nt, Human
ggcgggacccaggcac

SEQ ID NO: 2376746 - RNA, 17 nt, Human
ggcgcugccccuggcag

SEQ ID NO: 2376747 - RNA, 13 nt, Human
ggcgcccaccucc

SEQ ID NO: 2376748 - RNA, 14 nt, Human
ggcgcccaccuccc

SEQ ID NO: 2376749 - RNA, 15 nt, Human
ggcgcccaccucccc

SEQ ID NO: 2376750 - RNA, 24 nt, Human
ggcgcccaccuccccacgcccucc

SEQ ID NO: 2376751 - RNA, 13 nt, Human
ggcgccccugcca

SEQ ID NO: 2376752 - RNA, 15 nt, Human
ggcgccccugccacc

SEQ ID NO: 2376753 - RNA, 22 nt, Human
ggcgccccugccaccucccuga

SEQ ID NO: 2376754 - RNA, 11 nt, Human
ggcgcccucug

SEQ ID NO: 2376755 - RNA, 13 nt, Human
ggcgcccucuguc

SEQ ID NO: 2376756 - RNA, 14 nt, Human
ggcgcccucugucc

SEQ ID NO: 2376757 - RNA, 19 nt, Human
ggcgcgguggcucacgccu

SEQ ID NO: 2376758 - RNA, 16 nt, Human
ggcgcccuggaagccg

SEQ ID NO: 2376759 - RNA, 16 nt, Human
ggcgcccucuguccug

SEQ ID NO: 2376760 - RNA, 17 nt, Human
ggcgcccucuguccuga

SEQ ID NO: 2376761 - RNA, 12 nt, Human
ggcgcccuggaa

SEQ ID NO: 2376762 - RNA, 14 nt, Human
ggcgcccuggaagc

SEQ ID NO: 2376763 - RNA, 15 nt, Human
ggcgcgguggcucac

SEQ ID NO: 2376764 - RNA, 15 nt, Human
ggcuagucagagaga

SEQ ID NO: 2376765 - RNA, 14 nt, Human
ggcuagucagagag

SEQ ID NO: 2376766 - RNA, 20 nt, Human
ggcuagugacuuguguccca

SEQ ID NO: 2376767 - RNA, 18 nt, Human
ggcuagucagagagagug

SEQ ID NO: 2376768 - RNA, 23 nt, Human
ggcuagugacuugugucccauga

SEQ ID NO: 2376769 - RNA, 23 nt, Human
ggcuauaggugcuacaaaaacac

SEQ ID NO: 2376770 - RNA, 13 nt, Human
ggcuagucagaga

SEQ ID NO: 2376771 - RNA, 23 nt, Human
ggcuagucaagcuccuccucccu

SEQ ID NO: 2376772 - RNA, 22 nt, Human
ggcuagucaagcuccuccuccc

SEQ ID NO: 2376773 - RNA, 19 nt, Human
ggcuagucaagcuccuccu

SEQ ID NO: 2376774 - RNA, 17 nt, Human
ggcuagucaagcuccuc

SEQ ID NO: 2376775 - RNA, 16 nt, Human
ggcuagucaagcuccu

SEQ ID NO: 2376776 - RNA, 16 nt, Human
ggcgggugggggugga

SEQ ID NO: 2376777 - RNA, 20 nt, Human
ggcuaguaucaaaagaaaga

SEQ ID NO: 2376778 - RNA, 14 nt, Human
ggcgggcggucagg

SEQ ID NO: 2376779 - RNA, 12 nt, Human
ggcggguggggg

SEQ ID NO: 2376780 - RNA, 13 nt, Human
ggcuagguacaca

SEQ ID NO: 2376781 - RNA, 17 nt, Human
ggcgggccaaggacugc

SEQ ID NO: 2376782 - RNA, 12 nt, Human
ggcgggccagcc

SEQ ID NO: 2376783 - RNA, 13 nt, Human
ggcgggccagcca

SEQ ID NO: 2376784 - RNA, 14 nt, Human
ggcgggccagccag

SEQ ID NO: 2376785 - RNA, 15 nt, Human
ggcgggccagccagg

SEQ ID NO: 2376786 - RNA, 17 nt, Human
ggcgggccagccaggcg

SEQ ID NO: 2376787 - RNA, 14 nt, Human
ggcgggccccucau

SEQ ID NO: 2376788 - RNA, 22 nt, Human
ggcgggcaccuauagucccagc

SEQ ID NO: 2376789 - RNA, 15 nt, Human
ggcgggcagcacagc

SEQ ID NO: 2376790 - RNA, 16 nt, Human
ggcgggaugggccacc

SEQ ID NO: 2376791 - RNA, 19 nt, Human
ggcgggacccaggcaccug

SEQ ID NO: 2376792 - RNA, 21 nt, Human
ggcgggaguggaguggaagaa

SEQ ID NO: 2376793 - RNA, 13 nt, Human
ggcucacgugugu

SEQ ID NO: 2376794 - RNA, 24 nt, Human
ggcucacgccuguaaucccagcag

SEQ ID NO: 2376795 - RNA, 22 nt, Human
ggcucacgccuguaaucccagc

SEQ ID NO: 2376796 - RNA, 23 nt, Human
ggcucacgccuguaaucccagca

SEQ ID NO: 2376797 - RNA, 13 nt, Human
ggcuccagagggc

SEQ ID NO: 2376798 - RNA, 17 nt, Human
ggcucacuauggugcca

SEQ ID NO: 2376799 - RNA, 18 nt, Human
ggcucacuauggugccaa

SEQ ID NO: 2376800 - RNA, 10 nt, Human
ggcuccagac

SEQ ID NO: 2376801 - RNA, 14 nt, Human
ggcuccaggagcag

SEQ ID NO: 2376802 - RNA, 16 nt, Human
ggcuccaggagcagcc

SEQ ID NO: 2376803 - RNA, 12 nt, Human
ggcuccaggcuc

SEQ ID NO: 2376804 - RNA, 13 nt, Human
ggcuccaggcucc

SEQ ID NO: 2376805 - RNA, 18 nt, Human
ggcuccaggagcagccac

SEQ ID NO: 2376806 - RNA, 17 nt, Human
ggcuccaggagcagcca

SEQ ID NO: 2376807 - RNA, 19 nt, Human
ggcucacccaagcaaggcc

SEQ ID NO: 2376808 - RNA, 17 nt, Human
ggcucacacugagaaug

SEQ ID NO: 2376809 - RNA, 18 nt, Human
ggcucacacugagaaugu

SEQ ID NO: 2376810 - RNA, 14 nt, Human
ggcuaugcauuuga

SEQ ID NO: 2376811 - RNA, 15 nt, Human
ggcucacacugagaa

SEQ ID NO: 2376812 - RNA, 14 nt, Human
ggcucacacugaga

SEQ ID NO: 2376813 - RNA, 13 nt, Human
ggcuaugcauuug

SEQ ID NO: 2376814 - RNA, 12 nt, Human
ggcuaugcauuu

SEQ ID NO: 2376815 - RNA, 23 nt, Human
ggcucacgccuaugaucccagca

SEQ ID NO: 2376816 - RNA, 21 nt, Human
ggcucacgccuaugaucccag

SEQ ID NO: 2376817 - RNA, 17 nt, Human
ggcucacgccuguaauc

SEQ ID NO: 2376818 - RNA, 18 nt, Human
ggcucacgccuguaaucc

SEQ ID NO: 2376819 - RNA, 20 nt, Human
ggcucacgccuaugauccca

SEQ ID NO: 2376820 - RNA, 22 nt, Human
ggcucacccccuucuccaucca

SEQ ID NO: 2376821 - RNA, 17 nt, Human
ggcucacccccuucucc

SEQ ID NO: 2376822 - RNA, 9 nt, Human
ggcuccaga

SEQ ID NO: 2376823 - RNA, 16 nt, Human
ggcuccacuuggucug

SEQ ID NO: 2376824 - RNA, 12 nt, Human
ggcucugcccca

SEQ ID NO: 2376825 - RNA, 16 nt, Human
ggcucugccccagagg

SEQ ID NO: 2376826 - RNA, 17 nt, Human
ggcucugccccagaggc

SEQ ID NO: 2376827 - RNA, 19 nt, Human
ggcucugccacccuaccug

SEQ ID NO: 2376828 - RNA, 12 nt, Human
ggcucugcacag

SEQ ID NO: 2376829 - RNA, 14 nt, Human
ggcucugccacccu

SEQ ID NO: 2376830 - RNA, 19 nt, Human
ggcucugcaauuccccucu

SEQ ID NO: 2376831 - RNA, 20 nt, Human
ggcucugcaauuccccucug

SEQ ID NO: 2376832 - RNA, 21 nt, Human
ggcucugccccagcucuggcu

SEQ ID NO: 2376833 - RNA, 20 nt, Human
ggcucugccccagcucuggc

SEQ ID NO: 2376834 - RNA, 14 nt, Human
ggcucugccccagc

SEQ ID NO: 2376835 - RNA, 18 nt, Human
ggcucugccccagaggcc

SEQ ID NO: 2376836 - RNA, 21 nt, Human
ggcucugccccagaggccucu

SEQ ID NO: 2376837 - RNA, 12 nt, Human
ggcucugcccuu

SEQ ID NO: 2376838 - RNA, 13 nt, Human
ggcucugaccagu

SEQ ID NO: 2376839 - RNA, 14 nt, Human
ggcucugaaagcca

SEQ ID NO: 2376840 - RNA, 18 nt, Human
ggcucucuuuccuucuug

SEQ ID NO: 2376841 - RNA, 23 nt, Human
ggcucucuuuccuucuugccuuc

SEQ ID NO: 2376842 - RNA, 17 nt, Human
ggcucucuuuccuucuu

SEQ ID NO: 2376843 - RNA, 14 nt, Human
ggcucucuccagga

SEQ ID NO: 2376844 - RNA, 14 nt, Human
ggcucugagcgccu

SEQ ID NO: 2376845 - RNA, 15 nt, Human
ggcucugagcgccuc

SEQ ID NO: 2376846 - RNA, 17 nt, Human
ggcucugaggugccugu

SEQ ID NO: 2376847 - RNA, 19 nt, Human
ggcucugaggugccugucc

SEQ ID NO: 2376848 - RNA, 20 nt, Human
ggcucugaggugccuguccc

SEQ ID NO: 2376849 - RNA, 23 nt, Human
ggcucugaggugccugucccacc

SEQ ID NO: 2376850 - RNA, 20 nt, Human
ggcucugcaaugggcacugg

SEQ ID NO: 2376851 - RNA, 17 nt, Human
ggcucuggagcccacug

SEQ ID NO: 2376852 - RNA, 19 nt, Human
ggcucuggagcccacugua

SEQ ID NO: 2376853 - RNA, 16 nt, Human
ggcucuggagcccacu

SEQ ID NO: 2376854 - RNA, 16 nt, Human
ggcucugccucccauc

SEQ ID NO: 2376855 - RNA, 14 nt, Human
ggcucugcccuugg

SEQ ID NO: 2376856 - RNA, 15 nt, Human
ggcucugcccuuggu

SEQ ID NO: 2376857 - RNA, 13 nt, Human
ggcucugccuccc

SEQ ID NO: 2376858 - RNA, 15 nt, Human
ggcucugccucccau

SEQ ID NO: 2376859 - RNA, 22 nt, Human
ggcucuccaccucagccuugga

SEQ ID NO: 2376860 - RNA, 21 nt, Human
ggcucuccaccucagccuugg

SEQ ID NO: 2376861 - RNA, 13 nt, Human
ggcucuccaguua

SEQ ID NO: 2376862 - RNA, 20 nt, Human
ggcucuccucagaagaaaga

SEQ ID NO: 2376863 - RNA, 20 nt, Human
ggcucuccaccucagccuug

SEQ ID NO: 2376864 - RNA, 19 nt, Human
ggcucuccaccucagccuu

SEQ ID NO: 2376865 - RNA, 18 nt, Human
ggcucuccaccucagccu

SEQ ID NO: 2376866 - RNA, 17 nt, Human
ggcucuccaccucagcc

SEQ ID NO: 2376867 - RNA, 22 nt, Human
ggcucucuauagcaccagggcu

SEQ ID NO: 2376868 - RNA, 12 nt, Human
ggcucucuccag

SEQ ID NO: 2376869 - RNA, 13 nt, Human
ggcucucuccagg

SEQ ID NO: 2376870 - RNA, 16 nt, Human
ggcucuccaccucagc

SEQ ID NO: 2376871 - RNA, 15 nt, Human
ggcucuccaccucag

SEQ ID NO: 2376872 - RNA, 14 nt, Human
ggcucuccaccuca

SEQ ID NO: 2376873 - RNA, 13 nt, Human
ggcucuccaccuc

SEQ ID NO: 2376874 - RNA, 12 nt, Human
ggcucuccaccu

SEQ ID NO: 2376875 - RNA, 23 nt, Human
ggcucuccaagugccagaggugg

SEQ ID NO: 2376876 - RNA, 19 nt, Human
ggcucuccaagugccagag

SEQ ID NO: 2376877 - RNA, 20 nt, Human
ggcucuccaagugccagagg

SEQ ID NO: 2376878 - RNA, 23 nt, Human
ggcucucauguuuucaacugcca

SEQ ID NO: 2376879 - RNA, 12 nt, Human
ggcucuccaagu

SEQ ID NO: 2376880 - RNA, 17 nt, Human
ggcucuccaagugccag

SEQ ID NO: 2376881 - RNA, 18 nt, Human
ggcucuccaagugccaga

SEQ ID NO: 2376882 - RNA, 17 nt, Human
ggcucucaggccagcug

SEQ ID NO: 2376883 - RNA, 18 nt, Human
ggcucucaggccagcugc

SEQ ID NO: 2376884 - RNA, 19 nt, Human
ggcucucaggccagcugcu

SEQ ID NO: 2376885 - RNA, 20 nt, Human
ggcucucaggccagcugcuu

SEQ ID NO: 2376886 - RNA, 11 nt, Human
ggcuccccucu

SEQ ID NO: 2376887 - RNA, 22 nt, Human
ggcuccccauguguccugguuc

SEQ ID NO: 2376888 - RNA, 17 nt, Human
ggcuccccauguguccu

SEQ ID NO: 2376889 - RNA, 21 nt, Human
ggcuccccauguguccugguu

SEQ ID NO: 2376890 - RNA, 12 nt, Human
ggcuccccucua

SEQ ID NO: 2376891 - RNA, 22 nt, Human
ggcucccauucacucuuccaga

SEQ ID NO: 2376892 - RNA, 15 nt, Human
ggcucucaggccagc

SEQ ID NO: 2376893 - RNA, 16 nt, Human
ggcucucaggccagcu

SEQ ID NO: 2376894 - RNA, 14 nt, Human
ggcuccaggcuccu

SEQ ID NO: 2376895 - RNA, 16 nt, Human
ggcuccagagggcacu

SEQ ID NO: 2376896 - RNA, 19 nt, Human
ggcucccaugaccauacug

SEQ ID NO: 2376897 - RNA, 18 nt, Human
ggcucccauucacucuuc

SEQ ID NO: 2376898 - RNA, 15 nt, Human
ggcucccauucacuc

SEQ ID NO: 2376899 - RNA, 14 nt, Human
ggcuccagaaaugu

SEQ ID NO: 2376900 - RNA, 22 nt, Human
ggcgcacuuuccuccuggcaga

SEQ ID NO: 2376901 - RNA, 14 nt, Human
ggcgcagccaaggc

SEQ ID NO: 2376902 - RNA, 15 nt, Human
ggcgcagccaaggcc

SEQ ID NO: 2376903 - RNA, 11 nt, Human
ggcgcaggagg

SEQ ID NO: 2376904 - RNA, 17 nt, Human
ggcgcagccaaggccga

SEQ ID NO: 2376905 - RNA, 16 nt, Human
ggcgcagugccucugg

SEQ ID NO: 2376906 - RNA, 17 nt, Human
ggcgcagugccucuggu

SEQ ID NO: 2376907 - RNA, 15 nt, Human
ggcgccaccauccug

SEQ ID NO: 2376908 - RNA, 12 nt, Human
ggcgcccaccuc

SEQ ID NO: 2376909 - RNA, 23 nt, Human
ggcgcagcauauucaggaagcuc

SEQ ID NO: 2376910 - RNA, 24 nt, Human
ggcgcagcauauucaggaagcuca

SEQ ID NO: 2376911 - RNA, 18 nt, Human
ggcgcacccuccccuccc

SEQ ID NO: 2376912 - RNA, 12 nt, Human
ggcgcacuguga

SEQ ID NO: 2376913 - RNA, 16 nt, Human
ggcgcacccuccccuc

SEQ ID NO: 2376914 - RNA, 17 nt, Human
ggcgcacccuccccucc

SEQ ID NO: 2376915 - RNA, 19 nt, Human
ggccugggucugugucucu

SEQ ID NO: 2376916 - RNA, 11 nt, Human
ggccuggguuu

SEQ ID NO: 2376917 - RNA, 21 nt, Human
ggccugguccaugauggaguc

SEQ ID NO: 2376918 - RNA, 19 nt, Human
ggccugguguucuguggga

SEQ ID NO: 2376919 - RNA, 21 nt, Human
ggccugggugcuggcugccca

SEQ ID NO: 2376920 - RNA, 14 nt, Human
ggccugggucugug

SEQ ID NO: 2376921 - RNA, 21 nt, Human
ggccuggccggcaaccccagu

SEQ ID NO: 2376922 - RNA, 14 nt, Human
ggccugggccagag

SEQ ID NO: 2376923 - RNA, 15 nt, Human
ggccugggccgcugc

SEQ ID NO: 2376924 - RNA, 11 nt, Human
ggccugggccc

SEQ ID NO: 2376925 - RNA, 18 nt, Human
ggccugggguaccaagag

SEQ ID NO: 2376926 - RNA, 23 nt, Human
ggccugggggcugggcagaggaa

SEQ ID NO: 2376927 - RNA, 15 nt, Human
ggccuggccugagcu

SEQ ID NO: 2376928 - RNA, 16 nt, Human
ggccuggccugagcug

SEQ ID NO: 2376929 - RNA, 18 nt, Human
ggccugagcgcuccugcc

SEQ ID NO: 2376930 - RNA, 23 nt, Human
ggccucugccccgucucaugagg

SEQ ID NO: 2376931 - RNA, 23 nt, Human
ggccugaaugcuuauagguggcc

SEQ ID NO: 2376932 - RNA, 16 nt, Human
ggccugacucucagca

SEQ ID NO: 2376933 - RNA, 22 nt, Human
ggccucugcacuccccugcugg

SEQ ID NO: 2376934 - RNA, 18 nt, Human
ggccucugcacuccccug

SEQ ID NO: 2376935 - RNA, 19 nt, Human
ggccucugcacuccccugc

SEQ ID NO: 2376936 - RNA, 20 nt, Human
ggccugagauuucaucugcu

SEQ ID NO: 2376937 - RNA, 22 nt, Human
ggccugagauuucaucugcucu

SEQ ID NO: 2376938 - RNA, 13 nt, Human
ggccuggccccuc

SEQ ID NO: 2376939 - RNA, 16 nt, Human
ggccugagccuggcca

SEQ ID NO: 2376940 - RNA, 15 nt, Human
ggccugagccuggcc

SEQ ID NO: 2376941 - RNA, 14 nt, Human
ggccuggccccuca

SEQ ID NO: 2376942 - RNA, 15 nt, Human
ggccuggccccucag

SEQ ID NO: 2376943 - RNA, 17 nt, Human
ggccuggccccucaggg

SEQ ID NO: 2376944 - RNA, 18 nt, Human
ggccuggccccucagggu

SEQ ID NO: 2376945 - RNA, 23 nt, Human
ggccuggccccucagggucccug

SEQ ID NO: 2376946 - RNA, 10 nt, Human
ggccuggccu

SEQ ID NO: 2376947 - RNA, 13 nt, Human
ggccuggccugag

SEQ ID NO: 2376948 - RNA, 14 nt, Human
ggccuggccugagc

SEQ ID NO: 2376949 - RNA, 14 nt, Human
ggccucgccuggcc

SEQ ID NO: 2376950 - RNA, 15 nt, Human
ggccucgccuggccu

SEQ ID NO: 2376951 - RNA, 16 nt, Human
ggccucgccuggccug

SEQ ID NO: 2376952 - RNA, 17 nt, Human
ggccucgccuggccuga

SEQ ID NO: 2376953 - RNA, 20 nt, Human
ggccucgguguggagaagcg

SEQ ID NO: 2376954 - RNA, 19 nt, Human
ggccuccucuguccagggc

SEQ ID NO: 2376955 - RNA, 17 nt, Human
ggccuccucccuuagcu

SEQ ID NO: 2376956 - RNA, 14 nt, Human
ggccuccugugugu

SEQ ID NO: 2376957 - RNA, 20 nt, Human
ggccucucauuccagaggaa

SEQ ID NO: 2376958 - RNA, 19 nt, Human
ggccucuccuuguggccug

SEQ ID NO: 2376959 - RNA, 18 nt, Human
ggccucgccuggccugag

SEQ ID NO: 2376960 - RNA, 16 nt, Human
ggccucuaaccccagg

SEQ ID NO: 2376961 - RNA, 17 nt, Human
ggccucuaaccccaggc

SEQ ID NO: 2376962 - RNA, 18 nt, Human
ggccucuaaccccaggcc

SEQ ID NO: 2376963 - RNA, 19 nt, Human
ggccucuaaccccaggccc

SEQ ID NO: 2376964 - RNA, 20 nt, Human
ggccucuaaccccaggcccc

SEQ ID NO: 2376965 - RNA, 22 nt, Human
ggccucuaaccccaggccccga

SEQ ID NO: 2376966 - RNA, 13 nt, Human
ggccucucuggcc

SEQ ID NO: 2376967 - RNA, 15 nt, Human
ggccucucuggccuc

SEQ ID NO: 2376968 - RNA, 16 nt, Human
ggccucucuggccucc

SEQ ID NO: 2376969 - RNA, 17 nt, Human
ggccucucuggccuccc

SEQ ID NO: 2376970 - RNA, 19 nt, Human
ggccucucuggccucccac

SEQ ID NO: 2376971 - RNA, 20 nt, Human
ggccucucuggccucccacc

SEQ ID NO: 2376972 - RNA, 21 nt, Human
ggccucucuggccucccaccc

SEQ ID NO: 2376973 - RNA, 23 nt, Human
ggccuagauccacacacagagga

SEQ ID NO: 2376974 - RNA, 17 nt, Human
ggccuagauccacacac

SEQ ID NO: 2376975 - RNA, 21 nt, Human
ggccucaacccucccucagcc

SEQ ID NO: 2376976 - RNA, 22 nt, Human
ggccuagcauacguacacauuu

SEQ ID NO: 2376977 - RNA, 20 nt, Human
ggccuagcauacguacacau

SEQ ID NO: 2376978 - RNA, 18 nt, Human
ggccuccucuguccaggg

SEQ ID NO: 2376979 - RNA, 15 nt, Human
ggccucaaggacuug

SEQ ID NO: 2376980 - RNA, 22 nt, Human
ggccuccucacaacaugguguc

SEQ ID NO: 2376981 - RNA, 18 nt, Human
ggccucaagaucaaugaa

SEQ ID NO: 2376982 - RNA, 23 nt, Human
ggccucaacccucccucagcccc

SEQ ID NO: 2376983 - RNA, 22 nt, Human
ggccucaacccucccucagccc

SEQ ID NO: 2376984 - RNA, 12 nt, Human
ggccucaagauc

SEQ ID NO: 2376985 - RNA, 21 nt, Human
ggccuccguccaggagccugg

SEQ ID NO: 2376986 - RNA, 14 nt, Human
ggccucaagugauu

SEQ ID NO: 2376987 - RNA, 22 nt, Human
ggccucaagugauucuccugcc

SEQ ID NO: 2376988 - RNA, 13 nt, Human
ggccggggccggg

SEQ ID NO: 2376989 - RNA, 15 nt, Human
ggccgggagccugau

SEQ ID NO: 2376990 - RNA, 22 nt, Human
ggccggcuucaugccagcuacu

SEQ ID NO: 2376991 - RNA, 18 nt, Human
ggccggcgagcccugugg

SEQ ID NO: 2376992 - RNA, 17 nt, Human
ggccggcgagcccugug

SEQ ID NO: 2376993 - RNA, 23 nt, Human
ggccgggaccccgagccuggcuc

SEQ ID NO: 2376994 - RNA, 22 nt, Human
ggccgggaccccgagccuggcu

SEQ ID NO: 2376995 - RNA, 13 nt, Human
ggccguggcugcc

SEQ ID NO: 2376996 - RNA, 16 nt, Human
ggccguggcugcccac

SEQ ID NO: 2376997 - RNA, 14 nt, Human
ggccgugggccugg

SEQ ID NO: 2376998 - RNA, 16 nt, Human
ggccuaaaaguaaaca

SEQ ID NO: 2376999 - RNA, 13 nt, Human
ggccguuggccac

SEQ ID NO: 2377000 - RNA, 17 nt, Human
ggccgugggccuggggu

SEQ ID NO: 2377001 - RNA, 19 nt, Human
ggccguugauguuggcugg

SEQ ID NO: 2377002 - RNA, 21 nt, Human
ggccguugauguuggcuggga

SEQ ID NO: 2377003 - RNA, 17 nt, Human
ggccuaaaaguaaacau

SEQ ID NO: 2377004 - RNA, 22 nt, Human
ggcccagaucuggucccuugca

SEQ ID NO: 2377005 - RNA, 15 nt, Human
ggcccagcauugcug

SEQ ID NO: 2377006 - RNA, 17 nt, Human
ggcccagcauugcuggu

SEQ ID NO: 2377007 - RNA, 15 nt, Human
ggccggcgagcccug

SEQ ID NO: 2377008 - RNA, 20 nt, Human
ggcccagcauugcugguucu

SEQ ID NO: 2377009 - RNA, 20 nt, Human
ggcccagagggccugcaagg

SEQ ID NO: 2377010 - RNA, 17 nt, Human
ggcccagagggccugca

SEQ ID NO: 2377011 - RNA, 19 nt, Human
ggcccagagggccugcaag

SEQ ID NO: 2377012 - RNA, 19 nt, Human
ggcccagagcccagcucca

SEQ ID NO: 2377013 - RNA, 18 nt, Human
ggcccagagcccagcucc

SEQ ID NO: 2377014 - RNA, 14 nt, Human
ggcccagagggccu

SEQ ID NO: 2377015 - RNA, 17 nt, Human
ggcccagagcccagcuc

SEQ ID NO: 2377016 - RNA, 16 nt, Human
ggcccagagcccagcu

SEQ ID NO: 2377017 - RNA, 15 nt, Human
ggcccagagcccagc

SEQ ID NO: 2377018 - RNA, 14 nt, Human
ggcccagagcccag

SEQ ID NO: 2377019 - RNA, 13 nt, Human
ggcccagagccca

SEQ ID NO: 2377020 - RNA, 12 nt, Human
ggcccagagccc

SEQ ID NO: 2377021 - RNA, 14 nt, Human
ggcccaccuggcca

SEQ ID NO: 2377022 - RNA, 15 nt, Human
ggcccaccuggccac

SEQ ID NO: 2377023 - RNA, 14 nt, Human
ggcccagagcagga

SEQ ID NO: 2377024 - RNA, 16 nt, Human
ggcccagagcaggaag

SEQ ID NO: 2377025 - RNA, 19 nt, Human
ggcaugagggaucacaggg

SEQ ID NO: 2377026 - RNA, 14 nt, Human
ggcaugagggauca

SEQ ID NO: 2377027 - RNA, 18 nt, Human
ggcauggggugggccucu

SEQ ID NO: 2377028 - RNA, 22 nt, Human
ggcaugccccggccaccucugc

SEQ ID NO: 2377029 - RNA, 15 nt, Human
ggcaugccccggcca

SEQ ID NO: 2377030 - RNA, 18 nt, Human
ggcaugccccggccaccu

SEQ ID NO: 2377031 - RNA, 19 nt, Human
ggcaugccccggccaccuc

SEQ ID NO: 2377032 - RNA, 20 nt, Human
ggcaugccccggccaccucu

SEQ ID NO: 2377033 - RNA, 19 nt, Human
ggcaugguacggagauguu

SEQ ID NO: 2377034 - RNA, 19 nt, Human
ggcaugguggcgcaagccu

SEQ ID NO: 2377035 - RNA, 21 nt, Human
ggcaugccccggccaccucug

SEQ ID NO: 2377036 - RNA, 19 nt, Human
ggcauggggugggccucug

SEQ ID NO: 2377037 - RNA, 21 nt, Human
ggcauggggugggccucuggu

SEQ ID NO: 2377038 - RNA, 21 nt, Human
ggcauguauuggccuggaggu

SEQ ID NO: 2377039 - RNA, 19 nt, Human
ggcauguauuggccuggag

SEQ ID NO: 2377040 - RNA, 20 nt, Human
ggcauguauuggccuggagg

SEQ ID NO: 2377041 - RNA, 15 nt, Human
ggcauguauuggccu

SEQ ID NO: 2377042 - RNA, 16 nt, Human
ggcauguauuggccug

SEQ ID NO: 2377043 - RNA, 17 nt, Human
ggcauguauuggccugg

SEQ ID NO: 2377044 - RNA, 18 nt, Human
ggcauguauuggccugga

SEQ ID NO: 2377045 - RNA, 21 nt, Human
ggcaugguggcgcaagccugu

SEQ ID NO: 2377046 - RNA, 20 nt, Human
ggcauggggugggccucugg

SEQ ID NO: 2377047 - RNA, 22 nt, Human
ggcaugguggcgcaagccugua

SEQ ID NO: 2377048 - RNA, 18 nt, Human
ggcaugugaugagaggaa

SEQ ID NO: 2377049 - RNA, 23 nt, Human
ggcaugugaugagaggaaaucac

SEQ ID NO: 2377050 - RNA, 23 nt, Human
ggcaguagcuguggugagguggg

SEQ ID NO: 2377051 - RNA, 19 nt, Human
ggcagucaccugcccagau

SEQ ID NO: 2377052 - RNA, 20 nt, Human
ggcagucauuggcugucucc

SEQ ID NO: 2377053 - RNA, 21 nt, Human
ggcaguagaaggucggaggcu

SEQ ID NO: 2377054 - RNA, 22 nt, Human
ggcagucauucagcaccagagc

SEQ ID NO: 2377055 - RNA, 19 nt, Human
ggcagucgauagagcugua

SEQ ID NO: 2377056 - RNA, 23 nt, Human
ggcagucauucagcaccagagca

SEQ ID NO: 2377057 - RNA, 14 nt, Human
ggcagucgggggcu

SEQ ID NO: 2377058 - RNA, 15 nt, Human
ggcagucgggggcug

SEQ ID NO: 2377059 - RNA, 18 nt, Human
ggcagucgggggcuggcc

SEQ ID NO: 2377060 - RNA, 19 nt, Human
ggcagucgggggcuggccu

SEQ ID NO: 2377061 - RNA, 21 nt, Human
ggcagucgggggcuggccuag

SEQ ID NO: 2377062 - RNA, 20 nt, Human
ggcaguggagucggaagggc

SEQ ID NO: 2377063 - RNA, 22 nt, Human
ggcaugacacgaauauugcuga

SEQ ID NO: 2377064 - RNA, 21 nt, Human
ggcagaguucuauaauguaaa

SEQ ID NO: 2377065 - RNA, 12 nt, Human
ggcagcugccac

SEQ ID NO: 2377066 - RNA, 11 nt, Human
ggcagcugcca

SEQ ID NO: 2377067 - RNA, 17 nt, Human
ggcagcugaccauggaa

SEQ ID NO: 2377068 - RNA, 17 nt, Human
ggcagcugccagagaag

SEQ ID NO: 2377069 - RNA, 16 nt, Human
ggcagcugccagagaa

SEQ ID NO: 2377070 - RNA, 15 nt, Human
ggcagcugccagaga

SEQ ID NO: 2377071 - RNA, 14 nt, Human
ggcagcugccagag

SEQ ID NO: 2377072 - RNA, 21 nt, Human
ggcagcugcgguccacccagg

SEQ ID NO: 2377073 - RNA, 18 nt, Human
ggcagagguuguggugag

SEQ ID NO: 2377074 - RNA, 17 nt, Human
ggcagaguugaagacag

SEQ ID NO: 2377075 - RNA, 19 nt, Human
ggcagaguugaagacagag

SEQ ID NO: 2377076 - RNA, 21 nt, Human
ggcagaguugaagacagagcu

SEQ ID NO: 2377077 - RNA, 17 nt, Human
ggcagggucaggagagg

SEQ ID NO: 2377078 - RNA, 15 nt, Human
ggcagggucaggaga

SEQ ID NO: 2377079 - RNA, 14 nt, Human
ggcaguaauaaaaa

SEQ ID NO: 2377080 - RNA, 17 nt, Human
ggcagguuggugggggc

SEQ ID NO: 2377081 - RNA, 17 nt, Human
ggcagggucucacucug

SEQ ID NO: 2377082 - RNA, 18 nt, Human
ggcagggucucacucugu

SEQ ID NO: 2377083 - RNA, 12 nt, Human
ggcaggguccua

SEQ ID NO: 2377084 - RNA, 23 nt, Human
ggcagcugcgguccacccaggag

SEQ ID NO: 2377085 - RNA, 24 nt, Human
ggcagcugcgguccacccaggagc

SEQ ID NO: 2377086 - RNA, 15 nt, Human
ggccacuuuugacua

SEQ ID NO: 2377087 - RNA, 21 nt, Human
ggccacuucuggguggggcag

SEQ ID NO: 2377088 - RNA, 17 nt, Human
ggccagacacaggcccu

SEQ ID NO: 2377089 - RNA, 16 nt, Human
ggccagacacaggccc

SEQ ID NO: 2377090 - RNA, 16 nt, Human
ggccaggacaggcccg

SEQ ID NO: 2377091 - RNA, 15 nt, Human
ggccaggacaggccc

SEQ ID NO: 2377092 - RNA, 15 nt, Human
ggccagacaugccac

SEQ ID NO: 2377093 - RNA, 18 nt, Human
ggccagacacaggcccuc

SEQ ID NO: 2377094 - RNA, 22 nt, Human
ggccaccugaggugggcccagg

SEQ ID NO: 2377095 - RNA, 23 nt, Human
ggccaccugaggugggcccagga

SEQ ID NO: 2377096 - RNA, 13 nt, Human
ggccaccugcccc

SEQ ID NO: 2377097 - RNA, 15 nt, Human
ggccacuucugggug

SEQ ID NO: 2377098 - RNA, 20 nt, Human
ggccacugugaagagaacca

SEQ ID NO: 2377099 - RNA, 16 nt, Human
ggccaccugagguggg

SEQ ID NO: 2377100 - RNA, 17 nt, Human
ggccaccugaggugggc

SEQ ID NO: 2377101 - RNA, 19 nt, Human
ggccaccugaggugggccc

SEQ ID NO: 2377102 - RNA, 20 nt, Human
ggccaccugaggugggccca

SEQ ID NO: 2377103 - RNA, 21 nt, Human
ggccaccugaggugggcccag

SEQ ID NO: 2377104 - RNA, 12 nt, Human
ggccaccucugc

SEQ ID NO: 2377105 - RNA, 23 nt, Human
ggccaccucugcggaccccagcu

SEQ ID NO: 2377106 - RNA, 14 nt, Human
ggccaccucuccaa

SEQ ID NO: 2377107 - RNA, 15 nt, Human
ggccaccucuccaag

SEQ ID NO: 2377108 - RNA, 18 nt, Human
ggccaccucuccaagggc

SEQ ID NO: 2377109 - RNA, 20 nt, Human
ggccaccucuccaagggcuu

SEQ ID NO: 2377110 - RNA, 22 nt, Human
ggccacagaggacucacuugcc

SEQ ID NO: 2377111 - RNA, 20 nt, Human
ggccacagggcgagacuccg

SEQ ID NO: 2377112 - RNA, 23 nt, Human
ggccacagggcgagacuccgucu

SEQ ID NO: 2377113 - RNA, 14 nt, Human
ggccacaguuguuu

SEQ ID NO: 2377114 - RNA, 20 nt, Human
ggccacaguagucuugauga

SEQ ID NO: 2377115 - RNA, 16 nt, Human
ggccacaguuguuuga

SEQ ID NO: 2377116 - RNA, 16 nt, Human
ggccacaucaaagagg

SEQ ID NO: 2377117 - RNA, 11 nt, Human
ggccaccucuc

SEQ ID NO: 2377118 - RNA, 13 nt, Human
ggccaccucucca

SEQ ID NO: 2377119 - RNA, 17 nt, Human
ggccaccuccccagcau

SEQ ID NO: 2377120 - RNA, 19 nt, Human
ggccacaucaaagaggcug

SEQ ID NO: 2377121 - RNA, 13 nt, Human
ggccaccucccca

SEQ ID NO: 2377122 - RNA, 16 nt, Human
ggccaccuccccagca

SEQ ID NO: 2377123 - RNA, 13 nt, Human
ggcauguggccug

SEQ ID NO: 2377124 - RNA, 15 nt, Human
ggcauguggccugug

SEQ ID NO: 2377125 - RNA, 16 nt, Human
ggcauguggccugugg

SEQ ID NO: 2377126 - RNA, 17 nt, Human
ggcauguggccuguggc

SEQ ID NO: 2377127 - RNA, 23 nt, Human
ggcauguguuuacuuuauguuac

SEQ ID NO: 2377128 - RNA, 19 nt, Human
ggcauguggccuguggccu

SEQ ID NO: 2377129 - RNA, 20 nt, Human
ggcauguggccuguggccug

SEQ ID NO: 2377130 - RNA, 20 nt, Human
ggcauguucucugaggacac

SEQ ID NO: 2377131 - RNA, 22 nt, Human
ggccacagaaaauucuucucca

SEQ ID NO: 2377132 - RNA, 21 nt, Human
ggccacacucagcacaaggcc

SEQ ID NO: 2377133 - RNA, 17 nt, Human
ggcauguguauguuccc

SEQ ID NO: 2377134 - RNA, 16 nt, Human
ggccacacucagcaca

SEQ ID NO: 2377135 - RNA, 14 nt, Human
ggcauguuccucug

SEQ ID NO: 2377136 - RNA, 14 nt, Human
ggcccacagcuccc

SEQ ID NO: 2377137 - RNA, 13 nt, Human
ggcccacagcucc

SEQ ID NO: 2377138 - RNA, 19 nt, Human
ggcccacagcaggugcuga

SEQ ID NO: 2377139 - RNA, 23 nt, Human
ggcccacagcaggugcugagcaa

SEQ ID NO: 2377140 - RNA, 16 nt, Human
ggccauggagagcugg

SEQ ID NO: 2377141 - RNA, 17 nt, Human
ggccauggagagcugga

SEQ ID NO: 2377142 - RNA, 21 nt, Human
ggccauggagagcuggagccu

SEQ ID NO: 2377143 - RNA, 14 nt, Human
ggccauggagagcu

SEQ ID NO: 2377144 - RNA, 17 nt, Human
ggccaugcugaagggac

SEQ ID NO: 2377145 - RNA, 13 nt, Human
ggccaugcugagg

SEQ ID NO: 2377146 - RNA, 14 nt, Human
ggccaugcugaggc

SEQ ID NO: 2377147 - RNA, 15 nt, Human
ggccaugcugaggcc

SEQ ID NO: 2377148 - RNA, 18 nt, Human
ggccaugcugaggccugg

SEQ ID NO: 2377149 - RNA, 19 nt, Human
ggccaugcugaggccuggg

SEQ ID NO: 2377150 - RNA, 22 nt, Human
ggccaugcugaggccugggccg

SEQ ID NO: 2377151 - RNA, 19 nt, Human
ggcccacagcucccacccc

SEQ ID NO: 2377152 - RNA, 18 nt, Human
ggcccacagcucccaccc

SEQ ID NO: 2377153 - RNA, 17 nt, Human
ggcccacagcucccacc

SEQ ID NO: 2377154 - RNA, 15 nt, Human
ggcccacagcuccca

SEQ ID NO: 2377155 - RNA, 20 nt, Human
ggcccacagcucccacccca

SEQ ID NO: 2377156 - RNA, 20 nt, Human
ggcccacagggaacccugcu

SEQ ID NO: 2377157 - RNA, 15 nt, Human
ggcccaccagagcug

SEQ ID NO: 2377158 - RNA, 12 nt, Human
ggcccaccuggc

SEQ ID NO: 2377159 - RNA, 16 nt, Human
ggcccaccuggccacc

SEQ ID NO: 2377160 - RNA, 11 nt, Human
ggccaggagcc

SEQ ID NO: 2377161 - RNA, 13 nt, Human
ggccaggacugag

SEQ ID NO: 2377162 - RNA, 20 nt, Human
ggccaggacugagccccgca

SEQ ID NO: 2377163 - RNA, 15 nt, Human
ggccaggacugagcc

SEQ ID NO: 2377164 - RNA, 13 nt, Human
ggccaggagccuc

SEQ ID NO: 2377165 - RNA, 14 nt, Human
ggccaggcccucug

SEQ ID NO: 2377166 - RNA, 17 nt, Human
ggccaggcccucugccc

SEQ ID NO: 2377167 - RNA, 13 nt, Human
ggccaugccugcc

SEQ ID NO: 2377168 - RNA, 14 nt, Human
ggccaugccugccc

SEQ ID NO: 2377169 - RNA, 16 nt, Human
ggccaugcugaaggga

SEQ ID NO: 2377170 - RNA, 15 nt, Human
ggccaggcccucugc

SEQ ID NO: 2377171 - RNA, 16 nt, Human
ggccaggcccucugcc

SEQ ID NO: 2377172 - RNA, 22 nt, Human
ggcagagccuuuggaugaccag

SEQ ID NO: 2377173 - RNA, 16 nt, Human
ggcagagccgggaagc

SEQ ID NO: 2377174 - RNA, 16 nt, Human
ggcagagcccaaggga

SEQ ID NO: 2377175 - RNA, 12 nt, Human
ggcagagcccaa

SEQ ID NO: 2377176 - RNA, 22 nt, Human
ggcagagcagagaccaucccug

SEQ ID NO: 2377177 - RNA, 22 nt, Human
ggcacucacagaccuggagccc

SEQ ID NO: 2377178 - RNA, 23 nt, Human
ggcacucacagaccuggagcccc

SEQ ID NO: 2377179 - RNA, 16 nt, Human
ggcagagggcagaggc

SEQ ID NO: 2377180 - RNA, 14 nt, Human
ggcagagggcagag

SEQ ID NO: 2377181 - RNA, 23 nt, Human
ggcagaggcuggaggcagggccu

SEQ ID NO: 2377182 - RNA, 22 nt, Human
ggcagaggcuggaggcagggcc

SEQ ID NO: 2377183 - RNA, 20 nt, Human
ggcagagggcagaggcugga

SEQ ID NO: 2377184 - RNA, 19 nt, Human
ggcagagggcagaggcugg

SEQ ID NO: 2377185 - RNA, 21 nt, Human
ggcagaggcuggaggcagggc

SEQ ID NO: 2377186 - RNA, 19 nt, Human
ggcagagcuggcucugagc

SEQ ID NO: 2377187 - RNA, 16 nt, Human
ggcagagcuggcucug

SEQ ID NO: 2377188 - RNA, 17 nt, Human
ggcagagcuggcucuga

SEQ ID NO: 2377189 - RNA, 18 nt, Human
ggcagagguucauuucaa

SEQ ID NO: 2377190 - RNA, 21 nt, Human
ggcagagguugcagugagccg

SEQ ID NO: 2377191 - RNA, 20 nt, Human
ggcacccaccaucaugucug

SEQ ID NO: 2377192 - RNA, 18 nt, Human
ggcacccggccccugcug

SEQ ID NO: 2377193 - RNA, 19 nt, Human
ggcacccggccccugcugg

SEQ ID NO: 2377194 - RNA, 20 nt, Human
ggcacccggccccugcuggu

SEQ ID NO: 2377195 - RNA, 20 nt, Human
ggcacccacaagugccacug

SEQ ID NO: 2377196 - RNA, 18 nt, Human
ggcacucagaagacacug

SEQ ID NO: 2377197 - RNA, 19 nt, Human
ggcacucagaagacacuga

SEQ ID NO: 2377198 - RNA, 20 nt, Human
ggcacucagaagacacugau

SEQ ID NO: 2377199 - RNA, 18 nt, Human
ggcacucaaugcagccag

SEQ ID NO: 2377200 - RNA, 23 nt, Human
ggcacucaaugcagccagaccua

SEQ ID NO: 2377201 - RNA, 17 nt, Human
ggcacucacagaccugg

SEQ ID NO: 2377202 - RNA, 21 nt, Human
ggcacucacagaccuggagcc

SEQ ID NO: 2377203 - RNA, 17 nt, Human
ggcaccagggguuucuc

SEQ ID NO: 2377204 - RNA, 17 nt, Human
ggcaccagcagccugga

SEQ ID NO: 2377205 - RNA, 12 nt, Human
ggcaaggcaggu

SEQ ID NO: 2377206 - RNA, 13 nt, Human
ggcaaggcaggug

SEQ ID NO: 2377207 - RNA, 14 nt, Human
ggcaaggcaggugc

SEQ ID NO: 2377208 - RNA, 22 nt, Human
ggcaaggcaggugccuccaggu

SEQ ID NO: 2377209 - RNA, 18 nt, Human
ggcaagcaccuccugccu

SEQ ID NO: 2377210 - RNA, 19 nt, Human
ggcaagcaccuccugccuc

SEQ ID NO: 2377211 - RNA, 22 nt, Human
ggcaagcuuggcuguagaagga

SEQ ID NO: 2377212 - RNA, 16 nt, Human
ggcaaggacacagaug

SEQ ID NO: 2377213 - RNA, 23 nt, Human
ggcaagcugugacuucuccaggu

SEQ ID NO: 2377214 - RNA, 14 nt, Human
ggcaaggacacaga

SEQ ID NO: 2377215 - RNA, 22 nt, Human
ggcaagcugugacuucuccagg

SEQ ID NO: 2377216 - RNA, 20 nt, Human
ggcaagcuagaaccuggagg

SEQ ID NO: 2377217 - RNA, 19 nt, Human
ggcaagauuuuccuuuuuu

SEQ ID NO: 2377218 - RNA, 19 nt, Human
ggcaagccccugcccaucu

SEQ ID NO: 2377219 - RNA, 18 nt, Human
ggcaagcuagaaccugga

SEQ ID NO: 2377220 - RNA, 19 nt, Human
ggauucugggaggaagcag

SEQ ID NO: 2377221 - RNA, 14 nt, Human
ggauucugguucca

SEQ ID NO: 2377222 - RNA, 18 nt, Human
ggauucugguuccagggu

SEQ ID NO: 2377223 - RNA, 19 nt, Human
ggauucugguuccaggguc

SEQ ID NO: 2377224 - RNA, 21 nt, Human
ggauucuuccucccucccucu

SEQ ID NO: 2377225 - RNA, 18 nt, Human
ggauucuuuccauuauga

SEQ ID NO: 2377226 - RNA, 13 nt, Human
ggauucuuggccc

SEQ ID NO: 2377227 - RNA, 23 nt, Human
ggauucuguacaugcauugagcu

SEQ ID NO: 2377228 - RNA, 19 nt, Human
ggcaagagcccccuugaca

SEQ ID NO: 2377229 - RNA, 22 nt, Human
ggcaagagcccccuugacaccg

SEQ ID NO: 2377230 - RNA, 16 nt, Human
ggcaagagggggugga

SEQ ID NO: 2377231 - RNA, 12 nt, Human
ggcaagauuuuc

SEQ ID NO: 2377232 - RNA, 12 nt, Human
ggcaagaggggu

SEQ ID NO: 2377233 - RNA, 14 nt, Human
ggcaagaggggugg

SEQ ID NO: 2377234 - RNA, 17 nt, Human
ggcaagcaccuccugcc

SEQ ID NO: 2377235 - RNA, 14 nt, Human
ggauugaagcccuc

SEQ ID NO: 2377236 - RNA, 16 nt, Human
ggauugaagcccucca

SEQ ID NO: 2377237 - RNA, 13 nt, Human
ggauugagucugu

SEQ ID NO: 2377238 - RNA, 18 nt, Human
ggcaagaaggaauugacu

SEQ ID NO: 2377239 - RNA, 20 nt, Human
ggauugaucggagccuccuc

SEQ ID NO: 2377240 - RNA, 23 nt, Human
ggauucccaccaaggucuucagc

SEQ ID NO: 2377241 - RNA, 13 nt, Human
ggauuccugaccc

SEQ ID NO: 2377242 - RNA, 14 nt, Human
ggauuccugaccca

SEQ ID NO: 2377243 - RNA, 15 nt, Human
ggauuccugacccag

SEQ ID NO: 2377244 - RNA, 16 nt, Human
ggauuccugacccagg

SEQ ID NO: 2377245 - RNA, 18 nt, Human
ggauucauuuccugcccu

SEQ ID NO: 2377246 - RNA, 22 nt, Human
ggauucccaccaaggucuucag

SEQ ID NO: 2377247 - RNA, 13 nt, Human
ggauucugggagg

SEQ ID NO: 2377248 - RNA, 21 nt, Human
ggauucuggccuagucccuuc

SEQ ID NO: 2377249 - RNA, 23 nt, Human
ggauucuacuuuaagcacuacau

SEQ ID NO: 2377250 - RNA, 16 nt, Human
ggauucugagagcugu

SEQ ID NO: 2377251 - RNA, 19 nt, Human
ggauuccugacccaggccg

SEQ ID NO: 2377252 - RNA, 20 nt, Human
ggauuccugacccaggccgc

SEQ ID NO: 2377253 - RNA, 20 nt, Human
ggauucuacuuuaagcacua

SEQ ID NO: 2377254 - RNA, 15 nt, Human
ggauucaggcugcuu

SEQ ID NO: 2377255 - RNA, 14 nt, Human
ggauucaggcugcu

SEQ ID NO: 2377256 - RNA, 13 nt, Human
ggauucaggcugc

SEQ ID NO: 2377257 - RNA, 21 nt, Human
ggauucaggaauguguggccu

SEQ ID NO: 2377258 - RNA, 13 nt, Human
ggauucauuuccu

SEQ ID NO: 2377259 - RNA, 16 nt, Human
ggauucauuacagcuu

SEQ ID NO: 2377260 - RNA, 14 nt, Human
ggauucauuuccug

SEQ ID NO: 2377261 - RNA, 15 nt, Human
ggauucauuuccugc

SEQ ID NO: 2377262 - RNA, 16 nt, Human
ggauucauuuccugcc

SEQ ID NO: 2377263 - RNA, 17 nt, Human
ggauucauuuccugccc

SEQ ID NO: 2377264 - RNA, 19 nt, Human
ggauuauuuuuucagaccg

SEQ ID NO: 2377265 - RNA, 20 nt, Human
ggauuauuuuuucagaccga

SEQ ID NO: 2377266 - RNA, 17 nt, Human
ggauuauuuaauaacau

SEQ ID NO: 2377267 - RNA, 19 nt, Human
ggauuauuuaauaacauua

SEQ ID NO: 2377268 - RNA, 22 nt, Human
ggauuauuuaauaacauuaccu

SEQ ID NO: 2377269 - RNA, 13 nt, Human
ggauuauuuuuuc

SEQ ID NO: 2377270 - RNA, 14 nt, Human
ggauuauuuuuuca

SEQ ID NO: 2377271 - RNA, 16 nt, Human
ggauuauuuuuucaga

SEQ ID NO: 2377272 - RNA, 17 nt, Human
ggauuauuuuuucagac

SEQ ID NO: 2377273 - RNA, 18 nt, Human
ggauuauuuuuucagacc

SEQ ID NO: 2377274 - RNA, 23 nt, Human
ggaugcccagggccacucugccu

SEQ ID NO: 2377275 - RNA, 12 nt, Human
ggaugcccugga

SEQ ID NO: 2377276 - RNA, 15 nt, Human
ggaugcccuggaggu

SEQ ID NO: 2377277 - RNA, 13 nt, Human
ggaugcccuggag

SEQ ID NO: 2377278 - RNA, 21 nt, Human
ggaugcccuggagguggcuga

SEQ ID NO: 2377279 - RNA, 18 nt, Human
ggaugcccuggagguggc

SEQ ID NO: 2377280 - RNA, 12 nt, Human
ggauuauauuau

SEQ ID NO: 2377281 - RNA, 15 nt, Human
ggauuauucauuuaa

SEQ ID NO: 2377282 - RNA, 17 nt, Human
ggauuauucauuuaaaa

SEQ ID NO: 2377283 - RNA, 19 nt, Human
ggauuauucauuuaaaaug

SEQ ID NO: 2377284 - RNA, 21 nt, Human
ggauuauucauuuaaaaugau

SEQ ID NO: 2377285 - RNA, 22 nt, Human
ggauuauucauuuaaaaugauu

SEQ ID NO: 2377286 - RNA, 18 nt, Human
ggaugccugguggcagcu

SEQ ID NO: 2377287 - RNA, 19 nt, Human
ggaugccugguggcagcug

SEQ ID NO: 2377288 - RNA, 20 nt, Human
ggaugccugguggcagcugc

SEQ ID NO: 2377289 - RNA, 21 nt, Human
ggaugccugguggcagcugcg

SEQ ID NO: 2377290 - RNA, 15 nt, Human
ggaugaugccucaug

SEQ ID NO: 2377291 - RNA, 17 nt, Human
ggaugaggugcugggag

SEQ ID NO: 2377292 - RNA, 23 nt, Human
ggaugaguacccaaaagcucagc

SEQ ID NO: 2377293 - RNA, 18 nt, Human
ggaugaugacuauggaaa

SEQ ID NO: 2377294 - RNA, 18 nt, Human
ggaugcccaaagaugcag

SEQ ID NO: 2377295 - RNA, 14 nt, Human
ggaugaugccacac

SEQ ID NO: 2377296 - RNA, 16 nt, Human
ggaugauucagaaauu

SEQ ID NO: 2377297 - RNA, 20 nt, Human
ggaugauucagaaauuggaa

SEQ ID NO: 2377298 - RNA, 21 nt, Human
ggaugauucagaaauuggaac

SEQ ID NO: 2377299 - RNA, 22 nt, Human
ggaugccaauauuaaaucugcu

SEQ ID NO: 2377300 - RNA, 22 nt, Human
ggaugcccagggccacucugcc

SEQ ID NO: 2377301 - RNA, 19 nt, Human
ggaugccaucugugggcac

SEQ ID NO: 2377302 - RNA, 18 nt, Human
ggaugccaucugugggca

SEQ ID NO: 2377303 - RNA, 17 nt, Human
ggaugccccgucccccu

SEQ ID NO: 2377304 - RNA, 19 nt, Human
ggaugcccaaagaugcagc

SEQ ID NO: 2377305 - RNA, 13 nt, Human
ggaugccuggugg

SEQ ID NO: 2377306 - RNA, 17 nt, Human
ggaugccugguggcagc

SEQ ID NO: 2377307 - RNA, 18 nt, Human
ggaugaggugcugggagg

SEQ ID NO: 2377308 - RNA, 16 nt, Human
ggaugaggugcuggga

SEQ ID NO: 2377309 - RNA, 15 nt, Human
ggaugagcuggaagg

SEQ ID NO: 2377310 - RNA, 20 nt, Human
ggaugaggccgcuagaggcc

SEQ ID NO: 2377311 - RNA, 21 nt, Human
ggaugaggccgcuagaggccu

SEQ ID NO: 2377312 - RNA, 16 nt, Human
ggaugaucuaggaaga

SEQ ID NO: 2377313 - RNA, 18 nt, Human
ggaugaucuaggaagacu

SEQ ID NO: 2377314 - RNA, 22 nt, Human
ggaugaucuaggaagacuuugg

SEQ ID NO: 2377315 - RNA, 13 nt, Human
ggaugagcauuua

SEQ ID NO: 2377316 - RNA, 23 nt, Human
ggaguccccuccccggcccuacc

SEQ ID NO: 2377317 - RNA, 17 nt, Human
ggaugagcauggagcug

SEQ ID NO: 2377318 - RNA, 19 nt, Human
ggaugagcauggagcuggc

SEQ ID NO: 2377319 - RNA, 20 nt, Human
ggaugagcauggagcuggcc

SEQ ID NO: 2377320 - RNA, 15 nt, Human
ggagucccgucagga

SEQ ID NO: 2377321 - RNA, 13 nt, Human
ggaguccccuccc

SEQ ID NO: 2377322 - RNA, 21 nt, Human
ggaguccccuccccggcccua

SEQ ID NO: 2377323 - RNA, 20 nt, Human
ggaugagaguuuuggaugca

SEQ ID NO: 2377324 - RNA, 22 nt, Human
ggaugagaguuuuggaugcagu

SEQ ID NO: 2377325 - RNA, 23 nt, Human
ggagucccaccuuggcugcaggg

SEQ ID NO: 2377326 - RNA, 15 nt, Human
ggagucagugccagg

SEQ ID NO: 2377327 - RNA, 14 nt, Human
ggagucagugccag

SEQ ID NO: 2377328 - RNA, 13 nt, Human
ggaguccccucac

SEQ ID NO: 2377329 - RNA, 15 nt, Human
ggaguccccucaccu

SEQ ID NO: 2377330 - RNA, 17 nt, Human
ggaccaucauccuacug

SEQ ID NO: 2377331 - RNA, 16 nt, Human
ggacccaaugcacaca

SEQ ID NO: 2377332 - RNA, 14 nt, Human
ggaccauccuauuu

SEQ ID NO: 2377333 - RNA, 19 nt, Human
ggaccagucaaccugggca

SEQ ID NO: 2377334 - RNA, 17 nt, Human
ggaccagggcagggcca

SEQ ID NO: 2377335 - RNA, 13 nt, Human
ggaccaggcaaug

SEQ ID NO: 2377336 - RNA, 23 nt, Human
ggaccaggcaaugugacuuugca

SEQ ID NO: 2377337 - RNA, 20 nt, Human
ggaccuuuccaccacagcca

SEQ ID NO: 2377338 - RNA, 22 nt, Human
ggacgcagcaggaggccaggcc

SEQ ID NO: 2377339 - RNA, 14 nt, Human
ggacgacucugacc

SEQ ID NO: 2377340 - RNA, 18 nt, Human
ggaccuuuccaccacagc

SEQ ID NO: 2377341 - RNA, 19 nt, Human
ggaccuuuccaccacagcc

SEQ ID NO: 2377342 - RNA, 22 nt, Human
ggaccuuuccaccacagccagc

SEQ ID NO: 2377343 - RNA, 18 nt, Human
ggaccuugaacuggguac

SEQ ID NO: 2377344 - RNA, 19 nt, Human
ggacccaauguaggagcug

SEQ ID NO: 2377345 - RNA, 10 nt, Human
ggacccagac

SEQ ID NO: 2377346 - RNA, 12 nt, Human
ggacccagaccc

SEQ ID NO: 2377347 - RNA, 13 nt, Human
ggacccagaccca

SEQ ID NO: 2377348 - RNA, 19 nt, Human
ggaccuuuagugguggcca

SEQ ID NO: 2377349 - RNA, 15 nt, Human
ggaccuuucagcugu

SEQ ID NO: 2377350 - RNA, 17 nt, Human
ggaccuuucagcuguga

SEQ ID NO: 2377351 - RNA, 23 nt, Human
ggacgcagcaggaggccaggccg

SEQ ID NO: 2377352 - RNA, 13 nt, Human
ggacgcuucugaa

SEQ ID NO: 2377353 - RNA, 21 nt, Human
ggacucuugcucuuucuacuc

SEQ ID NO: 2377354 - RNA, 19 nt, Human
ggacgcucucuggccuucg

SEQ ID NO: 2377355 - RNA, 16 nt, Human
ggacgcucucuggccu

SEQ ID NO: 2377356 - RNA, 15 nt, Human
ggacgccacccagca

SEQ ID NO: 2377357 - RNA, 17 nt, Human
ggacugaaaaccucucc

SEQ ID NO: 2377358 - RNA, 16 nt, Human
ggacugaaaaccucuc

SEQ ID NO: 2377359 - RNA, 18 nt, Human
ggacugaaaaccucuccu

SEQ ID NO: 2377360 - RNA, 14 nt, Human
ggacugaagccugc

SEQ ID NO: 2377361 - RNA, 19 nt, Human
ggacucuuugguggcuuug

SEQ ID NO: 2377362 - RNA, 19 nt, Human
ggacugaauuguccccagu

SEQ ID NO: 2377363 - RNA, 19 nt, Human
ggacugaagccugcaggag

SEQ ID NO: 2377364 - RNA, 17 nt, Human
ggacugaagccugcagg

SEQ ID NO: 2377365 - RNA, 16 nt, Human
ggacugaagccugcag

SEQ ID NO: 2377366 - RNA, 16 nt, Human
ggacugacacccaugu

SEQ ID NO: 2377367 - RNA, 14 nt, Human
ggacugagaaauuu

SEQ ID NO: 2377368 - RNA, 22 nt, Human
ggagacagccccagagcagggu

SEQ ID NO: 2377369 - RNA, 23 nt, Human
ggagacagccccagagcagggug

SEQ ID NO: 2377370 - RNA, 21 nt, Human
ggagacagccccagagcaggg

SEQ ID NO: 2377371 - RNA, 20 nt, Human
ggagacagccccagagcagg

SEQ ID NO: 2377372 - RNA, 14 nt, Human
ggagaagggaugga

SEQ ID NO: 2377373 - RNA, 20 nt, Human
ggagaaggaucuagaaugug

SEQ ID NO: 2377374 - RNA, 21 nt, Human
ggagaagggauggaggucaca

SEQ ID NO: 2377375 - RNA, 22 nt, Human
ggagaagucuuagacuugaaau

SEQ ID NO: 2377376 - RNA, 16 nt, Human
ggagaagcagugagcc

SEQ ID NO: 2377377 - RNA, 15 nt, Human
ggagaagcagugagc

SEQ ID NO: 2377378 - RNA, 13 nt, Human
ggagaagcaugaa

SEQ ID NO: 2377379 - RNA, 19 nt, Human
ggagaagcagugagccgca

SEQ ID NO: 2377380 - RNA, 18 nt, Human
ggagaagccacaggccug

SEQ ID NO: 2377381 - RNA, 23 nt, Human
ggagaagagcuguucacagccag

SEQ ID NO: 2377382 - RNA, 22 nt, Human
ggagaaggaaggagacucaccu

SEQ ID NO: 2377383 - RNA, 13 nt, Human
ggagaagcugaug

SEQ ID NO: 2377384 - RNA, 12 nt, Human
ggagaaggaucu

SEQ ID NO: 2377385 - RNA, 14 nt, Human
ggagaaggaucuag

SEQ ID NO: 2377386 - RNA, 17 nt, Human
ggagaaggaaggagacu

SEQ ID NO: 2377387 - RNA, 18 nt, Human
ggagaagcaugaaaaagc

SEQ ID NO: 2377388 - RNA, 19 nt, Human
ggagaagccacaggccuga

SEQ ID NO: 2377389 - RNA, 19 nt, Human
ggagaagcuccucucccca

SEQ ID NO: 2377390 - RNA, 16 nt, Human
ggagaagcugaugcuu

SEQ ID NO: 2377391 - RNA, 22 nt, Human
ggagaagaauuuucagacccca

SEQ ID NO: 2377392 - RNA, 13 nt, Human
ggagaagagagga

SEQ ID NO: 2377393 - RNA, 13 nt, Human
ggagaagaaguca

SEQ ID NO: 2377394 - RNA, 14 nt, Human
ggagaagagaggag

SEQ ID NO: 2377395 - RNA, 15 nt, Human
ggagaagagaggaga

SEQ ID NO: 2377396 - RNA, 16 nt, Human
ggagaagagaggagag

SEQ ID NO: 2377397 - RNA, 22 nt, Human
ggagaagagaggagaggagaga

SEQ ID NO: 2377398 - RNA, 15 nt, Human
ggagaagagcuguuc

SEQ ID NO: 2377399 - RNA, 11 nt, Human
ggagaagaacu

SEQ ID NO: 2377400 - RNA, 14 nt, Human
ggagaagaacugaa

SEQ ID NO: 2377401 - RNA, 21 nt, Human
ggagaacuccuaggguggcug

SEQ ID NO: 2377402 - RNA, 17 nt, Human
ggacugagggacucuga

SEQ ID NO: 2377403 - RNA, 13 nt, Human
ggacugaggccug

SEQ ID NO: 2377404 - RNA, 15 nt, Human
ggacugagccccgca

SEQ ID NO: 2377405 - RNA, 14 nt, Human
ggacugaggccuga

SEQ ID NO: 2377406 - RNA, 21 nt, Human
ggacugagggacucugaagcc

SEQ ID NO: 2377407 - RNA, 12 nt, Human
ggacugagccag

SEQ ID NO: 2377408 - RNA, 17 nt, Human
ggacugagccaguccca

SEQ ID NO: 2377409 - RNA, 18 nt, Human
ggacugagccagucccag

SEQ ID NO: 2377410 - RNA, 12 nt, Human
ggacugagcccc

SEQ ID NO: 2377411 - RNA, 18 nt, Human
ggacugagaaauuuauaa

SEQ ID NO: 2377412 - RNA, 23 nt, Human
ggacagacucacaaccugaaccu

SEQ ID NO: 2377413 - RNA, 17 nt, Human
ggacagaagcagcucuu

SEQ ID NO: 2377414 - RNA, 16 nt, Human
ggacagaagcagcucu

SEQ ID NO: 2377415 - RNA, 15 nt, Human
ggacagaagcagcuc

SEQ ID NO: 2377416 - RNA, 14 nt, Human
ggacagaagaaggc

SEQ ID NO: 2377417 - RNA, 23 nt, Human
ggacacuuugaaauguguuucug

SEQ ID NO: 2377418 - RNA, 14 nt, Human
ggacagaagcagcu

SEQ ID NO: 2377419 - RNA, 17 nt, Human
ggacacuucccucuguu

SEQ ID NO: 2377420 - RNA, 18 nt, Human
ggacacuucccucuguuu

SEQ ID NO: 2377421 - RNA, 21 nt, Human
ggacacuucccucuguuucuc

SEQ ID NO: 2377422 - RNA, 14 nt, Human
ggacacuuccugcc

SEQ ID NO: 2377423 - RNA, 15 nt, Human
ggacacuuccugccu

SEQ ID NO: 2377424 - RNA, 16 nt, Human
ggacacuuccugccua

SEQ ID NO: 2377425 - RNA, 20 nt, Human
ggacacuuugaaauguguuu

SEQ ID NO: 2377426 - RNA, 19 nt, Human
ggacagagacaccugcacc

SEQ ID NO: 2377427 - RNA, 18 nt, Human
ggacagagacaccugcac

SEQ ID NO: 2377428 - RNA, 17 nt, Human
ggacagagacaccugca

SEQ ID NO: 2377429 - RNA, 14 nt, Human
ggacagagacaccu

SEQ ID NO: 2377430 - RNA, 21 nt, Human
ggacagagacaccugcaccuc

SEQ ID NO: 2377431 - RNA, 20 nt, Human
ggacagagacaccugcaccu

SEQ ID NO: 2377432 - RNA, 14 nt, Human
ggacagaggcccca

SEQ ID NO: 2377433 - RNA, 18 nt, Human
ggacagaggccccagccu

SEQ ID NO: 2377434 - RNA, 17 nt, Human
ggacagaggccccagcc

SEQ ID NO: 2377435 - RNA, 16 nt, Human
ggacagaggccccagc

SEQ ID NO: 2377436 - RNA, 15 nt, Human
ggacagaggccccag

SEQ ID NO: 2377437 - RNA, 16 nt, Human
ggacagaggggguggc

SEQ ID NO: 2377438 - RNA, 23 nt, Human
ggacagaggccccagccucccug

SEQ ID NO: 2377439 - RNA, 20 nt, Human
ggacagaggccccagccucc

SEQ ID NO: 2377440 - RNA, 14 nt, Human
ggacagagccaugc

SEQ ID NO: 2377441 - RNA, 14 nt, Human
ggacagaggccugc

SEQ ID NO: 2377442 - RNA, 15 nt, Human
ggacagaggccugcc

SEQ ID NO: 2377443 - RNA, 16 nt, Human
ggacagaggccugccc

SEQ ID NO: 2377444 - RNA, 18 nt, Human
ggacacuuaacagaugca

SEQ ID NO: 2377445 - RNA, 16 nt, Human
ggacacuuaauacuac

SEQ ID NO: 2377446 - RNA, 15 nt, Human
ggacacuccuagaga

SEQ ID NO: 2377447 - RNA, 21 nt, Human
ggacacuccagugccagcaau

SEQ ID NO: 2377448 - RNA, 14 nt, Human
ggacacuccuagag

SEQ ID NO: 2377449 - RNA, 14 nt, Human
ggacacucagaccu

SEQ ID NO: 2377450 - RNA, 14 nt, Human
ggacacuccagugc

SEQ ID NO: 2377451 - RNA, 15 nt, Human
ggacacuccagugcc

SEQ ID NO: 2377452 - RNA, 16 nt, Human
ggacacuccagugcca

SEQ ID NO: 2377453 - RNA, 18 nt, Human
ggacacuccagugccagc

SEQ ID NO: 2377454 - RNA, 12 nt, Human
gcuuuucacugc

SEQ ID NO: 2377455 - RNA, 19 nt, Human
gcuuuuauuaaugcacuuu

SEQ ID NO: 2377456 - RNA, 22 nt, Human
gcuuuuauuaaugcacuuucua

SEQ ID NO: 2377457 - RNA, 15 nt, Human
gcuuuuauuguauaa

SEQ ID NO: 2377458 - RNA, 19 nt, Human
gcuuuuaugugaaacaugu

SEQ ID NO: 2377459 - RNA, 20 nt, Human
gcuuuuaugugaaacauguu

SEQ ID NO: 2377460 - RNA, 21 nt, Human
gcuuuuaugugaaacauguuu

SEQ ID NO: 2377461 - RNA, 15 nt, Human
gcuuuuauuaaugca

SEQ ID NO: 2377462 - RNA, 18 nt, Human
gcuuuuauuaaugcacuu

SEQ ID NO: 2377463 - RNA, 22 nt, Human
gcuuuuauagaggcuagcuucu

SEQ ID NO: 2377464 - RNA, 19 nt, Human
gcuuuuauagaggcuagcu

SEQ ID NO: 2377465 - RNA, 22 nt, Human
ggacagccacggccaggccaga

SEQ ID NO: 2377466 - RNA, 17 nt, Human
ggacagaggccugcccg

SEQ ID NO: 2377467 - RNA, 20 nt, Human
ggacagaggggguggccucc

SEQ ID NO: 2377468 - RNA, 14 nt, Human
ggacagccccaccc

SEQ ID NO: 2377469 - RNA, 16 nt, Human
ggacagccccacccug

SEQ ID NO: 2377470 - RNA, 15 nt, Human
ggacagccccacccu

SEQ ID NO: 2377471 - RNA, 16 nt, Human
ggacagccccuccucc

SEQ ID NO: 2377472 - RNA, 15 nt, Human
ggacagccccuccuc

SEQ ID NO: 2377473 - RNA, 11 nt, Human
ggacagcuccu

SEQ ID NO: 2377474 - RNA, 15 nt, Human
ggacagcuccuucug

SEQ ID NO: 2377475 - RNA, 16 nt, Human
ggacagcuccuucugu

SEQ ID NO: 2377476 - RNA, 17 nt, Human
ggacagcuccuucuguc

SEQ ID NO: 2377477 - RNA, 21 nt, Human
ggacagccuguggcggugccu

SEQ ID NO: 2377478 - RNA, 17 nt, Human
ggacagccccacccugg

SEQ ID NO: 2377479 - RNA, 17 nt, Human
ggacauuugcucaugga

SEQ ID NO: 2377480 - RNA, 14 nt, Human
ggaccagagcugcc

SEQ ID NO: 2377481 - RNA, 20 nt, Human
ggacauuugcucauggaauu

SEQ ID NO: 2377482 - RNA, 23 nt, Human
ggacagccuguggcggugccugg

SEQ ID NO: 2377483 - RNA, 22 nt, Human
ggacagccuguggcggugccug

SEQ ID NO: 2377484 - RNA, 15 nt, Human
ggacauuuuuucagu

SEQ ID NO: 2377485 - RNA, 19 nt, Human
ggaccagagcugccaccug

SEQ ID NO: 2377486 - RNA, 13 nt, Human
ggaccagcucagg

SEQ ID NO: 2377487 - RNA, 17 nt, Human
ggaccagccuguuggac

SEQ ID NO: 2377488 - RNA, 17 nt, Human
ggagcuccacucugcuu

SEQ ID NO: 2377489 - RNA, 23 nt, Human
ggagcucacuguggugucugugu

SEQ ID NO: 2377490 - RNA, 20 nt, Human
ggagcucacuguggugucug

SEQ ID NO: 2377491 - RNA, 14 nt, Human
ggagcucagagagg

SEQ ID NO: 2377492 - RNA, 17 nt, Human
ggagcucagagagggca

SEQ ID NO: 2377493 - RNA, 20 nt, Human
ggagcucagagagggcaggc

SEQ ID NO: 2377494 - RNA, 15 nt, Human
ggagcuaucaggaac

SEQ ID NO: 2377495 - RNA, 22 nt, Human
ggagcuaucaggaacagcuaug

SEQ ID NO: 2377496 - RNA, 19 nt, Human
ggagcuaacacuggccccu

SEQ ID NO: 2377497 - RNA, 18 nt, Human
ggagcuaacacuggcccc

SEQ ID NO: 2377498 - RNA, 17 nt, Human
ggagcuaacacuggccc

SEQ ID NO: 2377499 - RNA, 16 nt, Human
ggagcuaacacuggcc

SEQ ID NO: 2377500 - RNA, 17 nt, Human
ggagcgggaccuguggc

SEQ ID NO: 2377501 - RNA, 15 nt, Human
ggagcgguggcccug

SEQ ID NO: 2377502 - RNA, 14 nt, Human
ggagcgugggaggc

SEQ ID NO: 2377503 - RNA, 22 nt, Human
ggagcgguggcccugucccucc

SEQ ID NO: 2377504 - RNA, 15 nt, Human
ggagcggaaagcagc

SEQ ID NO: 2377505 - RNA, 14 nt, Human
ggagcggaaagcag

SEQ ID NO: 2377506 - RNA, 23 nt, Human
ggagcgcaccugcccccuggugg

SEQ ID NO: 2377507 - RNA, 21 nt, Human
ggagcgcaccugcccccuggu

SEQ ID NO: 2377508 - RNA, 19 nt, Human
ggagcgcaccugcccccug

SEQ ID NO: 2377509 - RNA, 16 nt, Human
ggagcggaaagcagcu

SEQ ID NO: 2377510 - RNA, 20 nt, Human
ggagcggccggccagccccu

SEQ ID NO: 2377511 - RNA, 13 nt, Human
ggagcgggaccug

SEQ ID NO: 2377512 - RNA, 16 nt, Human
ggagcgggaccugugg

SEQ ID NO: 2377513 - RNA, 15 nt, Human
ggagcgcaccugccc

SEQ ID NO: 2377514 - RNA, 20 nt, Human
ggagccuuugguucuggcca

SEQ ID NO: 2377515 - RNA, 19 nt, Human
ggagccuguguaacagcuc

SEQ ID NO: 2377516 - RNA, 20 nt, Human
ggagccuguguaacagcucc

SEQ ID NO: 2377517 - RNA, 21 nt, Human
ggagccuguguaacagcuccu

SEQ ID NO: 2377518 - RNA, 22 nt, Human
ggagccuguguaacagcuccuu

SEQ ID NO: 2377519 - RNA, 15 nt, Human
ggagccuguguaaca

SEQ ID NO: 2377520 - RNA, 16 nt, Human
ggagccuguguaacag

SEQ ID NO: 2377521 - RNA, 17 nt, Human
ggagccuguguaacagc

SEQ ID NO: 2377522 - RNA, 18 nt, Human
ggagccuguguaacagcu

SEQ ID NO: 2377523 - RNA, 22 nt, Human
ggagccugcaaacucacugcuc

SEQ ID NO: 2377524 - RNA, 15 nt, Human
ggagccuccugcccu

SEQ ID NO: 2377525 - RNA, 17 nt, Human
ggagccugcagagcugc

SEQ ID NO: 2377526 - RNA, 11 nt, Human
ggagccugcag

SEQ ID NO: 2377527 - RNA, 13 nt, Human
ggagccugcaggg

SEQ ID NO: 2377528 - RNA, 16 nt, Human
ggagccugcagggugg

SEQ ID NO: 2377529 - RNA, 21 nt, Human
ggagccugcaggguggugcug

SEQ ID NO: 2377530 - RNA, 12 nt, Human
ggagccuggugc

SEQ ID NO: 2377531 - RNA, 22 nt, Human
ggagccugcaggguggugcugg

SEQ ID NO: 2377532 - RNA, 13 nt, Human
ggagccugcuggu

SEQ ID NO: 2377533 - RNA, 22 nt, Human
ggagccugcuggucacagccuc

SEQ ID NO: 2377534 - RNA, 13 nt, Human
ggagcacaggcag

SEQ ID NO: 2377535 - RNA, 14 nt, Human
ggagcacaggcagc

SEQ ID NO: 2377536 - RNA, 17 nt, Human
ggagcaccaggcacgaa

SEQ ID NO: 2377537 - RNA, 15 nt, Human
ggagcacaggcagcu

SEQ ID NO: 2377538 - RNA, 16 nt, Human
ggagcccugggaggcu

SEQ ID NO: 2377539 - RNA, 19 nt, Human
ggagcccugggaggcucug

SEQ ID NO: 2377540 - RNA, 22 nt, Human
ggagcaacuuguucguggguca

SEQ ID NO: 2377541 - RNA, 15 nt, Human
ggagcaaauguuucu

SEQ ID NO: 2377542 - RNA, 16 nt, Human
ggagcaaauguuucug

SEQ ID NO: 2377543 - RNA, 18 nt, Human
ggagcaaauguuucugca

SEQ ID NO: 2377544 - RNA, 20 nt, Human
ggagcaaauguuucugcagu

SEQ ID NO: 2377545 - RNA, 15 nt, Human
ggagcaaagugaggg

SEQ ID NO: 2377546 - RNA, 17 nt, Human
ggagcaaagugagggcc

SEQ ID NO: 2377547 - RNA, 20 nt, Human
ggagacauuccugggcacag

SEQ ID NO: 2377548 - RNA, 19 nt, Human
ggagaccaugcagagcgcc

SEQ ID NO: 2377549 - RNA, 11 nt, Human
ggagacagggu

SEQ ID NO: 2377550 - RNA, 13 nt, Human
ggagacagugauc

SEQ ID NO: 2377551 - RNA, 12 nt, Human
ggagacaggguu

SEQ ID NO: 2377552 - RNA, 18 nt, Human
ggagacagugaucuccau

SEQ ID NO: 2377553 - RNA, 14 nt, Human
ggagacaugugaca

SEQ ID NO: 2377554 - RNA, 17 nt, Human
ggagaccaaggcgggag

SEQ ID NO: 2377555 - RNA, 18 nt, Human
ggagaccaugcagagcgc

SEQ ID NO: 2377556 - RNA, 15 nt, Human
ggagacaugugacau

SEQ ID NO: 2377557 - RNA, 19 nt, Human
ggagacaugugacauuuau

SEQ ID NO: 2377558 - RNA, 11 nt, Human
ggagccuccug

SEQ ID NO: 2377559 - RNA, 12 nt, Human
ggagccuccugc

SEQ ID NO: 2377560 - RNA, 13 nt, Human
ggagccuccugcc

SEQ ID NO: 2377561 - RNA, 15 nt, Human
ggagccuccugccca

SEQ ID NO: 2377562 - RNA, 14 nt, Human
ggagccuccugccc

SEQ ID NO: 2377563 - RNA, 16 nt, Human
ggagccgguggcggug

SEQ ID NO: 2377564 - RNA, 17 nt, Human
ggagccgggucugccuc

SEQ ID NO: 2377565 - RNA, 21 nt, Human
ggagccuagagugagggccug

SEQ ID NO: 2377566 - RNA, 21 nt, Human
ggagccucauccgaggcaggg

SEQ ID NO: 2377567 - RNA, 20 nt, Human
ggagccucauccgaggcagg

SEQ ID NO: 2377568 - RNA, 19 nt, Human
ggagccucauccgaggcag

SEQ ID NO: 2377569 - RNA, 18 nt, Human
ggagcacuggagugcagg

SEQ ID NO: 2377570 - RNA, 16 nt, Human
ggagccuacccacccc

SEQ ID NO: 2377571 - RNA, 18 nt, Human
ggagccgggucugccucu

SEQ ID NO: 2377572 - RNA, 13 nt, Human
ggagcacuggagu

SEQ ID NO: 2377573 - RNA, 15 nt, Human
ggagcacuggagugc

SEQ ID NO: 2377574 - RNA, 20 nt, Human
ggagcccugggaggcucugg

SEQ ID NO: 2377575 - RNA, 16 nt, Human
ggaggcacacagcugc

SEQ ID NO: 2377576 - RNA, 14 nt, Human
ggaggcaagcccug

SEQ ID NO: 2377577 - RNA, 23 nt, Human
ggaggcaagagggguggagacug

SEQ ID NO: 2377578 - RNA, 19 nt, Human
ggaggcaagagggguggag

SEQ ID NO: 2377579 - RNA, 22 nt, Human
ggaggauugcuugagcccagga

SEQ ID NO: 2377580 - RNA, 20 nt, Human
ggaggauugcuugagcccag

SEQ ID NO: 2377581 - RNA, 17 nt, Human
ggaggauucuaugaggc

SEQ ID NO: 2377582 - RNA, 12 nt, Human
ggaggaccuuau

SEQ ID NO: 2377583 - RNA, 18 nt, Human
ggaggauguucugggaca

SEQ ID NO: 2377584 - RNA, 21 nt, Human
ggaggauguucugggacacag

SEQ ID NO: 2377585 - RNA, 16 nt, Human
ggaggacgcucucugg

SEQ ID NO: 2377586 - RNA, 17 nt, Human
ggaggcacacagcugca

SEQ ID NO: 2377587 - RNA, 22 nt, Human
ggaggcacuuuagggcuguaaa

SEQ ID NO: 2377588 - RNA, 17 nt, Human
ggaggcaggaguuucgu

SEQ ID NO: 2377589 - RNA, 21 nt, Human
ggaggcagggccuugcccaga

SEQ ID NO: 2377590 - RNA, 19 nt, Human
ggaggcagggccuugccca

SEQ ID NO: 2377591 - RNA, 18 nt, Human
ggaggcagggccuugccc

SEQ ID NO: 2377592 - RNA, 13 nt, Human
ggaggcagggccu

SEQ ID NO: 2377593 - RNA, 21 nt, Human
ggagggaugcugccugaguca

SEQ ID NO: 2377594 - RNA, 17 nt, Human
ggagggauucugguucc

SEQ ID NO: 2377595 - RNA, 22 nt, Human
ggagggauucugguuccagggu

SEQ ID NO: 2377596 - RNA, 17 nt, Human
ggagggagggcuccaga

SEQ ID NO: 2377597 - RNA, 13 nt, Human
ggagggagggcuc

SEQ ID NO: 2377598 - RNA, 16 nt, Human
ggagggagggcuccag

SEQ ID NO: 2377599 - RNA, 17 nt, Human
ggaguacaggugaagca

SEQ ID NO: 2377600 - RNA, 20 nt, Human
ggagguuuaggucaagaaga

SEQ ID NO: 2377601 - RNA, 15 nt, Human
ggagguugggugggc

SEQ ID NO: 2377602 - RNA, 19 nt, Human
ggaggggcgcuggcccagc

SEQ ID NO: 2377603 - RNA, 20 nt, Human
ggaggggcgcuggcccagcc

SEQ ID NO: 2377604 - RNA, 14 nt, Human
ggaggggccuggca

SEQ ID NO: 2377605 - RNA, 18 nt, Human
ggaggggccuggcagccg

SEQ ID NO: 2377606 - RNA, 21 nt, Human
ggaggggccuggcagccgugc

SEQ ID NO: 2377607 - RNA, 17 nt, Human
ggaggggcgcccaccuc

SEQ ID NO: 2377608 - RNA, 22 nt, Human
ggaggggcgcccaccuccccac

SEQ ID NO: 2377609 - RNA, 12 nt, Human
ggaggggcgcug

SEQ ID NO: 2377610 - RNA, 16 nt, Human
ggaggggcgcuggccc

SEQ ID NO: 2377611 - RNA, 14 nt, Human
ggagucagagagaa

SEQ ID NO: 2377612 - RNA, 18 nt, Human
ggagucagugccaggucc

SEQ ID NO: 2377613 - RNA, 22 nt, Human
ggagucccaccuuggcugcagg

SEQ ID NO: 2377614 - RNA, 15 nt, Human
ggaguaucugggaac

SEQ ID NO: 2377615 - RNA, 14 nt, Human
ggaguaucugggaa

SEQ ID NO: 2377616 - RNA, 15 nt, Human
ggaguaugcaaaagu

SEQ ID NO: 2377617 - RNA, 15 nt, Human
ggagucaagugugga

SEQ ID NO: 2377618 - RNA, 18 nt, Human
ggaguaaucuguguacaa

SEQ ID NO: 2377619 - RNA, 13 nt, Human
ggaguaucuggga

SEQ ID NO: 2377620 - RNA, 20 nt, Human
ggaggggcauggccagcagc

SEQ ID NO: 2377621 - RNA, 13 nt, Human
ggaggggccccug

SEQ ID NO: 2377622 - RNA, 14 nt, Human
ggaggggcaggcug

SEQ ID NO: 2377623 - RNA, 21 nt, Human
ggaggggccccugcuucucca

SEQ ID NO: 2377624 - RNA, 13 nt, Human
ggaggggcccgcu

SEQ ID NO: 2377625 - RNA, 18 nt, Human
ggaggggcccgcuugccu

SEQ ID NO: 2377626 - RNA, 22 nt, Human
ggaggggcccgcuugccucggc

SEQ ID NO: 2377627 - RNA, 13 nt, Human
ggaggggccuggc

SEQ ID NO: 2377628 - RNA, 21 nt, Human
ggaggggccuaggccucagcc

SEQ ID NO: 2377629 - RNA, 15 nt, Human
ggaggggccuaggcc

SEQ ID NO: 2377630 - RNA, 13 nt, Human
ggaggggccuagg

SEQ ID NO: 2377631 - RNA, 23 nt, Human
ggaggggcccgcuugccucggcu

SEQ ID NO: 2377632 - RNA, 13 nt, Human
ggaggggcaggcu

SEQ ID NO: 2377633 - RNA, 13 nt, Human
ggaggggaggggg

SEQ ID NO: 2377634 - RNA, 22 nt, Human
ggagggcuagaaccuggagagc

SEQ ID NO: 2377635 - RNA, 20 nt, Human
ggagggcuagaaccuggcag

SEQ ID NO: 2377636 - RNA, 16 nt, Human
ggagggcuagaaccug

SEQ ID NO: 2377637 - RNA, 21 nt, Human
ggagggcuagaaccuggaagg

SEQ ID NO: 2377638 - RNA, 19 nt, Human
ggagggcuagaaccuggag

SEQ ID NO: 2377639 - RNA, 20 nt, Human
ggagggcuagaaccuggaga

SEQ ID NO: 2377640 - RNA, 17 nt, Human
ggagggcgugacucacc

SEQ ID NO: 2377641 - RNA, 15 nt, Human
ggagggcgugggagc

SEQ ID NO: 2377642 - RNA, 16 nt, Human
ggagggcuagaaccua

SEQ ID NO: 2377643 - RNA, 20 nt, Human
ggagggcuagaaccuagaag

SEQ ID NO: 2377644 - RNA, 20 nt, Human
ggagggcggcaggggccugg

SEQ ID NO: 2377645 - RNA, 21 nt, Human
ggagggcggcaggggccugga

SEQ ID NO: 2377646 - RNA, 19 nt, Human
ggaggggagcaugggaagu

SEQ ID NO: 2377647 - RNA, 20 nt, Human
ggagggauagaggggggcug

SEQ ID NO: 2377648 - RNA, 20 nt, Human
ggagggccguaccccacccu

SEQ ID NO: 2377649 - RNA, 16 nt, Human
ggagggcccuaccuga

SEQ ID NO: 2377650 - RNA, 23 nt, Human
ggagggccacaugggaggcucac

SEQ ID NO: 2377651 - RNA, 19 nt, Human
ggagggccacaugggaggc

SEQ ID NO: 2377652 - RNA, 21 nt, Human
ggagggccguaccccacccuc

SEQ ID NO: 2377653 - RNA, 13 nt, Human
ggagggccugggc

SEQ ID NO: 2377654 - RNA, 16 nt, Human
gcggugcuguccucag

SEQ ID NO: 2377655 - RNA, 18 nt, Human
gcggugcuguccucaggu

SEQ ID NO: 2377656 - RNA, 19 nt, Human
gcuagaugggcauggggug

SEQ ID NO: 2377657 - RNA, 20 nt, Human
gcuagaguccucacucccag

SEQ ID NO: 2377658 - RNA, 13 nt, Human
gcuagauguaugu

SEQ ID NO: 2377659 - RNA, 19 nt, Human
gcggugcuaucucccccag

SEQ ID NO: 2377660 - RNA, 22 nt, Human
gcggugcuaucucccccagccc

SEQ ID NO: 2377661 - RNA, 21 nt, Human
gcuaguugggcuuccucauag

SEQ ID NO: 2377662 - RNA, 17 nt, Human
gcuauaaacaauuacau

SEQ ID NO: 2377663 - RNA, 15 nt, Human
gcuauaaauauauaa

SEQ ID NO: 2377664 - RNA, 13 nt, Human
gcuauaaauauau

SEQ ID NO: 2377665 - RNA, 14 nt, Human
gcuagauguaugua

SEQ ID NO: 2377666 - RNA, 16 nt, Human
gcuagauguauguacu

SEQ ID NO: 2377667 - RNA, 19 nt, Human
gcuauccagcuauuuuuau

SEQ ID NO: 2377668 - RNA, 14 nt, Human
gcuauauuuucaug

SEQ ID NO: 2377669 - RNA, 22 nt, Human
gcuauauuuucaugacuuuucc

SEQ ID NO: 2377670 - RNA, 23 nt, Human
gcuauauuuucaugacuuuucca

SEQ ID NO: 2377671 - RNA, 20 nt, Human
gcuauccugccaaaaucauu

SEQ ID NO: 2377672 - RNA, 17 nt, Human
gcuauccauuucucaug

SEQ ID NO: 2377673 - RNA, 23 nt, Human
gcuauauccauguacuguaguuu

SEQ ID NO: 2377674 - RNA, 21 nt, Human
gcuauauccauguacuguagu

SEQ ID NO: 2377675 - RNA, 15 nt, Human
gcuauaucuauauau

SEQ ID NO: 2377676 - RNA, 19 nt, Human
gcuauaucuauauauaauu

SEQ ID NO: 2377677 - RNA, 19 nt, Human
gcuauauccauguacugua

SEQ ID NO: 2377678 - RNA, 18 nt, Human
gcuauauccauguacugu

SEQ ID NO: 2377679 - RNA, 17 nt, Human
gcuauauccauguacug

SEQ ID NO: 2377680 - RNA, 15 nt, Human
gcuauauccauguac

SEQ ID NO: 2377681 - RNA, 14 nt, Human
gcuauauccaugua

SEQ ID NO: 2377682 - RNA, 23 nt, Human
gcuauaccugggcauacuaauaa

SEQ ID NO: 2377683 - RNA, 20 nt, Human
gcuauaacuauguugauaaa

SEQ ID NO: 2377684 - RNA, 23 nt, Human
gcuauaaauuccucuuugcuuug

SEQ ID NO: 2377685 - RNA, 18 nt, Human
gcuauaaauuccucuuug

SEQ ID NO: 2377686 - RNA, 18 nt, Human
gcuauaacaguagggaug

SEQ ID NO: 2377687 - RNA, 16 nt, Human
gcuauaccugugccuc

SEQ ID NO: 2377688 - RNA, 15 nt, Human
gcuauaccugugccu

SEQ ID NO: 2377689 - RNA, 17 nt, Human
gcuauaccugugccucg

SEQ ID NO: 2377690 - RNA, 21 nt, Human
gcuauacugcauacuuuuuaa

SEQ ID NO: 2377691 - RNA, 19 nt, Human
gcuauaggugcuacaaaaa

SEQ ID NO: 2377692 - RNA, 21 nt, Human
gcuauaggugcuacaaaaaca

SEQ ID NO: 2377693 - RNA, 14 nt, Human
gcucacaccuguaa

SEQ ID NO: 2377694 - RNA, 14 nt, Human
gcucacacaugaga

SEQ ID NO: 2377695 - RNA, 14 nt, Human
gcucacaccccauu

SEQ ID NO: 2377696 - RNA, 15 nt, Human
gcucacacaugagau

SEQ ID NO: 2377697 - RNA, 13 nt, Human
gcucacacaccug

SEQ ID NO: 2377698 - RNA, 23 nt, Human
gcucacaauaaaaauggcucaga

SEQ ID NO: 2377699 - RNA, 16 nt, Human
gcucaauccucuaagc

SEQ ID NO: 2377700 - RNA, 14 nt, Human
gcucaauccucuaa

SEQ ID NO: 2377701 - RNA, 22 nt, Human
gcucaauauuccugaaugaaau

SEQ ID NO: 2377702 - RNA, 20 nt, Human
gcucaauccauguucuauuu

SEQ ID NO: 2377703 - RNA, 14 nt, Human
gcucacaaaccaug

SEQ ID NO: 2377704 - RNA, 17 nt, Human
gcucaauggacuggaag

SEQ ID NO: 2377705 - RNA, 17 nt, Human
gcucaagucuucccuga

SEQ ID NO: 2377706 - RNA, 23 nt, Human
gcucaaggaaagggggucccagu

SEQ ID NO: 2377707 - RNA, 17 nt, Human
gcucaaggcgugaggau

SEQ ID NO: 2377708 - RNA, 20 nt, Human
gcucaaggaaaggccugaaa

SEQ ID NO: 2377709 - RNA, 19 nt, Human
gcucaaggaaaggccugaa

SEQ ID NO: 2377710 - RNA, 20 nt, Human
gcucaagucuucccugauca

SEQ ID NO: 2377711 - RNA, 21 nt, Human
gcucaauauuccugaaugaaa

SEQ ID NO: 2377712 - RNA, 19 nt, Human
gcucaauauuccugaauga

SEQ ID NO: 2377713 - RNA, 16 nt, Human
gcucaaucaagaaaau

SEQ ID NO: 2377714 - RNA, 19 nt, Human
gcucaaguccucuuuucug

SEQ ID NO: 2377715 - RNA, 22 nt, Human
gcucaaguccucuuuucugaga

SEQ ID NO: 2377716 - RNA, 22 nt, Human
gcucaagcagucuacccaccuc

SEQ ID NO: 2377717 - RNA, 18 nt, Human
gcucaagcgauucuccug

SEQ ID NO: 2377718 - RNA, 13 nt, Human
gcucaaggaaagg

SEQ ID NO: 2377719 - RNA, 17 nt, Human
gcucaaggaaaggccug

SEQ ID NO: 2377720 - RNA, 18 nt, Human
gcucaaguccucuuuucu

SEQ ID NO: 2377721 - RNA, 14 nt, Human
gcuaucucccccag

SEQ ID NO: 2377722 - RNA, 15 nt, Human
gcuaucucccccagc

SEQ ID NO: 2377723 - RNA, 15 nt, Human
gcuauccuggcucuu

SEQ ID NO: 2377724 - RNA, 13 nt, Human
gcuaucacacagu

SEQ ID NO: 2377725 - RNA, 15 nt, Human
gcuaucguaaaauua

SEQ ID NO: 2377726 - RNA, 16 nt, Human
gcuaucguaaaauuaa

SEQ ID NO: 2377727 - RNA, 17 nt, Human
gcuaucguaaaauuaag

SEQ ID NO: 2377728 - RNA, 13 nt, Human
gcuaucuccccca

SEQ ID NO: 2377729 - RNA, 17 nt, Human
gcucagcccaccccccu

SEQ ID NO: 2377730 - RNA, 16 nt, Human
gcucagcccacccccc

SEQ ID NO: 2377731 - RNA, 15 nt, Human
gcucagcccaccccc

SEQ ID NO: 2377732 - RNA, 14 nt, Human
gcucagcccacccc

SEQ ID NO: 2377733 - RNA, 18 nt, Human
gcucagcccaccccccuc

SEQ ID NO: 2377734 - RNA, 11 nt, Human
gcucaccuggg

SEQ ID NO: 2377735 - RNA, 17 nt, Human
gcucagccagccccauc

SEQ ID NO: 2377736 - RNA, 11 nt, Human
gcucagcccac

SEQ ID NO: 2377737 - RNA, 23 nt, Human
gcucacaguuccucgcccugggu

SEQ ID NO: 2377738 - RNA, 22 nt, Human
gcucacaguuccucgcccuggg

SEQ ID NO: 2377739 - RNA, 15 nt, Human
gcucagccagcacuu

SEQ ID NO: 2377740 - RNA, 15 nt, Human
gcucagcccucccug

SEQ ID NO: 2377741 - RNA, 16 nt, Human
gcucagcccucccugc

SEQ ID NO: 2377742 - RNA, 12 nt, Human
gcucagcccucc

SEQ ID NO: 2377743 - RNA, 14 nt, Human
gcucaccucucccu

SEQ ID NO: 2377744 - RNA, 16 nt, Human
gcucaccucucccuug

SEQ ID NO: 2377745 - RNA, 17 nt, Human
gcucaccucucccuugg

SEQ ID NO: 2377746 - RNA, 18 nt, Human
gcucaccucucccuugga

SEQ ID NO: 2377747 - RNA, 15 nt, Human
gcucacaguuccucg

SEQ ID NO: 2377748 - RNA, 13 nt, Human
gcucacaguuccu

SEQ ID NO: 2377749 - RNA, 22 nt, Human
gcucacagaacccuuggagcca

SEQ ID NO: 2377750 - RNA, 13 nt, Human
gcucacacugaga

SEQ ID NO: 2377751 - RNA, 22 nt, Human
gcucacaccccauugguggacu

SEQ ID NO: 2377752 - RNA, 21 nt, Human
gcucacacgggguauuuuagg

SEQ ID NO: 2377753 - RNA, 14 nt, Human
gcucacacugagaa

SEQ ID NO: 2377754 - RNA, 22 nt, Human
gcucacacugagaauguaagaa

SEQ ID NO: 2377755 - RNA, 16 nt, Human
gcucacauaucuguca

SEQ ID NO: 2377756 - RNA, 12 nt, Human
gcucaccagccc

SEQ ID NO: 2377757 - RNA, 13 nt, Human
gcucaccagcccc

SEQ ID NO: 2377758 - RNA, 14 nt, Human
gcucaccagcccca

SEQ ID NO: 2377759 - RNA, 21 nt, Human
gcucacaguuccucgcccugg

SEQ ID NO: 2377760 - RNA, 19 nt, Human
gcucacaguuccucgcccu

SEQ ID NO: 2377761 - RNA, 17 nt, Human
gcucacaguuccucgcc

SEQ ID NO: 2377762 - RNA, 16 nt, Human
gcucacaguuccucgc

SEQ ID NO: 2377763 - RNA, 15 nt, Human
gcucaccagccccag

SEQ ID NO: 2377764 - RNA, 16 nt, Human
gcucagcggggacagc

SEQ ID NO: 2377765 - RNA, 20 nt, Human
gcucagcccugacuggugcu

SEQ ID NO: 2377766 - RNA, 21 nt, Human
gcucagcccugacuggugcua

SEQ ID NO: 2377767 - RNA, 16 nt, Human
gcucagcccugacugg

SEQ ID NO: 2377768 - RNA, 11 nt, Human
gcucagcccug

SEQ ID NO: 2377769 - RNA, 19 nt, Human
gcucagcccugacuggugc

SEQ ID NO: 2377770 - RNA, 17 nt, Human
gcucagcccucccugcc

SEQ ID NO: 2377771 - RNA, 18 nt, Human
gcucagcccucccugccc

SEQ ID NO: 2377772 - RNA, 19 nt, Human
gcucagcccucccugcccc

SEQ ID NO: 2377773 - RNA, 21 nt, Human
gcucagcccucccugccccuc

SEQ ID NO: 2377774 - RNA, 17 nt, Human
gcucagcggggacagcu

SEQ ID NO: 2377775 - RNA, 18 nt, Human
gcucagcggggacagcuc

SEQ ID NO: 2377776 - RNA, 19 nt, Human
gcucagcggggacagcucc

SEQ ID NO: 2377777 - RNA, 23 nt, Human
gcucagcggggacagcuccuucu

SEQ ID NO: 2377778 - RNA, 12 nt, Human
gcucagcccugg

SEQ ID NO: 2377779 - RNA, 13 nt, Human
gcucagcccugga

SEQ ID NO: 2377780 - RNA, 20 nt, Human
gcucagcuacugauuuuugu

SEQ ID NO: 2377781 - RNA, 17 nt, Human
gcucagcucugggccau

SEQ ID NO: 2377782 - RNA, 16 nt, Human
gcucagcucugggcca

SEQ ID NO: 2377783 - RNA, 21 nt, Human
gcucagcuuuuugucuuuucu

SEQ ID NO: 2377784 - RNA, 16 nt, Human
gcucagcuucuccugu

SEQ ID NO: 2377785 - RNA, 11 nt, Human
gcucaggaaaa

SEQ ID NO: 2377786 - RNA, 13 nt, Human
gcucagcuucucc

SEQ ID NO: 2377787 - RNA, 12 nt, Human
gcucagcuucuc

SEQ ID NO: 2377788 - RNA, 20 nt, Human
gcucauauuccugcagccug

SEQ ID NO: 2377789 - RNA, 13 nt, Human
gcucaggaaaacg

SEQ ID NO: 2377790 - RNA, 14 nt, Human
gcucauauuuugua

SEQ ID NO: 2377791 - RNA, 22 nt, Human
gcucauauuccugcagccugga

SEQ ID NO: 2377792 - RNA, 18 nt, Human
gcucauauuuuguauaua

SEQ ID NO: 2377793 - RNA, 22 nt, Human
gcucaucucugucccacuuggc

SEQ ID NO: 2377794 - RNA, 23 nt, Human
gcucaucugcugguccgugggac

SEQ ID NO: 2377795 - RNA, 16 nt, Human
gcucaucugcuggucc

SEQ ID NO: 2377796 - RNA, 21 nt, Human
gcucaucugcugguccguggg

SEQ ID NO: 2377797 - RNA, 18 nt, Human
gcucauggacuucugcca

SEQ ID NO: 2377798 - RNA, 20 nt, Human
gcucaucauucucugucuca

SEQ ID NO: 2377799 - RNA, 19 nt, Human
gcucaucauucucugucuc

SEQ ID NO: 2377800 - RNA, 18 nt, Human
gcucaucauucucugucu

SEQ ID NO: 2377801 - RNA, 16 nt, Human
gcucaucauucucugu

SEQ ID NO: 2377802 - RNA, 13 nt, Human
gcucaucugcugg

SEQ ID NO: 2377803 - RNA, 21 nt, Human
gcucauccccaccugucuuca

SEQ ID NO: 2377804 - RNA, 16 nt, Human
gcucaucucuguccca

SEQ ID NO: 2377805 - RNA, 14 nt, Human
gcucaucugcuggu

SEQ ID NO: 2377806 - RNA, 15 nt, Human
gcucaucugcugguc

SEQ ID NO: 2377807 - RNA, 15 nt, Human
gcucauuuuuucuua

SEQ ID NO: 2377808 - RNA, 14 nt, Human
gcucauuucaggau

SEQ ID NO: 2377809 - RNA, 11 nt, Human
gcuccaggagc

SEQ ID NO: 2377810 - RNA, 12 nt, Human
gcuccaggagca

SEQ ID NO: 2377811 - RNA, 14 nt, Human
gcuccaggagcagc

SEQ ID NO: 2377812 - RNA, 17 nt, Human
gcucaugugugcaacag

SEQ ID NO: 2377813 - RNA, 22 nt, Human
gcucaugugugcaacaggguau

SEQ ID NO: 2377814 - RNA, 21 nt, Human
gcuccagcuguucagcugguu

SEQ ID NO: 2377815 - RNA, 13 nt, Human
gcuccaaacccuc

SEQ ID NO: 2377816 - RNA, 12 nt, Human
gcuccaggcucc

SEQ ID NO: 2377817 - RNA, 24 nt, Human
gcuccaggcuccuuuagcgcccag

SEQ ID NO: 2377818 - RNA, 13 nt, Human
gcuccaggcaggc

SEQ ID NO: 2377819 - RNA, 18 nt, Human
gcuccaggccagggggcc

SEQ ID NO: 2377820 - RNA, 17 nt, Human
gcuccaggccagggggc

SEQ ID NO: 2377821 - RNA, 15 nt, Human
gcuccaggagcagcc

SEQ ID NO: 2377822 - RNA, 16 nt, Human
gcuccaggagcagcca

SEQ ID NO: 2377823 - RNA, 17 nt, Human
gcuccaggagcagccac

SEQ ID NO: 2377824 - RNA, 18 nt, Human
gcuccaggagcagccaca

SEQ ID NO: 2377825 - RNA, 14 nt, Human
gcucccacaggcag

SEQ ID NO: 2377826 - RNA, 15 nt, Human
gcucccacaggcagc

SEQ ID NO: 2377827 - RNA, 16 nt, Human
gcucccacaggcagcu

SEQ ID NO: 2377828 - RNA, 15 nt, Human
gcucccuucucugua

SEQ ID NO: 2377829 - RNA, 17 nt, Human
gcucccacaggcagcuu

SEQ ID NO: 2377830 - RNA, 18 nt, Human
gcucccacaggcagcuuu

SEQ ID NO: 2377831 - RNA, 20 nt, Human
gcucccuucccaccucucuc

SEQ ID NO: 2377832 - RNA, 17 nt, Human
gcuccgccucugcuggc

SEQ ID NO: 2377833 - RNA, 14 nt, Human
gcuccgccucugcu

SEQ ID NO: 2377834 - RNA, 13 nt, Human
gcuccgccucugc

SEQ ID NO: 2377835 - RNA, 15 nt, Human
gcucccuugugcgug

SEQ ID NO: 2377836 - RNA, 16 nt, Human
gcucccuucucuguag

SEQ ID NO: 2377837 - RNA, 18 nt, Human
gcuccgcuuucuacccag

SEQ ID NO: 2377838 - RNA, 21 nt, Human
gcuccgcuuucuacccagcga

SEQ ID NO: 2377839 - RNA, 22 nt, Human
gcuccgcuuucuacccagcgag

SEQ ID NO: 2377840 - RNA, 23 nt, Human
gcuccgcuuucuacccagcgagc

SEQ ID NO: 2377841 - RNA, 11 nt, Human
gcucccaaggg

SEQ ID NO: 2377842 - RNA, 12 nt, Human
gcucccaaggga

SEQ ID NO: 2377843 - RNA, 23 nt, Human
gcucccaagggauggugcccugu

SEQ ID NO: 2377844 - RNA, 15 nt, Human
gcucccacaggcccu

SEQ ID NO: 2377845 - RNA, 15 nt, Human
gcuccagguggcucu

SEQ ID NO: 2377846 - RNA, 21 nt, Human
gcuccaggcaggcuaaggcgu

SEQ ID NO: 2377847 - RNA, 16 nt, Human
gcuccagguggcucug

SEQ ID NO: 2377848 - RNA, 18 nt, Human
gcuccagguggcucugag

SEQ ID NO: 2377849 - RNA, 21 nt, Human
gcuccagguggcucugaggug

SEQ ID NO: 2377850 - RNA, 21 nt, Human
gcuccagucaacaaacuauuu

SEQ ID NO: 2377851 - RNA, 17 nt, Human
gcuccagucugcugccc

SEQ ID NO: 2377852 - RNA, 21 nt, Human
gcuccagucugcugcccucca

SEQ ID NO: 2377853 - RNA, 20 nt, Human
gcuccagucugcugcccucc

SEQ ID NO: 2377854 - RNA, 18 nt, Human
gcuccagucugcugcccu

SEQ ID NO: 2377855 - RNA, 21 nt, Human
gcuccugucugccagccagca

SEQ ID NO: 2377856 - RNA, 20 nt, Human
gcuccugucugccagccagc

SEQ ID NO: 2377857 - RNA, 19 nt, Human
gcuccugucugccagccag

SEQ ID NO: 2377858 - RNA, 18 nt, Human
gcuccugucugccagcca

SEQ ID NO: 2377859 - RNA, 17 nt, Human
gcuccugucugccagcc

SEQ ID NO: 2377860 - RNA, 16 nt, Human
gcuccugucugccagc

SEQ ID NO: 2377861 - RNA, 14 nt, Human
gcuccugucugcca

SEQ ID NO: 2377862 - RNA, 15 nt, Human
gcuccuguccuccca

SEQ ID NO: 2377863 - RNA, 13 nt, Human
gcuccuguggccc

SEQ ID NO: 2377864 - RNA, 15 nt, Human
gcuccuguggcccca

SEQ ID NO: 2377865 - RNA, 20 nt, Human
gcuccuguggccccacccug

SEQ ID NO: 2377866 - RNA, 21 nt, Human
gcuccuguggccccacccugg

SEQ ID NO: 2377867 - RNA, 22 nt, Human
gcuccuguccucccauccccug

SEQ ID NO: 2377868 - RNA, 12 nt, Human
gcuccugugccc

SEQ ID NO: 2377869 - RNA, 13 nt, Human
gcuccugugcccu

SEQ ID NO: 2377870 - RNA, 15 nt, Human
gcuccugugcccuua

SEQ ID NO: 2377871 - RNA, 21 nt, Human
gcuccugugcuacuuugccuu

SEQ ID NO: 2377872 - RNA, 14 nt, Human
gcuccugugcuuuc

SEQ ID NO: 2377873 - RNA, 16 nt, Human
gcuccugugcuuuccc

SEQ ID NO: 2377874 - RNA, 22 nt, Human
gcuccugugcuuucccugaacu

SEQ ID NO: 2377875 - RNA, 23 nt, Human
gcuccuccagggccacgugccag

SEQ ID NO: 2377876 - RNA, 22 nt, Human
gcuccuccagggccacgugcca

SEQ ID NO: 2377877 - RNA, 18 nt, Human
gcuccuccagggccacgu

SEQ ID NO: 2377878 - RNA, 15 nt, Human
gcuccuccagggcca

SEQ ID NO: 2377879 - RNA, 20 nt, Human
gcuccuccagggugugugcu

SEQ ID NO: 2377880 - RNA, 11 nt, Human
gcuccucccac

SEQ ID NO: 2377881 - RNA, 13 nt, Human
gcuccuguccucc

SEQ ID NO: 2377882 - RNA, 19 nt, Human
gcuccuggucuugagaugu

SEQ ID NO: 2377883 - RNA, 23 nt, Human
gcuccuggggguucuuucuuccu

SEQ ID NO: 2377884 - RNA, 14 nt, Human
gcuccucccggugc

SEQ ID NO: 2377885 - RNA, 14 nt, Human
gcuccuccagggcc

SEQ ID NO: 2377886 - RNA, 21 nt, Human
gcuccucauccagggcucuga

SEQ ID NO: 2377887 - RNA, 19 nt, Human
gcuccucaugguggguuca

SEQ ID NO: 2377888 - RNA, 18 nt, Human
gcuccucauccagggcuc

SEQ ID NO: 2377889 - RNA, 18 nt, Human
gcuccucaacucaccuaa

SEQ ID NO: 2377890 - RNA, 15 nt, Human
gcuccuaucuguguu

SEQ ID NO: 2377891 - RNA, 19 nt, Human
gcuccuagagggaggggcc

SEQ ID NO: 2377892 - RNA, 18 nt, Human
gcuccuagagggaggggc

SEQ ID NO: 2377893 - RNA, 16 nt, Human
gcuccuagagggaggg

SEQ ID NO: 2377894 - RNA, 15 nt, Human
gcuccuagagggagg

SEQ ID NO: 2377895 - RNA, 14 nt, Human
gcuccuagcagaga

SEQ ID NO: 2377896 - RNA, 14 nt, Human
gcuccuaucugugu

SEQ ID NO: 2377897 - RNA, 14 nt, Human
gcuccuagagggag

SEQ ID NO: 2377898 - RNA, 13 nt, Human
gcuccuagaggga

SEQ ID NO: 2377899 - RNA, 15 nt, Human
gcuccuaagcuucaa

SEQ ID NO: 2377900 - RNA, 21 nt, Human
gcuccuacccaccgcccuugc

SEQ ID NO: 2377901 - RNA, 23 nt, Human
gcuccuaacccuuaucaccagcu

SEQ ID NO: 2377902 - RNA, 22 nt, Human
gcuccuaacccuuaucaccagc

SEQ ID NO: 2377903 - RNA, 24 nt, Human
gcuccgcuuucuacccagcgagcc

SEQ ID NO: 2377904 - RNA, 22 nt, Human
gcuccgugagugaaccaucauu

SEQ ID NO: 2377905 - RNA, 13 nt, Human
gcuccgugccucc

SEQ ID NO: 2377906 - RNA, 14 nt, Human
gcuccgugccucca

SEQ ID NO: 2377907 - RNA, 15 nt, Human
gcuccgugccuccac

SEQ ID NO: 2377908 - RNA, 16 nt, Human
gcuccgugccuccacc

SEQ ID NO: 2377909 - RNA, 17 nt, Human
gcuccgugccuccacca

SEQ ID NO: 2377910 - RNA, 23 nt, Human
gcuccguccaggagccugugccu

SEQ ID NO: 2377911 - RNA, 22 nt, Human
gcuccguccaggagccugugcc

SEQ ID NO: 2377912 - RNA, 12 nt, Human
gcuccugugucu

SEQ ID NO: 2377913 - RNA, 13 nt, Human
gcuccugugucuu

SEQ ID NO: 2377914 - RNA, 19 nt, Human
gcuccuuccugucuuccug

SEQ ID NO: 2377915 - RNA, 13 nt, Human
gcuccuuccuguc

SEQ ID NO: 2377916 - RNA, 15 nt, Human
gcuccuuccuucacc

SEQ ID NO: 2377917 - RNA, 21 nt, Human
gcuccuucucucuuacauuga

SEQ ID NO: 2377918 - RNA, 23 nt, Human
gcuccuuccuggagacugcccag

SEQ ID NO: 2377919 - RNA, 14 nt, Human
gcuccuuccuggag

SEQ ID NO: 2377920 - RNA, 22 nt, Human
gcuccuuccucugaggcugaaa

SEQ ID NO: 2377921 - RNA, 20 nt, Human
gcuccuuccucugaggcuga

SEQ ID NO: 2377922 - RNA, 23 nt, Human
gcuccuucccaggaguggaggag

SEQ ID NO: 2377923 - RNA, 13 nt, Human
gcuccuucccauc

SEQ ID NO: 2377924 - RNA, 18 nt, Human
gcuccuucccaucgcugu

SEQ ID NO: 2377925 - RNA, 18 nt, Human
gcuccuuccucugaggcu

SEQ ID NO: 2377926 - RNA, 13 nt, Human
gcuccuucugucc

SEQ ID NO: 2377927 - RNA, 19 nt, Human
gcuccuugggcccuuugag

SEQ ID NO: 2377928 - RNA, 17 nt, Human
gcuccuugggcccuuug

SEQ ID NO: 2377929 - RNA, 14 nt, Human
gcuccuugggcccu

SEQ ID NO: 2377930 - RNA, 17 nt, Human
gcuccuuuagcgcccag

SEQ ID NO: 2377931 - RNA, 14 nt, Human
gcuccuuguuccua

SEQ ID NO: 2377932 - RNA, 20 nt, Human
gcuccuuucuccagccagca

SEQ ID NO: 2377933 - RNA, 21 nt, Human
gcucgagcaugccuggauggg

SEQ ID NO: 2377934 - RNA, 19 nt, Human
gcucgagcaugccuggaug

SEQ ID NO: 2377935 - RNA, 16 nt, Human
gcuccuuguuccuaga

SEQ ID NO: 2377936 - RNA, 14 nt, Human
gcuccuuucuccag

SEQ ID NO: 2377937 - RNA, 16 nt, Human
gcuccuuucuccagcc

SEQ ID NO: 2377938 - RNA, 17 nt, Human
gcuccuuucuccagcca

SEQ ID NO: 2377939 - RNA, 18 nt, Human
gcuccuuucuccagccag

SEQ ID NO: 2377940 - RNA, 19 nt, Human
gcuccuuucuccagccagc

SEQ ID NO: 2377941 - RNA, 14 nt, Human
gccuggauucauuu

SEQ ID NO: 2377942 - RNA, 16 nt, Human
gccuggauucauuucc

SEQ ID NO: 2377943 - RNA, 18 nt, Human
gccuggauucauuuccug

SEQ ID NO: 2377944 - RNA, 19 nt, Human
gccuggauucauuuccugc

SEQ ID NO: 2377945 - RNA, 21 nt, Human
gccuggauucauuuccugccc

SEQ ID NO: 2377946 - RNA, 20 nt, Human
gccuggauggggcugcaccg

SEQ ID NO: 2377947 - RNA, 13 nt, Human
gccuggcacaggg

SEQ ID NO: 2377948 - RNA, 14 nt, Human
gccuggcacagggc

SEQ ID NO: 2377949 - RNA, 13 nt, Human
gccuggcacacau

SEQ ID NO: 2377950 - RNA, 18 nt, Human
gccuggcaagugggugaa

SEQ ID NO: 2377951 - RNA, 16 nt, Human
gccuggcacacaucag

SEQ ID NO: 2377952 - RNA, 20 nt, Human
gccuggacauuugccuugcu

SEQ ID NO: 2377953 - RNA, 17 nt, Human
gccuggacccccagcuu

SEQ ID NO: 2377954 - RNA, 13 nt, Human
gccuggaccccca

SEQ ID NO: 2377955 - RNA, 15 nt, Human
gccuggacccccagc

SEQ ID NO: 2377956 - RNA, 16 nt, Human
gccuggauggggcugc

SEQ ID NO: 2377957 - RNA, 18 nt, Human
gccuggauggggcugcac

SEQ ID NO: 2377958 - RNA, 13 nt, Human
gccugcauucugc

SEQ ID NO: 2377959 - RNA, 16 nt, Human
gccugcauguaaacac

SEQ ID NO: 2377960 - RNA, 22 nt, Human
gccugcucccagcagcccuaag

SEQ ID NO: 2377961 - RNA, 21 nt, Human
gccugcaugcuggguucugca

SEQ ID NO: 2377962 - RNA, 17 nt, Human
gccugcaguccuggaag

SEQ ID NO: 2377963 - RNA, 19 nt, Human
gccugcucccccacccccu

SEQ ID NO: 2377964 - RNA, 17 nt, Human
gccugcucccccacccc

SEQ ID NO: 2377965 - RNA, 16 nt, Human
gccugcucccccaccc

SEQ ID NO: 2377966 - RNA, 15 nt, Human
gccugcucccccacc

SEQ ID NO: 2377967 - RNA, 13 nt, Human
gccugcuccccca

SEQ ID NO: 2377968 - RNA, 11 nt, Human
gccugcucccc

SEQ ID NO: 2377969 - RNA, 23 nt, Human
gccugcugaaugauuuccaaaga

SEQ ID NO: 2377970 - RNA, 16 nt, Human
gcccagcuugggccca

SEQ ID NO: 2377971 - RNA, 18 nt, Human
gccugcugcauggggugg

SEQ ID NO: 2377972 - RNA, 11 nt, Human
gccugcugcau

SEQ ID NO: 2377973 - RNA, 10 nt, Human
gccugcugca

SEQ ID NO: 2377974 - RNA, 14 nt, Human
gccuggaagacaga

SEQ ID NO: 2377975 - RNA, 15 nt, Human
gccuggaagacagag

SEQ ID NO: 2377976 - RNA, 22 nt, Human
gccuggaagacagagaccuccu

SEQ ID NO: 2377977 - RNA, 23 nt, Human
gccuggaagacagagaccuccug

SEQ ID NO: 2377978 - RNA, 13 nt, Human
gccuggaagacag

SEQ ID NO: 2377979 - RNA, 13 nt, Human
gccugaggcuggg

SEQ ID NO: 2377980 - RNA, 18 nt, Human
gccugaggcugagacugc

SEQ ID NO: 2377981 - RNA, 17 nt, Human
gccugaggcugagacug

SEQ ID NO: 2377982 - RNA, 15 nt, Human
gccugaggcugagac

SEQ ID NO: 2377983 - RNA, 14 nt, Human
gccugaggcuggga

SEQ ID NO: 2377984 - RNA, 10 nt, Human
gccugaggga

SEQ ID NO: 2377985 - RNA, 22 nt, Human
gccugcaggaccugccuguagc

SEQ ID NO: 2377986 - RNA, 19 nt, Human
gccugcaggguggugcugg

SEQ ID NO: 2377987 - RNA, 20 nt, Human
gccugcaggguggugcuggg

SEQ ID NO: 2377988 - RNA, 21 nt, Human
gccugcaggguggugcuggga

SEQ ID NO: 2377989 - RNA, 22 nt, Human
gccugcaggguggugcugggac

SEQ ID NO: 2377990 - RNA, 23 nt, Human
gccugcaggguggugcugggacu

SEQ ID NO: 2377991 - RNA, 24 nt, Human
gccugcaggguggugcugggacug

SEQ ID NO: 2377992 - RNA, 14 nt, Human
gccugcaggugcug

SEQ ID NO: 2377993 - RNA, 16 nt, Human
gccugcaggugcugcu

SEQ ID NO: 2377994 - RNA, 19 nt, Human
gccugcaggugcugcugcg

SEQ ID NO: 2377995 - RNA, 14 nt, Human
gccugaggaugagc

SEQ ID NO: 2377996 - RNA, 23 nt, Human
gccugagcucacucggcacccug

SEQ ID NO: 2377997 - RNA, 17 nt, Human
gccugaggaugagcugg

SEQ ID NO: 2377998 - RNA, 23 nt, Human
gccugagcgcuccugccgcagag

SEQ ID NO: 2377999 - RNA, 14 nt, Human
gccugagcucacuc

SEQ ID NO: 2378000 - RNA, 17 nt, Human
gccugagcucacucggc

SEQ ID NO: 2378001 - RNA, 14 nt, Human
gccugaggcugaga

SEQ ID NO: 2378002 - RNA, 13 nt, Human
gccugaggcugag

SEQ ID NO: 2378003 - RNA, 21 nt, Human
gccugaggaugagcuggaagg

SEQ ID NO: 2378004 - RNA, 18 nt, Human
gccugaggaugagcugga

SEQ ID NO: 2378005 - RNA, 20 nt, Human
gccugaggaugagcuggaag

SEQ ID NO: 2378006 - RNA, 12 nt, Human
gccugagcuggg

SEQ ID NO: 2378007 - RNA, 22 nt, Human
gccugagcgcuccugccgcaga

SEQ ID NO: 2378008 - RNA, 17 nt, Human
gccugagccuggccagc

SEQ ID NO: 2378009 - RNA, 16 nt, Human
gccugagccuggccag

SEQ ID NO: 2378010 - RNA, 21 nt, Human
gcccaguccuggccuggcuuc

SEQ ID NO: 2378011 - RNA, 19 nt, Human
gcccaguuggguggaugcc

SEQ ID NO: 2378012 - RNA, 21 nt, Human
gcccaguuggguggaugccug

SEQ ID NO: 2378013 - RNA, 22 nt, Human
gcccaguuggguggaugccugg

SEQ ID NO: 2378014 - RNA, 16 nt, Human
gccugaagucacacag

SEQ ID NO: 2378015 - RNA, 17 nt, Human
gccugaagucacacagu

SEQ ID NO: 2378016 - RNA, 18 nt, Human
gccugaagucacacagug

SEQ ID NO: 2378017 - RNA, 20 nt, Human
gccugagcgacagugagacu

SEQ ID NO: 2378018 - RNA, 17 nt, Human
gccugagcgacagugag

SEQ ID NO: 2378019 - RNA, 23 nt, Human
gccuggguggggcugcuccucca

SEQ ID NO: 2378020 - RNA, 23 nt, Human
gccuggggcuccuuucuccagcc

SEQ ID NO: 2378021 - RNA, 17 nt, Human
gccuggggcgggccccu

SEQ ID NO: 2378022 - RNA, 22 nt, Human
gccuggggcuccuuucuccagc

SEQ ID NO: 2378023 - RNA, 24 nt, Human
gccuggguggggcugcuccuccag

SEQ ID NO: 2378024 - RNA, 20 nt, Human
gccuggguuuaaggggagag

SEQ ID NO: 2378025 - RNA, 15 nt, Human
gccugggcuguuggc

SEQ ID NO: 2378026 - RNA, 18 nt, Human
gccugggcuguuggcacu

SEQ ID NO: 2378027 - RNA, 20 nt, Human
gccugggcuguuggcacuca

SEQ ID NO: 2378028 - RNA, 13 nt, Human
gccuggucagccc

SEQ ID NO: 2378029 - RNA, 20 nt, Human
gccugguauauccaaaagcu

SEQ ID NO: 2378030 - RNA, 15 nt, Human
gccuggucagcccaa

SEQ ID NO: 2378031 - RNA, 14 nt, Human
gccuggucagccca

SEQ ID NO: 2378032 - RNA, 23 nt, Human
gccugggcucccuugugcguggg

SEQ ID NO: 2378033 - RNA, 20 nt, Human
gccugggcgacagagcgaga

SEQ ID NO: 2378034 - RNA, 21 nt, Human
gccugggccuccucacaacau

SEQ ID NO: 2378035 - RNA, 17 nt, Human
gccugggccgcugccac

SEQ ID NO: 2378036 - RNA, 18 nt, Human
gccugggccgcugccacg

SEQ ID NO: 2378037 - RNA, 22 nt, Human
gccugguccaugauggagucag

SEQ ID NO: 2378038 - RNA, 17 nt, Human
gccuggucacagggcau

SEQ ID NO: 2378039 - RNA, 14 nt, Human
gccuggucccuggg

SEQ ID NO: 2378040 - RNA, 15 nt, Human
gccuguaauccuagc

SEQ ID NO: 2378041 - RNA, 15 nt, Human
gccuggucccuggga

SEQ ID NO: 2378042 - RNA, 16 nt, Human
gccuggucccugggag

SEQ ID NO: 2378043 - RNA, 16 nt, Human
gccuguaaucccagcu

SEQ ID NO: 2378044 - RNA, 20 nt, Human
gccuguaauccuagcacuuu

SEQ ID NO: 2378045 - RNA, 18 nt, Human
gccugucucauccccagg

SEQ ID NO: 2378046 - RNA, 17 nt, Human
gccugucucauccccag

SEQ ID NO: 2378047 - RNA, 13 nt, Human
gccuguccugggc

SEQ ID NO: 2378048 - RNA, 19 nt, Human
gccuguaaucccagcuacu

SEQ ID NO: 2378049 - RNA, 19 nt, Human
gccuguacucgcuugugca

SEQ ID NO: 2378050 - RNA, 18 nt, Human
gccuguaaucccagcuac

SEQ ID NO: 2378051 - RNA, 17 nt, Human
gccuguaaucccagcua

SEQ ID NO: 2378052 - RNA, 20 nt, Human
gccuguacucgcuugugcag

SEQ ID NO: 2378053 - RNA, 22 nt, Human
gccugucuccuuugcaggcuca

SEQ ID NO: 2378054 - RNA, 21 nt, Human
gccugucuccuuugcaggcuc

SEQ ID NO: 2378055 - RNA, 13 nt, Human
gccugucuccuuu

SEQ ID NO: 2378056 - RNA, 16 nt, Human
gccuguccugggcugg

SEQ ID NO: 2378057 - RNA, 22 nt, Human
gccugucucauccccagggguc

SEQ ID NO: 2378058 - RNA, 19 nt, Human
gccugucucauccccaggg

SEQ ID NO: 2378059 - RNA, 13 nt, Human
gccugucucuucc

SEQ ID NO: 2378060 - RNA, 14 nt, Human
gccugucucuucca

SEQ ID NO: 2378061 - RNA, 12 nt, Human
gccugucugucu

SEQ ID NO: 2378062 - RNA, 14 nt, Human
gccugucugucucu

SEQ ID NO: 2378063 - RNA, 17 nt, Human
gccugucugucucucca

SEQ ID NO: 2378064 - RNA, 23 nt, Human
gccugggcagccaggcugccaag

SEQ ID NO: 2378065 - RNA, 20 nt, Human
gccugggcagccaggcugcc

SEQ ID NO: 2378066 - RNA, 18 nt, Human
gccugggcagccaggcug

SEQ ID NO: 2378067 - RNA, 17 nt, Human
gccugggcagccaggcu

SEQ ID NO: 2378068 - RNA, 19 nt, Human
gccugggcagcauagcaag

SEQ ID NO: 2378069 - RNA, 13 nt, Human
gccugggcagcau

SEQ ID NO: 2378070 - RNA, 18 nt, Human
gccuggcccccagcugug

SEQ ID NO: 2378071 - RNA, 15 nt, Human
gccuggcccccagcu

SEQ ID NO: 2378072 - RNA, 17 nt, Human
gccuggcccccuguccu

SEQ ID NO: 2378073 - RNA, 20 nt, Human
gccugggccacagggcgaga

SEQ ID NO: 2378074 - RNA, 16 nt, Human
gccugggccgcugcca

SEQ ID NO: 2378075 - RNA, 13 nt, Human
gccugggccagag

SEQ ID NO: 2378076 - RNA, 22 nt, Human
gccuggcagaacugagcuccuc

SEQ ID NO: 2378077 - RNA, 12 nt, Human
gccuggcccagc

SEQ ID NO: 2378078 - RNA, 11 nt, Human
gccuggcccag

SEQ ID NO: 2378079 - RNA, 13 nt, Human
gccuggcccagcu

SEQ ID NO: 2378080 - RNA, 14 nt, Human
gccuggcccagcuc

SEQ ID NO: 2378081 - RNA, 15 nt, Human
gccuggcccagcucc

SEQ ID NO: 2378082 - RNA, 16 nt, Human
gccuggcccagcuccc

SEQ ID NO: 2378083 - RNA, 17 nt, Human
gccuggcccagcucccc

SEQ ID NO: 2378084 - RNA, 16 nt, Human
gccuggccccaugguc

SEQ ID NO: 2378085 - RNA, 13 nt, Human
gccuggccccuca

SEQ ID NO: 2378086 - RNA, 14 nt, Human
gccuggccccucag

SEQ ID NO: 2378087 - RNA, 20 nt, Human
gccuggccagaugcaccagc

SEQ ID NO: 2378088 - RNA, 22 nt, Human
gccuggcagccgugccuucagc

SEQ ID NO: 2378089 - RNA, 16 nt, Human
gccuggccagaugcac

SEQ ID NO: 2378090 - RNA, 21 nt, Human
gccuggccagaugcaccagcc

SEQ ID NO: 2378091 - RNA, 22 nt, Human
gccuggccagaugcaccagccc

SEQ ID NO: 2378092 - RNA, 18 nt, Human
gccuggcacagggcagug

SEQ ID NO: 2378093 - RNA, 19 nt, Human
gccuggcacagggcagugg

SEQ ID NO: 2378094 - RNA, 14 nt, Human
gccuggcacacauc

SEQ ID NO: 2378095 - RNA, 20 nt, Human
gccuggauucauuuccugcc

SEQ ID NO: 2378096 - RNA, 14 nt, Human
gccuggcacagugu

SEQ ID NO: 2378097 - RNA, 16 nt, Human
gccuggcacagugucu

SEQ ID NO: 2378098 - RNA, 21 nt, Human
gccuggcacagugucugggcu

SEQ ID NO: 2378099 - RNA, 22 nt, Human
gccuggcacagugucugggcug

SEQ ID NO: 2378100 - RNA, 23 nt, Human
gccuggcacagugucugggcuga

SEQ ID NO: 2378101 - RNA, 19 nt, Human
gccuggcagaacugagcuc

SEQ ID NO: 2378102 - RNA, 18 nt, Human
gccuggcagaacugagcu

SEQ ID NO: 2378103 - RNA, 13 nt, Human
gccuggcagaacu

SEQ ID NO: 2378104 - RNA, 18 nt, Human
gccuggcacaucagaaag

SEQ ID NO: 2378105 - RNA, 12 nt, Human
gccuggcagccg

SEQ ID NO: 2378106 - RNA, 20 nt, Human
gccuggcagccgugccuuca

SEQ ID NO: 2378107 - RNA, 21 nt, Human
gccuggcagccgugccuucag

SEQ ID NO: 2378108 - RNA, 22 nt, Human
gcgcccaguccuuccaccucga

SEQ ID NO: 2378109 - RNA, 23 nt, Human
gcgccacucgcuucccccauagc

SEQ ID NO: 2378110 - RNA, 23 nt, Human
gcgcccaguuggguggaugccug

SEQ ID NO: 2378111 - RNA, 13 nt, Human
gcgccccuucccc

SEQ ID NO: 2378112 - RNA, 13 nt, Human
gcgcccgcgcccg

SEQ ID NO: 2378113 - RNA, 22 nt, Human
gcgcccccuccgcccugccacu

SEQ ID NO: 2378114 - RNA, 21 nt, Human
gcgcccccuccgcccugccac

SEQ ID NO: 2378115 - RNA, 18 nt, Human
gcgccacucgcuuccccc

SEQ ID NO: 2378116 - RNA, 16 nt, Human
gcgccacucgcuuccc

SEQ ID NO: 2378117 - RNA, 24 nt, Human
gcgccacuacacuccagccugagc

SEQ ID NO: 2378118 - RNA, 14 nt, Human
gcgccaccauccug

SEQ ID NO: 2378119 - RNA, 22 nt, Human
gcgccacuacacuccagccugg

SEQ ID NO: 2378120 - RNA, 22 nt, Human
gcgccacuacacuccagccuga

SEQ ID NO: 2378121 - RNA, 21 nt, Human
gcgccacuacacuccagccug

SEQ ID NO: 2378122 - RNA, 21 nt, Human
gcgccaagcaaccugggucca

SEQ ID NO: 2378123 - RNA, 22 nt, Human
gcgcagugcuucucuacagacu

SEQ ID NO: 2378124 - RNA, 21 nt, Human
gcgcagugccucuggucuggg

SEQ ID NO: 2378125 - RNA, 18 nt, Human
gcgcagugcuucucuaca

SEQ ID NO: 2378126 - RNA, 18 nt, Human
gcgccaaauaaugucucu

SEQ ID NO: 2378127 - RNA, 14 nt, Human
gcgccaagcaaccu

SEQ ID NO: 2378128 - RNA, 17 nt, Human
gcgccgcaaaccacacu

SEQ ID NO: 2378129 - RNA, 18 nt, Human
gcgccgcaaaccacacug

SEQ ID NO: 2378130 - RNA, 19 nt, Human
gcgccuccauccaaggcca

SEQ ID NO: 2378131 - RNA, 22 nt, Human
gcgccuccuuccuugcuguccu

SEQ ID NO: 2378132 - RNA, 15 nt, Human
gcgccuccuuccuug

SEQ ID NO: 2378133 - RNA, 20 nt, Human
gcgccgagucugucucuguc

SEQ ID NO: 2378134 - RNA, 12 nt, Human
gcgccucugcaa

SEQ ID NO: 2378135 - RNA, 18 nt, Human
gcgccugccccucccaga

SEQ ID NO: 2378136 - RNA, 16 nt, Human
gcgccuguagucccag

SEQ ID NO: 2378137 - RNA, 17 nt, Human
gcgccugccccucccag

SEQ ID NO: 2378138 - RNA, 16 nt, Human
gcgccugccccuccca

SEQ ID NO: 2378139 - RNA, 21 nt, Human
gcgccuuaaggauguucuagc

SEQ ID NO: 2378140 - RNA, 14 nt, Human
gcgcccuggaagcc

SEQ ID NO: 2378141 - RNA, 13 nt, Human
gcgcccuggaagc

SEQ ID NO: 2378142 - RNA, 13 nt, Human
gcgcccgcugggc

SEQ ID NO: 2378143 - RNA, 14 nt, Human
gcgcccgcugggcu

SEQ ID NO: 2378144 - RNA, 15 nt, Human
gcgcccgcugggcug

SEQ ID NO: 2378145 - RNA, 16 nt, Human
gcgcccgcugggcuga

SEQ ID NO: 2378146 - RNA, 13 nt, Human
gcgcccucugucc

SEQ ID NO: 2378147 - RNA, 14 nt, Human
gcgcccucuguccu

SEQ ID NO: 2378148 - RNA, 15 nt, Human
gcgcccucuguccug

SEQ ID NO: 2378149 - RNA, 16 nt, Human
gcgcccucuguccuga

SEQ ID NO: 2378150 - RNA, 12 nt, Human
gcgcccuuccuc

SEQ ID NO: 2378151 - RNA, 14 nt, Human
gcgcccuuccucuc

SEQ ID NO: 2378152 - RNA, 18 nt, Human
gcgcccuuccucuccacc

SEQ ID NO: 2378153 - RNA, 16 nt, Human
gcgcccuuccucucca

SEQ ID NO: 2378154 - RNA, 17 nt, Human
gcgccgagucugucucu

SEQ ID NO: 2378155 - RNA, 10 nt, Human
gcgcuggccc

SEQ ID NO: 2378156 - RNA, 19 nt, Human
gcgcugccugugugguguc

SEQ ID NO: 2378157 - RNA, 14 nt, Human
gcgcugccugugug

SEQ ID NO: 2378158 - RNA, 15 nt, Human
gcgcugccugugugg

SEQ ID NO: 2378159 - RNA, 11 nt, Human
gcgcuggccca

SEQ ID NO: 2378160 - RNA, 12 nt, Human
gcgcuggcccag

SEQ ID NO: 2378161 - RNA, 13 nt, Human
gcgcuggcccagc

SEQ ID NO: 2378162 - RNA, 14 nt, Human
gcgcuggcccagcc

SEQ ID NO: 2378163 - RNA, 21 nt, Human
gcgcugccgcaccccagagug

SEQ ID NO: 2378164 - RNA, 19 nt, Human
gcgcugccgcaccccagag

SEQ ID NO: 2378165 - RNA, 17 nt, Human
gcgcugccgcaccccag

SEQ ID NO: 2378166 - RNA, 16 nt, Human
gcgcugccgcacccca

SEQ ID NO: 2378167 - RNA, 13 nt, Human
gcgccuucucccc

SEQ ID NO: 2378168 - RNA, 18 nt, Human
gcgcugccccuggcagcc

SEQ ID NO: 2378169 - RNA, 21 nt, Human
gcgcugccccuggcagccccu

SEQ ID NO: 2378170 - RNA, 14 nt, Human
gcggacguuccagc

SEQ ID NO: 2378171 - RNA, 21 nt, Human
gcggaccccagcugugagccu

SEQ ID NO: 2378172 - RNA, 14 nt, Human
gcggaccccagcug

SEQ ID NO: 2378173 - RNA, 20 nt, Human
gcggaccccagcugugagcc

SEQ ID NO: 2378174 - RNA, 13 nt, Human
gcggaccccagcu

SEQ ID NO: 2378175 - RNA, 16 nt, Human
gcggagaaaggaaggg

SEQ ID NO: 2378176 - RNA, 19 nt, Human
gcggagacggagucccacc

SEQ ID NO: 2378177 - RNA, 14 nt, Human
gcggggacagcucc

SEQ ID NO: 2378178 - RNA, 15 nt, Human
gcggggacagcuccu

SEQ ID NO: 2378179 - RNA, 17 nt, Human
gcggggacagcuccuuc

SEQ ID NO: 2378180 - RNA, 15 nt, Human
gcgggugggggugga

SEQ ID NO: 2378181 - RNA, 15 nt, Human
gcgguagccagcaca

SEQ ID NO: 2378182 - RNA, 14 nt, Human
gcgggugggggugg

SEQ ID NO: 2378183 - RNA, 19 nt, Human
gcggagaaccuugugccug

SEQ ID NO: 2378184 - RNA, 23 nt, Human
gcggagaaccuugugccuggcuc

SEQ ID NO: 2378185 - RNA, 19 nt, Human
gcggguggaucaccugagg

SEQ ID NO: 2378186 - RNA, 16 nt, Human
gcggacguuccagccg

SEQ ID NO: 2378187 - RNA, 15 nt, Human
gcggacguuccagcc

SEQ ID NO: 2378188 - RNA, 18 nt, Human
gcggagaaccuugugccu

SEQ ID NO: 2378189 - RNA, 19 nt, Human
gcggugagaggggaacaga

SEQ ID NO: 2378190 - RNA, 23 nt, Human
gcgguagccagcacacagggcag

SEQ ID NO: 2378191 - RNA, 22 nt, Human
gcgguagccagcacacagggca

SEQ ID NO: 2378192 - RNA, 21 nt, Human
gcgguagccagcacacagggc

SEQ ID NO: 2378193 - RNA, 13 nt, Human
gcgguccacccag

SEQ ID NO: 2378194 - RNA, 14 nt, Human
gcgguccacccagg

SEQ ID NO: 2378195 - RNA, 12 nt, Human
gccuuguguaca

SEQ ID NO: 2378196 - RNA, 15 nt, Human
gccuugugucuacag

SEQ ID NO: 2378197 - RNA, 17 nt, Human
gccuugugucuacagag

SEQ ID NO: 2378198 - RNA, 17 nt, Human
gccuugucccagaggcu

SEQ ID NO: 2378199 - RNA, 18 nt, Human
gccuuguccccugccugu

SEQ ID NO: 2378200 - RNA, 23 nt, Human
gccuuguccccugccugugccug

SEQ ID NO: 2378201 - RNA, 21 nt, Human
gccuugguguccaccuggccc

SEQ ID NO: 2378202 - RNA, 19 nt, Human
gccuugguguccaccuggc

SEQ ID NO: 2378203 - RNA, 18 nt, Human
gccuugguguccaccugg

SEQ ID NO: 2378204 - RNA, 17 nt, Human
gccuugguguccaccug

SEQ ID NO: 2378205 - RNA, 18 nt, Human
gccuugguucccuugugu

SEQ ID NO: 2378206 - RNA, 22 nt, Human
gccuugguguccaccuggcccc

SEQ ID NO: 2378207 - RNA, 17 nt, Human
gccuuguaauucuaaau

SEQ ID NO: 2378208 - RNA, 20 nt, Human
gccuuguaauucuaaaugaa

SEQ ID NO: 2378209 - RNA, 16 nt, Human
gccuugguguccaccu

SEQ ID NO: 2378210 - RNA, 18 nt, Human
gccuuccuccacauccuu

SEQ ID NO: 2378211 - RNA, 18 nt, Human
gccuuccucucuccagau

SEQ ID NO: 2378212 - RNA, 17 nt, Human
gccuuccucucuccaga

SEQ ID NO: 2378213 - RNA, 16 nt, Human
gccuuccucucuccag

SEQ ID NO: 2378214 - RNA, 13 nt, Human
gccuuccucucuc

SEQ ID NO: 2378215 - RNA, 17 nt, Human
gccuuccuccacauccu

SEQ ID NO: 2378216 - RNA, 13 nt, Human
gccuuccuccugg

SEQ ID NO: 2378217 - RNA, 20 nt, Human
gccuuccguaacccaacucu

SEQ ID NO: 2378218 - RNA, 22 nt, Human
gccuuccuccugggcccucucu

SEQ ID NO: 2378219 - RNA, 17 nt, Human
gccuuccuccugggccc

SEQ ID NO: 2378220 - RNA, 16 nt, Human
gccuuccuccugggcc

SEQ ID NO: 2378221 - RNA, 14 nt, Human
gccuuccuccuggg

SEQ ID NO: 2378222 - RNA, 18 nt, Human
gccuuccccuugcccagg

SEQ ID NO: 2378223 - RNA, 17 nt, Human
gccuuaauuuucaguau

SEQ ID NO: 2378224 - RNA, 24 nt, Human
gccuucccuagcuuuagacccugg

SEQ ID NO: 2378225 - RNA, 23 nt, Human
gccuucccuagcuuuagacccug

SEQ ID NO: 2378226 - RNA, 16 nt, Human
gccuuacacaaugguu

SEQ ID NO: 2378227 - RNA, 16 nt, Human
gccuuaaaacuuuaau

SEQ ID NO: 2378228 - RNA, 20 nt, Human
gccugucugucucuccaucu

SEQ ID NO: 2378229 - RNA, 16 nt, Human
gccuuaaagaaagucg

SEQ ID NO: 2378230 - RNA, 15 nt, Human
gccuuacacaauggu

SEQ ID NO: 2378231 - RNA, 16 nt, Human
gcgaaggggcccuggu

SEQ ID NO: 2378232 - RNA, 15 nt, Human
gcgaaggggcccugg

SEQ ID NO: 2378233 - RNA, 14 nt, Human
gcgaaggggcccug

SEQ ID NO: 2378234 - RNA, 13 nt, Human
gccuuucugugug

SEQ ID NO: 2378235 - RNA, 16 nt, Human
gcgaauuuuaaaagau

SEQ ID NO: 2378236 - RNA, 15 nt, Human
gcgaauuuuaaaaga

SEQ ID NO: 2378237 - RNA, 14 nt, Human
gcgaaucauuuguu

SEQ ID NO: 2378238 - RNA, 14 nt, Human
gcgaauuuuaaaag

SEQ ID NO: 2378239 - RNA, 23 nt, Human
gccuuucucccaggccaggcucc

SEQ ID NO: 2378240 - RNA, 12 nt, Human
gccuuucugugu

SEQ ID NO: 2378241 - RNA, 19 nt, Human
gccuuucucgauuuuaucu

SEQ ID NO: 2378242 - RNA, 18 nt, Human
gccuuucucccaggccag

SEQ ID NO: 2378243 - RNA, 22 nt, Human
gccuuucucccaggccaggcuc

SEQ ID NO: 2378244 - RNA, 17 nt, Human
gccuuuccuguagccuu

SEQ ID NO: 2378245 - RNA, 21 nt, Human
gccuuuccuguagccuucugu

SEQ ID NO: 2378246 - RNA, 19 nt, Human
gccuuucccaacucuagcu

SEQ ID NO: 2378247 - RNA, 22 nt, Human
gccuuuccauaaggaauguagc

SEQ ID NO: 2378248 - RNA, 21 nt, Human
gccuuuccauaaggaauguag

SEQ ID NO: 2378249 - RNA, 13 nt, Human
gccuuuaaaauuu

SEQ ID NO: 2378250 - RNA, 18 nt, Human
gccuuucccaacucuagc

SEQ ID NO: 2378251 - RNA, 13 nt, Human
gcgacaaagauga

SEQ ID NO: 2378252 - RNA, 17 nt, Human
gcgcaggcuggcccugc

SEQ ID NO: 2378253 - RNA, 19 nt, Human
gcgcaggcuggcccugccc

SEQ ID NO: 2378254 - RNA, 18 nt, Human
gcgcaggcuggcccugcc

SEQ ID NO: 2378255 - RNA, 22 nt, Human
gcgcaggcuggcccugcccugg

SEQ ID NO: 2378256 - RNA, 14 nt, Human
gcgcagugccucug

SEQ ID NO: 2378257 - RNA, 15 nt, Human
gcgcagugccucugg

SEQ ID NO: 2378258 - RNA, 16 nt, Human
gcgcagugccucuggu

SEQ ID NO: 2378259 - RNA, 21 nt, Human
gcgcaggcuggcccugcccug

SEQ ID NO: 2378260 - RNA, 20 nt, Human
gcgcaggcuggcccugcccu

SEQ ID NO: 2378261 - RNA, 12 nt, Human
gcgacaaugcaa

SEQ ID NO: 2378262 - RNA, 13 nt, Human
gcgacaaugcaaa

SEQ ID NO: 2378263 - RNA, 20 nt, Human
gcgacaaugcaaaccaucau

SEQ ID NO: 2378264 - RNA, 21 nt, Human
gcgacaaugcaaaccaucauu

SEQ ID NO: 2378265 - RNA, 14 nt, Human
gcucuuuggagauc

SEQ ID NO: 2378266 - RNA, 18 nt, Human
gcucuuuggggucagcca

SEQ ID NO: 2378267 - RNA, 23 nt, Human
gcucuuugaaauagucuguguga

SEQ ID NO: 2378268 - RNA, 21 nt, Human
gcucuuugaaauagucugugu

SEQ ID NO: 2378269 - RNA, 18 nt, Human
gcucuuucugggccaagu

SEQ ID NO: 2378270 - RNA, 14 nt, Human
gcucuuucugggcc

SEQ ID NO: 2378271 - RNA, 13 nt, Human
gcucuuucugggc

SEQ ID NO: 2378272 - RNA, 18 nt, Human
gcucuuucucugccagug

SEQ ID NO: 2378273 - RNA, 21 nt, Human
gcucuuucucugccagugaca

SEQ ID NO: 2378274 - RNA, 20 nt, Human
gcucuugcuaaucagugucu

SEQ ID NO: 2378275 - RNA, 23 nt, Human
gcucuugcuaaucagugucucac

SEQ ID NO: 2378276 - RNA, 21 nt, Human
gcucuucugccggcccugggg

SEQ ID NO: 2378277 - RNA, 14 nt, Human
gcucuucuucuuuc

SEQ ID NO: 2378278 - RNA, 17 nt, Human
gcucuugauaccccccu

SEQ ID NO: 2378279 - RNA, 19 nt, Human
gcucuugauaccccccucu

SEQ ID NO: 2378280 - RNA, 20 nt, Human
gcucuugauaccccccucug

SEQ ID NO: 2378281 - RNA, 19 nt, Human
gcucuugaugccuggcggg

SEQ ID NO: 2378282 - RNA, 19 nt, Human
gcucuuggcagguacucag

SEQ ID NO: 2378283 - RNA, 22 nt, Human
gcucuugcccuucccugucccu

SEQ ID NO: 2378284 - RNA, 23 nt, Human
gcucuugcccuucccugucccuc

SEQ ID NO: 2378285 - RNA, 13 nt, Human
gcucuugcuaauc

SEQ ID NO: 2378286 - RNA, 19 nt, Human
gcucuugcuaaucaguguc

SEQ ID NO: 2378287 - RNA, 12 nt, Human
gcucuugcccuu

SEQ ID NO: 2378288 - RNA, 16 nt, Human
gcucuugcccuucccu

SEQ ID NO: 2378289 - RNA, 17 nt, Human
gcucuugcccuucccug

SEQ ID NO: 2378290 - RNA, 18 nt, Human
gcucuugcccuucccugu

SEQ ID NO: 2378291 - RNA, 19 nt, Human
gcucuugcccuucccuguc

SEQ ID NO: 2378292 - RNA, 14 nt, Human
gcucuucugccggc

SEQ ID NO: 2378293 - RNA, 19 nt, Human
gcucuccaagugccagagg

SEQ ID NO: 2378294 - RNA, 12 nt, Human
gcucuucuuaaa

SEQ ID NO: 2378295 - RNA, 13 nt, Human
gcucuccaagugc

SEQ ID NO: 2378296 - RNA, 16 nt, Human
gcucuccaagugccag

SEQ ID NO: 2378297 - RNA, 17 nt, Human
gcucuccaagugccaga

SEQ ID NO: 2378298 - RNA, 18 nt, Human
gcucuccaagugccagag

SEQ ID NO: 2378299 - RNA, 15 nt, Human
gcucuccaagcccag

SEQ ID NO: 2378300 - RNA, 18 nt, Human
gcucuccaagucucagug

SEQ ID NO: 2378301 - RNA, 22 nt, Human
gcucuccaagucucaguggcuu

SEQ ID NO: 2378302 - RNA, 21 nt, Human
gcucuugaacuccugaccuca

SEQ ID NO: 2378303 - RNA, 19 nt, Human
gcucuugaacuccugaccu

SEQ ID NO: 2378304 - RNA, 16 nt, Human
gcucuugaacuccuga

SEQ ID NO: 2378305 - RNA, 14 nt, Human
gcucuugaacuccu

SEQ ID NO: 2378306 - RNA, 14 nt, Human
gcucgauuuuguau

SEQ ID NO: 2378307 - RNA, 13 nt, Human
gcucgccaugccg

SEQ ID NO: 2378308 - RNA, 21 nt, Human
gcucgccucaggaaugggcug

SEQ ID NO: 2378309 - RNA, 22 nt, Human
gcucucaguuccgauuucccag

SEQ ID NO: 2378310 - RNA, 21 nt, Human
gcucucaggccagcugcuugg

SEQ ID NO: 2378311 - RNA, 23 nt, Human
gcugaccuugaacuccugggcuc

SEQ ID NO: 2378312 - RNA, 20 nt, Human
gcugaccuugaacuccuggg

SEQ ID NO: 2378313 - RNA, 23 nt, Human
gcugaccuuccucgcagagaggc

SEQ ID NO: 2378314 - RNA, 21 nt, Human
gcugaccuugaacuccugggc

SEQ ID NO: 2378315 - RNA, 15 nt, Human
gcugacgaacuucca

SEQ ID NO: 2378316 - RNA, 17 nt, Human
gcugaccuuccucgcag

SEQ ID NO: 2378317 - RNA, 18 nt, Human
gcugaccuuccucgcaga

SEQ ID NO: 2378318 - RNA, 19 nt, Human
gcugaccuuccucgcagag

SEQ ID NO: 2378319 - RNA, 20 nt, Human
gcugaccuuccucgcagaga

SEQ ID NO: 2378320 - RNA, 22 nt, Human
gcugaccuuccucgcagagagg

SEQ ID NO: 2378321 - RNA, 21 nt, Human
gcugaccacaggcaguuacuu

SEQ ID NO: 2378322 - RNA, 19 nt, Human
gcugaccucuguuguccuc

SEQ ID NO: 2378323 - RNA, 22 nt, Human
gcugaccucuguuguccucccc

SEQ ID NO: 2378324 - RNA, 19 nt, Human
gcugaccacagcacagcca

SEQ ID NO: 2378325 - RNA, 17 nt, Human
gcugaccacagcacagc

SEQ ID NO: 2378326 - RNA, 16 nt, Human
gcugaccacagcacag

SEQ ID NO: 2378327 - RNA, 14 nt, Human
gcugaccacagcac

SEQ ID NO: 2378328 - RNA, 19 nt, Human
gcugacgaacuuccauggc

SEQ ID NO: 2378329 - RNA, 17 nt, Human
gcugacgaacuuccaug

SEQ ID NO: 2378330 - RNA, 15 nt, Human
gcugacggccaggga

SEQ ID NO: 2378331 - RNA, 13 nt, Human
gcugacggccagg

SEQ ID NO: 2378332 - RNA, 22 nt, Human
gcugacuguuuucucuugagag

SEQ ID NO: 2378333 - RNA, 19 nt, Human
gcugacuucaucucccacc

SEQ ID NO: 2378334 - RNA, 17 nt, Human
gcugacggugcagucug

SEQ ID NO: 2378335 - RNA, 24 nt, Human
gcugacuucaucucccaccuagca

SEQ ID NO: 2378336 - RNA, 14 nt, Human
gcugaccaagagag

SEQ ID NO: 2378337 - RNA, 13 nt, Human
gcugaccaagaga

SEQ ID NO: 2378338 - RNA, 21 nt, Human
gcugacauuguggcacauucu

SEQ ID NO: 2378339 - RNA, 22 nt, Human
gcugacauuguggcacauucuu

SEQ ID NO: 2378340 - RNA, 17 nt, Human
gcugacauucaccugcc

SEQ ID NO: 2378341 - RNA, 16 nt, Human
gcugacauucaccugc

SEQ ID NO: 2378342 - RNA, 20 nt, Human
gcugaccaagagagaaagaa

SEQ ID NO: 2378343 - RNA, 16 nt, Human
gcugaccaagagagaa

SEQ ID NO: 2378344 - RNA, 15 nt, Human
gcugaccaagagaga

SEQ ID NO: 2378345 - RNA, 13 nt, Human
gcugaccacagca

SEQ ID NO: 2378346 - RNA, 20 nt, Human
gcugacagacacaggcccgg

SEQ ID NO: 2378347 - RNA, 22 nt, Human
gcucuuugguagaaaaggcuag

SEQ ID NO: 2378348 - RNA, 17 nt, Human
gcugacagacacaggcc

SEQ ID NO: 2378349 - RNA, 18 nt, Human
gcucuuugguagaaaagg

SEQ ID NO: 2378350 - RNA, 13 nt, Human
gcucuuugguaga

SEQ ID NO: 2378351 - RNA, 20 nt, Human
gcucuuuggggucagccagg

SEQ ID NO: 2378352 - RNA, 21 nt, Human
gcucuuuggggucagccaggg

SEQ ID NO: 2378353 - RNA, 22 nt, Human
gcucuuuggggucagccagggc

SEQ ID NO: 2378354 - RNA, 23 nt, Human
gcucuuuggggucagccagggcc

SEQ ID NO: 2378355 - RNA, 18 nt, Human
gcugacagacacaggccc

SEQ ID NO: 2378356 - RNA, 19 nt, Human
gcugacagacacaggcccg

SEQ ID NO: 2378357 - RNA, 14 nt, Human
gcugccacccaccu

SEQ ID NO: 2378358 - RNA, 16 nt, Human
gcugccacaccugagc

SEQ ID NO: 2378359 - RNA, 21 nt, Human
gcugccacccaccucccugcc

SEQ ID NO: 2378360 - RNA, 20 nt, Human
gcugccacccaccucccugc

SEQ ID NO: 2378361 - RNA, 19 nt, Human
gcugccacccaccucccug

SEQ ID NO: 2378362 - RNA, 17 nt, Human
gcugccacccaccuccc

SEQ ID NO: 2378363 - RNA, 12 nt, Human
gcugccaccugc

SEQ ID NO: 2378364 - RNA, 13 nt, Human
gcugccaccugcc

SEQ ID NO: 2378365 - RNA, 23 nt, Human
gcugccacccaccucccugccuc

SEQ ID NO: 2378366 - RNA, 22 nt, Human
gcugccacccaccucccugccu

SEQ ID NO: 2378367 - RNA, 16 nt, Human
gcugcccuccuugucc

SEQ ID NO: 2378368 - RNA, 20 nt, Human
gcugcccuccuuguccaccc

SEQ ID NO: 2378369 - RNA, 21 nt, Human
gcugcccuccuuguccaccca

SEQ ID NO: 2378370 - RNA, 22 nt, Human
gcugcccuccuuguccacccac

SEQ ID NO: 2378371 - RNA, 17 nt, Human
gcugccaaggccagagu

SEQ ID NO: 2378372 - RNA, 16 nt, Human
gcugccaaggccagag

SEQ ID NO: 2378373 - RNA, 20 nt, Human
gcugccaaugggagcucaug

SEQ ID NO: 2378374 - RNA, 15 nt, Human
gcugccacacuucag

SEQ ID NO: 2378375 - RNA, 17 nt, Human
gcugccacacuucaggc

SEQ ID NO: 2378376 - RNA, 18 nt, Human
gcugccacacuucaggcu

SEQ ID NO: 2378377 - RNA, 21 nt, Human
gcugccacacuucaggcucuu

SEQ ID NO: 2378378 - RNA, 22 nt, Human
gcugccacacuucaggcucuuc

SEQ ID NO: 2378379 - RNA, 23 nt, Human
gcugccacacuucaggcucuucu

SEQ ID NO: 2378380 - RNA, 20 nt, Human
gcugcagugacgugcaccug

SEQ ID NO: 2378381 - RNA, 18 nt, Human
gcugcaguaugaaaauaa

SEQ ID NO: 2378382 - RNA, 21 nt, Human
gcugcaggggcucuggagaga

SEQ ID NO: 2378383 - RNA, 17 nt, Human
gcugcaaaagugagggc

SEQ ID NO: 2378384 - RNA, 15 nt, Human
gcugcaaaggacaga

SEQ ID NO: 2378385 - RNA, 13 nt, Human
gcugcaaaggaca

SEQ ID NO: 2378386 - RNA, 22 nt, Human
gcugcaggggcucuggagagaa

SEQ ID NO: 2378387 - RNA, 13 nt, Human
gcugcaguugcca

SEQ ID NO: 2378388 - RNA, 14 nt, Human
gcugcaguugccag

SEQ ID NO: 2378389 - RNA, 15 nt, Human
gcugccaaggccaga

SEQ ID NO: 2378390 - RNA, 17 nt, Human
gcugccaaauuuuggcc

SEQ ID NO: 2378391 - RNA, 23 nt, Human
gcugcauuuuaauuuuaaccaaa

SEQ ID NO: 2378392 - RNA, 15 nt, Human
gcugccaaauuuugg

SEQ ID NO: 2378393 - RNA, 19 nt, Human
gcugcauuuaaaagauaca

SEQ ID NO: 2378394 - RNA, 18 nt, Human
gcugcauuuaaaagauac

SEQ ID NO: 2378395 - RNA, 17 nt, Human
gcugcauuuaaaagaua

SEQ ID NO: 2378396 - RNA, 17 nt, Human
gcugcaguugccaguca

SEQ ID NO: 2378397 - RNA, 20 nt, Human
gcugauauauguguuuuuca

SEQ ID NO: 2378398 - RNA, 18 nt, Human
gcugauauauguguuuuu

SEQ ID NO: 2378399 - RNA, 17 nt, Human
gcugauauauguguuuu

SEQ ID NO: 2378400 - RNA, 18 nt, Human
gcugauccagagcacaga

SEQ ID NO: 2378401 - RNA, 16 nt, Human
gcugaucagugggccu

SEQ ID NO: 2378402 - RNA, 22 nt, Human
gcugagagacccaaggaggaaa

SEQ ID NO: 2378403 - RNA, 20 nt, Human
gcugagagacccaaggagga

SEQ ID NO: 2378404 - RNA, 14 nt, Human
gcugagagacuuuu

SEQ ID NO: 2378405 - RNA, 13 nt, Human
gcugagagcccca

SEQ ID NO: 2378406 - RNA, 14 nt, Human
gcugagagccccag

SEQ ID NO: 2378407 - RNA, 15 nt, Human
gcugagagccccagc

SEQ ID NO: 2378408 - RNA, 17 nt, Human
gcugagagccccagcug

SEQ ID NO: 2378409 - RNA, 18 nt, Human
gcugagagccccagcuga

SEQ ID NO: 2378410 - RNA, 20 nt, Human
gcugagagccccagcugaca

SEQ ID NO: 2378411 - RNA, 18 nt, Human
gcugacuuugcucuuucu

SEQ ID NO: 2378412 - RNA, 14 nt, Human
gcugagaacacugu

SEQ ID NO: 2378413 - RNA, 23 nt, Human
gcugagaacccugcguggggaca

SEQ ID NO: 2378414 - RNA, 17 nt, Human
gcugagagacccaagga

SEQ ID NO: 2378415 - RNA, 15 nt, Human
gcugagagacccaag

SEQ ID NO: 2378416 - RNA, 14 nt, Human
gcugagagacccaa

SEQ ID NO: 2378417 - RNA, 22 nt, Human
gcugagagaccaggagggcacu

SEQ ID NO: 2378418 - RNA, 14 nt, Human
gcugagagaaccuc

SEQ ID NO: 2378419 - RNA, 19 nt, Human
gcugagagaccaggagggc

SEQ ID NO: 2378420 - RNA, 15 nt, Human
gcugagagaaaauaa

SEQ ID NO: 2378421 - RNA, 20 nt, Human
gcugagacuggauacugccc

SEQ ID NO: 2378422 - RNA, 19 nt, Human
gcugagacuggauacugcc

SEQ ID NO: 2378423 - RNA, 15 nt, Human
gcugagacaggagaa

SEQ ID NO: 2378424 - RNA, 14 nt, Human
gcugagacugcggg

SEQ ID NO: 2378425 - RNA, 18 nt, Human
gcugagaagcuuuugaau

SEQ ID NO: 2378426 - RNA, 13 nt, Human
gcugauucucagg

SEQ ID NO: 2378427 - RNA, 16 nt, Human
gcugaucgugcuaaau

SEQ ID NO: 2378428 - RNA, 21 nt, Human
gcugaugaacuuauucuguag

SEQ ID NO: 2378429 - RNA, 21 nt, Human
gcugauguucaguguaauuuc

SEQ ID NO: 2378430 - RNA, 20 nt, Human
gcugauguuggaagagaaag

SEQ ID NO: 2378431 - RNA, 20 nt, Human
gcugauucucagggucucug

SEQ ID NO: 2378432 - RNA, 14 nt, Human
gcugauuguauuua

SEQ ID NO: 2378433 - RNA, 21 nt, Human
gcugauuaaaccaaggcuaga

SEQ ID NO: 2378434 - RNA, 20 nt, Human
gcugauuuuaacaauaacua

SEQ ID NO: 2378435 - RNA, 14 nt, Human
gcugauuuuaacaa

SEQ ID NO: 2378436 - RNA, 15 nt, Human
gcugauuuuaacaau

SEQ ID NO: 2378437 - RNA, 17 nt, Human
gcugauuuggugaccaa

SEQ ID NO: 2378438 - RNA, 21 nt, Human
gcugauucucagggucucugc

SEQ ID NO: 2378439 - RNA, 22 nt, Human
gcugcaaaggguaucaggugcu

SEQ ID NO: 2378440 - RNA, 23 nt, Human
gcugcaaaggguaucaggugcug

SEQ ID NO: 2378441 - RNA, 16 nt, Human
gcuggccaguccaggc

SEQ ID NO: 2378442 - RNA, 17 nt, Human
gcuggccaguccaggcu

SEQ ID NO: 2378443 - RNA, 14 nt, Human
gcuggcccagccaa

SEQ ID NO: 2378444 - RNA, 12 nt, Human
gcuggcccagcc

SEQ ID NO: 2378445 - RNA, 11 nt, Human
gcuggcccagc

SEQ ID NO: 2378446 - RNA, 21 nt, Human
gcuggccagccccacagccca

SEQ ID NO: 2378447 - RNA, 18 nt, Human
gcuggccagccccacagc

SEQ ID NO: 2378448 - RNA, 19 nt, Human
gcuggccagccccacagcc

SEQ ID NO: 2378449 - RNA, 14 nt, Human
gcuggccaguccag

SEQ ID NO: 2378450 - RNA, 15 nt, Human
gcuggccaguccagg

SEQ ID NO: 2378451 - RNA, 13 nt, Human
gcuggccagcccc

SEQ ID NO: 2378452 - RNA, 14 nt, Human
gcuggccagcccca

SEQ ID NO: 2378453 - RNA, 15 nt, Human
gcuggccagccccac

SEQ ID NO: 2378454 - RNA, 16 nt, Human
gcuggccagccccaca

SEQ ID NO: 2378455 - RNA, 22 nt, Human
gcuggccagccccacagcccac

SEQ ID NO: 2378456 - RNA, 19 nt, Human
gcuggccgaggguccuggc

SEQ ID NO: 2378457 - RNA, 15 nt, Human
gcuggccgagggucc

SEQ ID NO: 2378458 - RNA, 19 nt, Human
gcuggcccuggcucccaca

SEQ ID NO: 2378459 - RNA, 24 nt, Human
gcuggccgaggguccuggcuccug

SEQ ID NO: 2378460 - RNA, 20 nt, Human
gcuggccgaggguccuggcu

SEQ ID NO: 2378461 - RNA, 15 nt, Human
gcuggcccagcccug

SEQ ID NO: 2378462 - RNA, 20 nt, Human
gcuggccgccucacccccuc

SEQ ID NO: 2378463 - RNA, 16 nt, Human
gcuggcccugcccugg

SEQ ID NO: 2378464 - RNA, 15 nt, Human
gcuggcccugcccug

SEQ ID NO: 2378465 - RNA, 14 nt, Human
gcuggcccugcccu

SEQ ID NO: 2378466 - RNA, 13 nt, Human
gcuggcccagccc

SEQ ID NO: 2378467 - RNA, 14 nt, Human
gcuggcccagcccu

SEQ ID NO: 2378468 - RNA, 13 nt, Human
gcuggcccugccc

SEQ ID NO: 2378469 - RNA, 12 nt, Human
gcuggccacugc

SEQ ID NO: 2378470 - RNA, 13 nt, Human
gcuggccacugca

SEQ ID NO: 2378471 - RNA, 19 nt, Human
gcuggccacugcacagagc

SEQ ID NO: 2378472 - RNA, 20 nt, Human
gcuggccacugcacagagcu

SEQ ID NO: 2378473 - RNA, 21 nt, Human
gcuggccacugcacagagcuc

SEQ ID NO: 2378474 - RNA, 16 nt, Human
gcuggcauuugcaccu

SEQ ID NO: 2378475 - RNA, 17 nt, Human
gcuggcaguccuggaag

SEQ ID NO: 2378476 - RNA, 18 nt, Human
gcuggcagcucuccaguc

SEQ ID NO: 2378477 - RNA, 23 nt, Human
gcuggcagcucuccagucaggag

SEQ ID NO: 2378478 - RNA, 15 nt, Human
gcuggcagcagagug

SEQ ID NO: 2378479 - RNA, 13 nt, Human
gcuggcagcucuc

SEQ ID NO: 2378480 - RNA, 13 nt, Human
gcuggcagcagag

SEQ ID NO: 2378481 - RNA, 17 nt, Human
gcuggcaccgccuucuc

SEQ ID NO: 2378482 - RNA, 14 nt, Human
gcuggcagcucucc

SEQ ID NO: 2378483 - RNA, 15 nt, Human
gcuggcagcucucca

SEQ ID NO: 2378484 - RNA, 16 nt, Human
gcuggcagcucuccag

SEQ ID NO: 2378485 - RNA, 17 nt, Human
gcuggcagcucuccagu

SEQ ID NO: 2378486 - RNA, 18 nt, Human
gcuggcaccgccuucucu

SEQ ID NO: 2378487 - RNA, 21 nt, Human
gcuggcacccaccguggagga

SEQ ID NO: 2378488 - RNA, 23 nt, Human
gcuggcacccaccguggaggagg

SEQ ID NO: 2378489 - RNA, 16 nt, Human
gcuggcacccaccgug

SEQ ID NO: 2378490 - RNA, 20 nt, Human
gcuggcacccaccguggagg

SEQ ID NO: 2378491 - RNA, 20 nt, Human
gcuggacaguaucacugucu

SEQ ID NO: 2378492 - RNA, 15 nt, Human
gcuggaccuugaacu

SEQ ID NO: 2378493 - RNA, 23 nt, Human
gcuggcacauuuccccagaccug

SEQ ID NO: 2378494 - RNA, 23 nt, Human
gcuggaccuauguccuaaggaca

SEQ ID NO: 2378495 - RNA, 20 nt, Human
gcuggaaacagacucgauuc

SEQ ID NO: 2378496 - RNA, 23 nt, Human
gcuggaaaagggucuugggaaau

SEQ ID NO: 2378497 - RNA, 15 nt, Human
gcuggaaaagggucu

SEQ ID NO: 2378498 - RNA, 22 nt, Human
gcuggaaaagggucuugggaaa

SEQ ID NO: 2378499 - RNA, 23 nt, Human
gcuggaaaaguauguuagugcaa

SEQ ID NO: 2378500 - RNA, 23 nt, Human
gcugcuuuuccuuggggcaggca

SEQ ID NO: 2378501 - RNA, 22 nt, Human
gcugcuuuuccuuggggcaggc

SEQ ID NO: 2378502 - RNA, 12 nt, Human
gcugcuuuuccu

SEQ ID NO: 2378503 - RNA, 18 nt, Human
gcugcuuuuugagguggc

SEQ ID NO: 2378504 - RNA, 19 nt, Human
gcugcuuuuugagguggca

SEQ ID NO: 2378505 - RNA, 21 nt, Human
gcuggaaaaguauguuagugc

SEQ ID NO: 2378506 - RNA, 13 nt, Human
gcuggaaggguca

SEQ ID NO: 2378507 - RNA, 21 nt, Human
gcuggaaucuggagagcuaga

SEQ ID NO: 2378508 - RNA, 16 nt, Human
gcuggaaucuggagag

SEQ ID NO: 2378509 - RNA, 19 nt, Human
gcuggaaucuggagagcua

SEQ ID NO: 2378510 - RNA, 23 nt, Human
gcuggaaugauuucagcucacug

SEQ ID NO: 2378511 - RNA, 16 nt, Human
gcuggaacagauucac

SEQ ID NO: 2378512 - RNA, 21 nt, Human
gcuggaacagauucacacugu

SEQ ID NO: 2378513 - RNA, 14 nt, Human
gcuggaagauccug

SEQ ID NO: 2378514 - RNA, 15 nt, Human
gcuggaagauccugc

SEQ ID NO: 2378515 - RNA, 17 nt, Human
gcuggaagauccugcgg

SEQ ID NO: 2378516 - RNA, 18 nt, Human
gcuggaagauccugcggg

SEQ ID NO: 2378517 - RNA, 14 nt, Human
gcugcuuuccccug

SEQ ID NO: 2378518 - RNA, 22 nt, Human
gcugcuugugucccuccuggga

SEQ ID NO: 2378519 - RNA, 23 nt, Human
gcugcuacuuaauuccuuucuca

SEQ ID NO: 2378520 - RNA, 19 nt, Human
gcugcuugugucccuccug

SEQ ID NO: 2378521 - RNA, 15 nt, Human
gcugcuuuccccugu

SEQ ID NO: 2378522 - RNA, 16 nt, Human
gcugcuuuccccugug

SEQ ID NO: 2378523 - RNA, 17 nt, Human
gcugcuuuccccugugg

SEQ ID NO: 2378524 - RNA, 18 nt, Human
gcugcuuuccccuguggg

SEQ ID NO: 2378525 - RNA, 20 nt, Human
gcugcuacccucccugcugu

SEQ ID NO: 2378526 - RNA, 21 nt, Human
gcugcuacccucccugcuguc

SEQ ID NO: 2378527 - RNA, 22 nt, Human
gcugcuacccucccugcugucc

SEQ ID NO: 2378528 - RNA, 23 nt, Human
gcugcuacccucccugcuguccc

SEQ ID NO: 2378529 - RNA, 22 nt, Human
gcugcuuuugucuaugggacuc

SEQ ID NO: 2378530 - RNA, 22 nt, Human
gcugcuuuucccuaagccaagg

SEQ ID NO: 2378531 - RNA, 19 nt, Human
gcugcuuuccccugugggg

SEQ ID NO: 2378532 - RNA, 20 nt, Human
gcugcuuuccccugugggga

SEQ ID NO: 2378533 - RNA, 21 nt, Human
gcugcuuuccccuguggggau

SEQ ID NO: 2378534 - RNA, 19 nt, Human
gcugcuuucuguugucauu

SEQ ID NO: 2378535 - RNA, 14 nt, Human
gcugcuacccagaa

SEQ ID NO: 2378536 - RNA, 23 nt, Human
gcugcuacaaagaagacauguuu

SEQ ID NO: 2378537 - RNA, 14 nt, Human
gcugcuacccuccc

SEQ ID NO: 2378538 - RNA, 16 nt, Human
gcugcuacccucccug

SEQ ID NO: 2378539 - RNA, 17 nt, Human
gcugcuacccucccugc

SEQ ID NO: 2378540 - RNA, 18 nt, Human
gcugcuacccucccugcu

SEQ ID NO: 2378541 - RNA, 19 nt, Human
gcugcuacccucccugcug

SEQ ID NO: 2378542 - RNA, 12 nt, Human
gcugcuacccag

SEQ ID NO: 2378543 - RNA, 20 nt, Human
gcugcuacaaagaagacaug

SEQ ID NO: 2378544 - RNA, 21 nt, Human
gcugcuacaaagaagacaugu

SEQ ID NO: 2378545 - RNA, 16 nt, Human
gcugcuacaaagaaga

SEQ ID NO: 2378546 - RNA, 17 nt, Human
gcugcuacaaagaagac

SEQ ID NO: 2378547 - RNA, 18 nt, Human
gcugcuacaaagaagaca

SEQ ID NO: 2378548 - RNA, 19 nt, Human
gcugcuacaaagaagacau

SEQ ID NO: 2378549 - RNA, 16 nt, Human
gcugcgucuggagggg

SEQ ID NO: 2378550 - RNA, 14 nt, Human
gcugcgugccugug

SEQ ID NO: 2378551 - RNA, 22 nt, Human
gcugcgucuggaggggccccug

SEQ ID NO: 2378552 - RNA, 18 nt, Human
gcugcuaaucuucagggc

SEQ ID NO: 2378553 - RNA, 15 nt, Human
gcugcuaaucuucag

SEQ ID NO: 2378554 - RNA, 20 nt, Human
gcugcuaaucuucagggcac

SEQ ID NO: 2378555 - RNA, 15 nt, Human
gcugcuacaaagaag

SEQ ID NO: 2378556 - RNA, 17 nt, Human
gcugcgcuugcuuuucu

SEQ ID NO: 2378557 - RNA, 16 nt, Human
gcugccuucuggauuc

SEQ ID NO: 2378558 - RNA, 17 nt, Human
gcugccuucuggauucu

SEQ ID NO: 2378559 - RNA, 19 nt, Human
gcugccuucuggauucuug

SEQ ID NO: 2378560 - RNA, 16 nt, Human
gcugccuucccuagcu

SEQ ID NO: 2378561 - RNA, 12 nt, Human
gcugccuucccu

SEQ ID NO: 2378562 - RNA, 13 nt, Human
gcugccuucccua

SEQ ID NO: 2378563 - RNA, 15 nt, Human
gcugccuucccuagc

SEQ ID NO: 2378564 - RNA, 14 nt, Human
gcugcgguccaccc

SEQ ID NO: 2378565 - RNA, 15 nt, Human
gcugcgguccaccca

SEQ ID NO: 2378566 - RNA, 14 nt, Human
gcugcggcacccuu

SEQ ID NO: 2378567 - RNA, 15 nt, Human
gcugcggcacccuug

SEQ ID NO: 2378568 - RNA, 22 nt, Human
gcugcgguccacccaggagccc

SEQ ID NO: 2378569 - RNA, 21 nt, Human
gcugcgguccacccaggagcc

SEQ ID NO: 2378570 - RNA, 20 nt, Human
gcugccuguucagcuccagc

SEQ ID NO: 2378571 - RNA, 22 nt, Human
gcugccuguucagcuccagcuc

SEQ ID NO: 2378572 - RNA, 20 nt, Human
gcugccuuagaaccuuucuu

SEQ ID NO: 2378573 - RNA, 19 nt, Human
gcugcccuggcccugaggu

SEQ ID NO: 2378574 - RNA, 23 nt, Human
gcugcccuggcccugaggugugg

SEQ ID NO: 2378575 - RNA, 17 nt, Human
gcugcccuggugcugcc

SEQ ID NO: 2378576 - RNA, 15 nt, Human
gcugccuuagaaccu

SEQ ID NO: 2378577 - RNA, 18 nt, Human
gcugccuguucagcucca

SEQ ID NO: 2378578 - RNA, 19 nt, Human
gcugccuguucagcuccag

SEQ ID NO: 2378579 - RNA, 12 nt, Human
gcugcccuggug

SEQ ID NO: 2378580 - RNA, 13 nt, Human
gcugcccuggugc

SEQ ID NO: 2378581 - RNA, 14 nt, Human
gcugcccuggugcu

SEQ ID NO: 2378582 - RNA, 15 nt, Human
gcugcccuggugcug

SEQ ID NO: 2378583 - RNA, 13 nt, Human
gcugcccuggccc

SEQ ID NO: 2378584 - RNA, 15 nt, Human
gcugcccugcggccc

SEQ ID NO: 2378585 - RNA, 15 nt, Human
gcugcccugccacuu

SEQ ID NO: 2378586 - RNA, 14 nt, Human
gcugcccuggcccu

SEQ ID NO: 2378587 - RNA, 15 nt, Human
gcugcccuggcccug

SEQ ID NO: 2378588 - RNA, 16 nt, Human
gcugcccuggcccuga

SEQ ID NO: 2378589 - RNA, 17 nt, Human
gcugcccuggcccugag

SEQ ID NO: 2378590 - RNA, 24 nt, Human
gcugcccugcccaccuggccucug

SEQ ID NO: 2378591 - RNA, 22 nt, Human
gcugcccugcccaccuggccuc

SEQ ID NO: 2378592 - RNA, 23 nt, Human
gcugcccugcccaccuggccucu

SEQ ID NO: 2378593 - RNA, 16 nt, Human
gcugcccugcccaccu

SEQ ID NO: 2378594 - RNA, 18 nt, Human
gcugcccugcccaccugg

SEQ ID NO: 2378595 - RNA, 20 nt, Human
gcugcccugcccaccuggcc

SEQ ID NO: 2378596 - RNA, 21 nt, Human
gcugcccugcccaccuggccu

SEQ ID NO: 2378597 - RNA, 13 nt, Human
gcugcccugccca

SEQ ID NO: 2378598 - RNA, 14 nt, Human
gcugcccugcccac

SEQ ID NO: 2378599 - RNA, 12 nt, Human
gcugcccugccc

SEQ ID NO: 2378600 - RNA, 13 nt, Human
gcuguccucaggu

SEQ ID NO: 2378601 - RNA, 18 nt, Human
gcuguccucagguggcca

SEQ ID NO: 2378602 - RNA, 19 nt, Human
gcuguccucagguggccau

SEQ ID NO: 2378603 - RNA, 14 nt, Human
gcuguggccagggu

SEQ ID NO: 2378604 - RNA, 16 nt, Human
gcuguggccaggguga

SEQ ID NO: 2378605 - RNA, 17 nt, Human
gcuguggccagggugag

SEQ ID NO: 2378606 - RNA, 13 nt, Human
gcuguggccaggg

SEQ ID NO: 2378607 - RNA, 14 nt, Human
gcuguggccugggc

SEQ ID NO: 2378608 - RNA, 19 nt, Human
gcuguggccagggugagag

SEQ ID NO: 2378609 - RNA, 21 nt, Human
gcuguggccagggugagagcu

SEQ ID NO: 2378610 - RNA, 15 nt, Human
gcuguggccugggca

SEQ ID NO: 2378611 - RNA, 14 nt, Human
gcugugggaacgag

SEQ ID NO: 2378612 - RNA, 17 nt, Human
gcugugggcagguggga

SEQ ID NO: 2378613 - RNA, 14 nt, Human
gcugugucuaaacu

SEQ ID NO: 2378614 - RNA, 15 nt, Human
gcugugucuaaacug

SEQ ID NO: 2378615 - RNA, 16 nt, Human
gcugugucuaaacugc

SEQ ID NO: 2378616 - RNA, 14 nt, Human
gcugugggcaggug

SEQ ID NO: 2378617 - RNA, 22 nt, Human
gcuguggccagggugagagcug

SEQ ID NO: 2378618 - RNA, 13 nt, Human
gcugugggcaggu

SEQ ID NO: 2378619 - RNA, 15 nt, Human
gcugugucucccuuc

SEQ ID NO: 2378620 - RNA, 16 nt, Human
gcuguguggcagucug

SEQ ID NO: 2378621 - RNA, 16 nt, Human
gcugugugcucuccaa

SEQ ID NO: 2378622 - RNA, 13 nt, Human
gcuguuagagucc

SEQ ID NO: 2378623 - RNA, 22 nt, Human
gcuuacaagccagcuggagaaa

SEQ ID NO: 2378624 - RNA, 18 nt, Human
gcuguuauuucuauuuuu

SEQ ID NO: 2378625 - RNA, 14 nt, Human
gcuuacaauucccu

SEQ ID NO: 2378626 - RNA, 19 nt, Human
gcuuacaauucccugcugu

SEQ ID NO: 2378627 - RNA, 20 nt, Human
gcuuacaauucccugcuguc

SEQ ID NO: 2378628 - RNA, 18 nt, Human
gcuuacacaucucagacc

SEQ ID NO: 2378629 - RNA, 11 nt, Human
gcuuacauuuu

SEQ ID NO: 2378630 - RNA, 14 nt, Human
gcuuacauuuuuac

SEQ ID NO: 2378631 - RNA, 18 nt, Human
gcuuacauuuuuacaaua

SEQ ID NO: 2378632 - RNA, 22 nt, Human
gcuuacaauuuuuuuaauuuug

SEQ ID NO: 2378633 - RNA, 23 nt, Human
gcuuacaauuuuuuuaauuuugu

SEQ ID NO: 2378634 - RNA, 12 nt, Human
gcuuacaauuuu

SEQ ID NO: 2378635 - RNA, 14 nt, Human
gcuuacaauuuuuu

SEQ ID NO: 2378636 - RNA, 19 nt, Human
gcuuacaauuuuuuuaauu

SEQ ID NO: 2378637 - RNA, 21 nt, Human
gcuuacaauuuuuuuaauuuu

SEQ ID NO: 2378638 - RNA, 13 nt, Human
gcugugugguuug

SEQ ID NO: 2378639 - RNA, 22 nt, Human
gcugugugguuugguguguucc

SEQ ID NO: 2378640 - RNA, 18 nt, Human
gcuguguuaaauaaaccu

SEQ ID NO: 2378641 - RNA, 18 nt, Human
gcuguguguuaguuccca

SEQ ID NO: 2378642 - RNA, 22 nt, Human
gcuguguguuaguucccaacau

SEQ ID NO: 2378643 - RNA, 14 nt, Human
gcuguguuccccaa

SEQ ID NO: 2378644 - RNA, 17 nt, Human
gcuguguucuggugagg

SEQ ID NO: 2378645 - RNA, 17 nt, Human
gcuguguuugagcucug

SEQ ID NO: 2378646 - RNA, 16 nt, Human
gcuguccuaggccaca

SEQ ID NO: 2378647 - RNA, 14 nt, Human
gcuguccuaggcca

SEQ ID NO: 2378648 - RNA, 13 nt, Human
gcuguccuaggcc

SEQ ID NO: 2378649 - RNA, 20 nt, Human
gcuguccccucuugccccaa

SEQ ID NO: 2378650 - RNA, 23 nt, Human
gcuguccccucuugccccaaccc

SEQ ID NO: 2378651 - RNA, 16 nt, Human
gcugucccuuuuccuu

SEQ ID NO: 2378652 - RNA, 16 nt, Human
gcuguccccucuugcc

SEQ ID NO: 2378653 - RNA, 17 nt, Human
gcuguccccucuugccc

SEQ ID NO: 2378654 - RNA, 18 nt, Human
gcuguccccucuugcccc

SEQ ID NO: 2378655 - RNA, 19 nt, Human
gcuguccccucuugcccca

SEQ ID NO: 2378656 - RNA, 23 nt, Human
gcugucccuuacgugaguccugg

SEQ ID NO: 2378657 - RNA, 22 nt, Human
gcugucaucugugcacugccca

SEQ ID NO: 2378658 - RNA, 12 nt, Human
gcuguccagaca

SEQ ID NO: 2378659 - RNA, 13 nt, Human
gcuguccagacag

SEQ ID NO: 2378660 - RNA, 14 nt, Human
gcuguccagacagc

SEQ ID NO: 2378661 - RNA, 15 nt, Human
gcuguccagacagcc

SEQ ID NO: 2378662 - RNA, 16 nt, Human
gcuguccagacagccu

SEQ ID NO: 2378663 - RNA, 18 nt, Human
gcuguccagacagccugu

SEQ ID NO: 2378664 - RNA, 22 nt, Human
gcuguccagacagccuguaucu

SEQ ID NO: 2378665 - RNA, 18 nt, Human
gcuguccagugcccauuc

SEQ ID NO: 2378666 - RNA, 23 nt, Human
gcuguccagugcccauuccucac

SEQ ID NO: 2378667 - RNA, 12 nt, Human
gcuguccagugc

SEQ ID NO: 2378668 - RNA, 14 nt, Human
gcuguccagugccc

SEQ ID NO: 2378669 - RNA, 15 nt, Human
gcuguccagugccca

SEQ ID NO: 2378670 - RNA, 16 nt, Human
gcuguccagugcccau

SEQ ID NO: 2378671 - RNA, 22 nt, Human
gcugucccaucuccacuguuau

SEQ ID NO: 2378672 - RNA, 12 nt, Human
gcuguccccucu

SEQ ID NO: 2378673 - RNA, 15 nt, Human
gcuguccccucuugc

SEQ ID NO: 2378674 - RNA, 13 nt, Human
gcugucaucucag

SEQ ID NO: 2378675 - RNA, 18 nt, Human
gcugucauaagaaugaau

SEQ ID NO: 2378676 - RNA, 16 nt, Human
gcugucaucugugcac

SEQ ID NO: 2378677 - RNA, 15 nt, Human
gcugucaucugugca

SEQ ID NO: 2378678 - RNA, 14 nt, Human
gcugucaucugugc

SEQ ID NO: 2378679 - RNA, 23 nt, Human
gcugucaucaauugaauggucag

SEQ ID NO: 2378680 - RNA, 17 nt, Human
gcugucagccauuccug

SEQ ID NO: 2378681 - RNA, 14 nt, Human
gcuggugcccggag

SEQ ID NO: 2378682 - RNA, 23 nt, Human
gcuggugccagccuuccucugca

SEQ ID NO: 2378683 - RNA, 14 nt, Human
gcuggugucaccug

SEQ ID NO: 2378684 - RNA, 15 nt, Human
gcuggugucaccuga

SEQ ID NO: 2378685 - RNA, 22 nt, Human
gcuggucaaacaaacucucuga

SEQ ID NO: 2378686 - RNA, 13 nt, Human
gcuggucacagcc

SEQ ID NO: 2378687 - RNA, 15 nt, Human
gcuggucacagccuc

SEQ ID NO: 2378688 - RNA, 17 nt, Human
gcuggucacagccuccu

SEQ ID NO: 2378689 - RNA, 18 nt, Human
gcuggucacagccuccuc

SEQ ID NO: 2378690 - RNA, 13 nt, Human
gcuggucacugcc

SEQ ID NO: 2378691 - RNA, 20 nt, Human
gcuggucacagccuccucug

SEQ ID NO: 2378692 - RNA, 22 nt, Human
gcuggucacagccuccucuguc

SEQ ID NO: 2378693 - RNA, 15 nt, Human
gcuggucacugccau

SEQ ID NO: 2378694 - RNA, 18 nt, Human
gcuggucacugccaugga

SEQ ID NO: 2378695 - RNA, 18 nt, Human
gcugggggccucagugcc

SEQ ID NO: 2378696 - RNA, 17 nt, Human
gcuggggcaagucccug

SEQ ID NO: 2378697 - RNA, 14 nt, Human
gcugggggccucag

SEQ ID NO: 2378698 - RNA, 15 nt, Human
gcugggggccucagu

SEQ ID NO: 2378699 - RNA, 14 nt, Human
gcuggggaugucuc

SEQ ID NO: 2378700 - RNA, 23 nt, Human
gcuggggacggggggccccaguc

SEQ ID NO: 2378701 - RNA, 22 nt, Human
gcuggggacggggggccccagu

SEQ ID NO: 2378702 - RNA, 20 nt, Human
gcuggggaaguccucugggu

SEQ ID NO: 2378703 - RNA, 16 nt, Human
gcuggggaccugguac

SEQ ID NO: 2378704 - RNA, 23 nt, Human
gcuggggaccugguacccuccug

SEQ ID NO: 2378705 - RNA, 20 nt, Human
gcuggucucaaacuccugac

SEQ ID NO: 2378706 - RNA, 19 nt, Human
gcuggucucaaacuccuga

SEQ ID NO: 2378707 - RNA, 22 nt, Human
gcuggucauguguuugaacuuc

SEQ ID NO: 2378708 - RNA, 15 nt, Human
gcugguccgugggac

SEQ ID NO: 2378709 - RNA, 16 nt, Human
gcugguccgugggacg

SEQ ID NO: 2378710 - RNA, 14 nt, Human
gcuggucccacuca

SEQ ID NO: 2378711 - RNA, 14 nt, Human
gcugguccagggcu

SEQ ID NO: 2378712 - RNA, 19 nt, Human
gcugguccagggcuaguga

SEQ ID NO: 2378713 - RNA, 13 nt, Human
gcuggugcccgga

SEQ ID NO: 2378714 - RNA, 15 nt, Human
gcuggugccagccuu

SEQ ID NO: 2378715 - RNA, 22 nt, Human
gcuggugccagccuuccucugc

SEQ ID NO: 2378716 - RNA, 22 nt, Human
gcuggugcauuacagagaggag

SEQ ID NO: 2378717 - RNA, 20 nt, Human
gcuggugcauuacagagagg

SEQ ID NO: 2378718 - RNA, 13 nt, Human
gcuggugccagcc

SEQ ID NO: 2378719 - RNA, 14 nt, Human
gcuggugccagccu

SEQ ID NO: 2378720 - RNA, 18 nt, Human
gcuggugcauuacagaga

SEQ ID NO: 2378721 - RNA, 17 nt, Human
gcuggugcauuacagag

SEQ ID NO: 2378722 - RNA, 13 nt, Human
gcuggugcauuac

SEQ ID NO: 2378723 - RNA, 21 nt, Human
gcuggugauggagguuucaua

SEQ ID NO: 2378724 - RNA, 19 nt, Human
gcuggugauggagguuuca

SEQ ID NO: 2378725 - RNA, 20 nt, Human
gcuggugcagagcugaagau

SEQ ID NO: 2378726 - RNA, 18 nt, Human
gcuggugagugaugcggc

SEQ ID NO: 2378727 - RNA, 20 nt, Human
gcuggugagugaugcggcag

SEQ ID NO: 2378728 - RNA, 23 nt, Human
gcuggucucgaacuccugaccuu

SEQ ID NO: 2378729 - RNA, 22 nt, Human
gcuggucucgaacuccugaccu

SEQ ID NO: 2378730 - RNA, 19 nt, Human
gcuggucucgaacuccuga

SEQ ID NO: 2378731 - RNA, 19 nt, Human
gcugggagggauagagggg

SEQ ID NO: 2378732 - RNA, 20 nt, Human
gcugggaggcauggcccugg

SEQ ID NO: 2378733 - RNA, 18 nt, Human
gcugggaguaguugucuu

SEQ ID NO: 2378734 - RNA, 16 nt, Human
gcugggaggcaagagg

SEQ ID NO: 2378735 - RNA, 21 nt, Human
gcugggaggcaagaggggugg

SEQ ID NO: 2378736 - RNA, 14 nt, Human
gcugggaggcaugg

SEQ ID NO: 2378737 - RNA, 15 nt, Human
gcugggaggcauggc

SEQ ID NO: 2378738 - RNA, 12 nt, Human
gcugggaggcaa

SEQ ID NO: 2378739 - RNA, 19 nt, Human
gcugggaugauuggagggg

SEQ ID NO: 2378740 - RNA, 21 nt, Human
gcugggcucccuucccaccuc

SEQ ID NO: 2378741 - RNA, 13 nt, Human
gcuggccuggccc

SEQ ID NO: 2378742 - RNA, 12 nt, Human
gcuggccuggcc

SEQ ID NO: 2378743 - RNA, 14 nt, Human
gcuggccuggcccc

SEQ ID NO: 2378744 - RNA, 15 nt, Human
gcuggccuggccccu

SEQ ID NO: 2378745 - RNA, 14 nt, Human
gcugggcugggcgc

SEQ ID NO: 2378746 - RNA, 13 nt, Human
gcugggcuggcuc

SEQ ID NO: 2378747 - RNA, 22 nt, Human
gcugggcuuggcagcccggguc

SEQ ID NO: 2378748 - RNA, 12 nt, Human
gcugggcugggg

SEQ ID NO: 2378749 - RNA, 21 nt, Human
gcugggcuucaguggcagcug

SEQ ID NO: 2378750 - RNA, 22 nt, Human
gcugggcuucaguggcagcugc

SEQ ID NO: 2378751 - RNA, 22 nt, Human
gcugggcucuccaccucagccu

SEQ ID NO: 2378752 - RNA, 21 nt, Human
gcugggcucuccaccucagcc

SEQ ID NO: 2378753 - RNA, 20 nt, Human
gcugggcucuccaccucagc

SEQ ID NO: 2378754 - RNA, 19 nt, Human
gcugggcucuccaccucag

SEQ ID NO: 2378755 - RNA, 13 nt, Human
gcugggcucugca

SEQ ID NO: 2378756 - RNA, 14 nt, Human
gcugggcucugcca

SEQ ID NO: 2378757 - RNA, 15 nt, Human
gcugggcucugccac

SEQ ID NO: 2378758 - RNA, 15 nt, Human
gcugggcucuccacc

SEQ ID NO: 2378759 - RNA, 14 nt, Human
gcugggcucuccac

SEQ ID NO: 2378760 - RNA, 13 nt, Human
gcugggcucucca

SEQ ID NO: 2378761 - RNA, 21 nt, Human
gcugggagggauagagggggg

SEQ ID NO: 2378762 - RNA, 20 nt, Human
gcugggcuucaguggcagcu

SEQ ID NO: 2378763 - RNA, 21 nt, Human
gcugggcucugccacccuacc

SEQ ID NO: 2378764 - RNA, 12 nt, Human
gcugggcugagc

SEQ ID NO: 2378765 - RNA, 13 nt, Human
gcugggcugagcc

SEQ ID NO: 2378766 - RNA, 14 nt, Human
gcugggcugagccc

SEQ ID NO: 2378767 - RNA, 18 nt, Human
gcugggcugagccccuac

SEQ ID NO: 2378768 - RNA, 19 nt, Human
gcugggcugagccccuacc

SEQ ID NO: 2378769 - RNA, 20 nt, Human
gcugggcugagccccuaccc

SEQ ID NO: 2378770 - RNA, 22 nt, Human
gcugggcugagccccuacccca

SEQ ID NO: 2378771 - RNA, 16 nt, Human
gcuucucauccugcag

SEQ ID NO: 2378772 - RNA, 16 nt, Human
gcuucucauacgucca

SEQ ID NO: 2378773 - RNA, 22 nt, Human
gcuuccagauugacgacaagug

SEQ ID NO: 2378774 - RNA, 23 nt, Human
gcuuccagauugacgacaagugc

SEQ ID NO: 2378775 - RNA, 17 nt, Human
gcuucucacugccaugc

SEQ ID NO: 2378776 - RNA, 22 nt, Human
gcuucucacugccaugccagcu

SEQ ID NO: 2378777 - RNA, 17 nt, Human
gcuuccaccucacccca

SEQ ID NO: 2378778 - RNA, 19 nt, Human
gcuuccaccucaccccacu

SEQ ID NO: 2378779 - RNA, 20 nt, Human
gcuuccaccucaccccacuu

SEQ ID NO: 2378780 - RNA, 13 nt, Human
gcuuccagagagu

SEQ ID NO: 2378781 - RNA, 19 nt, Human
gcuuccagagaguccucug

SEQ ID NO: 2378782 - RNA, 20 nt, Human
gcuuccagagaguccucugg

SEQ ID NO: 2378783 - RNA, 21 nt, Human
gcuuccagagaguccucugga

SEQ ID NO: 2378784 - RNA, 22 nt, Human
gcuuccagagaguccucuggau

SEQ ID NO: 2378785 - RNA, 15 nt, Human
gcuucauuagagcag

SEQ ID NO: 2378786 - RNA, 16 nt, Human
gcuucauuagagcagg

SEQ ID NO: 2378787 - RNA, 17 nt, Human
gcuucauuagagcaggc

SEQ ID NO: 2378788 - RNA, 18 nt, Human
gcuucauuagagcaggcg

SEQ ID NO: 2378789 - RNA, 18 nt, Human
gcuucauuuccugugucu

SEQ ID NO: 2378790 - RNA, 19 nt, Human
gcuuccagaaaaccccagc

SEQ ID NO: 2378791 - RNA, 12 nt, Human
gcuuccaccuca

SEQ ID NO: 2378792 - RNA, 14 nt, Human
gcuuccaccucacc

SEQ ID NO: 2378793 - RNA, 15 nt, Human
gcuuccaccucaccc

SEQ ID NO: 2378794 - RNA, 16 nt, Human
gcuuccaccucacccc

SEQ ID NO: 2378795 - RNA, 18 nt, Human
gcuuccaagguggucugc

SEQ ID NO: 2378796 - RNA, 12 nt, Human
gcuuccaauuuu

SEQ ID NO: 2378797 - RNA, 21 nt, Human
gcuuccaaggcagaagcagca

SEQ ID NO: 2378798 - RNA, 15 nt, Human
gcuuccaaggugguc

SEQ ID NO: 2378799 - RNA, 16 nt, Human
gcuuccaagguggucu

SEQ ID NO: 2378800 - RNA, 19 nt, Human
gcuucuguugcugccucau

SEQ ID NO: 2378801 - RNA, 19 nt, Human
gcuucuguuuuauaauuuu

SEQ ID NO: 2378802 - RNA, 18 nt, Human
gcuucuggagcccuuggg

SEQ ID NO: 2378803 - RNA, 17 nt, Human
gcuucuggagcccuugg

SEQ ID NO: 2378804 - RNA, 14 nt, Human
gcuucuggagcccu

SEQ ID NO: 2378805 - RNA, 13 nt, Human
gcuucuggagccc

SEQ ID NO: 2378806 - RNA, 18 nt, Human
gcuucuguugcugccuca

SEQ ID NO: 2378807 - RNA, 17 nt, Human
gcuucuguugcugccuc

SEQ ID NO: 2378808 - RNA, 17 nt, Human
gcuucucauccugcagg

SEQ ID NO: 2378809 - RNA, 18 nt, Human
gcuucucauccugcaggc

SEQ ID NO: 2378810 - RNA, 12 nt, Human
gcuucugcuggg

SEQ ID NO: 2378811 - RNA, 14 nt, Human
gcuucugcugggcu

SEQ ID NO: 2378812 - RNA, 15 nt, Human
gcuucugcugggcug

SEQ ID NO: 2378813 - RNA, 22 nt, Human
gcuucugcugggcuggggccug

SEQ ID NO: 2378814 - RNA, 16 nt, Human
gcuucugcugggcugg

SEQ ID NO: 2378815 - RNA, 17 nt, Human
gcuucugcugggcuggg

SEQ ID NO: 2378816 - RNA, 12 nt, Human
gcuucuggagcc

SEQ ID NO: 2378817 - RNA, 23 nt, Human
gcuucugcuuuucugcccuggcu

SEQ ID NO: 2378818 - RNA, 16 nt, Human
gcuucugcuuuucugc

SEQ ID NO: 2378819 - RNA, 19 nt, Human
gcuucugcuuuucugcccu

SEQ ID NO: 2378820 - RNA, 20 nt, Human
gcuucugcuuuucugcccug

SEQ ID NO: 2378821 - RNA, 21 nt, Human
gcuucugcuuuucugcccugg

SEQ ID NO: 2378822 - RNA, 13 nt, Human
gcuucugcuuuuc

SEQ ID NO: 2378823 - RNA, 14 nt, Human
gcuucugcuuuucu

SEQ ID NO: 2378824 - RNA, 15 nt, Human
gcuucugcuuuucug

SEQ ID NO: 2378825 - RNA, 19 nt, Human
gcuuacauuuuuacaauaa

SEQ ID NO: 2378826 - RNA, 21 nt, Human
gcuuacuacaugugggagcuu

SEQ ID NO: 2378827 - RNA, 23 nt, Human
gcuuacuaagcuuugccagcugc

SEQ ID NO: 2378828 - RNA, 17 nt, Human
gcuuacuaagcuuugcc

SEQ ID NO: 2378829 - RNA, 20 nt, Human
gcuuacuuuggaauacauuu

SEQ ID NO: 2378830 - RNA, 21 nt, Human
gcuuacugauauauuuuacaa

SEQ ID NO: 2378831 - RNA, 17 nt, Human
gcuuacugauauauuuu

SEQ ID NO: 2378832 - RNA, 18 nt, Human
gcuuagaccucagccugu

SEQ ID NO: 2378833 - RNA, 15 nt, Human
gcuuagacauaacaa

SEQ ID NO: 2378834 - RNA, 17 nt, Human
gcuuagaccucagccug

SEQ ID NO: 2378835 - RNA, 20 nt, Human
gcuuauacacuuacacuuua

SEQ ID NO: 2378836 - RNA, 16 nt, Human
gcuuagaccucagccu

SEQ ID NO: 2378837 - RNA, 15 nt, Human
gcuuagaccucagcc

SEQ ID NO: 2378838 - RNA, 14 nt, Human
gcuuagaccucagc

SEQ ID NO: 2378839 - RNA, 13 nt, Human
gcuuagaccucag

SEQ ID NO: 2378840 - RNA, 15 nt, Human
gcuuauagguggccu

SEQ ID NO: 2378841 - RNA, 17 nt, Human
gcuuauagguggccucu

SEQ ID NO: 2378842 - RNA, 16 nt, Human
gcuucaugacauuccu

SEQ ID NO: 2378843 - RNA, 14 nt, Human
gcuucaugccagcu

SEQ ID NO: 2378844 - RNA, 14 nt, Human
gcuucaugcucagc

SEQ ID NO: 2378845 - RNA, 17 nt, Human
gcuucauggcagaaggc

SEQ ID NO: 2378846 - RNA, 18 nt, Human
gcuucaugcucagcccug

SEQ ID NO: 2378847 - RNA, 11 nt, Human
gcuucauacac

SEQ ID NO: 2378848 - RNA, 18 nt, Human
gcuucauaaaugaagcag

SEQ ID NO: 2378849 - RNA, 22 nt, Human
gcuucauaaaugaagcagcuuu

SEQ ID NO: 2378850 - RNA, 10 nt, Human
gcuucauaca

SEQ ID NO: 2378851 - RNA, 14 nt, Human
gcuucaucuggcaa

SEQ ID NO: 2378852 - RNA, 13 nt, Human
gcuucaucuguca

SEQ ID NO: 2378853 - RNA, 18 nt, Human
gcuucaucugucaagugg

SEQ ID NO: 2378854 - RNA, 21 nt, Human
gcuucauccuccucagaucuu

SEQ ID NO: 2378855 - RNA, 23 nt, Human
gcuuaucaugcugucuuuacaug

SEQ ID NO: 2378856 - RNA, 17 nt, Human
gcuuaucaauaaaccug

SEQ ID NO: 2378857 - RNA, 19 nt, Human
gcuucaguggcagcugcuu

SEQ ID NO: 2378858 - RNA, 15 nt, Human
gcuucaguuguuuuc

SEQ ID NO: 2378859 - RNA, 18 nt, Human
gcuucaguuguuuucccg

SEQ ID NO: 2378860 - RNA, 19 nt, Human
gcuucaguuuccuggucug

SEQ ID NO: 2378861 - RNA, 14 nt, Human
gcuucauaaaugaa

SEQ ID NO: 2378862 - RNA, 20 nt, Human
gcuucaguggcagcugcuuu

SEQ ID NO: 2378863 - RNA, 21 nt, Human
gcuuuccauguugcugccaac

SEQ ID NO: 2378864 - RNA, 18 nt, Human
gcuuugggcugcccuggu

SEQ ID NO: 2378865 - RNA, 19 nt, Human
gcuuugggcugcccuggug

SEQ ID NO: 2378866 - RNA, 14 nt, Human
gcuuuccagcucac

SEQ ID NO: 2378867 - RNA, 18 nt, Human
gcuuuccacaccuggcac

SEQ ID NO: 2378868 - RNA, 11 nt, Human
gcuuuccagcu

SEQ ID NO: 2378869 - RNA, 19 nt, Human
gcuuuccauguugcugcca

SEQ ID NO: 2378870 - RNA, 16 nt, Human
gcuuuccauguugcug

SEQ ID NO: 2378871 - RNA, 15 nt, Human
gcuuuguaggugucu

SEQ ID NO: 2378872 - RNA, 16 nt, Human
gcuuuuauagaggcua

SEQ ID NO: 2378873 - RNA, 16 nt, Human
gcuuuguaggugucuc

SEQ ID NO: 2378874 - RNA, 13 nt, Human
gcuuuuaugugaa

SEQ ID NO: 2378875 - RNA, 15 nt, Human
gcuuuuaugugaaac

SEQ ID NO: 2378876 - RNA, 12 nt, Human
gcuuucaugauu

SEQ ID NO: 2378877 - RNA, 12 nt, Human
gcuuucaguauu

SEQ ID NO: 2378878 - RNA, 18 nt, Human
gcuuucaugauuagcaag

SEQ ID NO: 2378879 - RNA, 12 nt, Human
gcuuucauguaa

SEQ ID NO: 2378880 - RNA, 19 nt, Human
gcuuuaaccauuaaaacug

SEQ ID NO: 2378881 - RNA, 18 nt, Human
gcuuuaaacucagggaca

SEQ ID NO: 2378882 - RNA, 21 nt, Human
gcuuuaaacucagggacagag

SEQ ID NO: 2378883 - RNA, 22 nt, Human
gcuuuaaacucagggacagagc

SEQ ID NO: 2378884 - RNA, 14 nt, Human
gcuuuccaaagcca

SEQ ID NO: 2378885 - RNA, 21 nt, Human
gcuuucauguaaacugugcac

SEQ ID NO: 2378886 - RNA, 20 nt, Human
gcuuucauguaaacugugca

SEQ ID NO: 2378887 - RNA, 15 nt, Human
gcuuucauguaaacu

SEQ ID NO: 2378888 - RNA, 19 nt, Human
gcuuguuugcucaccuggg

SEQ ID NO: 2378889 - RNA, 23 nt, Human
gcuuguuuccuagcacacacuuu

SEQ ID NO: 2378890 - RNA, 15 nt, Human
gcuuguuuccuagca

SEQ ID NO: 2378891 - RNA, 23 nt, Human
gcuuguugggauuccugacccag

SEQ ID NO: 2378892 - RNA, 24 nt, Human
gcuuguugggauuccugacccagg

SEQ ID NO: 2378893 - RNA, 13 nt, Human
gcuuguuuacagc

SEQ ID NO: 2378894 - RNA, 20 nt, Human
gcuuguuuacagcacuacuc

SEQ ID NO: 2378895 - RNA, 23 nt, Human
gcuuguuuucuugccaaugaggu

SEQ ID NO: 2378896 - RNA, 21 nt, Human
gcuuguuugcucaccuggggu

SEQ ID NO: 2378897 - RNA, 15 nt, Human
gcuuuaaaaacuauu

SEQ ID NO: 2378898 - RNA, 20 nt, Human
gcuuuaaaaacuauuuaacu

SEQ ID NO: 2378899 - RNA, 23 nt, Human
gcuuuaaaaacuauuuaacuuga

SEQ ID NO: 2378900 - RNA, 13 nt, Human
gcuuuaaacaaau

SEQ ID NO: 2378901 - RNA, 17 nt, Human
gcuuuaaacaaauucau

SEQ ID NO: 2378902 - RNA, 22 nt, Human
gcuuuaaacauugguucuugua

SEQ ID NO: 2378903 - RNA, 16 nt, Human
gcuuuaaacacccuuc

SEQ ID NO: 2378904 - RNA, 16 nt, Human
gcuuuaaacucaggga

SEQ ID NO: 2378905 - RNA, 14 nt, Human
gcuucuuaaaugag

SEQ ID NO: 2378906 - RNA, 15 nt, Human
gcuucuuaaagaguu

SEQ ID NO: 2378907 - RNA, 22 nt, Human
gcuugccuagggccugguccau

SEQ ID NO: 2378908 - RNA, 14 nt, Human
gcuugccucggcuc

SEQ ID NO: 2378909 - RNA, 21 nt, Human
gcuugccuagggccuggucca

SEQ ID NO: 2378910 - RNA, 17 nt, Human
gcuugccuagggccugg

SEQ ID NO: 2378911 - RNA, 13 nt, Human
gcuugccuagggc

SEQ ID NO: 2378912 - RNA, 13 nt, Human
gcuugccugcagg

SEQ ID NO: 2378913 - RNA, 14 nt, Human
gcuugccugcaggc

SEQ ID NO: 2378914 - RNA, 15 nt, Human
gcuugccucggcucc

SEQ ID NO: 2378915 - RNA, 16 nt, Human
gcuugccucggcuccu

SEQ ID NO: 2378916 - RNA, 18 nt, Human
gcuugccucggcuccugc

SEQ ID NO: 2378917 - RNA, 19 nt, Human
gcuugccucggcuccugcu

SEQ ID NO: 2378918 - RNA, 20 nt, Human
gcuugccucggcuccugcug

SEQ ID NO: 2378919 - RNA, 21 nt, Human
gcuugccucggcuccugcugc

SEQ ID NO: 2378920 - RNA, 22 nt, Human
gcuugccucggcuccugcugca

SEQ ID NO: 2378921 - RNA, 23 nt, Human
gcuugccucggcuccugcugcac

SEQ ID NO: 2378922 - RNA, 18 nt, Human
gcuuggaaacuggaugag

SEQ ID NO: 2378923 - RNA, 12 nt, Human
gcuugcuuuucu

SEQ ID NO: 2378924 - RNA, 12 nt, Human
gcuugcugagag

SEQ ID NO: 2378925 - RNA, 13 nt, Human
gcuugcugagagg

SEQ ID NO: 2378926 - RNA, 21 nt, Human
gcuuggaaagcaucaccucag

SEQ ID NO: 2378927 - RNA, 19 nt, Human
gcuuggaaagcaucaccuc

SEQ ID NO: 2378928 - RNA, 15 nt, Human
gcuuggaagagccug

SEQ ID NO: 2378929 - RNA, 18 nt, Human
gcuuggaagagccugcag

SEQ ID NO: 2378930 - RNA, 23 nt, Human
gcuuggaagagccugcaggugcu

SEQ ID NO: 2378931 - RNA, 22 nt, Human
gcuugcguuagaaugaggagga

SEQ ID NO: 2378932 - RNA, 16 nt, Human
gcuugcguaugucugu

SEQ ID NO: 2378933 - RNA, 15 nt, Human
gcuugccucucuguu

SEQ ID NO: 2378934 - RNA, 19 nt, Human
gcuugccugauauaaaugc

SEQ ID NO: 2378935 - RNA, 23 nt, Human
gcuugcucuucagugggagaaaa

SEQ ID NO: 2378936 - RNA, 14 nt, Human
gcuugcucauuuuu

SEQ ID NO: 2378937 - RNA, 16 nt, Human
gcuuggacggcugggc

SEQ ID NO: 2378938 - RNA, 12 nt, Human
gcuuggacugga

SEQ ID NO: 2378939 - RNA, 14 nt, Human
gcuuggagcagagg

SEQ ID NO: 2378940 - RNA, 15 nt, Human
gcuugugcaacaaua

SEQ ID NO: 2378941 - RNA, 14 nt, Human
gcuugugcacaauu

SEQ ID NO: 2378942 - RNA, 18 nt, Human
gcuugugcagaaaacauu

SEQ ID NO: 2378943 - RNA, 21 nt, Human
gcuugugcagaaaacauuguu

SEQ ID NO: 2378944 - RNA, 22 nt, Human
gcuugugcagaaaacauuguuc

SEQ ID NO: 2378945 - RNA, 14 nt, Human
gcuuguggagcccc

SEQ ID NO: 2378946 - RNA, 19 nt, Human
gcuuguggagccccacacu

SEQ ID NO: 2378947 - RNA, 20 nt, Human
gcuuguggagccccacacug

SEQ ID NO: 2378948 - RNA, 23 nt, Human
gcuuguggauugaggguaggagg

SEQ ID NO: 2378949 - RNA, 11 nt, Human
gcuuguguauc

SEQ ID NO: 2378950 - RNA, 18 nt, Human
gcuuguguauccauuauc

SEQ ID NO: 2378951 - RNA, 19 nt, Human
gcuuguguauccauuauca

SEQ ID NO: 2378952 - RNA, 12 nt, Human
gcuuguguuaag

SEQ ID NO: 2378953 - RNA, 20 nt, Human
gcuuguguauccauuaucau

SEQ ID NO: 2378954 - RNA, 22 nt, Human
gcuuguguauccauuaucaugu

SEQ ID NO: 2378955 - RNA, 14 nt, Human
gcuuguguguuuca

SEQ ID NO: 2378956 - RNA, 15 nt, Human
gcuuguguguuucac

SEQ ID NO: 2378957 - RNA, 16 nt, Human
gcuuguguguuucacu

SEQ ID NO: 2378958 - RNA, 19 nt, Human
gcuuguguguuucacuuuu

SEQ ID NO: 2378959 - RNA, 20 nt, Human
gcuuguguguuucacuuuua

SEQ ID NO: 2378960 - RNA, 21 nt, Human
gcuuguguguuucacuuuuag

SEQ ID NO: 2378961 - RNA, 18 nt, Human
gcuuguucccucucccug

SEQ ID NO: 2378962 - RNA, 15 nt, Human
gcuuguuauuuauaa

SEQ ID NO: 2378963 - RNA, 14 nt, Human
gcuuguuggauuuu

SEQ ID NO: 2378964 - RNA, 18 nt, Human
gcuuguugggauuccuga

SEQ ID NO: 2378965 - RNA, 20 nt, Human
gcuuguugggauuccugacc

SEQ ID NO: 2378966 - RNA, 21 nt, Human
gcuuguugggauuccugaccc

SEQ ID NO: 2378967 - RNA, 22 nt, Human
gcuuguugggauuccugaccca

SEQ ID NO: 2378968 - RNA, 16 nt, Human
gcaggccaggccagcu

SEQ ID NO: 2378969 - RNA, 15 nt, Human
gcaggccaggccagc

SEQ ID NO: 2378970 - RNA, 17 nt, Human
gcaggccaggccagcug

SEQ ID NO: 2378971 - RNA, 12 nt, Human
gcaggcccugca

SEQ ID NO: 2378972 - RNA, 14 nt, Human
gcaggcccugcacu

SEQ ID NO: 2378973 - RNA, 15 nt, Human
gcaggcccugcacug

SEQ ID NO: 2378974 - RNA, 18 nt, Human
gcaggcccugcacugucc

SEQ ID NO: 2378975 - RNA, 20 nt, Human
gcaggcccugcacuguccug

SEQ ID NO: 2378976 - RNA, 23 nt, Human
gcaggcccugcacuguccugcuc

SEQ ID NO: 2378977 - RNA, 12 nt, Human
gcaggcccuggc

SEQ ID NO: 2378978 - RNA, 14 nt, Human
gcaggcccuggccu

SEQ ID NO: 2378979 - RNA, 15 nt, Human
gcaggcccuggccuc

SEQ ID NO: 2378980 - RNA, 16 nt, Human
gcaggcccuggccucc

SEQ ID NO: 2378981 - RNA, 20 nt, Human
gcaggccaagucaggcccuu

SEQ ID NO: 2378982 - RNA, 23 nt, Human
gcaggccaaggccuucuccuccc

SEQ ID NO: 2378983 - RNA, 14 nt, Human
gcaggagauugaga

SEQ ID NO: 2378984 - RNA, 19 nt, Human
gcaggccaaggccuucucc

SEQ ID NO: 2378985 - RNA, 20 nt, Human
gcaggccaaggccuucuccu

SEQ ID NO: 2378986 - RNA, 21 nt, Human
gcaggccaaggccuucuccuc

SEQ ID NO: 2378987 - RNA, 24 nt, Human
gcaggccaagagcagaggcagcga

SEQ ID NO: 2378988 - RNA, 22 nt, Human
gcaggccaagagcagaggcagc

SEQ ID NO: 2378989 - RNA, 20 nt, Human
gcaggccaagagcagaggca

SEQ ID NO: 2378990 - RNA, 16 nt, Human
gcaggcauguccugga

SEQ ID NO: 2378991 - RNA, 17 nt, Human
gcaggcauagaggcuuc

SEQ ID NO: 2378992 - RNA, 20 nt, Human
gcaggcaugcaugugcuugu

SEQ ID NO: 2378993 - RNA, 22 nt, Human
gcaggagaaucacuugcacucc

SEQ ID NO: 2378994 - RNA, 13 nt, Human
gcaggagaggaga

SEQ ID NO: 2378995 - RNA, 16 nt, Human
gcaggagaggagagcc

SEQ ID NO: 2378996 - RNA, 17 nt, Human
gcaggagaggagagcca

SEQ ID NO: 2378997 - RNA, 18 nt, Human
gcaggagaggagagccag

SEQ ID NO: 2378998 - RNA, 19 nt, Human
gcaggagaggagagccaga

SEQ ID NO: 2378999 - RNA, 20 nt, Human
gcaggagaggagagccagag

SEQ ID NO: 2379000 - RNA, 22 nt, Human
gcaggagaggagagccagagaa

SEQ ID NO: 2379001 - RNA, 19 nt, Human
gcaggacugcacagcgucc

SEQ ID NO: 2379002 - RNA, 18 nt, Human
gcaggcagccaggccaca

SEQ ID NO: 2379003 - RNA, 17 nt, Human
gcaggcagccaggccac

SEQ ID NO: 2379004 - RNA, 13 nt, Human
gcaggcagggcug

SEQ ID NO: 2379005 - RNA, 9 nt, Human
gcaggcagu

SEQ ID NO: 2379006 - RNA, 23 nt, Human
gcaggagaggagagccagagaag

SEQ ID NO: 2379007 - RNA, 13 nt, Human
gcaggcagcgcca

SEQ ID NO: 2379008 - RNA, 16 nt, Human
gcaggcagcgccaagc

SEQ ID NO: 2379009 - RNA, 22 nt, Human
gcaggcagcgccaagcaaccug

SEQ ID NO: 2379010 - RNA, 18 nt, Human
gcaggcagcgccaagcaa

SEQ ID NO: 2379011 - RNA, 21 nt, Human
gcaggcagcgccaagcaaccu

SEQ ID NO: 2379012 - RNA, 14 nt, Human
gcaggcggugggca

SEQ ID NO: 2379013 - RNA, 15 nt, Human
gcaggcggugggcac

SEQ ID NO: 2379014 - RNA, 16 nt, Human
gcaggcggugggcacc

SEQ ID NO: 2379015 - RNA, 23 nt, Human
gcaggcggugggcacccacccug

SEQ ID NO: 2379016 - RNA, 23 nt, Human
gcaggccucgaaaaccaucacau

SEQ ID NO: 2379017 - RNA, 21 nt, Human
gcaggcccugcacuguccugc

SEQ ID NO: 2379018 - RNA, 15 nt, Human
gcagggaggggacua

SEQ ID NO: 2379019 - RNA, 14 nt, Human
gcagggaggggacu

SEQ ID NO: 2379020 - RNA, 23 nt, Human
gcagggaugcccuggagguggcu

SEQ ID NO: 2379021 - RNA, 21 nt, Human
gcagggaugcccuggaggugg

SEQ ID NO: 2379022 - RNA, 13 nt, Human
gcagggaugcccu

SEQ ID NO: 2379023 - RNA, 14 nt, Human
gcagggauccuggu

SEQ ID NO: 2379024 - RNA, 19 nt, Human
gcagggauuaaccucugca

SEQ ID NO: 2379025 - RNA, 22 nt, Human
gcagggauuaaccucugcacua

SEQ ID NO: 2379026 - RNA, 15 nt, Human
gcagggauugcugcc

SEQ ID NO: 2379027 - RNA, 14 nt, Human
gcagggauuugagg

SEQ ID NO: 2379028 - RNA, 19 nt, Human
gcagggauugcugccacuu

SEQ ID NO: 2379029 - RNA, 22 nt, Human
gcagggauugcugccacuuuuu

SEQ ID NO: 2379030 - RNA, 15 nt, Human
gcagggauuugagga

SEQ ID NO: 2379031 - RNA, 12 nt, Human
gcagggcucagg

SEQ ID NO: 2379032 - RNA, 21 nt, Human
gcagggcucaggauuucgugg

SEQ ID NO: 2379033 - RNA, 13 nt, Human
gcagggcucagga

SEQ ID NO: 2379034 - RNA, 14 nt, Human
gcagggcucaggau

SEQ ID NO: 2379035 - RNA, 19 nt, Human
gcaggguccuagaaauucc

SEQ ID NO: 2379036 - RNA, 16 nt, Human
gcagggucucacucug

SEQ ID NO: 2379037 - RNA, 14 nt, Human
gcaggucccuaaua

SEQ ID NO: 2379038 - RNA, 15 nt, Human
gcaggucccuaauaa

SEQ ID NO: 2379039 - RNA, 16 nt, Human
gcagggucaggagagg

SEQ ID NO: 2379040 - RNA, 15 nt, Human
gcagggucaggagag

SEQ ID NO: 2379041 - RNA, 14 nt, Human
gcagggucaggaga

SEQ ID NO: 2379042 - RNA, 22 nt, Human
gcaggggaggguagagcggaga

SEQ ID NO: 2379043 - RNA, 12 nt, Human
gcagggcucuga

SEQ ID NO: 2379044 - RNA, 16 nt, Human
gcagggcucugcccca

SEQ ID NO: 2379045 - RNA, 23 nt, Human
gcagggcucucuuuccuucuugc

SEQ ID NO: 2379046 - RNA, 21 nt, Human
gcagggcucugccccagaggc

SEQ ID NO: 2379047 - RNA, 19 nt, Human
gcagggcucugccccagag

SEQ ID NO: 2379048 - RNA, 17 nt, Human
gcagggucaggagaggg

SEQ ID NO: 2379049 - RNA, 21 nt, Human
gcagggucccauuucucacug

SEQ ID NO: 2379050 - RNA, 16 nt, Human
gcaguggcucacgccu

SEQ ID NO: 2379051 - RNA, 23 nt, Human
gcaggucccuaauaaagcugugu

SEQ ID NO: 2379052 - RNA, 20 nt, Human
gcaggucccuaauaaagcug

SEQ ID NO: 2379053 - RNA, 21 nt, Human
gcaggucccuaauaaagcugu

SEQ ID NO: 2379054 - RNA, 16 nt, Human
gcaggucccuaauaaa

SEQ ID NO: 2379055 - RNA, 17 nt, Human
gcaggucccuaauaaag

SEQ ID NO: 2379056 - RNA, 18 nt, Human
gcaggucccuaauaaagc

SEQ ID NO: 2379057 - RNA, 19 nt, Human
gcaggucccuaauaaagcu

SEQ ID NO: 2379058 - RNA, 11 nt, Human
gcagugggagc

SEQ ID NO: 2379059 - RNA, 16 nt, Human
gcagugggccuggcca

SEQ ID NO: 2379060 - RNA, 21 nt, Human
gcagugggacagggcauggcc

SEQ ID NO: 2379061 - RNA, 20 nt, Human
gcaguggcugguccagggcu

SEQ ID NO: 2379062 - RNA, 14 nt, Human
gcaguggcuggucc

SEQ ID NO: 2379063 - RNA, 15 nt, Human
gcaguggcuggucca

SEQ ID NO: 2379064 - RNA, 18 nt, Human
gcaguggcugguccaggg

SEQ ID NO: 2379065 - RNA, 19 nt, Human
gcaguggcugguccagggc

SEQ ID NO: 2379066 - RNA, 18 nt, Human
gcagugguaagcucuggc

SEQ ID NO: 2379067 - RNA, 22 nt, Human
gcagugggucccacuuccccuc

SEQ ID NO: 2379068 - RNA, 23 nt, Human
gcagugggucccacuuccccucc

SEQ ID NO: 2379069 - RNA, 11 nt, Human
gcagugggucc

SEQ ID NO: 2379070 - RNA, 18 nt, Human
gcagugggucccacuucc

SEQ ID NO: 2379071 - RNA, 19 nt, Human
gcagugggucccacuuccc

SEQ ID NO: 2379072 - RNA, 21 nt, Human
gcagugggucccacuuccccu

SEQ ID NO: 2379073 - RNA, 17 nt, Human
gcagugggccuggccag

SEQ ID NO: 2379074 - RNA, 18 nt, Human
gcaguggugcgaucuggg

SEQ ID NO: 2379075 - RNA, 19 nt, Human
gcaguggugcgaucugggu

SEQ ID NO: 2379076 - RNA, 19 nt, Human
gcaguucagcaccacccua

SEQ ID NO: 2379077 - RNA, 17 nt, Human
gcaguucagcaccaccc

SEQ ID NO: 2379078 - RNA, 23 nt, Human
gcaguucccccaaccucagacuu

SEQ ID NO: 2379079 - RNA, 19 nt, Human
gcaguugaaaagacuccaa

SEQ ID NO: 2379080 - RNA, 16 nt, Human
gcaguugaaaagacuc

SEQ ID NO: 2379081 - RNA, 19 nt, Human
gcauacguacacauuuuau

SEQ ID NO: 2379082 - RNA, 21 nt, Human
gcaguugaaaagacuccaaag

SEQ ID NO: 2379083 - RNA, 16 nt, Human
gcauacuaauaaagua

SEQ ID NO: 2379084 - RNA, 20 nt, Human
gcaguucccccaaccucaga

SEQ ID NO: 2379085 - RNA, 22 nt, Human
gcaguggugcgaucuggguuca

SEQ ID NO: 2379086 - RNA, 19 nt, Human
gcaguggugguuuucuguu

SEQ ID NO: 2379087 - RNA, 20 nt, Human
gcaguggugcgaucuggguu

SEQ ID NO: 2379088 - RNA, 21 nt, Human
gcaguggugcgaucuggguuc

SEQ ID NO: 2379089 - RNA, 21 nt, Human
gcaguggugguuuucuguucu

SEQ ID NO: 2379090 - RNA, 20 nt, Human
gcaguggugguuuucuguuc

SEQ ID NO: 2379091 - RNA, 15 nt, Human
gcauccaccuccuuc

SEQ ID NO: 2379092 - RNA, 16 nt, Human
gcauccaccuccuucu

SEQ ID NO: 2379093 - RNA, 15 nt, Human
gcauccaaaggugcu

SEQ ID NO: 2379094 - RNA, 12 nt, Human
gcauccaccucc

SEQ ID NO: 2379095 - RNA, 14 nt, Human
gcaucuaucucauc

SEQ ID NO: 2379096 - RNA, 13 nt, Human
gcaucucagccca

SEQ ID NO: 2379097 - RNA, 14 nt, Human
gcaucucagcccac

SEQ ID NO: 2379098 - RNA, 17 nt, Human
gcauccaccuccuucuc

SEQ ID NO: 2379099 - RNA, 12 nt, Human
gcaucucagccc

SEQ ID NO: 2379100 - RNA, 23 nt, Human
gcaucagugcccuccaggauaga

SEQ ID NO: 2379101 - RNA, 19 nt, Human
gcaucagucccuauguauu

SEQ ID NO: 2379102 - RNA, 22 nt, Human
gcaucauuauuugcagagacag

SEQ ID NO: 2379103 - RNA, 20 nt, Human
gcaucauuuugcauucaaau

SEQ ID NO: 2379104 - RNA, 20 nt, Human
gcaucauucuuguuaauuau

SEQ ID NO: 2379105 - RNA, 13 nt, Human
gcaucauggcuau

SEQ ID NO: 2379106 - RNA, 15 nt, Human
gcaucagugcccucc

SEQ ID NO: 2379107 - RNA, 12 nt, Human
gcaucaggguua

SEQ ID NO: 2379108 - RNA, 23 nt, Human
gcaucaggccaggcccucugccc

SEQ ID NO: 2379109 - RNA, 18 nt, Human
gcauacuucaaaaguauu

SEQ ID NO: 2379110 - RNA, 21 nt, Human
gcauacuucaaaaguauuuuc

SEQ ID NO: 2379111 - RNA, 17 nt, Human
gcaucagcuggcgucau

SEQ ID NO: 2379112 - RNA, 21 nt, Human
gcaucagcuggcgucaugcaa

SEQ ID NO: 2379113 - RNA, 18 nt, Human
gcaucaggccaggcccuc

SEQ ID NO: 2379114 - RNA, 13 nt, Human
gcauacuucaaaa

SEQ ID NO: 2379115 - RNA, 14 nt, Human
gcauacuucaaaag

SEQ ID NO: 2379116 - RNA, 16 nt, Human
gcauacuucaaaagua

SEQ ID NO: 2379117 - RNA, 17 nt, Human
gcauacuucaaaaguau

SEQ ID NO: 2379118 - RNA, 22 nt, Human
gcaucagcugcugaaacaacaa

SEQ ID NO: 2379119 - RNA, 12 nt, Human
gcaucaggccag

SEQ ID NO: 2379120 - RNA, 23 nt, Human
gcaucagcugcugaaacaacaaa

SEQ ID NO: 2379121 - RNA, 15 nt, Human
gcaucuccugugcau

SEQ ID NO: 2379122 - RNA, 16 nt, Human
gcaucuccaggaaggc

SEQ ID NO: 2379123 - RNA, 17 nt, Human
gcaucucccucacugaa

SEQ ID NO: 2379124 - RNA, 16 nt, Human
gcaucuccugugcaug

SEQ ID NO: 2379125 - RNA, 20 nt, Human
gcaucucccucacugaaacc

SEQ ID NO: 2379126 - RNA, 21 nt, Human
gcaucucccagauaaugugaa

SEQ ID NO: 2379127 - RNA, 13 nt, Human
gcaucucccagau

SEQ ID NO: 2379128 - RNA, 12 nt, Human
gcaucucccaga

SEQ ID NO: 2379129 - RNA, 13 nt, Human
gcaucuccaggaa

SEQ ID NO: 2379130 - RNA, 14 nt, Human
gcaucuccaggaag

SEQ ID NO: 2379131 - RNA, 15 nt, Human
gcaucucagcccaca

SEQ ID NO: 2379132 - RNA, 15 nt, Human
gcaucuccaccugcu

SEQ ID NO: 2379133 - RNA, 17 nt, Human
gcaucuccaccugcucc

SEQ ID NO: 2379134 - RNA, 18 nt, Human
gcaucuccaccugcuccc

SEQ ID NO: 2379135 - RNA, 20 nt, Human
gcaucuccaccugcucccag

SEQ ID NO: 2379136 - RNA, 12 nt, Human
gcaucuccagga

SEQ ID NO: 2379137 - RNA, 17 nt, Human
gcaucugccccuccccc

SEQ ID NO: 2379138 - RNA, 15 nt, Human
gcaucugccccuccc

SEQ ID NO: 2379139 - RNA, 14 nt, Human
gcaucugccccucc

SEQ ID NO: 2379140 - RNA, 12 nt, Human
gcaucugccccu

SEQ ID NO: 2379141 - RNA, 16 nt, Human
gcaucugggauuccca

SEQ ID NO: 2379142 - RNA, 20 nt, Human
gcaucugggauucccaccaa

SEQ ID NO: 2379143 - RNA, 23 nt, Human
gcaucugggauucccaccaaggu

SEQ ID NO: 2379144 - RNA, 18 nt, Human
gcaucugccccuccccca

SEQ ID NO: 2379145 - RNA, 18 nt, Human
gcaucugcuaauaaaacc

SEQ ID NO: 2379146 - RNA, 17 nt, Human
gcaucuggguagcugua

SEQ ID NO: 2379147 - RNA, 11 nt, Human
gcaucuguaua

SEQ ID NO: 2379148 - RNA, 13 nt, Human
gcaucuguauaag

SEQ ID NO: 2379149 - RNA, 20 nt, Human
gcaugaaguaauaugcacac

SEQ ID NO: 2379150 - RNA, 22 nt, Human
gcaugaaguaauaugcacacau

SEQ ID NO: 2379151 - RNA, 21 nt, Human
gcaugaaguaauaugcacaca

SEQ ID NO: 2379152 - RNA, 20 nt, Human
gcaugacacgaauauugcug

SEQ ID NO: 2379153 - RNA, 21 nt, Human
gcaugacacgaauauugcuga

SEQ ID NO: 2379154 - RNA, 23 nt, Human
gcaucuguauaaguaagaaaaua

SEQ ID NO: 2379155 - RNA, 21 nt, Human
gcaucuguauaaguaagaaaa

SEQ ID NO: 2379156 - RNA, 22 nt, Human
gcaucuguauaaguaagaaaau

SEQ ID NO: 2379157 - RNA, 13 nt, Human
gcaucuguccuca

SEQ ID NO: 2379158 - RNA, 22 nt, Human
gcaugacacgaauauugcugau

SEQ ID NO: 2379159 - RNA, 19 nt, Human
gcauuccuacaaagauguu

SEQ ID NO: 2379160 - RNA, 16 nt, Human
gcauuccuacaaagau

SEQ ID NO: 2379161 - RNA, 22 nt, Human
gcauucccugagucaccaggaa

SEQ ID NO: 2379162 - RNA, 21 nt, Human
gcauucccugagucaccagga

SEQ ID NO: 2379163 - RNA, 14 nt, Human
gcauucccugaguc

SEQ ID NO: 2379164 - RNA, 13 nt, Human
gcauucccugagu

SEQ ID NO: 2379165 - RNA, 21 nt, Human
gcauuauguccacuguguaua

SEQ ID NO: 2379166 - RNA, 22 nt, Human
gcauuauguccacuguguauag

SEQ ID NO: 2379167 - RNA, 22 nt, Human
gcauuccccaggaggccagccu

SEQ ID NO: 2379168 - RNA, 21 nt, Human
gcauugaacacaaacuguaaa

SEQ ID NO: 2379169 - RNA, 14 nt, Human
gcauuccuucuuug

SEQ ID NO: 2379170 - RNA, 15 nt, Human
gcauuccuucuuuga

SEQ ID NO: 2379171 - RNA, 19 nt, Human
gcauuccugauaugauuua

SEQ ID NO: 2379172 - RNA, 21 nt, Human
gcauuccugauaugauuuaaa

SEQ ID NO: 2379173 - RNA, 22 nt, Human
gcauuccugauaugauuuaaaa

SEQ ID NO: 2379174 - RNA, 13 nt, Human
gcauuccuucuuu

SEQ ID NO: 2379175 - RNA, 23 nt, Human
gcauugaacacaaacuguaaaua

SEQ ID NO: 2379176 - RNA, 22 nt, Human
gcauugaacacaaacuguaaau

SEQ ID NO: 2379177 - RNA, 21 nt, Human
gcauugagaacugcauauguu

SEQ ID NO: 2379178 - RNA, 12 nt, Human
gcauugagaacu

SEQ ID NO: 2379179 - RNA, 16 nt, Human
gcauugaauauauuau

SEQ ID NO: 2379180 - RNA, 19 nt, Human
gcauuccuucuuugauaau

SEQ ID NO: 2379181 - RNA, 22 nt, Human
gcauugaccgcgacuaauuuca

SEQ ID NO: 2379182 - RNA, 23 nt, Human
gcauugaccgcgacuaauuucaa

SEQ ID NO: 2379183 - RNA, 22 nt, Human
gcauugagaacugcauauguuu

SEQ ID NO: 2379184 - RNA, 14 nt, Human
gcauuugagaaaug

SEQ ID NO: 2379185 - RNA, 18 nt, Human
gcauuugaggucuguucu

SEQ ID NO: 2379186 - RNA, 14 nt, Human
gcauuccccaggag

SEQ ID NO: 2379187 - RNA, 15 nt, Human
gcauuccccaggagg

SEQ ID NO: 2379188 - RNA, 16 nt, Human
gcauuccccaggaggc

SEQ ID NO: 2379189 - RNA, 17 nt, Human
gcauuccccaggaggcc

SEQ ID NO: 2379190 - RNA, 18 nt, Human
gcauuccccaggaggcca

SEQ ID NO: 2379191 - RNA, 19 nt, Human
gcauuccccaggaggccag

SEQ ID NO: 2379192 - RNA, 20 nt, Human
gcauuccccaggaggccagc

SEQ ID NO: 2379193 - RNA, 21 nt, Human
gcauuccccaggaggccagcc

SEQ ID NO: 2379194 - RNA, 22 nt, Human
gcauguguuugguucuggggcc

SEQ ID NO: 2379195 - RNA, 20 nt, Human
gcauguguuugguucugggg

SEQ ID NO: 2379196 - RNA, 19 nt, Human
gcauuaaauauaauaugca

SEQ ID NO: 2379197 - RNA, 16 nt, Human
gcauguuccacuaacc

SEQ ID NO: 2379198 - RNA, 22 nt, Human
gcauuaaauucacaaacuuuua

SEQ ID NO: 2379199 - RNA, 18 nt, Human
gcauuaaauucacaaacu

SEQ ID NO: 2379200 - RNA, 23 nt, Human
gcauuaaauuuuagcaaagauau

SEQ ID NO: 2379201 - RNA, 14 nt, Human
gcauuacagagagg

SEQ ID NO: 2379202 - RNA, 14 nt, Human
gcauuaacuucucu

SEQ ID NO: 2379203 - RNA, 16 nt, Human
gcauuaacuucucugg

SEQ ID NO: 2379204 - RNA, 22 nt, Human
gcauuaacuaaucuauuggguu

SEQ ID NO: 2379205 - RNA, 18 nt, Human
gcauuaacuaaucuauug

SEQ ID NO: 2379206 - RNA, 14 nt, Human
gcauuaacuaaucu

SEQ ID NO: 2379207 - RNA, 16 nt, Human
gcauuacauuuccaaa

SEQ ID NO: 2379208 - RNA, 19 nt, Human
gcauuacagagaggagaaa

SEQ ID NO: 2379209 - RNA, 18 nt, Human
gcauuaccgcguuguaaa

SEQ ID NO: 2379210 - RNA, 19 nt, Human
gcauuaccgcguuguaaaa

SEQ ID NO: 2379211 - RNA, 20 nt, Human
gcauuaccgcguuguaaaau

SEQ ID NO: 2379212 - RNA, 23 nt, Human
gcauuaccgcguuguaaaauaua

SEQ ID NO: 2379213 - RNA, 24 nt, Human
gcauuaucuagauacuguaucaug

SEQ ID NO: 2379214 - RNA, 22 nt, Human
gcauuaucuagauacuguauca

SEQ ID NO: 2379215 - RNA, 15 nt, Human
gcauuacgugagcca

SEQ ID NO: 2379216 - RNA, 19 nt, Human
gcauuaucuagauacugua

SEQ ID NO: 2379217 - RNA, 19 nt, Human
gcauuauguccacugugua

SEQ ID NO: 2379218 - RNA, 23 nt, Human
gcauuauguccacuguguauaga

SEQ ID NO: 2379219 - RNA, 19 nt, Human
gcauguguuugguucuggg

SEQ ID NO: 2379220 - RNA, 14 nt, Human
gcaugugugugcuc

SEQ ID NO: 2379221 - RNA, 16 nt, Human
gcaugugugugcucag

SEQ ID NO: 2379222 - RNA, 11 nt, Human
gcaugugugug

SEQ ID NO: 2379223 - RNA, 19 nt, Human
gcaugugugcgagugugug

SEQ ID NO: 2379224 - RNA, 21 nt, Human
gcauguguauuuccagugcaa

SEQ ID NO: 2379225 - RNA, 15 nt, Human
gcaugccuggauggg

SEQ ID NO: 2379226 - RNA, 13 nt, Human
gcauguuacauaa

SEQ ID NO: 2379227 - RNA, 18 nt, Human
gcauguuaccuccuauaa

SEQ ID NO: 2379228 - RNA, 14 nt, Human
gcauguucucugag

SEQ ID NO: 2379229 - RNA, 16 nt, Human
gcaugaccugugacca

SEQ ID NO: 2379230 - RNA, 18 nt, Human
gcaugcccccucgugcca

SEQ ID NO: 2379231 - RNA, 19 nt, Human
gcaugcccccucgugccag

SEQ ID NO: 2379232 - RNA, 20 nt, Human
gcaugcccccucgugccagu

SEQ ID NO: 2379233 - RNA, 14 nt, Human
gcaugccccggcca

SEQ ID NO: 2379234 - RNA, 16 nt, Human
gcaugccccggccacc

SEQ ID NO: 2379235 - RNA, 17 nt, Human
gcaugccccggccaccu

SEQ ID NO: 2379236 - RNA, 14 nt, Human
gcaugacauuucuu

SEQ ID NO: 2379237 - RNA, 14 nt, Human
gcaugccuggaugg

SEQ ID NO: 2379238 - RNA, 22 nt, Human
gcaugccccggccaccucugcg

SEQ ID NO: 2379239 - RNA, 23 nt, Human
gcaugccccggccaccucugcgg

SEQ ID NO: 2379240 - RNA, 18 nt, Human
gcaugccccggccaccuc

SEQ ID NO: 2379241 - RNA, 19 nt, Human
gcaugccccggccaccucu

SEQ ID NO: 2379242 - RNA, 20 nt, Human
gcaugccccggccaccucug

SEQ ID NO: 2379243 - RNA, 21 nt, Human
gcaugccccggccaccucugc

SEQ ID NO: 2379244 - RNA, 17 nt, Human
gcacagcccaaagaagg

SEQ ID NO: 2379245 - RNA, 21 nt, Human
gcacagccauacggcacugaa

SEQ ID NO: 2379246 - RNA, 11 nt, Human
gcacagcccuc

SEQ ID NO: 2379247 - RNA, 12 nt, Human
gcacagcccucc

SEQ ID NO: 2379248 - RNA, 13 nt, Human
gcacagcccuccc

SEQ ID NO: 2379249 - RNA, 16 nt, Human
gcacagcccucccgcc

SEQ ID NO: 2379250 - RNA, 17 nt, Human
gcacagcccucccgccc

SEQ ID NO: 2379251 - RNA, 15 nt, Human
gcacagccucuuaga

SEQ ID NO: 2379252 - RNA, 15 nt, Human
gcacagcagccuggg

SEQ ID NO: 2379253 - RNA, 23 nt, Human
gcacagcaaggaggcuggcuggg

SEQ ID NO: 2379254 - RNA, 13 nt, Human
gcacagcaguucc

SEQ ID NO: 2379255 - RNA, 22 nt, Human
gcacagccaacacgcaccugcc

SEQ ID NO: 2379256 - RNA, 15 nt, Human
gcacagccaaggacu

SEQ ID NO: 2379257 - RNA, 22 nt, Human
gcacagcaugagaggcucugug

SEQ ID NO: 2379258 - RNA, 16 nt, Human
gcacagcaguuccgga

SEQ ID NO: 2379259 - RNA, 14 nt, Human
gauuguuaaaauaa

SEQ ID NO: 2379260 - RNA, 20 nt, Human
gauugugucucuugguccug

SEQ ID NO: 2379261 - RNA, 22 nt, Human
gcacagcagccuggggcuggcc

SEQ ID NO: 2379262 - RNA, 13 nt, Human
gcacagcagcauc

SEQ ID NO: 2379263 - RNA, 14 nt, Human
gcacagcaaggagg

SEQ ID NO: 2379264 - RNA, 17 nt, Human
gcacagcaaggaggcug

SEQ ID NO: 2379265 - RNA, 19 nt, Human
gcacagcaaggaggcuggc

SEQ ID NO: 2379266 - RNA, 22 nt, Human
gcacagcaaggaggcuggcugg

SEQ ID NO: 2379267 - RNA, 22 nt, Human
gcacagcuugaccugaggcugu

SEQ ID NO: 2379268 - RNA, 18 nt, Human
gcacagcuugaccugagg

SEQ ID NO: 2379269 - RNA, 19 nt, Human
gcacagcuugaccugaggc

SEQ ID NO: 2379270 - RNA, 20 nt, Human
gcacagcuugaccugaggcu

SEQ ID NO: 2379271 - RNA, 21 nt, Human
gcacagcuugaccugaggcug

SEQ ID NO: 2379272 - RNA, 16 nt, Human
gcacagggcaguggga

SEQ ID NO: 2379273 - RNA, 15 nt, Human
gcacagggcagcugg

SEQ ID NO: 2379274 - RNA, 16 nt, Human
gcacagggcagcuggg

SEQ ID NO: 2379275 - RNA, 17 nt, Human
gcacagggcagcugggc

SEQ ID NO: 2379276 - RNA, 20 nt, Human
gcacagggcagcugggccca

SEQ ID NO: 2379277 - RNA, 18 nt, Human
gcacagggcagcugggcc

SEQ ID NO: 2379278 - RNA, 19 nt, Human
gcacagggcagcugggccc

SEQ ID NO: 2379279 - RNA, 23 nt, Human
gcacagcuucauuuccugugucu

SEQ ID NO: 2379280 - RNA, 14 nt, Human
gcacagcuugaccu

SEQ ID NO: 2379281 - RNA, 18 nt, Human
gcacagcccucccgcccc

SEQ ID NO: 2379282 - RNA, 19 nt, Human
gcacagcccucccgccccu

SEQ ID NO: 2379283 - RNA, 21 nt, Human
gcacagcccucccgccccuuc

SEQ ID NO: 2379284 - RNA, 22 nt, Human
gcacagcccucccgccccuucc

SEQ ID NO: 2379285 - RNA, 21 nt, Human
gcacagcuucauuuccugugu

SEQ ID NO: 2379286 - RNA, 18 nt, Human
gcacagccucuuagaugc

SEQ ID NO: 2379287 - RNA, 15 nt, Human
gcaccaagcaggaaa

SEQ ID NO: 2379288 - RNA, 15 nt, Human
gcaccacacucagcc

SEQ ID NO: 2379289 - RNA, 17 nt, Human
gcaccacacucagcccu

SEQ ID NO: 2379290 - RNA, 13 nt, Human
gcaccaccaagcc

SEQ ID NO: 2379291 - RNA, 20 nt, Human
gcaccagacacccaggacuu

SEQ ID NO: 2379292 - RNA, 19 nt, Human
gcaccagacacccaggacu

SEQ ID NO: 2379293 - RNA, 18 nt, Human
gcaccagacacccaggac

SEQ ID NO: 2379294 - RNA, 17 nt, Human
gcaccagacacccagga

SEQ ID NO: 2379295 - RNA, 16 nt, Human
gcaccagacacccagg

SEQ ID NO: 2379296 - RNA, 15 nt, Human
gcaccagacacccag

SEQ ID NO: 2379297 - RNA, 14 nt, Human
gcaccaccaagcca

SEQ ID NO: 2379298 - RNA, 17 nt, Human
gcaccaccaagccaagg

SEQ ID NO: 2379299 - RNA, 20 nt, Human
gcaccaaaauaagaaaagau

SEQ ID NO: 2379300 - RNA, 19 nt, Human
gcaccaaaauaagaaaaga

SEQ ID NO: 2379301 - RNA, 14 nt, Human
gcaccaacccagcc

SEQ ID NO: 2379302 - RNA, 15 nt, Human
gcaccaacccagccg

SEQ ID NO: 2379303 - RNA, 16 nt, Human
gcaccaacccagccgc

SEQ ID NO: 2379304 - RNA, 17 nt, Human
gcaccaacccagccgcu

SEQ ID NO: 2379305 - RNA, 18 nt, Human
gcaccaacccagccgcug

SEQ ID NO: 2379306 - RNA, 20 nt, Human
gcaccaacccagccgcugcc

SEQ ID NO: 2379307 - RNA, 22 nt, Human
gcaccaacccagccgcugcccg

SEQ ID NO: 2379308 - RNA, 18 nt, Human
gcacagggucugcucuuu

SEQ ID NO: 2379309 - RNA, 23 nt, Human
gcacagggucugcucuuucucug

SEQ ID NO: 2379310 - RNA, 12 nt, Human
gcacagggucug

SEQ ID NO: 2379311 - RNA, 17 nt, Human
gcacagggucugcucuu

SEQ ID NO: 2379312 - RNA, 13 nt, Human
gcaccagcagccu

SEQ ID NO: 2379313 - RNA, 15 nt, Human
gcaccagaggcugca

SEQ ID NO: 2379314 - RNA, 21 nt, Human
gcaccagacacccaggacuua

SEQ ID NO: 2379315 - RNA, 14 nt, Human
gcaccagcagccug

SEQ ID NO: 2379316 - RNA, 14 nt, Human
gcaccaucucuccu

SEQ ID NO: 2379317 - RNA, 15 nt, Human
gcaccaucucuccuc

SEQ ID NO: 2379318 - RNA, 17 nt, Human
gcaccaucucuccuccu

SEQ ID NO: 2379319 - RNA, 20 nt, Human
gcaccaucucugauuuucaa

SEQ ID NO: 2379320 - RNA, 17 nt, Human
gcaccauccgccagggc

SEQ ID NO: 2379321 - RNA, 18 nt, Human
gcaccauccgccagggcc

SEQ ID NO: 2379322 - RNA, 21 nt, Human
gcaccagaggcugcagaaggc

SEQ ID NO: 2379323 - RNA, 21 nt, Human
gcaccaucccuuuuugaagug

SEQ ID NO: 2379324 - RNA, 22 nt, Human
gcaccaucccuuuuugaagugu

SEQ ID NO: 2379325 - RNA, 13 nt, Human
gcaccauccgcca

SEQ ID NO: 2379326 - RNA, 13 nt, Human
gcaccccucccau

SEQ ID NO: 2379327 - RNA, 13 nt, Human
gcaccccugucuc

SEQ ID NO: 2379328 - RNA, 14 nt, Human
gcacccccuggaga

SEQ ID NO: 2379329 - RNA, 12 nt, Human
gcacccccuccu

SEQ ID NO: 2379330 - RNA, 19 nt, Human
gcaccauccgccagggccc

SEQ ID NO: 2379331 - RNA, 15 nt, Human
gcacccccuccugcu

SEQ ID NO: 2379332 - RNA, 16 nt, Human
gcacccccuccugcug

SEQ ID NO: 2379333 - RNA, 19 nt, Human
gcacccccuccugcugcag

SEQ ID NO: 2379334 - RNA, 17 nt, Human
gcacccccuccugcugc

SEQ ID NO: 2379335 - RNA, 18 nt, Human
gcacccccuccugcugca

SEQ ID NO: 2379336 - RNA, 13 nt, Human
gcacccuccaccc

SEQ ID NO: 2379337 - RNA, 14 nt, Human
gcacccuccacccu

SEQ ID NO: 2379338 - RNA, 15 nt, Human
gcacccuccacccug

SEQ ID NO: 2379339 - RNA, 16 nt, Human
gcacccuccacccugu

SEQ ID NO: 2379340 - RNA, 17 nt, Human
gcacccuccacccuguc

SEQ ID NO: 2379341 - RNA, 18 nt, Human
gcacccuccacccugucc

SEQ ID NO: 2379342 - RNA, 19 nt, Human
gcacccuccacccuguccc

SEQ ID NO: 2379343 - RNA, 22 nt, Human
gcacccuccacccuguccccca

SEQ ID NO: 2379344 - RNA, 13 nt, Human
gcacccuccccuc

SEQ ID NO: 2379345 - RNA, 14 nt, Human
gcacccuccccucc

SEQ ID NO: 2379346 - RNA, 15 nt, Human
gcacccuccccuccc

SEQ ID NO: 2379347 - RNA, 17 nt, Human
gcacccuccccucccgu

SEQ ID NO: 2379348 - RNA, 13 nt, Human
gcacccucccucc

SEQ ID NO: 2379349 - RNA, 18 nt, Human
gcacgcccaugugugagu

SEQ ID NO: 2379350 - RNA, 17 nt, Human
gcacgcccaugugugag

SEQ ID NO: 2379351 - RNA, 15 nt, Human
gcacgcccaugugug

SEQ ID NO: 2379352 - RNA, 12 nt, Human
gcacgcaguggc

SEQ ID NO: 2379353 - RNA, 22 nt, Human
gcacgcccaugugugagugugu

SEQ ID NO: 2379354 - RNA, 19 nt, Human
gcacccucaggcagguggg

SEQ ID NO: 2379355 - RNA, 16 nt, Human
gcacccucaggcaggu

SEQ ID NO: 2379356 - RNA, 12 nt, Human
gcaccccuucuc

SEQ ID NO: 2379357 - RNA, 13 nt, Human
gcaccccuucucu

SEQ ID NO: 2379358 - RNA, 17 nt, Human
gcaccccuucucuccuc

SEQ ID NO: 2379359 - RNA, 13 nt, Human
gcaccccuuccau

SEQ ID NO: 2379360 - RNA, 16 nt, Human
gcaccccuuccaugug

SEQ ID NO: 2379361 - RNA, 18 nt, Human
gcaccccuucucuccucc

SEQ ID NO: 2379362 - RNA, 19 nt, Human
gcaccccuucucuccuccc

SEQ ID NO: 2379363 - RNA, 20 nt, Human
gcaccccuucucuccucccc

SEQ ID NO: 2379364 - RNA, 21 nt, Human
gcaccccuucucuccucccca

SEQ ID NO: 2379365 - RNA, 22 nt, Human
gcaccccuucucuccuccccaa

SEQ ID NO: 2379366 - RNA, 13 nt, Human
gcacccgccucuc

SEQ ID NO: 2379367 - RNA, 15 nt, Human
gcacccgccucuccc

SEQ ID NO: 2379368 - RNA, 16 nt, Human
gcacccgccucucccg

SEQ ID NO: 2379369 - RNA, 20 nt, Human
gcacuaaagcaguggacacc

SEQ ID NO: 2379370 - RNA, 14 nt, Human
gcacuaaagcagug

SEQ ID NO: 2379371 - RNA, 22 nt, Human
gcacguuaugguguuucucccu

SEQ ID NO: 2379372 - RNA, 20 nt, Human
gcacgcugugggcagguggg

SEQ ID NO: 2379373 - RNA, 16 nt, Human
gcacgcugugggcagg

SEQ ID NO: 2379374 - RNA, 12 nt, Human
gcacgcuguggg

SEQ ID NO: 2379375 - RNA, 19 nt, Human
gcacgcuugcguaugucug

SEQ ID NO: 2379376 - RNA, 20 nt, Human
gcacgcuugcguaugucugu

SEQ ID NO: 2379377 - RNA, 21 nt, Human
gcacgcuugcguaugucuguu

SEQ ID NO: 2379378 - RNA, 14 nt, Human
gcacgugugugcac

SEQ ID NO: 2379379 - RNA, 20 nt, Human
gcacuaaggugugcucugau

SEQ ID NO: 2379380 - RNA, 19 nt, Human
gcacuaaaguauguaaagu

SEQ ID NO: 2379381 - RNA, 20 nt, Human
gcacuaaaguauguaaagua

SEQ ID NO: 2379382 - RNA, 22 nt, Human
gcacuaaaguauguaaaguaug

SEQ ID NO: 2379383 - RNA, 19 nt, Human
gcacuaauuugauguuuac

SEQ ID NO: 2379384 - RNA, 14 nt, Human
gcacuacauaaacu

SEQ ID NO: 2379385 - RNA, 15 nt, Human
gcacuacauaaacug

SEQ ID NO: 2379386 - RNA, 16 nt, Human
gcacuacauaaacuga

SEQ ID NO: 2379387 - RNA, 13 nt, Human
gcacuacaugugg

SEQ ID NO: 2379388 - RNA, 19 nt, Human
gcacuaaggugugcucuga

SEQ ID NO: 2379389 - RNA, 15 nt, Human
gcacuauaauguaag

SEQ ID NO: 2379390 - RNA, 14 nt, Human
gcacuauaauguaa

SEQ ID NO: 2379391 - RNA, 20 nt, Human
gcacuauaauguaagcucua

SEQ ID NO: 2379392 - RNA, 22 nt, Human
gcacuauaauguaagcucuacu

SEQ ID NO: 2379393 - RNA, 16 nt, Human
gcacuacauucauuua

SEQ ID NO: 2379394 - RNA, 12 nt, Human
gcacuacauuca

SEQ ID NO: 2379395 - RNA, 12 nt, Human
gcacugcuucca

SEQ ID NO: 2379396 - RNA, 13 nt, Human
gcacugcuuccag

SEQ ID NO: 2379397 - RNA, 14 nt, Human
gcacugcuuccagu

SEQ ID NO: 2379398 - RNA, 15 nt, Human
gcacugcuuccagug

SEQ ID NO: 2379399 - RNA, 19 nt, Human
gcacuguuuuauuuuaauu

SEQ ID NO: 2379400 - RNA, 20 nt, Human
gcacuguucccccugugcag

SEQ ID NO: 2379401 - RNA, 19 nt, Human
gcacuguucccccugugca

SEQ ID NO: 2379402 - RNA, 18 nt, Human
gcacuguucccccugugc

SEQ ID NO: 2379403 - RNA, 15 nt, Human
gcacuguucccccug

SEQ ID NO: 2379404 - RNA, 16 nt, Human
gcacuguuccagccug

SEQ ID NO: 2379405 - RNA, 21 nt, Human
gcacuguuccagccugcccuc

SEQ ID NO: 2379406 - RNA, 12 nt, Human
gcacugggcuug

SEQ ID NO: 2379407 - RNA, 19 nt, Human
gcacuggcucucuccagga

SEQ ID NO: 2379408 - RNA, 23 nt, Human
gcacugggaugagccgcugugag

SEQ ID NO: 2379409 - RNA, 20 nt, Human
gcacuaccacuccugccaag

SEQ ID NO: 2379410 - RNA, 21 nt, Human
gcacuacaugugguuuauaga

SEQ ID NO: 2379411 - RNA, 22 nt, Human
gcacugcugugcugugcccaag

SEQ ID NO: 2379412 - RNA, 11 nt, Human
gcacuggccug

SEQ ID NO: 2379413 - RNA, 15 nt, Human
gcacuggccugcacg

SEQ ID NO: 2379414 - RNA, 15 nt, Human
gcacuggcucucucc

SEQ ID NO: 2379415 - RNA, 16 nt, Human
gcacuggcucucucca

SEQ ID NO: 2379416 - RNA, 17 nt, Human
gcacuggcucucuccag

SEQ ID NO: 2379417 - RNA, 18 nt, Human
gcacuggcucucuccagg

SEQ ID NO: 2379418 - RNA, 15 nt, Human
gcaggaaggagagcc

SEQ ID NO: 2379419 - RNA, 21 nt, Human
gcaggaccuucgggcugugcc

SEQ ID NO: 2379420 - RNA, 19 nt, Human
gcaggacucagcuccccag

SEQ ID NO: 2379421 - RNA, 16 nt, Human
gcaggaagcugcuccg

SEQ ID NO: 2379422 - RNA, 15 nt, Human
gcaggaagcugcucc

SEQ ID NO: 2379423 - RNA, 13 nt, Human
gcaggaagcugcu

SEQ ID NO: 2379424 - RNA, 18 nt, Human
gcaggaagcucagacugg

SEQ ID NO: 2379425 - RNA, 17 nt, Human
gcaggaagcucagacug

SEQ ID NO: 2379426 - RNA, 14 nt, Human
gcaggaagcucaga

SEQ ID NO: 2379427 - RNA, 20 nt, Human
gcaggaagcauucagagagc

SEQ ID NO: 2379428 - RNA, 21 nt, Human
gcaggaagcauucagagagca

SEQ ID NO: 2379429 - RNA, 13 nt, Human
gcaggaaggagag

SEQ ID NO: 2379430 - RNA, 12 nt, Human
gcaggaaggaga

SEQ ID NO: 2379431 - RNA, 16 nt, Human
gcagcucacuacccua

SEQ ID NO: 2379432 - RNA, 18 nt, Human
gcaggaaauggcugugga

SEQ ID NO: 2379433 - RNA, 18 nt, Human
gcaggaagcaacgaaggg

SEQ ID NO: 2379434 - RNA, 16 nt, Human
gcaggaacucccagca

SEQ ID NO: 2379435 - RNA, 14 nt, Human
gcaggaacucccag

SEQ ID NO: 2379436 - RNA, 15 nt, Human
gcaggaacucccagc

SEQ ID NO: 2379437 - RNA, 18 nt, Human
gcagcucagagagggugg

SEQ ID NO: 2379438 - RNA, 19 nt, Human
gcagcucagagaggguggg

SEQ ID NO: 2379439 - RNA, 20 nt, Human
gcagccucuccccaggucca

SEQ ID NO: 2379440 - RNA, 16 nt, Human
gcagcucaccucuccc

SEQ ID NO: 2379441 - RNA, 18 nt, Human
gcagccuccuccugacca

SEQ ID NO: 2379442 - RNA, 14 nt, Human
gcagccuccuccug

SEQ ID NO: 2379443 - RNA, 15 nt, Human
gcagccuccuccuga

SEQ ID NO: 2379444 - RNA, 23 nt, Human
gcagccucccucugaccugcagg

SEQ ID NO: 2379445 - RNA, 12 nt, Human
gcagccucuccc

SEQ ID NO: 2379446 - RNA, 16 nt, Human
gcagccucuccccagg

SEQ ID NO: 2379447 - RNA, 17 nt, Human
gcagcucaccucucccu

SEQ ID NO: 2379448 - RNA, 20 nt, Human
gcagcucaccucucccuugg

SEQ ID NO: 2379449 - RNA, 21 nt, Human
gcagcucaccucucccuugga

SEQ ID NO: 2379450 - RNA, 14 nt, Human
gcagcucagagagg

SEQ ID NO: 2379451 - RNA, 23 nt, Human
gcagcagcuuuuaauacagggua

SEQ ID NO: 2379452 - RNA, 12 nt, Human
gcagagagaagc

SEQ ID NO: 2379453 - RNA, 16 nt, Human
gcagcaggaggccagg

SEQ ID NO: 2379454 - RNA, 14 nt, Human
gcagcagccaucau

SEQ ID NO: 2379455 - RNA, 22 nt, Human
gcagcagccaucauaggaaggg

SEQ ID NO: 2379456 - RNA, 19 nt, Human
gcagcagggagggcuucug

SEQ ID NO: 2379457 - RNA, 18 nt, Human
gcagcagggagggcuucu

SEQ ID NO: 2379458 - RNA, 20 nt, Human
gcagcagggagggcuucugc

SEQ ID NO: 2379459 - RNA, 14 nt, Human
gcagcccugcuuug

SEQ ID NO: 2379460 - RNA, 14 nt, Human
gcagcccuggaguc

SEQ ID NO: 2379461 - RNA, 16 nt, Human
gcagcccuggagucau

SEQ ID NO: 2379462 - RNA, 24 nt, Human
gcagcccugcuuugggcugcccug

SEQ ID NO: 2379463 - RNA, 22 nt, Human
gcagccucccucugaccugcag

SEQ ID NO: 2379464 - RNA, 16 nt, Human
gcagccucccucugac

SEQ ID NO: 2379465 - RNA, 14 nt, Human
gcagccucccucug

SEQ ID NO: 2379466 - RNA, 21 nt, Human
gcagccucccauccagggccc

SEQ ID NO: 2379467 - RNA, 20 nt, Human
gcagccucccauccagggcc

SEQ ID NO: 2379468 - RNA, 18 nt, Human
gcagccucccauccaggg

SEQ ID NO: 2379469 - RNA, 19 nt, Human
gcagccucacaguccuuac

SEQ ID NO: 2379470 - RNA, 18 nt, Human
gcagccggcacagggucu

SEQ ID NO: 2379471 - RNA, 19 nt, Human
gcagccggcacagggucug

SEQ ID NO: 2379472 - RNA, 15 nt, Human
gcagccgugaucaag

SEQ ID NO: 2379473 - RNA, 15 nt, Human
gcagcccuuggccag

SEQ ID NO: 2379474 - RNA, 14 nt, Human
gcagccgagcucgu

SEQ ID NO: 2379475 - RNA, 12 nt, Human
gcagcccuugcu

SEQ ID NO: 2379476 - RNA, 18 nt, Human
gcagcccuggagucaugc

SEQ ID NO: 2379477 - RNA, 17 nt, Human
gcagccgcugagcgagg

SEQ ID NO: 2379478 - RNA, 16 nt, Human
gcagccgcugagcgag

SEQ ID NO: 2379479 - RNA, 15 nt, Human
gcagccucacagucc

SEQ ID NO: 2379480 - RNA, 17 nt, Human
gcagccucacaguccuu

SEQ ID NO: 2379481 - RNA, 13 nt, Human
gcagaggggcagg

SEQ ID NO: 2379482 - RNA, 12 nt, Human
gcagagacuugg

SEQ ID NO: 2379483 - RNA, 17 nt, Human
gcagaggggcaggcccu

SEQ ID NO: 2379484 - RNA, 18 nt, Human
gcagaggggcaggcccug

SEQ ID NO: 2379485 - RNA, 19 nt, Human
gcagaggggcaggcccugc

SEQ ID NO: 2379486 - RNA, 22 nt, Human
gcagagaccaucccugaaggcc

SEQ ID NO: 2379487 - RNA, 20 nt, Human
gcagagaccaucccugaagg

SEQ ID NO: 2379488 - RNA, 21 nt, Human
gcagagaccaucccugaaggc

SEQ ID NO: 2379489 - RNA, 21 nt, Human
gcagacugcugcuagagccag

SEQ ID NO: 2379490 - RNA, 15 nt, Human
gcagacuggagggga

SEQ ID NO: 2379491 - RNA, 14 nt, Human
gcagacuggagggg

SEQ ID NO: 2379492 - RNA, 13 nt, Human
gcagacuggaggg

SEQ ID NO: 2379493 - RNA, 12 nt, Human
gcagacuggagg

SEQ ID NO: 2379494 - RNA, 13 nt, Human
gcagacugguggg

SEQ ID NO: 2379495 - RNA, 17 nt, Human
gcagacuggugagcaga

SEQ ID NO: 2379496 - RNA, 19 nt, Human
gcagagaccaucccugaag

SEQ ID NO: 2379497 - RNA, 15 nt, Human
gcagagaaagaagag

SEQ ID NO: 2379498 - RNA, 16 nt, Human
gcagagaaagaagaga

SEQ ID NO: 2379499 - RNA, 18 nt, Human
gcagagaaagaagagaca

SEQ ID NO: 2379500 - RNA, 22 nt, Human
gcagagaaagaagagacaggag

SEQ ID NO: 2379501 - RNA, 23 nt, Human
gcagagaaagaagagacaggagg

SEQ ID NO: 2379502 - RNA, 17 nt, Human
gcagacucuacagaggc

SEQ ID NO: 2379503 - RNA, 18 nt, Human
gcagacucuacagaggcc

SEQ ID NO: 2379504 - RNA, 19 nt, Human
gcagacucuacagaggcca

SEQ ID NO: 2379505 - RNA, 22 nt, Human
gcagacucuacagaggccaugg

SEQ ID NO: 2379506 - RNA, 22 nt, Human
gcacuucgggaggucgaggcag

SEQ ID NO: 2379507 - RNA, 21 nt, Human
gcacuugcacgcccaugugug

SEQ ID NO: 2379508 - RNA, 22 nt, Human
gcacuugcacgcccauguguga

SEQ ID NO: 2379509 - RNA, 14 nt, Human
gcacuugcagacuc

SEQ ID NO: 2379510 - RNA, 16 nt, Human
gcacuugcagacucua

SEQ ID NO: 2379511 - RNA, 17 nt, Human
gcagaugcaaagaggca

SEQ ID NO: 2379512 - RNA, 18 nt, Human
gcagauggagaccccuug

SEQ ID NO: 2379513 - RNA, 16 nt, Human
gcagaugaccccuccc

SEQ ID NO: 2379514 - RNA, 15 nt, Human
gcagaugaccccucc

SEQ ID NO: 2379515 - RNA, 13 nt, Human
gcagaugacaaaa

SEQ ID NO: 2379516 - RNA, 16 nt, Human
gcagaugcaaagaggc

SEQ ID NO: 2379517 - RNA, 15 nt, Human
gcagaugcaaagagg

SEQ ID NO: 2379518 - RNA, 14 nt, Human
gcagaugauccaug

SEQ ID NO: 2379519 - RNA, 13 nt, Human
gcagaugauccau

SEQ ID NO: 2379520 - RNA, 14 nt, Human
gcagaugagguugc

SEQ ID NO: 2379521 - RNA, 19 nt, Human
gcagaugagguugcuagag

SEQ ID NO: 2379522 - RNA, 12 nt, Human
gcagcagaggca

SEQ ID NO: 2379523 - RNA, 15 nt, Human
gcagcagaggcacug

SEQ ID NO: 2379524 - RNA, 13 nt, Human
gcagcagauuuua

SEQ ID NO: 2379525 - RNA, 20 nt, Human
gcagcagauuuuaggaaaug

SEQ ID NO: 2379526 - RNA, 15 nt, Human
gcagcagaagggggu

SEQ ID NO: 2379527 - RNA, 22 nt, Human
gcagcagaaggggguggugucu

SEQ ID NO: 2379528 - RNA, 13 nt, Human
gcagcagaagggg

SEQ ID NO: 2379529 - RNA, 18 nt, Human
gcagauguccuugaugcu

SEQ ID NO: 2379530 - RNA, 22 nt, Human
gcagaucugugccccaugccug

SEQ ID NO: 2379531 - RNA, 20 nt, Human
gcagaucugugccccaugcc

SEQ ID NO: 2379532 - RNA, 14 nt, Human
gcagaucugugccc

SEQ ID NO: 2379533 - RNA, 13 nt, Human
gcagaucugugcc

SEQ ID NO: 2379534 - RNA, 14 nt, Human
gcagaucccagcuc

SEQ ID NO: 2379535 - RNA, 12 nt, Human
gcagaucccagc

SEQ ID NO: 2379536 - RNA, 15 nt, Human
gcagaucccagcuca

SEQ ID NO: 2379537 - RNA, 14 nt, Human
gcagauccaggacu

SEQ ID NO: 2379538 - RNA, 23 nt, Human
gcagagguggccagagcugggag

SEQ ID NO: 2379539 - RNA, 15 nt, Human
gcagauccaggacua

SEQ ID NO: 2379540 - RNA, 14 nt, Human
gcagagguggccag

SEQ ID NO: 2379541 - RNA, 15 nt, Human
gcagagguggccaga

SEQ ID NO: 2379542 - RNA, 21 nt, Human
gcagagguaaaagugugagca

SEQ ID NO: 2379543 - RNA, 15 nt, Human
gcagaggucugugcu

SEQ ID NO: 2379544 - RNA, 16 nt, Human
gcagaggucugugcug

SEQ ID NO: 2379545 - RNA, 18 nt, Human
gcagaggucugugcugag

SEQ ID NO: 2379546 - RNA, 23 nt, Human
gcagagguugcagugagccgaga

SEQ ID NO: 2379547 - RNA, 21 nt, Human
gcagaggggcuuucuggagag

SEQ ID NO: 2379548 - RNA, 20 nt, Human
gcagaggggcuuucuggaga

SEQ ID NO: 2379549 - RNA, 20 nt, Human
gcagaggggcaggcccugca

SEQ ID NO: 2379550 - RNA, 19 nt, Human
gcagagggguaggcagagc

SEQ ID NO: 2379551 - RNA, 13 nt, Human
gcagagguaaaag

SEQ ID NO: 2379552 - RNA, 20 nt, Human
gcagagguaaaagugugagc

SEQ ID NO: 2379553 - RNA, 19 nt, Human
gcagaggggcuuucuggag

SEQ ID NO: 2379554 - RNA, 18 nt, Human
gcagaggggcuuucugga

SEQ ID NO: 2379555 - RNA, 16 nt, Human
gcagaggggcuuucug

SEQ ID NO: 2379556 - RNA, 12 nt, Human
gcagaggggcuu

SEQ ID NO: 2379557 - RNA, 21 nt, Human
gcagagguccacaacacacag

SEQ ID NO: 2379558 - RNA, 23 nt, Human
gcagagguaaaagugugagcagu

SEQ ID NO: 2379559 - RNA, 18 nt, Human
gcagagguugcagugagc

SEQ ID NO: 2379560 - RNA, 22 nt, Human
gcccaauucuuacaaacaugug

SEQ ID NO: 2379561 - RNA, 14 nt, Human
gcccaaugaaauga

SEQ ID NO: 2379562 - RNA, 14 nt, Human
gcccaauuggagga

SEQ ID NO: 2379563 - RNA, 15 nt, Human
gcccaauuggaggaa

SEQ ID NO: 2379564 - RNA, 20 nt, Human
gcccaauuggaggaaagcaa

SEQ ID NO: 2379565 - RNA, 21 nt, Human
gcccagaccccucuggccagg

SEQ ID NO: 2379566 - RNA, 20 nt, Human
gcccagaccccucuggccag

SEQ ID NO: 2379567 - RNA, 19 nt, Human
gcccagaccccucuggcca

SEQ ID NO: 2379568 - RNA, 16 nt, Human
gcccagaccccucugg

SEQ ID NO: 2379569 - RNA, 12 nt, Human
gcccaauauuau

SEQ ID NO: 2379570 - RNA, 18 nt, Human
gcccaauauuauaauuuu

SEQ ID NO: 2379571 - RNA, 20 nt, Human
gcccaaguggcagagcuugg

SEQ ID NO: 2379572 - RNA, 18 nt, Human
gcccaaguuguggugcug

SEQ ID NO: 2379573 - RNA, 21 nt, Human
gcccaaguuguggugcugaca

SEQ ID NO: 2379574 - RNA, 19 nt, Human
gcccaauaugcaguucugc

SEQ ID NO: 2379575 - RNA, 21 nt, Human
gcccaaugcacuuuguucugg

SEQ ID NO: 2379576 - RNA, 13 nt, Human
gcccagagaagcc

SEQ ID NO: 2379577 - RNA, 15 nt, Human
gcccagagaagccaa

SEQ ID NO: 2379578 - RNA, 20 nt, Human
gcccagagacauacuugaag

SEQ ID NO: 2379579 - RNA, 10 nt, Human
gcccagagac

SEQ ID NO: 2379580 - RNA, 19 nt, Human
gcccagagacccaagcugc

SEQ ID NO: 2379581 - RNA, 23 nt, Human
gcccagagacauacuugaagggc

SEQ ID NO: 2379582 - RNA, 13 nt, Human
gcccagagcccag

SEQ ID NO: 2379583 - RNA, 14 nt, Human
gcccagagcccagc

SEQ ID NO: 2379584 - RNA, 16 nt, Human
gcccagagcccagcuc

SEQ ID NO: 2379585 - RNA, 15 nt, Human
gcccagagcccagcu

SEQ ID NO: 2379586 - RNA, 20 nt, Human
gcccagagggcccaggcagg

SEQ ID NO: 2379587 - RNA, 16 nt, Human
gcccagagggcccagg

SEQ ID NO: 2379588 - RNA, 15 nt, Human
gcccagagggcccag

SEQ ID NO: 2379589 - RNA, 13 nt, Human
gcccagagggccc

SEQ ID NO: 2379590 - RNA, 12 nt, Human
gcccagagggcc

SEQ ID NO: 2379591 - RNA, 18 nt, Human
gcccagagcccagcucca

SEQ ID NO: 2379592 - RNA, 17 nt, Human
gcccagagcccagcucc

SEQ ID NO: 2379593 - RNA, 23 nt, Human
gcccagaggagggcagcagaagg

SEQ ID NO: 2379594 - RNA, 16 nt, Human
gcccagaggagggcag

SEQ ID NO: 2379595 - RNA, 14 nt, Human
gcccagagggccug

SEQ ID NO: 2379596 - RNA, 15 nt, Human
gcccagagggccugc

SEQ ID NO: 2379597 - RNA, 18 nt, Human
gcccagagggccugcaag

SEQ ID NO: 2379598 - RNA, 19 nt, Human
gcccagagggccugcaagg

SEQ ID NO: 2379599 - RNA, 14 nt, Human
gcccagccaggccc

SEQ ID NO: 2379600 - RNA, 15 nt, Human
gcccagccaggcccc

SEQ ID NO: 2379601 - RNA, 16 nt, Human
gcccagccaggcccca

SEQ ID NO: 2379602 - RNA, 17 nt, Human
gcccagccaggccccag

SEQ ID NO: 2379603 - RNA, 21 nt, Human
gcccagccaaacccugucuga

SEQ ID NO: 2379604 - RNA, 20 nt, Human
gcccagccaaacccugucug

SEQ ID NO: 2379605 - RNA, 23 nt, Human
gcccagccauuaccauggagaca

SEQ ID NO: 2379606 - RNA, 22 nt, Human
gcccagccauuaccauggagac

SEQ ID NO: 2379607 - RNA, 21 nt, Human
gcccagccauuaccauggaga

SEQ ID NO: 2379608 - RNA, 20 nt, Human
gcccagccauuaccauggag

SEQ ID NO: 2379609 - RNA, 9 nt, Human
gcccagccc

SEQ ID NO: 2379610 - RNA, 15 nt, Human
gcccagcccagcugg

SEQ ID NO: 2379611 - RNA, 14 nt, Human
gcccagcccagcug

SEQ ID NO: 2379612 - RNA, 16 nt, Human
gcccagcccagcuggu

SEQ ID NO: 2379613 - RNA, 11 nt, Human
gcccagccccu

SEQ ID NO: 2379614 - RNA, 12 nt, Human
gcccagccccuu

SEQ ID NO: 2379615 - RNA, 23 nt, Human
gcccagcccccacagugcugucu

SEQ ID NO: 2379616 - RNA, 15 nt, Human
gcccagcccccacag

SEQ ID NO: 2379617 - RNA, 21 nt, Human
gcccagcccccacagugcugu

SEQ ID NO: 2379618 - RNA, 20 nt, Human
gcccagcacugcuugaggaa

SEQ ID NO: 2379619 - RNA, 17 nt, Human
gcccagccaaacccugu

SEQ ID NO: 2379620 - RNA, 18 nt, Human
gcccagcauugcugguuc

SEQ ID NO: 2379621 - RNA, 19 nt, Human
gcccagcauugcugguucu

SEQ ID NO: 2379622 - RNA, 21 nt, Human
gcccagcacugcuugaggaaa

SEQ ID NO: 2379623 - RNA, 14 nt, Human
gcccagcauugcug

SEQ ID NO: 2379624 - RNA, 16 nt, Human
gcccagcauugcuggu

SEQ ID NO: 2379625 - RNA, 15 nt, Human
gcccagaucccagaa

SEQ ID NO: 2379626 - RNA, 21 nt, Human
gcccagauguuuuacgucugg

SEQ ID NO: 2379627 - RNA, 16 nt, Human
gcccagaucagcuccu

SEQ ID NO: 2379628 - RNA, 17 nt, Human
gcccagaucagcuccua

SEQ ID NO: 2379629 - RNA, 14 nt, Human
gcccagaguugcug

SEQ ID NO: 2379630 - RNA, 23 nt, Human
gcccagaguugcugggagcugaa

SEQ ID NO: 2379631 - RNA, 22 nt, Human
gcccagagguaacagaacagcu

SEQ ID NO: 2379632 - RNA, 18 nt, Human
gcccagagguaacagaac

SEQ ID NO: 2379633 - RNA, 20 nt, Human
gcccagagguaacagaacag

SEQ ID NO: 2379634 - RNA, 21 nt, Human
gcccagagggcccaggcaggc

SEQ ID NO: 2379635 - RNA, 12 nt, Human
gcccagagguaa

SEQ ID NO: 2379636 - RNA, 16 nt, Human
gcccagagguaacaga

SEQ ID NO: 2379637 - RNA, 22 nt, Human
gcccagagggccugcaagggag

SEQ ID NO: 2379638 - RNA, 20 nt, Human
gcccagagggccugcaaggg

SEQ ID NO: 2379639 - RNA, 21 nt, Human
gcccagagggccugcaaggga

SEQ ID NO: 2379640 - RNA, 18 nt, Human
gcccaguccuuccaccuc

SEQ ID NO: 2379641 - RNA, 19 nt, Human
gcccaguccuuccaccucg

SEQ ID NO: 2379642 - RNA, 20 nt, Human
gcccagucuggaaugcagug

SEQ ID NO: 2379643 - RNA, 15 nt, Human
gcccaguugggugga

SEQ ID NO: 2379644 - RNA, 14 nt, Human
gcccaguccuucca

SEQ ID NO: 2379645 - RNA, 17 nt, Human
gcccaguccuggccugg

SEQ ID NO: 2379646 - RNA, 18 nt, Human
gcccaguccuggccuggc

SEQ ID NO: 2379647 - RNA, 15 nt, Human
gcccaguccuuccac

SEQ ID NO: 2379648 - RNA, 17 nt, Human
gcccaguccuuccaccu

SEQ ID NO: 2379649 - RNA, 19 nt, Human
gcccagucuggaaugcagu

SEQ ID NO: 2379650 - RNA, 23 nt, Human
gcccaggcuuagucacugagaca

SEQ ID NO: 2379651 - RNA, 17 nt, Human
gcccagggacaccagcc

SEQ ID NO: 2379652 - RNA, 18 nt, Human
gcccagggacaccagcca

SEQ ID NO: 2379653 - RNA, 19 nt, Human
gcccagggacaccagccag

SEQ ID NO: 2379654 - RNA, 20 nt, Human
gcccagggacaccagccagg

SEQ ID NO: 2379655 - RNA, 13 nt, Human
gcccaguccuggc

SEQ ID NO: 2379656 - RNA, 15 nt, Human
gcccaguccuggccu

SEQ ID NO: 2379657 - RNA, 16 nt, Human
gcccaguccuggccug

SEQ ID NO: 2379658 - RNA, 19 nt, Human
gcccaggcuuagucacuga

SEQ ID NO: 2379659 - RNA, 21 nt, Human
gcccaggcuuagucacugaga

SEQ ID NO: 2379660 - RNA, 17 nt, Human
gcccagcuggugggaag

SEQ ID NO: 2379661 - RNA, 13 nt, Human
gcccagcuugggc

SEQ ID NO: 2379662 - RNA, 14 nt, Human
gcccagcuugggcc

SEQ ID NO: 2379663 - RNA, 15 nt, Human
gcccagcuugggccc

SEQ ID NO: 2379664 - RNA, 16 nt, Human
gcccaggcugguuucg

SEQ ID NO: 2379665 - RNA, 22 nt, Human
gcccaggcuggcgugcaguggu

SEQ ID NO: 2379666 - RNA, 19 nt, Human
gcccaggcuggcgugcagu

SEQ ID NO: 2379667 - RNA, 20 nt, Human
gcccaggcuggcgugcagug

SEQ ID NO: 2379668 - RNA, 18 nt, Human
gcccaggaaaggcuccag

SEQ ID NO: 2379669 - RNA, 19 nt, Human
gcccaggaaaggcuccagg

SEQ ID NO: 2379670 - RNA, 20 nt, Human
gcccaggaaaggcuccagga

SEQ ID NO: 2379671 - RNA, 21 nt, Human
gcccaggaaaggcuccaggag

SEQ ID NO: 2379672 - RNA, 16 nt, Human
gcccagcggccccucc

SEQ ID NO: 2379673 - RNA, 17 nt, Human
gcccagcggccccuccc

SEQ ID NO: 2379674 - RNA, 18 nt, Human
gcccagcggccccuccca

SEQ ID NO: 2379675 - RNA, 19 nt, Human
gcccagcggccccucccac

SEQ ID NO: 2379676 - RNA, 20 nt, Human
gcccagcggccccucccaca

SEQ ID NO: 2379677 - RNA, 13 nt, Human
gcccagccggccu

SEQ ID NO: 2379678 - RNA, 15 nt, Human
gcccagccggccucu

SEQ ID NO: 2379679 - RNA, 16 nt, Human
gcccagccggccucuc

SEQ ID NO: 2379680 - RNA, 18 nt, Human
gcccagccggccucucug

SEQ ID NO: 2379681 - RNA, 23 nt, Human
gcccagccggccucucuggccuc

SEQ ID NO: 2379682 - RNA, 24 nt, Human
gcccagccggccucucuggccucc

SEQ ID NO: 2379683 - RNA, 19 nt, Human
gcccagccggccucucugg

SEQ ID NO: 2379684 - RNA, 20 nt, Human
gcccagccggccucucuggc

SEQ ID NO: 2379685 - RNA, 21 nt, Human
gcccagccggccucucuggcc

SEQ ID NO: 2379686 - RNA, 22 nt, Human
gcccagccggccucucuggccu

SEQ ID NO: 2379687 - RNA, 13 nt, Human
gcccagcugggcu

SEQ ID NO: 2379688 - RNA, 18 nt, Human
gcccagcuauaccugugc

SEQ ID NO: 2379689 - RNA, 15 nt, Human
gcccagcuagcugca

SEQ ID NO: 2379690 - RNA, 23 nt, Human
gcccagcggccccucccacacac

SEQ ID NO: 2379691 - RNA, 14 nt, Human
gcccagcugggcuc

SEQ ID NO: 2379692 - RNA, 15 nt, Human
gcccagcugggcucu

SEQ ID NO: 2379693 - RNA, 16 nt, Human
gcccagcugggcucug

SEQ ID NO: 2379694 - RNA, 18 nt, Human
gcccagcugggcucugcc

SEQ ID NO: 2379695 - RNA, 19 nt, Human
gcccagcugggcucugcca

SEQ ID NO: 2379696 - RNA, 21 nt, Human
gcccagcugggcucugccacc

SEQ ID NO: 2379697 - RNA, 23 nt, Human
gcccagcugggcucugccacccu

SEQ ID NO: 2379698 - RNA, 21 nt, Human
gcccagcuugaaaccuucacu

SEQ ID NO: 2379699 - RNA, 20 nt, Human
gcccagcugggucaggcagg

SEQ ID NO: 2379700 - RNA, 19 nt, Human
gcccagcugggucaggcag

SEQ ID NO: 2379701 - RNA, 18 nt, Human
gcccagcugggucaggca

SEQ ID NO: 2379702 - RNA, 15 nt, Human
gcccagcugggucag

SEQ ID NO: 2379703 - RNA, 14 nt, Human
gcccagcuggguca

SEQ ID NO: 2379704 - RNA, 13 nt, Human
gcccagcuggguc

SEQ ID NO: 2379705 - RNA, 20 nt, Human
gcccagccccuucugaccca

SEQ ID NO: 2379706 - RNA, 24 nt, Human
gcccagccccuucugacccaugcu

SEQ ID NO: 2379707 - RNA, 16 nt, Human
gcccagcccuccccau

SEQ ID NO: 2379708 - RNA, 18 nt, Human
gcccagcccggaccuugg

SEQ ID NO: 2379709 - RNA, 13 nt, Human
gcccagcccggcu

SEQ ID NO: 2379710 - RNA, 12 nt, Human
gcccagcccucc

SEQ ID NO: 2379711 - RNA, 14 nt, Human
gcccagcccggcuc

SEQ ID NO: 2379712 - RNA, 11 nt, Human
gcccagcccug

SEQ ID NO: 2379713 - RNA, 12 nt, Human
gcccagcccugc

SEQ ID NO: 2379714 - RNA, 13 nt, Human
gcccagcccugcu

SEQ ID NO: 2379715 - RNA, 15 nt, Human
gcccagcccugcugg

SEQ ID NO: 2379716 - RNA, 16 nt, Human
gcccagcccugcuggc

SEQ ID NO: 2379717 - RNA, 17 nt, Human
gcccagcccugcuggcc

SEQ ID NO: 2379718 - RNA, 21 nt, Human
gcccagcccugcuggccgccu

SEQ ID NO: 2379719 - RNA, 13 nt, Human
gcccagccccuuc

SEQ ID NO: 2379720 - RNA, 14 nt, Human
gcccagccccuucu

SEQ ID NO: 2379721 - RNA, 16 nt, Human
gcccagccccuucuga

SEQ ID NO: 2379722 - RNA, 17 nt, Human
gcccagccccuucugac

SEQ ID NO: 2379723 - RNA, 11 nt, Human
gccagggagcu

SEQ ID NO: 2379724 - RNA, 20 nt, Human
gccagggcaaugaugaauga

SEQ ID NO: 2379725 - RNA, 16 nt, Human
gccagggcagagugag

SEQ ID NO: 2379726 - RNA, 15 nt, Human
gccagggcagaguga

SEQ ID NO: 2379727 - RNA, 19 nt, Human
gccagggcagggccccagg

SEQ ID NO: 2379728 - RNA, 14 nt, Human
gccagggcagggcc

SEQ ID NO: 2379729 - RNA, 21 nt, Human
gccagggcagagugagaccca

SEQ ID NO: 2379730 - RNA, 19 nt, Human
gccagggggacuagccccu

SEQ ID NO: 2379731 - RNA, 20 nt, Human
gccagggggacuagccccug

SEQ ID NO: 2379732 - RNA, 13 nt, Human
gccagggccaggg

SEQ ID NO: 2379733 - RNA, 22 nt, Human
gccagggccccucacccugccu

SEQ ID NO: 2379734 - RNA, 22 nt, Human
gccaggggggugaggagcuggg

SEQ ID NO: 2379735 - RNA, 18 nt, Human
gccaggggucucccugga

SEQ ID NO: 2379736 - RNA, 21 nt, Human
gccaggggggugaggagcugg

SEQ ID NO: 2379737 - RNA, 20 nt, Human
gccaggggggugaggagcug

SEQ ID NO: 2379738 - RNA, 19 nt, Human
gccaggggggugaggagcu

SEQ ID NO: 2379739 - RNA, 21 nt, Human
gccagggggacuagccccugu

SEQ ID NO: 2379740 - RNA, 13 nt, Human
gccagguuuucug

SEQ ID NO: 2379741 - RNA, 19 nt, Human
gccagguuuucuggguguc

SEQ ID NO: 2379742 - RNA, 14 nt, Human
gccaguauuuuuua

SEQ ID NO: 2379743 - RNA, 20 nt, Human
gccagucaccccggccaccu

SEQ ID NO: 2379744 - RNA, 17 nt, Human
gccagucaccccggcca

SEQ ID NO: 2379745 - RNA, 18 nt, Human
gccagucaccccggccac

SEQ ID NO: 2379746 - RNA, 22 nt, Human
gccagguuucugcccacauugg

SEQ ID NO: 2379747 - RNA, 12 nt, Human
gccaguaaaugg

SEQ ID NO: 2379748 - RNA, 17 nt, Human
gccagguuuuuggucug

SEQ ID NO: 2379749 - RNA, 18 nt, Human
gccagguggccacuccag

SEQ ID NO: 2379750 - RNA, 17 nt, Human
gccagggugagagcugc

SEQ ID NO: 2379751 - RNA, 23 nt, Human
gccagggugagagcugcucugga

SEQ ID NO: 2379752 - RNA, 21 nt, Human
gccaggggucucccuggagug

SEQ ID NO: 2379753 - RNA, 15 nt, Human
gccagggugagagcu

SEQ ID NO: 2379754 - RNA, 16 nt, Human
gccagggugagagcug

SEQ ID NO: 2379755 - RNA, 23 nt, Human
gccagguucuccguuagcuccug

SEQ ID NO: 2379756 - RNA, 20 nt, Human
gccagguucuauuuggaauu

SEQ ID NO: 2379757 - RNA, 23 nt, Human
gccagguucuauuuggaauuuau

SEQ ID NO: 2379758 - RNA, 18 nt, Human
gccaggugggcgggcagc

SEQ ID NO: 2379759 - RNA, 19 nt, Human
gccaggugggcgggcagca

SEQ ID NO: 2379760 - RNA, 18 nt, Human
gccagguucuauuuggaa

SEQ ID NO: 2379761 - RNA, 19 nt, Human
gccagguucuauuuggaau

SEQ ID NO: 2379762 - RNA, 16 nt, Human
gccagggagacagagc

SEQ ID NO: 2379763 - RNA, 21 nt, Human
gccagggagacagagcucaca

SEQ ID NO: 2379764 - RNA, 20 nt, Human
gccagggagaagcuccucuc

SEQ ID NO: 2379765 - RNA, 16 nt, Human
gccagggagaagcucc

SEQ ID NO: 2379766 - RNA, 15 nt, Human
gccagggagaagcuc

SEQ ID NO: 2379767 - RNA, 14 nt, Human
gccagggagaagcu

SEQ ID NO: 2379768 - RNA, 18 nt, Human
gccagggaaguccccgag

SEQ ID NO: 2379769 - RNA, 23 nt, Human
gccagggacagaggggguggccu

SEQ ID NO: 2379770 - RNA, 22 nt, Human
gccaggcuggucucgaacuccu

SEQ ID NO: 2379771 - RNA, 13 nt, Human
gccagggacagag

SEQ ID NO: 2379772 - RNA, 16 nt, Human
gccagggacagagggg

SEQ ID NO: 2379773 - RNA, 18 nt, Human
gccagggacagagggggu

SEQ ID NO: 2379774 - RNA, 14 nt, Human
gccaggcugccaag

SEQ ID NO: 2379775 - RNA, 22 nt, Human
gccaggcugcucuugaacuccu

SEQ ID NO: 2379776 - RNA, 13 nt, Human
gccaggcuggguc

SEQ ID NO: 2379777 - RNA, 14 nt, Human
gccaggcugcucuu

SEQ ID NO: 2379778 - RNA, 13 nt, Human
gccaggcugcucu

SEQ ID NO: 2379779 - RNA, 22 nt, Human
gccaggcugaccacagcacagc

SEQ ID NO: 2379780 - RNA, 19 nt, Human
gccagauuuuccugaaaac

SEQ ID NO: 2379781 - RNA, 16 nt, Human
gccagauuucacucuc

SEQ ID NO: 2379782 - RNA, 11 nt, Human
gccagauccag

SEQ ID NO: 2379783 - RNA, 11 nt, Human
gccagaugcug

SEQ ID NO: 2379784 - RNA, 12 nt, Human
gccagaugcuga

SEQ ID NO: 2379785 - RNA, 14 nt, Human
gccagauccagccu

SEQ ID NO: 2379786 - RNA, 18 nt, Human
gccagauuucacucuccu

SEQ ID NO: 2379787 - RNA, 21 nt, Human
gccagauuucacucuccuugg

SEQ ID NO: 2379788 - RNA, 17 nt, Human
gccagugacuccaggag

SEQ ID NO: 2379789 - RNA, 18 nt, Human
gccagugacuccaggaga

SEQ ID NO: 2379790 - RNA, 19 nt, Human
gccagugaugcuaaagguu

SEQ ID NO: 2379791 - RNA, 20 nt, Human
gccagugaugcuaaagguug

SEQ ID NO: 2379792 - RNA, 20 nt, Human
gccagugaccugaggaagcg

SEQ ID NO: 2379793 - RNA, 13 nt, Human
gccagugacucca

SEQ ID NO: 2379794 - RNA, 15 nt, Human
gccagugacuccagg

SEQ ID NO: 2379795 - RNA, 16 nt, Human
gccagugacuccagga

SEQ ID NO: 2379796 - RNA, 18 nt, Human
gccagugaccugaggaag

SEQ ID NO: 2379797 - RNA, 17 nt, Human
gccagugaccugaggaa

SEQ ID NO: 2379798 - RNA, 17 nt, Human
gccagugccuuaccucc

SEQ ID NO: 2379799 - RNA, 15 nt, Human
gccagugccuuaccu

SEQ ID NO: 2379800 - RNA, 11 nt, Human
gccagugccuu

SEQ ID NO: 2379801 - RNA, 10 nt, Human
gccagugccu

SEQ ID NO: 2379802 - RNA, 21 nt, Human
gccagugacuccaggagagga

SEQ ID NO: 2379803 - RNA, 19 nt, Human
gccaucgccgggacuccag

SEQ ID NO: 2379804 - RNA, 23 nt, Human
gccaucgccgggacuccagaacc

SEQ ID NO: 2379805 - RNA, 19 nt, Human
gccagugccuuaccuccug

SEQ ID NO: 2379806 - RNA, 12 nt, Human
gccauccugucc

SEQ ID NO: 2379807 - RNA, 18 nt, Human
gccaucgccgggacucca

SEQ ID NO: 2379808 - RNA, 22 nt, Human
gccaucuccacccccagcugcu

SEQ ID NO: 2379809 - RNA, 12 nt, Human
gccaucucugga

SEQ ID NO: 2379810 - RNA, 15 nt, Human
gccaucucuggaugc

SEQ ID NO: 2379811 - RNA, 16 nt, Human
gccaucucuggaugcc

SEQ ID NO: 2379812 - RNA, 19 nt, Human
gccaucucuggaugccuga

SEQ ID NO: 2379813 - RNA, 21 nt, Human
gccaucugcgugacaauaaaa

SEQ ID NO: 2379814 - RNA, 17 nt, Human
gccaucugcccaggggu

SEQ ID NO: 2379815 - RNA, 19 nt, Human
gccaucugcccaggggugc

SEQ ID NO: 2379816 - RNA, 12 nt, Human
gccaucugccca

SEQ ID NO: 2379817 - RNA, 13 nt, Human
gccaucugcccag

SEQ ID NO: 2379818 - RNA, 14 nt, Human
gccaucugcccagg

SEQ ID NO: 2379819 - RNA, 15 nt, Human
gccaucugcccaggg

SEQ ID NO: 2379820 - RNA, 17 nt, Human
gccaugagcuccagacc

SEQ ID NO: 2379821 - RNA, 16 nt, Human
gccaugagcuccagac

SEQ ID NO: 2379822 - RNA, 15 nt, Human
gccaugagcuccaga

SEQ ID NO: 2379823 - RNA, 14 nt, Human
gccaugagcuccag

SEQ ID NO: 2379824 - RNA, 23 nt, Human
gccaugagaugauacauccaaag

SEQ ID NO: 2379825 - RNA, 20 nt, Human
gccaucugcccaggggugcc

SEQ ID NO: 2379826 - RNA, 18 nt, Human
gccaugaccuuacauuuc

SEQ ID NO: 2379827 - RNA, 23 nt, Human
gccaugagcuccagacccccagc

SEQ ID NO: 2379828 - RNA, 22 nt, Human
gccaugagcuccagacccccag

SEQ ID NO: 2379829 - RNA, 19 nt, Human
gccaugagcuccagacccc

SEQ ID NO: 2379830 - RNA, 18 nt, Human
gccaugagcuccagaccc

SEQ ID NO: 2379831 - RNA, 18 nt, Human
gccaugaggaacaaggca

SEQ ID NO: 2379832 - RNA, 18 nt, Human
gccaugccagcuuaucuc

SEQ ID NO: 2379833 - RNA, 13 nt, Human
gccaugccagcuu

SEQ ID NO: 2379834 - RNA, 19 nt, Human
gccaugccagcuuaucuca

SEQ ID NO: 2379835 - RNA, 14 nt, Human
gccaugccacccug

SEQ ID NO: 2379836 - RNA, 18 nt, Human
gccauuuugugaauggau

SEQ ID NO: 2379837 - RNA, 19 nt, Human
gccauuuugugaauggauu

SEQ ID NO: 2379838 - RNA, 18 nt, Human
gcccaaaaauaugguuga

SEQ ID NO: 2379839 - RNA, 22 nt, Human
gcccaaaccaccagaagcccag

SEQ ID NO: 2379840 - RNA, 21 nt, Human
gcccaaaccaccagaagccca

SEQ ID NO: 2379841 - RNA, 13 nt, Human
gcccaacaccagc

SEQ ID NO: 2379842 - RNA, 14 nt, Human
gcccaacaccagcc

SEQ ID NO: 2379843 - RNA, 17 nt, Human
gcccaacaccagccccu

SEQ ID NO: 2379844 - RNA, 18 nt, Human
gcccaacaccagccccug

SEQ ID NO: 2379845 - RNA, 23 nt, Human
gcccaaaccaccagaagcccaga

SEQ ID NO: 2379846 - RNA, 23 nt, Human
gcccaaccggggagcccccgccc

SEQ ID NO: 2379847 - RNA, 16 nt, Human
gcccaacccuucccuc

SEQ ID NO: 2379848 - RNA, 15 nt, Human
gcccaacccugucug

SEQ ID NO: 2379849 - RNA, 16 nt, Human
gcccaacccugucugu

SEQ ID NO: 2379850 - RNA, 15 nt, Human
gcccaacccuucccc

SEQ ID NO: 2379851 - RNA, 16 nt, Human
gcccaacccuucccca

SEQ ID NO: 2379852 - RNA, 13 nt, Human
gcccaacccuguc

SEQ ID NO: 2379853 - RNA, 14 nt, Human
gcccaacccugucu

SEQ ID NO: 2379854 - RNA, 22 nt, Human
gcccaacaccagccccugcccc

SEQ ID NO: 2379855 - RNA, 23 nt, Human
gcccaacagacaccaucuuuugu

SEQ ID NO: 2379856 - RNA, 14 nt, Human
gcccaaccugcucu

SEQ ID NO: 2379857 - RNA, 13 nt, Human
gcccaaccuccug

SEQ ID NO: 2379858 - RNA, 14 nt, Human
gcccaaccuccuga

SEQ ID NO: 2379859 - RNA, 15 nt, Human
gcccaagucccuguu

SEQ ID NO: 2379860 - RNA, 17 nt, Human
gcccaagucccuguuuu

SEQ ID NO: 2379861 - RNA, 20 nt, Human
gccaggguggucuugaucuc

SEQ ID NO: 2379862 - RNA, 13 nt, Human
gccauuuugugaa

SEQ ID NO: 2379863 - RNA, 14 nt, Human
gccauuuugugaau

SEQ ID NO: 2379864 - RNA, 23 nt, Human
gccaugggacagggaggacgcuc

SEQ ID NO: 2379865 - RNA, 21 nt, Human
gccaugggaccaaaccuagcc

SEQ ID NO: 2379866 - RNA, 13 nt, Human
gccaugggaccaa

SEQ ID NO: 2379867 - RNA, 17 nt, Human
gccaugggaccaaaccu

SEQ ID NO: 2379868 - RNA, 12 nt, Human
gccaugggacca

SEQ ID NO: 2379869 - RNA, 18 nt, Human
gccauggacagaagaagg

SEQ ID NO: 2379870 - RNA, 16 nt, Human
gccaugcugggaagac

SEQ ID NO: 2379871 - RNA, 23 nt, Human
gccauggacucuacacugugaac

SEQ ID NO: 2379872 - RNA, 22 nt, Human
gccauggacucuacacugugaa

SEQ ID NO: 2379873 - RNA, 20 nt, Human
gccauggacucuacacugug

SEQ ID NO: 2379874 - RNA, 18 nt, Human
gccauggacucuacacug

SEQ ID NO: 2379875 - RNA, 22 nt, Human
gccaugggacagggaggacgcu

SEQ ID NO: 2379876 - RNA, 13 nt, Human
gccaugcugaggc

SEQ ID NO: 2379877 - RNA, 14 nt, Human
gccaugcugaaggg

SEQ ID NO: 2379878 - RNA, 15 nt, Human
gccaugcugaaggga

SEQ ID NO: 2379879 - RNA, 14 nt, Human
gccaugcugaggcc

SEQ ID NO: 2379880 - RNA, 17 nt, Human
gccaugcugaggccugg

SEQ ID NO: 2379881 - RNA, 18 nt, Human
gccaugcugaggccuggg

SEQ ID NO: 2379882 - RNA, 19 nt, Human
gccaugcugaggccugggc

SEQ ID NO: 2379883 - RNA, 20 nt, Human
gccaugcugaggccugggcc

SEQ ID NO: 2379884 - RNA, 21 nt, Human
gccaugcugaggccugggccg

SEQ ID NO: 2379885 - RNA, 22 nt, Human
gccacacucugggcuccagagu

SEQ ID NO: 2379886 - RNA, 19 nt, Human
gccacacucagcacaaggc

SEQ ID NO: 2379887 - RNA, 21 nt, Human
gccacacuauuaccaugagaa

SEQ ID NO: 2379888 - RNA, 20 nt, Human
gccacacuucaggcucuucu

SEQ ID NO: 2379889 - RNA, 22 nt, Human
gccacacuucaggcucuucucc

SEQ ID NO: 2379890 - RNA, 21 nt, Human
gccacacgucugacccucucc

SEQ ID NO: 2379891 - RNA, 22 nt, Human
gccacacccucccccgccacuc

SEQ ID NO: 2379892 - RNA, 13 nt, Human
gccacacccuccc

SEQ ID NO: 2379893 - RNA, 16 nt, Human
gccacacccucccccg

SEQ ID NO: 2379894 - RNA, 17 nt, Human
gccacacucagcacaag

SEQ ID NO: 2379895 - RNA, 16 nt, Human
gccacacucagcacaa

SEQ ID NO: 2379896 - RNA, 13 nt, Human
gccacacucagca

SEQ ID NO: 2379897 - RNA, 14 nt, Human
gccacaccugagcc

SEQ ID NO: 2379898 - RNA, 18 nt, Human
gccacacuauuaccauga

SEQ ID NO: 2379899 - RNA, 13 nt, Human
gccacagagaaag

SEQ ID NO: 2379900 - RNA, 23 nt, Human
gccacacuucaggcucuucuccu

SEQ ID NO: 2379901 - RNA, 14 nt, Human
gccacagagaaagu

SEQ ID NO: 2379902 - RNA, 20 nt, Human
gccacagagaaaguacuucu

SEQ ID NO: 2379903 - RNA, 11 nt, Human
gccacagcucu

SEQ ID NO: 2379904 - RNA, 16 nt, Human
gccacagccuccccug

SEQ ID NO: 2379905 - RNA, 18 nt, Human
gccacaggacacagucag

SEQ ID NO: 2379906 - RNA, 12 nt, Human
gccacaggacac

SEQ ID NO: 2379907 - RNA, 12 nt, Human
gccacaggccuc

SEQ ID NO: 2379908 - RNA, 13 nt, Human
gccacaggccucc

SEQ ID NO: 2379909 - RNA, 12 nt, Human
gccacaggccug

SEQ ID NO: 2379910 - RNA, 13 nt, Human
gccacaggccuga

SEQ ID NO: 2379911 - RNA, 14 nt, Human
gccacaggccuccc

SEQ ID NO: 2379912 - RNA, 16 nt, Human
gccacaggccucccug

SEQ ID NO: 2379913 - RNA, 17 nt, Human
gccacaggccucccugu

SEQ ID NO: 2379914 - RNA, 21 nt, Human
gccacaggccucccuguuuga

SEQ ID NO: 2379915 - RNA, 15 nt, Human
gccacaggccugaga

SEQ ID NO: 2379916 - RNA, 20 nt, Human
gccacaggccugagauuuca

SEQ ID NO: 2379917 - RNA, 22 nt, Human
gccacaggccugagauuucauc

SEQ ID NO: 2379918 - RNA, 23 nt, Human
gccacaggccugagauuucaucu

SEQ ID NO: 2379919 - RNA, 19 nt, Human
gccacagaagccaggagca

SEQ ID NO: 2379920 - RNA, 21 nt, Human
gccacagccuccccugccagg

SEQ ID NO: 2379921 - RNA, 23 nt, Human
gccacagagaaaguacuucucca

SEQ ID NO: 2379922 - RNA, 14 nt, Human
gccacagaagccag

SEQ ID NO: 2379923 - RNA, 18 nt, Human
gccacagaagccaggagc

SEQ ID NO: 2379924 - RNA, 23 nt, Human
gccacagaggacucacuugccca

SEQ ID NO: 2379925 - RNA, 19 nt, Human
gccacaccaucuccuuuca

SEQ ID NO: 2379926 - RNA, 20 nt, Human
gccacaccaagcugugccac

SEQ ID NO: 2379927 - RNA, 21 nt, Human
gccacaccaagcugugccacc

SEQ ID NO: 2379928 - RNA, 22 nt, Human
gccacaccaagcugugccaccc

SEQ ID NO: 2379929 - RNA, 23 nt, Human
gccacaccaagcugugccacccu

SEQ ID NO: 2379930 - RNA, 13 nt, Human
gccacaccaagcu

SEQ ID NO: 2379931 - RNA, 14 nt, Human
gccacaccaagcug

SEQ ID NO: 2379932 - RNA, 15 nt, Human
gccacaccaagcugu

SEQ ID NO: 2379933 - RNA, 16 nt, Human
gccacaccaagcugug

SEQ ID NO: 2379934 - RNA, 17 nt, Human
gccacaccaagcugugc

SEQ ID NO: 2379935 - RNA, 18 nt, Human
gccacaccaagcugugcc

SEQ ID NO: 2379936 - RNA, 19 nt, Human
gccacaccaagcugugcca

SEQ ID NO: 2379937 - RNA, 23 nt, Human
gccacacaucacccuuaccaugu

SEQ ID NO: 2379938 - RNA, 23 nt, Human
gccacacacacagaaaauauacu

SEQ ID NO: 2379939 - RNA, 13 nt, Human
gccacacagaaac

SEQ ID NO: 2379940 - RNA, 22 nt, Human
gccacacacacagaaaauauac

SEQ ID NO: 2379941 - RNA, 21 nt, Human
gccacacacacagaaaauaua

SEQ ID NO: 2379942 - RNA, 20 nt, Human
gccacacacacagaaaauau

SEQ ID NO: 2379943 - RNA, 19 nt, Human
gccacacacacagaaaaua

SEQ ID NO: 2379944 - RNA, 19 nt, Human
gccacacaaacguuuacuu

SEQ ID NO: 2379945 - RNA, 10 nt, Human
gccacacaca

SEQ ID NO: 2379946 - RNA, 21 nt, Human
gccacaaggacuuccugucca

SEQ ID NO: 2379947 - RNA, 18 nt, Human
gccacacaaacguuuacu

SEQ ID NO: 2379948 - RNA, 19 nt, Human
gccacaaggacuuccuguc

SEQ ID NO: 2379949 - RNA, 18 nt, Human
gccacaaggacuuccugu

SEQ ID NO: 2379950 - RNA, 17 nt, Human
gccacaaggacuuccug

SEQ ID NO: 2379951 - RNA, 14 nt, Human
gccacaaggacuuc

SEQ ID NO: 2379952 - RNA, 18 nt, Human
gccacacacacagaaaau

SEQ ID NO: 2379953 - RNA, 17 nt, Human
gccacacacacagaaaa

SEQ ID NO: 2379954 - RNA, 16 nt, Human
gccacacacacagaaa

SEQ ID NO: 2379955 - RNA, 15 nt, Human
gccacacacacagaa

SEQ ID NO: 2379956 - RNA, 14 nt, Human
gccacacacacaga

SEQ ID NO: 2379957 - RNA, 13 nt, Human
gccacacacacag

SEQ ID NO: 2379958 - RNA, 12 nt, Human
gccacacacaca

SEQ ID NO: 2379959 - RNA, 11 nt, Human
gccacacacac

SEQ ID NO: 2379960 - RNA, 13 nt, Human
gccaauuccuaua

SEQ ID NO: 2379961 - RNA, 20 nt, Human
gccaauuucaaguuccaagu

SEQ ID NO: 2379962 - RNA, 18 nt, Human
gccaauucagacaggcaa

SEQ ID NO: 2379963 - RNA, 17 nt, Human
gccaauucagacaggca

SEQ ID NO: 2379964 - RNA, 15 nt, Human
gccaauucagacagg

SEQ ID NO: 2379965 - RNA, 20 nt, Human
gccaauuauguuaaacuagc

SEQ ID NO: 2379966 - RNA, 20 nt, Human
gccaaugugaacagcggcug

SEQ ID NO: 2379967 - RNA, 14 nt, Human
gccaauuauguuaa

SEQ ID NO: 2379968 - RNA, 15 nt, Human
gccaauuauguuaaa

SEQ ID NO: 2379969 - RNA, 16 nt, Human
gccaauuauguuaaac

SEQ ID NO: 2379970 - RNA, 17 nt, Human
gccaauuauguuaaacu

SEQ ID NO: 2379971 - RNA, 19 nt, Human
gccaauuauguuaaacuag

SEQ ID NO: 2379972 - RNA, 21 nt, Human
gccacaacccuguuuuauacu

SEQ ID NO: 2379973 - RNA, 14 nt, Human
gccacaagaaauuu

SEQ ID NO: 2379974 - RNA, 16 nt, Human
gccacaagaaauuuga

SEQ ID NO: 2379975 - RNA, 23 nt, Human
gccacaagaaauuugauuucuau

SEQ ID NO: 2379976 - RNA, 22 nt, Human
gccacaagacccuugugguccc

SEQ ID NO: 2379977 - RNA, 16 nt, Human
gccacaagacccuugu

SEQ ID NO: 2379978 - RNA, 15 nt, Human
gccacaaauaaaaug

SEQ ID NO: 2379979 - RNA, 22 nt, Human
gccaauuuuucugcacugagca

SEQ ID NO: 2379980 - RNA, 23 nt, Human
gccaauuuuugccuucauuaccu

SEQ ID NO: 2379981 - RNA, 11 nt, Human
gccaauuuuuc

SEQ ID NO: 2379982 - RNA, 13 nt, Human
gccaauuuuucug

SEQ ID NO: 2379983 - RNA, 15 nt, Human
gccaauuuuucugca

SEQ ID NO: 2379984 - RNA, 16 nt, Human
gccaauuuuucugcac

SEQ ID NO: 2379985 - RNA, 12 nt, Human
gccaaguucuua

SEQ ID NO: 2379986 - RNA, 21 nt, Human
gccaaguuccucuagugcccu

SEQ ID NO: 2379987 - RNA, 15 nt, Human
gccaaguuccucuag

SEQ ID NO: 2379988 - RNA, 16 nt, Human
gccaagugcaggcugg

SEQ ID NO: 2379989 - RNA, 15 nt, Human
gccaagugcaggcug

SEQ ID NO: 2379990 - RNA, 13 nt, Human
gccaaguggggug

SEQ ID NO: 2379991 - RNA, 18 nt, Human
gccaaguggggugcuggg

SEQ ID NO: 2379992 - RNA, 23 nt, Human
gccaaguggggugcugggaggag

SEQ ID NO: 2379993 - RNA, 19 nt, Human
gccaaguggggugcuggga

SEQ ID NO: 2379994 - RNA, 20 nt, Human
gccaaguggggugcugggag

SEQ ID NO: 2379995 - RNA, 22 nt, Human
gccaagucagcuuugccuucca

SEQ ID NO: 2379996 - RNA, 12 nt, Human
gccaaguccaga

SEQ ID NO: 2379997 - RNA, 14 nt, Human
gccaaguccagauu

SEQ ID NO: 2379998 - RNA, 20 nt, Human
gccaagugcaggcuggcacc

SEQ ID NO: 2379999 - RNA, 17 nt, Human
gccaaguuuauauacaa

SEQ ID NO: 2380000 - RNA, 15 nt, Human
gccaaguuuauauac

SEQ ID NO: 2380001 - RNA, 20 nt, Human
gccaauaauaauaccucccu

SEQ ID NO: 2380002 - RNA, 20 nt, Human
gccaaguuuauauacaauua

SEQ ID NO: 2380003 - RNA, 13 nt, Human
gccaauauguauu

SEQ ID NO: 2380004 - RNA, 17 nt, Human
gccaauauguauuguaa

SEQ ID NO: 2380005 - RNA, 23 nt, Human
gccaauauguauuguaaacaugu

SEQ ID NO: 2380006 - RNA, 13 nt, Human
gccaauccccucc

SEQ ID NO: 2380007 - RNA, 18 nt, Human
gccaauccccuccuuggg

SEQ ID NO: 2380008 - RNA, 18 nt, Human
gccaauauuaaaucugcu

SEQ ID NO: 2380009 - RNA, 15 nt, Human
gccaaucaagggcaa

SEQ ID NO: 2380010 - RNA, 18 nt, Human
gccaaugccccacuggca

SEQ ID NO: 2380011 - RNA, 13 nt, Human
gccaauggaaccu

SEQ ID NO: 2380012 - RNA, 17 nt, Human
gccaauggaaccuccuu

SEQ ID NO: 2380013 - RNA, 22 nt, Human
gccaaugaggucugaaauggag

SEQ ID NO: 2380014 - RNA, 19 nt, Human
gccaaugaggucugaaaug

SEQ ID NO: 2380015 - RNA, 12 nt, Human
gccaaugagguc

SEQ ID NO: 2380016 - RNA, 19 nt, Human
gccaauccccuccuugggc

SEQ ID NO: 2380017 - RNA, 21 nt, Human
gccaauccccuccuugggcac

SEQ ID NO: 2380018 - RNA, 16 nt, Human
gccaauggagacuguc

SEQ ID NO: 2380019 - RNA, 19 nt, Human
gccaauggagacugucuca

SEQ ID NO: 2380020 - RNA, 21 nt, Human
gccaauggagacugucucaag

SEQ ID NO: 2380021 - RNA, 18 nt, Human
gccaauggaaccuccuuu

SEQ ID NO: 2380022 - RNA, 19 nt, Human
gccaauggaaccuccuuuc

SEQ ID NO: 2380023 - RNA, 20 nt, Human
gccaauggaaccuccuuucu

SEQ ID NO: 2380024 - RNA, 22 nt, Human
gccaauguauugauaagagggc

SEQ ID NO: 2380025 - RNA, 18 nt, Human
gcauuugucaaugacagu

SEQ ID NO: 2380026 - RNA, 11 nt, Human
gcauuugucua

SEQ ID NO: 2380027 - RNA, 12 nt, Human
gcauuugucuau

SEQ ID NO: 2380028 - RNA, 13 nt, Human
gcauuugucaaug

SEQ ID NO: 2380029 - RNA, 15 nt, Human
gcauuugagaaaugc

SEQ ID NO: 2380030 - RNA, 16 nt, Human
gcauuugagaaaugca

SEQ ID NO: 2380031 - RNA, 21 nt, Human
gccaaggcugggggaagaagc

SEQ ID NO: 2380032 - RNA, 12 nt, Human
gcauuugugaaa

SEQ ID NO: 2380033 - RNA, 23 nt, Human
gcauuugucuauucuccagcuga

SEQ ID NO: 2380034 - RNA, 19 nt, Human
gccaaggcuggagugcagu

SEQ ID NO: 2380035 - RNA, 12 nt, Human
gccaagggaaag

SEQ ID NO: 2380036 - RNA, 18 nt, Human
gccaagggaaaggggugc

SEQ ID NO: 2380037 - RNA, 23 nt, Human
gcauuuggugguuucagaaaugu

SEQ ID NO: 2380038 - RNA, 22 nt, Human
gcauuuggugguuucagaaaug

SEQ ID NO: 2380039 - RNA, 20 nt, Human
gcauuugaggucuguucuuu

SEQ ID NO: 2380040 - RNA, 19 nt, Human
gcauuugaggucuguucuu

SEQ ID NO: 2380041 - RNA, 16 nt, Human
gccaaguaagaaagug

SEQ ID NO: 2380042 - RNA, 20 nt, Human
gccaagguuuuauaaggcug

SEQ ID NO: 2380043 - RNA, 23 nt, Human
gccaaggugggcugagcccuggc

SEQ ID NO: 2380044 - RNA, 22 nt, Human
gccaaggugggcugagcccugg

SEQ ID NO: 2380045 - RNA, 21 nt, Human
gccaaggugggcugagcccug

SEQ ID NO: 2380046 - RNA, 19 nt, Human
gccaaggugggcugagccc

SEQ ID NO: 2380047 - RNA, 18 nt, Human
gccaaggugggcugagcc

SEQ ID NO: 2380048 - RNA, 16 nt, Human
gccaaggugggcugag

SEQ ID NO: 2380049 - RNA, 23 nt, Human
gccaaggugggaggauugcuuga

SEQ ID NO: 2380050 - RNA, 15 nt, Human
gccaaggugggagga

SEQ ID NO: 2380051 - RNA, 14 nt, Human
gccaaggugggagg

SEQ ID NO: 2380052 - RNA, 16 nt, Human
gccaagggcuuuguuu

SEQ ID NO: 2380053 - RNA, 22 nt, Human
gccaagguagccaucccaugaa

SEQ ID NO: 2380054 - RNA, 18 nt, Human
gccaagggaaccuguguc

SEQ ID NO: 2380055 - RNA, 19 nt, Human
gccaagggaaccugugucc

SEQ ID NO: 2380056 - RNA, 22 nt, Human
gccaagggaaaggggugcuuuu

SEQ ID NO: 2380057 - RNA, 21 nt, Human
gccaagggaugaaagagaagg

SEQ ID NO: 2380058 - RNA, 22 nt, Human
gccacaggccucccuguuugaa

SEQ ID NO: 2380059 - RNA, 18 nt, Human
gccacaguagucuugaug

SEQ ID NO: 2380060 - RNA, 12 nt, Human
gccacaguuguu

SEQ ID NO: 2380061 - RNA, 15 nt, Human
gccacaucaaagagg

SEQ ID NO: 2380062 - RNA, 17 nt, Human
gccaccgcgcccagccu

SEQ ID NO: 2380063 - RNA, 14 nt, Human
gccacaugaguccc

SEQ ID NO: 2380064 - RNA, 16 nt, Human
gccacaugagucccag

SEQ ID NO: 2380065 - RNA, 18 nt, Human
gccacaugagucccagug

SEQ ID NO: 2380066 - RNA, 23 nt, Human
gccacaucuugaucugcucagcc

SEQ ID NO: 2380067 - RNA, 19 nt, Human
gccaccgccuccuacagcc

SEQ ID NO: 2380068 - RNA, 15 nt, Human
gccaccuccccaggc

SEQ ID NO: 2380069 - RNA, 11 nt, Human
gccaccucccc

SEQ ID NO: 2380070 - RNA, 15 nt, Human
gccaccuccagaaac

SEQ ID NO: 2380071 - RNA, 13 nt, Human
gccaccuccagaa

SEQ ID NO: 2380072 - RNA, 21 nt, Human
gccaccuaucucgugggagag

SEQ ID NO: 2380073 - RNA, 22 nt, Human
gccaccuaucucgugggagagc

SEQ ID NO: 2380074 - RNA, 17 nt, Human
gccaccuccccaggccg

SEQ ID NO: 2380075 - RNA, 13 nt, Human
gccaccuccccua

SEQ ID NO: 2380076 - RNA, 12 nt, Human
gccaccuccccu

SEQ ID NO: 2380077 - RNA, 21 nt, Human
gccaccuccccuauccaccca

SEQ ID NO: 2380078 - RNA, 20 nt, Human
gccaccuccccuauccaccc

SEQ ID NO: 2380079 - RNA, 17 nt, Human
gccaccuccccuaucca

SEQ ID NO: 2380080 - RNA, 15 nt, Human
gccaccuccccuauc

SEQ ID NO: 2380081 - RNA, 22 nt, Human
gccaccgugccuggccacgccc

SEQ ID NO: 2380082 - RNA, 23 nt, Human
gccaccgcuuccggcuccugugc

SEQ ID NO: 2380083 - RNA, 15 nt, Human
gccaccuaucucgug

SEQ ID NO: 2380084 - RNA, 19 nt, Human
gccaccuaucucgugggag

SEQ ID NO: 2380085 - RNA, 20 nt, Human
gccaccuaucucgugggaga

SEQ ID NO: 2380086 - RNA, 17 nt, Human
gccaccgugccuggcca

SEQ ID NO: 2380087 - RNA, 17 nt, Human
gccaccgcgccuggccg

SEQ ID NO: 2380088 - RNA, 20 nt, Human
gccaccgcuuccggcuccug

SEQ ID NO: 2380089 - RNA, 17 nt, Human
gccaccugcccccuucu

SEQ ID NO: 2380090 - RNA, 16 nt, Human
gccaccugcccccuuc

SEQ ID NO: 2380091 - RNA, 14 nt, Human
gccaccugcccccu

SEQ ID NO: 2380092 - RNA, 13 nt, Human
gccaccugccccc

SEQ ID NO: 2380093 - RNA, 17 nt, Human
gccaccugccuguuggg

SEQ ID NO: 2380094 - RNA, 23 nt, Human
gccaccugaggugggcccaggac

SEQ ID NO: 2380095 - RNA, 21 nt, Human
gccaccugaggugggcccagg

SEQ ID NO: 2380096 - RNA, 22 nt, Human
gccaccugaggugggcccagga

SEQ ID NO: 2380097 - RNA, 15 nt, Human
gccaccugagguggg

SEQ ID NO: 2380098 - RNA, 18 nt, Human
gccaccugaggugggccc

SEQ ID NO: 2380099 - RNA, 19 nt, Human
gccaccugaggugggccca

SEQ ID NO: 2380100 - RNA, 20 nt, Human
gccaccugaggugggcccag

SEQ ID NO: 2380101 - RNA, 22 nt, Human
gccaccucugcggaccccagcu

SEQ ID NO: 2380102 - RNA, 22 nt, Human
gccaccuccccuauccacccag

SEQ ID NO: 2380103 - RNA, 20 nt, Human
gccaccucccugacccgucu

SEQ ID NO: 2380104 - RNA, 12 nt, Human
gccaccucucca

SEQ ID NO: 2380105 - RNA, 13 nt, Human
gccaccucuccaa

SEQ ID NO: 2380106 - RNA, 14 nt, Human
gccaccucuccaag

SEQ ID NO: 2380107 - RNA, 15 nt, Human
gccaccucuccaagg

SEQ ID NO: 2380108 - RNA, 17 nt, Human
gccaccucuccaagggc

SEQ ID NO: 2380109 - RNA, 18 nt, Human
gccaccucuccaagggcu

SEQ ID NO: 2380110 - RNA, 22 nt, Human
gccaccucuccaagggcuucug

SEQ ID NO: 2380111 - RNA, 23 nt, Human
gccaccucuccaagggcuucugc

SEQ ID NO: 2380112 - RNA, 15 nt, Human
gccaccucucccuca

SEQ ID NO: 2380113 - RNA, 13 nt, Human
gccaccucucucc

SEQ ID NO: 2380114 - RNA, 16 nt, Human
gccaccucucuccuuu

SEQ ID NO: 2380115 - RNA, 11 nt, Human
gccaccucugc

SEQ ID NO: 2380116 - RNA, 14 nt, Human
gccaccucugcgga

SEQ ID NO: 2380117 - RNA, 20 nt, Human
gccaccucugcggaccccag

SEQ ID NO: 2380118 - RNA, 21 nt, Human
gccaccucugcggaccccagc

SEQ ID NO: 2380119 - RNA, 23 nt, Human
gccaccucugcggaccccagcug

SEQ ID NO: 2380120 - RNA, 13 nt, Human
gccacggcagccu

SEQ ID NO: 2380121 - RNA, 22 nt, Human
gccacgggucuguguucgacuc

SEQ ID NO: 2380122 - RNA, 14 nt, Human
gccacgugccaggc

SEQ ID NO: 2380123 - RNA, 13 nt, Human
gccacgugccagg

SEQ ID NO: 2380124 - RNA, 19 nt, Human
gccacggccaggccagagg

SEQ ID NO: 2380125 - RNA, 19 nt, Human
gccacuacacuccagccug

SEQ ID NO: 2380126 - RNA, 18 nt, Human
gccacuacacuccagccu

SEQ ID NO: 2380127 - RNA, 17 nt, Human
gccacuacacuccagcc

SEQ ID NO: 2380128 - RNA, 23 nt, Human
gccacuaagcagaggaggggccg

SEQ ID NO: 2380129 - RNA, 20 nt, Human
gccacuaagcagaggagggg

SEQ ID NO: 2380130 - RNA, 19 nt, Human
gccacuaagcagaggaggg

SEQ ID NO: 2380131 - RNA, 17 nt, Human
gccacuaagcagaggag

SEQ ID NO: 2380132 - RNA, 16 nt, Human
gccacuaagcagagga

SEQ ID NO: 2380133 - RNA, 15 nt, Human
gccacuaagcagagg

SEQ ID NO: 2380134 - RNA, 14 nt, Human
gccacuaagcagag

SEQ ID NO: 2380135 - RNA, 13 nt, Human
gccacuaagcaga

SEQ ID NO: 2380136 - RNA, 18 nt, Human
gccacggccaggccagag

SEQ ID NO: 2380137 - RNA, 17 nt, Human
gccacggccaggccaga

SEQ ID NO: 2380138 - RNA, 20 nt, Human
gccacgcccaacuaauuuuu

SEQ ID NO: 2380139 - RNA, 23 nt, Human
gccaccugcccccuucucccaca

SEQ ID NO: 2380140 - RNA, 20 nt, Human
gccaccugcccccuucuccc

SEQ ID NO: 2380141 - RNA, 18 nt, Human
gccaccugcccccuucuc

SEQ ID NO: 2380142 - RNA, 21 nt, Human
gccaccugcccccuucuccca

SEQ ID NO: 2380143 - RNA, 22 nt, Human
gccaccugcggugcuaucuccc

SEQ ID NO: 2380144 - RNA, 14 nt, Human
gccaccugcggugc

SEQ ID NO: 2380145 - RNA, 20 nt, Human
gccaccugcggugcuaucuc

SEQ ID NO: 2380146 - RNA, 15 nt, Human
gccacgauugcagga

SEQ ID NO: 2380147 - RNA, 12 nt, Human
gccaccuggggc

SEQ ID NO: 2380148 - RNA, 20 nt, Human
gccaccuggcauuccuucug

SEQ ID NO: 2380149 - RNA, 17 nt, Human
gccaccuggggcaguca

SEQ ID NO: 2380150 - RNA, 16 nt, Human
gccaccuggggcaguc

SEQ ID NO: 2380151 - RNA, 14 nt, Human
gccaccuggggcag

SEQ ID NO: 2380152 - RNA, 11 nt, Human
gccaccugggu

SEQ ID NO: 2380153 - RNA, 21 nt, Human
gccagagggagugacagaggc

SEQ ID NO: 2380154 - RNA, 22 nt, Human
gccagagggagugacagaggca

SEQ ID NO: 2380155 - RNA, 19 nt, Human
gccagaggagagaggaccc

SEQ ID NO: 2380156 - RNA, 22 nt, Human
gccagaggagagaggacccccu

SEQ ID NO: 2380157 - RNA, 12 nt, Human
gccagaggagag

SEQ ID NO: 2380158 - RNA, 13 nt, Human
gccagaggagaga

SEQ ID NO: 2380159 - RNA, 15 nt, Human
gccagaggagagagg

SEQ ID NO: 2380160 - RNA, 17 nt, Human
gccagaggagagaggac

SEQ ID NO: 2380161 - RNA, 22 nt, Human
gccagaguggccuggccaggag

SEQ ID NO: 2380162 - RNA, 19 nt, Human
gccagaguggccuggccag

SEQ ID NO: 2380163 - RNA, 18 nt, Human
gccagaguggccuggcca

SEQ ID NO: 2380164 - RNA, 17 nt, Human
gccagaguggccuggcc

SEQ ID NO: 2380165 - RNA, 15 nt, Human
gccagaguggccugg

SEQ ID NO: 2380166 - RNA, 14 nt, Human
gccagaguggccug

SEQ ID NO: 2380167 - RNA, 13 nt, Human
gccagaguggccu

SEQ ID NO: 2380168 - RNA, 22 nt, Human
gccagaggugggcagguggugg

SEQ ID NO: 2380169 - RNA, 17 nt, Human
gccagaguccuuuccaa

SEQ ID NO: 2380170 - RNA, 23 nt, Human
gccagagggagugacagaggcag

SEQ ID NO: 2380171 - RNA, 12 nt, Human
gccagagguggg

SEQ ID NO: 2380172 - RNA, 15 nt, Human
gccagaggugggcag

SEQ ID NO: 2380173 - RNA, 16 nt, Human
gccagaggugggcagg

SEQ ID NO: 2380174 - RNA, 17 nt, Human
gccagaggugggcaggu

SEQ ID NO: 2380175 - RNA, 19 nt, Human
gccagaggugggcaggugg

SEQ ID NO: 2380176 - RNA, 20 nt, Human
gccagaggugggcagguggu

SEQ ID NO: 2380177 - RNA, 24 nt, Human
gccagaguggccuggccaggagcu

SEQ ID NO: 2380178 - RNA, 23 nt, Human
gccagaguggccuggccaggagc

SEQ ID NO: 2380179 - RNA, 13 nt, Human
gccagaguuccug

SEQ ID NO: 2380180 - RNA, 18 nt, Human
gccagaguuccugcggag

SEQ ID NO: 2380181 - RNA, 22 nt, Human
gccagaguuccugcggagugaa

SEQ ID NO: 2380182 - RNA, 24 nt, Human
gccagaguuccugcggagugaaga

SEQ ID NO: 2380183 - RNA, 16 nt, Human
gccagaugcaccagcc

SEQ ID NO: 2380184 - RNA, 17 nt, Human
gccagaugcaccagccc

SEQ ID NO: 2380185 - RNA, 18 nt, Human
gccagaugcaccagcccu

SEQ ID NO: 2380186 - RNA, 17 nt, Human
gccacugaagcugggau

SEQ ID NO: 2380187 - RNA, 15 nt, Human
gccacugaagcuggg

SEQ ID NO: 2380188 - RNA, 14 nt, Human
gccacugaagcugg

SEQ ID NO: 2380189 - RNA, 21 nt, Human
gccacucugccucugccugca

SEQ ID NO: 2380190 - RNA, 19 nt, Human
gccacucugccucugccug

SEQ ID NO: 2380191 - RNA, 13 nt, Human
gccacucuuccaa

SEQ ID NO: 2380192 - RNA, 17 nt, Human
gccacucugccucugcc

SEQ ID NO: 2380193 - RNA, 15 nt, Human
gccacucugccucug

SEQ ID NO: 2380194 - RNA, 14 nt, Human
gccacucugccucu

SEQ ID NO: 2380195 - RNA, 13 nt, Human
gccacucugccuc

SEQ ID NO: 2380196 - RNA, 18 nt, Human
gccagacuggcacaguuu

SEQ ID NO: 2380197 - RNA, 15 nt, Human
gccagacuggcacag

SEQ ID NO: 2380198 - RNA, 12 nt, Human
gccacucugccu

SEQ ID NO: 2380199 - RNA, 20 nt, Human
gccacucgggaggcugagac

SEQ ID NO: 2380200 - RNA, 23 nt, Human
gccacucgggaggcugagacagg

SEQ ID NO: 2380201 - RNA, 18 nt, Human
gccacucgcuucccccau

SEQ ID NO: 2380202 - RNA, 14 nt, Human
gccacucgcuuccc

SEQ ID NO: 2380203 - RNA, 15 nt, Human
gccacuccugaaccc

SEQ ID NO: 2380204 - RNA, 23 nt, Human
gccacuccucugacucagggcuc

SEQ ID NO: 2380205 - RNA, 23 nt, Human
gccacuacacuccagccugagca

SEQ ID NO: 2380206 - RNA, 22 nt, Human
gccacuacacuccagccugagc

SEQ ID NO: 2380207 - RNA, 21 nt, Human
gccacuacacuccagccugag

SEQ ID NO: 2380208 - RNA, 20 nt, Human
gccacuacacuccagccuga

SEQ ID NO: 2380209 - RNA, 22 nt, Human
gccacucugccucugccugcau

SEQ ID NO: 2380210 - RNA, 13 nt, Human
gccagacucuggu

SEQ ID NO: 2380211 - RNA, 15 nt, Human
gccagacucuggucu

SEQ ID NO: 2380212 - RNA, 20 nt, Human
gccagagacacaagccuucg

SEQ ID NO: 2380213 - RNA, 10 nt, Human
gccagaggag

SEQ ID NO: 2380214 - RNA, 17 nt, Human
gccagagacacaagccu

SEQ ID NO: 2380215 - RNA, 19 nt, Human
gccagagacacaagccuuc

SEQ ID NO: 2380216 - RNA, 16 nt, Human
gccagagacacaagcc

SEQ ID NO: 2380217 - RNA, 19 nt, Human
gccagacuggcacaguuuu

SEQ ID NO: 2380218 - RNA, 12 nt, Human
gauucagaaauu

SEQ ID NO: 2380219 - RNA, 14 nt, Human
gauucagaagggga

SEQ ID NO: 2380220 - RNA, 22 nt, Human
gauucccaagcucugcuccucu

SEQ ID NO: 2380221 - RNA, 21 nt, Human
gauucacccuguccaaacugc

SEQ ID NO: 2380222 - RNA, 14 nt, Human
gauucaccugagca

SEQ ID NO: 2380223 - RNA, 12 nt, Human
gauucagacagc

SEQ ID NO: 2380224 - RNA, 14 nt, Human
gauucacaucugca

SEQ ID NO: 2380225 - RNA, 23 nt, Human
gauucaacuaaaaaaaaaaaagu

SEQ ID NO: 2380226 - RNA, 21 nt, Human
gauucacaccugacucugaaa

SEQ ID NO: 2380227 - RNA, 12 nt, Human
gauucacacugu

SEQ ID NO: 2380228 - RNA, 18 nt, Human
gauucaaucgacuggguu

SEQ ID NO: 2380229 - RNA, 21 nt, Human
gauucaaaauugacauugcuu

SEQ ID NO: 2380230 - RNA, 19 nt, Human
gauucaaucuguaaacugu

SEQ ID NO: 2380231 - RNA, 18 nt, Human
gauucaaucuguaaacug

SEQ ID NO: 2380232 - RNA, 16 nt, Human
gauucaaucuguaaac

SEQ ID NO: 2380233 - RNA, 14 nt, Human
gauucaaucuguaa

SEQ ID NO: 2380234 - RNA, 17 nt, Human
gauuccccauugccucc

SEQ ID NO: 2380235 - RNA, 21 nt, Human
gauucccuccugcuacucugu

SEQ ID NO: 2380236 - RNA, 21 nt, Human
gauuccccuaaccucauuccc

SEQ ID NO: 2380237 - RNA, 22 nt, Human
gauuccccauugccuccuccuu

SEQ ID NO: 2380238 - RNA, 19 nt, Human
gauucccagagcaaaauaa

SEQ ID NO: 2380239 - RNA, 17 nt, Human
gauucccaggaugagca

SEQ ID NO: 2380240 - RNA, 14 nt, Human
gauucccagagaca

SEQ ID NO: 2380241 - RNA, 13 nt, Human
gauucccagagac

SEQ ID NO: 2380242 - RNA, 16 nt, Human
gauucccaccaagguc

SEQ ID NO: 2380243 - RNA, 22 nt, Human
gauucccaccaaggucuucagc

SEQ ID NO: 2380244 - RNA, 21 nt, Human
gauucccagagacaggaaaau

SEQ ID NO: 2380245 - RNA, 19 nt, Human
gauucccagagacaggaaa

SEQ ID NO: 2380246 - RNA, 13 nt, Human
gauucccagagca

SEQ ID NO: 2380247 - RNA, 15 nt, Human
gauuccugagccagu

SEQ ID NO: 2380248 - RNA, 23 nt, Human
gauucuaccacacagcagcaguu

SEQ ID NO: 2380249 - RNA, 19 nt, Human
gauucuaauuuuuaagcaa

SEQ ID NO: 2380250 - RNA, 12 nt, Human
gauuccugaccc

SEQ ID NO: 2380251 - RNA, 13 nt, Human
gauuccugaccca

SEQ ID NO: 2380252 - RNA, 15 nt, Human
gauuccugacccagg

SEQ ID NO: 2380253 - RNA, 16 nt, Human
gauuccugacccaggc

SEQ ID NO: 2380254 - RNA, 17 nt, Human
gauuccugacccaggcc

SEQ ID NO: 2380255 - RNA, 18 nt, Human
gauuccugacccaggccg

SEQ ID NO: 2380256 - RNA, 19 nt, Human
gauuccugacccaggccgc

SEQ ID NO: 2380257 - RNA, 19 nt, Human
gauugacagcuuugcugcu

SEQ ID NO: 2380258 - RNA, 17 nt, Human
gauugacagcuuugcug

SEQ ID NO: 2380259 - RNA, 23 nt, Human
gauugacgggacuguugguauug

SEQ ID NO: 2380260 - RNA, 18 nt, Human
gauugcuugagcucagga

SEQ ID NO: 2380261 - RNA, 14 nt, Human
gauuggacauuuuc

SEQ ID NO: 2380262 - RNA, 23 nt, Human
gauucuacuuuaagcacuacaua

SEQ ID NO: 2380263 - RNA, 15 nt, Human
gauucuaaugucuuc

SEQ ID NO: 2380264 - RNA, 14 nt, Human
gauucuacuuuaag

SEQ ID NO: 2380265 - RNA, 18 nt, Human
gauucuacuuuaagcacu

SEQ ID NO: 2380266 - RNA, 22 nt, Human
gauucuacuuuaagcacuacau

SEQ ID NO: 2380267 - RNA, 20 nt, Human
gauugaaaacuuuucucaga

SEQ ID NO: 2380268 - RNA, 21 nt, Human
gauugaaaacuuuucucagau

SEQ ID NO: 2380269 - RNA, 16 nt, Human
gauugacagcuuugcu

SEQ ID NO: 2380270 - RNA, 23 nt, Human
gauugaaguauuuugcuggaaua

SEQ ID NO: 2380271 - RNA, 21 nt, Human
gauugaaguauuuugcuggaa

SEQ ID NO: 2380272 - RNA, 23 nt, Human
gauuggacggccugaugcucccu

SEQ ID NO: 2380273 - RNA, 16 nt, Human
gauuggacggccugau

SEQ ID NO: 2380274 - RNA, 22 nt, Human
gauuggauacgcaucagacaga

SEQ ID NO: 2380275 - RNA, 22 nt, Human
gauuggagauagggaaagaaag

SEQ ID NO: 2380276 - RNA, 11 nt, Human
gauuggauuau

SEQ ID NO: 2380277 - RNA, 14 nt, Human
gauuggauuauuca

SEQ ID NO: 2380278 - RNA, 15 nt, Human
gauuggauuauucau

SEQ ID NO: 2380279 - RNA, 17 nt, Human
gauuggauuauucauuu

SEQ ID NO: 2380280 - RNA, 20 nt, Human
gauuggauuauucauuuaaa

SEQ ID NO: 2380281 - RNA, 13 nt, Human
gauuggauuauuu

SEQ ID NO: 2380282 - RNA, 20 nt, Human
gauuggauuauuuaauaaca

SEQ ID NO: 2380283 - RNA, 21 nt, Human
gauuggauuauuuaauaacau

SEQ ID NO: 2380284 - RNA, 22 nt, Human
gauuggauuauuuaauaacauu

SEQ ID NO: 2380285 - RNA, 22 nt, Human
gauuguaacguugcugugggaa

SEQ ID NO: 2380286 - RNA, 23 nt, Human
gauuguaacguugcugugggaac

SEQ ID NO: 2380287 - RNA, 15 nt, Human
gauuguccccgaccc

SEQ ID NO: 2380288 - RNA, 23 nt, Human
gauugugggaauuaaggaaguga

SEQ ID NO: 2380289 - RNA, 21 nt, Human
gauugugaauauuuccauaug

SEQ ID NO: 2380290 - RNA, 13 nt, Human
gauugugccccug

SEQ ID NO: 2380291 - RNA, 20 nt, Human
gauuguccccgacccuugcc

SEQ ID NO: 2380292 - RNA, 16 nt, Human
gaugggcccaauucuu

SEQ ID NO: 2380293 - RNA, 14 nt, Human
gaugggccaccgcc

SEQ ID NO: 2380294 - RNA, 13 nt, Human
gaugggccaccgc

SEQ ID NO: 2380295 - RNA, 15 nt, Human
gaugggccaccgccg

SEQ ID NO: 2380296 - RNA, 22 nt, Human
gaugggcauggggugggccucu

SEQ ID NO: 2380297 - RNA, 20 nt, Human
gaugggcauggggugggccu

SEQ ID NO: 2380298 - RNA, 21 nt, Human
gaugggcauggggugggccuc

SEQ ID NO: 2380299 - RNA, 22 nt, Human
gaugggagcuccucuccuggag

SEQ ID NO: 2380300 - RNA, 23 nt, Human
gaugggagcuccucuccuggagg

SEQ ID NO: 2380301 - RNA, 17 nt, Human
gaugggcaugggguggg

SEQ ID NO: 2380302 - RNA, 13 nt, Human
gauggggaaggag

SEQ ID NO: 2380303 - RNA, 18 nt, Human
gaugggcuuguuuucuug

SEQ ID NO: 2380304 - RNA, 20 nt, Human
gaugggccugcuuccugucu

SEQ ID NO: 2380305 - RNA, 20 nt, Human
gauggugcaaugaccuuuca

SEQ ID NO: 2380306 - RNA, 14 nt, Human
gauggggaaggagg

SEQ ID NO: 2380307 - RNA, 14 nt, Human
gauggugcugagaa

SEQ ID NO: 2380308 - RNA, 12 nt, Human
gauggugcugag

SEQ ID NO: 2380309 - RNA, 17 nt, Human
gauggugcugagaagcu

SEQ ID NO: 2380310 - RNA, 16 nt, Human
gauggugcugagaagc

SEQ ID NO: 2380311 - RNA, 14 nt, Human
gaugguggagggcc

SEQ ID NO: 2380312 - RNA, 23 nt, Human
gauggugcaaugaccuuucaaua

SEQ ID NO: 2380313 - RNA, 13 nt, Human
gaugugccugggu

SEQ ID NO: 2380314 - RNA, 20 nt, Human
gaugugccauuuuaaaaaaa

SEQ ID NO: 2380315 - RNA, 15 nt, Human
gaugguggagggcca

SEQ ID NO: 2380316 - RNA, 15 nt, Human
gaugugccugggugg

SEQ ID NO: 2380317 - RNA, 19 nt, Human
gaugugcuuguuaacugag

SEQ ID NO: 2380318 - RNA, 21 nt, Human
gaugugcuuugcauuccuaca

SEQ ID NO: 2380319 - RNA, 11 nt, Human
gaugugcuuuu

SEQ ID NO: 2380320 - RNA, 20 nt, Human
gaugugcuuguuaacugagu

SEQ ID NO: 2380321 - RNA, 23 nt, Human
gauguggaaaagccaagaggcug

SEQ ID NO: 2380322 - RNA, 21 nt, Human
gauguggaaaagccaagaggc

SEQ ID NO: 2380323 - RNA, 16 nt, Human
gaugugcuuuucucca

SEQ ID NO: 2380324 - RNA, 22 nt, Human
gauguguacaucccauguaaca

SEQ ID NO: 2380325 - RNA, 12 nt, Human
gauguguacauc

SEQ ID NO: 2380326 - RNA, 13 nt, Human
gaugugugcaugu

SEQ ID NO: 2380327 - RNA, 21 nt, Human
gauguguccugauaagcugag

SEQ ID NO: 2380328 - RNA, 14 nt, Human
gauguucugggaca

SEQ ID NO: 2380329 - RNA, 12 nt, Human
gauguguuguga

SEQ ID NO: 2380330 - RNA, 14 nt, Human
gauguguugugaua

SEQ ID NO: 2380331 - RNA, 16 nt, Human
gauguucugggacaca

SEQ ID NO: 2380332 - RNA, 21 nt, Human
gauuaaccacuucagcugacu

SEQ ID NO: 2380333 - RNA, 19 nt, Human
gauuaaccacuucagcuga

SEQ ID NO: 2380334 - RNA, 18 nt, Human
gauuaaccacuucagcug

SEQ ID NO: 2380335 - RNA, 23 nt, Human
gauguuuuagccauuguuggcuu

SEQ ID NO: 2380336 - RNA, 18 nt, Human
gauguuuuaauuccauga

SEQ ID NO: 2380337 - RNA, 21 nt, Human
gauguuuuacgucugggagaa

SEQ ID NO: 2380338 - RNA, 22 nt, Human
gauuaagagauggguuugacaa

SEQ ID NO: 2380339 - RNA, 22 nt, Human
gauuaagaucucagugguuaag

SEQ ID NO: 2380340 - RNA, 17 nt, Human
gauuaaccucugcacua

SEQ ID NO: 2380341 - RNA, 14 nt, Human
gauuaaccucugca

SEQ ID NO: 2380342 - RNA, 19 nt, Human
gauucaacagguuuuccug

SEQ ID NO: 2380343 - RNA, 13 nt, Human
gauuaagagccau

SEQ ID NO: 2380344 - RNA, 11 nt, Human
gauguuaacac

SEQ ID NO: 2380345 - RNA, 17 nt, Human
gauuauuuuuucagacc

SEQ ID NO: 2380346 - RNA, 18 nt, Human
gauuauuuuuucagaccg

SEQ ID NO: 2380347 - RNA, 21 nt, Human
gauuauuuuuucagaccgaaa

SEQ ID NO: 2380348 - RNA, 19 nt, Human
gauuaaauucuugcaaagu

SEQ ID NO: 2380349 - RNA, 12 nt, Human
gauuaaauucuu

SEQ ID NO: 2380350 - RNA, 15 nt, Human
gauguuuuccaugag

SEQ ID NO: 2380351 - RNA, 23 nt, Human
gauguuuuccaugaguccccugu

SEQ ID NO: 2380352 - RNA, 14 nt, Human
gauguuuuccauga

SEQ ID NO: 2380353 - RNA, 13 nt, Human
gauguuuuaauuc

SEQ ID NO: 2380354 - RNA, 21 nt, Human
gauguucuuucacccuuuucu

SEQ ID NO: 2380355 - RNA, 19 nt, Human
gauguugaaaaaguucugc

SEQ ID NO: 2380356 - RNA, 18 nt, Human
gaucuuucuuuccuuucu

SEQ ID NO: 2380357 - RNA, 16 nt, Human
gaucuuuucaaguuaa

SEQ ID NO: 2380358 - RNA, 15 nt, Human
gaugaaaaaauaaca

SEQ ID NO: 2380359 - RNA, 14 nt, Human
gaugaaaaauagca

SEQ ID NO: 2380360 - RNA, 15 nt, Human
gaugaaaaagcaugu

SEQ ID NO: 2380361 - RNA, 16 nt, Human
gaugaaaaagcaugua

SEQ ID NO: 2380362 - RNA, 17 nt, Human
gaugaaaaagcauguac

SEQ ID NO: 2380363 - RNA, 18 nt, Human
gaugaaaaagcauguaca

SEQ ID NO: 2380364 - RNA, 19 nt, Human
gaugaaaaagcauguacag

SEQ ID NO: 2380365 - RNA, 20 nt, Human
gaugaaaaagcauguacagu

SEQ ID NO: 2380366 - RNA, 22 nt, Human
gaugaaaaagcauguacagugu

SEQ ID NO: 2380367 - RNA, 15 nt, Human
gaucuuucaggaaag

SEQ ID NO: 2380368 - RNA, 12 nt, Human
gaucuuucagga

SEQ ID NO: 2380369 - RNA, 11 nt, Human
gaucuuucagg

SEQ ID NO: 2380370 - RNA, 16 nt, Human
gaucuuugcagacagg

SEQ ID NO: 2380371 - RNA, 14 nt, Human
gaucuuuaaaauac

SEQ ID NO: 2380372 - RNA, 15 nt, Human
gaucuucaauggcuu

SEQ ID NO: 2380373 - RNA, 16 nt, Human
gaucuucaauggcuuu

SEQ ID NO: 2380374 - RNA, 14 nt, Human
gaucuucagagcag

SEQ ID NO: 2380375 - RNA, 14 nt, Human
gaucuucaauggcu

SEQ ID NO: 2380376 - RNA, 23 nt, Human
gaucuguuuuuaaaaaucauaaa

SEQ ID NO: 2380377 - RNA, 21 nt, Human
gaucuguuuuuaaaaaucaua

SEQ ID NO: 2380378 - RNA, 19 nt, Human
gaucuguuuuuaaaaauca

SEQ ID NO: 2380379 - RNA, 14 nt, Human
gaucgcccccaccu

SEQ ID NO: 2380380 - RNA, 19 nt, Human
gaucuuaaauuuugugaua

SEQ ID NO: 2380381 - RNA, 12 nt, Human
gaucuuaaauuu

SEQ ID NO: 2380382 - RNA, 13 nt, Human
gaucuuaaauuuu

SEQ ID NO: 2380383 - RNA, 18 nt, Human
gaucgcaguuugccuggu

SEQ ID NO: 2380384 - RNA, 15 nt, Human
gaucgcaucauugca

SEQ ID NO: 2380385 - RNA, 23 nt, Human
gaucgcaucauugcacucuagcc

SEQ ID NO: 2380386 - RNA, 20 nt, Human
gaucuguuuugaaggcaaaa

SEQ ID NO: 2380387 - RNA, 19 nt, Human
gaucuguuuugaaggcaaa

SEQ ID NO: 2380388 - RNA, 13 nt, Human
gaucgcaguuugc

SEQ ID NO: 2380389 - RNA, 20 nt, Human
gaucgcaagagccauguaga

SEQ ID NO: 2380390 - RNA, 17 nt, Human
gaucgaaccguuuugaa

SEQ ID NO: 2380391 - RNA, 17 nt, Human
gauccuuuuggagucag

SEQ ID NO: 2380392 - RNA, 15 nt, Human
gauccuuuuggaguc

SEQ ID NO: 2380393 - RNA, 18 nt, Human
gauccucccaccucagcc

SEQ ID NO: 2380394 - RNA, 23 nt, Human
gauccucauauggcccaguguca

SEQ ID NO: 2380395 - RNA, 20 nt, Human
gauccuauucucaccaggaa

SEQ ID NO: 2380396 - RNA, 19 nt, Human
gauccucacaaccaccuaa

SEQ ID NO: 2380397 - RNA, 14 nt, Human
gauccuuuuauguu

SEQ ID NO: 2380398 - RNA, 12 nt, Human
gauccuuccucc

SEQ ID NO: 2380399 - RNA, 15 nt, Human
gaucacgccacugca

SEQ ID NO: 2380400 - RNA, 18 nt, Human
gauccuaguuccaccauc

SEQ ID NO: 2380401 - RNA, 11 nt, Human
gauccuccagg

SEQ ID NO: 2380402 - RNA, 19 nt, Human
gauccuauucucaccagga

SEQ ID NO: 2380403 - RNA, 18 nt, Human
gauccuauucucaccagg

SEQ ID NO: 2380404 - RNA, 14 nt, Human
gaucaagcugugag

SEQ ID NO: 2380405 - RNA, 16 nt, Human
gaucaaggagaggagg

SEQ ID NO: 2380406 - RNA, 14 nt, Human
gaucaagaaagugu

SEQ ID NO: 2380407 - RNA, 16 nt, Human
gauauauuuuuaagau

SEQ ID NO: 2380408 - RNA, 23 nt, Human
gaucaaccccuucgcuccugugu

SEQ ID NO: 2380409 - RNA, 13 nt, Human
gaucacgccacug

SEQ ID NO: 2380410 - RNA, 14 nt, Human
gaucacgccacugc

SEQ ID NO: 2380411 - RNA, 19 nt, Human
gauccucccaccucagccu

SEQ ID NO: 2380412 - RNA, 12 nt, Human
gauccuccaggu

SEQ ID NO: 2380413 - RNA, 20 nt, Human
gauccucccaccucagccuc

SEQ ID NO: 2380414 - RNA, 21 nt, Human
gauccucccaccucagccucc

SEQ ID NO: 2380415 - RNA, 13 nt, Human
gauccugagccag

SEQ ID NO: 2380416 - RNA, 14 nt, Human
gauccugagccaga

SEQ ID NO: 2380417 - RNA, 15 nt, Human
gauccugagccagau

SEQ ID NO: 2380418 - RNA, 19 nt, Human
gauccugagccagauuuca

SEQ ID NO: 2380419 - RNA, 18 nt, Human
gaugacucccuuaaaaua

SEQ ID NO: 2380420 - RNA, 16 nt, Human
gaugacuagaggcagg

SEQ ID NO: 2380421 - RNA, 14 nt, Human
gaugacuauggaaa

SEQ ID NO: 2380422 - RNA, 19 nt, Human
gaugacgguauuaugcuuc

SEQ ID NO: 2380423 - RNA, 20 nt, Human
gaugacgguauuaugcuucu

SEQ ID NO: 2380424 - RNA, 21 nt, Human
gaugacgguauuaugcuucuu

SEQ ID NO: 2380425 - RNA, 15 nt, Human
gaugacuagaggcag

SEQ ID NO: 2380426 - RNA, 18 nt, Human
gaugacuaaaauauuuau

SEQ ID NO: 2380427 - RNA, 15 nt, Human
gaugacuaaaauauu

SEQ ID NO: 2380428 - RNA, 12 nt, Human
gaugacuaaaau

SEQ ID NO: 2380429 - RNA, 14 nt, Human
gaugacugaguccu

SEQ ID NO: 2380430 - RNA, 12 nt, Human
gaugacugaguc

SEQ ID NO: 2380431 - RNA, 11 nt, Human
gaugagaaagg

SEQ ID NO: 2380432 - RNA, 17 nt, Human
gaugacugaguccucgu

SEQ ID NO: 2380433 - RNA, 22 nt, Human
gaugagaaagguugaagcacca

SEQ ID NO: 2380434 - RNA, 17 nt, Human
gaugcaaggaccaggac

SEQ ID NO: 2380435 - RNA, 14 nt, Human
gaugcaaggaccag

SEQ ID NO: 2380436 - RNA, 16 nt, Human
gaugcaaagaggcaag

SEQ ID NO: 2380437 - RNA, 17 nt, Human
gaugcaagauauuuaua

SEQ ID NO: 2380438 - RNA, 15 nt, Human
gaugcaaagaggcaa

SEQ ID NO: 2380439 - RNA, 14 nt, Human
gaugcaaagaggca

SEQ ID NO: 2380440 - RNA, 17 nt, Human
gaugcaaagaggcaaga

SEQ ID NO: 2380441 - RNA, 21 nt, Human
gaugacucccuuaaaauagaa

SEQ ID NO: 2380442 - RNA, 14 nt, Human
gaugcaaagaaaau

SEQ ID NO: 2380443 - RNA, 18 nt, Human
gaugcaaugugcuacuga

SEQ ID NO: 2380444 - RNA, 17 nt, Human
gaugcaauguagagggg

SEQ ID NO: 2380445 - RNA, 19 nt, Human
gaugcaaggaccaggacuc

SEQ ID NO: 2380446 - RNA, 18 nt, Human
gaugcaaggaccaggacu

SEQ ID NO: 2380447 - RNA, 21 nt, Human
gaugcaaucgguuuaaacaug

SEQ ID NO: 2380448 - RNA, 13 nt, Human
gaugcauggagau

SEQ ID NO: 2380449 - RNA, 13 nt, Human
gaugcaaugaaca

SEQ ID NO: 2380450 - RNA, 18 nt, Human
gaugcaguucugaagaag

SEQ ID NO: 2380451 - RNA, 17 nt, Human
gaugcauuaaaagaaaa

SEQ ID NO: 2380452 - RNA, 16 nt, Human
gaugcauuaaaagaaa

SEQ ID NO: 2380453 - RNA, 15 nt, Human
gaugcauuaaaagaa

SEQ ID NO: 2380454 - RNA, 20 nt, Human
gaugcauguuuuccagcucc

SEQ ID NO: 2380455 - RNA, 21 nt, Human
gaugcauguuuuccagcuccu

SEQ ID NO: 2380456 - RNA, 20 nt, Human
gaugcauggagauagcccca

SEQ ID NO: 2380457 - RNA, 22 nt, Human
gaugcaucuaccgcucuuggga

SEQ ID NO: 2380458 - RNA, 15 nt, Human
gaugcccuggaggug

SEQ ID NO: 2380459 - RNA, 12 nt, Human
gaugcccuggag

SEQ ID NO: 2380460 - RNA, 18 nt, Human
gaugcauuaaaagaaaau

SEQ ID NO: 2380461 - RNA, 21 nt, Human
gaugcauucuugguuggcugg

SEQ ID NO: 2380462 - RNA, 17 nt, Human
gaugccuccaccgcugc

SEQ ID NO: 2380463 - RNA, 16 nt, Human
gaugccuccaccgcug

SEQ ID NO: 2380464 - RNA, 13 nt, Human
gaugccuccaccg

SEQ ID NO: 2380465 - RNA, 12 nt, Human
gaugccuccacc

SEQ ID NO: 2380466 - RNA, 23 nt, Human
gaugccucaugauaugucagggc

SEQ ID NO: 2380467 - RNA, 19 nt, Human
gaugcccuggagguggcug

SEQ ID NO: 2380468 - RNA, 18 nt, Human
gaugcccuggagguggcu

SEQ ID NO: 2380469 - RNA, 20 nt, Human
gaugccuccaccgcugccua

SEQ ID NO: 2380470 - RNA, 15 nt, Human
gaugccugauugcca

SEQ ID NO: 2380471 - RNA, 21 nt, Human
gaugccuggcgggguggggug

SEQ ID NO: 2380472 - RNA, 14 nt, Human
gaugcucaggcuug

SEQ ID NO: 2380473 - RNA, 14 nt, Human
gaugcucacagggc

SEQ ID NO: 2380474 - RNA, 22 nt, Human
gaugccugauugccaagcucag

SEQ ID NO: 2380475 - RNA, 21 nt, Human
gaugcucaggcuugaaaugca

SEQ ID NO: 2380476 - RNA, 23 nt, Human
gaugcucccuccccugcccuggu

SEQ ID NO: 2380477 - RNA, 21 nt, Human
gaugcucccuccccugcccug

SEQ ID NO: 2380478 - RNA, 20 nt, Human
gaugcucccuccccugcccu

SEQ ID NO: 2380479 - RNA, 15 nt, Human
gaugcucccuccccu

SEQ ID NO: 2380480 - RNA, 13 nt, Human
gaugcucccuccc

SEQ ID NO: 2380481 - RNA, 23 nt, Human
gaugcuccagccaaccccugugg

SEQ ID NO: 2380482 - RNA, 22 nt, Human
gaugcuccagccaaccccugug

SEQ ID NO: 2380483 - RNA, 17 nt, Human
gaugcuccagccaaccc

SEQ ID NO: 2380484 - RNA, 16 nt, Human
gaugcuccagccaacc

SEQ ID NO: 2380485 - RNA, 13 nt, Human
gaugcuccagcca

SEQ ID NO: 2380486 - RNA, 12 nt, Human
gaugcuccagcc

SEQ ID NO: 2380487 - RNA, 14 nt, Human
gaugggacugggag

SEQ ID NO: 2380488 - RNA, 17 nt, Human
gaugggacugggagggc

SEQ ID NO: 2380489 - RNA, 15 nt, Human
gaugggacugggagg

SEQ ID NO: 2380490 - RNA, 20 nt, Human
gaugggagcuccucuccugg

SEQ ID NO: 2380491 - RNA, 21 nt, Human
gaugggagcuccucuccugga

SEQ ID NO: 2380492 - RNA, 22 nt, Human
gaugggcaacccccagccugcu

SEQ ID NO: 2380493 - RNA, 18 nt, Human
gaugggaaggagggaggu

SEQ ID NO: 2380494 - RNA, 21 nt, Human
gauggcuuugaaugcggccca

SEQ ID NO: 2380495 - RNA, 13 nt, Human
gaugggaaugaag

SEQ ID NO: 2380496 - RNA, 14 nt, Human
gaugggaaugaagc

SEQ ID NO: 2380497 - RNA, 16 nt, Human
gaugggaaugaagcuu

SEQ ID NO: 2380498 - RNA, 18 nt, Human
gaugggaaugaagcuugu

SEQ ID NO: 2380499 - RNA, 22 nt, Human
gaugggaaugaagcuuguguau

SEQ ID NO: 2380500 - RNA, 23 nt, Human
gaugggaaugaggugggaggugg

SEQ ID NO: 2380501 - RNA, 21 nt, Human
gaugggaacgcagaugaucca

SEQ ID NO: 2380502 - RNA, 21 nt, Human
gauggcaggauggccuggcca

SEQ ID NO: 2380503 - RNA, 18 nt, Human
gauggcaggauggccugg

SEQ ID NO: 2380504 - RNA, 15 nt, Human
gauggcagcuguuua

SEQ ID NO: 2380505 - RNA, 15 nt, Human
gauggcaggauggcc

SEQ ID NO: 2380506 - RNA, 17 nt, Human
gauggcaggauggccug

SEQ ID NO: 2380507 - RNA, 13 nt, Human
gauggcaggaugg

SEQ ID NO: 2380508 - RNA, 21 nt, Human
gauggcacuuauaaccaaagc

SEQ ID NO: 2380509 - RNA, 16 nt, Human
gaugggaaagcauugu

SEQ ID NO: 2380510 - RNA, 22 nt, Human
gauggcaacagaucuggaaccu

SEQ ID NO: 2380511 - RNA, 14 nt, Human
gauggcaccagagg

SEQ ID NO: 2380512 - RNA, 15 nt, Human
gauggcaccagaggc

SEQ ID NO: 2380513 - RNA, 21 nt, Human
gauggcacuuagcuaucagaa

SEQ ID NO: 2380514 - RNA, 21 nt, Human
gauggcaacagaucuggaacc

SEQ ID NO: 2380515 - RNA, 17 nt, Human
gauggcaacagaucugg

SEQ ID NO: 2380516 - RNA, 16 nt, Human
gauggcaacagaucug

SEQ ID NO: 2380517 - RNA, 15 nt, Human
gauggcaacagaucu

SEQ ID NO: 2380518 - RNA, 17 nt, Human
gaguuacauuaauguua

SEQ ID NO: 2380519 - RNA, 12 nt, Human
gaguuagacugu

SEQ ID NO: 2380520 - RNA, 16 nt, Human
gaguuagaggccagcc

SEQ ID NO: 2380521 - RNA, 14 nt, Human
gaguuagaggccag

SEQ ID NO: 2380522 - RNA, 14 nt, Human
gaguuagacuguug

SEQ ID NO: 2380523 - RNA, 17 nt, Human
gagugugccugaagucc

SEQ ID NO: 2380524 - RNA, 22 nt, Human
gagugucuuuccacggagccac

SEQ ID NO: 2380525 - RNA, 22 nt, Human
gagugggggagagcaggcuggc

SEQ ID NO: 2380526 - RNA, 18 nt, Human
gaguuaguuucuuuggga

SEQ ID NO: 2380527 - RNA, 14 nt, Human
gaguuauauguuca

SEQ ID NO: 2380528 - RNA, 18 nt, Human
gaguuauauguucacugu

SEQ ID NO: 2380529 - RNA, 18 nt, Human
gaguuaggcuauucacaa

SEQ ID NO: 2380530 - RNA, 17 nt, Human
gaguuaggcuauucaca

SEQ ID NO: 2380531 - RNA, 20 nt, Human
gaguuagaggccagccuggc

SEQ ID NO: 2380532 - RNA, 18 nt, Human
gaguuagaggccagccug

SEQ ID NO: 2380533 - RNA, 23 nt, Human
gaguucaucuugaauuguaagga

SEQ ID NO: 2380534 - RNA, 16 nt, Human
gaguuaucuaaaagaa

SEQ ID NO: 2380535 - RNA, 18 nt, Human
gaguuaucuaaaagaaau

SEQ ID NO: 2380536 - RNA, 16 nt, Human
gaguuuuggaugcagu

SEQ ID NO: 2380537 - RNA, 13 nt, Human
gaguuuuccccac

SEQ ID NO: 2380538 - RNA, 14 nt, Human
gaguugaagacaga

SEQ ID NO: 2380539 - RNA, 21 nt, Human
gaguugaaaaucuuauaauuu

SEQ ID NO: 2380540 - RNA, 17 nt, Human
gaguucgagaccagccu

SEQ ID NO: 2380541 - RNA, 21 nt, Human
gaguuccuugaucuguauaua

SEQ ID NO: 2380542 - RNA, 14 nt, Human
gaguuccugcaugc

SEQ ID NO: 2380543 - RNA, 21 nt, Human
gaguucuuaaggauugugaua

SEQ ID NO: 2380544 - RNA, 15 nt, Human
gaguucuugugccau

SEQ ID NO: 2380545 - RNA, 23 nt, Human
gaguuccugcggagugaagaggg

SEQ ID NO: 2380546 - RNA, 15 nt, Human
gaguuccaugaagac

SEQ ID NO: 2380547 - RNA, 17 nt, Human
gaguuccaugaagacca

SEQ ID NO: 2380548 - RNA, 18 nt, Human
gaguuccccaugcagaca

SEQ ID NO: 2380549 - RNA, 12 nt, Human
gaguuccugcau

SEQ ID NO: 2380550 - RNA, 13 nt, Human
gaguuccuagcca

SEQ ID NO: 2380551 - RNA, 15 nt, Human
gaguggcuccucccg

SEQ ID NO: 2380552 - RNA, 17 nt, Human
gagugggacagagucug

SEQ ID NO: 2380553 - RNA, 18 nt, Human
gaguggccuggccaggag

SEQ ID NO: 2380554 - RNA, 15 nt, Human
gaguggccuggccag

SEQ ID NO: 2380555 - RNA, 14 nt, Human
gaguggccuggcca

SEQ ID NO: 2380556 - RNA, 13 nt, Human
gaguggccuggcc

SEQ ID NO: 2380557 - RNA, 20 nt, Human
gaguggccuggccaggagcu

SEQ ID NO: 2380558 - RNA, 19 nt, Human
gaguggccuggccaggagc

SEQ ID NO: 2380559 - RNA, 13 nt, Human
gaguggcuccucc

SEQ ID NO: 2380560 - RNA, 14 nt, Human
gaguggggcaguag

SEQ ID NO: 2380561 - RNA, 19 nt, Human
gagugggggagagcaggcu

SEQ ID NO: 2380562 - RNA, 18 nt, Human
gagugggacagagucugg

SEQ ID NO: 2380563 - RNA, 21 nt, Human
gagugucuuuccacggagcca

SEQ ID NO: 2380564 - RNA, 19 nt, Human
gagugucuuuccacggagc

SEQ ID NO: 2380565 - RNA, 15 nt, Human
gagugucuuuccacg

SEQ ID NO: 2380566 - RNA, 13 nt, Human
gagugucuuucca

SEQ ID NO: 2380567 - RNA, 23 nt, Human
gagugggggaucacagccucuga

SEQ ID NO: 2380568 - RNA, 12 nt, Human
gagugggcccaa

SEQ ID NO: 2380569 - RNA, 12 nt, Human
gagucugaugau

SEQ ID NO: 2380570 - RNA, 19 nt, Human
gagugaacaaauuuacaga

SEQ ID NO: 2380571 - RNA, 11 nt, Human
gagucugcaca

SEQ ID NO: 2380572 - RNA, 18 nt, Human
gagucugcuauauuuuca

SEQ ID NO: 2380573 - RNA, 21 nt, Human
gagucugcuauauuuucauga

SEQ ID NO: 2380574 - RNA, 11 nt, Human
gaguggccacu

SEQ ID NO: 2380575 - RNA, 23 nt, Human
gaguggcauuggcagcaggugcu

SEQ ID NO: 2380576 - RNA, 20 nt, Human
gaguggcauggccaccacca

SEQ ID NO: 2380577 - RNA, 18 nt, Human
gaguggcauuggcagcag

SEQ ID NO: 2380578 - RNA, 12 nt, Human
gaguggccuggc

SEQ ID NO: 2380579 - RNA, 10 nt, Human
gaguggccug

SEQ ID NO: 2380580 - RNA, 23 nt, Human
gagugaacaaauuuacagagaca

SEQ ID NO: 2380581 - RNA, 22 nt, Human
gagugaacaaauuuacagagac

SEQ ID NO: 2380582 - RNA, 22 nt, Human
gaguuuuucccagcuacaccuu

SEQ ID NO: 2380583 - RNA, 19 nt, Human
gaguuuuuauggggcugaa

SEQ ID NO: 2380584 - RNA, 18 nt, Human
gaguuuuuauggggcuga

SEQ ID NO: 2380585 - RNA, 19 nt, Human
gaguuuuguuuuaaaauua

SEQ ID NO: 2380586 - RNA, 13 nt, Human
gaguuuuguuuua

SEQ ID NO: 2380587 - RNA, 16 nt, Human
gauaaucagccucuua

SEQ ID NO: 2380588 - RNA, 15 nt, Human
gauaaucagccucuu

SEQ ID NO: 2380589 - RNA, 14 nt, Human
gauaaucagccucu

SEQ ID NO: 2380590 - RNA, 13 nt, Human
gauaaucagccuc

SEQ ID NO: 2380591 - RNA, 21 nt, Human
gauaaucaacugggcugaaca

SEQ ID NO: 2380592 - RNA, 19 nt, Human
gaguuuuuguuuggagagc

SEQ ID NO: 2380593 - RNA, 21 nt, Human
gauaaaaagauguucagucau

SEQ ID NO: 2380594 - RNA, 19 nt, Human
gauaaugcuguugccucau

SEQ ID NO: 2380595 - RNA, 20 nt, Human
gauaaugccggugagaauaa

SEQ ID NO: 2380596 - RNA, 15 nt, Human
gauaaugcuguugcc

SEQ ID NO: 2380597 - RNA, 11 nt, Human
gauaauguuaa

SEQ ID NO: 2380598 - RNA, 21 nt, Human
gauaaugugauauuauacaua

SEQ ID NO: 2380599 - RNA, 21 nt, Human
gauaaucagugugucuaaauu

SEQ ID NO: 2380600 - RNA, 21 nt, Human
gauaauguuaaauuuguaagu

SEQ ID NO: 2380601 - RNA, 20 nt, Human
gauacaacuucaagugcaug

SEQ ID NO: 2380602 - RNA, 17 nt, Human
gauacaaaagcauguga

SEQ ID NO: 2380603 - RNA, 12 nt, Human
gauaauguuaaa

SEQ ID NO: 2380604 - RNA, 13 nt, Human
gauaauguuaaau

SEQ ID NO: 2380605 - RNA, 14 nt, Human
gauaauguuaaauu

SEQ ID NO: 2380606 - RNA, 19 nt, Human
gauaauguuaaauuuguaa

SEQ ID NO: 2380607 - RNA, 19 nt, Human
gauacacccaaaguaucag

SEQ ID NO: 2380608 - RNA, 22 nt, Human
gauacaauguauuuauuuaaaa

SEQ ID NO: 2380609 - RNA, 16 nt, Human
gauacaagauuagaag

SEQ ID NO: 2380610 - RNA, 20 nt, Human
gauagacacauaugaggggg

SEQ ID NO: 2380611 - RNA, 21 nt, Human
gauagacacauaugaggggga

SEQ ID NO: 2380612 - RNA, 18 nt, Human
gauacaaugcugugcccu

SEQ ID NO: 2380613 - RNA, 13 nt, Human
gauacaaugcugu

SEQ ID NO: 2380614 - RNA, 12 nt, Human
gauagagggggg

SEQ ID NO: 2380615 - RNA, 17 nt, Human
gauagcacagacccugc

SEQ ID NO: 2380616 - RNA, 18 nt, Human
gauagcacagacccugcc

SEQ ID NO: 2380617 - RNA, 12 nt, Human
gauagccaaggc

SEQ ID NO: 2380618 - RNA, 19 nt, Human
gauagcacagacccugccc

SEQ ID NO: 2380619 - RNA, 15 nt, Human
gauagcauugugaac

SEQ ID NO: 2380620 - RNA, 17 nt, Human
gauagcauugugaacug

SEQ ID NO: 2380621 - RNA, 13 nt, Human
gauagccaaggcc

SEQ ID NO: 2380622 - RNA, 17 nt, Human
gauauaaguguguguuu

SEQ ID NO: 2380623 - RNA, 17 nt, Human
gauagcauuuuugauuu

SEQ ID NO: 2380624 - RNA, 22 nt, Human
gauagcauuuuugauuuaugca

SEQ ID NO: 2380625 - RNA, 21 nt, Human
gauauaaguguguguuuuuca

SEQ ID NO: 2380626 - RNA, 18 nt, Human
gauauacacggaugacuu

SEQ ID NO: 2380627 - RNA, 23 nt, Human
gauagcauuuuugauuuaugcau

SEQ ID NO: 2380628 - RNA, 17 nt, Human
gauauacucuagaugaa

SEQ ID NO: 2380629 - RNA, 18 nt, Human
gauauacuuuuuucuuau

SEQ ID NO: 2380630 - RNA, 12 nt, Human
gauauagaacag

SEQ ID NO: 2380631 - RNA, 23 nt, Human
gauauaugcucugcauguuacau

SEQ ID NO: 2380632 - RNA, 20 nt, Human
gauauauguguuuuucacau

SEQ ID NO: 2380633 - RNA, 16 nt, Human
gauauagaacagugcu

SEQ ID NO: 2380634 - RNA, 22 nt, Human
gauauauguguuuuucacauuu

SEQ ID NO: 2380635 - RNA, 19 nt, Human
gauauauguuuuugaaggc

SEQ ID NO: 2380636 - RNA, 21 nt, Human
gaucaaccccuucgcuccugu

SEQ ID NO: 2380637 - RNA, 22 nt, Human
gaucaaccccuucgcuccugug

SEQ ID NO: 2380638 - RNA, 19 nt, Human
gauauauuuaaaaauauuu

SEQ ID NO: 2380639 - RNA, 23 nt, Human
gauauauuuuacaauuuuuuauc

SEQ ID NO: 2380640 - RNA, 15 nt, Human
gauauauuuaaaaau

SEQ ID NO: 2380641 - RNA, 14 nt, Human
gauauauuuuacaa

SEQ ID NO: 2380642 - RNA, 16 nt, Human
gauauauggauaaugc

SEQ ID NO: 2380643 - RNA, 13 nt, Human
gauauauuaaaaa

SEQ ID NO: 2380644 - RNA, 14 nt, Human
gauauauuaaaaau

SEQ ID NO: 2380645 - RNA, 17 nt, Human
gauauauuaaaaauaua

SEQ ID NO: 2380646 - RNA, 18 nt, Human
gauauauuaaaaauauaa

SEQ ID NO: 2380647 - RNA, 20 nt, Human
gauauauuaaaaauauaaaa

SEQ ID NO: 2380648 - RNA, 21 nt, Human
gauauauuaaaaauauaaaac

SEQ ID NO: 2380649 - RNA, 22 nt, Human
gauauauuaaaaauauaaaacu

SEQ ID NO: 2380650 - RNA, 12 nt, Human
gaguaaaggaaa

SEQ ID NO: 2380651 - RNA, 16 nt, Human
gaguacguugugcauu

SEQ ID NO: 2380652 - RNA, 19 nt, Human
gagguuuuaaaaaaauccc

SEQ ID NO: 2380653 - RNA, 15 nt, Human
gagguuuuaaaguga

SEQ ID NO: 2380654 - RNA, 22 nt, Human
gagguuauaggucacuccuggg

SEQ ID NO: 2380655 - RNA, 19 nt, Human
gagguuauaggucacuccu

SEQ ID NO: 2380656 - RNA, 17 nt, Human
gagguucauuucaaaua

SEQ ID NO: 2380657 - RNA, 22 nt, Human
gagguuuguuuagaagaagugu

SEQ ID NO: 2380658 - RNA, 14 nt, Human
gagguucccuuuga

SEQ ID NO: 2380659 - RNA, 19 nt, Human
gagguuaaggcugaggaaa

SEQ ID NO: 2380660 - RNA, 15 nt, Human
gagguuaaggcugag

SEQ ID NO: 2380661 - RNA, 21 nt, Human
gagguguuuaaagagagguua

SEQ ID NO: 2380662 - RNA, 22 nt, Human
gagguuaggaguucgagaccag

SEQ ID NO: 2380663 - RNA, 13 nt, Human
gagguuauagguc

SEQ ID NO: 2380664 - RNA, 19 nt, Human
gagguucaaagauauuuug

SEQ ID NO: 2380665 - RNA, 16 nt, Human
gaguacaggugaagca

SEQ ID NO: 2380666 - RNA, 12 nt, Human
gaguagcuggau

SEQ ID NO: 2380667 - RNA, 21 nt, Human
gaguagccgagagccugcucc

SEQ ID NO: 2380668 - RNA, 19 nt, Human
gaguagccgagagccugcu

SEQ ID NO: 2380669 - RNA, 15 nt, Human
gaguagcgguccaag

SEQ ID NO: 2380670 - RNA, 20 nt, Human
gaguagcgguccaagccugc

SEQ ID NO: 2380671 - RNA, 18 nt, Human
gaguacuacaguccuccc

SEQ ID NO: 2380672 - RNA, 19 nt, Human
gaguacuacaguccuccca

SEQ ID NO: 2380673 - RNA, 20 nt, Human
gaguacguugugcauuuggu

SEQ ID NO: 2380674 - RNA, 15 nt, Human
gaguacuacaguccu

SEQ ID NO: 2380675 - RNA, 18 nt, Human
gaguacguugugcauuug

SEQ ID NO: 2380676 - RNA, 17 nt, Human
gaguacguugugcauuu

SEQ ID NO: 2380677 - RNA, 14 nt, Human
gaggucccaggcag

SEQ ID NO: 2380678 - RNA, 12 nt, Human
gaggucccaggc

SEQ ID NO: 2380679 - RNA, 13 nt, Human
gaggggguggagg

SEQ ID NO: 2380680 - RNA, 14 nt, Human
gaggggguggaggg

SEQ ID NO: 2380681 - RNA, 17 nt, Human
gagguccagcccuggcu

SEQ ID NO: 2380682 - RNA, 19 nt, Human
gagguccagcccuggcuga

SEQ ID NO: 2380683 - RNA, 20 nt, Human
gagguccagcccuggcugaa

SEQ ID NO: 2380684 - RNA, 22 nt, Human
gagguccagcccuggcugaagg

SEQ ID NO: 2380685 - RNA, 23 nt, Human
gagguccagcccuggcugaagga

SEQ ID NO: 2380686 - RNA, 18 nt, Human
gaggugggauccuccagg

SEQ ID NO: 2380687 - RNA, 11 nt, Human
gaggugggcag

SEQ ID NO: 2380688 - RNA, 12 nt, Human
gaggugggcagg

SEQ ID NO: 2380689 - RNA, 14 nt, Human
gaggugggcaggug

SEQ ID NO: 2380690 - RNA, 17 nt, Human
gaggugggccagucugu

SEQ ID NO: 2380691 - RNA, 21 nt, Human
gaggugggcaggugguggcac

SEQ ID NO: 2380692 - RNA, 23 nt, Human
gaggugggcaggugguggcacug

SEQ ID NO: 2380693 - RNA, 16 nt, Human
gaggugugggggcugc

SEQ ID NO: 2380694 - RNA, 17 nt, Human
gaggugugggggcugca

SEQ ID NO: 2380695 - RNA, 14 nt, Human
gagguguuuaaaga

SEQ ID NO: 2380696 - RNA, 19 nt, Human
gagguguuuaaagagaggu

SEQ ID NO: 2380697 - RNA, 21 nt, Human
gaggugggauccuccaggugc

SEQ ID NO: 2380698 - RNA, 22 nt, Human
gaggugggauccuccaggugca

SEQ ID NO: 2380699 - RNA, 13 nt, Human
gaggggcuccugg

SEQ ID NO: 2380700 - RNA, 12 nt, Human
gaggggcuccug

SEQ ID NO: 2380701 - RNA, 16 nt, Human
gaggggcgggacccag

SEQ ID NO: 2380702 - RNA, 15 nt, Human
gaggggcucaggaaa

SEQ ID NO: 2380703 - RNA, 20 nt, Human
gaggggcgcuggcccagccg

SEQ ID NO: 2380704 - RNA, 22 nt, Human
gaggggcgcuggcccagccggc

SEQ ID NO: 2380705 - RNA, 16 nt, Human
gaggggcgcccaccuc

SEQ ID NO: 2380706 - RNA, 13 nt, Human
gaggggcgcuggc

SEQ ID NO: 2380707 - RNA, 14 nt, Human
gaggggcgcuggcc

SEQ ID NO: 2380708 - RNA, 15 nt, Human
gaggggcgcuggccc

SEQ ID NO: 2380709 - RNA, 16 nt, Human
gaggggcgcuggccca

SEQ ID NO: 2380710 - RNA, 17 nt, Human
gaggggcgcuggcccag

SEQ ID NO: 2380711 - RNA, 18 nt, Human
gaggggcgcuggcccagc

SEQ ID NO: 2380712 - RNA, 19 nt, Human
gaggggcgcuggcccagcc

SEQ ID NO: 2380713 - RNA, 15 nt, Human
gaggggcuccuggaa

SEQ ID NO: 2380714 - RNA, 14 nt, Human
gaggggcuccugga

SEQ ID NO: 2380715 - RNA, 16 nt, Human
gaggggcucaggaaaa

SEQ ID NO: 2380716 - RNA, 11 nt, Human
gaggggcucuc

SEQ ID NO: 2380717 - RNA, 12 nt, Human
gaggggcucuca

SEQ ID NO: 2380718 - RNA, 16 nt, Human
gaggggcucucagcuc

SEQ ID NO: 2380719 - RNA, 15 nt, Human
gaggggggagguggg

SEQ ID NO: 2380720 - RNA, 22 nt, Human
gaggucaggaguuagaggccag

SEQ ID NO: 2380721 - RNA, 18 nt, Human
gagguccacaacacacag

SEQ ID NO: 2380722 - RNA, 15 nt, Human
gaggggguggccucc

SEQ ID NO: 2380723 - RNA, 22 nt, Human
gaggggggaggugggauccucc

SEQ ID NO: 2380724 - RNA, 19 nt, Human
gaggggcucucagcucagc

SEQ ID NO: 2380725 - RNA, 23 nt, Human
gaggggcucucagcucagcgcca

SEQ ID NO: 2380726 - RNA, 19 nt, Human
gaggggggauuuccagcca

SEQ ID NO: 2380727 - RNA, 15 nt, Human
gaggggggcacaugc

SEQ ID NO: 2380728 - RNA, 14 nt, Human
gagucugaagcaga

SEQ ID NO: 2380729 - RNA, 18 nt, Human
gagucucuucuccacugg

SEQ ID NO: 2380730 - RNA, 21 nt, Human
gagucugaaggcuggguucug

SEQ ID NO: 2380731 - RNA, 14 nt, Human
gagucucuucucca

SEQ ID NO: 2380732 - RNA, 15 nt, Human
gagucucuucuccac

SEQ ID NO: 2380733 - RNA, 16 nt, Human
gagucucuucuccacu

SEQ ID NO: 2380734 - RNA, 17 nt, Human
gagucucuucuccacug

SEQ ID NO: 2380735 - RNA, 22 nt, Human
gagucucacuguugcccaggcu

SEQ ID NO: 2380736 - RNA, 23 nt, Human
gagucucacuguugcccaggcug

SEQ ID NO: 2380737 - RNA, 12 nt, Human
gagucucuucuc

SEQ ID NO: 2380738 - RNA, 12 nt, Human
gagucuccugug

SEQ ID NO: 2380739 - RNA, 23 nt, Human
gagucucgcuauugucaccaggg

SEQ ID NO: 2380740 - RNA, 23 nt, Human
gagucgucaucacuuuucaguga

SEQ ID NO: 2380741 - RNA, 20 nt, Human
gagucuccagugguugcugu

SEQ ID NO: 2380742 - RNA, 13 nt, Human
gagucucccaagg

SEQ ID NO: 2380743 - RNA, 14 nt, Human
gagucucccaaggc

SEQ ID NO: 2380744 - RNA, 19 nt, Human
gagucucacuguugcccag

SEQ ID NO: 2380745 - RNA, 18 nt, Human
gagucguggggugugcug

SEQ ID NO: 2380746 - RNA, 19 nt, Human
gagucguggggugugcugg

SEQ ID NO: 2380747 - RNA, 20 nt, Human
gagucguggggugugcuggg

SEQ ID NO: 2380748 - RNA, 21 nt, Human
gagucguggggugugcuggga

SEQ ID NO: 2380749 - RNA, 20 nt, Human
gagucucacuguugcccagg

SEQ ID NO: 2380750 - RNA, 21 nt, Human
gagucucacuguugcccaggc

SEQ ID NO: 2380751 - RNA, 14 nt, Human
gagucccgucagga

SEQ ID NO: 2380752 - RNA, 19 nt, Human
gagucgucaucacuuuuca

SEQ ID NO: 2380753 - RNA, 17 nt, Human
gagucguggggugugcu

SEQ ID NO: 2380754 - RNA, 22 nt, Human
gagucguacagaaagcugccug

SEQ ID NO: 2380755 - RNA, 17 nt, Human
gagucguacagaaagcu

SEQ ID NO: 2380756 - RNA, 13 nt, Human
gagucggaagggc

SEQ ID NO: 2380757 - RNA, 18 nt, Human
gaguccccuccccggccc

SEQ ID NO: 2380758 - RNA, 17 nt, Human
gagucgaggacagggag

SEQ ID NO: 2380759 - RNA, 19 nt, Human
gagucaaaugguaggcauu

SEQ ID NO: 2380760 - RNA, 19 nt, Human
gagucaaaacuacaaauca

SEQ ID NO: 2380761 - RNA, 20 nt, Human
gaguauuuaggcagauugaa

SEQ ID NO: 2380762 - RNA, 19 nt, Human
gagucaaaacucaaaugcu

SEQ ID NO: 2380763 - RNA, 13 nt, Human
gagucccacugcc

SEQ ID NO: 2380764 - RNA, 14 nt, Human
gagucccacugccu

SEQ ID NO: 2380765 - RNA, 17 nt, Human
gagucccacugccucag

SEQ ID NO: 2380766 - RNA, 19 nt, Human
gagucccacugccucaggu

SEQ ID NO: 2380767 - RNA, 20 nt, Human
gagucccacugccucagguu

SEQ ID NO: 2380768 - RNA, 22 nt, Human
gagucccacugccucagguucc

SEQ ID NO: 2380769 - RNA, 23 nt, Human
gagucccacugccucagguuccu

SEQ ID NO: 2380770 - RNA, 18 nt, Human
gagucccagagcaggagg

SEQ ID NO: 2380771 - RNA, 19 nt, Human
gagucccagagcaggaggc

SEQ ID NO: 2380772 - RNA, 21 nt, Human
gagucccagagcaggaggccc

SEQ ID NO: 2380773 - RNA, 23 nt, Human
gagucccagagcaggaggccccu

SEQ ID NO: 2380774 - RNA, 12 nt, Human
gaguagcuggga

SEQ ID NO: 2380775 - RNA, 14 nt, Human
gaguagcugggacu

SEQ ID NO: 2380776 - RNA, 14 nt, Human
gaguccccuguuug

SEQ ID NO: 2380777 - RNA, 23 nt, Human
gaguccccuguuuguuucugaaa

SEQ ID NO: 2380778 - RNA, 14 nt, Human
gagucccugccauc

SEQ ID NO: 2380779 - RNA, 18 nt, Human
gaguccccucaccuccuc

SEQ ID NO: 2380780 - RNA, 19 nt, Human
gaguccccucaccuccucu

SEQ ID NO: 2380781 - RNA, 19 nt, Human
gagucccaggcugagccuc

SEQ ID NO: 2380782 - RNA, 18 nt, Human
gagucccaggcugagccu

SEQ ID NO: 2380783 - RNA, 19 nt, Human
gagucccaggagcugccca

SEQ ID NO: 2380784 - RNA, 20 nt, Human
gagucccaggagcugcccag

SEQ ID NO: 2380785 - RNA, 14 nt, Human
gagucccaguggga

SEQ ID NO: 2380786 - RNA, 16 nt, Human
gagucccagugggagg

SEQ ID NO: 2380787 - RNA, 18 nt, Human
gagucccagugggaggcg

SEQ ID NO: 2380788 - RNA, 11 nt, Human
gaguccccuca

SEQ ID NO: 2380789 - RNA, 16 nt, Human
gaguccccucaccucc

SEQ ID NO: 2380790 - RNA, 17 nt, Human
gaguccccucaccuccu

SEQ ID NO: 2380791 - RNA, 12 nt, Human
gaguccccuguu

SEQ ID NO: 2380792 - RNA, 19 nt, Human
gagcggugcuguccucagg

SEQ ID NO: 2380793 - RNA, 22 nt, Human
gagcggucucaggcugguggga

SEQ ID NO: 2380794 - RNA, 23 nt, Human
gagcggucucaggcuggugggag

SEQ ID NO: 2380795 - RNA, 14 nt, Human
gagcgguggcccug

SEQ ID NO: 2380796 - RNA, 23 nt, Human
gagcgguggcccugucccuccca

SEQ ID NO: 2380797 - RNA, 17 nt, Human
gagcgguggcccugucc

SEQ ID NO: 2380798 - RNA, 20 nt, Human
gagcgugcuccagccuggcu

SEQ ID NO: 2380799 - RNA, 21 nt, Human
gagcgugcuccagccuggcuc

SEQ ID NO: 2380800 - RNA, 22 nt, Human
gagcgugggaggcgggagugga

SEQ ID NO: 2380801 - RNA, 14 nt, Human
gagccuggugcccu

SEQ ID NO: 2380802 - RNA, 13 nt, Human
gagcuacaaaugc

SEQ ID NO: 2380803 - RNA, 12 nt, Human
gagcuacaaaug

SEQ ID NO: 2380804 - RNA, 10 nt, Human
gagccuggca

SEQ ID NO: 2380805 - RNA, 15 nt, Human
gagccugcuggcacc

SEQ ID NO: 2380806 - RNA, 12 nt, Human
gagccugcuggu

SEQ ID NO: 2380807 - RNA, 21 nt, Human
gagccugcuggucacagccuc

SEQ ID NO: 2380808 - RNA, 23 nt, Human
gagccugcuggucacagccuccu

SEQ ID NO: 2380809 - RNA, 12 nt, Human
gagccuggagaa

SEQ ID NO: 2380810 - RNA, 13 nt, Human
gagccuggagaag

SEQ ID NO: 2380811 - RNA, 14 nt, Human
gagccuggagaagc

SEQ ID NO: 2380812 - RNA, 15 nt, Human
gagccuggagaagcu

SEQ ID NO: 2380813 - RNA, 15 nt, Human
gagccuggcaagaau

SEQ ID NO: 2380814 - RNA, 15 nt, Human
gagccuggccagccu

SEQ ID NO: 2380815 - RNA, 23 nt, Human
gagccuggcuccguccaggagcc

SEQ ID NO: 2380816 - RNA, 12 nt, Human
gagccuggcucu

SEQ ID NO: 2380817 - RNA, 21 nt, Human
gagccuggcucuugugcugga

SEQ ID NO: 2380818 - RNA, 23 nt, Human
gagccuggcucuugugcuggaug

SEQ ID NO: 2380819 - RNA, 17 nt, Human
gagccuggugcugcugc

SEQ ID NO: 2380820 - RNA, 16 nt, Human
gagccuggugcugcug

SEQ ID NO: 2380821 - RNA, 12 nt, Human
gagccuggugcc

SEQ ID NO: 2380822 - RNA, 21 nt, Human
gagccugggaggucaaggcug

SEQ ID NO: 2380823 - RNA, 13 nt, Human
gagccugggaggu

SEQ ID NO: 2380824 - RNA, 20 nt, Human
gagccucagcauccuggcac

SEQ ID NO: 2380825 - RNA, 21 nt, Human
gagccucagcauccuggcacc

SEQ ID NO: 2380826 - RNA, 14 nt, Human
gagccuccugcccu

SEQ ID NO: 2380827 - RNA, 14 nt, Human
gagccuccugccca

SEQ ID NO: 2380828 - RNA, 15 nt, Human
gagccuccugcccag

SEQ ID NO: 2380829 - RNA, 15 nt, Human
gagcccugguggcag

SEQ ID NO: 2380830 - RNA, 16 nt, Human
gagcccugguggcagu

SEQ ID NO: 2380831 - RNA, 19 nt, Human
gagccucagcauccuggca

SEQ ID NO: 2380832 - RNA, 17 nt, Human
gagcccugguggcagug

SEQ ID NO: 2380833 - RNA, 13 nt, Human
gagccugcucccc

SEQ ID NO: 2380834 - RNA, 19 nt, Human
gagccugcggccugcugga

SEQ ID NO: 2380835 - RNA, 18 nt, Human
gagccugcaggugcugcu

SEQ ID NO: 2380836 - RNA, 16 nt, Human
gagccugccuggagcg

SEQ ID NO: 2380837 - RNA, 16 nt, Human
gagccugcaggguggu

SEQ ID NO: 2380838 - RNA, 20 nt, Human
gagccugcaggguggugcug

SEQ ID NO: 2380839 - RNA, 22 nt, Human
gagccugcaggguggugcuggg

SEQ ID NO: 2380840 - RNA, 23 nt, Human
gagccugcaggguggugcuggga

SEQ ID NO: 2380841 - RNA, 19 nt, Human
gagccugcucccccacccc

SEQ ID NO: 2380842 - RNA, 10 nt, Human
gagccugcug

SEQ ID NO: 2380843 - RNA, 18 nt, Human
gagccugcucccccaccc

SEQ ID NO: 2380844 - RNA, 17 nt, Human
gagccugcucccccacc

SEQ ID NO: 2380845 - RNA, 12 nt, Human
gagccugcuggc

SEQ ID NO: 2380846 - RNA, 11 nt, Human
gagccugcugg

SEQ ID NO: 2380847 - RNA, 13 nt, Human
gagccugcuggca

SEQ ID NO: 2380848 - RNA, 12 nt, Human
gagccugcagag

SEQ ID NO: 2380849 - RNA, 15 nt, Human
gagccugcagagcug

SEQ ID NO: 2380850 - RNA, 15 nt, Human
gagccugcagggugg

SEQ ID NO: 2380851 - RNA, 20 nt, Human
gagccuccugcccuuaccug

SEQ ID NO: 2380852 - RNA, 22 nt, Human
gagccuccugcccuuaccugcc

SEQ ID NO: 2380853 - RNA, 17 nt, Human
gagccuccugcccaguc

SEQ ID NO: 2380854 - RNA, 18 nt, Human
gagccuccugcccagucc

SEQ ID NO: 2380855 - RNA, 19 nt, Human
gagccuccugcccaguccc

SEQ ID NO: 2380856 - RNA, 21 nt, Human
gagccugcaaacucacugcuc

SEQ ID NO: 2380857 - RNA, 17 nt, Human
gagcuucccugacucau

SEQ ID NO: 2380858 - RNA, 13 nt, Human
gagcuucccugac

SEQ ID NO: 2380859 - RNA, 19 nt, Human
gagcuucauggcagaaggc

SEQ ID NO: 2380860 - RNA, 18 nt, Human
gagcuuagugaaauuacu

SEQ ID NO: 2380861 - RNA, 16 nt, Human
gagcuucauggcagaa

SEQ ID NO: 2380862 - RNA, 17 nt, Human
gagcuuagccaaugugg

SEQ ID NO: 2380863 - RNA, 10 nt, Human
gagcuucucu

SEQ ID NO: 2380864 - RNA, 14 nt, Human
gagcuucucuguga

SEQ ID NO: 2380865 - RNA, 16 nt, Human
gagcuucucugugaac

SEQ ID NO: 2380866 - RNA, 14 nt, Human
gagcuucuggcacu

SEQ ID NO: 2380867 - RNA, 18 nt, Human
gagcuucuguugcugccu

SEQ ID NO: 2380868 - RNA, 22 nt, Human
gagcuguuuauggccucagcug

SEQ ID NO: 2380869 - RNA, 20 nt, Human
gagcuguuuauggccucagc

SEQ ID NO: 2380870 - RNA, 15 nt, Human
gagcuuaacagugug

SEQ ID NO: 2380871 - RNA, 15 nt, Human
gagcugcccuccuug

SEQ ID NO: 2380872 - RNA, 21 nt, Human
gagcugcccuccuuguccacc

SEQ ID NO: 2380873 - RNA, 23 nt, Human
gagcugcccuccuuguccaccca

SEQ ID NO: 2380874 - RNA, 19 nt, Human
gagcuguuuauggccucag

SEQ ID NO: 2380875 - RNA, 21 nt, Human
gagcugcccagaguugcuggg

SEQ ID NO: 2380876 - RNA, 20 nt, Human
gagcugccauccagggaugc

SEQ ID NO: 2380877 - RNA, 11 nt, Human
gagcugcccuc

SEQ ID NO: 2380878 - RNA, 15 nt, Human
gagcugccaccugcc

SEQ ID NO: 2380879 - RNA, 16 nt, Human
gagcugccaccugccu

SEQ ID NO: 2380880 - RNA, 22 nt, Human
gagcucuucaggccucccucuc

SEQ ID NO: 2380881 - RNA, 17 nt, Human
gagcucuucauguuuca

SEQ ID NO: 2380882 - RNA, 13 nt, Human
gagcugccaccug

SEQ ID NO: 2380883 - RNA, 19 nt, Human
gagcucuucaggccucccu

SEQ ID NO: 2380884 - RNA, 17 nt, Human
gagcucuucaggccucc

SEQ ID NO: 2380885 - RNA, 16 nt, Human
gagcucuucaggccuc

SEQ ID NO: 2380886 - RNA, 16 nt, Human
gagcucugcagagcag

SEQ ID NO: 2380887 - RNA, 15 nt, Human
gagcucugcagccca

SEQ ID NO: 2380888 - RNA, 19 nt, Human
gagcuccccaccaccccag

SEQ ID NO: 2380889 - RNA, 21 nt, Human
gagcuccacucugcuucucug

SEQ ID NO: 2380890 - RNA, 22 nt, Human
gagcuccccaccaccccagcug

SEQ ID NO: 2380891 - RNA, 20 nt, Human
gagcuccccaccaccccagc

SEQ ID NO: 2380892 - RNA, 15 nt, Human
gagcuccucuccugg

SEQ ID NO: 2380893 - RNA, 19 nt, Human
gagcucccggcguggugga

SEQ ID NO: 2380894 - RNA, 12 nt, Human
gagcuccacucu

SEQ ID NO: 2380895 - RNA, 13 nt, Human
gagcuccacucug

SEQ ID NO: 2380896 - RNA, 16 nt, Human
gagcuccacucugcuu

SEQ ID NO: 2380897 - RNA, 18 nt, Human
gagcuccacucugcuucu

SEQ ID NO: 2380898 - RNA, 18 nt, Human
gagcuccucugggcagga

SEQ ID NO: 2380899 - RNA, 16 nt, Human
gagcuccucugggcag

SEQ ID NO: 2380900 - RNA, 15 nt, Human
gagcuccucugggca

SEQ ID NO: 2380901 - RNA, 14 nt, Human
gagcuccucugggc

SEQ ID NO: 2380902 - RNA, 16 nt, Human
gagcuccucuccugga

SEQ ID NO: 2380903 - RNA, 17 nt, Human
gagcuccucuccuggag

SEQ ID NO: 2380904 - RNA, 18 nt, Human
gagcuccucuccuggagg

SEQ ID NO: 2380905 - RNA, 19 nt, Human
gagcuccucuccuggagga

SEQ ID NO: 2380906 - RNA, 22 nt, Human
gagcuccucugggcaggaccuc

SEQ ID NO: 2380907 - RNA, 19 nt, Human
gagcucuaugggcagaucu

SEQ ID NO: 2380908 - RNA, 13 nt, Human
gagcucuccagcu

SEQ ID NO: 2380909 - RNA, 18 nt, Human
gagcuacccgcagaguuc

SEQ ID NO: 2380910 - RNA, 23 nt, Human
gagcuacgccugccuccccugug

SEQ ID NO: 2380911 - RNA, 17 nt, Human
gagcuacgccugccucc

SEQ ID NO: 2380912 - RNA, 17 nt, Human
gagcucaggacacuaau

SEQ ID NO: 2380913 - RNA, 14 nt, Human
gagcucaggacacu

SEQ ID NO: 2380914 - RNA, 20 nt, Human
gagcuacuugggccauagcu

SEQ ID NO: 2380915 - RNA, 15 nt, Human
gagcuaacacuggcc

SEQ ID NO: 2380916 - RNA, 14 nt, Human
gagcuaacacuggc

SEQ ID NO: 2380917 - RNA, 19 nt, Human
gagcuaacacuggccccua

SEQ ID NO: 2380918 - RNA, 21 nt, Human
gagcuaaauuacaauugucau

SEQ ID NO: 2380919 - RNA, 19 nt, Human
gagcuaaauuacaauuguc

SEQ ID NO: 2380920 - RNA, 23 nt, Human
gagcuacacaggggaaaagagga

SEQ ID NO: 2380921 - RNA, 14 nt, Human
gagcuacaaaugca

SEQ ID NO: 2380922 - RNA, 13 nt, Human
gagcacacuguag

SEQ ID NO: 2380923 - RNA, 15 nt, Human
gagcacacuguagca

SEQ ID NO: 2380924 - RNA, 18 nt, Human
gagcacacuuggcccaag

SEQ ID NO: 2380925 - RNA, 20 nt, Human
gagcacacuuuaguggccga

SEQ ID NO: 2380926 - RNA, 23 nt, Human
gagcaccaggcacgaacccaccu

SEQ ID NO: 2380927 - RNA, 15 nt, Human
gagcaccaggcacga

SEQ ID NO: 2380928 - RNA, 13 nt, Human
gagcaccaggcac

SEQ ID NO: 2380929 - RNA, 14 nt, Human
gagcacaggcagcu

SEQ ID NO: 2380930 - RNA, 15 nt, Human
gagcacaggcagcug

SEQ ID NO: 2380931 - RNA, 17 nt, Human
gagcacagaucuguuuc

SEQ ID NO: 2380932 - RNA, 12 nt, Human
gagcacagcccu

SEQ ID NO: 2380933 - RNA, 13 nt, Human
gagcacagcccuc

SEQ ID NO: 2380934 - RNA, 14 nt, Human
gagcacagcccucc

SEQ ID NO: 2380935 - RNA, 15 nt, Human
gagcacagcccuccc

SEQ ID NO: 2380936 - RNA, 18 nt, Human
gagcacagcccucccgcc

SEQ ID NO: 2380937 - RNA, 20 nt, Human
gagcacagcccucccgcccc

SEQ ID NO: 2380938 - RNA, 13 nt, Human
gagcacaggcagc

SEQ ID NO: 2380939 - RNA, 13 nt, Human
gagcaccagggga

SEQ ID NO: 2380940 - RNA, 16 nt, Human
gagcaccccucucugc

SEQ ID NO: 2380941 - RNA, 17 nt, Human
gagcaccccucucugca

SEQ ID NO: 2380942 - RNA, 19 nt, Human
gagcaccuccacauccucc

SEQ ID NO: 2380943 - RNA, 14 nt, Human
gagcaccuccacau

SEQ ID NO: 2380944 - RNA, 19 nt, Human
gagcaccuuagacaguccc

SEQ ID NO: 2380945 - RNA, 21 nt, Human
gagcaccccucucugcaucug

SEQ ID NO: 2380946 - RNA, 17 nt, Human
gagcaccuuagacaguc

SEQ ID NO: 2380947 - RNA, 19 nt, Human
gagcaaaaucgaugcagug

SEQ ID NO: 2380948 - RNA, 21 nt, Human
gagaugaagagugagagggca

SEQ ID NO: 2380949 - RNA, 16 nt, Human
gagaucugguuuugcu

SEQ ID NO: 2380950 - RNA, 21 nt, Human
gagaugaaaucuuacagcugg

SEQ ID NO: 2380951 - RNA, 12 nt, Human
gagcaaaauaau

SEQ ID NO: 2380952 - RNA, 15 nt, Human
gagcaaacucugcug

SEQ ID NO: 2380953 - RNA, 13 nt, Human
gagcaaagaucaa

SEQ ID NO: 2380954 - RNA, 13 nt, Human
gagcaaagcugau

SEQ ID NO: 2380955 - RNA, 22 nt, Human
gagcaaagaucaaaauaaaaag

SEQ ID NO: 2380956 - RNA, 14 nt, Human
gagcaaagaucaaa

SEQ ID NO: 2380957 - RNA, 18 nt, Human
gagcaaagaucaaaauaa

SEQ ID NO: 2380958 - RNA, 21 nt, Human
gagcaagacgcugugcugccc

SEQ ID NO: 2380959 - RNA, 18 nt, Human
gagcaagacgcugugcug

SEQ ID NO: 2380960 - RNA, 22 nt, Human
gagcaagacgcugugcugcccu

SEQ ID NO: 2380961 - RNA, 23 nt, Human
gagcaagacgcugugcugcccug

SEQ ID NO: 2380962 - RNA, 16 nt, Human
gagaucagccugggca

SEQ ID NO: 2380963 - RNA, 14 nt, Human
gagaucagccuggg

SEQ ID NO: 2380964 - RNA, 23 nt, Human
gagaucaaauggaaaggagagga

SEQ ID NO: 2380965 - RNA, 17 nt, Human
gagaucaaauggaaagg

SEQ ID NO: 2380966 - RNA, 18 nt, Human
gagaucaaauggaaagga

SEQ ID NO: 2380967 - RNA, 13 nt, Human
gagaucagccugg

SEQ ID NO: 2380968 - RNA, 17 nt, Human
gagauccuccugcagac

SEQ ID NO: 2380969 - RNA, 23 nt, Human
gagauccuccugcagaccacgcc

SEQ ID NO: 2380970 - RNA, 13 nt, Human
gagaucaggcucu

SEQ ID NO: 2380971 - RNA, 13 nt, Human
gagauccuccugc

SEQ ID NO: 2380972 - RNA, 14 nt, Human
gagauccuccugca

SEQ ID NO: 2380973 - RNA, 20 nt, Human
gagaucgcgccacugcacuc

SEQ ID NO: 2380974 - RNA, 21 nt, Human
gagaucuaagccuuuccauaa

SEQ ID NO: 2380975 - RNA, 23 nt, Human
gagaucuaaggaugucacagggc

SEQ ID NO: 2380976 - RNA, 20 nt, Human
gagaucuaagccuuuccaua

SEQ ID NO: 2380977 - RNA, 19 nt, Human
gagaucuaagccuuuccau

SEQ ID NO: 2380978 - RNA, 22 nt, Human
gagaucgugccguuacucucca

SEQ ID NO: 2380979 - RNA, 21 nt, Human
gagaucgugccguuacucucc

SEQ ID NO: 2380980 - RNA, 18 nt, Human
gaaugcugguuuuccuaa

SEQ ID NO: 2380981 - RNA, 17 nt, Human
gaaugcugguuuuccua

SEQ ID NO: 2380982 - RNA, 13 nt, Human
gaaugcuguacau

SEQ ID NO: 2380983 - RNA, 18 nt, Human
gaaugcugggacucagcc

SEQ ID NO: 2380984 - RNA, 19 nt, Human
gaaugcugggacucagccu

SEQ ID NO: 2380985 - RNA, 13 nt, Human
gaaugcugggacu

SEQ ID NO: 2380986 - RNA, 14 nt, Human
gaaugcugggacuc

SEQ ID NO: 2380987 - RNA, 16 nt, Human
gaaugcugggacucag

SEQ ID NO: 2380988 - RNA, 17 nt, Human
gaaugcugggacucagc

SEQ ID NO: 2380989 - RNA, 23 nt, Human
gaaugcucccccauccuccccuu

SEQ ID NO: 2380990 - RNA, 22 nt, Human
gaaugcucccccauccuccccu

SEQ ID NO: 2380991 - RNA, 21 nt, Human
gaaugcucccccauccucccc

SEQ ID NO: 2380992 - RNA, 20 nt, Human
gaaugcucccccauccuccc

SEQ ID NO: 2380993 - RNA, 19 nt, Human
gaaugcucccccauccucc

SEQ ID NO: 2380994 - RNA, 13 nt, Human
gaaugcuccccca

SEQ ID NO: 2380995 - RNA, 11 nt, Human
gaaugcucccc

SEQ ID NO: 2380996 - RNA, 21 nt, Human
gaaugcggccgcauucccuga

SEQ ID NO: 2380997 - RNA, 21 nt, Human
gaaugcugcaggacuugagaa

SEQ ID NO: 2380998 - RNA, 13 nt, Human
gaaugcugaaacc

SEQ ID NO: 2380999 - RNA, 15 nt, Human
gaaugcugaaaccaa

SEQ ID NO: 2381000 - RNA, 21 nt, Human
gaaugcugcccgcucugcaga

SEQ ID NO: 2381001 - RNA, 22 nt, Human
gaaugcugguuuuccuaaaugc

SEQ ID NO: 2381002 - RNA, 21 nt, Human
gagauaucugagggaggaggc

SEQ ID NO: 2381003 - RNA, 22 nt, Human
gagauaucugagggaggaggcc

SEQ ID NO: 2381004 - RNA, 16 nt, Human
gagauaugcagaagga

SEQ ID NO: 2381005 - RNA, 17 nt, Human
gagauauggcagcgaaa

SEQ ID NO: 2381006 - RNA, 16 nt, Human
gagauauggcagcgaa

SEQ ID NO: 2381007 - RNA, 20 nt, Human
gaaugcuguacaucuauuuu

SEQ ID NO: 2381008 - RNA, 17 nt, Human
gaaugcuguacaucuau

SEQ ID NO: 2381009 - RNA, 15 nt, Human
gaaugcuguacaucu

SEQ ID NO: 2381010 - RNA, 14 nt, Human
gaaugcuguacauc

SEQ ID NO: 2381011 - RNA, 22 nt, Human
gagauauuuauggggggagaac

SEQ ID NO: 2381012 - RNA, 22 nt, Human
gagauauuuacaugaauugcau

SEQ ID NO: 2381013 - RNA, 11 nt, Human
gagauauuuac

SEQ ID NO: 2381014 - RNA, 17 nt, Human
gagauauuuuaaaauga

SEQ ID NO: 2381015 - RNA, 20 nt, Human
gagaucaaccccuucgcucc

SEQ ID NO: 2381016 - RNA, 22 nt, Human
gagccauggaccacgcaggaag

SEQ ID NO: 2381017 - RNA, 17 nt, Human
gagccaugcgcccccuc

SEQ ID NO: 2381018 - RNA, 22 nt, Human
gagccaugauguggaguggggc

SEQ ID NO: 2381019 - RNA, 14 nt, Human
gagccaugcuggga

SEQ ID NO: 2381020 - RNA, 21 nt, Human
gagccauguagaagcugcauc

SEQ ID NO: 2381021 - RNA, 11 nt, Human
gagcccacgcc

SEQ ID NO: 2381022 - RNA, 21 nt, Human
gagccauuuuggggggccccc

SEQ ID NO: 2381023 - RNA, 23 nt, Human
gagccauuuuggggggccccccu

SEQ ID NO: 2381024 - RNA, 14 nt, Human
gagccauuuuguga

SEQ ID NO: 2381025 - RNA, 22 nt, Human
gagccaucggugaaacuaacag

SEQ ID NO: 2381026 - RNA, 22 nt, Human
gagccagagaagugacagggaa

SEQ ID NO: 2381027 - RNA, 19 nt, Human
gagccagagaagugacagg

SEQ ID NO: 2381028 - RNA, 20 nt, Human
gagccagagaagugacaggg

SEQ ID NO: 2381029 - RNA, 23 nt, Human
gagccauauaaguuugaaggaaa

SEQ ID NO: 2381030 - RNA, 23 nt, Human
gagccagacucuggucuucuuug

SEQ ID NO: 2381031 - RNA, 12 nt, Human
gagccagagaag

SEQ ID NO: 2381032 - RNA, 13 nt, Human
gagccagagaagu

SEQ ID NO: 2381033 - RNA, 14 nt, Human
gagccagagaagug

SEQ ID NO: 2381034 - RNA, 15 nt, Human
gagccagagaaguga

SEQ ID NO: 2381035 - RNA, 16 nt, Human
gagccagagaagugac

SEQ ID NO: 2381036 - RNA, 17 nt, Human
gagccagagaagugaca

SEQ ID NO: 2381037 - RNA, 18 nt, Human
gagccagagaagugacag

SEQ ID NO: 2381038 - RNA, 19 nt, Human
gagccaccaugcccagcuc

SEQ ID NO: 2381039 - RNA, 16 nt, Human
gagccagaaccuggag

SEQ ID NO: 2381040 - RNA, 21 nt, Human
gagccagaaccuggagggcua

SEQ ID NO: 2381041 - RNA, 15 nt, Human
gagccacuccucuga

SEQ ID NO: 2381042 - RNA, 14 nt, Human
gagccacuccucug

SEQ ID NO: 2381043 - RNA, 22 nt, Human
gagccacugcaccgggccacag

SEQ ID NO: 2381044 - RNA, 13 nt, Human
gagcccaggccuc

SEQ ID NO: 2381045 - RNA, 14 nt, Human
gagcccaggccucc

SEQ ID NO: 2381046 - RNA, 14 nt, Human
gagcccaagggaau

SEQ ID NO: 2381047 - RNA, 16 nt, Human
gagccauuuugugaau

SEQ ID NO: 2381048 - RNA, 21 nt, Human
gagccauuuugugaauggauu

SEQ ID NO: 2381049 - RNA, 13 nt, Human
gagcccaggcggg

SEQ ID NO: 2381050 - RNA, 15 nt, Human
gagcccaggcgggag

SEQ ID NO: 2381051 - RNA, 12 nt, Human
gagcccacgccc

SEQ ID NO: 2381052 - RNA, 15 nt, Human
gagcccacgccccca

SEQ ID NO: 2381053 - RNA, 16 nt, Human
gagcccacgcccccac

SEQ ID NO: 2381054 - RNA, 12 nt, Human
gagcccaggccu

SEQ ID NO: 2381055 - RNA, 14 nt, Human
gagccacuaacuag

SEQ ID NO: 2381056 - RNA, 20 nt, Human
gagccaccgugccuggccac

SEQ ID NO: 2381057 - RNA, 18 nt, Human
gagcaggcggugggcacc

SEQ ID NO: 2381058 - RNA, 22 nt, Human
gagcaggcggugggcacccacc

SEQ ID NO: 2381059 - RNA, 14 nt, Human
gagccaccaugccc

SEQ ID NO: 2381060 - RNA, 18 nt, Human
gagccaccgcgcccagcc

SEQ ID NO: 2381061 - RNA, 14 nt, Human
gagccaccgugccu

SEQ ID NO: 2381062 - RNA, 19 nt, Human
gagcaggcacauggaggag

SEQ ID NO: 2381063 - RNA, 19 nt, Human
gagcaggccuugcgcuguu

SEQ ID NO: 2381064 - RNA, 21 nt, Human
gagcaggcuacugucagcucc

SEQ ID NO: 2381065 - RNA, 15 nt, Human
gagcaggcacaugga

SEQ ID NO: 2381066 - RNA, 17 nt, Human
gagcaggaggccccugg

SEQ ID NO: 2381067 - RNA, 21 nt, Human
gagcaggaggccccuggccca

SEQ ID NO: 2381068 - RNA, 20 nt, Human
gagcaggagauugagaagga

SEQ ID NO: 2381069 - RNA, 22 nt, Human
gagcaggagauugagaaggaga

SEQ ID NO: 2381070 - RNA, 23 nt, Human
gagcaggagauugagaaggagag

SEQ ID NO: 2381071 - RNA, 16 nt, Human
gagcaggaggccccug

SEQ ID NO: 2381072 - RNA, 16 nt, Human
gagcagcagugaaaac

SEQ ID NO: 2381073 - RNA, 17 nt, Human
gagcagcagugaaaaca

SEQ ID NO: 2381074 - RNA, 19 nt, Human
gagcaggacucuauuuuaa

SEQ ID NO: 2381075 - RNA, 18 nt, Human
gagcaggagauugagaag

SEQ ID NO: 2381076 - RNA, 13 nt, Human
gagcacuggguug

SEQ ID NO: 2381077 - RNA, 23 nt, Human
gagcaccugcuucaugcucagcc

SEQ ID NO: 2381078 - RNA, 20 nt, Human
gagcacuggagugcagggag

SEQ ID NO: 2381079 - RNA, 14 nt, Human
gagcacuggagugc

SEQ ID NO: 2381080 - RNA, 12 nt, Human
gagcaccugcuu

SEQ ID NO: 2381081 - RNA, 17 nt, Human
gagcacuggguugacuu

SEQ ID NO: 2381082 - RNA, 16 nt, Human
gagcacuuaagagaau

SEQ ID NO: 2381083 - RNA, 15 nt, Human
gagcacuuaagagaa

SEQ ID NO: 2381084 - RNA, 14 nt, Human
gagcagacaggagg

SEQ ID NO: 2381085 - RNA, 17 nt, Human
gagcagaaguggagcug

SEQ ID NO: 2381086 - RNA, 23 nt, Human
gagcagaacggagccccaggccu

SEQ ID NO: 2381087 - RNA, 14 nt, Human
gagcacuugcugua

SEQ ID NO: 2381088 - RNA, 18 nt, Human
gagcacuuaagagaauau

SEQ ID NO: 2381089 - RNA, 19 nt, Human
gagcacuuaagagaauauu

SEQ ID NO: 2381090 - RNA, 19 nt, Human
gagcagaugcagagagcca

SEQ ID NO: 2381091 - RNA, 21 nt, Human
gagcagaugcagagagccauu

SEQ ID NO: 2381092 - RNA, 14 nt, Human
gagcagaugcagag

SEQ ID NO: 2381093 - RNA, 16 nt, Human
gagcagaugcagagag

SEQ ID NO: 2381094 - RNA, 18 nt, Human
gagcagaugcagagagcc

SEQ ID NO: 2381095 - RNA, 16 nt, Human
gagcagaggggcugaa

SEQ ID NO: 2381096 - RNA, 20 nt, Human
gagcagagucuugcuaccuc

SEQ ID NO: 2381097 - RNA, 11 nt, Human
gagcagagucu

SEQ ID NO: 2381098 - RNA, 22 nt, Human
gagcagaccaccccgccugccc

SEQ ID NO: 2381099 - RNA, 15 nt, Human
gagcagacaggagga

SEQ ID NO: 2381100 - RNA, 21 nt, Human
gagcagacaggaggaaucaug

SEQ ID NO: 2381101 - RNA, 18 nt, Human
gagcagccacauuccuga

SEQ ID NO: 2381102 - RNA, 18 nt, Human
gaggagcucaggacacua

SEQ ID NO: 2381103 - RNA, 15 nt, Human
gaggagcugcuggcu

SEQ ID NO: 2381104 - RNA, 13 nt, Human
gaggagcugcugg

SEQ ID NO: 2381105 - RNA, 12 nt, Human
gaggagcugcug

SEQ ID NO: 2381106 - RNA, 11 nt, Human
gaggagcugcu

SEQ ID NO: 2381107 - RNA, 18 nt, Human
gaggaggcaauugggaug

SEQ ID NO: 2381108 - RNA, 16 nt, Human
gaggaggaaggcaaga

SEQ ID NO: 2381109 - RNA, 14 nt, Human
gaggaggaggaggu

SEQ ID NO: 2381110 - RNA, 19 nt, Human
gaggaggaaggagagaagg

SEQ ID NO: 2381111 - RNA, 13 nt, Human
gaggaggaaggca

SEQ ID NO: 2381112 - RNA, 21 nt, Human
gaggagcuugggggaugacua

SEQ ID NO: 2381113 - RNA, 15 nt, Human
gaggagcuuggggga

SEQ ID NO: 2381114 - RNA, 20 nt, Human
gaggagggcgugacucaccc

SEQ ID NO: 2381115 - RNA, 19 nt, Human
gaggagggaugcugccuga

SEQ ID NO: 2381116 - RNA, 13 nt, Human
gaggaggccucca

SEQ ID NO: 2381117 - RNA, 21 nt, Human
gaggaggccugggggcaggga

SEQ ID NO: 2381118 - RNA, 18 nt, Human
gaggaggcuccagagggc

SEQ ID NO: 2381119 - RNA, 11 nt, Human
gaggagggaga

SEQ ID NO: 2381120 - RNA, 17 nt, Human
gaggagggagagggagg

SEQ ID NO: 2381121 - RNA, 12 nt, Human
gaggaggccacc

SEQ ID NO: 2381122 - RNA, 14 nt, Human
gaggaggccaccuc

SEQ ID NO: 2381123 - RNA, 15 nt, Human
gaggaggccaccucu

SEQ ID NO: 2381124 - RNA, 16 nt, Human
gaggaggccaccucuc

SEQ ID NO: 2381125 - RNA, 18 nt, Human
gaggaggccaccucucca

SEQ ID NO: 2381126 - RNA, 19 nt, Human
gaggaggccaccucuccaa

SEQ ID NO: 2381127 - RNA, 20 nt, Human
gaggaggccaccucuccaag

SEQ ID NO: 2381128 - RNA, 13 nt, Human
gaggacagggagg

SEQ ID NO: 2381129 - RNA, 21 nt, Human
gaggacaauucaugaacuucg

SEQ ID NO: 2381130 - RNA, 13 nt, Human
gaggacagcuguc

SEQ ID NO: 2381131 - RNA, 22 nt, Human
gaggacagggaggugaccccag

SEQ ID NO: 2381132 - RNA, 23 nt, Human
gaggacagggaggugaccccagg

SEQ ID NO: 2381133 - RNA, 17 nt, Human
gaggagcagugcaggca

SEQ ID NO: 2381134 - RNA, 14 nt, Human
gaggacagcugucc

SEQ ID NO: 2381135 - RNA, 15 nt, Human
gaggacagcuugagc

SEQ ID NO: 2381136 - RNA, 18 nt, Human
gaggacagcuugagccgg

SEQ ID NO: 2381137 - RNA, 14 nt, Human
gaggagccccagcu

SEQ ID NO: 2381138 - RNA, 15 nt, Human
gaggagccccagcua

SEQ ID NO: 2381139 - RNA, 22 nt, Human
gagcuucuuccaggugcccagc

SEQ ID NO: 2381140 - RNA, 21 nt, Human
gagcuucuguugcugccucau

SEQ ID NO: 2381141 - RNA, 22 nt, Human
gaggaaggaaacccagcucugg

SEQ ID NO: 2381142 - RNA, 14 nt, Human
gaggaaggagagaa

SEQ ID NO: 2381143 - RNA, 16 nt, Human
gaggaaggagagaagg

SEQ ID NO: 2381144 - RNA, 18 nt, Human
gaggaauaauuauuuauu

SEQ ID NO: 2381145 - RNA, 19 nt, Human
gaggaauaguugagcccca

SEQ ID NO: 2381146 - RNA, 17 nt, Human
gaggaauaauuauuuau

SEQ ID NO: 2381147 - RNA, 19 nt, Human
gaggaaggggccagaggcu

SEQ ID NO: 2381148 - RNA, 21 nt, Human
gaggaaggcaagagggggugg

SEQ ID NO: 2381149 - RNA, 16 nt, Human
gaggaaggcaggaaga

SEQ ID NO: 2381150 - RNA, 14 nt, Human
gaggaaggauugua

SEQ ID NO: 2381151 - RNA, 15 nt, Human
gaggaaggauuguaa

SEQ ID NO: 2381152 - RNA, 16 nt, Human
gaggaaggauuguaaa

SEQ ID NO: 2381153 - RNA, 13 nt, Human
gaggaaggcaaga

SEQ ID NO: 2381154 - RNA, 19 nt, Human
gaggaaucacucuugugga

SEQ ID NO: 2381155 - RNA, 23 nt, Human
gaggaauaugacggaagaacaua

SEQ ID NO: 2381156 - RNA, 21 nt, Human
gaggaauaauuauuuauuuaa

SEQ ID NO: 2381157 - RNA, 13 nt, Human
gaggaauaucaau

SEQ ID NO: 2381158 - RNA, 22 nt, Human
gaggaaucacucuuguggaugu

SEQ ID NO: 2381159 - RNA, 20 nt, Human
gaggaaucaugucaggccug

SEQ ID NO: 2381160 - RNA, 21 nt, Human
gaggaaucaugucaggccugu

SEQ ID NO: 2381161 - RNA, 22 nt, Human
gaggaaucaugucaggccugug

SEQ ID NO: 2381162 - RNA, 14 nt, Human
gaggaauccagacc

SEQ ID NO: 2381163 - RNA, 20 nt, Human
gaggaaucgaggaaccagag

SEQ ID NO: 2381164 - RNA, 15 nt, Human
gaggaauccagaccc

SEQ ID NO: 2381165 - RNA, 13 nt, Human
gaggaaugcuccc

SEQ ID NO: 2381166 - RNA, 17 nt, Human
gaggaaugaugaagcuu

SEQ ID NO: 2381167 - RNA, 21 nt, Human
gaggaaugcucccccauccuc

SEQ ID NO: 2381168 - RNA, 14 nt, Human
gaggaauggacaga

SEQ ID NO: 2381169 - RNA, 15 nt, Human
gaggaaugcuccccc

SEQ ID NO: 2381170 - RNA, 13 nt, Human
gaggaauguauau

SEQ ID NO: 2381171 - RNA, 14 nt, Human
gaggaauguauaug

SEQ ID NO: 2381172 - RNA, 12 nt, Human
gaggacaauuca

SEQ ID NO: 2381173 - RNA, 19 nt, Human
gaggacaauucaugaacuu

SEQ ID NO: 2381174 - RNA, 20 nt, Human
gaggacaauucaugaacuuc

SEQ ID NO: 2381175 - RNA, 15 nt, Human
gaggacaaccauucc

SEQ ID NO: 2381176 - RNA, 14 nt, Human
gaggaauuucaccu

SEQ ID NO: 2381177 - RNA, 22 nt, Human
gaggaauuuucuuuguguagcu

SEQ ID NO: 2381178 - RNA, 19 nt, Human
gaggagguaaugaauuaaa

SEQ ID NO: 2381179 - RNA, 18 nt, Human
gaggagguggcagcccug

SEQ ID NO: 2381180 - RNA, 15 nt, Human
gaggagguggcagcc

SEQ ID NO: 2381181 - RNA, 17 nt, Human
gaggagggcggggggca

SEQ ID NO: 2381182 - RNA, 17 nt, Human
gaggaggggccgcugcc

SEQ ID NO: 2381183 - RNA, 16 nt, Human
gaggaggggccgcugc

SEQ ID NO: 2381184 - RNA, 18 nt, Human
gaggaggggccgcugcca

SEQ ID NO: 2381185 - RNA, 17 nt, Human
gaggagguuuaggucaa

SEQ ID NO: 2381186 - RNA, 20 nt, Human
gaggagguuuggggucugcc

SEQ ID NO: 2381187 - RNA, 22 nt, Human
gaggagguggcagcccuguagg

SEQ ID NO: 2381188 - RNA, 20 nt, Human
gaggagguggcagcccugua

SEQ ID NO: 2381189 - RNA, 16 nt, Human
gaggaguuucgaggua

SEQ ID NO: 2381190 - RNA, 18 nt, Human
gaggaguucaaugaucua

SEQ ID NO: 2381191 - RNA, 19 nt, Human
gaggaguucaaugaucuag

SEQ ID NO: 2381192 - RNA, 14 nt, Human
gaggaguucaauga

SEQ ID NO: 2381193 - RNA, 15 nt, Human
gaggaguucaaugau

SEQ ID NO: 2381194 - RNA, 16 nt, Human
gaggaguucaaugauc

SEQ ID NO: 2381195 - RNA, 17 nt, Human
gaggaguucaaugaucu

SEQ ID NO: 2381196 - RNA, 23 nt, Human
gaggaguuugggguaugggagag

SEQ ID NO: 2381197 - RNA, 13 nt, Human
gaggagugaggaa

SEQ ID NO: 2381198 - RNA, 11 nt, Human
gaggaguucaa

SEQ ID NO: 2381199 - RNA, 12 nt, Human
gaggaguucaau

SEQ ID NO: 2381200 - RNA, 14 nt, Human
gaggagucuugugu

SEQ ID NO: 2381201 - RNA, 15 nt, Human
gaggaguacagguga

SEQ ID NO: 2381202 - RNA, 20 nt, Human
gaggaugucacucagaugga

SEQ ID NO: 2381203 - RNA, 15 nt, Human
gaggaugucugggcc

SEQ ID NO: 2381204 - RNA, 12 nt, Human
gaggauguucug

SEQ ID NO: 2381205 - RNA, 16 nt, Human
gaggaucacuggagcc

SEQ ID NO: 2381206 - RNA, 18 nt, Human
gaggaucacagugcugag

SEQ ID NO: 2381207 - RNA, 19 nt, Human
gaggaucacagugcugaga

SEQ ID NO: 2381208 - RNA, 23 nt, Human
gaggauaggaguucacuucaucu

SEQ ID NO: 2381209 - RNA, 20 nt, Human
gaggaguuucgagguagagu

SEQ ID NO: 2381210 - RNA, 18 nt, Human
gaggauauauuuucacuu

SEQ ID NO: 2381211 - RNA, 19 nt, Human
gaggaucacuggagcccag

SEQ ID NO: 2381212 - RNA, 20 nt, Human
gaggauggccagugucuguc

SEQ ID NO: 2381213 - RNA, 17 nt, Human
gaggaucacuggagccc

SEQ ID NO: 2381214 - RNA, 19 nt, Human
gaggaugggaaggagggag

SEQ ID NO: 2381215 - RNA, 15 nt, Human
gaggaugggaaggag

SEQ ID NO: 2381216 - RNA, 20 nt, Human
gaggauggccucugcuaagc

SEQ ID NO: 2381217 - RNA, 17 nt, Human
gaggauguucugggaca

SEQ ID NO: 2381218 - RNA, 20 nt, Human
gaggauguucugggacacag

SEQ ID NO: 2381219 - RNA, 16 nt, Human
gaggauugcuugagcu

SEQ ID NO: 2381220 - RNA, 17 nt, Human
gaggauucuaugaggca

SEQ ID NO: 2381221 - RNA, 16 nt, Human
gaggauucuaugaggc

SEQ ID NO: 2381222 - RNA, 13 nt, Human
gaggaugggcucg

SEQ ID NO: 2381223 - RNA, 14 nt, Human
gaggaugggcucgc

SEQ ID NO: 2381224 - RNA, 20 nt, Human
gaggcacacagcugcagaga

SEQ ID NO: 2381225 - RNA, 24 nt, Human
gaggcacacagcugcagagacaga

SEQ ID NO: 2381226 - RNA, 23 nt, Human
gaggcaaugucaggaacagaagg

SEQ ID NO: 2381227 - RNA, 21 nt, Human
gaggcaaugucaggaacagaa

SEQ ID NO: 2381228 - RNA, 22 nt, Human
gaggauugcuugagcccaggag

SEQ ID NO: 2381229 - RNA, 19 nt, Human
gaggauugcuugagcccag

SEQ ID NO: 2381230 - RNA, 18 nt, Human
gaggauugcuugagccca

SEQ ID NO: 2381231 - RNA, 23 nt, Human
gaggcagaagaauugaacccagg

SEQ ID NO: 2381232 - RNA, 18 nt, Human
gaggcacugaagugcuua

SEQ ID NO: 2381233 - RNA, 16 nt, Human
gaggcagaaaauugca

SEQ ID NO: 2381234 - RNA, 20 nt, Human
gaggcagaaaauugcacaau

SEQ ID NO: 2381235 - RNA, 16 nt, Human
gaggcagacagcagcu

SEQ ID NO: 2381236 - RNA, 15 nt, Human
gaggcagacagcagc

SEQ ID NO: 2381237 - RNA, 12 nt, Human
gaggcagacagc

SEQ ID NO: 2381238 - RNA, 13 nt, Human
gaggcagccccau

SEQ ID NO: 2381239 - RNA, 22 nt, Human
gaggcagcagugugaggccagg

SEQ ID NO: 2381240 - RNA, 21 nt, Human
gaggcagcagugugaggccag

SEQ ID NO: 2381241 - RNA, 20 nt, Human
gaggcagcagugugaggcca

SEQ ID NO: 2381242 - RNA, 13 nt, Human
gaggcagcagugu

SEQ ID NO: 2381243 - RNA, 23 nt, Human
gaggcagccccauucugccugcc

SEQ ID NO: 2381244 - RNA, 21 nt, Human
gaggcagcgugaaagcagaug

SEQ ID NO: 2381245 - RNA, 23 nt, Human
gaggcagcgugaaagcagaugag

SEQ ID NO: 2381246 - RNA, 22 nt, Human
gaggcagccccauucugccugc

SEQ ID NO: 2381247 - RNA, 23 nt, Human
gaggcaggaggauugcuugagcc

SEQ ID NO: 2381248 - RNA, 12 nt, Human
gaggccagccuu

SEQ ID NO: 2381249 - RNA, 22 nt, Human
gaggccaggaguuugagaccag

SEQ ID NO: 2381250 - RNA, 12 nt, Human
gaggccaggagu

SEQ ID NO: 2381251 - RNA, 15 nt, Human
gaggccagggcagag

SEQ ID NO: 2381252 - RNA, 13 nt, Human
gaggccagggcag

SEQ ID NO: 2381253 - RNA, 13 nt, Human
gaggccagccuug

SEQ ID NO: 2381254 - RNA, 18 nt, Human
gagggaccucucccaggg

SEQ ID NO: 2381255 - RNA, 17 nt, Human
gagggaccucucccagg

SEQ ID NO: 2381256 - RNA, 15 nt, Human
gagggacgccugggg

SEQ ID NO: 2381257 - RNA, 14 nt, Human
gagggacgccuggg

SEQ ID NO: 2381258 - RNA, 15 nt, Human
gagggaccucuccca

SEQ ID NO: 2381259 - RNA, 14 nt, Human
gagggaccucuccc

SEQ ID NO: 2381260 - RNA, 13 nt, Human
gagggaccucucc

SEQ ID NO: 2381261 - RNA, 16 nt, Human
gagggaccagccaaga

SEQ ID NO: 2381262 - RNA, 12 nt, Human
gagggaccagcc

SEQ ID NO: 2381263 - RNA, 14 nt, Human
gagggacucugaag

SEQ ID NO: 2381264 - RNA, 23 nt, Human
gagggacgccugggggugccagg

SEQ ID NO: 2381265 - RNA, 16 nt, Human
gagggacgccuggggg

SEQ ID NO: 2381266 - RNA, 22 nt, Human
gagggacucugaagccucuggg

SEQ ID NO: 2381267 - RNA, 23 nt, Human
gagggacucugaagccucuggga

SEQ ID NO: 2381268 - RNA, 18 nt, Human
gagggacucugaagccuc

SEQ ID NO: 2381269 - RNA, 19 nt, Human
gagggacucugaagccucu

SEQ ID NO: 2381270 - RNA, 20 nt, Human
gagggacucugaagccucug

SEQ ID NO: 2381271 - RNA, 21 nt, Human
gagggacucugaagccucugg

SEQ ID NO: 2381272 - RNA, 14 nt, Human
gagggagggagggc

SEQ ID NO: 2381273 - RNA, 17 nt, Human
gagggaggcaagcccug

SEQ ID NO: 2381274 - RNA, 13 nt, Human
gagggagaagaag

SEQ ID NO: 2381275 - RNA, 15 nt, Human
gagggagggagggcu

SEQ ID NO: 2381276 - RNA, 15 nt, Human
gagggagggcuccag

SEQ ID NO: 2381277 - RNA, 18 nt, Human
gagggaacagacaggaga

SEQ ID NO: 2381278 - RNA, 15 nt, Human
gagggaacagacagg

SEQ ID NO: 2381279 - RNA, 19 nt, Human
gagggaacagacaggagaa

SEQ ID NO: 2381280 - RNA, 18 nt, Human
gagggaauugaggucugc

SEQ ID NO: 2381281 - RNA, 21 nt, Human
gagggaauccccgaaggugcu

SEQ ID NO: 2381282 - RNA, 16 nt, Human
gagggaaugaaccugg

SEQ ID NO: 2381283 - RNA, 19 nt, Human
gagggaccaacugggccca

SEQ ID NO: 2381284 - RNA, 18 nt, Human
gagggaccaacugggccc

SEQ ID NO: 2381285 - RNA, 17 nt, Human
gagggaccaacugggcc

SEQ ID NO: 2381286 - RNA, 22 nt, Human
gaggcuucuucagaucagugcu

SEQ ID NO: 2381287 - RNA, 15 nt, Human
gaggcuugcugagag

SEQ ID NO: 2381288 - RNA, 16 nt, Human
gaggcuucuucagauc

SEQ ID NO: 2381289 - RNA, 23 nt, Human
gaggcuucuccgccagccuccuc

SEQ ID NO: 2381290 - RNA, 19 nt, Human
gaggcuucuccgccagccu

SEQ ID NO: 2381291 - RNA, 20 nt, Human
gaggcuucuccgccagccuc

SEQ ID NO: 2381292 - RNA, 21 nt, Human
gaggcuucuccgccagccucc

SEQ ID NO: 2381293 - RNA, 22 nt, Human
gaggcuucuccgccagccuccu

SEQ ID NO: 2381294 - RNA, 15 nt, Human
gaggcuuggaaagca

SEQ ID NO: 2381295 - RNA, 20 nt, Human
gaggcuugcugagaggggcu

SEQ ID NO: 2381296 - RNA, 18 nt, Human
gaggcuugggaccgccag

SEQ ID NO: 2381297 - RNA, 18 nt, Human
gaggcuugucagagcugg

SEQ ID NO: 2381298 - RNA, 22 nt, Human
gaggcuugggaccgccagaugg

SEQ ID NO: 2381299 - RNA, 17 nt, Human
gaggcuugucagagcug

SEQ ID NO: 2381300 - RNA, 21 nt, Human
gaggcuugucagagcugggag

SEQ ID NO: 2381301 - RNA, 19 nt, Human
gaggcuugucagagcuggg

SEQ ID NO: 2381302 - RNA, 16 nt, Human
gaggcuuuggauuuga

SEQ ID NO: 2381303 - RNA, 14 nt, Human
gaggcuuuggauuu

SEQ ID NO: 2381304 - RNA, 21 nt, Human
gagggaaagcccagaaaagga

SEQ ID NO: 2381305 - RNA, 20 nt, Human
gaggcuuuggauuugacauu

SEQ ID NO: 2381306 - RNA, 14 nt, Human
gagggcagaggcug

SEQ ID NO: 2381307 - RNA, 23 nt, Human
gagggcagaaagguucugcccgg

SEQ ID NO: 2381308 - RNA, 15 nt, Human
gagggcagaggcugg

SEQ ID NO: 2381309 - RNA, 19 nt, Human
gagggcagcagaagggggu

SEQ ID NO: 2381310 - RNA, 21 nt, Human
gagggcagcagaagggggugg

SEQ ID NO: 2381311 - RNA, 22 nt, Human
gagggcagcagaaggggguggu

SEQ ID NO: 2381312 - RNA, 16 nt, Human
gagggcacugguggcc

SEQ ID NO: 2381313 - RNA, 18 nt, Human
gagggcacugguggcccg

SEQ ID NO: 2381314 - RNA, 23 nt, Human
gagggcacauuccuugccugcac

SEQ ID NO: 2381315 - RNA, 15 nt, Human
gagggcacuggagcu

SEQ ID NO: 2381316 - RNA, 17 nt, Human
gagggcagaaagguucu

SEQ ID NO: 2381317 - RNA, 20 nt, Human
gagggcagaaagguucugcc

SEQ ID NO: 2381318 - RNA, 21 nt, Human
gagggcagaaagguucugccc

SEQ ID NO: 2381319 - RNA, 22 nt, Human
gagggcagaaagguucugcccg

SEQ ID NO: 2381320 - RNA, 16 nt, Human
gagggcagaggcugga

SEQ ID NO: 2381321 - RNA, 22 nt, Human
gaggggccucuuaugggcuggg

SEQ ID NO: 2381322 - RNA, 13 nt, Human
gaggggccuggca

SEQ ID NO: 2381323 - RNA, 14 nt, Human
gaggggccuggcag

SEQ ID NO: 2381324 - RNA, 18 nt, Human
gaggggccuggcagccgu

SEQ ID NO: 2381325 - RNA, 20 nt, Human
gaggggccuggcagccgugc

SEQ ID NO: 2381326 - RNA, 12 nt, Human
gagggcacuggu

SEQ ID NO: 2381327 - RNA, 15 nt, Human
gagggagguguuuaa

SEQ ID NO: 2381328 - RNA, 18 nt, Human
gagggagguguuuaaaga

SEQ ID NO: 2381329 - RNA, 23 nt, Human
gagggagguguuuaaagagaggu

SEQ ID NO: 2381330 - RNA, 20 nt, Human
gagggcacauuccuugccug

SEQ ID NO: 2381331 - RNA, 23 nt, Human
gagggcacagaaaauggaagaca

SEQ ID NO: 2381332 - RNA, 14 nt, Human
gagggcacagaaaa

SEQ ID NO: 2381333 - RNA, 22 nt, Human
gagggcacagaaaauggaagac

SEQ ID NO: 2381334 - RNA, 13 nt, Human
gagggagugacag

SEQ ID NO: 2381335 - RNA, 14 nt, Human
gagggagguaagga

SEQ ID NO: 2381336 - RNA, 14 nt, Human
gagggagugacaga

SEQ ID NO: 2381337 - RNA, 16 nt, Human
gagggagggcuccaga

SEQ ID NO: 2381338 - RNA, 15 nt, Human
gaggcccccagccca

SEQ ID NO: 2381339 - RNA, 19 nt, Human
gaggccagggcagagugag

SEQ ID NO: 2381340 - RNA, 14 nt, Human
gaggccaggugcag

SEQ ID NO: 2381341 - RNA, 16 nt, Human
gaggcccccagcccag

SEQ ID NO: 2381342 - RNA, 17 nt, Human
gaggcccccagcccagg

SEQ ID NO: 2381343 - RNA, 19 nt, Human
gaggcccccagcccagggc

SEQ ID NO: 2381344 - RNA, 20 nt, Human
gaggcccccagcccagggcu

SEQ ID NO: 2381345 - RNA, 20 nt, Human
gaggccccugucucagggug

SEQ ID NO: 2381346 - RNA, 13 nt, Human
gaggccccuggac

SEQ ID NO: 2381347 - RNA, 15 nt, Human
gaggccccuggccca

SEQ ID NO: 2381348 - RNA, 19 nt, Human
gaggccccuucuagguggc

SEQ ID NO: 2381349 - RNA, 20 nt, Human
gaggccccuucuagguggca

SEQ ID NO: 2381350 - RNA, 24 nt, Human
gaggccccuauguaguccgugcug

SEQ ID NO: 2381351 - RNA, 17 nt, Human
gaggccaguaccuuucc

SEQ ID NO: 2381352 - RNA, 21 nt, Human
gaggcccccagcccagggcuc

SEQ ID NO: 2381353 - RNA, 22 nt, Human
gaggccccuauguaguccgugc

SEQ ID NO: 2381354 - RNA, 20 nt, Human
gaggcccgcaugcggcccag

SEQ ID NO: 2381355 - RNA, 13 nt, Human
gaggcccggccuc

SEQ ID NO: 2381356 - RNA, 17 nt, Human
gaggcccucgcugccag

SEQ ID NO: 2381357 - RNA, 16 nt, Human
gaggcccucgggccca

SEQ ID NO: 2381358 - RNA, 17 nt, Human
gaggcccucuggagugg

SEQ ID NO: 2381359 - RNA, 21 nt, Human
gaggcccucgggcccagcccc

SEQ ID NO: 2381360 - RNA, 19 nt, Human
gaggcccucuggaguggcc

SEQ ID NO: 2381361 - RNA, 17 nt, Human
gaggcccucgggcccag

SEQ ID NO: 2381362 - RNA, 18 nt, Human
gaggcccucgggcccagc

SEQ ID NO: 2381363 - RNA, 19 nt, Human
gaggcccucgggcccagcc

SEQ ID NO: 2381364 - RNA, 20 nt, Human
gaggcccucgggcccagccc

SEQ ID NO: 2381365 - RNA, 19 nt, Human
gaggccgggugcucagggc

SEQ ID NO: 2381366 - RNA, 16 nt, Human
gaggccggggccgggu

SEQ ID NO: 2381367 - RNA, 15 nt, Human
gaggccgcuagaggc

SEQ ID NO: 2381368 - RNA, 20 nt, Human
gaggccgcuagaggccugag

SEQ ID NO: 2381369 - RNA, 22 nt, Human
gaggccgcuagaggccugagga

SEQ ID NO: 2381370 - RNA, 20 nt, Human
gaggccugagcgcuccugcc

SEQ ID NO: 2381371 - RNA, 13 nt, Human
gaggccugaggau

SEQ ID NO: 2381372 - RNA, 20 nt, Human
gaggccugaggaugagcugg

SEQ ID NO: 2381373 - RNA, 21 nt, Human
gaggccugaggaugagcugga

SEQ ID NO: 2381374 - RNA, 22 nt, Human
gaggccugaggaugagcuggaa

SEQ ID NO: 2381375 - RNA, 21 nt, Human
gaggccugccuccagggcugg

SEQ ID NO: 2381376 - RNA, 22 nt, Human
gaggccugccuccagggcugga

SEQ ID NO: 2381377 - RNA, 13 nt, Human
gaggccuggacuu

SEQ ID NO: 2381378 - RNA, 18 nt, Human
gaggccuggacuuuccug

SEQ ID NO: 2381379 - RNA, 19 nt, Human
gaggccugccuccagggcu

SEQ ID NO: 2381380 - RNA, 20 nt, Human
gaggccugccuccagggcug

SEQ ID NO: 2381381 - RNA, 12 nt, Human
gaggccugcccg

SEQ ID NO: 2381382 - RNA, 13 nt, Human
gaggccugcccgg

SEQ ID NO: 2381383 - RNA, 16 nt, Human
gaggccugcccgggcg

SEQ ID NO: 2381384 - RNA, 20 nt, Human
gaggccugcccucagggauc

SEQ ID NO: 2381385 - RNA, 24 nt, Human
gaggcccuucucuccagccccugg

SEQ ID NO: 2381386 - RNA, 14 nt, Human
gaggcccuucucuc

SEQ ID NO: 2381387 - RNA, 23 nt, Human
gaggcccuucucuccagccccug

SEQ ID NO: 2381388 - RNA, 18 nt, Human
gaggccuuaucauucauu

SEQ ID NO: 2381389 - RNA, 21 nt, Human
gaggccugggccgcugccacg

SEQ ID NO: 2381390 - RNA, 22 nt, Human
gaggccugggccgcugccacgu

SEQ ID NO: 2381391 - RNA, 17 nt, Human
gaggccuggccaggcac

SEQ ID NO: 2381392 - RNA, 19 nt, Human
gaggccuggacuuuccugc

SEQ ID NO: 2381393 - RNA, 20 nt, Human
gaggccuggacuuuccugca

SEQ ID NO: 2381394 - RNA, 23 nt, Human
gaggccugcccucagggaucuug

SEQ ID NO: 2381395 - RNA, 18 nt, Human
gaggccuggaguaacaca

SEQ ID NO: 2381396 - RNA, 13 nt, Human
gaggccuggccag

SEQ ID NO: 2381397 - RNA, 14 nt, Human
gaggccuggccagg

SEQ ID NO: 2381398 - RNA, 14 nt, Human
gaggccugggccgc

SEQ ID NO: 2381399 - RNA, 15 nt, Human
gaggccuggccaggc

SEQ ID NO: 2381400 - RNA, 16 nt, Human
gaggccuggccaggca

SEQ ID NO: 2381401 - RNA, 16 nt, Human
gaggccugggccgcug

SEQ ID NO: 2381402 - RNA, 20 nt, Human
gaggccugggccgcugccac

SEQ ID NO: 2381403 - RNA, 15 nt, Human
gaggcgggagaauca

SEQ ID NO: 2381404 - RNA, 20 nt, Human
gaggcgggagaaucauguga

SEQ ID NO: 2381405 - RNA, 13 nt, Human
gaggcgggccagc

SEQ ID NO: 2381406 - RNA, 14 nt, Human
gaggcgggccagcc

SEQ ID NO: 2381407 - RNA, 19 nt, Human
gaggcggguggaucaccug

SEQ ID NO: 2381408 - RNA, 12 nt, Human
gaggcgggugga

SEQ ID NO: 2381409 - RNA, 15 nt, Human
gaggcgggccagcca

SEQ ID NO: 2381410 - RNA, 16 nt, Human
gaggcgggccagccag

SEQ ID NO: 2381411 - RNA, 17 nt, Human
gaggcgggccagccagg

SEQ ID NO: 2381412 - RNA, 19 nt, Human
gaggcgggccagccaggcg

SEQ ID NO: 2381413 - RNA, 20 nt, Human
gaggcggagcuugcagugag

SEQ ID NO: 2381414 - RNA, 20 nt, Human
gaggccuuaucauucauucu

SEQ ID NO: 2381415 - RNA, 19 nt, Human
gaggcggagaguacaguga

SEQ ID NO: 2381416 - RNA, 19 nt, Human
gaggcggaucuuuggacag

SEQ ID NO: 2381417 - RNA, 14 nt, Human
gaggccuucucuga

SEQ ID NO: 2381418 - RNA, 17 nt, Human
gaggcuguucccaccag

SEQ ID NO: 2381419 - RNA, 15 nt, Human
gaggcugggcucccu

SEQ ID NO: 2381420 - RNA, 22 nt, Human
gaggcuuagcuuugcucugcca

SEQ ID NO: 2381421 - RNA, 16 nt, Human
gaggcuuccagagagu

SEQ ID NO: 2381422 - RNA, 20 nt, Human
gaggcuuccagagaguccuc

SEQ ID NO: 2381423 - RNA, 21 nt, Human
gaggcuuccagagaguccucu

SEQ ID NO: 2381424 - RNA, 22 nt, Human
gaggcuuccagagaguccucug

SEQ ID NO: 2381425 - RNA, 14 nt, Human
gaggcuuccuucau

SEQ ID NO: 2381426 - RNA, 15 nt, Human
gaggcuucuccgcca

SEQ ID NO: 2381427 - RNA, 18 nt, Human
gaggcuucuccgccagcc

SEQ ID NO: 2381428 - RNA, 23 nt, Human
gaggcuuccagagaguccucugg

SEQ ID NO: 2381429 - RNA, 13 nt, Human
gaggcuuccugcg

SEQ ID NO: 2381430 - RNA, 15 nt, Human
gaggcuuccugcguc

SEQ ID NO: 2381431 - RNA, 21 nt, Human
gaggcuuccugcguccuccuc

SEQ ID NO: 2381432 - RNA, 19 nt, Human
gaggcggguggaucacuug

SEQ ID NO: 2381433 - RNA, 20 nt, Human
gaggcgggccagccaggcgg

SEQ ID NO: 2381434 - RNA, 23 nt, Human
gaggcuaaauuacucaggaagaa

SEQ ID NO: 2381435 - RNA, 13 nt, Human
gaggcugggcucc

SEQ ID NO: 2381436 - RNA, 14 nt, Human
gaggcugggcuccc

SEQ ID NO: 2381437 - RNA, 22 nt, Human
cuaugaggaauaauuauuuauu

SEQ ID NO: 2381438 - RNA, 23 nt, Human
cuaugaggaauaauuauuuauuu

SEQ ID NO: 2381439 - RNA, 13 nt, Human
cuaugagggccuu

SEQ ID NO: 2381440 - RNA, 16 nt, Human
cuaucuguuuacagug

SEQ ID NO: 2381441 - RNA, 20 nt, Human
cuaugauaugguaaaaguua

SEQ ID NO: 2381442 - RNA, 17 nt, Human
cuaugagggccuugagu

SEQ ID NO: 2381443 - RNA, 15 nt, Human
cuaugagggccuuga

SEQ ID NO: 2381444 - RNA, 20 nt, Human
cuaugcauaucaguugagcu

SEQ ID NO: 2381445 - RNA, 22 nt, Human
cuaugcacauauggacucugca

SEQ ID NO: 2381446 - RNA, 19 nt, Human
cuaugcauggugccccagg

SEQ ID NO: 2381447 - RNA, 13 nt, Human
cuaugcauggugc

SEQ ID NO: 2381448 - RNA, 23 nt, Human
cuaugcauggugccccaggacca

SEQ ID NO: 2381449 - RNA, 22 nt, Human
cuaugcauggugccccaggacc

SEQ ID NO: 2381450 - RNA, 21 nt, Human
cuaugcauggugccccaggac

SEQ ID NO: 2381451 - RNA, 20 nt, Human
cuaugcauggugccccagga

SEQ ID NO: 2381452 - RNA, 21 nt, Human
cuaugaucccagcacuuuggg

SEQ ID NO: 2381453 - RNA, 23 nt, Human
cuaugauauuuucugugccugaa

SEQ ID NO: 2381454 - RNA, 13 nt, Human
cuaugcacauaug

SEQ ID NO: 2381455 - RNA, 18 nt, Human
cuaugcacauauggacuc

SEQ ID NO: 2381456 - RNA, 20 nt, Human
cuaugcagagguccacaaca

SEQ ID NO: 2381457 - RNA, 20 nt, Human
cuaugcacauauggacucug

SEQ ID NO: 2381458 - RNA, 21 nt, Human
cuaugcacauauggacucugc

SEQ ID NO: 2381459 - RNA, 24 nt, Human
cuauggaugugggguccccaucau

SEQ ID NO: 2381460 - RNA, 11 nt, Human
cuauggaugug

SEQ ID NO: 2381461 - RNA, 18 nt, Human
cuauggaugugggguccc

SEQ ID NO: 2381462 - RNA, 16 nt, Human
cuauggauggcuucua

SEQ ID NO: 2381463 - RNA, 10 nt, Human
cuauggaugu

SEQ ID NO: 2381464 - RNA, 15 nt, Human
cuauggauggcuucu

SEQ ID NO: 2381465 - RNA, 14 nt, Human
cuauggauggcuuc

SEQ ID NO: 2381466 - RNA, 23 nt, Human
cuauggcuggccacugcacagag

SEQ ID NO: 2381467 - RNA, 17 nt, Human
cuauggcuggccacugc

SEQ ID NO: 2381468 - RNA, 13 nt, Human
cuauggccugugg

SEQ ID NO: 2381469 - RNA, 14 nt, Human
cuaugcugccuagg

SEQ ID NO: 2381470 - RNA, 22 nt, Human
cuaugaucccagcacuuuggga

SEQ ID NO: 2381471 - RNA, 21 nt, Human
cuaugcugguaggcuccugcc

SEQ ID NO: 2381472 - RNA, 19 nt, Human
cuaugcugccuaggcugac

SEQ ID NO: 2381473 - RNA, 17 nt, Human
cuauggaagcauauugu

SEQ ID NO: 2381474 - RNA, 19 nt, Human
cuauggacggugcuccagg

SEQ ID NO: 2381475 - RNA, 22 nt, Human
cuauggacggugcuccaggcag

SEQ ID NO: 2381476 - RNA, 23 nt, Human
cuauggacggugcuccaggcagg

SEQ ID NO: 2381477 - RNA, 18 nt, Human
cuaugggacucaaugcac

SEQ ID NO: 2381478 - RNA, 22 nt, Human
cuaugggacucaaugcacugac

SEQ ID NO: 2381479 - RNA, 15 nt, Human
cuaugggagccccag

SEQ ID NO: 2381480 - RNA, 14 nt, Human
cuaugggagcccca

SEQ ID NO: 2381481 - RNA, 13 nt, Human
cuaugggagcccc

SEQ ID NO: 2381482 - RNA, 23 nt, Human
cuaugggacucaaugcacugaca

SEQ ID NO: 2381483 - RNA, 17 nt, Human
cuaugggagccccaggg

SEQ ID NO: 2381484 - RNA, 19 nt, Human
cuaugggggcacugaggac

SEQ ID NO: 2381485 - RNA, 16 nt, Human
cuaugggagccccagg

SEQ ID NO: 2381486 - RNA, 12 nt, Human
cuauggucaucu

SEQ ID NO: 2381487 - RNA, 17 nt, Human
cuauggucgggagacag

SEQ ID NO: 2381488 - RNA, 21 nt, Human
cuauggucgggagacagcauc

SEQ ID NO: 2381489 - RNA, 19 nt, Human
cuauggugagaugcagcug

SEQ ID NO: 2381490 - RNA, 20 nt, Human
cuauggugagaugcagcugg

SEQ ID NO: 2381491 - RNA, 21 nt, Human
cuauggugagaugcagcugga

SEQ ID NO: 2381492 - RNA, 14 nt, Human
cuauggugccaaug

SEQ ID NO: 2381493 - RNA, 15 nt, Human
cuauggugccaaugg

SEQ ID NO: 2381494 - RNA, 21 nt, Human
cuauggugccaauggaaccuc

SEQ ID NO: 2381495 - RNA, 11 nt, Human
cuauucacaac

SEQ ID NO: 2381496 - RNA, 22 nt, Human
cuauucaagguggccaaauuau

SEQ ID NO: 2381497 - RNA, 13 nt, Human
cuauucagacaag

SEQ ID NO: 2381498 - RNA, 23 nt, Human
cuauucaagguggccaaauuauu

SEQ ID NO: 2381499 - RNA, 17 nt, Human
cuauucaguucccagaa

SEQ ID NO: 2381500 - RNA, 23 nt, Human
cuauucaaacagucucaggaaau

SEQ ID NO: 2381501 - RNA, 16 nt, Human
cuauucaaacagucuc

SEQ ID NO: 2381502 - RNA, 18 nt, Human
cuauucaaacagucucag

SEQ ID NO: 2381503 - RNA, 15 nt, Human
cuauuagagaagaga

SEQ ID NO: 2381504 - RNA, 17 nt, Human
cuauuaccaugagaaga

SEQ ID NO: 2381505 - RNA, 22 nt, Human
cuauguaaaugcaucuguccuc

SEQ ID NO: 2381506 - RNA, 18 nt, Human
cuauguaacaaaccugca

SEQ ID NO: 2381507 - RNA, 16 nt, Human
cuauuagccacaaaau

SEQ ID NO: 2381508 - RNA, 23 nt, Human
cuauuacugucugguuuuaacaa

SEQ ID NO: 2381509 - RNA, 14 nt, Human
cuauuagacuguag

SEQ ID NO: 2381510 - RNA, 13 nt, Human
cuauuagccaguc

SEQ ID NO: 2381511 - RNA, 16 nt, Human
cuauuagccaggauca

SEQ ID NO: 2381512 - RNA, 22 nt, Human
cuauuagccaggaucauggugu

SEQ ID NO: 2381513 - RNA, 13 nt, Human
cuauauuguacac

SEQ ID NO: 2381514 - RNA, 19 nt, Human
cuauauguuuguauaauga

SEQ ID NO: 2381515 - RNA, 21 nt, Human
cuauauguacuugucaaagaa

SEQ ID NO: 2381516 - RNA, 18 nt, Human
cuauaugugaauccucuu

SEQ ID NO: 2381517 - RNA, 18 nt, Human
cuauauuguuugcuaagc

SEQ ID NO: 2381518 - RNA, 13 nt, Human
cuauauggcaaga

SEQ ID NO: 2381519 - RNA, 19 nt, Human
cuauauggcaagaaagcug

SEQ ID NO: 2381520 - RNA, 14 nt, Human
cuauauguacuugu

SEQ ID NO: 2381521 - RNA, 21 nt, Human
cuauauguaguauaaagaaaa

SEQ ID NO: 2381522 - RNA, 12 nt, Human
cuauaugugaau

SEQ ID NO: 2381523 - RNA, 15 nt, Human
cuauagcccaggucc

SEQ ID NO: 2381524 - RNA, 17 nt, Human
cuauagccuaggugaca

SEQ ID NO: 2381525 - RNA, 20 nt, Human
cuauaggugcuacaaaaaca

SEQ ID NO: 2381526 - RNA, 22 nt, Human
cuauaggugcuacaaaaacaca

SEQ ID NO: 2381527 - RNA, 21 nt, Human
cuauaggugcuacaaaaacac

SEQ ID NO: 2381528 - RNA, 14 nt, Human
cuauauuguacaca

SEQ ID NO: 2381529 - RNA, 15 nt, Human
cuauauuguacacac

SEQ ID NO: 2381530 - RNA, 16 nt, Human
cuauauuuaacaagau

SEQ ID NO: 2381531 - RNA, 13 nt, Human
cuauauuuagauu

SEQ ID NO: 2381532 - RNA, 15 nt, Human
cuauauuuacaguga

SEQ ID NO: 2381533 - RNA, 16 nt, Human
cuauauuuacagugaa

SEQ ID NO: 2381534 - RNA, 12 nt, Human
cuauauuuacag

SEQ ID NO: 2381535 - RNA, 23 nt, Human
cuauauuuagauuguuaaaauaa

SEQ ID NO: 2381536 - RNA, 22 nt, Human
cuauauuuagauuguuaaaaua

SEQ ID NO: 2381537 - RNA, 22 nt, Human
cuauauuugggccugcuccaga

SEQ ID NO: 2381538 - RNA, 12 nt, Human
cuauauuugggc

SEQ ID NO: 2381539 - RNA, 22 nt, Human
cuaucuggucaaccuccuggac

SEQ ID NO: 2381540 - RNA, 21 nt, Human
cuaucuggucaaccuccugga

SEQ ID NO: 2381541 - RNA, 11 nt, Human
cuaucugucug

SEQ ID NO: 2381542 - RNA, 14 nt, Human
cuaucugucuggug

SEQ ID NO: 2381543 - RNA, 16 nt, Human
cuaucugucugguggc

SEQ ID NO: 2381544 - RNA, 17 nt, Human
cuaucugucugguggcc

SEQ ID NO: 2381545 - RNA, 18 nt, Human
cuaucugucugguggccc

SEQ ID NO: 2381546 - RNA, 21 nt, Human
cuaucugucugguggccccgu

SEQ ID NO: 2381547 - RNA, 14 nt, Human
cuaucuguguuuug

SEQ ID NO: 2381548 - RNA, 15 nt, Human
cuauacaacuggaca

SEQ ID NO: 2381549 - RNA, 15 nt, Human
cuauacauaucuuua

SEQ ID NO: 2381550 - RNA, 14 nt, Human
cuauacauaucuuu

SEQ ID NO: 2381551 - RNA, 22 nt, Human
cuauacauaucuuuauuaauca

SEQ ID NO: 2381552 - RNA, 20 nt, Human
cuauacauaucuuuauuaau

SEQ ID NO: 2381553 - RNA, 17 nt, Human
cuauacauaucuuuauu

SEQ ID NO: 2381554 - RNA, 12 nt, Human
cuauagacucua

SEQ ID NO: 2381555 - RNA, 19 nt, Human
cuauagacccgaggaaacu

SEQ ID NO: 2381556 - RNA, 10 nt, Human
cuauagcacc

SEQ ID NO: 2381557 - RNA, 21 nt, Human
cuauaauguaagcucuacuga

SEQ ID NO: 2381558 - RNA, 15 nt, Human
cuauaaugaagcuuu

SEQ ID NO: 2381559 - RNA, 19 nt, Human
cuauaaugaagcuuuauac

SEQ ID NO: 2381560 - RNA, 22 nt, Human
cuauaauuuaccugaagucuuu

SEQ ID NO: 2381561 - RNA, 16 nt, Human
cuauaauguaagcucu

SEQ ID NO: 2381562 - RNA, 12 nt, Human
cuauaaugaagc

SEQ ID NO: 2381563 - RNA, 22 nt, Human
cuaguggggucucccucuccug

SEQ ID NO: 2381564 - RNA, 21 nt, Human
cuaguggggucucccucuccu

SEQ ID NO: 2381565 - RNA, 20 nt, Human
cuaguggggucucccucucc

SEQ ID NO: 2381566 - RNA, 19 nt, Human
cuaguggggucucccucuc

SEQ ID NO: 2381567 - RNA, 18 nt, Human
cuaguggggucucccucu

SEQ ID NO: 2381568 - RNA, 17 nt, Human
cuaguggggucucccuc

SEQ ID NO: 2381569 - RNA, 15 nt, Human
cuaguggcuucaaaa

SEQ ID NO: 2381570 - RNA, 19 nt, Human
cuauaaucccagcacuuug

SEQ ID NO: 2381571 - RNA, 13 nt, Human
cuagugcagcuga

SEQ ID NO: 2381572 - RNA, 13 nt, Human
cuagugcuuuccu

SEQ ID NO: 2381573 - RNA, 22 nt, Human
cuagugcugugaaaaaaaaaau

SEQ ID NO: 2381574 - RNA, 22 nt, Human
cuagugcuuuccuuuuuuaaaa

SEQ ID NO: 2381575 - RNA, 21 nt, Human
cuagugcuuuccuuuuuuaaa

SEQ ID NO: 2381576 - RNA, 23 nt, Human
cuagugcuuuccuuuuuuaaaaa

SEQ ID NO: 2381577 - RNA, 14 nt, Human
cuaguggcugucca

SEQ ID NO: 2381578 - RNA, 15 nt, Human
cuaguggcuguccag

SEQ ID NO: 2381579 - RNA, 16 nt, Human
cuaguggcuguccagu

SEQ ID NO: 2381580 - RNA, 17 nt, Human
cuaguggcuguccagug

SEQ ID NO: 2381581 - RNA, 18 nt, Human
cuaguggcuguccagugc

SEQ ID NO: 2381582 - RNA, 19 nt, Human
cuaguggcuguccagugcc

SEQ ID NO: 2381583 - RNA, 20 nt, Human
cuaguggcuguccagugccc

SEQ ID NO: 2381584 - RNA, 22 nt, Human
cuaguggcuguccagugcccau

SEQ ID NO: 2381585 - RNA, 13 nt, Human
cuagugcaaauca

SEQ ID NO: 2381586 - RNA, 19 nt, Human
cuagugacuugugucccau

SEQ ID NO: 2381587 - RNA, 20 nt, Human
cuagugacuugugucccaug

SEQ ID NO: 2381588 - RNA, 16 nt, Human
cuagugcaaaucauag

SEQ ID NO: 2381589 - RNA, 13 nt, Human
cuagugcugugaa

SEQ ID NO: 2381590 - RNA, 17 nt, Human
cuagugcugugaaaaaa

SEQ ID NO: 2381591 - RNA, 14 nt, Human
cuagugcugugaaa

SEQ ID NO: 2381592 - RNA, 16 nt, Human
cuaguaaaaauacaaa

SEQ ID NO: 2381593 - RNA, 20 nt, Human
cuagguuuaacucagaucac

SEQ ID NO: 2381594 - RNA, 22 nt, Human
cuagguuuaacucagaucacua

SEQ ID NO: 2381595 - RNA, 17 nt, Human
cuaguaagugccuucca

SEQ ID NO: 2381596 - RNA, 18 nt, Human
cuaguaagugccuuccau

SEQ ID NO: 2381597 - RNA, 15 nt, Human
cuaguaagugccuuc

SEQ ID NO: 2381598 - RNA, 16 nt, Human
cuaguaagugccuucc

SEQ ID NO: 2381599 - RNA, 13 nt, Human
cuagguucuaaaa

SEQ ID NO: 2381600 - RNA, 12 nt, Human
cuagguuuaacu

SEQ ID NO: 2381601 - RNA, 14 nt, Human
cuagguuuaacuca

SEQ ID NO: 2381602 - RNA, 15 nt, Human
cuagguuuaacucag

SEQ ID NO: 2381603 - RNA, 16 nt, Human
cuagguuuaacucaga

SEQ ID NO: 2381604 - RNA, 18 nt, Human
cuagguuuaacucagauc

SEQ ID NO: 2381605 - RNA, 19 nt, Human
cuagguuuaacucagauca

SEQ ID NO: 2381606 - RNA, 16 nt, Human
cuagucagagagagug

SEQ ID NO: 2381607 - RNA, 13 nt, Human
cuagucagagaga

SEQ ID NO: 2381608 - RNA, 23 nt, Human
cuagucaagcuccuccucccugc

SEQ ID NO: 2381609 - RNA, 22 nt, Human
cuagucaagcuccuccucccug

SEQ ID NO: 2381610 - RNA, 19 nt, Human
cuagucaagcuccuccucc

SEQ ID NO: 2381611 - RNA, 16 nt, Human
cuagucaagcuccucc

SEQ ID NO: 2381612 - RNA, 15 nt, Human
cuagucaagcuccuc

SEQ ID NO: 2381613 - RNA, 16 nt, Human
cuaguacuaacuccua

SEQ ID NO: 2381614 - RNA, 16 nt, Human
cuaguaauuggaaagg

SEQ ID NO: 2381615 - RNA, 14 nt, Human
cuagucccuucccc

SEQ ID NO: 2381616 - RNA, 14 nt, Human
cuaguccagugacc

SEQ ID NO: 2381617 - RNA, 15 nt, Human
cuagucccuuccaca

SEQ ID NO: 2381618 - RNA, 18 nt, Human
cuagucagagagaguguu

SEQ ID NO: 2381619 - RNA, 13 nt, Human
cuagucauaaccu

SEQ ID NO: 2381620 - RNA, 20 nt, Human
cuagugaaacucguuaauuu

SEQ ID NO: 2381621 - RNA, 19 nt, Human
cuagugaaagaggcagcuu

SEQ ID NO: 2381622 - RNA, 18 nt, Human
cuagugaaagaggcagcu

SEQ ID NO: 2381623 - RNA, 17 nt, Human
cuagucccuuccccucc

SEQ ID NO: 2381624 - RNA, 15 nt, Human
cuagucccuuccccu

SEQ ID NO: 2381625 - RNA, 17 nt, Human
cuagugaaggcuucucu

SEQ ID NO: 2381626 - RNA, 20 nt, Human
cuagucccuuccacaccccc

SEQ ID NO: 2381627 - RNA, 21 nt, Human
cuagugaaggcuucucucugu

SEQ ID NO: 2381628 - RNA, 14 nt, Human
cuagugaaugaauc

SEQ ID NO: 2381629 - RNA, 21 nt, Human
cuagugagcagucaggaaaga

SEQ ID NO: 2381630 - RNA, 18 nt, Human
cuagugacuuguguccca

SEQ ID NO: 2381631 - RNA, 14 nt, Human
cuagugacccggag

SEQ ID NO: 2381632 - RNA, 18 nt, Human
cuagugacccggaggcca

SEQ ID NO: 2381633 - RNA, 11 nt, Human
cgccagggccc

SEQ ID NO: 2381634 - RNA, 17 nt, Human
cgccaucccagccccaa

SEQ ID NO: 2381635 - RNA, 22 nt, Human
cgcccaguuggguggaugccug

SEQ ID NO: 2381636 - RNA, 15 nt, Human
cgccaugcuccuggc

SEQ ID NO: 2381637 - RNA, 20 nt, Human
cgccaucccagccccaauga

SEQ ID NO: 2381638 - RNA, 13 nt, Human
cgccccacccaga

SEQ ID NO: 2381639 - RNA, 19 nt, Human
cgccccagauaccagcccc

SEQ ID NO: 2381640 - RNA, 20 nt, Human
cgccccagauaccagccccu

SEQ ID NO: 2381641 - RNA, 21 nt, Human
cgccccagaucaccagcccgg

SEQ ID NO: 2381642 - RNA, 22 nt, Human
cuagguaaauuacaguuccuag

SEQ ID NO: 2381643 - RNA, 13 nt, Human
cgcccauguguga

SEQ ID NO: 2381644 - RNA, 12 nt, Human
cgccccacccag

SEQ ID NO: 2381645 - RNA, 23 nt, Human
cgcccaguuggguggaugccugg

SEQ ID NO: 2381646 - RNA, 14 nt, Human
cuaggugacagagu

SEQ ID NO: 2381647 - RNA, 18 nt, Human
cuaggugacagagugaga

SEQ ID NO: 2381648 - RNA, 17 nt, Human
cuaggucagcuugcugc

SEQ ID NO: 2381649 - RNA, 15 nt, Human
cuagguaggguuuaa

SEQ ID NO: 2381650 - RNA, 14 nt, Human
cuagguacuucagg

SEQ ID NO: 2381651 - RNA, 23 nt, Human
cuaggugggccagccccucccac

SEQ ID NO: 2381652 - RNA, 21 nt, Human
cuaggugggccagccccuccc

SEQ ID NO: 2381653 - RNA, 19 nt, Human
cuaggugggccagccccuc

SEQ ID NO: 2381654 - RNA, 18 nt, Human
cuaggugggccagccccu

SEQ ID NO: 2381655 - RNA, 17 nt, Human
cuaggugggccagcccc

SEQ ID NO: 2381656 - RNA, 15 nt, Human
cuaggugggccagcc

SEQ ID NO: 2381657 - RNA, 13 nt, Human
cuaggugggccag

SEQ ID NO: 2381658 - RNA, 23 nt, Human
cuagguggcaaggcugugcuccc

SEQ ID NO: 2381659 - RNA, 18 nt, Human
cuaggugcccuuggaggc

SEQ ID NO: 2381660 - RNA, 22 nt, Human
cuaggugcccuuggaggccagc

SEQ ID NO: 2381661 - RNA, 17 nt, Human
cuagguggcaaggcugu

SEQ ID NO: 2381662 - RNA, 19 nt, Human
cuagguggcaaggcugugc

SEQ ID NO: 2381663 - RNA, 24 nt, Human
cuaggugacagagugagacucugu

SEQ ID NO: 2381664 - RNA, 12 nt, Human
cuaggucugaua

SEQ ID NO: 2381665 - RNA, 23 nt, Human
cuaggucucggacuaagccuacc

SEQ ID NO: 2381666 - RNA, 19 nt, Human
cucacccccagcuuugcua

SEQ ID NO: 2381667 - RNA, 23 nt, Human
cucacuauguugcccaggcaggu

SEQ ID NO: 2381668 - RNA, 21 nt, Human
cucacuauguugcccaggcag

SEQ ID NO: 2381669 - RNA, 22 nt, Human
cucacuauguugcccaggcagg

SEQ ID NO: 2381670 - RNA, 21 nt, Human
cucacucccuucccauaagcu

SEQ ID NO: 2381671 - RNA, 15 nt, Human
cucacucccuuccca

SEQ ID NO: 2381672 - RNA, 15 nt, Human
cucacucccagucca

SEQ ID NO: 2381673 - RNA, 13 nt, Human
cucacuccuaccu

SEQ ID NO: 2381674 - RNA, 15 nt, Human
cucacuccuaccugg

SEQ ID NO: 2381675 - RNA, 20 nt, Human
cucacuccaccacccaaaag

SEQ ID NO: 2381676 - RNA, 17 nt, Human
cucacuccaccacccaa

SEQ ID NO: 2381677 - RNA, 16 nt, Human
cucacuccaccaccca

SEQ ID NO: 2381678 - RNA, 14 nt, Human
cucacuccaccacc

SEQ ID NO: 2381679 - RNA, 12 nt, Human
cucacuccacca

SEQ ID NO: 2381680 - RNA, 13 nt, Human
cucaccccauccc

SEQ ID NO: 2381681 - RNA, 12 nt, Human
cucaccccaucc

SEQ ID NO: 2381682 - RNA, 22 nt, Human
cucacccacuuuggccuccguu

SEQ ID NO: 2381683 - RNA, 15 nt, Human
cucaccccagcccca

SEQ ID NO: 2381684 - RNA, 14 nt, Human
cucaccauguaaaa

SEQ ID NO: 2381685 - RNA, 14 nt, Human
cucaccaucugugc

SEQ ID NO: 2381686 - RNA, 23 nt, Human
cucaccaggggcaggcacagcac

SEQ ID NO: 2381687 - RNA, 20 nt, Human
cucaccaguguccccuccac

SEQ ID NO: 2381688 - RNA, 23 nt, Human
cucaccaguguccccuccacugu

SEQ ID NO: 2381689 - RNA, 24 nt, Human
cucaccaguguccccuccacuguc

SEQ ID NO: 2381690 - RNA, 17 nt, Human
cucacccccaaggggca

SEQ ID NO: 2381691 - RNA, 22 nt, Human
cucaccccaucccacacccugg

SEQ ID NO: 2381692 - RNA, 21 nt, Human
cucaccccaucccacacccug

SEQ ID NO: 2381693 - RNA, 19 nt, Human
cucaccccaucccacaccc

SEQ ID NO: 2381694 - RNA, 22 nt, Human
cucacccccaaggggcagucug

SEQ ID NO: 2381695 - RNA, 21 nt, Human
cucacccccaaggggcagucu

SEQ ID NO: 2381696 - RNA, 14 nt, Human
cucacccccagcuu

SEQ ID NO: 2381697 - RNA, 18 nt, Human
cucacccccagcuuugcu

SEQ ID NO: 2381698 - RNA, 17 nt, Human
cucacccccagcuuugc

SEQ ID NO: 2381699 - RNA, 19 nt, Human
cucacuauguugcccaggc

SEQ ID NO: 2381700 - RNA, 20 nt, Human
cucacuauguugcccaggca

SEQ ID NO: 2381701 - RNA, 16 nt, Human
cucacuccuaccuggu

SEQ ID NO: 2381702 - RNA, 17 nt, Human
cucacuccuaccuggua

SEQ ID NO: 2381703 - RNA, 12 nt, Human
cucacuccugag

SEQ ID NO: 2381704 - RNA, 22 nt, Human
cucacucccuucuaccugccac

SEQ ID NO: 2381705 - RNA, 23 nt, Human
cucacucccuucuaccugccacu

SEQ ID NO: 2381706 - RNA, 19 nt, Human
cucacuccuaccugguaau

SEQ ID NO: 2381707 - RNA, 13 nt, Human
cucacuccuugaa

SEQ ID NO: 2381708 - RNA, 12 nt, Human
cucacuccuguu

SEQ ID NO: 2381709 - RNA, 20 nt, Human
cucacuccuguuacuuaccu

SEQ ID NO: 2381710 - RNA, 14 nt, Human
cucacuccugagac

SEQ ID NO: 2381711 - RNA, 20 nt, Human
cucacuccugagaccccugg

SEQ ID NO: 2381712 - RNA, 22 nt, Human
cucacuccugagaccccuggcc

SEQ ID NO: 2381713 - RNA, 11 nt, Human
cucacuccugu

SEQ ID NO: 2381714 - RNA, 11 nt, Human
cucacucuguc

SEQ ID NO: 2381715 - RNA, 12 nt, Human
cucacucugucg

SEQ ID NO: 2381716 - RNA, 14 nt, Human
cucacucuggccuc

SEQ ID NO: 2381717 - RNA, 22 nt, Human
cucacucugucgcccagucugg

SEQ ID NO: 2381718 - RNA, 14 nt, Human
cucacucuugccaa

SEQ ID NO: 2381719 - RNA, 15 nt, Human
cucacucuggccuca

SEQ ID NO: 2381720 - RNA, 16 nt, Human
cucacucuugccaacc

SEQ ID NO: 2381721 - RNA, 13 nt, Human
cucacugaaaaca

SEQ ID NO: 2381722 - RNA, 17 nt, Human
cucacugaaaacaucug

SEQ ID NO: 2381723 - RNA, 18 nt, Human
cucacugaaaacaucugg

SEQ ID NO: 2381724 - RNA, 19 nt, Human
cucacugaaaacaucugga

SEQ ID NO: 2381725 - RNA, 13 nt, Human
cucacucugucgc

SEQ ID NO: 2381726 - RNA, 21 nt, Human
cucacucugucgcccagucug

SEQ ID NO: 2381727 - RNA, 12 nt, Human
cucacugcagcc

SEQ ID NO: 2381728 - RNA, 14 nt, Human
cucacugaaaccag

SEQ ID NO: 2381729 - RNA, 21 nt, Human
cucacugaaaacaucuggaag

SEQ ID NO: 2381730 - RNA, 22 nt, Human
cucacugagaagauugugaaua

SEQ ID NO: 2381731 - RNA, 13 nt, Human
cucacugcagccu

SEQ ID NO: 2381732 - RNA, 17 nt, Human
cucacugcaaccuccgc

SEQ ID NO: 2381733 - RNA, 13 nt, Human
cucacugccaggc

SEQ ID NO: 2381734 - RNA, 13 nt, Human
cucagagugcaag

SEQ ID NO: 2381735 - RNA, 17 nt, Human
cucagagucggaacgga

SEQ ID NO: 2381736 - RNA, 18 nt, Human
cucagaguccaggcccca

SEQ ID NO: 2381737 - RNA, 15 nt, Human
cucagaguccaggcc

SEQ ID NO: 2381738 - RNA, 18 nt, Human
cucagagucggaacggag

SEQ ID NO: 2381739 - RNA, 14 nt, Human
cucagauauuuaua

SEQ ID NO: 2381740 - RNA, 14 nt, Human
cucagagagggugg

SEQ ID NO: 2381741 - RNA, 15 nt, Human
cucagagagcaccau

SEQ ID NO: 2381742 - RNA, 13 nt, Human
cucagagagggca

SEQ ID NO: 2381743 - RNA, 15 nt, Human
cucagagagggcagg

SEQ ID NO: 2381744 - RNA, 23 nt, Human
cucagagagggcaggcaugaagu

SEQ ID NO: 2381745 - RNA, 17 nt, Human
cucagauauuuauauuu

SEQ ID NO: 2381746 - RNA, 17 nt, Human
cucagaucacuacugca

SEQ ID NO: 2381747 - RNA, 18 nt, Human
cucagaucacuacugcag

SEQ ID NO: 2381748 - RNA, 17 nt, Human
cucagaucaguguacca

SEQ ID NO: 2381749 - RNA, 20 nt, Human
cucagaucacuacugcaguc

SEQ ID NO: 2381750 - RNA, 14 nt, Human
cucagauccaggga

SEQ ID NO: 2381751 - RNA, 13 nt, Human
cucagauccaggg

SEQ ID NO: 2381752 - RNA, 10 nt, Human
cucagaucca

SEQ ID NO: 2381753 - RNA, 21 nt, Human
cucagaucaguguaccauuug

SEQ ID NO: 2381754 - RNA, 15 nt, Human
cucagauccuuguuu

SEQ ID NO: 2381755 - RNA, 22 nt, Human
cucagauccagggacagaggcc

SEQ ID NO: 2381756 - RNA, 20 nt, Human
cucagauccagggacagagg

SEQ ID NO: 2381757 - RNA, 18 nt, Human
cucagauccagggacaga

SEQ ID NO: 2381758 - RNA, 17 nt, Human
cucagauccagggacag

SEQ ID NO: 2381759 - RNA, 16 nt, Human
cucagauccagggaca

SEQ ID NO: 2381760 - RNA, 15 nt, Human
cucagauccagggac

SEQ ID NO: 2381761 - RNA, 21 nt, Human
cucacuguugcccaggcuggc

SEQ ID NO: 2381762 - RNA, 22 nt, Human
cucacuguugcccaggcuggcg

SEQ ID NO: 2381763 - RNA, 17 nt, Human
cucagacuuuggaaaau

SEQ ID NO: 2381764 - RNA, 23 nt, Human
cucagagaauuucuaccauuuca

SEQ ID NO: 2381765 - RNA, 22 nt, Human
cucacugccaggccagccuccg

SEQ ID NO: 2381766 - RNA, 22 nt, Human
cucagacuuuggaaaaugcauu

SEQ ID NO: 2381767 - RNA, 22 nt, Human
cucacugccaugccagcuuauc

SEQ ID NO: 2381768 - RNA, 19 nt, Human
cucacugccaugccagcuu

SEQ ID NO: 2381769 - RNA, 20 nt, Human
cucacuguugcccaggcugg

SEQ ID NO: 2381770 - RNA, 14 nt, Human
cucacugccaggcc

SEQ ID NO: 2381771 - RNA, 15 nt, Human
cucacugccaggcca

SEQ ID NO: 2381772 - RNA, 18 nt, Human
cucacugccaggccagcc

SEQ ID NO: 2381773 - RNA, 19 nt, Human
cucacugccaggccagccu

SEQ ID NO: 2381774 - RNA, 20 nt, Human
cucacugccaggccagccuc

SEQ ID NO: 2381775 - RNA, 21 nt, Human
cucacugccaggccagccucc

SEQ ID NO: 2381776 - RNA, 20 nt, Human
cucagcacaaggccaucugg

SEQ ID NO: 2381777 - RNA, 14 nt, Human
cucagcacaaggcc

SEQ ID NO: 2381778 - RNA, 15 nt, Human
cucagaucuucugug

SEQ ID NO: 2381779 - RNA, 17 nt, Human
cucagauccuuguuuca

SEQ ID NO: 2381780 - RNA, 19 nt, Human
cucagauccuuguuucaaa

SEQ ID NO: 2381781 - RNA, 15 nt, Human
cucagaucugucuga

SEQ ID NO: 2381782 - RNA, 17 nt, Human
cucagauuauuuuuccu

SEQ ID NO: 2381783 - RNA, 18 nt, Human
cucagaucugucugauag

SEQ ID NO: 2381784 - RNA, 19 nt, Human
cucagcagcccuccucacc

SEQ ID NO: 2381785 - RNA, 18 nt, Human
cucagcagcgaccacccc

SEQ ID NO: 2381786 - RNA, 19 nt, Human
cucagcagcgaccaccccu

SEQ ID NO: 2381787 - RNA, 20 nt, Human
cucagcagcgaccaccccug

SEQ ID NO: 2381788 - RNA, 21 nt, Human
cucagcagcccuccucacccc

SEQ ID NO: 2381789 - RNA, 18 nt, Human
cucagcagcccuccucac

SEQ ID NO: 2381790 - RNA, 17 nt, Human
cucagcagcccuccuca

SEQ ID NO: 2381791 - RNA, 16 nt, Human
cucagcagcccuccuc

SEQ ID NO: 2381792 - RNA, 15 nt, Human
cucagcagcccuccu

SEQ ID NO: 2381793 - RNA, 14 nt, Human
cucagcagcccucc

SEQ ID NO: 2381794 - RNA, 13 nt, Human
cucagcagcccuc

SEQ ID NO: 2381795 - RNA, 12 nt, Human
cucagcagcccu

SEQ ID NO: 2381796 - RNA, 16 nt, Human
cucagcauccuggcac

SEQ ID NO: 2381797 - RNA, 17 nt, Human
cucagcauccuggcacc

SEQ ID NO: 2381798 - RNA, 12 nt, Human
cucagcacuugg

SEQ ID NO: 2381799 - RNA, 12 nt, Human
cucagcaccccu

SEQ ID NO: 2381800 - RNA, 13 nt, Human
cucagcaccccuu

SEQ ID NO: 2381801 - RNA, 15 nt, Human
cucagcaccccuucc

SEQ ID NO: 2381802 - RNA, 16 nt, Human
cucagcaccccuucca

SEQ ID NO: 2381803 - RNA, 17 nt, Human
cucagcaccccuuccau

SEQ ID NO: 2381804 - RNA, 20 nt, Human
cucagcaccccuuccaugug

SEQ ID NO: 2381805 - RNA, 21 nt, Human
cucagcaccccuuccaugugg

SEQ ID NO: 2381806 - RNA, 19 nt, Human
cucaaaugcucagaccagc

SEQ ID NO: 2381807 - RNA, 15 nt, Human
cucaacaaagcacag

SEQ ID NO: 2381808 - RNA, 19 nt, Human
cucaacaaagcacaguguu

SEQ ID NO: 2381809 - RNA, 15 nt, Human
cucaacaagggagag

SEQ ID NO: 2381810 - RNA, 19 nt, Human
cucaacaagggagagaccu

SEQ ID NO: 2381811 - RNA, 22 nt, Human
cucaacaagggagagaccucau

SEQ ID NO: 2381812 - RNA, 21 nt, Human
cucaacaccucugcacaagcu

SEQ ID NO: 2381813 - RNA, 23 nt, Human
cucaacaagggagagaccucauc

SEQ ID NO: 2381814 - RNA, 20 nt, Human
cucaacacccaacugucucg

SEQ ID NO: 2381815 - RNA, 13 nt, Human
cucaaccuccugg

SEQ ID NO: 2381816 - RNA, 22 nt, Human
cucaaccuaccaccccuuccug

SEQ ID NO: 2381817 - RNA, 15 nt, Human
cucaaccuccugggc

SEQ ID NO: 2381818 - RNA, 17 nt, Human
cucaaccuccugggcua

SEQ ID NO: 2381819 - RNA, 16 nt, Human
cucaaaugcucagacc

SEQ ID NO: 2381820 - RNA, 21 nt, Human
cucaaaucuuuuagucauuau

SEQ ID NO: 2381821 - RNA, 17 nt, Human
cucaaaugacccaaaga

SEQ ID NO: 2381822 - RNA, 22 nt, Human
cucaaaucuauucagacaagca

SEQ ID NO: 2381823 - RNA, 15 nt, Human
cucaaaucuauucag

SEQ ID NO: 2381824 - RNA, 16 nt, Human
cucaaaucuauucaga

SEQ ID NO: 2381825 - RNA, 13 nt, Human
cucaaaucuauuc

SEQ ID NO: 2381826 - RNA, 19 nt, Human
cucaaaucguccagcgacc

SEQ ID NO: 2381827 - RNA, 12 nt, Human
cuauuucuaguu

SEQ ID NO: 2381828 - RNA, 21 nt, Human
cuauuuccccaggggaaaaug

SEQ ID NO: 2381829 - RNA, 22 nt, Human
cuauuuccccaggggaaaauga

SEQ ID NO: 2381830 - RNA, 23 nt, Human
cuauuuccccaggggaaaaugaa

SEQ ID NO: 2381831 - RNA, 14 nt, Human
cuauuuccauucca

SEQ ID NO: 2381832 - RNA, 17 nt, Human
cuauuuccauuccagaa

SEQ ID NO: 2381833 - RNA, 16 nt, Human
cuauuucagugccaau

SEQ ID NO: 2381834 - RNA, 15 nt, Human
cuauucucaccagga

SEQ ID NO: 2381835 - RNA, 14 nt, Human
cuauucuauugcag

SEQ ID NO: 2381836 - RNA, 17 nt, Human
cuauuccccagcagggu

SEQ ID NO: 2381837 - RNA, 14 nt, Human
cuauuccuccuggg

SEQ ID NO: 2381838 - RNA, 19 nt, Human
cuauucccacaccuccaca

SEQ ID NO: 2381839 - RNA, 20 nt, Human
cuauucccacaccuccacag

SEQ ID NO: 2381840 - RNA, 22 nt, Human
cuauucccacaccuccacaguu

SEQ ID NO: 2381841 - RNA, 18 nt, Human
cuauucaguucccagaau

SEQ ID NO: 2381842 - RNA, 21 nt, Human
cuauucaguucccagaaucaa

SEQ ID NO: 2381843 - RNA, 14 nt, Human
cuauucuccagcug

SEQ ID NO: 2381844 - RNA, 22 nt, Human
cuauuuaucuguguuuuugaaa

SEQ ID NO: 2381845 - RNA, 19 nt, Human
cuauuuaucuguguuuuug

SEQ ID NO: 2381846 - RNA, 16 nt, Human
cuauuuaucuguguuu

SEQ ID NO: 2381847 - RNA, 21 nt, Human
cuauuuaucuguaguaaacua

SEQ ID NO: 2381848 - RNA, 23 nt, Human
cuauuuagcaugacaagccccag

SEQ ID NO: 2381849 - RNA, 17 nt, Human
cuauuuauauguacaug

SEQ ID NO: 2381850 - RNA, 11 nt, Human
cuauuuaugaa

SEQ ID NO: 2381851 - RNA, 23 nt, Human
cuauuuaguuuuuguaauuuauu

SEQ ID NO: 2381852 - RNA, 22 nt, Human
cuauuuaguuuuuguaauuuau

SEQ ID NO: 2381853 - RNA, 20 nt, Human
cuauuuaguuuuuguaauuu

SEQ ID NO: 2381854 - RNA, 17 nt, Human
cuauuuaguuuuuguaa

SEQ ID NO: 2381855 - RNA, 18 nt, Human
cuauuuagcaugacaagc

SEQ ID NO: 2381856 - RNA, 13 nt, Human
cuauuuagcauga

SEQ ID NO: 2381857 - RNA, 16 nt, Human
cuauuguuacucuggu

SEQ ID NO: 2381858 - RNA, 20 nt, Human
cuauuguuacucugguucuu

SEQ ID NO: 2381859 - RNA, 12 nt, Human
cuauuuaaugga

SEQ ID NO: 2381860 - RNA, 22 nt, Human
cuauuguccccuagcaaggcau

SEQ ID NO: 2381861 - RNA, 13 nt, Human
cuauugugauuug

SEQ ID NO: 2381862 - RNA, 14 nt, Human
cuauugucauuaaa

SEQ ID NO: 2381863 - RNA, 15 nt, Human
cuauugucauuaaag

SEQ ID NO: 2381864 - RNA, 14 nt, Human
cuauugugauuuga

SEQ ID NO: 2381865 - RNA, 17 nt, Human
cuauugugauuugacug

SEQ ID NO: 2381866 - RNA, 18 nt, Human
cuauugugauuugacugu

SEQ ID NO: 2381867 - RNA, 19 nt, Human
cuauugugauuugacuguu

SEQ ID NO: 2381868 - RNA, 11 nt, Human
cuauuuaaugg

SEQ ID NO: 2381869 - RNA, 20 nt, Human
cuauugugauuugacuguuu

SEQ ID NO: 2381870 - RNA, 23 nt, Human
cuauugugauuugacuguuuuua

SEQ ID NO: 2381871 - RNA, 14 nt, Human
cuauuguagagcca

SEQ ID NO: 2381872 - RNA, 16 nt, Human
cuauucucaccaggaa

SEQ ID NO: 2381873 - RNA, 12 nt, Human
cuauuguacaga

SEQ ID NO: 2381874 - RNA, 16 nt, Human
cuauuguagcauuucu

SEQ ID NO: 2381875 - RNA, 19 nt, Human
cuauugucaccagggcugg

SEQ ID NO: 2381876 - RNA, 23 nt, Human
cucacaccaggcuugccugcagg

SEQ ID NO: 2381877 - RNA, 12 nt, Human
cucacacccacc

SEQ ID NO: 2381878 - RNA, 13 nt, Human
cucacacccaccg

SEQ ID NO: 2381879 - RNA, 15 nt, Human
cucacacccaccguc

SEQ ID NO: 2381880 - RNA, 22 nt, Human
cucacacccaccguccgcccug

SEQ ID NO: 2381881 - RNA, 23 nt, Human
cucacacccaccguccgcccugc

SEQ ID NO: 2381882 - RNA, 22 nt, Human
cucacacaugagcaucaggcca

SEQ ID NO: 2381883 - RNA, 24 nt, Human
cucacacaugagcaucaggccagg

SEQ ID NO: 2381884 - RNA, 15 nt, Human
cucacaguccuuacc

SEQ ID NO: 2381885 - RNA, 16 nt, Human
cucacagccucugacc

SEQ ID NO: 2381886 - RNA, 19 nt, Human
cucacagccucugaccccu

SEQ ID NO: 2381887 - RNA, 21 nt, Human
cucacagccucugaccccucc

SEQ ID NO: 2381888 - RNA, 22 nt, Human
cucacagccucugaccccuccu

SEQ ID NO: 2381889 - RNA, 19 nt, Human
cucacaccgcgucugguga

SEQ ID NO: 2381890 - RNA, 11 nt, Human
cucacagccuc

SEQ ID NO: 2381891 - RNA, 12 nt, Human
cucacagccucu

SEQ ID NO: 2381892 - RNA, 13 nt, Human
cucacagccucug

SEQ ID NO: 2381893 - RNA, 14 nt, Human
cucacagccucuga

SEQ ID NO: 2381894 - RNA, 15 nt, Human
cucacagccucugac

SEQ ID NO: 2381895 - RNA, 19 nt, Human
cucaagaagacauggagac

SEQ ID NO: 2381896 - RNA, 23 nt, Human
cucaagaaauaaaaggaagccaa

SEQ ID NO: 2381897 - RNA, 22 nt, Human
cucaagaaauaaaaggaagcca

SEQ ID NO: 2381898 - RNA, 21 nt, Human
cucaagaaauaaaaggaagcc

SEQ ID NO: 2381899 - RNA, 23 nt, Human
cucaaccuaccaccccuuccugu

SEQ ID NO: 2381900 - RNA, 15 nt, Human
cucaagaagcaggcu

SEQ ID NO: 2381901 - RNA, 20 nt, Human
cucaagaagacauggagacu

SEQ ID NO: 2381902 - RNA, 21 nt, Human
cucaagaagacauggagacuc

SEQ ID NO: 2381903 - RNA, 22 nt, Human
cucaagaagacauggagacucc

SEQ ID NO: 2381904 - RNA, 13 nt, Human
cucaagaagcagg

SEQ ID NO: 2381905 - RNA, 14 nt, Human
cucaagaagcaggc

SEQ ID NO: 2381906 - RNA, 23 nt, Human
cucaagaagcaggcuacacugac

SEQ ID NO: 2381907 - RNA, 21 nt, Human
cucaaguccucuuuucugaga

SEQ ID NO: 2381908 - RNA, 18 nt, Human
cucaagucuucccugauc

SEQ ID NO: 2381909 - RNA, 17 nt, Human
cucaagucuucccugau

SEQ ID NO: 2381910 - RNA, 16 nt, Human
cucaagucuucccuga

SEQ ID NO: 2381911 - RNA, 17 nt, Human
cucaagugauucuccug

SEQ ID NO: 2381912 - RNA, 17 nt, Human
cucaccagccccagugc

SEQ ID NO: 2381913 - RNA, 18 nt, Human
cucaccagccccagugcc

SEQ ID NO: 2381914 - RNA, 13 nt, Human
cucaccaggaagg

SEQ ID NO: 2381915 - RNA, 14 nt, Human
cucaccaggggcag

SEQ ID NO: 2381916 - RNA, 13 nt, Human
cucaccaggggca

SEQ ID NO: 2381917 - RNA, 15 nt, Human
cucaccaggggcagg

SEQ ID NO: 2381918 - RNA, 20 nt, Human
cucaccaggggcaggcacag

SEQ ID NO: 2381919 - RNA, 21 nt, Human
cucaccaggggcaggcacagc

SEQ ID NO: 2381920 - RNA, 22 nt, Human
cucaccaggggcaggcacagca

SEQ ID NO: 2381921 - RNA, 13 nt, Human
cucaccagcccca

SEQ ID NO: 2381922 - RNA, 14 nt, Human
cucaccagccccag

SEQ ID NO: 2381923 - RNA, 15 nt, Human
cucaccagccccagu

SEQ ID NO: 2381924 - RNA, 15 nt, Human
cucacauuuauucug

SEQ ID NO: 2381925 - RNA, 19 nt, Human
cucacauuuauucugcuca

SEQ ID NO: 2381926 - RNA, 22 nt, Human
cucacauuuauucugcucacau

SEQ ID NO: 2381927 - RNA, 20 nt, Human
cucaccacuacaucacuuga

SEQ ID NO: 2381928 - RNA, 12 nt, Human
cucacauuuaug

SEQ ID NO: 2381929 - RNA, 17 nt, Human
cucacaguccuuaccag

SEQ ID NO: 2381930 - RNA, 19 nt, Human
cucacaguccuuaccagca

SEQ ID NO: 2381931 - RNA, 22 nt, Human
cucacaguccuuaccagcagag

SEQ ID NO: 2381932 - RNA, 22 nt, Human
cuccaauuaaggauuuuaugcu

SEQ ID NO: 2381933 - RNA, 20 nt, Human
cuccaauuaaggauuuuaug

SEQ ID NO: 2381934 - RNA, 17 nt, Human
cuccaauuaaggauuuu

SEQ ID NO: 2381935 - RNA, 18 nt, Human
cuccacaccauucagguc

SEQ ID NO: 2381936 - RNA, 21 nt, Human
cuccacacacagcugggcugu

SEQ ID NO: 2381937 - RNA, 20 nt, Human
cuccacaccauucaggucuu

SEQ ID NO: 2381938 - RNA, 23 nt, Human
cuccacacacagcugggcugugg

SEQ ID NO: 2381939 - RNA, 17 nt, Human
cuccacacccucuccca

SEQ ID NO: 2381940 - RNA, 13 nt, Human
cuccacauccucc

SEQ ID NO: 2381941 - RNA, 15 nt, Human
cuccaagucucagug

SEQ ID NO: 2381942 - RNA, 22 nt, Human
cuccaaaggaagucuaggagcu

SEQ ID NO: 2381943 - RNA, 14 nt, Human
cuccaaaggccccc

SEQ ID NO: 2381944 - RNA, 16 nt, Human
cuccaagucucagugg

SEQ ID NO: 2381945 - RNA, 17 nt, Human
cuccaagucucaguggc

SEQ ID NO: 2381946 - RNA, 21 nt, Human
cuccaagucucaguggcuuca

SEQ ID NO: 2381947 - RNA, 14 nt, Human
cuccaagugccaga

SEQ ID NO: 2381948 - RNA, 15 nt, Human
cuccaagugccagag

SEQ ID NO: 2381949 - RNA, 16 nt, Human
cuccaagugccagagg

SEQ ID NO: 2381950 - RNA, 18 nt, Human
cuccaagugccagaggug

SEQ ID NO: 2381951 - RNA, 19 nt, Human
cuccaagugccagaggugg

SEQ ID NO: 2381952 - RNA, 20 nt, Human
cuccaagugccagagguggg

SEQ ID NO: 2381953 - RNA, 22 nt, Human
cuccaaucccaccaacccucag

SEQ ID NO: 2381954 - RNA, 21 nt, Human
cuccaagugccagaggugggc

SEQ ID NO: 2381955 - RNA, 22 nt, Human
cuccaagugccagaggugggca

SEQ ID NO: 2381956 - RNA, 16 nt, Human
cuccaauaucagugcu

SEQ ID NO: 2381957 - RNA, 17 nt, Human
cuccaauaucagugcuc

SEQ ID NO: 2381958 - RNA, 21 nt, Human
cuccaaugcuguuaucccugc

SEQ ID NO: 2381959 - RNA, 19 nt, Human
cuccaauaucagugcucga

SEQ ID NO: 2381960 - RNA, 14 nt, Human
cuccaauccugccc

SEQ ID NO: 2381961 - RNA, 15 nt, Human
cuccaauccugcccc

SEQ ID NO: 2381962 - RNA, 16 nt, Human
cuccaauccugccccc

SEQ ID NO: 2381963 - RNA, 13 nt, Human
cuccacccuuggc

SEQ ID NO: 2381964 - RNA, 12 nt, Human
cuccacccuugg

SEQ ID NO: 2381965 - RNA, 20 nt, Human
cuccacccugucccccagcu

SEQ ID NO: 2381966 - RNA, 22 nt, Human
cuccacccugucccccagcucu

SEQ ID NO: 2381967 - RNA, 15 nt, Human
cuccacccuggccga

SEQ ID NO: 2381968 - RNA, 15 nt, Human
cuccaaaggcccccu

SEQ ID NO: 2381969 - RNA, 17 nt, Human
cuccaccaccacuggcc

SEQ ID NO: 2381970 - RNA, 13 nt, Human
cuccacccugucc

SEQ ID NO: 2381971 - RNA, 14 nt, Human
cuccacccuguccc

SEQ ID NO: 2381972 - RNA, 15 nt, Human
cuccacccugucccc

SEQ ID NO: 2381973 - RNA, 17 nt, Human
cuccacccuguccccca

SEQ ID NO: 2381974 - RNA, 18 nt, Human
cuccacccugucccccag

SEQ ID NO: 2381975 - RNA, 13 nt, Human
cuccaccacaucc

SEQ ID NO: 2381976 - RNA, 20 nt, Human
cuccaccaacccaucagaag

SEQ ID NO: 2381977 - RNA, 13 nt, Human
cuccaccaaccca

SEQ ID NO: 2381978 - RNA, 14 nt, Human
cuccacccuggccg

SEQ ID NO: 2381979 - RNA, 12 nt, Human
cuccaccaccac

SEQ ID NO: 2381980 - RNA, 15 nt, Human
cuccaccaccacugg

SEQ ID NO: 2381981 - RNA, 15 nt, Human
cuccacccugcucuc

SEQ ID NO: 2381982 - RNA, 20 nt, Human
cuccacacccucucccagga

SEQ ID NO: 2381983 - RNA, 14 nt, Human
cuccacauccuuuc

SEQ ID NO: 2381984 - RNA, 17 nt, Human
cuccacauccuccacgu

SEQ ID NO: 2381985 - RNA, 15 nt, Human
cuccacauccuccac

SEQ ID NO: 2381986 - RNA, 14 nt, Human
cuccacauccucca

SEQ ID NO: 2381987 - RNA, 22 nt, Human
cuccacauccuuucuaaacaag

SEQ ID NO: 2381988 - RNA, 13 nt, Human
cuccacaucugcc

SEQ ID NO: 2381989 - RNA, 14 nt, Human
cuccacaucugccu

SEQ ID NO: 2381990 - RNA, 15 nt, Human
cuccacaucugccuu

SEQ ID NO: 2381991 - RNA, 17 nt, Human
cuccacaucugccuuaa

SEQ ID NO: 2381992 - RNA, 12 nt, Human
cuccaccaaccc

SEQ ID NO: 2381993 - RNA, 16 nt, Human
cuccacaucugccuua

SEQ ID NO: 2381994 - RNA, 23 nt, Human
cuccaccaagccuggucagccca

SEQ ID NO: 2381995 - RNA, 13 nt, Human
cuccacccugcuc

SEQ ID NO: 2381996 - RNA, 13 nt, Human
cucauuaaaaaaa

SEQ ID NO: 2381997 - RNA, 20 nt, Human
cucauguuuucaacugccaa

SEQ ID NO: 2381998 - RNA, 18 nt, Human
cucauguuuucaacugcc

SEQ ID NO: 2381999 - RNA, 13 nt, Human
cucauguuuucca

SEQ ID NO: 2382000 - RNA, 17 nt, Human
cucauguuuuccauugu

SEQ ID NO: 2382001 - RNA, 13 nt, Human
cucaucugcuggu

SEQ ID NO: 2382002 - RNA, 17 nt, Human
cucaucugcucagcagc

SEQ ID NO: 2382003 - RNA, 17 nt, Human
cucauguuuucaacugc

SEQ ID NO: 2382004 - RNA, 16 nt, Human
cucauguuuucaacug

SEQ ID NO: 2382005 - RNA, 20 nt, Human
cucaucucuuagcuccccuc

SEQ ID NO: 2382006 - RNA, 22 nt, Human
cucaucucuuagcuccccucca

SEQ ID NO: 2382007 - RNA, 15 nt, Human
cucaucucuucuuuu

SEQ ID NO: 2382008 - RNA, 12 nt, Human
cucaucucuucu

SEQ ID NO: 2382009 - RNA, 12 nt, Human
cucaucugcugg

SEQ ID NO: 2382010 - RNA, 15 nt, Human
cucaucucuguccca

SEQ ID NO: 2382011 - RNA, 12 nt, Human
cucaucugcuca

SEQ ID NO: 2382012 - RNA, 16 nt, Human
cucauuaaugacacuu

SEQ ID NO: 2382013 - RNA, 15 nt, Human
cucauuaaugacacu

SEQ ID NO: 2382014 - RNA, 18 nt, Human
cucauguuuuccauuguu

SEQ ID NO: 2382015 - RNA, 21 nt, Human
cucauguuuuccauuguuuga

SEQ ID NO: 2382016 - RNA, 21 nt, Human
cucauuuccaagcaaguauua

SEQ ID NO: 2382017 - RNA, 17 nt, Human
cucauuugucacacacu

SEQ ID NO: 2382018 - RNA, 23 nt, Human
cucauuacuuuaccacccccaca

SEQ ID NO: 2382019 - RNA, 17 nt, Human
cucauuacuuuugaagu

SEQ ID NO: 2382020 - RNA, 20 nt, Human
cucauuugggguagcuagag

SEQ ID NO: 2382021 - RNA, 17 nt, Human
cucauuugggguagcua

SEQ ID NO: 2382022 - RNA, 18 nt, Human
cucauuugucacacacuu

SEQ ID NO: 2382023 - RNA, 20 nt, Human
cucauuuuuuuaauuuauua

SEQ ID NO: 2382024 - RNA, 16 nt, Human
cuccaaaacuccugcc

SEQ ID NO: 2382025 - RNA, 16 nt, Human
cuccaaaauaaaacuu

SEQ ID NO: 2382026 - RNA, 15 nt, Human
cuccaaaauaaaacu

SEQ ID NO: 2382027 - RNA, 15 nt, Human
cuccaaaagcacuua

SEQ ID NO: 2382028 - RNA, 16 nt, Human
cuccaaaagcacuuac

SEQ ID NO: 2382029 - RNA, 23 nt, Human
cuccaaagaggugacugggcccu

SEQ ID NO: 2382030 - RNA, 13 nt, Human
cuccaaagaaaug

SEQ ID NO: 2382031 - RNA, 21 nt, Human
cuccaaacugacucuuaagaa

SEQ ID NO: 2382032 - RNA, 12 nt, Human
cuccaaagaaau

SEQ ID NO: 2382033 - RNA, 20 nt, Human
cuccacguucaccccuccac

SEQ ID NO: 2382034 - RNA, 15 nt, Human
cuccacguucugcuc

SEQ ID NO: 2382035 - RNA, 17 nt, Human
cuccacguucugcucau

SEQ ID NO: 2382036 - RNA, 16 nt, Human
cuccacguucugcuca

SEQ ID NO: 2382037 - RNA, 15 nt, Human
cuccagccccuggau

SEQ ID NO: 2382038 - RNA, 16 nt, Human
cuccacguucaccccu

SEQ ID NO: 2382039 - RNA, 18 nt, Human
cuccacguucaccccucc

SEQ ID NO: 2382040 - RNA, 15 nt, Human
cuccaccuugcgggg

SEQ ID NO: 2382041 - RNA, 13 nt, Human
cuccaccugcucu

SEQ ID NO: 2382042 - RNA, 14 nt, Human
cuccaccugccagg

SEQ ID NO: 2382043 - RNA, 18 nt, Human
cuccaccugcucccaggc

SEQ ID NO: 2382044 - RNA, 22 nt, Human
cuccaccucuucaccccccacu

SEQ ID NO: 2382045 - RNA, 23 nt, Human
cuccacccugucccccagcucug

SEQ ID NO: 2382046 - RNA, 22 nt, Human
cuccaccugcucccaggccagu

SEQ ID NO: 2382047 - RNA, 12 nt, Human
cuccaccugcca

SEQ ID NO: 2382048 - RNA, 13 nt, Human
cuccaccugccag

SEQ ID NO: 2382049 - RNA, 20 nt, Human
cuccagccugggcaacacag

SEQ ID NO: 2382050 - RNA, 14 nt, Human
cuccagccugggca

SEQ ID NO: 2382051 - RNA, 13 nt, Human
cuccagccugggc

SEQ ID NO: 2382052 - RNA, 12 nt, Human
cuccagccuggg

SEQ ID NO: 2382053 - RNA, 14 nt, Human
cuccagcucaccag

SEQ ID NO: 2382054 - RNA, 13 nt, Human
cuccagcuucugg

SEQ ID NO: 2382055 - RNA, 19 nt, Human
cuccagcuucugguacucu

SEQ ID NO: 2382056 - RNA, 20 nt, Human
cuccagcuucugguacucuc

SEQ ID NO: 2382057 - RNA, 21 nt, Human
cuccagcuucugguacucucc

SEQ ID NO: 2382058 - RNA, 22 nt, Human
cuccagcuucugguacucuccu

SEQ ID NO: 2382059 - RNA, 12 nt, Human
cuccagcuugug

SEQ ID NO: 2382060 - RNA, 18 nt, Human
cuccagcuuguggagccc

SEQ ID NO: 2382061 - RNA, 20 nt, Human
cuccagccccuggaugcagc

SEQ ID NO: 2382062 - RNA, 18 nt, Human
cuccacguucugcucauc

SEQ ID NO: 2382063 - RNA, 20 nt, Human
cuccagccuggacccccagc

SEQ ID NO: 2382064 - RNA, 21 nt, Human
cuccagccuggacccccagcu

SEQ ID NO: 2382065 - RNA, 22 nt, Human
cuccagccuggacccccagcuu

SEQ ID NO: 2382066 - RNA, 12 nt, Human
cuccagccuggc

SEQ ID NO: 2382067 - RNA, 13 nt, Human
cuccagccuggcu

SEQ ID NO: 2382068 - RNA, 14 nt, Human
cuccagccuggcuc

SEQ ID NO: 2382069 - RNA, 16 nt, Human
cuccagccccuggaug

SEQ ID NO: 2382070 - RNA, 17 nt, Human
cuccagccccuggaugc

SEQ ID NO: 2382071 - RNA, 20 nt, Human
cuccaggaaugccuccuccc

SEQ ID NO: 2382072 - RNA, 13 nt, Human
cuccaggagagga

SEQ ID NO: 2382073 - RNA, 14 nt, Human
cuccaggagaggag

SEQ ID NO: 2382074 - RNA, 22 nt, Human
cuccaggagaggagcgggaccu

SEQ ID NO: 2382075 - RNA, 18 nt, Human
cuccaggaaccacaccac

SEQ ID NO: 2382076 - RNA, 12 nt, Human
cuccaggaacca

SEQ ID NO: 2382077 - RNA, 21 nt, Human
cuccagcuuguggagccccac

SEQ ID NO: 2382078 - RNA, 19 nt, Human
cuccagcuuguggagcccc

SEQ ID NO: 2382079 - RNA, 20 nt, Human
cuccagcuuguggagcccca

SEQ ID NO: 2382080 - RNA, 11 nt, Human
cuccaggagca

SEQ ID NO: 2382081 - RNA, 13 nt, Human
cuccaggagcagc

SEQ ID NO: 2382082 - RNA, 14 nt, Human
cuccaggagcagcc

SEQ ID NO: 2382083 - RNA, 15 nt, Human
cuccaggagcagcca

SEQ ID NO: 2382084 - RNA, 16 nt, Human
cuccaggagcagccac

SEQ ID NO: 2382085 - RNA, 17 nt, Human
cuccaggagcagccaca

SEQ ID NO: 2382086 - RNA, 15 nt, Human
cuccaucagcuguaa

SEQ ID NO: 2382087 - RNA, 18 nt, Human
cuccaucaguuagagcug

SEQ ID NO: 2382088 - RNA, 19 nt, Human
cuccaucaguuagagcuga

SEQ ID NO: 2382089 - RNA, 11 nt, Human
cuccaggcagg

SEQ ID NO: 2382090 - RNA, 21 nt, Human
cuccaggcacccuucuuuccu

SEQ ID NO: 2382091 - RNA, 19 nt, Human
cuccaggauugaagagcau

SEQ ID NO: 2382092 - RNA, 16 nt, Human
cuccaggcacccuucu

SEQ ID NO: 2382093 - RNA, 20 nt, Human
cuccaggcacccuucuuucc

SEQ ID NO: 2382094 - RNA, 18 nt, Human
cuccaggagcagccacau

SEQ ID NO: 2382095 - RNA, 23 nt, Human
cuccaggagcagccacauuccug

SEQ ID NO: 2382096 - RNA, 12 nt, Human
cuccauccugag

SEQ ID NO: 2382097 - RNA, 20 nt, Human
cuccauccacaugggagccg

SEQ ID NO: 2382098 - RNA, 12 nt, Human
cuccauccaagg

SEQ ID NO: 2382099 - RNA, 13 nt, Human
cuccauccaaggc

SEQ ID NO: 2382100 - RNA, 14 nt, Human
cuccauccaaggcc

SEQ ID NO: 2382101 - RNA, 18 nt, Human
cuccauccaaggccaggu

SEQ ID NO: 2382102 - RNA, 14 nt, Human
cucauacucaccuc

SEQ ID NO: 2382103 - RNA, 15 nt, Human
cucauacccaccccc

SEQ ID NO: 2382104 - RNA, 22 nt, Human
cucauacucaccucaccccacu

SEQ ID NO: 2382105 - RNA, 16 nt, Human
cucauaccuuuaaagg

SEQ ID NO: 2382106 - RNA, 18 nt, Human
cucauaccuuuaaaggaa

SEQ ID NO: 2382107 - RNA, 14 nt, Human
cucauacguccacc

SEQ ID NO: 2382108 - RNA, 15 nt, Human
cucauacguccacca

SEQ ID NO: 2382109 - RNA, 17 nt, Human
cucauacguccaccaug

SEQ ID NO: 2382110 - RNA, 13 nt, Human
cucauacugugcu

SEQ ID NO: 2382111 - RNA, 21 nt, Human
cucauaguaugguggcugggu

SEQ ID NO: 2382112 - RNA, 21 nt, Human
cucauagcccucacccugggg

SEQ ID NO: 2382113 - RNA, 20 nt, Human
cucauagcccucacccuggg

SEQ ID NO: 2382114 - RNA, 18 nt, Human
cucauagcauuaacuaau

SEQ ID NO: 2382115 - RNA, 16 nt, Human
cucauagcauuaacua

SEQ ID NO: 2382116 - RNA, 14 nt, Human
cucauagcauuaac

SEQ ID NO: 2382117 - RNA, 12 nt, Human
cucauagcauua

SEQ ID NO: 2382118 - RNA, 15 nt, Human
cucauagcacuuccc

SEQ ID NO: 2382119 - RNA, 17 nt, Human
cucauagcccucacccu

SEQ ID NO: 2382120 - RNA, 13 nt, Human
cucauagcccuca

SEQ ID NO: 2382121 - RNA, 20 nt, Human
cucaggugauccacccaccu

SEQ ID NO: 2382122 - RNA, 18 nt, Human
cucaggugauccacccac

SEQ ID NO: 2382123 - RNA, 19 nt, Human
cucaggugauccacccacc

SEQ ID NO: 2382124 - RNA, 16 nt, Human
cucauacccaccccca

SEQ ID NO: 2382125 - RNA, 18 nt, Human
cucauacccacccccacc

SEQ ID NO: 2382126 - RNA, 19 nt, Human
cucauacccacccccaccc

SEQ ID NO: 2382127 - RNA, 21 nt, Human
cucauacccacccccacccaa

SEQ ID NO: 2382128 - RNA, 15 nt, Human
cucaucauaaaauaa

SEQ ID NO: 2382129 - RNA, 14 nt, Human
cucaucauaaaaua

SEQ ID NO: 2382130 - RNA, 12 nt, Human
cucaucauaaaa

SEQ ID NO: 2382131 - RNA, 24 nt, Human
cucaucaguguccucuugcucaaa

SEQ ID NO: 2382132 - RNA, 17 nt, Human
cucaucacuccccucca

SEQ ID NO: 2382133 - RNA, 15 nt, Human
cucaucacuggauga

SEQ ID NO: 2382134 - RNA, 12 nt, Human
cucaucaggaug

SEQ ID NO: 2382135 - RNA, 13 nt, Human
cucaucaggauga

SEQ ID NO: 2382136 - RNA, 16 nt, Human
cucaucaggaugaacc

SEQ ID NO: 2382137 - RNA, 20 nt, Human
cucaucaggaugaacccagg

SEQ ID NO: 2382138 - RNA, 22 nt, Human
cucaucaccaacgucugugcca

SEQ ID NO: 2382139 - RNA, 14 nt, Human
cucaucaacugaau

SEQ ID NO: 2382140 - RNA, 14 nt, Human
cucaucacuccccu

SEQ ID NO: 2382141 - RNA, 15 nt, Human
cucaucacuccccuc

SEQ ID NO: 2382142 - RNA, 16 nt, Human
cucaucacuccccucc

SEQ ID NO: 2382143 - RNA, 19 nt, Human
cucauauauaucuaucuua

SEQ ID NO: 2382144 - RNA, 15 nt, Human
cucauaucaguuugc

SEQ ID NO: 2382145 - RNA, 21 nt, Human
cucauauccaguauuguuccu

SEQ ID NO: 2382146 - RNA, 23 nt, Human
cucauaguaugguggcuggguug

SEQ ID NO: 2382147 - RNA, 20 nt, Human
cucauauccccuauuuaaca

SEQ ID NO: 2382148 - RNA, 13 nt, Human
cucaucaacugaa

SEQ ID NO: 2382149 - RNA, 16 nt, Human
cucaucaacugaauga

SEQ ID NO: 2382150 - RNA, 21 nt, Human
cucaucaccaacgucugugcc

SEQ ID NO: 2382151 - RNA, 16 nt, Human
cucaucauaaaauaaa

SEQ ID NO: 2382152 - RNA, 13 nt, Human
cucaucauucucu

SEQ ID NO: 2382153 - RNA, 15 nt, Human
cucaucauucucugu

SEQ ID NO: 2382154 - RNA, 14 nt, Human
cucaucauucucug

SEQ ID NO: 2382155 - RNA, 20 nt, Human
cucaucauucucugucucau

SEQ ID NO: 2382156 - RNA, 19 nt, Human
cucaucauucucugucuca

SEQ ID NO: 2382157 - RNA, 18 nt, Human
cucaucauucucugucuc

SEQ ID NO: 2382158 - RNA, 17 nt, Human
cucaucauucucugucu

SEQ ID NO: 2382159 - RNA, 15 nt, Human
cucauccgaggcagg

SEQ ID NO: 2382160 - RNA, 14 nt, Human
cucauccgaggcag

SEQ ID NO: 2382161 - RNA, 19 nt, Human
cucaucccguguucuccuu

SEQ ID NO: 2382162 - RNA, 22 nt, Human
cucaucaggaugaacccaggac

SEQ ID NO: 2382163 - RNA, 18 nt, Human
cucaucccuaaugcugca

SEQ ID NO: 2382164 - RNA, 22 nt, Human
cucaucccgagcaccuccacau

SEQ ID NO: 2382165 - RNA, 16 nt, Human
cucaucccguguucuc

SEQ ID NO: 2382166 - RNA, 22 nt, Human
cucaucauucucugucucaucc

SEQ ID NO: 2382167 - RNA, 17 nt, Human
cucauccgaggcagggu

SEQ ID NO: 2382168 - RNA, 21 nt, Human
cucaucccuaaugcugcagau

SEQ ID NO: 2382169 - RNA, 15 nt, Human
cucauccucauaccc

SEQ ID NO: 2382170 - RNA, 24 nt, Human
cucaucucuaacagcucaggaucu

SEQ ID NO: 2382171 - RNA, 23 nt, Human
cucaucucuaacagcucaggauc

SEQ ID NO: 2382172 - RNA, 22 nt, Human
cucaucucuaacagcucaggau

SEQ ID NO: 2382173 - RNA, 20 nt, Human
cucaucucuaacagcucagg

SEQ ID NO: 2382174 - RNA, 18 nt, Human
cucaucucuaacagcuca

SEQ ID NO: 2382175 - RNA, 17 nt, Human
cucaucucucugcccaa

SEQ ID NO: 2382176 - RNA, 16 nt, Human
cucaucucucugccca

SEQ ID NO: 2382177 - RNA, 17 nt, Human
cucaucucuuagcuccc

SEQ ID NO: 2382178 - RNA, 19 nt, Human
cucaucucuuagcuccccu

SEQ ID NO: 2382179 - RNA, 22 nt, Human
cucaggaugcccagggccacuc

SEQ ID NO: 2382180 - RNA, 19 nt, Human
cucaggaugcccagggcca

SEQ ID NO: 2382181 - RNA, 16 nt, Human
cucaggaugcccaggg

SEQ ID NO: 2382182 - RNA, 19 nt, Human
cucaggauuucgugggucu

SEQ ID NO: 2382183 - RNA, 21 nt, Human
cucaggcaaggucuggccuca

SEQ ID NO: 2382184 - RNA, 14 nt, Human
cucaggcacuagcc

SEQ ID NO: 2382185 - RNA, 15 nt, Human
cucaggcacuagccu

SEQ ID NO: 2382186 - RNA, 18 nt, Human
cucaggcacuagccuuug

SEQ ID NO: 2382187 - RNA, 19 nt, Human
cucaggcacuagccuuugg

SEQ ID NO: 2382188 - RNA, 16 nt, Human
cucaggaggcugaggg

SEQ ID NO: 2382189 - RNA, 23 nt, Human
cucaggaggcugaggcaggagga

SEQ ID NO: 2382190 - RNA, 23 nt, Human
cucaggaggcugaggcagaagaa

SEQ ID NO: 2382191 - RNA, 14 nt, Human
cucaggaugcccag

SEQ ID NO: 2382192 - RNA, 15 nt, Human
cucaggaugcccagg

SEQ ID NO: 2382193 - RNA, 13 nt, Human
cucaggaucucuu

SEQ ID NO: 2382194 - RNA, 23 nt, Human
cucagggacagagacaccugcac

SEQ ID NO: 2382195 - RNA, 22 nt, Human
cucagggacagagacaccugca

SEQ ID NO: 2382196 - RNA, 14 nt, Human
cucagggacagagc

SEQ ID NO: 2382197 - RNA, 15 nt, Human
cucagggacagagcc

SEQ ID NO: 2382198 - RNA, 16 nt, Human
cucagggacagagcca

SEQ ID NO: 2382199 - RNA, 18 nt, Human
cucagggacagagccaug

SEQ ID NO: 2382200 - RNA, 19 nt, Human
cucagggacagagccaugc

SEQ ID NO: 2382201 - RNA, 12 nt, Human
cucagggaccac

SEQ ID NO: 2382202 - RNA, 21 nt, Human
cucagggacagagacaccugc

SEQ ID NO: 2382203 - RNA, 23 nt, Human
cucaggcacuagccuuuggcucu

SEQ ID NO: 2382204 - RNA, 14 nt, Human
cucaggcagcucaa

SEQ ID NO: 2382205 - RNA, 15 nt, Human
cucaggcagcucaag

SEQ ID NO: 2382206 - RNA, 22 nt, Human
cucagggauggccguuggccac

SEQ ID NO: 2382207 - RNA, 19 nt, Human
cucagggaccacagcaagg

SEQ ID NO: 2382208 - RNA, 15 nt, Human
cucagggaccacagc

SEQ ID NO: 2382209 - RNA, 16 nt, Human
cucagggaccacagca

SEQ ID NO: 2382210 - RNA, 17 nt, Human
cucagggaccacagcaa

SEQ ID NO: 2382211 - RNA, 18 nt, Human
cucagggaccacagcaag

SEQ ID NO: 2382212 - RNA, 23 nt, Human
cucaggaguuugagaccaaccug

SEQ ID NO: 2382213 - RNA, 18 nt, Human
cucaggaguuugagacca

SEQ ID NO: 2382214 - RNA, 22 nt, Human
cucaggaggcugaggcaggagg

SEQ ID NO: 2382215 - RNA, 20 nt, Human
cucaggaggcugaggcagga

SEQ ID NO: 2382216 - RNA, 20 nt, Human
cucaggaggcugaggcagaa

SEQ ID NO: 2382217 - RNA, 21 nt, Human
cucagccaugaggaguugcug

SEQ ID NO: 2382218 - RNA, 15 nt, Human
cucagccaugaggag

SEQ ID NO: 2382219 - RNA, 19 nt, Human
cucagcccacauagugaug

SEQ ID NO: 2382220 - RNA, 21 nt, Human
cucagcccacauagugauggu

SEQ ID NO: 2382221 - RNA, 18 nt, Human
cucagcauccuggcaccc

SEQ ID NO: 2382222 - RNA, 23 nt, Human
cucagcagcgaccaccccugccu

SEQ ID NO: 2382223 - RNA, 21 nt, Human
cucagcagcgaccaccccugc

SEQ ID NO: 2382224 - RNA, 18 nt, Human
cucagccaagcacagugg

SEQ ID NO: 2382225 - RNA, 20 nt, Human
cucagccaagcacaguggug

SEQ ID NO: 2382226 - RNA, 23 nt, Human
cucagccaagcacagugguggca

SEQ ID NO: 2382227 - RNA, 14 nt, Human
cucagccagagaag

SEQ ID NO: 2382228 - RNA, 16 nt, Human
cucagccagccccauc

SEQ ID NO: 2382229 - RNA, 13 nt, Human
cucagccagcacu

SEQ ID NO: 2382230 - RNA, 11 nt, Human
cucagccagca

SEQ ID NO: 2382231 - RNA, 12 nt, Human
cucagccagaga

SEQ ID NO: 2382232 - RNA, 15 nt, Human
cucagggccuggucg

SEQ ID NO: 2382233 - RNA, 16 nt, Human
cucagggccuggcuca

SEQ ID NO: 2382234 - RNA, 14 nt, Human
cucagggcuccugg

SEQ ID NO: 2382235 - RNA, 22 nt, Human
cucagggcuccugccuucuguc

SEQ ID NO: 2382236 - RNA, 23 nt, Human
cucagggcuccugccuucugucc

SEQ ID NO: 2382237 - RNA, 22 nt, Human
cucagggcuaaacgggcauugc

SEQ ID NO: 2382238 - RNA, 14 nt, Human
cucagggcuccugc

SEQ ID NO: 2382239 - RNA, 15 nt, Human
cucagggcuccugcc

SEQ ID NO: 2382240 - RNA, 16 nt, Human
cucagggcuccugccu

SEQ ID NO: 2382241 - RNA, 13 nt, Human
cucagggcuccug

SEQ ID NO: 2382242 - RNA, 14 nt, Human
cucagggccuggcu

SEQ ID NO: 2382243 - RNA, 15 nt, Human
cucagggccuggcuc

SEQ ID NO: 2382244 - RNA, 13 nt, Human
cucagggccuggc

SEQ ID NO: 2382245 - RNA, 10 nt, Human
cucagggcag

SEQ ID NO: 2382246 - RNA, 20 nt, Human
cucaggugagaagcagagga

SEQ ID NO: 2382247 - RNA, 19 nt, Human
cucaggugagaagcagagg

SEQ ID NO: 2382248 - RNA, 16 nt, Human
cucaggugagaagcag

SEQ ID NO: 2382249 - RNA, 18 nt, Human
cucagggucccugguggc

SEQ ID NO: 2382250 - RNA, 16 nt, Human
cucagggcugacacgu

SEQ ID NO: 2382251 - RNA, 17 nt, Human
cucagggcuccuggguu

SEQ ID NO: 2382252 - RNA, 15 nt, Human
cucagggcuccuggg

SEQ ID NO: 2382253 - RNA, 15 nt, Human
cucagggucccuggu

SEQ ID NO: 2382254 - RNA, 16 nt, Human
cucagggucccuggug

SEQ ID NO: 2382255 - RNA, 17 nt, Human
cucagggucccuggugg

SEQ ID NO: 2382256 - RNA, 14 nt, Human
cucccugccuccag

SEQ ID NO: 2382257 - RNA, 19 nt, Human
cucccugccgccucaaugu

SEQ ID NO: 2382258 - RNA, 18 nt, Human
cucccugccgccucaaug

SEQ ID NO: 2382259 - RNA, 16 nt, Human
cucccugccgccucaa

SEQ ID NO: 2382260 - RNA, 15 nt, Human
cucccugccgccuca

SEQ ID NO: 2382261 - RNA, 10 nt, Human
cucccugccg

SEQ ID NO: 2382262 - RNA, 16 nt, Human
cucccugccuccagga

SEQ ID NO: 2382263 - RNA, 15 nt, Human
cucccugccuccagg

SEQ ID NO: 2382264 - RNA, 17 nt, Human
cucccugccccucccuu

SEQ ID NO: 2382265 - RNA, 18 nt, Human
cucccugccccucccuuc

SEQ ID NO: 2382266 - RNA, 20 nt, Human
cucccugccccucccuucaa

SEQ ID NO: 2382267 - RNA, 21 nt, Human
cucccugccccucccuucaac

SEQ ID NO: 2382268 - RNA, 23 nt, Human
cucccugcaucugaccagcagcg

SEQ ID NO: 2382269 - RNA, 22 nt, Human
cucccugcaucugaccagcagc

SEQ ID NO: 2382270 - RNA, 14 nt, Human
cucccuaaacugua

SEQ ID NO: 2382271 - RNA, 15 nt, Human
cucccgucagggccc

SEQ ID NO: 2382272 - RNA, 16 nt, Human
cucccgucagggccca

SEQ ID NO: 2382273 - RNA, 19 nt, Human
cucccgucagggcccaagu

SEQ ID NO: 2382274 - RNA, 21 nt, Human
cucccgucagggcccaagucc

SEQ ID NO: 2382275 - RNA, 13 nt, Human
cucccugccccuc

SEQ ID NO: 2382276 - RNA, 14 nt, Human
cucccugccccucc

SEQ ID NO: 2382277 - RNA, 23 nt, Human
cucccugccccccagcccuccuu

SEQ ID NO: 2382278 - RNA, 17 nt, Human
cucccugccccccagcc

SEQ ID NO: 2382279 - RNA, 19 nt, Human
cucccgaguagcugggacu

SEQ ID NO: 2382280 - RNA, 20 nt, Human
cucccgaguagcugggacua

SEQ ID NO: 2382281 - RNA, 12 nt, Human
cuccccuugggc

SEQ ID NO: 2382282 - RNA, 13 nt, Human
cuccccuugggcg

SEQ ID NO: 2382283 - RNA, 15 nt, Human
cuccccuugggcggc

SEQ ID NO: 2382284 - RNA, 15 nt, Human
cucccggugcccaag

SEQ ID NO: 2382285 - RNA, 21 nt, Human
cucccggugcccaagaauaga

SEQ ID NO: 2382286 - RNA, 15 nt, Human
cucccgguucuucca

SEQ ID NO: 2382287 - RNA, 16 nt, Human
cucccgguucuuccag

SEQ ID NO: 2382288 - RNA, 21 nt, Human
cucccgguucuuccagugguu

SEQ ID NO: 2382289 - RNA, 14 nt, Human
cucccgucagggcc

SEQ ID NO: 2382290 - RNA, 16 nt, Human
cucccgccccuuccca

SEQ ID NO: 2382291 - RNA, 21 nt, Human
cucccgccagacuguuagaaa

SEQ ID NO: 2382292 - RNA, 18 nt, Human
cuccccuugggcggcuga

SEQ ID NO: 2382293 - RNA, 21 nt, Human
cucccgccccuuccccgaggg

SEQ ID NO: 2382294 - RNA, 15 nt, Human
cucccgggcccuccc

SEQ ID NO: 2382295 - RNA, 16 nt, Human
cucccgggcccucccu

SEQ ID NO: 2382296 - RNA, 22 nt, Human
cucccgggcccucccuuggaaa

SEQ ID NO: 2382297 - RNA, 19 nt, Human
cucccgggcccucccuugg

SEQ ID NO: 2382298 - RNA, 20 nt, Human
cucccgggcccucccuugga

SEQ ID NO: 2382299 - RNA, 15 nt, Human
cuccccuccuugccu

SEQ ID NO: 2382300 - RNA, 16 nt, Human
cuccccuccucucccc

SEQ ID NO: 2382301 - RNA, 17 nt, Human
cuccccuccucuccccu

SEQ ID NO: 2382302 - RNA, 14 nt, Human
cuccccugccauuu

SEQ ID NO: 2382303 - RNA, 13 nt, Human
cuccccugccccc

SEQ ID NO: 2382304 - RNA, 14 nt, Human
cuccccugccccca

SEQ ID NO: 2382305 - RNA, 15 nt, Human
cuccccugcccccag

SEQ ID NO: 2382306 - RNA, 16 nt, Human
cuccccugcccccagg

SEQ ID NO: 2382307 - RNA, 17 nt, Human
cuccccugcccccagga

SEQ ID NO: 2382308 - RNA, 18 nt, Human
cuccccugcccccaggac

SEQ ID NO: 2382309 - RNA, 19 nt, Human
cuccccugcccccaggacu

SEQ ID NO: 2382310 - RNA, 20 nt, Human
cuccccugcccccaggacug

SEQ ID NO: 2382311 - RNA, 21 nt, Human
cuccccugcccccaggacugg

SEQ ID NO: 2382312 - RNA, 22 nt, Human
cuccccugcccccaggacuggg

SEQ ID NO: 2382313 - RNA, 23 nt, Human
cuccccugcccccaggacugggc

SEQ ID NO: 2382314 - RNA, 13 nt, Human
cuccccugcccug

SEQ ID NO: 2382315 - RNA, 12 nt, Human
cuccccugcccu

SEQ ID NO: 2382316 - RNA, 14 nt, Human
cuccccugcccugc

SEQ ID NO: 2382317 - RNA, 19 nt, Human
cuccccuuccucacugccc

SEQ ID NO: 2382318 - RNA, 16 nt, Human
cuccccuucccugcaa

SEQ ID NO: 2382319 - RNA, 15 nt, Human
cuccccuucccugca

SEQ ID NO: 2382320 - RNA, 16 nt, Human
cuccccuugagcugag

SEQ ID NO: 2382321 - RNA, 14 nt, Human
cuccccuugagcug

SEQ ID NO: 2382322 - RNA, 11 nt, Human
cuccccuuccc

SEQ ID NO: 2382323 - RNA, 22 nt, Human
cuccccagcaagugagagcugg

SEQ ID NO: 2382324 - RNA, 23 nt, Human
cuccccagcaagugagagcuggg

SEQ ID NO: 2382325 - RNA, 13 nt, Human
cuccauccugagg

SEQ ID NO: 2382326 - RNA, 14 nt, Human
cuccauccugaggc

SEQ ID NO: 2382327 - RNA, 19 nt, Human
cuccccagcagguggggag

SEQ ID NO: 2382328 - RNA, 12 nt, Human
cuccccuccucu

SEQ ID NO: 2382329 - RNA, 19 nt, Human
cuccccagcauuccagccc

SEQ ID NO: 2382330 - RNA, 20 nt, Human
cuccccuccuccuggacucc

SEQ ID NO: 2382331 - RNA, 12 nt, Human
cuccccuccucc

SEQ ID NO: 2382332 - RNA, 16 nt, Human
cuccccagcagguggg

SEQ ID NO: 2382333 - RNA, 15 nt, Human
cuccccagcaggugg

SEQ ID NO: 2382334 - RNA, 21 nt, Human
cuccccagcaagugagagcug

SEQ ID NO: 2382335 - RNA, 16 nt, Human
cuccucauccagggcu

SEQ ID NO: 2382336 - RNA, 23 nt, Human
cuccucaggguugagguccagcc

SEQ ID NO: 2382337 - RNA, 20 nt, Human
cuccucauccagggcucuga

SEQ ID NO: 2382338 - RNA, 18 nt, Human
cuccucaggguugagguc

SEQ ID NO: 2382339 - RNA, 22 nt, Human
cuccucagggauggccguuggc

SEQ ID NO: 2382340 - RNA, 14 nt, Human
cuccucagggaugg

SEQ ID NO: 2382341 - RNA, 14 nt, Human
cuccucacccccag

SEQ ID NO: 2382342 - RNA, 21 nt, Human
cuccucacaacauggugucug

SEQ ID NO: 2382343 - RNA, 15 nt, Human
cuccuccagccgcca

SEQ ID NO: 2382344 - RNA, 17 nt, Human
cuccuccacucuccccc

SEQ ID NO: 2382345 - RNA, 15 nt, Human
cuccucccacccggc

SEQ ID NO: 2382346 - RNA, 13 nt, Human
cuccuccagaguc

SEQ ID NO: 2382347 - RNA, 15 nt, Human
cuccuccagagucag

SEQ ID NO: 2382348 - RNA, 15 nt, Human
cuccuccucccccag

SEQ ID NO: 2382349 - RNA, 14 nt, Human
cuccuccuccccca

SEQ ID NO: 2382350 - RNA, 15 nt, Human
cuccuccucccugca

SEQ ID NO: 2382351 - RNA, 15 nt, Human
cuccuccuggacucc

SEQ ID NO: 2382352 - RNA, 14 nt, Human
cuccuccuggacuc

SEQ ID NO: 2382353 - RNA, 19 nt, Human
cuccuccuggacuccugca

SEQ ID NO: 2382354 - RNA, 14 nt, Human
cuccuccucccugc

SEQ ID NO: 2382355 - RNA, 12 nt, Human
cuccuccuuccc

SEQ ID NO: 2382356 - RNA, 12 nt, Human
cuccucuccagg

SEQ ID NO: 2382357 - RNA, 13 nt, Human
cuccuccucccug

SEQ ID NO: 2382358 - RNA, 20 nt, Human
cuccuccgugcuuccucagu

SEQ ID NO: 2382359 - RNA, 21 nt, Human
cuccucucccauugucccucu

SEQ ID NO: 2382360 - RNA, 23 nt, Human
cuccucucccaucccccugcccu

SEQ ID NO: 2382361 - RNA, 15 nt, Human
cuccucucccauccc

SEQ ID NO: 2382362 - RNA, 21 nt, Human
cuccucucccaucccccugcc

SEQ ID NO: 2382363 - RNA, 13 nt, Human
cuccucuccaggc

SEQ ID NO: 2382364 - RNA, 15 nt, Human
cuccucuccaggcac

SEQ ID NO: 2382365 - RNA, 12 nt, Human
cuccucucccau

SEQ ID NO: 2382366 - RNA, 13 nt, Human
cuccucucccauc

SEQ ID NO: 2382367 - RNA, 22 nt, Human
cuccucccaggcgccccuuccc

SEQ ID NO: 2382368 - RNA, 23 nt, Human
cuccucccaggcgccccuucccc

SEQ ID NO: 2382369 - RNA, 12 nt, Human
cuccuccuagcc

SEQ ID NO: 2382370 - RNA, 12 nt, Human
cuccucccagga

SEQ ID NO: 2382371 - RNA, 19 nt, Human
cuccucccuuuuuccuugu

SEQ ID NO: 2382372 - RNA, 17 nt, Human
cuccucccaggcgcccc

SEQ ID NO: 2382373 - RNA, 20 nt, Human
cuccucccacccggcugcag

SEQ ID NO: 2382374 - RNA, 22 nt, Human
cuccucccacccggcugcagag

SEQ ID NO: 2382375 - RNA, 22 nt, Human
cuccuauucucuuaauuuuucu

SEQ ID NO: 2382376 - RNA, 14 nt, Human
cuccucaacucacc

SEQ ID NO: 2382377 - RNA, 18 nt, Human
cuccucagaucuucugug

SEQ ID NO: 2382378 - RNA, 17 nt, Human
cuccuaugaucucaggu

SEQ ID NO: 2382379 - RNA, 13 nt, Human
cuccuaucugugu

SEQ ID NO: 2382380 - RNA, 14 nt, Human
cuccuaucuguguu

SEQ ID NO: 2382381 - RNA, 15 nt, Human
cuccuaucuguguuu

SEQ ID NO: 2382382 - RNA, 18 nt, Human
cuccuaucuguguuuuga

SEQ ID NO: 2382383 - RNA, 13 nt, Human
cuccuauguguaa

SEQ ID NO: 2382384 - RNA, 22 nt, Human
cuccuauucaguucccagaauc

SEQ ID NO: 2382385 - RNA, 12 nt, Human
cuccuaugugua

SEQ ID NO: 2382386 - RNA, 15 nt, Human
cuccgcaguuccugu

SEQ ID NO: 2382387 - RNA, 12 nt, Human
cuccgccagccu

SEQ ID NO: 2382388 - RNA, 13 nt, Human
cuccgccagccuc

SEQ ID NO: 2382389 - RNA, 22 nt, Human
cuccuaucagaaguuucucagc

SEQ ID NO: 2382390 - RNA, 14 nt, Human
cuccgccagccucc

SEQ ID NO: 2382391 - RNA, 14 nt, Human
cuccuauccugguu

SEQ ID NO: 2382392 - RNA, 16 nt, Human
cuccgauccuuccucc

SEQ ID NO: 2382393 - RNA, 15 nt, Human
cuccgauccuuccuc

SEQ ID NO: 2382394 - RNA, 13 nt, Human
cuccgaggccagu

SEQ ID NO: 2382395 - RNA, 14 nt, Human
cuccgagagggaga

SEQ ID NO: 2382396 - RNA, 13 nt, Human
cuccgagaggugg

SEQ ID NO: 2382397 - RNA, 14 nt, Human
cuccgagagguggg

SEQ ID NO: 2382398 - RNA, 15 nt, Human
cuccgagaggugggc

SEQ ID NO: 2382399 - RNA, 17 nt, Human
cuccgagaggugggcca

SEQ ID NO: 2382400 - RNA, 18 nt, Human
cuccgagaggugggccag

SEQ ID NO: 2382401 - RNA, 22 nt, Human
cuccgagaggugggccagucug

SEQ ID NO: 2382402 - RNA, 16 nt, Human
cuccgagagggagaga

SEQ ID NO: 2382403 - RNA, 16 nt, Human
cucccuguccuccucg

SEQ ID NO: 2382404 - RNA, 15 nt, Human
cucccuguccuccuc

SEQ ID NO: 2382405 - RNA, 14 nt, Human
cucccuguccuccu

SEQ ID NO: 2382406 - RNA, 13 nt, Human
cucccuguccucc

SEQ ID NO: 2382407 - RNA, 11 nt, Human
cucccuguccu

SEQ ID NO: 2382408 - RNA, 21 nt, Human
cucccuguaggaagucauccu

SEQ ID NO: 2382409 - RNA, 19 nt, Human
cucccuguaaccucuucag

SEQ ID NO: 2382410 - RNA, 18 nt, Human
cucccugguucugaugau

SEQ ID NO: 2382411 - RNA, 18 nt, Human
cucccuguccuccucgga

SEQ ID NO: 2382412 - RNA, 17 nt, Human
cucccugucggccuggu

SEQ ID NO: 2382413 - RNA, 16 nt, Human
cucccuguuccccaga

SEQ ID NO: 2382414 - RNA, 19 nt, Human
cucccuguuccccagagaa

SEQ ID NO: 2382415 - RNA, 20 nt, Human
cucccuuggauuguccccga

SEQ ID NO: 2382416 - RNA, 18 nt, Human
cucccuguuccccagaga

SEQ ID NO: 2382417 - RNA, 17 nt, Human
cucccuguuccccagag

SEQ ID NO: 2382418 - RNA, 19 nt, Human
cucccuuggggccuaugca

SEQ ID NO: 2382419 - RNA, 18 nt, Human
cucccuugggcucccugu

SEQ ID NO: 2382420 - RNA, 14 nt, Human
cucccuugggcucc

SEQ ID NO: 2382421 - RNA, 13 nt, Human
cucccuugggcuc

SEQ ID NO: 2382422 - RNA, 17 nt, Human
cucccuuggguucugau

SEQ ID NO: 2382423 - RNA, 18 nt, Human
cucccuuggguucugaua

SEQ ID NO: 2382424 - RNA, 20 nt, Human
cucccuugguggcaagagcc

SEQ ID NO: 2382425 - RNA, 21 nt, Human
cucccuugguggcaagagccc

SEQ ID NO: 2382426 - RNA, 14 nt, Human
cucccuuguucucu

SEQ ID NO: 2382427 - RNA, 17 nt, Human
cucccuuguucucuaag

SEQ ID NO: 2382428 - RNA, 16 nt, Human
cuccgacugcuaggga

SEQ ID NO: 2382429 - RNA, 18 nt, Human
cucgcauaggaccuuucc

SEQ ID NO: 2382430 - RNA, 19 nt, Human
cucgcauaggaccuuucca

SEQ ID NO: 2382431 - RNA, 22 nt, Human
cucgcccgcccacuguccuggg

SEQ ID NO: 2382432 - RNA, 23 nt, Human
cucgcccgcccacuguccugggc

SEQ ID NO: 2382433 - RNA, 15 nt, Human
cucgcccugggucua

SEQ ID NO: 2382434 - RNA, 13 nt, Human
cucgcccuggguc

SEQ ID NO: 2382435 - RNA, 12 nt, Human
cucgcccugggu

SEQ ID NO: 2382436 - RNA, 20 nt, Human
cucgcccugcgguagauggg

SEQ ID NO: 2382437 - RNA, 15 nt, Human
cucgccgucugugaa

SEQ ID NO: 2382438 - RNA, 16 nt, Human
cucgccgucugugaau

SEQ ID NO: 2382439 - RNA, 15 nt, Human
cucgccuucaucucc

SEQ ID NO: 2382440 - RNA, 23 nt, Human
cucgccugacaaccacuggucug

SEQ ID NO: 2382441 - RNA, 16 nt, Human
cucgccuggccugagg

SEQ ID NO: 2382442 - RNA, 17 nt, Human
cucgccuggccugaggu

SEQ ID NO: 2382443 - RNA, 16 nt, Human
cucgcugaugcugggc

SEQ ID NO: 2382444 - RNA, 17 nt, Human
cucgcugaugcugggcu

SEQ ID NO: 2382445 - RNA, 18 nt, Human
cucgcugaugcugggcug

SEQ ID NO: 2382446 - RNA, 19 nt, Human
cucgcugaugcugggcugg

SEQ ID NO: 2382447 - RNA, 23 nt, Human
cucgcucugucgcccaggcugga

SEQ ID NO: 2382448 - RNA, 12 nt, Human
cucgcucuguca

SEQ ID NO: 2382449 - RNA, 13 nt, Human
cucgcucugucac

SEQ ID NO: 2382450 - RNA, 15 nt, Human
cucgcucugucaccc

SEQ ID NO: 2382451 - RNA, 20 nt, Human
cucgccuggccugaggucuc

SEQ ID NO: 2382452 - RNA, 22 nt, Human
cucgcuauugucaccagggcug

SEQ ID NO: 2382453 - RNA, 17 nt, Human
cucgauucauauugaau

SEQ ID NO: 2382454 - RNA, 23 nt, Human
cucgaggguuggguucaucugag

SEQ ID NO: 2382455 - RNA, 14 nt, Human
cucgauuucuccag

SEQ ID NO: 2382456 - RNA, 22 nt, Human
cucgauuuuaucuuucgcacag

SEQ ID NO: 2382457 - RNA, 20 nt, Human
cucgauuuuguaucugcagg

SEQ ID NO: 2382458 - RNA, 18 nt, Human
cucgauuuuguaucugca

SEQ ID NO: 2382459 - RNA, 19 nt, Human
cucgauuuuguaucugcag

SEQ ID NO: 2382460 - RNA, 13 nt, Human
cucgauuuuguau

SEQ ID NO: 2382461 - RNA, 14 nt, Human
cucgauuuuguauc

SEQ ID NO: 2382462 - RNA, 15 nt, Human
cucgauuuuguaucu

SEQ ID NO: 2382463 - RNA, 16 nt, Human
cucgauuuuguaucug

SEQ ID NO: 2382464 - RNA, 14 nt, Human
cucgcagagaggcc

SEQ ID NO: 2382465 - RNA, 20 nt, Human
cucgcagagaggccaggugc

SEQ ID NO: 2382466 - RNA, 14 nt, Human
cucgcaccuuucca

SEQ ID NO: 2382467 - RNA, 15 nt, Human
cucgcaccuuuccaa

SEQ ID NO: 2382468 - RNA, 14 nt, Human
cucgcaagcugggu

SEQ ID NO: 2382469 - RNA, 13 nt, Human
cucgcaagcuggg

SEQ ID NO: 2382470 - RNA, 23 nt, Human
cucgagcaguccugccucagccu

SEQ ID NO: 2382471 - RNA, 22 nt, Human
cucgagcaugccuggauggggc

SEQ ID NO: 2382472 - RNA, 16 nt, Human
cucgaggacuguauuu

SEQ ID NO: 2382473 - RNA, 17 nt, Human
cucgaggacuguauuug

SEQ ID NO: 2382474 - RNA, 20 nt, Human
cucgaggacuguauuuguga

SEQ ID NO: 2382475 - RNA, 22 nt, Human
cucgaggacuguauuugugacu

SEQ ID NO: 2382476 - RNA, 23 nt, Human
cucgaggacuguauuugugacua

SEQ ID NO: 2382477 - RNA, 18 nt, Human
cucgagggcagggaccac

SEQ ID NO: 2382478 - RNA, 23 nt, Human
cucgagggcagggaccacacccu

SEQ ID NO: 2382479 - RNA, 13 nt, Human
cucgagggcaggg

SEQ ID NO: 2382480 - RNA, 12 nt, Human
cuccuuccuguc

SEQ ID NO: 2382481 - RNA, 13 nt, Human
cuccuuccugucu

SEQ ID NO: 2382482 - RNA, 23 nt, Human
cuccuuccuggagcccagaggag

SEQ ID NO: 2382483 - RNA, 17 nt, Human
cuccuuccugucuuccu

SEQ ID NO: 2382484 - RNA, 16 nt, Human
cuccuuccugucuucc

SEQ ID NO: 2382485 - RNA, 15 nt, Human
cuccuuccugucuuc

SEQ ID NO: 2382486 - RNA, 14 nt, Human
cuccuuccugucuu

SEQ ID NO: 2382487 - RNA, 13 nt, Human
cuccuuccugugu

SEQ ID NO: 2382488 - RNA, 16 nt, Human
cuccuuccugccaccu

SEQ ID NO: 2382489 - RNA, 21 nt, Human
cuccuuccugccaccugcugc

SEQ ID NO: 2382490 - RNA, 20 nt, Human
cuccuuccuggagcccagag

SEQ ID NO: 2382491 - RNA, 14 nt, Human
cuccuuccuggaga

SEQ ID NO: 2382492 - RNA, 13 nt, Human
cuccuuccuggag

SEQ ID NO: 2382493 - RNA, 22 nt, Human
cuccuuccuugcuguccuaggc

SEQ ID NO: 2382494 - RNA, 12 nt, Human
cuccuugggccc

SEQ ID NO: 2382495 - RNA, 16 nt, Human
cuccuugggcccuuug

SEQ ID NO: 2382496 - RNA, 13 nt, Human
cuccuugggcccu

SEQ ID NO: 2382497 - RNA, 18 nt, Human
cuccuuccuugaccagca

SEQ ID NO: 2382498 - RNA, 17 nt, Human
cuccuuccuugaccagc

SEQ ID NO: 2382499 - RNA, 14 nt, Human
cuccuuccuugacc

SEQ ID NO: 2382500 - RNA, 18 nt, Human
cuccuuccuucaccucug

SEQ ID NO: 2382501 - RNA, 15 nt, Human
cuccuuccugugugu

SEQ ID NO: 2382502 - RNA, 23 nt, Human
cuccuuggugucgggcaugacac

SEQ ID NO: 2382503 - RNA, 14 nt, Human
cuccuuggugccug

SEQ ID NO: 2382504 - RNA, 19 nt, Human
cuccuugggcccuuugagu

SEQ ID NO: 2382505 - RNA, 18 nt, Human
cuccuugggcccuuugag

SEQ ID NO: 2382506 - RNA, 17 nt, Human
cuccuugggcccuuuga

SEQ ID NO: 2382507 - RNA, 17 nt, Human
cucgagcaguccugccu

SEQ ID NO: 2382508 - RNA, 21 nt, Human
cucgagacacagugaagcaaa

SEQ ID NO: 2382509 - RNA, 15 nt, Human
cucgagcaacugcug

SEQ ID NO: 2382510 - RNA, 19 nt, Human
cucgagaacuuucauuuuu

SEQ ID NO: 2382511 - RNA, 15 nt, Human
cuccuuggugccugg

SEQ ID NO: 2382512 - RNA, 19 nt, Human
cuccuuggugccuggccug

SEQ ID NO: 2382513 - RNA, 22 nt, Human
cuccuuggugccuggccuggca

SEQ ID NO: 2382514 - RNA, 19 nt, Human
cuccuucgcaggcaugucc

SEQ ID NO: 2382515 - RNA, 13 nt, Human
cucgagcaugccu

SEQ ID NO: 2382516 - RNA, 15 nt, Human
cucgagcaugccugg

SEQ ID NO: 2382517 - RNA, 16 nt, Human
cucgagcaugccugga

SEQ ID NO: 2382518 - RNA, 19 nt, Human
cucgagcaugccuggaugg

SEQ ID NO: 2382519 - RNA, 11 nt, Human
cuccuggaaau

SEQ ID NO: 2382520 - RNA, 17 nt, Human
cuccuggaagcuguguc

SEQ ID NO: 2382521 - RNA, 15 nt, Human
cuccuggaagcugug

SEQ ID NO: 2382522 - RNA, 14 nt, Human
cuccuggaaauauu

SEQ ID NO: 2382523 - RNA, 17 nt, Human
cuccuggaaaggcucag

SEQ ID NO: 2382524 - RNA, 19 nt, Human
cuccuggaaaggcucaguc

SEQ ID NO: 2382525 - RNA, 18 nt, Human
cuccuggaaaggcucagu

SEQ ID NO: 2382526 - RNA, 24 nt, Human
cuccuggaaaggcucagucucagg

SEQ ID NO: 2382527 - RNA, 23 nt, Human
cuccuggaaaggcucagucucag

SEQ ID NO: 2382528 - RNA, 22 nt, Human
cuccuggaaaggcucagucuca

SEQ ID NO: 2382529 - RNA, 20 nt, Human
cuccuggaaaggcucagucu

SEQ ID NO: 2382530 - RNA, 21 nt, Human
cuccugugugugcgccuacag

SEQ ID NO: 2382531 - RNA, 23 nt, Human
cuccuggaagcuguguccuugca

SEQ ID NO: 2382532 - RNA, 20 nt, Human
cuccuggaagcuguguccuu

SEQ ID NO: 2382533 - RNA, 18 nt, Human
cuccuggacauuuuuuca

SEQ ID NO: 2382534 - RNA, 11 nt, Human
cuccuggacuc

SEQ ID NO: 2382535 - RNA, 23 nt, Human
cuccugugugugcgccuacagga

SEQ ID NO: 2382536 - RNA, 24 nt, Human
cuccugugugugcgccuacaggag

SEQ ID NO: 2382537 - RNA, 16 nt, Human
cuccuucccaucgcug

SEQ ID NO: 2382538 - RNA, 17 nt, Human
cuccuucccaucgcugu

SEQ ID NO: 2382539 - RNA, 19 nt, Human
cuccuuagucuucucauag

SEQ ID NO: 2382540 - RNA, 17 nt, Human
cuccuuagucuucucau

SEQ ID NO: 2382541 - RNA, 14 nt, Human
cuccuuccaguguc

SEQ ID NO: 2382542 - RNA, 13 nt, Human
cuccuucccaaag

SEQ ID NO: 2382543 - RNA, 22 nt, Human
cuccuucccaaaggacuccacc

SEQ ID NO: 2382544 - RNA, 23 nt, Human
cuccuucccaaaggacuccaccc

SEQ ID NO: 2382545 - RNA, 12 nt, Human
cuccuggacucc

SEQ ID NO: 2382546 - RNA, 21 nt, Human
cuccuuagagacaucaaaauc

SEQ ID NO: 2382547 - RNA, 20 nt, Human
cuccuuagagacaucaaaau

SEQ ID NO: 2382548 - RNA, 16 nt, Human
cuccuuagucuucuca

SEQ ID NO: 2382549 - RNA, 22 nt, Human
cuccuuaucaaaggacaccauu

SEQ ID NO: 2382550 - RNA, 17 nt, Human
cuccuuaucaaaggaca

SEQ ID NO: 2382551 - RNA, 21 nt, Human
cuccugccucagccuccugag

SEQ ID NO: 2382552 - RNA, 19 nt, Human
cuccugccucagccucccg

SEQ ID NO: 2382553 - RNA, 18 nt, Human
cuccugccucgaacuggc

SEQ ID NO: 2382554 - RNA, 20 nt, Human
cuccugccucgaacuggcug

SEQ ID NO: 2382555 - RNA, 21 nt, Human
cuccugccucgaacuggcugc

SEQ ID NO: 2382556 - RNA, 22 nt, Human
cuccugccucgaacuggcugca

SEQ ID NO: 2382557 - RNA, 13 nt, Human
cuccugcugcacc

SEQ ID NO: 2382558 - RNA, 18 nt, Human
cuccugcuacucuguucc

SEQ ID NO: 2382559 - RNA, 14 nt, Human
cuccugcugcacca

SEQ ID NO: 2382560 - RNA, 18 nt, Human
cuccugcugcaccaaccc

SEQ ID NO: 2382561 - RNA, 19 nt, Human
cuccugcugcaccaaccca

SEQ ID NO: 2382562 - RNA, 21 nt, Human
cuccugcugcaccaacccagc

SEQ ID NO: 2382563 - RNA, 16 nt, Human
cuccugcugcagaggg

SEQ ID NO: 2382564 - RNA, 22 nt, Human
cuccugcugcaccaacccagcc

SEQ ID NO: 2382565 - RNA, 12 nt, Human
cuccugcugcag

SEQ ID NO: 2382566 - RNA, 17 nt, Human
cuccugccucagccucc

SEQ ID NO: 2382567 - RNA, 16 nt, Human
cuccugccucagccuc

SEQ ID NO: 2382568 - RNA, 12 nt, Human
cuccugccucag

SEQ ID NO: 2382569 - RNA, 11 nt, Human
cuccugccuca

SEQ ID NO: 2382570 - RNA, 13 nt, Human
cuccugccuacuc

SEQ ID NO: 2382571 - RNA, 18 nt, Human
cuccugccgcagagcugg

SEQ ID NO: 2382572 - RNA, 16 nt, Human
cuccugccuacucacg

SEQ ID NO: 2382573 - RNA, 14 nt, Human
cuccugccuacuca

SEQ ID NO: 2382574 - RNA, 23 nt, Human
cuccucucccauugucccucugc

SEQ ID NO: 2382575 - RNA, 14 nt, Human
cuccucuccccagc

SEQ ID NO: 2382576 - RNA, 14 nt, Human
cuccugccgcagag

SEQ ID NO: 2382577 - RNA, 16 nt, Human
cuccugccgcagagcu

SEQ ID NO: 2382578 - RNA, 17 nt, Human
cuccugccgcagagcug

SEQ ID NO: 2382579 - RNA, 13 nt, Human
cuccucuccccag

SEQ ID NO: 2382580 - RNA, 15 nt, Human
cuccucuccccagca

SEQ ID NO: 2382581 - RNA, 17 nt, Human
cugagggagccuggccc

SEQ ID NO: 2382582 - RNA, 13 nt, Human
cugagggagccug

SEQ ID NO: 2382583 - RNA, 18 nt, Human
cugagggaccagccaaga

SEQ ID NO: 2382584 - RNA, 14 nt, Human
cugagggacucuga

SEQ ID NO: 2382585 - RNA, 16 nt, Human
cugagggacucugaag

SEQ ID NO: 2382586 - RNA, 20 nt, Human
cugagggacucugaagccuc

SEQ ID NO: 2382587 - RNA, 12 nt, Human
cugagggagccu

SEQ ID NO: 2382588 - RNA, 21 nt, Human
cugagggacucugaagccucu

SEQ ID NO: 2382589 - RNA, 22 nt, Human
cugagggacucugaagccucug

SEQ ID NO: 2382590 - RNA, 11 nt, Human
cugaggcugua

SEQ ID NO: 2382591 - RNA, 21 nt, Human
cugaggcuggauccuagccuu

SEQ ID NO: 2382592 - RNA, 13 nt, Human
cugaggcuguggu

SEQ ID NO: 2382593 - RNA, 14 nt, Human
cugaggcugugguc

SEQ ID NO: 2382594 - RNA, 17 nt, Human
cugaggcuguggucaca

SEQ ID NO: 2382595 - RNA, 19 nt, Human
cugaggcuguggucacagc

SEQ ID NO: 2382596 - RNA, 20 nt, Human
cugaggcuguggucacagcg

SEQ ID NO: 2382597 - RNA, 18 nt, Human
cugaggcuuccagagagu

SEQ ID NO: 2382598 - RNA, 14 nt, Human
cugaggcuguagga

SEQ ID NO: 2382599 - RNA, 14 nt, Human
cugaggcuuccaga

SEQ ID NO: 2382600 - RNA, 19 nt, Human
cugagucaugaucucccug

SEQ ID NO: 2382601 - RNA, 18 nt, Human
cugagucaugaucucccu

SEQ ID NO: 2382602 - RNA, 23 nt, Human
cugagucacccuaccugugccug

SEQ ID NO: 2382603 - RNA, 22 nt, Human
cugagucacccuaccugugccu

SEQ ID NO: 2382604 - RNA, 20 nt, Human
cugagggauggacugaugcu

SEQ ID NO: 2382605 - RNA, 22 nt, Human
cugagucacccaugaagacagg

SEQ ID NO: 2382606 - RNA, 23 nt, Human
cugagggaggaggccaccucucc

SEQ ID NO: 2382607 - RNA, 16 nt, Human
cugagggauggacuga

SEQ ID NO: 2382608 - RNA, 15 nt, Human
cugagggaucuuuac

SEQ ID NO: 2382609 - RNA, 21 nt, Human
cugagggaggaggccaccucu

SEQ ID NO: 2382610 - RNA, 22 nt, Human
cugagggaggaggccaccucuc

SEQ ID NO: 2382611 - RNA, 23 nt, Human
cugagggacucugaagccucugg

SEQ ID NO: 2382612 - RNA, 13 nt, Human
cugagggaggagg

SEQ ID NO: 2382613 - RNA, 15 nt, Human
cugagggaggaggcc

SEQ ID NO: 2382614 - RNA, 16 nt, Human
cugagggaggaggcca

SEQ ID NO: 2382615 - RNA, 17 nt, Human
cugagggaggaggccac

SEQ ID NO: 2382616 - RNA, 18 nt, Human
cugagggaggaggccacc

SEQ ID NO: 2382617 - RNA, 19 nt, Human
cugagggaggaggccaccu

SEQ ID NO: 2382618 - RNA, 20 nt, Human
cugagggaggaggccaccuc

SEQ ID NO: 2382619 - RNA, 20 nt, Human
cugaggcucuuucugggcca

SEQ ID NO: 2382620 - RNA, 18 nt, Human
cugaggcucuuucugggc

SEQ ID NO: 2382621 - RNA, 15 nt, Human
cugaggcugagacug

SEQ ID NO: 2382622 - RNA, 15 nt, Human
cugaggcuggauccu

SEQ ID NO: 2382623 - RNA, 13 nt, Human
cugaggcuggcac

SEQ ID NO: 2382624 - RNA, 11 nt, Human
cugaggcuggc

SEQ ID NO: 2382625 - RNA, 13 nt, Human
cugaggcugggcu

SEQ ID NO: 2382626 - RNA, 20 nt, Human
cugaggcuggcacaggacau

SEQ ID NO: 2382627 - RNA, 19 nt, Human
cugaggcuggcacaggaca

SEQ ID NO: 2382628 - RNA, 18 nt, Human
cugaggcuggcacaggac

SEQ ID NO: 2382629 - RNA, 17 nt, Human
cugaggcuggcacagga

SEQ ID NO: 2382630 - RNA, 15 nt, Human
cugaggcugggcucc

SEQ ID NO: 2382631 - RNA, 16 nt, Human
cugaggcugggcuccc

SEQ ID NO: 2382632 - RNA, 17 nt, Human
cugaggcugggcucccu

SEQ ID NO: 2382633 - RNA, 22 nt, Human
cugaggcugggcucccuuccca

SEQ ID NO: 2382634 - RNA, 18 nt, Human
cugaggcggguggaucac

SEQ ID NO: 2382635 - RNA, 16 nt, Human
cugaggcucagggaaa

SEQ ID NO: 2382636 - RNA, 18 nt, Human
cugaggccuuaucauuca

SEQ ID NO: 2382637 - RNA, 17 nt, Human
cugaggcgggagaauca

SEQ ID NO: 2382638 - RNA, 15 nt, Human
cugaggcuccacuug

SEQ ID NO: 2382639 - RNA, 16 nt, Human
cugaggcucuuucugg

SEQ ID NO: 2382640 - RNA, 15 nt, Human
cugaggcucuuucug

SEQ ID NO: 2382641 - RNA, 17 nt, Human
cugaggcuccugugcua

SEQ ID NO: 2382642 - RNA, 20 nt, Human
cugaggcuccugugcuacuu

SEQ ID NO: 2382643 - RNA, 22 nt, Human
cugaggcucugacccagugaga

SEQ ID NO: 2382644 - RNA, 23 nt, Human
cugaggcucugacccagugagau

SEQ ID NO: 2382645 - RNA, 21 nt, Human
cugaggcuccacuuggucugu

SEQ ID NO: 2382646 - RNA, 17 nt, Human
cugaggccugagcgcuc

SEQ ID NO: 2382647 - RNA, 23 nt, Human
cugaggccuaaaaguaaacauua

SEQ ID NO: 2382648 - RNA, 15 nt, Human
cugaggccuccagcu

SEQ ID NO: 2382649 - RNA, 18 nt, Human
cugaggccugagcgcucc

SEQ ID NO: 2382650 - RNA, 22 nt, Human
cugaggccugagcgcuccugcc

SEQ ID NO: 2382651 - RNA, 12 nt, Human
cugaggccugga

SEQ ID NO: 2382652 - RNA, 15 nt, Human
cugaggccuggacuu

SEQ ID NO: 2382653 - RNA, 19 nt, Human
cugaggccuggacuuuccu

SEQ ID NO: 2382654 - RNA, 20 nt, Human
cugaggccuggacuuuccug

SEQ ID NO: 2382655 - RNA, 22 nt, Human
cugaggccuggacuuuccugca

SEQ ID NO: 2382656 - RNA, 14 nt, Human
cugaggccugggcc

SEQ ID NO: 2382657 - RNA, 15 nt, Human
cugaggccugggccg

SEQ ID NO: 2382658 - RNA, 19 nt, Human
cugaggccugggccgcugc

SEQ ID NO: 2382659 - RNA, 22 nt, Human
cugaggccugggccgcugccac

SEQ ID NO: 2382660 - RNA, 23 nt, Human
cugaggccugggccgcugccacg

SEQ ID NO: 2382661 - RNA, 19 nt, Human
cugagccccugggacugcu

SEQ ID NO: 2382662 - RNA, 16 nt, Human
cugagccccugggacu

SEQ ID NO: 2382663 - RNA, 22 nt, Human
cugagccccugggacugcugcu

SEQ ID NO: 2382664 - RNA, 12 nt, Human
cugagccccugu

SEQ ID NO: 2382665 - RNA, 15 nt, Human
cugagccccuacccc

SEQ ID NO: 2382666 - RNA, 17 nt, Human
cugagccccuaccccac

SEQ ID NO: 2382667 - RNA, 19 nt, Human
cugagccccuaccccacac

SEQ ID NO: 2382668 - RNA, 22 nt, Human
cugagccccuaccccacaccag

SEQ ID NO: 2382669 - RNA, 23 nt, Human
cugagccccgcagaccuccccag

SEQ ID NO: 2382670 - RNA, 21 nt, Human
cugagccccgcagaccucccc

SEQ ID NO: 2382671 - RNA, 22 nt, Human
cugagccccgcagaccucccca

SEQ ID NO: 2382672 - RNA, 13 nt, Human
cugagccccuacc

SEQ ID NO: 2382673 - RNA, 14 nt, Human
cugagccccuaccc

SEQ ID NO: 2382674 - RNA, 21 nt, Human
cugagcccccccaacacugug

SEQ ID NO: 2382675 - RNA, 22 nt, Human
cugagcccccccaacacugugc

SEQ ID NO: 2382676 - RNA, 17 nt, Human
cugagccccgcagaccu

SEQ ID NO: 2382677 - RNA, 18 nt, Human
cugagccccgcagaccuc

SEQ ID NO: 2382678 - RNA, 19 nt, Human
cugaggccuaaaaguaaac

SEQ ID NO: 2382679 - RNA, 21 nt, Human
cugaggccuaaaaguaaacau

SEQ ID NO: 2382680 - RNA, 20 nt, Human
cugagcccgggcugccuggg

SEQ ID NO: 2382681 - RNA, 21 nt, Human
cugagcccgggcugccugggc

SEQ ID NO: 2382682 - RNA, 22 nt, Human
cugagcccgggcugccugggcu

SEQ ID NO: 2382683 - RNA, 23 nt, Human
cugagcccgggcugccugggcug

SEQ ID NO: 2382684 - RNA, 24 nt, Human
cugaggcccuucucuccagccccu

SEQ ID NO: 2382685 - RNA, 23 nt, Human
cugagccccugucuagagaggga

SEQ ID NO: 2382686 - RNA, 13 nt, Human
cugagccccuucc

SEQ ID NO: 2382687 - RNA, 14 nt, Human
cugagccccuuccu

SEQ ID NO: 2382688 - RNA, 16 nt, Human
cugagccccuuccuug

SEQ ID NO: 2382689 - RNA, 22 nt, Human
cugagccccugucuagagaggg

SEQ ID NO: 2382690 - RNA, 16 nt, Human
cugagccccugucuag

SEQ ID NO: 2382691 - RNA, 15 nt, Human
cugagccccugucua

SEQ ID NO: 2382692 - RNA, 13 nt, Human
cugagccccuguc

SEQ ID NO: 2382693 - RNA, 19 nt, Human
cugagccccuuccuugcuc

SEQ ID NO: 2382694 - RNA, 20 nt, Human
cugagccccuuccuugcucu

SEQ ID NO: 2382695 - RNA, 14 nt, Human
cugagcccgggcug

SEQ ID NO: 2382696 - RNA, 15 nt, Human
cugagcccgggcugc

SEQ ID NO: 2382697 - RNA, 16 nt, Human
cugagcccgggcugcc

SEQ ID NO: 2382698 - RNA, 17 nt, Human
cugagcccgggcugccu

SEQ ID NO: 2382699 - RNA, 18 nt, Human
cugagcccgggcugccug

SEQ ID NO: 2382700 - RNA, 19 nt, Human
cugagcccgggcugccugg

SEQ ID NO: 2382701 - RNA, 20 nt, Human
cugaucagagccgugguccu

SEQ ID NO: 2382702 - RNA, 17 nt, Human
cugaucagaccacggcu

SEQ ID NO: 2382703 - RNA, 14 nt, Human
cugaucagagccgu

SEQ ID NO: 2382704 - RNA, 13 nt, Human
cugaucagucuaa

SEQ ID NO: 2382705 - RNA, 15 nt, Human
cugaucccucuacag

SEQ ID NO: 2382706 - RNA, 20 nt, Human
cugauccuaguuccaccauc

SEQ ID NO: 2382707 - RNA, 21 nt, Human
cugauccuaguuccaccauca

SEQ ID NO: 2382708 - RNA, 12 nt, Human
cugauccuggag

SEQ ID NO: 2382709 - RNA, 17 nt, Human
cugauccuggaggccca

SEQ ID NO: 2382710 - RNA, 15 nt, Human
cugauccuggaggcc

SEQ ID NO: 2382711 - RNA, 14 nt, Human
cugauggugcaaug

SEQ ID NO: 2382712 - RNA, 15 nt, Human
cugauggugcaauga

SEQ ID NO: 2382713 - RNA, 16 nt, Human
cugauggugcaaugac

SEQ ID NO: 2382714 - RNA, 14 nt, Human
cugauaauaauuga

SEQ ID NO: 2382715 - RNA, 15 nt, Human
cugauaauuccagug

SEQ ID NO: 2382716 - RNA, 21 nt, Human
cugauauauguguuuuucaca

SEQ ID NO: 2382717 - RNA, 15 nt, Human
cugauauauguguuu

SEQ ID NO: 2382718 - RNA, 22 nt, Human
cugauauauguguuuuucacau

SEQ ID NO: 2382719 - RNA, 14 nt, Human
cugauacccagagc

SEQ ID NO: 2382720 - RNA, 18 nt, Human
cugauauauuuuacaauu

SEQ ID NO: 2382721 - RNA, 16 nt, Human
cugauauauuuuacaa

SEQ ID NO: 2382722 - RNA, 16 nt, Human
cugauaugauuuaaaa

SEQ ID NO: 2382723 - RNA, 18 nt, Human
cugauaugauuuaaaaca

SEQ ID NO: 2382724 - RNA, 19 nt, Human
cugauaugauuuaaaacau

SEQ ID NO: 2382725 - RNA, 21 nt, Human
cugauaugauuuaaaacaugu

SEQ ID NO: 2382726 - RNA, 23 nt, Human
cugauaugauuuaaaacauguaa

SEQ ID NO: 2382727 - RNA, 22 nt, Human
cugauaugauuuaaaacaugua

SEQ ID NO: 2382728 - RNA, 22 nt, Human
cugaucaagucaccggagcuuu

SEQ ID NO: 2382729 - RNA, 14 nt, Human
cugaucaaugacag

SEQ ID NO: 2382730 - RNA, 18 nt, Human
cugaucaagucaccggag

SEQ ID NO: 2382731 - RNA, 15 nt, Human
cugaucaaugacaga

SEQ ID NO: 2382732 - RNA, 17 nt, Human
cugaucaaugacagagc

SEQ ID NO: 2382733 - RNA, 15 nt, Human
cugaucaccugcccu

SEQ ID NO: 2382734 - RNA, 18 nt, Human
cugauauuccaugaaugu

SEQ ID NO: 2382735 - RNA, 19 nt, Human
cugauauuccaugaaugua

SEQ ID NO: 2382736 - RNA, 20 nt, Human
cugauauucaaauggacaaa

SEQ ID NO: 2382737 - RNA, 19 nt, Human
cugauauugccgcacuagg

SEQ ID NO: 2382738 - RNA, 22 nt, Human
cugauauugccgcacuagggga

SEQ ID NO: 2382739 - RNA, 22 nt, Human
cugauauuucccuccccugggg

SEQ ID NO: 2382740 - RNA, 17 nt, Human
cugauauuuuaccucuu

SEQ ID NO: 2382741 - RNA, 23 nt, Human
cugauauuuuaccucuuauugca

SEQ ID NO: 2382742 - RNA, 13 nt, Human
cugagugaaccug

SEQ ID NO: 2382743 - RNA, 15 nt, Human
cugagugaaccugua

SEQ ID NO: 2382744 - RNA, 17 nt, Human
cugaguuacauugucau

SEQ ID NO: 2382745 - RNA, 21 nt, Human
cugagucugcuauauuuucau

SEQ ID NO: 2382746 - RNA, 22 nt, Human
cugagucccaggagcugcccag

SEQ ID NO: 2382747 - RNA, 17 nt, Human
cugagucugcuauauuu

SEQ ID NO: 2382748 - RNA, 22 nt, Human
cugagucugcuauauuuucaug

SEQ ID NO: 2382749 - RNA, 18 nt, Human
cugaguuccuagccaccg

SEQ ID NO: 2382750 - RNA, 17 nt, Human
cugaguuccuagccacc

SEQ ID NO: 2382751 - RNA, 16 nt, Human
cugaguuccuagccac

SEQ ID NO: 2382752 - RNA, 15 nt, Human
cugaguuccuagcca

SEQ ID NO: 2382753 - RNA, 22 nt, Human
cugagucaugaucucccugccg

SEQ ID NO: 2382754 - RNA, 18 nt, Human
cugagucauggccgggug

SEQ ID NO: 2382755 - RNA, 21 nt, Human
cugagucaugaucucccugcc

SEQ ID NO: 2382756 - RNA, 20 nt, Human
cugagucaugaucucccugc

SEQ ID NO: 2382757 - RNA, 21 nt, Human
cugaguccaagaggguccuuu

SEQ ID NO: 2382758 - RNA, 16 nt, Human
cugagucccaggagcu

SEQ ID NO: 2382759 - RNA, 17 nt, Human
cugagucccaggagcug

SEQ ID NO: 2382760 - RNA, 21 nt, Human
cugagucccaggagcugccca

SEQ ID NO: 2382761 - RNA, 17 nt, Human
cugagucugaaggcugg

SEQ ID NO: 2382762 - RNA, 20 nt, Human
cugagucccaggcugagccu

SEQ ID NO: 2382763 - RNA, 18 nt, Human
cugagucugaaggcuggg

SEQ ID NO: 2382764 - RNA, 19 nt, Human
cugagucugaaggcugggu

SEQ ID NO: 2382765 - RNA, 18 nt, Human
cugaguuucauucuccug

SEQ ID NO: 2382766 - RNA, 21 nt, Human
cugaguuucauucuccugccu

SEQ ID NO: 2382767 - RNA, 19 nt, Human
cugaguuucauucuccugc

SEQ ID NO: 2382768 - RNA, 20 nt, Human
cugaguuucauucuccugcc

SEQ ID NO: 2382769 - RNA, 21 nt, Human
cugaguugguguugacaugug

SEQ ID NO: 2382770 - RNA, 17 nt, Human
cugaguuucauucuccu

SEQ ID NO: 2382771 - RNA, 20 nt, Human
cugaguugacuugacagaac

SEQ ID NO: 2382772 - RNA, 16 nt, Human
cugaguuccugcaugc

SEQ ID NO: 2382773 - RNA, 14 nt, Human
cugaguuccugcau

SEQ ID NO: 2382774 - RNA, 16 nt, Human
cugauaacaaccugga

SEQ ID NO: 2382775 - RNA, 17 nt, Human
cugauaacaaccuggag

SEQ ID NO: 2382776 - RNA, 18 nt, Human
cugauaacaaccuggaga

SEQ ID NO: 2382777 - RNA, 22 nt, Human
cugauaacaaccuggagaccag

SEQ ID NO: 2382778 - RNA, 21 nt, Human
cugauaacuagauggugcuga

SEQ ID NO: 2382779 - RNA, 20 nt, Human
cugauaacuagauggugcug

SEQ ID NO: 2382780 - RNA, 19 nt, Human
cugauaacuagauggugcu

SEQ ID NO: 2382781 - RNA, 18 nt, Human
cugauaacuagauggugc

SEQ ID NO: 2382782 - RNA, 24 nt, Human
cugauaacuagauggugcugagaa

SEQ ID NO: 2382783 - RNA, 23 nt, Human
cugauaacuagauggugcugaga

SEQ ID NO: 2382784 - RNA, 19 nt, Human
cugauaagagaaucaacau

SEQ ID NO: 2382785 - RNA, 23 nt, Human
cugcacucuaacccuaggcauca

SEQ ID NO: 2382786 - RNA, 13 nt, Human
cugcacucugugc

SEQ ID NO: 2382787 - RNA, 14 nt, Human
cugcacucugugcc

SEQ ID NO: 2382788 - RNA, 15 nt, Human
cugcacucugugccc

SEQ ID NO: 2382789 - RNA, 16 nt, Human
cugcacucugugccca

SEQ ID NO: 2382790 - RNA, 19 nt, Human
cugcaccccuucucuccuc

SEQ ID NO: 2382791 - RNA, 20 nt, Human
cugcaccccuucucuccucc

SEQ ID NO: 2382792 - RNA, 21 nt, Human
cugcaccccuucucuccuccc

SEQ ID NO: 2382793 - RNA, 16 nt, Human
cugcacuccccugcug

SEQ ID NO: 2382794 - RNA, 17 nt, Human
cugcacuccccugcugg

SEQ ID NO: 2382795 - RNA, 18 nt, Human
cugcacuugcagacucua

SEQ ID NO: 2382796 - RNA, 19 nt, Human
cugcacugaugcugccccu

SEQ ID NO: 2382797 - RNA, 18 nt, Human
cugcacugaugcugcccc

SEQ ID NO: 2382798 - RNA, 17 nt, Human
cugcacugaugcugccc

SEQ ID NO: 2382799 - RNA, 15 nt, Human
cugcacugaugcugc

SEQ ID NO: 2382800 - RNA, 19 nt, Human
cugcacucuuaagcuuccg

SEQ ID NO: 2382801 - RNA, 17 nt, Human
cugcacucugugcccau

SEQ ID NO: 2382802 - RNA, 18 nt, Human
cugcacucugugcccaug

SEQ ID NO: 2382803 - RNA, 20 nt, Human
cugcacucugugcccauggg

SEQ ID NO: 2382804 - RNA, 21 nt, Human
cugcacucugugcccaugggc

SEQ ID NO: 2382805 - RNA, 22 nt, Human
cugcacucugugcccaugggca

SEQ ID NO: 2382806 - RNA, 14 nt, Human
cugcacugagcaga

SEQ ID NO: 2382807 - RNA, 18 nt, Human
cugcacugagcagagucu

SEQ ID NO: 2382808 - RNA, 22 nt, Human
cugcaccggcuggccuggcccc

SEQ ID NO: 2382809 - RNA, 14 nt, Human
cugcacccucaggc

SEQ ID NO: 2382810 - RNA, 13 nt, Human
cugcacccucagg

SEQ ID NO: 2382811 - RNA, 12 nt, Human
cugcaccgggcc

SEQ ID NO: 2382812 - RNA, 23 nt, Human
cugcaccggcuggccuggccccu

SEQ ID NO: 2382813 - RNA, 15 nt, Human
cugcacuccccugcu

SEQ ID NO: 2382814 - RNA, 18 nt, Human
cugcacaauaaaaauguu

SEQ ID NO: 2382815 - RNA, 15 nt, Human
cugcacaauaaaaau

SEQ ID NO: 2382816 - RNA, 22 nt, Human
cugcacaagcugcacccucagg

SEQ ID NO: 2382817 - RNA, 13 nt, Human
cugcacacagcac

SEQ ID NO: 2382818 - RNA, 15 nt, Human
cugcacacaccucag

SEQ ID NO: 2382819 - RNA, 19 nt, Human
cugcacacaccucagaggc

SEQ ID NO: 2382820 - RNA, 22 nt, Human
cugcacaauaaaaauguuuaac

SEQ ID NO: 2382821 - RNA, 19 nt, Human
cugcaagugacaucucuuu

SEQ ID NO: 2382822 - RNA, 18 nt, Human
cugcaauaaggggagagu

SEQ ID NO: 2382823 - RNA, 13 nt, Human
cugcacagaugga

SEQ ID NO: 2382824 - RNA, 12 nt, Human
cugcacagaugg

SEQ ID NO: 2382825 - RNA, 21 nt, Human
cugcacagagcucuccagcuc

SEQ ID NO: 2382826 - RNA, 23 nt, Human
cugcacagagcucuccagcucca

SEQ ID NO: 2382827 - RNA, 13 nt, Human
cugcacagagcuc

SEQ ID NO: 2382828 - RNA, 14 nt, Human
cugcacagagcucu

SEQ ID NO: 2382829 - RNA, 18 nt, Human
cugcacagagcucuccag

SEQ ID NO: 2382830 - RNA, 20 nt, Human
cugcacagagcucuccagcu

SEQ ID NO: 2382831 - RNA, 20 nt, Human
cugcacagauggauuugccu

SEQ ID NO: 2382832 - RNA, 23 nt, Human
cugcacagauggauuugccugug

SEQ ID NO: 2382833 - RNA, 22 nt, Human
cugcacagugcaucucagccca

SEQ ID NO: 2382834 - RNA, 18 nt, Human
cugcacaguuuucuggcu

SEQ ID NO: 2382835 - RNA, 22 nt, Human
cugcacacgcuccuuccucuga

SEQ ID NO: 2382836 - RNA, 20 nt, Human
cugcacacaccucagaggcu

SEQ ID NO: 2382837 - RNA, 11 nt, Human
cugcacagagc

SEQ ID NO: 2382838 - RNA, 20 nt, Human
cugcacacgcuccuuccucu

SEQ ID NO: 2382839 - RNA, 14 nt, Human
cugcacacagcacg

SEQ ID NO: 2382840 - RNA, 20 nt, Human
cugcacaugcagcugcaccc

SEQ ID NO: 2382841 - RNA, 21 nt, Human
cugcacaugcagcugcacccu

SEQ ID NO: 2382842 - RNA, 14 nt, Human
cugcacaugucuug

SEQ ID NO: 2382843 - RNA, 16 nt, Human
cugcacaugucuugua

SEQ ID NO: 2382844 - RNA, 20 nt, Human
cugcacccccuccugcugca

SEQ ID NO: 2382845 - RNA, 21 nt, Human
cugcacaugucuuguacaugu

SEQ ID NO: 2382846 - RNA, 23 nt, Human
cugcacaugucuuguacaugugu

SEQ ID NO: 2382847 - RNA, 22 nt, Human
cugcacaugacucggggguggg

SEQ ID NO: 2382848 - RNA, 23 nt, Human
cugcacaugacucgggggugggg

SEQ ID NO: 2382849 - RNA, 22 nt, Human
cugcacaugaaucccacccaca

SEQ ID NO: 2382850 - RNA, 23 nt, Human
cugcacaugaaucccacccacau

SEQ ID NO: 2382851 - RNA, 21 nt, Human
cugcacaguuuucuggcugga

SEQ ID NO: 2382852 - RNA, 13 nt, Human
cugauuucacaac

SEQ ID NO: 2382853 - RNA, 21 nt, Human
cugauuuaggagaagccagga

SEQ ID NO: 2382854 - RNA, 22 nt, Human
cugauuuaggagaagccaggaa

SEQ ID NO: 2382855 - RNA, 20 nt, Human
cugauuuaggagaagccagg

SEQ ID NO: 2382856 - RNA, 18 nt, Human
cugauuuaggagaagcca

SEQ ID NO: 2382857 - RNA, 17 nt, Human
cugauuuaggagaagcc

SEQ ID NO: 2382858 - RNA, 16 nt, Human
cugauuuaggagaagc

SEQ ID NO: 2382859 - RNA, 17 nt, Human
cugauuguuucauugcg

SEQ ID NO: 2382860 - RNA, 23 nt, Human
cugauuguaacguugcuguggga

SEQ ID NO: 2382861 - RNA, 12 nt, Human
cugauuuacagu

SEQ ID NO: 2382862 - RNA, 21 nt, Human
cugauugugucucuugguccu

SEQ ID NO: 2382863 - RNA, 14 nt, Human
cugauuuccuuugg

SEQ ID NO: 2382864 - RNA, 12 nt, Human
cugauuucagga

SEQ ID NO: 2382865 - RNA, 16 nt, Human
cugauuugcaaaaaaa

SEQ ID NO: 2382866 - RNA, 11 nt, Human
cugauuugcug

SEQ ID NO: 2382867 - RNA, 11 nt, Human
cugauuugcaa

SEQ ID NO: 2382868 - RNA, 21 nt, Human
cugauuugcugggcaguuuuu

SEQ ID NO: 2382869 - RNA, 15 nt, Human
cugauggucagcucc

SEQ ID NO: 2382870 - RNA, 16 nt, Human
cugauggucagcuccc

SEQ ID NO: 2382871 - RNA, 18 nt, Human
cugauccuggaggcccag

SEQ ID NO: 2382872 - RNA, 14 nt, Human
cugauggucagcuc

SEQ ID NO: 2382873 - RNA, 17 nt, Human
cugauuggugcaacccu

SEQ ID NO: 2382874 - RNA, 19 nt, Human
cugauggucagcucccuuc

SEQ ID NO: 2382875 - RNA, 17 nt, Human
cugauugugucucuugg

SEQ ID NO: 2382876 - RNA, 13 nt, Human
cugauuguauuua

SEQ ID NO: 2382877 - RNA, 14 nt, Human
cugauuguaacguu

SEQ ID NO: 2382878 - RNA, 18 nt, Human
cugauuguaacguugcug

SEQ ID NO: 2382879 - RNA, 20 nt, Human
cugauuguaacguugcugug

SEQ ID NO: 2382880 - RNA, 21 nt, Human
cugauuguaacguugcugugg

SEQ ID NO: 2382881 - RNA, 17 nt, Human
cugauggugcaaugacc

SEQ ID NO: 2382882 - RNA, 19 nt, Human
cugauggugcaaugaccuu

SEQ ID NO: 2382883 - RNA, 20 nt, Human
cugauggugcaaugaccuuu

SEQ ID NO: 2382884 - RNA, 21 nt, Human
cugauggugcaaugaccuuuc

SEQ ID NO: 2382885 - RNA, 22 nt, Human
cugauuuuaacaauaacuacug

SEQ ID NO: 2382886 - RNA, 17 nt, Human
cugauuuuaacaauaac

SEQ ID NO: 2382887 - RNA, 14 nt, Human
cugauuuuaacaau

SEQ ID NO: 2382888 - RNA, 13 nt, Human
cugauuuuaacaa

SEQ ID NO: 2382889 - RNA, 12 nt, Human
cugauuuuaaca

SEQ ID NO: 2382890 - RNA, 14 nt, Human
cugauuuggaaaaa

SEQ ID NO: 2382891 - RNA, 18 nt, Human
cugauuuucaaagcuuuu

SEQ ID NO: 2382892 - RNA, 20 nt, Human
cugauuuuuuuuccuuuuaa

SEQ ID NO: 2382893 - RNA, 19 nt, Human
cugauuuuuuuuccuuuua

SEQ ID NO: 2382894 - RNA, 15 nt, Human
cugauuuuuuuuccu

SEQ ID NO: 2382895 - RNA, 21 nt, Human
cugauuuucaaagcuuuuucc

SEQ ID NO: 2382896 - RNA, 16 nt, Human
cugauuuuuuuuuccu

SEQ ID NO: 2382897 - RNA, 18 nt, Human
cugauuuuuuuuuccuuc

SEQ ID NO: 2382898 - RNA, 19 nt, Human
cugauuuuuuuuuccuuca

SEQ ID NO: 2382899 - RNA, 20 nt, Human
cugauuuuuuuuuccuucag

SEQ ID NO: 2382900 - RNA, 18 nt, Human
cugcaaacgcugccugcc

SEQ ID NO: 2382901 - RNA, 20 nt, Human
cugcaaacgcugccugccca

SEQ ID NO: 2382902 - RNA, 19 nt, Human
cugcaaacgcugccugccc

SEQ ID NO: 2382903 - RNA, 19 nt, Human
cugcaaacgcugccugccg

SEQ ID NO: 2382904 - RNA, 16 nt, Human
cugcaaacucacugcu

SEQ ID NO: 2382905 - RNA, 20 nt, Human
cugcaaacucacugcucaag

SEQ ID NO: 2382906 - RNA, 15 nt, Human
cugcaaagcccagcu

SEQ ID NO: 2382907 - RNA, 13 nt, Human
cugcaaagcccag

SEQ ID NO: 2382908 - RNA, 23 nt, Human
cugcaaagaucuguccucagccu

SEQ ID NO: 2382909 - RNA, 22 nt, Human
cugcaaagaucuguccucagcc

SEQ ID NO: 2382910 - RNA, 23 nt, Human
cugauuuuuuuuuccuucagugc

SEQ ID NO: 2382911 - RNA, 15 nt, Human
cugcaaaaauauuua

SEQ ID NO: 2382912 - RNA, 21 nt, Human
cugcaaaaauauuuauaaaac

SEQ ID NO: 2382913 - RNA, 20 nt, Human
cugcaaaaauauuuauaaaa

SEQ ID NO: 2382914 - RNA, 17 nt, Human
cugcaaaaauauuuaua

SEQ ID NO: 2382915 - RNA, 21 nt, Human
cugauuuuuuuuuccuucagu

SEQ ID NO: 2382916 - RNA, 22 nt, Human
cugauuuuuuuuuccuucagug

SEQ ID NO: 2382917 - RNA, 13 nt, Human
cugcccagcuugg

SEQ ID NO: 2382918 - RNA, 18 nt, Human
cugcccagaucccagaag

SEQ ID NO: 2382919 - RNA, 14 nt, Human
cugcccagcuuggg

SEQ ID NO: 2382920 - RNA, 22 nt, Human
cugcccaucacaggguugggcc

SEQ ID NO: 2382921 - RNA, 18 nt, Human
cugcccaucacaggguug

SEQ ID NO: 2382922 - RNA, 15 nt, Human
cugcccaucacaggg

SEQ ID NO: 2382923 - RNA, 15 nt, Human
cugccccaaacaaau

SEQ ID NO: 2382924 - RNA, 20 nt, Human
cugcccauggacaggcuggc

SEQ ID NO: 2382925 - RNA, 21 nt, Human
cugcccaugucgcgcucagca

SEQ ID NO: 2382926 - RNA, 22 nt, Human
cugcccaugucgcgcucagcau

SEQ ID NO: 2382927 - RNA, 18 nt, Human
cugcccauggacaggcug

SEQ ID NO: 2382928 - RNA, 16 nt, Human
cugcccauggacaggc

SEQ ID NO: 2382929 - RNA, 18 nt, Human
cugcccaucugggaaaau

SEQ ID NO: 2382930 - RNA, 20 nt, Human
cugcccaucugggaaaauac

SEQ ID NO: 2382931 - RNA, 18 nt, Human
cugcccaugccaccgcuu

SEQ ID NO: 2382932 - RNA, 12 nt, Human
cugcccaccugu

SEQ ID NO: 2382933 - RNA, 17 nt, Human
cugccaugcagggccuc

SEQ ID NO: 2382934 - RNA, 18 nt, Human
cugcccacucccugcaac

SEQ ID NO: 2382935 - RNA, 18 nt, Human
cugcccagaguugcuggg

SEQ ID NO: 2382936 - RNA, 23 nt, Human
cugcccagaccccucuggccagg

SEQ ID NO: 2382937 - RNA, 22 nt, Human
cugcccagaccccucuggccag

SEQ ID NO: 2382938 - RNA, 21 nt, Human
cugcccagaccccucuggcca

SEQ ID NO: 2382939 - RNA, 18 nt, Human
cugcccagaccccucugg

SEQ ID NO: 2382940 - RNA, 17 nt, Human
cugcccagccuccaagc

SEQ ID NO: 2382941 - RNA, 22 nt, Human
cugcccagaguugcugggagcu

SEQ ID NO: 2382942 - RNA, 17 nt, Human
cugcccaccuggccucu

SEQ ID NO: 2382943 - RNA, 18 nt, Human
cugcccaccuggccucug

SEQ ID NO: 2382944 - RNA, 19 nt, Human
cugcccaccuggccucugc

SEQ ID NO: 2382945 - RNA, 20 nt, Human
cugcccaccuggccucugca

SEQ ID NO: 2382946 - RNA, 22 nt, Human
cugcccaccuggccucugcacu

SEQ ID NO: 2382947 - RNA, 14 nt, Human
cugcccacucccug

SEQ ID NO: 2382948 - RNA, 15 nt, Human
cugcccacucccugc

SEQ ID NO: 2382949 - RNA, 16 nt, Human
cugcccacucccugca

SEQ ID NO: 2382950 - RNA, 15 nt, Human
cugccaugcagggcc

SEQ ID NO: 2382951 - RNA, 18 nt, Human
cugccaucuucccagcag

SEQ ID NO: 2382952 - RNA, 16 nt, Human
cugccaugcagggccu

SEQ ID NO: 2382953 - RNA, 15 nt, Human
cugccaugccagcuu

SEQ ID NO: 2382954 - RNA, 13 nt, Human
cugcccaccuggc

SEQ ID NO: 2382955 - RNA, 14 nt, Human
cugcccaccuggcc

SEQ ID NO: 2382956 - RNA, 15 nt, Human
cugcccaccuggccu

SEQ ID NO: 2382957 - RNA, 23 nt, Human
cugccacuuugguacauggccag

SEQ ID NO: 2382958 - RNA, 17 nt, Human
cugccaggcaggggugg

SEQ ID NO: 2382959 - RNA, 20 nt, Human
cugccaggcagggguggggg

SEQ ID NO: 2382960 - RNA, 13 nt, Human
cugccaggccagc

SEQ ID NO: 2382961 - RNA, 15 nt, Human
cugccaggccagccu

SEQ ID NO: 2382962 - RNA, 16 nt, Human
cugccaggccagccuc

SEQ ID NO: 2382963 - RNA, 17 nt, Human
cugccaggccagccucc

SEQ ID NO: 2382964 - RNA, 18 nt, Human
cugccaggccagccuccg

SEQ ID NO: 2382965 - RNA, 19 nt, Human
cugccaucuuaguuuggau

SEQ ID NO: 2382966 - RNA, 19 nt, Human
cugccaggccagccuccga

SEQ ID NO: 2382967 - RNA, 20 nt, Human
cugccaggccagccuccgag

SEQ ID NO: 2382968 - RNA, 22 nt, Human
cugccaggccagccuccgagag

SEQ ID NO: 2382969 - RNA, 23 nt, Human
cugccaggccagccuccgagagg

SEQ ID NO: 2382970 - RNA, 14 nt, Human
cugccaugccagcu

SEQ ID NO: 2382971 - RNA, 22 nt, Human
cugccaucuuaguuuggauucu

SEQ ID NO: 2382972 - RNA, 23 nt, Human
cugccaucuuaguuuggauucuu

SEQ ID NO: 2382973 - RNA, 14 nt, Human
cugccaucuuccca

SEQ ID NO: 2382974 - RNA, 15 nt, Human
cugccaucuucccag

SEQ ID NO: 2382975 - RNA, 16 nt, Human
cugccaucuucccagc

SEQ ID NO: 2382976 - RNA, 17 nt, Human
cugccaucuucccagca

SEQ ID NO: 2382977 - RNA, 12 nt, Human
cugccacucaca

SEQ ID NO: 2382978 - RNA, 23 nt, Human
cugccacucaggcccaaagccuc

SEQ ID NO: 2382979 - RNA, 16 nt, Human
cugccacucaggccca

SEQ ID NO: 2382980 - RNA, 13 nt, Human
cugccacucacac

SEQ ID NO: 2382981 - RNA, 15 nt, Human
cugccacucacacag

SEQ ID NO: 2382982 - RNA, 16 nt, Human
cugccacucacuaggc

SEQ ID NO: 2382983 - RNA, 18 nt, Human
cugccacucacacagcca

SEQ ID NO: 2382984 - RNA, 20 nt, Human
cugccacucacacagccagg

SEQ ID NO: 2382985 - RNA, 19 nt, Human
cugccacuuugguacaugg

SEQ ID NO: 2382986 - RNA, 13 nt, Human
cugccacuuccca

SEQ ID NO: 2382987 - RNA, 16 nt, Human
cugccacuucccaggu

SEQ ID NO: 2382988 - RNA, 24 nt, Human
cugccacucacacagccaggugcc

SEQ ID NO: 2382989 - RNA, 19 nt, Human
cugccacucacuaggcccc

SEQ ID NO: 2382990 - RNA, 13 nt, Human
cugccaggcaugg

SEQ ID NO: 2382991 - RNA, 11 nt, Human
cugccaggcau

SEQ ID NO: 2382992 - RNA, 21 nt, Human
cugcauguaaacacgccugca

SEQ ID NO: 2382993 - RNA, 18 nt, Human
cugccaaugggagcucau

SEQ ID NO: 2382994 - RNA, 19 nt, Human
cugccaaugggagcucaug

SEQ ID NO: 2382995 - RNA, 18 nt, Human
cugccaccuggggcaguc

SEQ ID NO: 2382996 - RNA, 16 nt, Human
cugccaccuggggcag

SEQ ID NO: 2382997 - RNA, 15 nt, Human
cugccaccuggggca

SEQ ID NO: 2382998 - RNA, 14 nt, Human
cugccaccuggggc

SEQ ID NO: 2382999 - RNA, 15 nt, Human
cugccaccugcugcu

SEQ ID NO: 2383000 - RNA, 24 nt, Human
cugccacacgucugacccucucca

SEQ ID NO: 2383001 - RNA, 23 nt, Human
cugccacacgucugacccucucc

SEQ ID NO: 2383002 - RNA, 22 nt, Human
cugccacacgucugacccucuc

SEQ ID NO: 2383003 - RNA, 15 nt, Human
cugccacaccugagc

SEQ ID NO: 2383004 - RNA, 16 nt, Human
cugccacaccugagcc

SEQ ID NO: 2383005 - RNA, 13 nt, Human
cugccacacaaac

SEQ ID NO: 2383006 - RNA, 15 nt, Human
cugccacacaaacgu

SEQ ID NO: 2383007 - RNA, 12 nt, Human
cugccacacagg

SEQ ID NO: 2383008 - RNA, 22 nt, Human
cugccacacaaacguauguaaa

SEQ ID NO: 2383009 - RNA, 23 nt, Human
cugccacacaaacguauguaaau

SEQ ID NO: 2383010 - RNA, 21 nt, Human
cugcaucuuggggacaucucu

SEQ ID NO: 2383011 - RNA, 20 nt, Human
cugcaugccuggucuuuccu

SEQ ID NO: 2383012 - RNA, 22 nt, Human
cugcaugccuggucuuuccucu

SEQ ID NO: 2383013 - RNA, 23 nt, Human
cugcaugccuggucuuuccucug

SEQ ID NO: 2383014 - RNA, 23 nt, Human
cugcaugcgagugcucauuucag

SEQ ID NO: 2383015 - RNA, 14 nt, Human
cugcaugcggccca

SEQ ID NO: 2383016 - RNA, 15 nt, Human
cugcaugcggcccag

SEQ ID NO: 2383017 - RNA, 16 nt, Human
cugcaugcggcccagc

SEQ ID NO: 2383018 - RNA, 17 nt, Human
cugcaugcggcccagcc

SEQ ID NO: 2383019 - RNA, 18 nt, Human
cugcaugcggcccagccc

SEQ ID NO: 2383020 - RNA, 20 nt, Human
cugcaugcggcccagcccgg

SEQ ID NO: 2383021 - RNA, 22 nt, Human
cugcaugcugcuggacaguauc

SEQ ID NO: 2383022 - RNA, 18 nt, Human
cugcaugcugcuggacag

SEQ ID NO: 2383023 - RNA, 19 nt, Human
cugcaugcuggguucugca

SEQ ID NO: 2383024 - RNA, 21 nt, Human
cugcaugcuggguucugcaca

SEQ ID NO: 2383025 - RNA, 15 nt, Human
cugcaugcugcugga

SEQ ID NO: 2383026 - RNA, 13 nt, Human
cugcaugcugcug

SEQ ID NO: 2383027 - RNA, 12 nt, Human
cugcaugcugcu

SEQ ID NO: 2383028 - RNA, 21 nt, Human
cugcaugcggcccagcccggc

SEQ ID NO: 2383029 - RNA, 18 nt, Human
cugcaugcgggcuuccuc

SEQ ID NO: 2383030 - RNA, 22 nt, Human
cugcaugcgggcuuccuccugg

SEQ ID NO: 2383031 - RNA, 16 nt, Human
cugcaucguuucaucu

SEQ ID NO: 2383032 - RNA, 20 nt, Human
cugcauccuccgccucccgg

SEQ ID NO: 2383033 - RNA, 19 nt, Human
cugcauccguaguucccug

SEQ ID NO: 2383034 - RNA, 22 nt, Human
cugcauccccuuggcugugagg

SEQ ID NO: 2383035 - RNA, 15 nt, Human
cugcauccccuuggc

SEQ ID NO: 2383036 - RNA, 16 nt, Human
cugcauccccuuggcu

SEQ ID NO: 2383037 - RNA, 12 nt, Human
cugcauccccuu

SEQ ID NO: 2383038 - RNA, 21 nt, Human
cugcauccguaguucccugaa

SEQ ID NO: 2383039 - RNA, 20 nt, Human
cugcauccguaguucccuga

SEQ ID NO: 2383040 - RNA, 17 nt, Human
cugcauccuccaagaau

SEQ ID NO: 2383041 - RNA, 23 nt, Human
cugcauccuccaagaaucuaucu

SEQ ID NO: 2383042 - RNA, 19 nt, Human
cugcauccuccgccucccg

SEQ ID NO: 2383043 - RNA, 15 nt, Human
cugcaucuacuccca

SEQ ID NO: 2383044 - RNA, 20 nt, Human
cugcaucuagaggcuuccuu

SEQ ID NO: 2383045 - RNA, 17 nt, Human
cugcaucuacucccaag

SEQ ID NO: 2383046 - RNA, 18 nt, Human
cugcaucuacucccaagu

SEQ ID NO: 2383047 - RNA, 22 nt, Human
cugcaucguuucaucuuccaac

SEQ ID NO: 2383048 - RNA, 21 nt, Human
cugcaucugaccagcagcgcc

SEQ ID NO: 2383049 - RNA, 20 nt, Human
cugcaucugaccagcagcgc

SEQ ID NO: 2383050 - RNA, 19 nt, Human
cugcaucugaccagcagcg

SEQ ID NO: 2383051 - RNA, 18 nt, Human
cugcaucugaccagcagc

SEQ ID NO: 2383052 - RNA, 17 nt, Human
cugcaucugaccagcag

SEQ ID NO: 2383053 - RNA, 16 nt, Human
cugcaucugaccagca

SEQ ID NO: 2383054 - RNA, 21 nt, Human
cugcaucuagaggcuuccuuc

SEQ ID NO: 2383055 - RNA, 22 nt, Human
cugcaucugaccagcagcgccu

SEQ ID NO: 2383056 - RNA, 21 nt, Human
cugcaucugggauucccacca

SEQ ID NO: 2383057 - RNA, 13 nt, Human
cugcaucuugggg

SEQ ID NO: 2383058 - RNA, 14 nt, Human
cugcaucuugggga

SEQ ID NO: 2383059 - RNA, 16 nt, Human
cugcaucuuggggaca

SEQ ID NO: 2383060 - RNA, 19 nt, Human
cugcaucuuggggacaucu

SEQ ID NO: 2383061 - RNA, 17 nt, Human
cugcaguugccagucac

SEQ ID NO: 2383062 - RNA, 21 nt, Human
cugcaguugccagucaccccg

SEQ ID NO: 2383063 - RNA, 22 nt, Human
cugcaguugccagucaccccgg

SEQ ID NO: 2383064 - RNA, 23 nt, Human
cugcacuugcagacucuacagag

SEQ ID NO: 2383065 - RNA, 16 nt, Human
cugcacuggaguccag

SEQ ID NO: 2383066 - RNA, 19 nt, Human
cugcaguugccagucaccc

SEQ ID NO: 2383067 - RNA, 18 nt, Human
cugccuggacuagaggga

SEQ ID NO: 2383068 - RNA, 22 nt, Human
cugccuggagacuuagggcacc

SEQ ID NO: 2383069 - RNA, 11 nt, Human
cugccuggagc

SEQ ID NO: 2383070 - RNA, 12 nt, Human
cugccuggcagg

SEQ ID NO: 2383071 - RNA, 21 nt, Human
cugccuugaagccacugaagc

SEQ ID NO: 2383072 - RNA, 20 nt, Human
cugccuugaagccacugaag

SEQ ID NO: 2383073 - RNA, 16 nt, Human
cugccuugaagccacu

SEQ ID NO: 2383074 - RNA, 24 nt, Human
cugccuucuucggggaacuccugg

SEQ ID NO: 2383075 - RNA, 15 nt, Human
cugccuucuucuuuu

SEQ ID NO: 2383076 - RNA, 21 nt, Human
cugccuucuucuuuuugcugu

SEQ ID NO: 2383077 - RNA, 15 nt, Human
cugccuucuguccug

SEQ ID NO: 2383078 - RNA, 16 nt, Human
cugccuucuguccugg

SEQ ID NO: 2383079 - RNA, 17 nt, Human
cugccuucuguccuggu

SEQ ID NO: 2383080 - RNA, 21 nt, Human
cugccuucuguccugguguca

SEQ ID NO: 2383081 - RNA, 21 nt, Human
cugccuucgcuucuugccucu

SEQ ID NO: 2383082 - RNA, 23 nt, Human
cugccuucgcuucuugccucugu

SEQ ID NO: 2383083 - RNA, 20 nt, Human
cugccuucuggauucuuggc

SEQ ID NO: 2383084 - RNA, 12 nt, Human
cugccuucuguc

SEQ ID NO: 2383085 - RNA, 13 nt, Human
cugccuucugucc

SEQ ID NO: 2383086 - RNA, 17 nt, Human
cugccucugacacacag

SEQ ID NO: 2383087 - RNA, 18 nt, Human
cugccucugacacacagc

SEQ ID NO: 2383088 - RNA, 21 nt, Human
cugccucugacacacagcucu

SEQ ID NO: 2383089 - RNA, 19 nt, Human
cugccugccccgcccccag

SEQ ID NO: 2383090 - RNA, 21 nt, Human
cugccugccccgcccccaguc

SEQ ID NO: 2383091 - RNA, 13 nt, Human
cugccuccaggaa

SEQ ID NO: 2383092 - RNA, 14 nt, Human
cugccugccccgcc

SEQ ID NO: 2383093 - RNA, 15 nt, Human
cugccugccccgccc

SEQ ID NO: 2383094 - RNA, 18 nt, Human
cugccugccccgccccca

SEQ ID NO: 2383095 - RNA, 22 nt, Human
cugccugccccgcccccagucc

SEQ ID NO: 2383096 - RNA, 21 nt, Human
cugccugcccaggccccugcc

SEQ ID NO: 2383097 - RNA, 22 nt, Human
cugccugcccaggccccugcca

SEQ ID NO: 2383098 - RNA, 23 nt, Human
cugcgucuggaggggccccugcu

SEQ ID NO: 2383099 - RNA, 15 nt, Human
cugcgugccugugga

SEQ ID NO: 2383100 - RNA, 15 nt, Human
cugcguggggacagg

SEQ ID NO: 2383101 - RNA, 13 nt, Human
cugcgucuguguu

SEQ ID NO: 2383102 - RNA, 19 nt, Human
cugcgugacaauaaaacau

SEQ ID NO: 2383103 - RNA, 15 nt, Human
cugcgucuggagggg

SEQ ID NO: 2383104 - RNA, 16 nt, Human
cugcgucuggaggggc

SEQ ID NO: 2383105 - RNA, 18 nt, Human
cugcgucuggaggggccc

SEQ ID NO: 2383106 - RNA, 22 nt, Human
cugcgucuggaggggccccugc

SEQ ID NO: 2383107 - RNA, 24 nt, Human
cugcguccuccucaccucaugccc

SEQ ID NO: 2383108 - RNA, 14 nt, Human
cugcgucuggaggg

SEQ ID NO: 2383109 - RNA, 19 nt, Human
cugcggcugcugugugccu

SEQ ID NO: 2383110 - RNA, 19 nt, Human
cugcgucaugcuuguguua

SEQ ID NO: 2383111 - RNA, 13 nt, Human
cugcguccuccuc

SEQ ID NO: 2383112 - RNA, 14 nt, Human
cugcguccuccuca

SEQ ID NO: 2383113 - RNA, 15 nt, Human
cugcguccuccucac

SEQ ID NO: 2383114 - RNA, 17 nt, Human
cugcguccuccucaccu

SEQ ID NO: 2383115 - RNA, 18 nt, Human
cugcguccuccucaccuc

SEQ ID NO: 2383116 - RNA, 19 nt, Human
cugcguccuccucaccuca

SEQ ID NO: 2383117 - RNA, 19 nt, Human
cugcgguccacccaggagc

SEQ ID NO: 2383118 - RNA, 20 nt, Human
cugcgguccacccaggagcc

SEQ ID NO: 2383119 - RNA, 22 nt, Human
cugcgggaugguccuggggcuc

SEQ ID NO: 2383120 - RNA, 20 nt, Human
cugcgggaugguccuggggc

SEQ ID NO: 2383121 - RNA, 18 nt, Human
cugcgguccacccaggag

SEQ ID NO: 2383122 - RNA, 18 nt, Human
cugccuuuggcagaguuc

SEQ ID NO: 2383123 - RNA, 21 nt, Human
cugccuuugcuccucccaugu

SEQ ID NO: 2383124 - RNA, 17 nt, Human
cugcgaaggggcccugg

SEQ ID NO: 2383125 - RNA, 22 nt, Human
cugccuugaagccacugaagcu

SEQ ID NO: 2383126 - RNA, 22 nt, Human
cugccuucuucuuuuugcuguu

SEQ ID NO: 2383127 - RNA, 22 nt, Human
cugccuuuauuguguuugucau

SEQ ID NO: 2383128 - RNA, 24 nt, Human
cugccuuuauuguguuugucauua

SEQ ID NO: 2383129 - RNA, 19 nt, Human
cugcgaaggggcccugguc

SEQ ID NO: 2383130 - RNA, 18 nt, Human
cugcgaaggggcccuggu

SEQ ID NO: 2383131 - RNA, 18 nt, Human
cugcggagugaagagggg

SEQ ID NO: 2383132 - RNA, 19 nt, Human
cugcggagugaagaggggc

SEQ ID NO: 2383133 - RNA, 20 nt, Human
cugcggagugaagaggggca

SEQ ID NO: 2383134 - RNA, 21 nt, Human
cugcggagugaagaggggcag

SEQ ID NO: 2383135 - RNA, 23 nt, Human
cugcggagugaagaggggcagcc

SEQ ID NO: 2383136 - RNA, 21 nt, Human
cugcggcacccuugcgcuuuu

SEQ ID NO: 2383137 - RNA, 14 nt, Human
cugcggcaucagau

SEQ ID NO: 2383138 - RNA, 22 nt, Human
cugcggagugaagaggggcagc

SEQ ID NO: 2383139 - RNA, 15 nt, Human
cugcggccugcugga

SEQ ID NO: 2383140 - RNA, 19 nt, Human
cugcgggaugguccugggg

SEQ ID NO: 2383141 - RNA, 18 nt, Human
cugcgggaugguccuggg

SEQ ID NO: 2383142 - RNA, 17 nt, Human
cugcgggaugguccugg

SEQ ID NO: 2383143 - RNA, 16 nt, Human
cugcggcugcugugug

SEQ ID NO: 2383144 - RNA, 17 nt, Human
cugcggcugcugugugc

SEQ ID NO: 2383145 - RNA, 22 nt, Human
cugccuccagaauggucuuucu

SEQ ID NO: 2383146 - RNA, 14 nt, Human
cugccuccagggcu

SEQ ID NO: 2383147 - RNA, 18 nt, Human
cugccuccacucccacuu

SEQ ID NO: 2383148 - RNA, 19 nt, Human
cugccuccacucccacuuc

SEQ ID NO: 2383149 - RNA, 17 nt, Human
cugccuccacucccacu

SEQ ID NO: 2383150 - RNA, 16 nt, Human
cugccuccacucccac

SEQ ID NO: 2383151 - RNA, 14 nt, Human
cugccuccagaaug

SEQ ID NO: 2383152 - RNA, 15 nt, Human
cugccuccagggcug

SEQ ID NO: 2383153 - RNA, 16 nt, Human
cugccuccagggcugg

SEQ ID NO: 2383154 - RNA, 17 nt, Human
cugccuccagggcugga

SEQ ID NO: 2383155 - RNA, 18 nt, Human
cugccuccagggcuggac

SEQ ID NO: 2383156 - RNA, 19 nt, Human
cugccuccagggcuggacu

SEQ ID NO: 2383157 - RNA, 20 nt, Human
cugccuccagggcuggacug

SEQ ID NO: 2383158 - RNA, 22 nt, Human
cugccuccagggcuggacugag

SEQ ID NO: 2383159 - RNA, 23 nt, Human
cugccuccagggcuggacugagg

SEQ ID NO: 2383160 - RNA, 15 nt, Human
cugccucucugcagg

SEQ ID NO: 2383161 - RNA, 16 nt, Human
cugccucucugcaggu

SEQ ID NO: 2383162 - RNA, 17 nt, Human
cugccucucugcagguc

SEQ ID NO: 2383163 - RNA, 18 nt, Human
cugccucucugcaggucc

SEQ ID NO: 2383164 - RNA, 16 nt, Human
cugccuaggcugaccu

SEQ ID NO: 2383165 - RNA, 15 nt, Human
cugccucagccuccc

SEQ ID NO: 2383166 - RNA, 19 nt, Human
cugccucagccucccaaag

SEQ ID NO: 2383167 - RNA, 17 nt, Human
cugccucagccucccga

SEQ ID NO: 2383168 - RNA, 10 nt, Human
cugccucagg

SEQ ID NO: 2383169 - RNA, 18 nt, Human
cugccucagccucccaag

SEQ ID NO: 2383170 - RNA, 14 nt, Human
cugccuacucacga

SEQ ID NO: 2383171 - RNA, 14 nt, Human
cugccuacugcauc

SEQ ID NO: 2383172 - RNA, 13 nt, Human
cugccuacucacg

SEQ ID NO: 2383173 - RNA, 15 nt, Human
cugccuacugcaucg

SEQ ID NO: 2383174 - RNA, 20 nt, Human
cugccuaaguggcugcugac

SEQ ID NO: 2383175 - RNA, 21 nt, Human
cugccggcccuggggcuaggc

SEQ ID NO: 2383176 - RNA, 16 nt, Human
cugccggcccuggggc

SEQ ID NO: 2383177 - RNA, 15 nt, Human
cugccggcccugggg

SEQ ID NO: 2383178 - RNA, 19 nt, Human
cugccuaaguggcugcuga

SEQ ID NO: 2383179 - RNA, 19 nt, Human
cugccuaggaauucccagc

SEQ ID NO: 2383180 - RNA, 19 nt, Human
cugccgccucccagccugg

SEQ ID NO: 2383181 - RNA, 18 nt, Human
cugccgccucccagccug

SEQ ID NO: 2383182 - RNA, 16 nt, Human
cugccgccucccagcc

SEQ ID NO: 2383183 - RNA, 15 nt, Human
cugccgccucccagc

SEQ ID NO: 2383184 - RNA, 14 nt, Human
cugccgccucccag

SEQ ID NO: 2383185 - RNA, 23 nt, Human
cugccgcagcccugcagagggca

SEQ ID NO: 2383186 - RNA, 16 nt, Human
cugccgcagagcuggc

SEQ ID NO: 2383187 - RNA, 18 nt, Human
cugccgcagagcuggccg

SEQ ID NO: 2383188 - RNA, 16 nt, Human
cugccgccccacccag

SEQ ID NO: 2383189 - RNA, 19 nt, Human
cugccgcagcccugcagag

SEQ ID NO: 2383190 - RNA, 20 nt, Human
cugccgcagcccugcagagg

SEQ ID NO: 2383191 - RNA, 21 nt, Human
cugccgcagcccugcagaggg

SEQ ID NO: 2383192 - RNA, 22 nt, Human
cugccgcagcccugcagagggc

SEQ ID NO: 2383193 - RNA, 17 nt, Human
cugccgcaccccagagu

SEQ ID NO: 2383194 - RNA, 16 nt, Human
cugccgcaccccagag

SEQ ID NO: 2383195 - RNA, 13 nt, Human
cugccgcagagcu

SEQ ID NO: 2383196 - RNA, 14 nt, Human
cugccgcagagcug

SEQ ID NO: 2383197 - RNA, 15 nt, Human
cugccgcagagcugg

SEQ ID NO: 2383198 - RNA, 17 nt, Human
cugccccugccccguca

SEQ ID NO: 2383199 - RNA, 16 nt, Human
cugccccugccccguc

SEQ ID NO: 2383200 - RNA, 14 nt, Human
cugccgcaccccag

SEQ ID NO: 2383201 - RNA, 15 nt, Human
cugccgcaccccaga

SEQ ID NO: 2383202 - RNA, 12 nt, Human
cugccgcagccc

SEQ ID NO: 2383203 - RNA, 13 nt, Human
cugccgcagcccu

SEQ ID NO: 2383204 - RNA, 21 nt, Human
cugccccaaacaaauaugcaa

SEQ ID NO: 2383205 - RNA, 20 nt, Human
cugccccuccucucugcccu

SEQ ID NO: 2383206 - RNA, 21 nt, Human
cugccccuccucucugcccua

SEQ ID NO: 2383207 - RNA, 17 nt, Human
cugccccaaccugcuga

SEQ ID NO: 2383208 - RNA, 10 nt, Human
cugccccugc

SEQ ID NO: 2383209 - RNA, 14 nt, Human
cugccccugccccg

SEQ ID NO: 2383210 - RNA, 11 nt, Human
cugccccugcc

SEQ ID NO: 2383211 - RNA, 13 nt, Human
cugccccugcccc

SEQ ID NO: 2383212 - RNA, 22 nt, Human
cugaaguuggagugaguguggc

SEQ ID NO: 2383213 - RNA, 13 nt, Human
cugaaguuucaca

SEQ ID NO: 2383214 - RNA, 16 nt, Human
cugaaguuaacagaga

SEQ ID NO: 2383215 - RNA, 21 nt, Human
cugaaguguuucacgagagcc

SEQ ID NO: 2383216 - RNA, 14 nt, Human
cugaaguucaccau

SEQ ID NO: 2383217 - RNA, 17 nt, Human
cugaaguucagcugcau

SEQ ID NO: 2383218 - RNA, 22 nt, Human
cugaagucccagauacuugggg

SEQ ID NO: 2383219 - RNA, 15 nt, Human
cugaacccugugcug

SEQ ID NO: 2383220 - RNA, 14 nt, Human
cugaagucugaaau

SEQ ID NO: 2383221 - RNA, 15 nt, Human
cugaagucugaaauu

SEQ ID NO: 2383222 - RNA, 13 nt, Human
cugaagucugaaa

SEQ ID NO: 2383223 - RNA, 17 nt, Human
cugaagucuuuguacag

SEQ ID NO: 2383224 - RNA, 20 nt, Human
cugaagucuuuguacagaca

SEQ ID NO: 2383225 - RNA, 19 nt, Human
cugaagucacaucacagga

SEQ ID NO: 2383226 - RNA, 21 nt, Human
cugaagucacacagugagucg

SEQ ID NO: 2383227 - RNA, 22 nt, Human
cugaagucacaucacaggacac

SEQ ID NO: 2383228 - RNA, 21 nt, Human
cugaagucacaucacaggaca

SEQ ID NO: 2383229 - RNA, 13 nt, Human
cugaagucacugc

SEQ ID NO: 2383230 - RNA, 14 nt, Human
cugaagucacugca

SEQ ID NO: 2383231 - RNA, 15 nt, Human
cugaagucacugcac

SEQ ID NO: 2383232 - RNA, 18 nt, Human
cugaagucacacagugag

SEQ ID NO: 2383233 - RNA, 19 nt, Human
cugaagucacacagugagu

SEQ ID NO: 2383234 - RNA, 17 nt, Human
cugaagucacacaguga

SEQ ID NO: 2383235 - RNA, 14 nt, Human
cugaagaagauggu

SEQ ID NO: 2383236 - RNA, 21 nt, Human
cugaauuaaugacagagccag

SEQ ID NO: 2383237 - RNA, 17 nt, Human
cugaauuaguccuugcu

SEQ ID NO: 2383238 - RNA, 22 nt, Human
cugaauuaaugacagagccagu

SEQ ID NO: 2383239 - RNA, 18 nt, Human
cugaauuaguccuugcuu

SEQ ID NO: 2383240 - RNA, 19 nt, Human
cugaauuaguccuugcuug

SEQ ID NO: 2383241 - RNA, 20 nt, Human
cugaauuaguccuugcuugg

SEQ ID NO: 2383242 - RNA, 22 nt, Human
cugaauuaguccuugcuuggcu

SEQ ID NO: 2383243 - RNA, 20 nt, Human
cugaauuaaugacagagcca

SEQ ID NO: 2383244 - RNA, 17 nt, Human
cugaauuaaucaucuau

SEQ ID NO: 2383245 - RNA, 20 nt, Human
cugaauguucugacauuaac

SEQ ID NO: 2383246 - RNA, 19 nt, Human
cugaauguucugacauuaa

SEQ ID NO: 2383247 - RNA, 18 nt, Human
cugaauguucugacauua

SEQ ID NO: 2383248 - RNA, 17 nt, Human
cugaauguucugacauu

SEQ ID NO: 2383249 - RNA, 23 nt, Human
cugaauguucugacauuaacagu

SEQ ID NO: 2383250 - RNA, 22 nt, Human
cugaauguucugacauuaacag

SEQ ID NO: 2383251 - RNA, 15 nt, Human
cugaauguugggacu

SEQ ID NO: 2383252 - RNA, 16 nt, Human
cugaauguugggacug

SEQ ID NO: 2383253 - RNA, 19 nt, Human
cugaauguugggacugcua

SEQ ID NO: 2383254 - RNA, 19 nt, Human
cugaauguuuauuccuuga

SEQ ID NO: 2383255 - RNA, 16 nt, Human
cugaauguuuauuccu

SEQ ID NO: 2383256 - RNA, 18 nt, Human
cugaauguuuauuccuug

SEQ ID NO: 2383257 - RNA, 12 nt, Human
cugaauuauuuu

SEQ ID NO: 2383258 - RNA, 12 nt, Human
cugaauuucuuu

SEQ ID NO: 2383259 - RNA, 23 nt, Human
cugaauuaucuauacauaucuuu

SEQ ID NO: 2383260 - RNA, 14 nt, Human
cugaauuauaagag

SEQ ID NO: 2383261 - RNA, 24 nt, Human
cugaauuauaagaggcugauaauu

SEQ ID NO: 2383262 - RNA, 11 nt, Human
cugaauguauu

SEQ ID NO: 2383263 - RNA, 18 nt, Human
cugaaugguccaggguug

SEQ ID NO: 2383264 - RNA, 18 nt, Human
cugaaugguuccaugccu

SEQ ID NO: 2383265 - RNA, 16 nt, Human
cugaauguucugacau

SEQ ID NO: 2383266 - RNA, 14 nt, Human
cugaauguucugac

SEQ ID NO: 2383267 - RNA, 13 nt, Human
cugaauguucuga

SEQ ID NO: 2383268 - RNA, 12 nt, Human
cugaauguucug

SEQ ID NO: 2383269 - RNA, 11 nt, Human
cugaauguucu

SEQ ID NO: 2383270 - RNA, 22 nt, Human
cugaaugguuccaugccugagg

SEQ ID NO: 2383271 - RNA, 20 nt, Human
cugaaugguuuucaaaauaa

SEQ ID NO: 2383272 - RNA, 19 nt, Human
cugaaugguuuucaaaaua

SEQ ID NO: 2383273 - RNA, 12 nt, Human
cugaaugcucug

SEQ ID NO: 2383274 - RNA, 17 nt, Human
cugaaugcucugugcga

SEQ ID NO: 2383275 - RNA, 22 nt, Human
cugaaugccucaaugugaccag

SEQ ID NO: 2383276 - RNA, 23 nt, Human
cugaaugccucaaugugaccagg

SEQ ID NO: 2383277 - RNA, 15 nt, Human
cugaauaaauaccuc

SEQ ID NO: 2383278 - RNA, 20 nt, Human
cugaaugaggucagcauguc

SEQ ID NO: 2383279 - RNA, 21 nt, Human
cugaauaaauaccucuuagcu

SEQ ID NO: 2383280 - RNA, 22 nt, Human
cugaauggaagguuuguauauu

SEQ ID NO: 2383281 - RNA, 14 nt, Human
cugaaugguccagg

SEQ ID NO: 2383282 - RNA, 15 nt, Human
cugaaugguccaggg

SEQ ID NO: 2383283 - RNA, 16 nt, Human
cugaaugguccagggu

SEQ ID NO: 2383284 - RNA, 16 nt, Human
cugaaugcugcuacuu

SEQ ID NO: 2383285 - RNA, 19 nt, Human
cugaaugcuuauagguggc

SEQ ID NO: 2383286 - RNA, 21 nt, Human
cugaaugcuuauagguggccu

SEQ ID NO: 2383287 - RNA, 22 nt, Human
cugaaugcuuauagguggccuc

SEQ ID NO: 2383288 - RNA, 16 nt, Human
cugaaccccucccucc

SEQ ID NO: 2383289 - RNA, 21 nt, Human
cugaaccccgucgaggggcuc

SEQ ID NO: 2383290 - RNA, 12 nt, Human
cugaacuuugcu

SEQ ID NO: 2383291 - RNA, 13 nt, Human
cugaacccugugc

SEQ ID NO: 2383292 - RNA, 14 nt, Human
cugaacccugugcu

SEQ ID NO: 2383293 - RNA, 16 nt, Human
cugaaccaucccugau

SEQ ID NO: 2383294 - RNA, 14 nt, Human
cugaaccaucccug

SEQ ID NO: 2383295 - RNA, 13 nt, Human
cugaagaacagua

SEQ ID NO: 2383296 - RNA, 14 nt, Human
cugaagaaccaguc

SEQ ID NO: 2383297 - RNA, 22 nt, Human
cugaagaaccaguccccccacc

SEQ ID NO: 2383298 - RNA, 15 nt, Human
cugaagaaccagucc

SEQ ID NO: 2383299 - RNA, 21 nt, Human
cugaacuuugcugagccugua

SEQ ID NO: 2383300 - RNA, 14 nt, Human
cugaacuuugcuga

SEQ ID NO: 2383301 - RNA, 13 nt, Human
cugaacuuugcug

SEQ ID NO: 2383302 - RNA, 15 nt, Human
cugaacauuccagag

SEQ ID NO: 2383303 - RNA, 17 nt, Human
cugaacauccuuccuuc

SEQ ID NO: 2383304 - RNA, 20 nt, Human
cugaacauccuuccuuccca

SEQ ID NO: 2383305 - RNA, 14 nt, Human
cugaacauugcaua

SEQ ID NO: 2383306 - RNA, 21 nt, Human
cugaacaauaggcuguuccca

SEQ ID NO: 2383307 - RNA, 19 nt, Human
cugaacaauaggcuguucc

SEQ ID NO: 2383308 - RNA, 16 nt, Human
cugaacaauucucucu

SEQ ID NO: 2383309 - RNA, 16 nt, Human
cugaacaaaaaauaaa

SEQ ID NO: 2383310 - RNA, 21 nt, Human
cugaacaaacuaucagaggaa

SEQ ID NO: 2383311 - RNA, 16 nt, Human
cugaacaagaauugga

SEQ ID NO: 2383312 - RNA, 14 nt, Human
cugaacaagaauug

SEQ ID NO: 2383313 - RNA, 13 nt, Human
cugaacaagaauu

SEQ ID NO: 2383314 - RNA, 12 nt, Human
cugaacaagaau

SEQ ID NO: 2383315 - RNA, 22 nt, Human
cugaaauuuuauaugcuuacug

SEQ ID NO: 2383316 - RNA, 19 nt, Human
cugaaauuuuauaugcuua

SEQ ID NO: 2383317 - RNA, 18 nt, Human
cugaaauucuccuggagg

SEQ ID NO: 2383318 - RNA, 19 nt, Human
cugaaauucuccuggaggu

SEQ ID NO: 2383319 - RNA, 14 nt, Human
cugaaauucuccug

SEQ ID NO: 2383320 - RNA, 15 nt, Human
cugaaauucuccugg

SEQ ID NO: 2383321 - RNA, 16 nt, Human
cugaaauucuccugga

SEQ ID NO: 2383322 - RNA, 17 nt, Human
cugaaauucuccuggag

SEQ ID NO: 2383323 - RNA, 20 nt, Human
cugaaaugcugcauuuuaau

SEQ ID NO: 2383324 - RNA, 19 nt, Human
cugaaagugaaaguccaga

SEQ ID NO: 2383325 - RNA, 23 nt, Human
cugaaagugaaaguccagaaacu

SEQ ID NO: 2383326 - RNA, 14 nt, Human
cucuuuucaaaaca

SEQ ID NO: 2383327 - RNA, 23 nt, Human
cugaaagggacgcuacccgggaa

SEQ ID NO: 2383328 - RNA, 20 nt, Human
cucuuuguucuaaagaugga

SEQ ID NO: 2383329 - RNA, 21 nt, Human
cucuucugccggcccuggggc

SEQ ID NO: 2383330 - RNA, 14 nt, Human
cucuuugucuaaaa

SEQ ID NO: 2383331 - RNA, 12 nt, Human
cucuuuguaaga

SEQ ID NO: 2383332 - RNA, 21 nt, Human
cucuuugucuaaaacaauaaa

SEQ ID NO: 2383333 - RNA, 18 nt, Human
cucuuugucuaaaacaau

SEQ ID NO: 2383334 - RNA, 17 nt, Human
cucuuugucuaaaacaa

SEQ ID NO: 2383335 - RNA, 16 nt, Human
cucuuugucuaaaaca

SEQ ID NO: 2383336 - RNA, 22 nt, Human
cucuuugucuaaaacaauaaaa

SEQ ID NO: 2383337 - RNA, 17 nt, Human
cucuuuguucucagcuc

SEQ ID NO: 2383338 - RNA, 19 nt, Human
cucuuuguucucagcuccc

SEQ ID NO: 2383339 - RNA, 13 nt, Human
cucuucugcucca

SEQ ID NO: 2383340 - RNA, 12 nt, Human
cucuucugcucc

SEQ ID NO: 2383341 - RNA, 20 nt, Human
cucuucugccggcccugggg

SEQ ID NO: 2383342 - RNA, 16 nt, Human
cucuucugcaucuugg

SEQ ID NO: 2383343 - RNA, 23 nt, Human
cucuucugagcuauuucaucuau

SEQ ID NO: 2383344 - RNA, 22 nt, Human
cucuucugagcuauuucaucua

SEQ ID NO: 2383345 - RNA, 21 nt, Human
cucuucugagcuauuucaucu

SEQ ID NO: 2383346 - RNA, 18 nt, Human
cucuucugagcuauuuca

SEQ ID NO: 2383347 - RNA, 15 nt, Human
cucuucugagcuauu

SEQ ID NO: 2383348 - RNA, 22 nt, Human
cucuuuggucuacacugugcug

SEQ ID NO: 2383349 - RNA, 23 nt, Human
cucuuuggucuacacugugcuga

SEQ ID NO: 2383350 - RNA, 16 nt, Human
cucuucuccaggcugu

SEQ ID NO: 2383351 - RNA, 13 nt, Human
cucuucuccccag

SEQ ID NO: 2383352 - RNA, 14 nt, Human
cucuucuccccaga

SEQ ID NO: 2383353 - RNA, 16 nt, Human
cucuucugacgugccu

SEQ ID NO: 2383354 - RNA, 16 nt, Human
cucuucucuuccugua

SEQ ID NO: 2383355 - RNA, 17 nt, Human
cucuucugacgugccuu

SEQ ID NO: 2383356 - RNA, 12 nt, Human
cucuucugagcu

SEQ ID NO: 2383357 - RNA, 20 nt, Human
cucuucugacgugccuuuug

SEQ ID NO: 2383358 - RNA, 22 nt, Human
cucuucugacgugccuuuugca

SEQ ID NO: 2383359 - RNA, 14 nt, Human
cucuucucuuccug

SEQ ID NO: 2383360 - RNA, 15 nt, Human
cucuucucuuccugu

SEQ ID NO: 2383361 - RNA, 21 nt, Human
cugacggggaggaaccacugc

SEQ ID NO: 2383362 - RNA, 16 nt, Human
cugacggugcagucug

SEQ ID NO: 2383363 - RNA, 23 nt, Human
cugacguagcugcaaaggacaga

SEQ ID NO: 2383364 - RNA, 18 nt, Human
cugacguagcugcaaagg

SEQ ID NO: 2383365 - RNA, 18 nt, Human
cugacggugcagucuggg

SEQ ID NO: 2383366 - RNA, 22 nt, Human
cugacguagcugcaaaggacag

SEQ ID NO: 2383367 - RNA, 14 nt, Human
cugacgugccuuuu

SEQ ID NO: 2383368 - RNA, 17 nt, Human
cugacgugccuuuugca

SEQ ID NO: 2383369 - RNA, 18 nt, Human
cugacgugccuuuugcac

SEQ ID NO: 2383370 - RNA, 20 nt, Human
cugacgugccuuuugcaccc

SEQ ID NO: 2383371 - RNA, 22 nt, Human
cugacgugccuuuugcaccccu

SEQ ID NO: 2383372 - RNA, 23 nt, Human
cugacgugccuuuugcaccccuc

SEQ ID NO: 2383373 - RNA, 21 nt, Human
cugacggccagggagaagcuc

SEQ ID NO: 2383374 - RNA, 20 nt, Human
cugacggccagggagaagcu

SEQ ID NO: 2383375 - RNA, 19 nt, Human
cugacggccagggagaagc

SEQ ID NO: 2383376 - RNA, 15 nt, Human
cugacggccagggag

SEQ ID NO: 2383377 - RNA, 23 nt, Human
cugacggaagccaacuuggcuuu

SEQ ID NO: 2383378 - RNA, 16 nt, Human
cugacgcaacccacgu

SEQ ID NO: 2383379 - RNA, 16 nt, Human
cugacggaagccaacu

SEQ ID NO: 2383380 - RNA, 21 nt, Human
cugacggaagccaacuuggcu

SEQ ID NO: 2383381 - RNA, 22 nt, Human
cugacggaagccaacuuggcuu

SEQ ID NO: 2383382 - RNA, 21 nt, Human
cugaccuuugucaucuuucuu

SEQ ID NO: 2383383 - RNA, 23 nt, Human
cugaccuuugucaucuuucuucu

SEQ ID NO: 2383384 - RNA, 21 nt, Human
cugacgaacuuccauggcccu

SEQ ID NO: 2383385 - RNA, 23 nt, Human
cugaccaguuuaaccugaugcag

SEQ ID NO: 2383386 - RNA, 21 nt, Human
cugaccagccuccaugcugcc

SEQ ID NO: 2383387 - RNA, 23 nt, Human
cugaccagccuccaugcugccuc

SEQ ID NO: 2383388 - RNA, 21 nt, Human
cugaauuuggccugcacuaau

SEQ ID NO: 2383389 - RNA, 20 nt, Human
cugaauuuucacaugaacau

SEQ ID NO: 2383390 - RNA, 13 nt, Human
cugaauuuucaca

SEQ ID NO: 2383391 - RNA, 14 nt, Human
cugaauuuucacau

SEQ ID NO: 2383392 - RNA, 16 nt, Human
cugacagacacaggcc

SEQ ID NO: 2383393 - RNA, 14 nt, Human
cugaauuucuuuug

SEQ ID NO: 2383394 - RNA, 17 nt, Human
cugaccagccuccaugc

SEQ ID NO: 2383395 - RNA, 22 nt, Human
cugaccagcagcgccuuuccca

SEQ ID NO: 2383396 - RNA, 21 nt, Human
cugaccagcagcgccuuuccc

SEQ ID NO: 2383397 - RNA, 20 nt, Human
cugaccagcagcgccuuucc

SEQ ID NO: 2383398 - RNA, 16 nt, Human
cugaccagcagcgccu

SEQ ID NO: 2383399 - RNA, 17 nt, Human
cugacagacacaggccc

SEQ ID NO: 2383400 - RNA, 18 nt, Human
cugacagacacaggcccg

SEQ ID NO: 2383401 - RNA, 21 nt, Human
cugagaaaagcuuugaacccu

SEQ ID NO: 2383402 - RNA, 18 nt, Human
cugacuuugcucuuucuu

SEQ ID NO: 2383403 - RNA, 17 nt, Human
cugacuguacuccuccc

SEQ ID NO: 2383404 - RNA, 22 nt, Human
cugacuggugcuauaggcugga

SEQ ID NO: 2383405 - RNA, 18 nt, Human
cugagaaagacuauucaa

SEQ ID NO: 2383406 - RNA, 15 nt, Human
cugagaaagacuauu

SEQ ID NO: 2383407 - RNA, 13 nt, Human
cugagaaagacua

SEQ ID NO: 2383408 - RNA, 12 nt, Human
cugagaaagacu

SEQ ID NO: 2383409 - RNA, 15 nt, Human
cugacucagggcucc

SEQ ID NO: 2383410 - RNA, 13 nt, Human
cugacuccagugg

SEQ ID NO: 2383411 - RNA, 16 nt, Human
cugacucauucugaag

SEQ ID NO: 2383412 - RNA, 21 nt, Human
cugacucagggcuccuggguu

SEQ ID NO: 2383413 - RNA, 19 nt, Human
cugacucagggcuccuggg

SEQ ID NO: 2383414 - RNA, 18 nt, Human
cugacucagggcuccugg

SEQ ID NO: 2383415 - RNA, 16 nt, Human
cugacucagggcuccu

SEQ ID NO: 2383416 - RNA, 17 nt, Human
cugacuacuggcucuca

SEQ ID NO: 2383417 - RNA, 15 nt, Human
cugacuacugggcaa

SEQ ID NO: 2383418 - RNA, 16 nt, Human
cugacuacugggcaaa

SEQ ID NO: 2383419 - RNA, 22 nt, Human
cugacuacugggcaaagagugu

SEQ ID NO: 2383420 - RNA, 19 nt, Human
cugacugauguugagggaa

SEQ ID NO: 2383421 - RNA, 16 nt, Human
cugacugaugcuuuca

SEQ ID NO: 2383422 - RNA, 12 nt, Human
cugacugggagu

SEQ ID NO: 2383423 - RNA, 15 nt, Human
cugacuccuuagaga

SEQ ID NO: 2383424 - RNA, 13 nt, Human
cugacuccuuaga

SEQ ID NO: 2383425 - RNA, 15 nt, Human
cugacucgguuucuc

SEQ ID NO: 2383426 - RNA, 17 nt, Human
cugacuccucuaagcca

SEQ ID NO: 2383427 - RNA, 19 nt, Human
cugacuccucuaagccacu

SEQ ID NO: 2383428 - RNA, 16 nt, Human
cugacucgguuucucc

SEQ ID NO: 2383429 - RNA, 17 nt, Human
cugacucgguuucucca

SEQ ID NO: 2383430 - RNA, 18 nt, Human
cugacucgguuucuccaa

SEQ ID NO: 2383431 - RNA, 20 nt, Human
cugacucgucugacugugug

SEQ ID NO: 2383432 - RNA, 24 nt, Human
cugagcaacagagugagacccugu

SEQ ID NO: 2383433 - RNA, 23 nt, Human
cugagcaacagagugagacccug

SEQ ID NO: 2383434 - RNA, 16 nt, Human
cugagcaacagaguga

SEQ ID NO: 2383435 - RNA, 22 nt, Human
cugagauuucaucugcucuccu

SEQ ID NO: 2383436 - RNA, 12 nt, Human
cugagcaaagca

SEQ ID NO: 2383437 - RNA, 12 nt, Human
cugagcaagagc

SEQ ID NO: 2383438 - RNA, 20 nt, Human
cugagcaacucuugauuauc

SEQ ID NO: 2383439 - RNA, 15 nt, Human
cugagcaaauguggc

SEQ ID NO: 2383440 - RNA, 17 nt, Human
cugagcaaauguggcuc

SEQ ID NO: 2383441 - RNA, 20 nt, Human
cugagcaaauguggcuccug

SEQ ID NO: 2383442 - RNA, 21 nt, Human
cugagcaaauguggcuccugg

SEQ ID NO: 2383443 - RNA, 19 nt, Human
cugagauuauuuuaaucua

SEQ ID NO: 2383444 - RNA, 23 nt, Human
cugagauuauaggcaccuaccac

SEQ ID NO: 2383445 - RNA, 21 nt, Human
cugagaugugaacacaucagc

SEQ ID NO: 2383446 - RNA, 14 nt, Human
cugagauuucaucu

SEQ ID NO: 2383447 - RNA, 15 nt, Human
cugagauuucaucug

SEQ ID NO: 2383448 - RNA, 16 nt, Human
cugagauuucaucugc

SEQ ID NO: 2383449 - RNA, 18 nt, Human
cugagauuucaucugcuc

SEQ ID NO: 2383450 - RNA, 19 nt, Human
cugagauuucaucugcucu

SEQ ID NO: 2383451 - RNA, 20 nt, Human
cugagauuucaucugcucuc

SEQ ID NO: 2383452 - RNA, 21 nt, Human
cugagauuucaucugcucucc

SEQ ID NO: 2383453 - RNA, 20 nt, Human
cugagacagcccgggcucug

SEQ ID NO: 2383454 - RNA, 19 nt, Human
cugagacagcccgggcucu

SEQ ID NO: 2383455 - RNA, 20 nt, Human
cugagaaagacuauucaaac

SEQ ID NO: 2383456 - RNA, 19 nt, Human
cugagaaagacuauucaaa

SEQ ID NO: 2383457 - RNA, 21 nt, Human
cugagacagcccgggcucugc

SEQ ID NO: 2383458 - RNA, 22 nt, Human
cugagacagcccgggcucugcc

SEQ ID NO: 2383459 - RNA, 20 nt, Human
cugagaugugaacacaucag

SEQ ID NO: 2383460 - RNA, 16 nt, Human
cugagaugugaacaca

SEQ ID NO: 2383461 - RNA, 17 nt, Human
cugagcagacuggugag

SEQ ID NO: 2383462 - RNA, 16 nt, Human
cugagcagacugguga

SEQ ID NO: 2383463 - RNA, 22 nt, Human
cugagcagacuggugagcagac

SEQ ID NO: 2383464 - RNA, 21 nt, Human
cugagcagacuggugagcaga

SEQ ID NO: 2383465 - RNA, 22 nt, Human
cugagcagagucuugcuaccuc

SEQ ID NO: 2383466 - RNA, 23 nt, Human
cugagcagagucuugcuaccuca

SEQ ID NO: 2383467 - RNA, 16 nt, Human
cugagcaggaccucug

SEQ ID NO: 2383468 - RNA, 16 nt, Human
cugagcaggauuuuaa

SEQ ID NO: 2383469 - RNA, 13 nt, Human
cugagcaccaggg

SEQ ID NO: 2383470 - RNA, 17 nt, Human
cugagcaaugucugugc

SEQ ID NO: 2383471 - RNA, 18 nt, Human
cugagcaaugucugugcu

SEQ ID NO: 2383472 - RNA, 19 nt, Human
cugagcaaugucugugcua

SEQ ID NO: 2383473 - RNA, 17 nt, Human
cugagcacacuuuagug

SEQ ID NO: 2383474 - RNA, 15 nt, Human
cugagcaaugucugu

SEQ ID NO: 2383475 - RNA, 20 nt, Human
cugagcaagagcuggcaaag

SEQ ID NO: 2383476 - RNA, 16 nt, Human
cugagcaaugucugug

SEQ ID NO: 2383477 - RNA, 14 nt, Human
cugagcaagagcug

SEQ ID NO: 2383478 - RNA, 15 nt, Human
cugagcaagagcugg

SEQ ID NO: 2383479 - RNA, 16 nt, Human
cugagcaagagcuggc

SEQ ID NO: 2383480 - RNA, 17 nt, Human
cugagcaagagcuggca

SEQ ID NO: 2383481 - RNA, 13 nt, Human
cugagcaccugcu

SEQ ID NO: 2383482 - RNA, 19 nt, Human
cugagcacauucuggcuca

SEQ ID NO: 2383483 - RNA, 16 nt, Human
cugagcaccugcuuca

SEQ ID NO: 2383484 - RNA, 17 nt, Human
cugagcaccugcuucau

SEQ ID NO: 2383485 - RNA, 23 nt, Human
cugagcaccugcuucaugcucag

SEQ ID NO: 2383486 - RNA, 13 nt, Human
cugagcagggaga

SEQ ID NO: 2383487 - RNA, 18 nt, Human
cugagcaggaccucugaa

SEQ ID NO: 2383488 - RNA, 12 nt, Human
cugagcaggugu

SEQ ID NO: 2383489 - RNA, 22 nt, Human
cugagccaagcuagaauucccu

SEQ ID NO: 2383490 - RNA, 20 nt, Human
cugagcagugaaugauucag

SEQ ID NO: 2383491 - RNA, 23 nt, Human
cugagccaguucaguaccuggag

SEQ ID NO: 2383492 - RNA, 13 nt, Human
cugagccagauuu

SEQ ID NO: 2383493 - RNA, 14 nt, Human
cugagccagauuuc

SEQ ID NO: 2383494 - RNA, 19 nt, Human
cucugaauuugagauacaa

SEQ ID NO: 2383495 - RNA, 16 nt, Human
cucugacaacagacuu

SEQ ID NO: 2383496 - RNA, 20 nt, Human
cucugaauuaguccuugcuu

SEQ ID NO: 2383497 - RNA, 21 nt, Human
cucugaauuaguccuugcuug

SEQ ID NO: 2383498 - RNA, 17 nt, Human
cucugaaugguccaggg

SEQ ID NO: 2383499 - RNA, 18 nt, Human
cucugaaugguccagggu

SEQ ID NO: 2383500 - RNA, 13 nt, Human
cucugaagucaca

SEQ ID NO: 2383501 - RNA, 23 nt, Human
cucugaagggcaucaugcaucuu

SEQ ID NO: 2383502 - RNA, 23 nt, Human
cucugaagucacaucacaggaca

SEQ ID NO: 2383503 - RNA, 19 nt, Human
cucugaagugaaacugcuu

SEQ ID NO: 2383504 - RNA, 23 nt, Human
cucugaagugaaacugcuuguuu

SEQ ID NO: 2383505 - RNA, 18 nt, Human
cucgcugcacaaauacuc

SEQ ID NO: 2383506 - RNA, 12 nt, Human
cucgcugccagc

SEQ ID NO: 2383507 - RNA, 20 nt, Human
cucgcugaugcugggcuggg

SEQ ID NO: 2383508 - RNA, 21 nt, Human
cucgcugaugcugggcugggu

SEQ ID NO: 2383509 - RNA, 22 nt, Human
cucgcugaugcugggcugggug

SEQ ID NO: 2383510 - RNA, 23 nt, Human
cucgcugaugcugggcugggugc

SEQ ID NO: 2383511 - RNA, 22 nt, Human
cucugaaggacauugcggacag

SEQ ID NO: 2383512 - RNA, 22 nt, Human
cucugaagggcaucaugcaucu

SEQ ID NO: 2383513 - RNA, 19 nt, Human
cucugaagggcaucaugca

SEQ ID NO: 2383514 - RNA, 17 nt, Human
cucugaagggcaucaug

SEQ ID NO: 2383515 - RNA, 13 nt, Human
cucugaagggagg

SEQ ID NO: 2383516 - RNA, 14 nt, Human
cucugaagggaggu

SEQ ID NO: 2383517 - RNA, 14 nt, Human
cucugacacacagc

SEQ ID NO: 2383518 - RNA, 22 nt, Human
cucugacaacagacuucugaaa

SEQ ID NO: 2383519 - RNA, 21 nt, Human
cucugacaacagacuucugaa

SEQ ID NO: 2383520 - RNA, 15 nt, Human
cucugacacacagcu

SEQ ID NO: 2383521 - RNA, 16 nt, Human
cucugacacacagcuc

SEQ ID NO: 2383522 - RNA, 17 nt, Human
cucugacacacagcucu

SEQ ID NO: 2383523 - RNA, 18 nt, Human
cucugacacacagcucug

SEQ ID NO: 2383524 - RNA, 23 nt, Human
cucugacagaagaaccccagggu

SEQ ID NO: 2383525 - RNA, 19 nt, Human
cucugacacacagcucugu

SEQ ID NO: 2383526 - RNA, 17 nt, Human
cucugagcuuugcaugu

SEQ ID NO: 2383527 - RNA, 16 nt, Human
cucugagcugugcagg

SEQ ID NO: 2383528 - RNA, 13 nt, Human
cucugagcuuugc

SEQ ID NO: 2383529 - RNA, 18 nt, Human
cucugacuggcacagucu

SEQ ID NO: 2383530 - RNA, 20 nt, Human
cucugagacucgcgacaaug

SEQ ID NO: 2383531 - RNA, 16 nt, Human
cucugacucucaaauc

SEQ ID NO: 2383532 - RNA, 18 nt, Human
cucugacucucaaaucuu

SEQ ID NO: 2383533 - RNA, 23 nt, Human
cucugagacucgcgacaaugcaa

SEQ ID NO: 2383534 - RNA, 16 nt, Human
cucugaggacacuaac

SEQ ID NO: 2383535 - RNA, 16 nt, Human
cucugaguaucuccuc

SEQ ID NO: 2383536 - RNA, 22 nt, Human
cucugaggugccugucccaccc

SEQ ID NO: 2383537 - RNA, 15 nt, Human
cucugaggugccugu

SEQ ID NO: 2383538 - RNA, 19 nt, Human
cucugaggugccuguccca

SEQ ID NO: 2383539 - RNA, 12 nt, Human
cucugaggacac

SEQ ID NO: 2383540 - RNA, 14 nt, Human
cucugaggacacua

SEQ ID NO: 2383541 - RNA, 15 nt, Human
cucugaccugcaggc

SEQ ID NO: 2383542 - RNA, 14 nt, Human
cucugaccugcagg

SEQ ID NO: 2383543 - RNA, 13 nt, Human
cucugaccugcag

SEQ ID NO: 2383544 - RNA, 15 nt, Human
cucugaccugcacug

SEQ ID NO: 2383545 - RNA, 16 nt, Human
cucugaccugcaggcc

SEQ ID NO: 2383546 - RNA, 14 nt, Human
cucugacucagggc

SEQ ID NO: 2383547 - RNA, 16 nt, Human
cucugacucagggcuc

SEQ ID NO: 2383548 - RNA, 15 nt, Human
cucugacucagggcu

SEQ ID NO: 2383549 - RNA, 15 nt, Human
cucugacucucaaau

SEQ ID NO: 2383550 - RNA, 21 nt, Human
cucugacucagggcuccuggg

SEQ ID NO: 2383551 - RNA, 20 nt, Human
cucugacucagggcuccugg

SEQ ID NO: 2383552 - RNA, 17 nt, Human
cucugacucagggcucc

SEQ ID NO: 2383553 - RNA, 21 nt, Human
cucugagacucgcgacaaugc

SEQ ID NO: 2383554 - RNA, 23 nt, Human
cucugaccgaaacagcgcugggu

SEQ ID NO: 2383555 - RNA, 22 nt, Human
cucugaccgaaacagcgcuggg

SEQ ID NO: 2383556 - RNA, 23 nt, Human
cucugaccuacucgagggacuua

SEQ ID NO: 2383557 - RNA, 17 nt, Human
cucugaccucuuggcca

SEQ ID NO: 2383558 - RNA, 12 nt, Human
cucugaccugca

SEQ ID NO: 2383559 - RNA, 14 nt, Human
cucugaccugcacu

SEQ ID NO: 2383560 - RNA, 19 nt, Human
cucugaccgaaacagcgcu

SEQ ID NO: 2383561 - RNA, 17 nt, Human
cucugaccgaaacagcg

SEQ ID NO: 2383562 - RNA, 21 nt, Human
cucugaccccuccucacuggc

SEQ ID NO: 2383563 - RNA, 13 nt, Human
cucugaccccucc

SEQ ID NO: 2383564 - RNA, 14 nt, Human
cucugaccccuccu

SEQ ID NO: 2383565 - RNA, 16 nt, Human
cucugaccccuccuca

SEQ ID NO: 2383566 - RNA, 18 nt, Human
cucugaccccuccucacu

SEQ ID NO: 2383567 - RNA, 12 nt, Human
cucugaccccuc

SEQ ID NO: 2383568 - RNA, 16 nt, Human
cucugacccagugaga

SEQ ID NO: 2383569 - RNA, 13 nt, Human
cucugccggcucu

SEQ ID NO: 2383570 - RNA, 20 nt, Human
cucugccgcaauacaggaac

SEQ ID NO: 2383571 - RNA, 14 nt, Human
cucugccggcucuu

SEQ ID NO: 2383572 - RNA, 15 nt, Human
cucugccggcucuuu

SEQ ID NO: 2383573 - RNA, 18 nt, Human
cucugccggcucuuuccu

SEQ ID NO: 2383574 - RNA, 20 nt, Human
cucugccggcucuuuccuug

SEQ ID NO: 2383575 - RNA, 23 nt, Human
cucugccggcucuuuccuugcuc

SEQ ID NO: 2383576 - RNA, 12 nt, Human
cucugcccccug

SEQ ID NO: 2383577 - RNA, 17 nt, Human
cucugcccccugcuggc

SEQ ID NO: 2383578 - RNA, 19 nt, Human
cucugcccuuguucccuag

SEQ ID NO: 2383579 - RNA, 21 nt, Human
cucugcccuuguucccuaggg

SEQ ID NO: 2383580 - RNA, 18 nt, Human
cucugccgcaauacagga

SEQ ID NO: 2383581 - RNA, 21 nt, Human
cucugccgcaauacaggaacc

SEQ ID NO: 2383582 - RNA, 20 nt, Human
cucugcccuaaugcgcaggc

SEQ ID NO: 2383583 - RNA, 22 nt, Human
cucugcccuaaugcgcaggcug

SEQ ID NO: 2383584 - RNA, 12 nt, Human
cucugcccuugg

SEQ ID NO: 2383585 - RNA, 13 nt, Human
cucugccucccau

SEQ ID NO: 2383586 - RNA, 14 nt, Human
cucugccucccauc

SEQ ID NO: 2383587 - RNA, 16 nt, Human
cucugccucccaucac

SEQ ID NO: 2383588 - RNA, 17 nt, Human
cucugccucccaucacc

SEQ ID NO: 2383589 - RNA, 14 nt, Human
cucugcccaacccu

SEQ ID NO: 2383590 - RNA, 15 nt, Human
cucugccccauccuc

SEQ ID NO: 2383591 - RNA, 20 nt, Human
cucugcccaacccuucccuc

SEQ ID NO: 2383592 - RNA, 24 nt, Human
cucugccccauccuccagcaggga

SEQ ID NO: 2383593 - RNA, 22 nt, Human
cucugccccauccuccagcagg

SEQ ID NO: 2383594 - RNA, 21 nt, Human
cucugccccauccuccagcag

SEQ ID NO: 2383595 - RNA, 17 nt, Human
cucugccccauccucca

SEQ ID NO: 2383596 - RNA, 18 nt, Human
cucugcccacucccugca

SEQ ID NO: 2383597 - RNA, 20 nt, Human
cucugcccacucccugcaac

SEQ ID NO: 2383598 - RNA, 13 nt, Human
cucugcccacucc

SEQ ID NO: 2383599 - RNA, 15 nt, Human
cucugcccacucccu

SEQ ID NO: 2383600 - RNA, 16 nt, Human
cucugcccacucccug

SEQ ID NO: 2383601 - RNA, 17 nt, Human
cucugcccacucccugc

SEQ ID NO: 2383602 - RNA, 15 nt, Human
cucugcacaagcugc

SEQ ID NO: 2383603 - RNA, 14 nt, Human
cucugcacaagcug

SEQ ID NO: 2383604 - RNA, 19 nt, Human
cucugcaggucccuaauaa

SEQ ID NO: 2383605 - RNA, 20 nt, Human
cucugcaggucccuaauaaa

SEQ ID NO: 2383606 - RNA, 13 nt, Human
cucugcacaagcu

SEQ ID NO: 2383607 - RNA, 17 nt, Human
cucugauacccagagca

SEQ ID NO: 2383608 - RNA, 14 nt, Human
cucugauaagagaa

SEQ ID NO: 2383609 - RNA, 10 nt, Human
cucugcacaa

SEQ ID NO: 2383610 - RNA, 17 nt, Human
cucugaguaucuccucg

SEQ ID NO: 2383611 - RNA, 12 nt, Human
cucugaguguga

SEQ ID NO: 2383612 - RNA, 21 nt, Human
cucugcaggucccuaauaaag

SEQ ID NO: 2383613 - RNA, 22 nt, Human
cucugcaggucccuaauaaagc

SEQ ID NO: 2383614 - RNA, 18 nt, Human
cucugcaggucccuaaua

SEQ ID NO: 2383615 - RNA, 17 nt, Human
cucugcaucuacuccca

SEQ ID NO: 2383616 - RNA, 19 nt, Human
cucugcaucuacucccaag

SEQ ID NO: 2383617 - RNA, 20 nt, Human
cucugcaucuacucccaagu

SEQ ID NO: 2383618 - RNA, 22 nt, Human
cucugcaucuacucccaaguau

SEQ ID NO: 2383619 - RNA, 13 nt, Human
cucugcaucugac

SEQ ID NO: 2383620 - RNA, 14 nt, Human
cucugcaucugacc

SEQ ID NO: 2383621 - RNA, 16 nt, Human
cucugcaugcggccca

SEQ ID NO: 2383622 - RNA, 14 nt, Human
cucugcauucuagu

SEQ ID NO: 2383623 - RNA, 21 nt, Human
cucugcaugcggcccagcccg

SEQ ID NO: 2383624 - RNA, 22 nt, Human
cucugcaugcggcccagcccgg

SEQ ID NO: 2383625 - RNA, 17 nt, Human
cucugcaugcggcccag

SEQ ID NO: 2383626 - RNA, 18 nt, Human
cucugcaugcggcccagc

SEQ ID NO: 2383627 - RNA, 19 nt, Human
cucugcaugcggcccagcc

SEQ ID NO: 2383628 - RNA, 20 nt, Human
cucugcaugcggcccagccc

SEQ ID NO: 2383629 - RNA, 15 nt, Human
cucugcauucuagua

SEQ ID NO: 2383630 - RNA, 23 nt, Human
cucugcaugcggcccagcccggc

SEQ ID NO: 2383631 - RNA, 14 nt, Human
cucugcauuugucu

SEQ ID NO: 2383632 - RNA, 19 nt, Human
cucugcauuugucuauucu

SEQ ID NO: 2383633 - RNA, 22 nt, Human
cucugcauuugucuauucucca

SEQ ID NO: 2383634 - RNA, 23 nt, Human
cucugcauuugucuauucuccag

SEQ ID NO: 2383635 - RNA, 14 nt, Human
cucugccaaaggau

SEQ ID NO: 2383636 - RNA, 19 nt, Human
cucugccaaaggaugugau

SEQ ID NO: 2383637 - RNA, 21 nt, Human
cucugccaaaggaugugauau

SEQ ID NO: 2383638 - RNA, 13 nt, Human
cucugccagugac

SEQ ID NO: 2383639 - RNA, 14 nt, Human
cucugccagugaca

SEQ ID NO: 2383640 - RNA, 15 nt, Human
cucugccagugacag

SEQ ID NO: 2383641 - RNA, 20 nt, Human
cucugccagugacagacagg

SEQ ID NO: 2383642 - RNA, 14 nt, Human
cucuucucaagugc

SEQ ID NO: 2383643 - RNA, 15 nt, Human
cucuucucaagugcc

SEQ ID NO: 2383644 - RNA, 19 nt, Human
cucuucuauuuuguaaacu

SEQ ID NO: 2383645 - RNA, 17 nt, Human
cucuucuauuuuguaaa

SEQ ID NO: 2383646 - RNA, 15 nt, Human
cucuucuagagccgu

SEQ ID NO: 2383647 - RNA, 18 nt, Human
cucuuccuugcuguguca

SEQ ID NO: 2383648 - RNA, 20 nt, Human
cucuucguuucagugucaaa

SEQ ID NO: 2383649 - RNA, 10 nt, Human
cucuuccugu

SEQ ID NO: 2383650 - RNA, 23 nt, Human
cucuuccuugaagaacugcaggc

SEQ ID NO: 2383651 - RNA, 16 nt, Human
cucuuccuuuuaucag

SEQ ID NO: 2383652 - RNA, 12 nt, Human
cucuucuccacu

SEQ ID NO: 2383653 - RNA, 13 nt, Human
cucuucuccacug

SEQ ID NO: 2383654 - RNA, 11 nt, Human
cucuucucauu

SEQ ID NO: 2383655 - RNA, 12 nt, Human
cucuucucauuu

SEQ ID NO: 2383656 - RNA, 15 nt, Human
cucuucucauuucac

SEQ ID NO: 2383657 - RNA, 19 nt, Human
cucuucucauuucaccccu

SEQ ID NO: 2383658 - RNA, 15 nt, Human
cucuucuccaggcug

SEQ ID NO: 2383659 - RNA, 13 nt, Human
cucuucuccaggc

SEQ ID NO: 2383660 - RNA, 22 nt, Human
cucuuaagcuuccgccgucuca

SEQ ID NO: 2383661 - RNA, 22 nt, Human
cucuuaagccaucuugguaaau

SEQ ID NO: 2383662 - RNA, 12 nt, Human
cucuuaaguuuc

SEQ ID NO: 2383663 - RNA, 14 nt, Human
cucuuaaguuucuc

SEQ ID NO: 2383664 - RNA, 18 nt, Human
cucuuaaguuucucagcu

SEQ ID NO: 2383665 - RNA, 19 nt, Human
cucuuaaguuucucagcuc

SEQ ID NO: 2383666 - RNA, 22 nt, Human
cucuuaaguuucucagcuccca

SEQ ID NO: 2383667 - RNA, 17 nt, Human
cucuuaauuguucauuu

SEQ ID NO: 2383668 - RNA, 16 nt, Human
cucuuccaucaugucc

SEQ ID NO: 2383669 - RNA, 21 nt, Human
cucuuccccagaaaggagacu

SEQ ID NO: 2383670 - RNA, 12 nt, Human
cucuuccccaga

SEQ ID NO: 2383671 - RNA, 14 nt, Human
cucuuccccucuca

SEQ ID NO: 2383672 - RNA, 16 nt, Human
cucuuccccucucaga

SEQ ID NO: 2383673 - RNA, 12 nt, Human
cucuuccccucu

SEQ ID NO: 2383674 - RNA, 23 nt, Human
cucuuccccuugcccuugcccug

SEQ ID NO: 2383675 - RNA, 15 nt, Human
cucuuccccuugccc

SEQ ID NO: 2383676 - RNA, 16 nt, Human
cucuuccccuugcccu

SEQ ID NO: 2383677 - RNA, 18 nt, Human
cucuuccccuugcccuug

SEQ ID NO: 2383678 - RNA, 19 nt, Human
cucuuccccuugcccuugc

SEQ ID NO: 2383679 - RNA, 11 nt, Human
cucuuccucug

SEQ ID NO: 2383680 - RNA, 12 nt, Human
cucuuccucuga

SEQ ID NO: 2383681 - RNA, 13 nt, Human
cucuuccucugag

SEQ ID NO: 2383682 - RNA, 16 nt, Human
cucuuccucugaggcu

SEQ ID NO: 2383683 - RNA, 17 nt, Human
cucuuccucugaggcug

SEQ ID NO: 2383684 - RNA, 22 nt, Human
cucuuccucugaggcuggaucc

SEQ ID NO: 2383685 - RNA, 14 nt, Human
cucuuccugcaagg

SEQ ID NO: 2383686 - RNA, 14 nt, Human
cucuguuucucuuu

SEQ ID NO: 2383687 - RNA, 16 nt, Human
cucuguuucuccuucu

SEQ ID NO: 2383688 - RNA, 22 nt, Human
cucuguuguccuccccuugggc

SEQ ID NO: 2383689 - RNA, 16 nt, Human
cucuuaaaaaauaaaa

SEQ ID NO: 2383690 - RNA, 19 nt, Human
cucuuaaaaaauaaaaacu

SEQ ID NO: 2383691 - RNA, 12 nt, Human
cucuuaagccau

SEQ ID NO: 2383692 - RNA, 18 nt, Human
cucuuaaaaaauaaaaac

SEQ ID NO: 2383693 - RNA, 17 nt, Human
cucuuaaaaaauaaaaa

SEQ ID NO: 2383694 - RNA, 13 nt, Human
cucuuaagccauc

SEQ ID NO: 2383695 - RNA, 14 nt, Human
cucuuaagccaucu

SEQ ID NO: 2383696 - RNA, 20 nt, Human
cucuuaagccaucuugguaa

SEQ ID NO: 2383697 - RNA, 21 nt, Human
cucuuaagccaucuugguaaa

SEQ ID NO: 2383698 - RNA, 19 nt, Human
cucuuaagaagacugcauu

SEQ ID NO: 2383699 - RNA, 17 nt, Human
cucugugugcacaaaua

SEQ ID NO: 2383700 - RNA, 15 nt, Human
cucugugugcacaaa

SEQ ID NO: 2383701 - RNA, 17 nt, Human
cucuguguccuucccug

SEQ ID NO: 2383702 - RNA, 14 nt, Human
cucuguguccuucc

SEQ ID NO: 2383703 - RNA, 16 nt, Human
cucuguguccuucccu

SEQ ID NO: 2383704 - RNA, 20 nt, Human
cucuguugcccaggcuggag

SEQ ID NO: 2383705 - RNA, 22 nt, Human
cucuguugcccaggcuggagug

SEQ ID NO: 2383706 - RNA, 12 nt, Human
cucuguuguccu

SEQ ID NO: 2383707 - RNA, 17 nt, Human
cucuguuguccuccccu

SEQ ID NO: 2383708 - RNA, 20 nt, Human
cucuguuguccuccccuugg

SEQ ID NO: 2383709 - RNA, 21 nt, Human
cucuguuguccuccccuuggg

SEQ ID NO: 2383710 - RNA, 23 nt, Human
cucugugaccugccccgcccagc

SEQ ID NO: 2383711 - RNA, 15 nt, Human
cucugugaccugccc

SEQ ID NO: 2383712 - RNA, 19 nt, Human
cucugugucagguggggca

SEQ ID NO: 2383713 - RNA, 19 nt, Human
cucugugaccaaugucuug

SEQ ID NO: 2383714 - RNA, 14 nt, Human
cucugugaccucag

SEQ ID NO: 2383715 - RNA, 16 nt, Human
cucugugaccucaggc

SEQ ID NO: 2383716 - RNA, 19 nt, Human
cucugugaccucaggcacu

SEQ ID NO: 2383717 - RNA, 24 nt, Human
cucugugaccucaggcacuagccu

SEQ ID NO: 2383718 - RNA, 23 nt, Human
cucugugaacgauuuagaaagaa

SEQ ID NO: 2383719 - RNA, 18 nt, Human
cucugugaagcauucgag

SEQ ID NO: 2383720 - RNA, 18 nt, Human
cucugugaacccuaugag

SEQ ID NO: 2383721 - RNA, 18 nt, Human
cucugugaacgauuuaga

SEQ ID NO: 2383722 - RNA, 21 nt, Human
cucugugaacgauuuagaaag

SEQ ID NO: 2383723 - RNA, 18 nt, Human
cucugugaccaaugucuu

SEQ ID NO: 2383724 - RNA, 17 nt, Human
cucugugaccaaugucu

SEQ ID NO: 2383725 - RNA, 15 nt, Human
cucugugaccaaugu

SEQ ID NO: 2383726 - RNA, 14 nt, Human
cucugugaccaaug

SEQ ID NO: 2383727 - RNA, 20 nt, Human
cucugugucagguggggcag

SEQ ID NO: 2383728 - RNA, 21 nt, Human
cucugugucagguggggcagc

SEQ ID NO: 2383729 - RNA, 22 nt, Human
cucugugucagguggggcagcu

SEQ ID NO: 2383730 - RNA, 23 nt, Human
cucugugucagguggggcagcuu

SEQ ID NO: 2383731 - RNA, 18 nt, Human
cucugucgcccagucugg

SEQ ID NO: 2383732 - RNA, 19 nt, Human
cucugucgcccagucugga

SEQ ID NO: 2383733 - RNA, 23 nt, Human
cucugucuucuuugcccacaaug

SEQ ID NO: 2383734 - RNA, 15 nt, Human
cucugucuuguguuu

SEQ ID NO: 2383735 - RNA, 16 nt, Human
cucugucuuguguuuc

SEQ ID NO: 2383736 - RNA, 17 nt, Human
cucugucgcccagucug

SEQ ID NO: 2383737 - RNA, 22 nt, Human
cucugucgcccaggcuggagug

SEQ ID NO: 2383738 - RNA, 18 nt, Human
cucugucgcccaggcugg

SEQ ID NO: 2383739 - RNA, 13 nt, Human
cucugucgcccag

SEQ ID NO: 2383740 - RNA, 15 nt, Human
cucugucgcccaggc

SEQ ID NO: 2383741 - RNA, 17 nt, Human
cucuggggccacacaga

SEQ ID NO: 2383742 - RNA, 20 nt, Human
cucuggggccacacagaaac

SEQ ID NO: 2383743 - RNA, 14 nt, Human
cucuggggacuccg

SEQ ID NO: 2383744 - RNA, 17 nt, Human
cucugggcugccaugug

SEQ ID NO: 2383745 - RNA, 23 nt, Human
cucugggccaagucaaagacauu

SEQ ID NO: 2383746 - RNA, 23 nt, Human
cucugggcaggaccucagagucc

SEQ ID NO: 2383747 - RNA, 14 nt, Human
cucuggcuagaggc

SEQ ID NO: 2383748 - RNA, 16 nt, Human
cucuggcgacaguuuu

SEQ ID NO: 2383749 - RNA, 17 nt, Human
cucugggagaggauuuu

SEQ ID NO: 2383750 - RNA, 14 nt, Human
cucuggcguguggg

SEQ ID NO: 2383751 - RNA, 15 nt, Human
cucugggcaggaccu

SEQ ID NO: 2383752 - RNA, 20 nt, Human
cucugggccauucuccacag

SEQ ID NO: 2383753 - RNA, 14 nt, Human
cucuguccugggag

SEQ ID NO: 2383754 - RNA, 13 nt, Human
cucuguccuggga

SEQ ID NO: 2383755 - RNA, 15 nt, Human
cucuguccugggagu

SEQ ID NO: 2383756 - RNA, 22 nt, Human
cucuguccugggagugagcugg

SEQ ID NO: 2383757 - RNA, 19 nt, Human
cucuggccaggauggaggg

SEQ ID NO: 2383758 - RNA, 13 nt, Human
cucuggccccaag

SEQ ID NO: 2383759 - RNA, 15 nt, Human
cucuggccaggaugg

SEQ ID NO: 2383760 - RNA, 10 nt, Human
cucuggccag

SEQ ID NO: 2383761 - RNA, 20 nt, Human
cucuggcauuagaauuauuu

SEQ ID NO: 2383762 - RNA, 23 nt, Human
cucuggcauuagaauuauuuaaa

SEQ ID NO: 2383763 - RNA, 21 nt, Human
cucuggccuucggccuccauc

SEQ ID NO: 2383764 - RNA, 14 nt, Human
cucuggcccugccu

SEQ ID NO: 2383765 - RNA, 15 nt, Human
cucuggccuuuuccu

SEQ ID NO: 2383766 - RNA, 16 nt, Human
cucuggccuuuuccua

SEQ ID NO: 2383767 - RNA, 13 nt, Human
cucuggcccugcc

SEQ ID NO: 2383768 - RNA, 24 nt, Human
cucuggcccucuaccccugaucug

SEQ ID NO: 2383769 - RNA, 14 nt, Human
cucuggccccaagg

SEQ ID NO: 2383770 - RNA, 15 nt, Human
cucuggccccaaggg

SEQ ID NO: 2383771 - RNA, 22 nt, Human
cucuggccuucggccuccaucc

SEQ ID NO: 2383772 - RNA, 18 nt, Human
cucuggauugugggaauu

SEQ ID NO: 2383773 - RNA, 22 nt, Human
cucuggauuggagauagggaaa

SEQ ID NO: 2383774 - RNA, 23 nt, Human
cucuggcagcucagagagggugg

SEQ ID NO: 2383775 - RNA, 19 nt, Human
cucuggcaguucuggaaug

SEQ ID NO: 2383776 - RNA, 18 nt, Human
cucuggcauuagaauuau

SEQ ID NO: 2383777 - RNA, 19 nt, Human
cucuggcauuagaauuauu

SEQ ID NO: 2383778 - RNA, 17 nt, Human
cucugccucugccugca

SEQ ID NO: 2383779 - RNA, 13 nt, Human
cucuggauggcac

SEQ ID NO: 2383780 - RNA, 14 nt, Human
cucugccucccuca

SEQ ID NO: 2383781 - RNA, 15 nt, Human
cucuggauggcacca

SEQ ID NO: 2383782 - RNA, 16 nt, Human
cucuggauggcaccag

SEQ ID NO: 2383783 - RNA, 19 nt, Human
cucuggauggcaccagagg

SEQ ID NO: 2383784 - RNA, 20 nt, Human
cucuggauggcaccagaggc

SEQ ID NO: 2383785 - RNA, 10 nt, Human
cucugccuga

SEQ ID NO: 2383786 - RNA, 19 nt, Human
cucuggauuauauuaugaa

SEQ ID NO: 2383787 - RNA, 20 nt, Human
cucuggauuauauuaugaag

SEQ ID NO: 2383788 - RNA, 16 nt, Human
cucugccucugacaca

SEQ ID NO: 2383789 - RNA, 22 nt, Human
cucugccggcucuuuccuugcu

SEQ ID NO: 2383790 - RNA, 21 nt, Human
cucugccucccaucacccgcu

SEQ ID NO: 2383791 - RNA, 19 nt, Human
cucugccucugacacacag

SEQ ID NO: 2383792 - RNA, 20 nt, Human
cucugccucugacacacagc

SEQ ID NO: 2383793 - RNA, 16 nt, Human
gaaccgcaggaagcug

SEQ ID NO: 2383794 - RNA, 15 nt, Human
gaaccgcugaauaug

SEQ ID NO: 2383795 - RNA, 15 nt, Human
gaaccgcaggaagcu

SEQ ID NO: 2383796 - RNA, 14 nt, Human
gaaccgcaggaagc

SEQ ID NO: 2383797 - RNA, 20 nt, Human
gaaccgcaggaagcugcucc

SEQ ID NO: 2383798 - RNA, 13 nt, Human
gaaccgcaggaag

SEQ ID NO: 2383799 - RNA, 17 nt, Human
gaacagacaggagaaau

SEQ ID NO: 2383800 - RNA, 18 nt, Human
gaacagacaggagaaaug

SEQ ID NO: 2383801 - RNA, 16 nt, Human
gaaccaccacacccag

SEQ ID NO: 2383802 - RNA, 17 nt, Human
gaaccaccacacccagc

SEQ ID NO: 2383803 - RNA, 11 nt, Human
gaaccugaccc

SEQ ID NO: 2383804 - RNA, 14 nt, Human
gaaccuagaagggc

SEQ ID NO: 2383805 - RNA, 12 nt, Human
gaaccugacccc

SEQ ID NO: 2383806 - RNA, 17 nt, Human
gaaccugacguagcugc

SEQ ID NO: 2383807 - RNA, 18 nt, Human
gaaccguuuugaagcuac

SEQ ID NO: 2383808 - RNA, 17 nt, Human
gaaccguuuugaagcua

SEQ ID NO: 2383809 - RNA, 20 nt, Human
gaaccuaacuccccacccca

SEQ ID NO: 2383810 - RNA, 19 nt, Human
gaaccguuuugaagcuacu

SEQ ID NO: 2383811 - RNA, 15 nt, Human
gaaccuaccuucauu

SEQ ID NO: 2383812 - RNA, 12 nt, Human
gaacagaaggau

SEQ ID NO: 2383813 - RNA, 15 nt, Human
gaacacuuuuaauaa

SEQ ID NO: 2383814 - RNA, 13 nt, Human
gaacagaaauacc

SEQ ID NO: 2383815 - RNA, 20 nt, Human
gaacacugggggaggggaca

SEQ ID NO: 2383816 - RNA, 18 nt, Human
gaacacugggggagggga

SEQ ID NO: 2383817 - RNA, 12 nt, Human
gaacagaauguu

SEQ ID NO: 2383818 - RNA, 14 nt, Human
gaacagaauguuuu

SEQ ID NO: 2383819 - RNA, 15 nt, Human
gaacagaauguuuua

SEQ ID NO: 2383820 - RNA, 19 nt, Human
gaacagaaggaugaaugag

SEQ ID NO: 2383821 - RNA, 14 nt, Human
gaacagaaggauga

SEQ ID NO: 2383822 - RNA, 16 nt, Human
gaacagacaggagaaa

SEQ ID NO: 2383823 - RNA, 15 nt, Human
gaacagacaggagaa

SEQ ID NO: 2383824 - RNA, 19 nt, Human
gaacagacaacagaaguca

SEQ ID NO: 2383825 - RNA, 18 nt, Human
gaacagacaacagaaguc

SEQ ID NO: 2383826 - RNA, 17 nt, Human
gaacagacaacagaagu

SEQ ID NO: 2383827 - RNA, 15 nt, Human
gaacagacuggaagc

SEQ ID NO: 2383828 - RNA, 16 nt, Human
gaacagacuggaagca

SEQ ID NO: 2383829 - RNA, 21 nt, Human
gaaccacaucuugcucugcug

SEQ ID NO: 2383830 - RNA, 21 nt, Human
gaaccuucuggccucccacag

SEQ ID NO: 2383831 - RNA, 18 nt, Human
gaaccuucuggccuccca

SEQ ID NO: 2383832 - RNA, 14 nt, Human
gaaccuugugccug

SEQ ID NO: 2383833 - RNA, 16 nt, Human
gaaccuugugccuggc

SEQ ID NO: 2383834 - RNA, 17 nt, Human
gaaccuugugccuggcu

SEQ ID NO: 2383835 - RNA, 18 nt, Human
gaaccuugugccuggcuc

SEQ ID NO: 2383836 - RNA, 19 nt, Human
gaaccuugugccuggcuca

SEQ ID NO: 2383837 - RNA, 14 nt, Human
gaacggggagaaaa

SEQ ID NO: 2383838 - RNA, 23 nt, Human
gaacggagccccaggccucugug

SEQ ID NO: 2383839 - RNA, 22 nt, Human
gaacggagccccaggccucugu

SEQ ID NO: 2383840 - RNA, 19 nt, Human
gaacggggcucuucucauu

SEQ ID NO: 2383841 - RNA, 22 nt, Human
gaacggggcucuucucauuuca

SEQ ID NO: 2383842 - RNA, 18 nt, Human
gaaccuuguuauuucuca

SEQ ID NO: 2383843 - RNA, 13 nt, Human
gaaccuuguuauu

SEQ ID NO: 2383844 - RNA, 12 nt, Human
gaaccuggagag

SEQ ID NO: 2383845 - RNA, 12 nt, Human
gaaccuggaacu

SEQ ID NO: 2383846 - RNA, 15 nt, Human
gaaccuggagagcua

SEQ ID NO: 2383847 - RNA, 16 nt, Human
gaaccuggaacuuggg

SEQ ID NO: 2383848 - RNA, 15 nt, Human
gaaccuggaguuccu

SEQ ID NO: 2383849 - RNA, 16 nt, Human
gaaccuggaggggcua

SEQ ID NO: 2383850 - RNA, 17 nt, Human
gaaccuggaggggcuag

SEQ ID NO: 2383851 - RNA, 15 nt, Human
gaaccuggagggcua

SEQ ID NO: 2383852 - RNA, 16 nt, Human
gaaccuggagggcuag

SEQ ID NO: 2383853 - RNA, 21 nt, Human
gaaccuggagggcuggaaucu

SEQ ID NO: 2383854 - RNA, 13 nt, Human
gaaccuggagggg

SEQ ID NO: 2383855 - RNA, 12 nt, Human
gaaccuguccuu

SEQ ID NO: 2383856 - RNA, 20 nt, Human
gaaccuguccuugcacacuc

SEQ ID NO: 2383857 - RNA, 12 nt, Human
gaaccugugucc

SEQ ID NO: 2383858 - RNA, 15 nt, Human
gaaccuguagagcua

SEQ ID NO: 2383859 - RNA, 23 nt, Human
gaacuagccaccaacucuugcag

SEQ ID NO: 2383860 - RNA, 22 nt, Human
gaacuagccaccaacucuugca

SEQ ID NO: 2383861 - RNA, 15 nt, Human
gaacuauaaagaagu

SEQ ID NO: 2383862 - RNA, 22 nt, Human
gaacuauuggagggugggagag

SEQ ID NO: 2383863 - RNA, 20 nt, Human
gaacuauuccccagcagggu

SEQ ID NO: 2383864 - RNA, 15 nt, Human
gaacuauuggagggu

SEQ ID NO: 2383865 - RNA, 21 nt, Human
gaacuauggacggugcuccag

SEQ ID NO: 2383866 - RNA, 18 nt, Human
gaacuauuccccagcagg

SEQ ID NO: 2383867 - RNA, 15 nt, Human
gaacuaugaacuaca

SEQ ID NO: 2383868 - RNA, 17 nt, Human
gaacuauggacggugcu

SEQ ID NO: 2383869 - RNA, 13 nt, Human
gaacuauuagagc

SEQ ID NO: 2383870 - RNA, 15 nt, Human
gaacggggagaaaag

SEQ ID NO: 2383871 - RNA, 17 nt, Human
gaacgguaaauuucugu

SEQ ID NO: 2383872 - RNA, 15 nt, Human
gaacgguaaauuucu

SEQ ID NO: 2383873 - RNA, 16 nt, Human
gaacgggguccuucaa

SEQ ID NO: 2383874 - RNA, 17 nt, Human
gaacguggcucugcugg

SEQ ID NO: 2383875 - RNA, 16 nt, Human
gaacguggcucugcug

SEQ ID NO: 2383876 - RNA, 14 nt, Human
gaacgugacugccc

SEQ ID NO: 2383877 - RNA, 22 nt, Human
gaacgugacugccccaacuccu

SEQ ID NO: 2383878 - RNA, 21 nt, Human
gaacuagaguuuagcuggaaa

SEQ ID NO: 2383879 - RNA, 22 nt, Human
gaacuagaguuuagcuggaaaa

SEQ ID NO: 2383880 - RNA, 17 nt, Human
gaagaaaauugcugugc

SEQ ID NO: 2383881 - RNA, 20 nt, Human
gaagaaaagugggccagugu

SEQ ID NO: 2383882 - RNA, 22 nt, Human
gaagaaaacaucuauucucucc

SEQ ID NO: 2383883 - RNA, 15 nt, Human
gaacuuggaggcacc

SEQ ID NO: 2383884 - RNA, 17 nt, Human
gaacuuggaggcaccau

SEQ ID NO: 2383885 - RNA, 14 nt, Human
gaagaaaacaucua

SEQ ID NO: 2383886 - RNA, 22 nt, Human
gaagaaaacuccuuuagcaggu

SEQ ID NO: 2383887 - RNA, 22 nt, Human
gaagaacuguguuucaaguuca

SEQ ID NO: 2383888 - RNA, 16 nt, Human
gaagaacuugcaugga

SEQ ID NO: 2383889 - RNA, 14 nt, Human
gaagaagagggaga

SEQ ID NO: 2383890 - RNA, 22 nt, Human
gaagaagagggagagguggagc

SEQ ID NO: 2383891 - RNA, 21 nt, Human
gaagaagcaccaaucaugaau

SEQ ID NO: 2383892 - RNA, 18 nt, Human
gaagaaaauugcugugcc

SEQ ID NO: 2383893 - RNA, 15 nt, Human
gaagaaacagaucuc

SEQ ID NO: 2383894 - RNA, 19 nt, Human
gaacuuggaaagaaaugcc

SEQ ID NO: 2383895 - RNA, 22 nt, Human
gaacuugcugcugagugcacca

SEQ ID NO: 2383896 - RNA, 13 nt, Human
gaacuuggcgcug

SEQ ID NO: 2383897 - RNA, 15 nt, Human
gaacuuggcgcugcc

SEQ ID NO: 2383898 - RNA, 16 nt, Human
gaacuuggcgcugccc

SEQ ID NO: 2383899 - RNA, 21 nt, Human
gaacuuguaaaggaauuuaaa

SEQ ID NO: 2383900 - RNA, 23 nt, Human
gaacuugguucccauuugcuccu

SEQ ID NO: 2383901 - RNA, 12 nt, Human
gaacuugguucc

SEQ ID NO: 2383902 - RNA, 20 nt, Human
gaacuuauccuaaaacaaau

SEQ ID NO: 2383903 - RNA, 22 nt, Human
gaacugugaggguaaaggcuau

SEQ ID NO: 2383904 - RNA, 21 nt, Human
gaacugucucucaugaaccuc

SEQ ID NO: 2383905 - RNA, 17 nt, Human
gaacuuacauuguucaa

SEQ ID NO: 2383906 - RNA, 18 nt, Human
gaacuguccagagagcaa

SEQ ID NO: 2383907 - RNA, 15 nt, Human
gaacuuauucuguag

SEQ ID NO: 2383908 - RNA, 22 nt, Human
gaacuuccagauccuggaaauc

SEQ ID NO: 2383909 - RNA, 23 nt, Human
gaacuuccagguguuacuguaau

SEQ ID NO: 2383910 - RNA, 18 nt, Human
gaacuucgcaucaaaaga

SEQ ID NO: 2383911 - RNA, 12 nt, Human
gaacuugacaau

SEQ ID NO: 2383912 - RNA, 12 nt, Human
gaacuugcaugg

SEQ ID NO: 2383913 - RNA, 21 nt, Human
gaacuugcagcugauguugga

SEQ ID NO: 2383914 - RNA, 16 nt, Human
gaacucauuccugccu

SEQ ID NO: 2383915 - RNA, 17 nt, Human
gaacucccagcaacaca

SEQ ID NO: 2383916 - RNA, 11 nt, Human
gaacucccagc

SEQ ID NO: 2383917 - RNA, 13 nt, Human
gaacuguccagag

SEQ ID NO: 2383918 - RNA, 19 nt, Human
gaacucccagcaacacaag

SEQ ID NO: 2383919 - RNA, 20 nt, Human
gaacuggucaccaugaaacu

SEQ ID NO: 2383920 - RNA, 17 nt, Human
gaacugucucucaugaa

SEQ ID NO: 2383921 - RNA, 22 nt, Human
gaacuguccagagagcaacucu

SEQ ID NO: 2383922 - RNA, 14 nt, Human
gaacuguccagaga

SEQ ID NO: 2383923 - RNA, 15 nt, Human
gaacuguccagagag

SEQ ID NO: 2383924 - RNA, 16 nt, Human
gaacuguccagagagc

SEQ ID NO: 2383925 - RNA, 17 nt, Human
gaacuguccagagagca

SEQ ID NO: 2383926 - RNA, 22 nt, Human
gaacuggguacuuguggacaca

SEQ ID NO: 2383927 - RNA, 15 nt, Human
gaacucccuuucaac

SEQ ID NO: 2383928 - RNA, 22 nt, Human
gaacucauuccugccugucucc

SEQ ID NO: 2383929 - RNA, 14 nt, Human
gaacucauuccugc

SEQ ID NO: 2383930 - RNA, 13 nt, Human
gaacucauuccug

SEQ ID NO: 2383931 - RNA, 15 nt, Human
gaacucaacuuugac

SEQ ID NO: 2383932 - RNA, 14 nt, Human
gaacucccuuucaa

SEQ ID NO: 2383933 - RNA, 22 nt, Human
gaacucaucuagguaaauuaca

SEQ ID NO: 2383934 - RNA, 23 nt, Human
gaacucaaauggggccagaucca

SEQ ID NO: 2383935 - RNA, 22 nt, Human
gaacucaaauggggccagaucc

SEQ ID NO: 2383936 - RNA, 20 nt, Human
gaacucaaauggggccagau

SEQ ID NO: 2383937 - RNA, 19 nt, Human
gaacucaaauggggccaga

SEQ ID NO: 2383938 - RNA, 16 nt, Human
gaacucaaauggggcc

SEQ ID NO: 2383939 - RNA, 17 nt, Human
gaaauauacacacagca

SEQ ID NO: 2383940 - RNA, 15 nt, Human
gaaauauacacacag

SEQ ID NO: 2383941 - RNA, 18 nt, Human
gaaauaguucaaagccaa

SEQ ID NO: 2383942 - RNA, 13 nt, Human
gaaauauaauuga

SEQ ID NO: 2383943 - RNA, 15 nt, Human
gaaauagucugugug

SEQ ID NO: 2383944 - RNA, 17 nt, Human
gaaauagucugugugaa

SEQ ID NO: 2383945 - RNA, 22 nt, Human
gaaauaguguggaaauuaagaa

SEQ ID NO: 2383946 - RNA, 21 nt, Human
gaaauaucugaaaauguaugu

SEQ ID NO: 2383947 - RNA, 20 nt, Human
gaaauaugaagaacugagga

SEQ ID NO: 2383948 - RNA, 14 nt, Human
gaaauaugaaugcc

SEQ ID NO: 2383949 - RNA, 14 nt, Human
gaaauaugauuuua

SEQ ID NO: 2383950 - RNA, 14 nt, Human
gaaauaucuguauu

SEQ ID NO: 2383951 - RNA, 13 nt, Human
gaaauaugcaucu

SEQ ID NO: 2383952 - RNA, 18 nt, Human
gaaauaugcacaauagca

SEQ ID NO: 2383953 - RNA, 17 nt, Human
gaaauaugcacaauagc

SEQ ID NO: 2383954 - RNA, 15 nt, Human
gaaauaugauuuuau

SEQ ID NO: 2383955 - RNA, 22 nt, Human
gaaauaugauuuuauuugacaa

SEQ ID NO: 2383956 - RNA, 19 nt, Human
gaaauagacaguauauuua

SEQ ID NO: 2383957 - RNA, 20 nt, Human
gaaauagcuccguggagcag

SEQ ID NO: 2383958 - RNA, 18 nt, Human
gaaauagacaguauauuu

SEQ ID NO: 2383959 - RNA, 20 nt, Human
gaaauagaaauuuccagaga

SEQ ID NO: 2383960 - RNA, 18 nt, Human
gaaauacugcaagaaaau

SEQ ID NO: 2383961 - RNA, 19 nt, Human
gaaauacuguuugagguuu

SEQ ID NO: 2383962 - RNA, 19 nt, Human
gaaauagaaaaacccugcc

SEQ ID NO: 2383963 - RNA, 20 nt, Human
gaaauagaaaaacccugccc

SEQ ID NO: 2383964 - RNA, 21 nt, Human
gaaauagaaaaacccugcccc

SEQ ID NO: 2383965 - RNA, 23 nt, Human
gaaauagaaaaacccugccccca

SEQ ID NO: 2383966 - RNA, 15 nt, Human
gaaauacuguuugag

SEQ ID NO: 2383967 - RNA, 14 nt, Human
gaaauacuauuuaa

SEQ ID NO: 2383968 - RNA, 15 nt, Human
gaaauacuauuuaaa

SEQ ID NO: 2383969 - RNA, 21 nt, Human
gaaauacaauucuacauuguc

SEQ ID NO: 2383970 - RNA, 18 nt, Human
gaaauacacaaguaaaca

SEQ ID NO: 2383971 - RNA, 19 nt, Human
gaaauacacaaguaaacau

SEQ ID NO: 2383972 - RNA, 17 nt, Human
gaaauacagauuuugau

SEQ ID NO: 2383973 - RNA, 22 nt, Human
gaaauacagauuuugauagcaa

SEQ ID NO: 2383974 - RNA, 16 nt, Human
gaaauacuacuccugu

SEQ ID NO: 2383975 - RNA, 17 nt, Human
gaaauacauauuuccaa

SEQ ID NO: 2383976 - RNA, 21 nt, Human
gaaauacauauuuccaagaag

SEQ ID NO: 2383977 - RNA, 21 nt, Human
gaaauacuacuuaccauaugu

SEQ ID NO: 2383978 - RNA, 19 nt, Human
gaaauacuacuccuguaau

SEQ ID NO: 2383979 - RNA, 16 nt, Human
gaaauacuacuuacca

SEQ ID NO: 2383980 - RNA, 12 nt, Human
gaaauacauauu

SEQ ID NO: 2383981 - RNA, 17 nt, Human
gaaauacauggacaaua

SEQ ID NO: 2383982 - RNA, 18 nt, Human
gaaauaaaguuggugaca

SEQ ID NO: 2383983 - RNA, 17 nt, Human
gaaauaaaguuugcuua

SEQ ID NO: 2383984 - RNA, 20 nt, Human
gaaacaugacucguauaugu

SEQ ID NO: 2383985 - RNA, 15 nt, Human
gaaacaugguuuuga

SEQ ID NO: 2383986 - RNA, 17 nt, Human
gaaacaggagagaaagg

SEQ ID NO: 2383987 - RNA, 13 nt, Human
gaaacaggagaga

SEQ ID NO: 2383988 - RNA, 22 nt, Human
gaaacaggaccacaaaaaugaa

SEQ ID NO: 2383989 - RNA, 20 nt, Human
gaaacaucaguuacucugaa

SEQ ID NO: 2383990 - RNA, 19 nt, Human
gaaacaucaguuacucuga

SEQ ID NO: 2383991 - RNA, 23 nt, Human
gaaacaucaguuacucugaaggg

SEQ ID NO: 2383992 - RNA, 22 nt, Human
gaaacauaaauaaaaugaccag

SEQ ID NO: 2383993 - RNA, 13 nt, Human
gaaacauaaauaa

SEQ ID NO: 2383994 - RNA, 15 nt, Human
gaaacauaaauaaaa

SEQ ID NO: 2383995 - RNA, 17 nt, Human
gaaacauaaauaaaaug

SEQ ID NO: 2383996 - RNA, 18 nt, Human
gaaacauaaauaaaauga

SEQ ID NO: 2383997 - RNA, 19 nt, Human
gaaauaauguacaucuggc

SEQ ID NO: 2383998 - RNA, 15 nt, Human
gaaauaauaugcauu

SEQ ID NO: 2383999 - RNA, 17 nt, Human
gaaauaauaaaucuggu

SEQ ID NO: 2384000 - RNA, 14 nt, Human
gaaauaauaaaucu

SEQ ID NO: 2384001 - RNA, 13 nt, Human
gaaauaauaaauc

SEQ ID NO: 2384002 - RNA, 13 nt, Human
gaaauaauaugca

SEQ ID NO: 2384003 - RNA, 14 nt, Human
gaaauaauaugcau

SEQ ID NO: 2384004 - RNA, 11 nt, Human
gaaauaauaaa

SEQ ID NO: 2384005 - RNA, 23 nt, Human
gaaauaaauagcuauauccaugu

SEQ ID NO: 2384006 - RNA, 18 nt, Human
gaaauaacaagucgauga

SEQ ID NO: 2384007 - RNA, 15 nt, Human
gaaauaacaauguua

SEQ ID NO: 2384008 - RNA, 16 nt, Human
gaaauaacaauguuaa

SEQ ID NO: 2384009 - RNA, 17 nt, Human
gaaauaacaauguuaag

SEQ ID NO: 2384010 - RNA, 18 nt, Human
gaaauaacaauguuaagg

SEQ ID NO: 2384011 - RNA, 20 nt, Human
gaaauaacaauguuaaggaa

SEQ ID NO: 2384012 - RNA, 21 nt, Human
gaaauaaauagcuauauccau

SEQ ID NO: 2384013 - RNA, 17 nt, Human
gaaauaaauagcuauau

SEQ ID NO: 2384014 - RNA, 15 nt, Human
gaaauaaauagcuau

SEQ ID NO: 2384015 - RNA, 14 nt, Human
gaaauaaauagcua

SEQ ID NO: 2384016 - RNA, 21 nt, Human
gaaauaaauguaucauagaaa

SEQ ID NO: 2384017 - RNA, 22 nt, Human
gaaauaacuccuucuuguagua

SEQ ID NO: 2384018 - RNA, 14 nt, Human
gaaauaagaaaaau

SEQ ID NO: 2384019 - RNA, 21 nt, Human
gaaauaagaaaaaucauguuu

SEQ ID NO: 2384020 - RNA, 16 nt, Human
gaaauaagaaaaauca

SEQ ID NO: 2384021 - RNA, 18 nt, Human
gaaauaagaaaaaucaug

SEQ ID NO: 2384022 - RNA, 23 nt, Human
gaaaugcugguuuuucaguuuuc

SEQ ID NO: 2384023 - RNA, 15 nt, Human
gaaaugcugggcuga

SEQ ID NO: 2384024 - RNA, 17 nt, Human
gaaaugcugccugccug

SEQ ID NO: 2384025 - RNA, 19 nt, Human
gaaaugcugggcugacggu

SEQ ID NO: 2384026 - RNA, 19 nt, Human
gaaauauuaaacccuggau

SEQ ID NO: 2384027 - RNA, 15 nt, Human
gaaauauucccuaga

SEQ ID NO: 2384028 - RNA, 16 nt, Human
gaaauauugcuggggu

SEQ ID NO: 2384029 - RNA, 15 nt, Human
gaaauauuuagcaaa

SEQ ID NO: 2384030 - RNA, 15 nt, Human
gaaaugcugccugcc

SEQ ID NO: 2384031 - RNA, 16 nt, Human
gaaaugcugccugccu

SEQ ID NO: 2384032 - RNA, 13 nt, Human
gaaauauuauguu

SEQ ID NO: 2384033 - RNA, 16 nt, Human
gaaauauuauguuaaa

SEQ ID NO: 2384034 - RNA, 18 nt, Human
gaaauggcuugaagccaa

SEQ ID NO: 2384035 - RNA, 17 nt, Human
gaaaugggacuuaacuc

SEQ ID NO: 2384036 - RNA, 19 nt, Human
gaaaugggacuuaacuccu

SEQ ID NO: 2384037 - RNA, 16 nt, Human
gaaaugguaugagcug

SEQ ID NO: 2384038 - RNA, 20 nt, Human
gaaaugggcagagcagagac

SEQ ID NO: 2384039 - RNA, 17 nt, Human
gaaauggcuugaagcca

SEQ ID NO: 2384040 - RNA, 17 nt, Human
gaaauggaauacugaag

SEQ ID NO: 2384041 - RNA, 16 nt, Human
gaaauggcuuugugau

SEQ ID NO: 2384042 - RNA, 22 nt, Human
gaaaugcuuguggauugagggu

SEQ ID NO: 2384043 - RNA, 14 nt, Human
gaaaugggcagagc

SEQ ID NO: 2384044 - RNA, 21 nt, Human
gaaauguuauuuuuuaauuau

SEQ ID NO: 2384045 - RNA, 22 nt, Human
gaaauguaagggaaacugccag

SEQ ID NO: 2384046 - RNA, 22 nt, Human
gaaauguuauuuuuuaauuauu

SEQ ID NO: 2384047 - RNA, 13 nt, Human
gaaaugguuguau

SEQ ID NO: 2384048 - RNA, 17 nt, Human
gaaaugguaugagcuga

SEQ ID NO: 2384049 - RNA, 21 nt, Human
gaaaugguaugagcugagggg

SEQ ID NO: 2384050 - RNA, 14 nt, Human
gaaaugguuguauu

SEQ ID NO: 2384051 - RNA, 15 nt, Human
gaaaugguuguauua

SEQ ID NO: 2384052 - RNA, 17 nt, Human
gaaaugguuguauuaga

SEQ ID NO: 2384053 - RNA, 18 nt, Human
gaaaugguuguauuagau

SEQ ID NO: 2384054 - RNA, 19 nt, Human
gaaaugguuguauuagaug

SEQ ID NO: 2384055 - RNA, 20 nt, Human
gaaaugguuguauuagaugu

SEQ ID NO: 2384056 - RNA, 16 nt, Human
gaaauuaagaagaaac

SEQ ID NO: 2384057 - RNA, 15 nt, Human
gaaauuaagaagaaa

SEQ ID NO: 2384058 - RNA, 13 nt, Human
gaaauuaagaaga

SEQ ID NO: 2384059 - RNA, 22 nt, Human
gaaauuaagaaggcaaaaaugu

SEQ ID NO: 2384060 - RNA, 18 nt, Human
gaaauuaagaaggcaaaa

SEQ ID NO: 2384061 - RNA, 17 nt, Human
gaaauuaagaaggcaaa

SEQ ID NO: 2384062 - RNA, 17 nt, Human
gaaauuacacccaaaga

SEQ ID NO: 2384063 - RNA, 20 nt, Human
gaaauuaccagaguuguucu

SEQ ID NO: 2384064 - RNA, 19 nt, Human
gaaauuccuguagcaucuu

SEQ ID NO: 2384065 - RNA, 16 nt, Human
gaaauuccuguagcau

SEQ ID NO: 2384066 - RNA, 14 nt, Human
gaaauucuccugga

SEQ ID NO: 2384067 - RNA, 15 nt, Human
gaaauucuccuggag

SEQ ID NO: 2384068 - RNA, 16 nt, Human
gaaauucuccuggagg

SEQ ID NO: 2384069 - RNA, 17 nt, Human
gaacacugggggagggg

SEQ ID NO: 2384070 - RNA, 16 nt, Human
gaacacugggggaggg

SEQ ID NO: 2384071 - RNA, 18 nt, Human
gaaauuuucuagacuuuc

SEQ ID NO: 2384072 - RNA, 20 nt, Human
gaaauuuucuagacuuucug

SEQ ID NO: 2384073 - RNA, 22 nt, Human
gaaauuuuauaugcuuacugau

SEQ ID NO: 2384074 - RNA, 21 nt, Human
gaaauuugauuucuauucaag

SEQ ID NO: 2384075 - RNA, 14 nt, Human
gaaauuuuccaaug

SEQ ID NO: 2384076 - RNA, 21 nt, Human
gaaauuuucuagacuuucugu

SEQ ID NO: 2384077 - RNA, 22 nt, Human
gaaauuuuaaccuaugauauuu

SEQ ID NO: 2384078 - RNA, 19 nt, Human
gaaauuuuauaugcuuacu

SEQ ID NO: 2384079 - RNA, 15 nt, Human
gaaauuuuauaugcu

SEQ ID NO: 2384080 - RNA, 17 nt, Human
gaaauuuguuauaauga

SEQ ID NO: 2384081 - RNA, 23 nt, Human
gaaauuuaauucauguuucuuaa

SEQ ID NO: 2384082 - RNA, 15 nt, Human
gaaauuugauuucua

SEQ ID NO: 2384083 - RNA, 21 nt, Human
gaaauuuaauucauguuucuu

SEQ ID NO: 2384084 - RNA, 20 nt, Human
gaaauuuaauucauguuucu

SEQ ID NO: 2384085 - RNA, 16 nt, Human
gaaauuuaauucaugu

SEQ ID NO: 2384086 - RNA, 22 nt, Human
gaaauuuaauauagcuauuuuu

SEQ ID NO: 2384087 - RNA, 13 nt, Human
gaaauuuaaaaga

SEQ ID NO: 2384088 - RNA, 21 nt, Human
gaaauugucuagcagagcagg

SEQ ID NO: 2384089 - RNA, 20 nt, Human
gaaauugucuagcagagcag

SEQ ID NO: 2384090 - RNA, 19 nt, Human
gaaauuuaaaagacacugu

SEQ ID NO: 2384091 - RNA, 22 nt, Human
gaaauuguuuaaguguuguaaa

SEQ ID NO: 2384092 - RNA, 19 nt, Human
gaaauugcauuuccugaca

SEQ ID NO: 2384093 - RNA, 13 nt, Human
gaaauugacagau

SEQ ID NO: 2384094 - RNA, 17 nt, Human
gaaauugccugacgaac

SEQ ID NO: 2384095 - RNA, 17 nt, Human
gaaauuggaacagaaug

SEQ ID NO: 2384096 - RNA, 22 nt, Human
gaaauuggaacagaauguuuua

SEQ ID NO: 2384097 - RNA, 14 nt, Human
gaaauuggcuggau

SEQ ID NO: 2384098 - RNA, 15 nt, Human
gaaauuggcuggaug

SEQ ID NO: 2384099 - RNA, 17 nt, Human
gaaauucuccuggaggu

SEQ ID NO: 2384100 - RNA, 21 nt, Human
gaaauugacacaaguggaccu

SEQ ID NO: 2384101 - RNA, 12 nt, Human
gaaauugacaga

SEQ ID NO: 2384102 - RNA, 17 nt, Human
gaaggcagcagguggca

SEQ ID NO: 2384103 - RNA, 13 nt, Human
gaaggcaaugcca

SEQ ID NO: 2384104 - RNA, 16 nt, Human
gaaggcagccaccagc

SEQ ID NO: 2384105 - RNA, 13 nt, Human
gaaggcaggaaga

SEQ ID NO: 2384106 - RNA, 18 nt, Human
gaaggcagaaagcaaaau

SEQ ID NO: 2384107 - RNA, 15 nt, Human
gaaggcagaaagcaa

SEQ ID NO: 2384108 - RNA, 24 nt, Human
gaaggcacuaaaaagagcuguccu

SEQ ID NO: 2384109 - RNA, 22 nt, Human
gaaggcaagaggggguggaggg

SEQ ID NO: 2384110 - RNA, 23 nt, Human
gaaggcaagaggggguggagggg

SEQ ID NO: 2384111 - RNA, 16 nt, Human
gaaggcaaaugacuuu

SEQ ID NO: 2384112 - RNA, 15 nt, Human
gaaggcaaaugacuu

SEQ ID NO: 2384113 - RNA, 12 nt, Human
gaaggcaaaaaa

SEQ ID NO: 2384114 - RNA, 14 nt, Human
gaaggcaagagggg

SEQ ID NO: 2384115 - RNA, 16 nt, Human
gaaggcaagagggggu

SEQ ID NO: 2384116 - RNA, 17 nt, Human
gaaggcaagagggggug

SEQ ID NO: 2384117 - RNA, 13 nt, Human
gaaggcagggaaa

SEQ ID NO: 2384118 - RNA, 13 nt, Human
gaaggcagggagg

SEQ ID NO: 2384119 - RNA, 22 nt, Human
gaaggccagcugccccagccag

SEQ ID NO: 2384120 - RNA, 13 nt, Human
gaaggccacaugu

SEQ ID NO: 2384121 - RNA, 14 nt, Human
gaaggcagggaggg

SEQ ID NO: 2384122 - RNA, 21 nt, Human
gaaggguuuguggcugggggc

SEQ ID NO: 2384123 - RNA, 15 nt, Human
gaaggguuuguggcu

SEQ ID NO: 2384124 - RNA, 21 nt, Human
gaaggguccuucccucucccc

SEQ ID NO: 2384125 - RNA, 17 nt, Human
gaagggugguggagcca

SEQ ID NO: 2384126 - RNA, 14 nt, Human
gaaggguccuuccc

SEQ ID NO: 2384127 - RNA, 13 nt, Human
gaagguaaaauug

SEQ ID NO: 2384128 - RNA, 20 nt, Human
gaaggguuuuccacccugga

SEQ ID NO: 2384129 - RNA, 20 nt, Human
gaagguucuggugugaacua

SEQ ID NO: 2384130 - RNA, 16 nt, Human
gaagguucugguguga

SEQ ID NO: 2384131 - RNA, 13 nt, Human
gaaggguaaagaa

SEQ ID NO: 2384132 - RNA, 16 nt, Human
gaaggccccgcccagg

SEQ ID NO: 2384133 - RNA, 14 nt, Human
gaaggccccgccca

SEQ ID NO: 2384134 - RNA, 15 nt, Human
gaaggccccgcccag

SEQ ID NO: 2384135 - RNA, 20 nt, Human
gaaggaaaaggcagggagcg

SEQ ID NO: 2384136 - RNA, 15 nt, Human
gaaggaccuccugag

SEQ ID NO: 2384137 - RNA, 16 nt, Human
gaaggagaaggaagga

SEQ ID NO: 2384138 - RNA, 23 nt, Human
gaaggacugugacaggcagcaga

SEQ ID NO: 2384139 - RNA, 21 nt, Human
gaaggacugugacaggcagca

SEQ ID NO: 2384140 - RNA, 22 nt, Human
gaaggacugugacaggcagcag

SEQ ID NO: 2384141 - RNA, 18 nt, Human
gaaggacugugacaggca

SEQ ID NO: 2384142 - RNA, 19 nt, Human
gaaggacugugacaggcag

SEQ ID NO: 2384143 - RNA, 22 nt, Human
gaaggagacucaccucugccuc

SEQ ID NO: 2384144 - RNA, 20 nt, Human
gaaggagacucaccucugcc

SEQ ID NO: 2384145 - RNA, 17 nt, Human
gaaggagacucaccucu

SEQ ID NO: 2384146 - RNA, 15 nt, Human
gaaggagacucaccu

SEQ ID NO: 2384147 - RNA, 18 nt, Human
gaaggagacagagcuggu

SEQ ID NO: 2384148 - RNA, 15 nt, Human
gaaggagacagagcu

SEQ ID NO: 2384149 - RNA, 17 nt, Human
gaaggagaaggaaggag

SEQ ID NO: 2384150 - RNA, 23 nt, Human
gaaggacccggaggggccuggca

SEQ ID NO: 2384151 - RNA, 14 nt, Human
gaaggaaaaugaua

SEQ ID NO: 2384152 - RNA, 18 nt, Human
gaaggaaacccagcucug

SEQ ID NO: 2384153 - RNA, 14 nt, Human
gaaggaaacccagc

SEQ ID NO: 2384154 - RNA, 17 nt, Human
gaaggaaacccagcucu

SEQ ID NO: 2384155 - RNA, 16 nt, Human
gaaggagagccugcug

SEQ ID NO: 2384156 - RNA, 15 nt, Human
gaaggagagccugcu

SEQ ID NO: 2384157 - RNA, 13 nt, Human
gaaggagagccug

SEQ ID NO: 2384158 - RNA, 20 nt, Human
gaaggagagaaggggaggag

SEQ ID NO: 2384159 - RNA, 18 nt, Human
gaaggagagaaggggagg

SEQ ID NO: 2384160 - RNA, 16 nt, Human
gaaggagagaagggga

SEQ ID NO: 2384161 - RNA, 15 nt, Human
gaaggagagaagggg

SEQ ID NO: 2384162 - RNA, 20 nt, Human
gaaggagagaaaguggguga

SEQ ID NO: 2384163 - RNA, 21 nt, Human
gaaggagagaaagugggugag

SEQ ID NO: 2384164 - RNA, 23 nt, Human
gaaggagacucaccucugccuca

SEQ ID NO: 2384165 - RNA, 12 nt, Human
gaaggagagaaa

SEQ ID NO: 2384166 - RNA, 13 nt, Human
gaaggagagaaag

SEQ ID NO: 2384167 - RNA, 16 nt, Human
gaaggagagaaagugg

SEQ ID NO: 2384168 - RNA, 22 nt, Human
gaaggagccccauuccugggaa

SEQ ID NO: 2384169 - RNA, 21 nt, Human
gaaggagccccauuccuggga

SEQ ID NO: 2384170 - RNA, 20 nt, Human
gaaggagccccauuccuggg

SEQ ID NO: 2384171 - RNA, 13 nt, Human
gaaggaguuuuau

SEQ ID NO: 2384172 - RNA, 21 nt, Human
gaaggauacaaaagcauguga

SEQ ID NO: 2384173 - RNA, 15 nt, Human
gaaggcaaagcacga

SEQ ID NO: 2384174 - RNA, 14 nt, Human
gaaggcaaaugacu

SEQ ID NO: 2384175 - RNA, 19 nt, Human
gaaggauacaaaagcaugu

SEQ ID NO: 2384176 - RNA, 12 nt, Human
gaaggauacaaa

SEQ ID NO: 2384177 - RNA, 12 nt, Human
gaagccauuguc

SEQ ID NO: 2384178 - RNA, 18 nt, Human
gaagccagugcggcaggu

SEQ ID NO: 2384179 - RNA, 22 nt, Human
gaagccaggagcaaauguuucu

SEQ ID NO: 2384180 - RNA, 15 nt, Human
gaagccaggagcaaa

SEQ ID NO: 2384181 - RNA, 18 nt, Human
gaagccaggagcaaaugu

SEQ ID NO: 2384182 - RNA, 12 nt, Human
gaagccaggagc

SEQ ID NO: 2384183 - RNA, 13 nt, Human
gaagccaggagca

SEQ ID NO: 2384184 - RNA, 14 nt, Human
gaagccaggagcaa

SEQ ID NO: 2384185 - RNA, 14 nt, Human
gaagcccaauaaac

SEQ ID NO: 2384186 - RNA, 16 nt, Human
gaagccauugucuucg

SEQ ID NO: 2384187 - RNA, 16 nt, Human
gaagcccaagugaaau

SEQ ID NO: 2384188 - RNA, 15 nt, Human
gaagcccaagugaaa

SEQ ID NO: 2384189 - RNA, 13 nt, Human
gaagccauugucu

SEQ ID NO: 2384190 - RNA, 14 nt, Human
gaagccauugucuu

SEQ ID NO: 2384191 - RNA, 12 nt, Human
gaagcccagaau

SEQ ID NO: 2384192 - RNA, 10 nt, Human
gaagcccaga

SEQ ID NO: 2384193 - RNA, 23 nt, Human
gaagccagcaggcucucaggcca

SEQ ID NO: 2384194 - RNA, 22 nt, Human
gaagccacuuucuacaggccag

SEQ ID NO: 2384195 - RNA, 20 nt, Human
gaagccagccuucuuccauc

SEQ ID NO: 2384196 - RNA, 12 nt, Human
gaagccagccuu

SEQ ID NO: 2384197 - RNA, 22 nt, Human
gaagccagcuuucccugccucu

SEQ ID NO: 2384198 - RNA, 24 nt, Human
gaagccaggaauuucccaggaccc

SEQ ID NO: 2384199 - RNA, 23 nt, Human
gaagccaggaauuucccaggacc

SEQ ID NO: 2384200 - RNA, 21 nt, Human
gaagccaggaauuucccagga

SEQ ID NO: 2384201 - RNA, 19 nt, Human
gaagccaggaauuucccag

SEQ ID NO: 2384202 - RNA, 18 nt, Human
gaagccacugaagcuggg

SEQ ID NO: 2384203 - RNA, 15 nt, Human
gaagccacugaagcu

SEQ ID NO: 2384204 - RNA, 13 nt, Human
gaagacucuacca

SEQ ID NO: 2384205 - RNA, 15 nt, Human
gaagacucuaccaga

SEQ ID NO: 2384206 - RNA, 23 nt, Human
gaagacucuaccagacuguguau

SEQ ID NO: 2384207 - RNA, 22 nt, Human
gaagccacgguguucugugaua

SEQ ID NO: 2384208 - RNA, 15 nt, Human
gaagccagcaggcuc

SEQ ID NO: 2384209 - RNA, 16 nt, Human
gaagccagcaggcucu

SEQ ID NO: 2384210 - RNA, 19 nt, Human
gaagacucauucuucugua

SEQ ID NO: 2384211 - RNA, 21 nt, Human
gaagacucauucuucuguacg

SEQ ID NO: 2384212 - RNA, 15 nt, Human
gaagaagagggagag

SEQ ID NO: 2384213 - RNA, 17 nt, Human
gaagacugcauuauauu

SEQ ID NO: 2384214 - RNA, 18 nt, Human
gaaggaaaaggcagggag

SEQ ID NO: 2384215 - RNA, 15 nt, Human
gaaggaaaaaugugu

SEQ ID NO: 2384216 - RNA, 18 nt, Human
gaagcuuuuaugugaaac

SEQ ID NO: 2384217 - RNA, 23 nt, Human
gaagcuuguguauccauuaucau

SEQ ID NO: 2384218 - RNA, 14 nt, Human
gaagcuuucaguau

SEQ ID NO: 2384219 - RNA, 14 nt, Human
gaagcuuucugucu

SEQ ID NO: 2384220 - RNA, 15 nt, Human
gaagcuuugaaggcc

SEQ ID NO: 2384221 - RNA, 22 nt, Human
gaagcgcgccacucgcuucccc

SEQ ID NO: 2384222 - RNA, 23 nt, Human
gaagcuucuuaaaugagaaggaa

SEQ ID NO: 2384223 - RNA, 22 nt, Human
gaagcuuguguauccauuauca

SEQ ID NO: 2384224 - RNA, 14 nt, Human
gaagccucuggcua

SEQ ID NO: 2384225 - RNA, 13 nt, Human
gaagccucuggcu

SEQ ID NO: 2384226 - RNA, 17 nt, Human
gaagccucuggcuagag

SEQ ID NO: 2384227 - RNA, 16 nt, Human
gaagccuccccagcuc

SEQ ID NO: 2384228 - RNA, 21 nt, Human
gaagccuuggggcugaugcag

SEQ ID NO: 2384229 - RNA, 16 nt, Human
gaagcgagcacugacc

SEQ ID NO: 2384230 - RNA, 18 nt, Human
gaagccuuugggaagggg

SEQ ID NO: 2384231 - RNA, 15 nt, Human
gaagccuuuccugua

SEQ ID NO: 2384232 - RNA, 13 nt, Human
gaagccuuuggga

SEQ ID NO: 2384233 - RNA, 11 nt, Human
gaagccuuugu

SEQ ID NO: 2384234 - RNA, 10 nt, Human
gaagccuuug

SEQ ID NO: 2384235 - RNA, 12 nt, Human
gaagccucuggc

SEQ ID NO: 2384236 - RNA, 19 nt, Human
gaagccgugcccugccccc

SEQ ID NO: 2384237 - RNA, 17 nt, Human
gaagccgugcccugccc

SEQ ID NO: 2384238 - RNA, 16 nt, Human
gaagccgugcccugcc

SEQ ID NO: 2384239 - RNA, 20 nt, Human
gaagccgugcucgccccagc

SEQ ID NO: 2384240 - RNA, 16 nt, Human
gaagccgggaacagac

SEQ ID NO: 2384241 - RNA, 20 nt, Human
gaagccggcggcccaagccc

SEQ ID NO: 2384242 - RNA, 16 nt, Human
gaagccggaggguguu

SEQ ID NO: 2384243 - RNA, 15 nt, Human
gaagccggcggccca

SEQ ID NO: 2384244 - RNA, 18 nt, Human
gaagccggcggcccaagc

SEQ ID NO: 2384245 - RNA, 23 nt, Human
gaagcccaggaaaggcuccagga

SEQ ID NO: 2384246 - RNA, 21 nt, Human
gaagccgcuggggccaguugg

SEQ ID NO: 2384247 - RNA, 19 nt, Human
gaagcccaauaaaccucuu

SEQ ID NO: 2384248 - RNA, 18 nt, Human
gaagcccaauaaaccucu

SEQ ID NO: 2384249 - RNA, 20 nt, Human
gaagcccaggaaaggcucca

SEQ ID NO: 2384250 - RNA, 21 nt, Human
gaagcccaggaaaggcuccag

SEQ ID NO: 2384251 - RNA, 22 nt, Human
gaagcccaggaaaggcuccagg

SEQ ID NO: 2384252 - RNA, 21 nt, Human
gaaucuauuauacuguauuaa

SEQ ID NO: 2384253 - RNA, 16 nt, Human
gaaucucaaauaacua

SEQ ID NO: 2384254 - RNA, 18 nt, Human
gaaucuggagaccaggga

SEQ ID NO: 2384255 - RNA, 16 nt, Human
gaaucuggagaccagg

SEQ ID NO: 2384256 - RNA, 22 nt, Human
gaaucuggagaccagggagccu

SEQ ID NO: 2384257 - RNA, 13 nt, Human
gaaucuauuuaag

SEQ ID NO: 2384258 - RNA, 22 nt, Human
gaaucuaugccaaagaucacuu

SEQ ID NO: 2384259 - RNA, 15 nt, Human
gaaucuauuauacug

SEQ ID NO: 2384260 - RNA, 21 nt, Human
gaaucuaucugcuuaugcagu

SEQ ID NO: 2384261 - RNA, 12 nt, Human
gaaucuaugcca

SEQ ID NO: 2384262 - RNA, 15 nt, Human
gaaucuaugccaaag

SEQ ID NO: 2384263 - RNA, 19 nt, Human
gaaucuaugccaaagauca

SEQ ID NO: 2384264 - RNA, 15 nt, Human
gaaucuauuuaagua

SEQ ID NO: 2384265 - RNA, 16 nt, Human
gaaucuauuuaaguaa

SEQ ID NO: 2384266 - RNA, 22 nt, Human
gaauccuguccucagcuucuua

SEQ ID NO: 2384267 - RNA, 23 nt, Human
gaauccuacacaccuaagggaca

SEQ ID NO: 2384268 - RNA, 15 nt, Human
gaauccuagggccug

SEQ ID NO: 2384269 - RNA, 20 nt, Human
gaauccuaggcuccacccca

SEQ ID NO: 2384270 - RNA, 14 nt, Human
gaaugaaagggccc

SEQ ID NO: 2384271 - RNA, 21 nt, Human
gaaucuugucucaaugcucau

SEQ ID NO: 2384272 - RNA, 16 nt, Human
gaaugaaacccccaca

SEQ ID NO: 2384273 - RNA, 20 nt, Human
gaaugaaacccccacacaca

SEQ ID NO: 2384274 - RNA, 19 nt, Human
gaaugaaacccccacacac

SEQ ID NO: 2384275 - RNA, 15 nt, Human
gaaucuugucucaau

SEQ ID NO: 2384276 - RNA, 16 nt, Human
gaaucuugucucaaug

SEQ ID NO: 2384277 - RNA, 18 nt, Human
gaaucuugucucaaugcu

SEQ ID NO: 2384278 - RNA, 20 nt, Human
gaaucuugucucaaugcuca

SEQ ID NO: 2384279 - RNA, 13 nt, Human
gaaucuugucuca

SEQ ID NO: 2384280 - RNA, 14 nt, Human
gaaucuugucucaa

SEQ ID NO: 2384281 - RNA, 22 nt, Human
gaaugcucaaguuuuucagaaa

SEQ ID NO: 2384282 - RNA, 23 nt, Human
gaaugcggcaagaaggaauugac

SEQ ID NO: 2384283 - RNA, 19 nt, Human
gaaugccugagugccuggc

SEQ ID NO: 2384284 - RNA, 16 nt, Human
gaaugccugagugccu

SEQ ID NO: 2384285 - RNA, 18 nt, Human
gaaugccugagugccugg

SEQ ID NO: 2384286 - RNA, 13 nt, Human
gaaugccuccucc

SEQ ID NO: 2384287 - RNA, 22 nt, Human
gaaugccucaaugugaccaggg

SEQ ID NO: 2384288 - RNA, 22 nt, Human
gaaugaaagaguaaaggaaaug

SEQ ID NO: 2384289 - RNA, 14 nt, Human
gaaugaaagcuccu

SEQ ID NO: 2384290 - RNA, 14 nt, Human
gaaugccuccugca

SEQ ID NO: 2384291 - RNA, 19 nt, Human
gaaugaaagggcccagaga

SEQ ID NO: 2384292 - RNA, 21 nt, Human
gaaugccucaaugugaccagg

SEQ ID NO: 2384293 - RNA, 21 nt, Human
gaaugaaacccccacacacac

SEQ ID NO: 2384294 - RNA, 12 nt, Human
gaaugaaagagu

SEQ ID NO: 2384295 - RNA, 14 nt, Human
gaaugaaagaguaa

SEQ ID NO: 2384296 - RNA, 19 nt, Human
gaaucagacuucacacugc

SEQ ID NO: 2384297 - RNA, 23 nt, Human
gaaucagacccuaccccaccacg

SEQ ID NO: 2384298 - RNA, 22 nt, Human
gaaucagacccuaccccaccac

SEQ ID NO: 2384299 - RNA, 18 nt, Human
gaaucagacccuacccca

SEQ ID NO: 2384300 - RNA, 13 nt, Human
gaaucagaacuca

SEQ ID NO: 2384301 - RNA, 19 nt, Human
gaaucagaucauuucaaaa

SEQ ID NO: 2384302 - RNA, 12 nt, Human
gaaucagcuucu

SEQ ID NO: 2384303 - RNA, 23 nt, Human
gaaucauuuguucaaagcuguug

SEQ ID NO: 2384304 - RNA, 14 nt, Human
gaaucauuuguuca

SEQ ID NO: 2384305 - RNA, 22 nt, Human
gaaucauuucuauuucuccucc

SEQ ID NO: 2384306 - RNA, 12 nt, Human
gaauccaaacuu

SEQ ID NO: 2384307 - RNA, 13 nt, Human
gaauccaaacuug

SEQ ID NO: 2384308 - RNA, 16 nt, Human
gaauccaagcgagguc

SEQ ID NO: 2384309 - RNA, 17 nt, Human
gaauccaagugaacacu

SEQ ID NO: 2384310 - RNA, 15 nt, Human
gaauccacccauccu

SEQ ID NO: 2384311 - RNA, 24 nt, Human
gaauccacccauccuaccaaugca

SEQ ID NO: 2384312 - RNA, 16 nt, Human
gaauccccucccuguc

SEQ ID NO: 2384313 - RNA, 23 nt, Human
gaaucccccuugccaccccaccc

SEQ ID NO: 2384314 - RNA, 16 nt, Human
gaauccccgaaggugc

SEQ ID NO: 2384315 - RNA, 17 nt, Human
gaauccccucccuguca

SEQ ID NO: 2384316 - RNA, 14 nt, Human
gaaucccccuugcc

SEQ ID NO: 2384317 - RNA, 17 nt, Human
gaaucccccuugccacc

SEQ ID NO: 2384318 - RNA, 18 nt, Human
gaaucccccuugccaccc

SEQ ID NO: 2384319 - RNA, 17 nt, Human
gaauccacucccaggca

SEQ ID NO: 2384320 - RNA, 15 nt, Human
gaauagcugggacua

SEQ ID NO: 2384321 - RNA, 21 nt, Human
gaaucaauaauauauuuucug

SEQ ID NO: 2384322 - RNA, 13 nt, Human
gaaucagaaacag

SEQ ID NO: 2384323 - RNA, 19 nt, Human
gaaucacucuuguggaugu

SEQ ID NO: 2384324 - RNA, 18 nt, Human
gaaucacucuuguggaug

SEQ ID NO: 2384325 - RNA, 14 nt, Human
gaauagcugggacu

SEQ ID NO: 2384326 - RNA, 23 nt, Human
gaauagccacauuuggaauacuu

SEQ ID NO: 2384327 - RNA, 18 nt, Human
gaauagccacauuuggaa

SEQ ID NO: 2384328 - RNA, 15 nt, Human
gaauagccacauuug

SEQ ID NO: 2384329 - RNA, 19 nt, Human
gaauagcaaggugcucaca

SEQ ID NO: 2384330 - RNA, 15 nt, Human
gaauagaugcugacu

SEQ ID NO: 2384331 - RNA, 18 nt, Human
gaaguuuaauugacuuau

SEQ ID NO: 2384332 - RNA, 14 nt, Human
gaaguuucacauga

SEQ ID NO: 2384333 - RNA, 12 nt, Human
gaaguuucugcc

SEQ ID NO: 2384334 - RNA, 21 nt, Human
gaaguuuccuuggcuggugca

SEQ ID NO: 2384335 - RNA, 15 nt, Human
gaauaaaauguugaa

SEQ ID NO: 2384336 - RNA, 17 nt, Human
gaauaaaauguugaaaa

SEQ ID NO: 2384337 - RNA, 21 nt, Human
gaauaaaauguugaaaaguca

SEQ ID NO: 2384338 - RNA, 12 nt, Human
gaauaaaauuuu

SEQ ID NO: 2384339 - RNA, 15 nt, Human
gaagguuuguauauu

SEQ ID NO: 2384340 - RNA, 16 nt, Human
gaagguuuguguuuuu

SEQ ID NO: 2384341 - RNA, 16 nt, Human
gaagguuuguauauug

SEQ ID NO: 2384342 - RNA, 20 nt, Human
gaagguuuacucuguggcca

SEQ ID NO: 2384343 - RNA, 20 nt, Human
gaagguuuacaauuuacaaa

SEQ ID NO: 2384344 - RNA, 20 nt, Human
gaagguuugguguguggaga

SEQ ID NO: 2384345 - RNA, 15 nt, Human
gaagguugugaugaa

SEQ ID NO: 2384346 - RNA, 13 nt, Human
gaagguugaagag

SEQ ID NO: 2384347 - RNA, 12 nt, Human
gaagguuguaag

SEQ ID NO: 2384348 - RNA, 20 nt, Human
gaagguuuguguuuuucugc

SEQ ID NO: 2384349 - RNA, 16 nt, Human
gaaguuuacauuguaa

SEQ ID NO: 2384350 - RNA, 17 nt, Human
gaaguuuacauuguaaa

SEQ ID NO: 2384351 - RNA, 16 nt, Human
gaauaaaguugaagcu

SEQ ID NO: 2384352 - RNA, 14 nt, Human
gaauaaaguugaag

SEQ ID NO: 2384353 - RNA, 22 nt, Human
gaauaaauaaauguaucuuauu

SEQ ID NO: 2384354 - RNA, 11 nt, Human
gaauaaauaug

SEQ ID NO: 2384355 - RNA, 12 nt, Human
gaauaaauaugc

SEQ ID NO: 2384356 - RNA, 16 nt, Human
gaauaaauaugccucu

SEQ ID NO: 2384357 - RNA, 19 nt, Human
gaauaaauaugccucuccu

SEQ ID NO: 2384358 - RNA, 20 nt, Human
gaauaaaguucugaguguuu

SEQ ID NO: 2384359 - RNA, 14 nt, Human
gaauaaaguucuga

SEQ ID NO: 2384360 - RNA, 13 nt, Human
gaauaaaguucug

SEQ ID NO: 2384361 - RNA, 17 nt, Human
gaauaaagccugcuuuu

SEQ ID NO: 2384362 - RNA, 20 nt, Human
gaauaaagcaauuuuccuug

SEQ ID NO: 2384363 - RNA, 21 nt, Human
gaauaaagcaauuuuccuuga

SEQ ID NO: 2384364 - RNA, 16 nt, Human
gaauaaagcaauuuuc

SEQ ID NO: 2384365 - RNA, 17 nt, Human
gaauaaagcaauuuucc

SEQ ID NO: 2384366 - RNA, 18 nt, Human
gaauaaagcaauuuuccu

SEQ ID NO: 2384367 - RNA, 19 nt, Human
gaauaaagcaauuuuccuu

SEQ ID NO: 2384368 - RNA, 22 nt, Human
gaauaaagcaauuuuccuugaa

SEQ ID NO: 2384369 - RNA, 14 nt, Human
gaauaaagacaccu

SEQ ID NO: 2384370 - RNA, 12 nt, Human
gaauaaagcaau

SEQ ID NO: 2384371 - RNA, 13 nt, Human
gaauaaagcaauu

SEQ ID NO: 2384372 - RNA, 14 nt, Human
gaauaaagcaauuu

SEQ ID NO: 2384373 - RNA, 15 nt, Human
gaauaaagcaauuuu

SEQ ID NO: 2384374 - RNA, 19 nt, Human
gaauaaacuagauuacauu

SEQ ID NO: 2384375 - RNA, 16 nt, Human
gaauaaacuagauuac

SEQ ID NO: 2384376 - RNA, 22 nt, Human
gaauaaaauuguaaaauuguau

SEQ ID NO: 2384377 - RNA, 12 nt, Human
gaauaaacuaga

SEQ ID NO: 2384378 - RNA, 23 nt, Human
gaauaaaauguugaaaagucaaa

SEQ ID NO: 2384379 - RNA, 17 nt, Human
gaauaaaauuauuuugg

SEQ ID NO: 2384380 - RNA, 21 nt, Human
gaauaaaauuauuuuggauuu

SEQ ID NO: 2384381 - RNA, 13 nt, Human
gaauaaaauugua

SEQ ID NO: 2384382 - RNA, 14 nt, Human
gaauaacauguaau

SEQ ID NO: 2384383 - RNA, 12 nt, Human
gaauaaggccuu

SEQ ID NO: 2384384 - RNA, 22 nt, Human
gaauaagccauucugacucaua

SEQ ID NO: 2384385 - RNA, 21 nt, Human
gaauaagccauucugacucau

SEQ ID NO: 2384386 - RNA, 20 nt, Human
gaauaagccauucugacuca

SEQ ID NO: 2384387 - RNA, 15 nt, Human
gaauaaauugcuccu

SEQ ID NO: 2384388 - RNA, 21 nt, Human
gaauaaauaugccucuccuuu

SEQ ID NO: 2384389 - RNA, 11 nt, Human
gaauaaauguc

SEQ ID NO: 2384390 - RNA, 14 nt, Human
gaauaaaugucuuu

SEQ ID NO: 2384391 - RNA, 15 nt, Human
gaauaaucuuugggu

SEQ ID NO: 2384392 - RNA, 19 nt, Human
gaauaauaaaaguauauau

SEQ ID NO: 2384393 - RNA, 21 nt, Human
gaauaauaaaaguauauauau

SEQ ID NO: 2384394 - RNA, 18 nt, Human
gaauaaguuauugcaguu

SEQ ID NO: 2384395 - RNA, 19 nt, Human
gaauaaguuauugcaguuu

SEQ ID NO: 2384396 - RNA, 20 nt, Human
gaauaauccuaaacauauga

SEQ ID NO: 2384397 - RNA, 20 nt, Human
gaauaagugccaggauggaa

SEQ ID NO: 2384398 - RNA, 12 nt, Human
gaauaaguuauu

SEQ ID NO: 2384399 - RNA, 13 nt, Human
gaauaaguuauug

SEQ ID NO: 2384400 - RNA, 14 nt, Human
gaauaaguuauugc

SEQ ID NO: 2384401 - RNA, 16 nt, Human
gaauaaguuauugcag

SEQ ID NO: 2384402 - RNA, 14 nt, Human
gaauaaugaaugga

SEQ ID NO: 2384403 - RNA, 22 nt, Human
gaauaaucuuuggguaacuuca

SEQ ID NO: 2384404 - RNA, 13 nt, Human
gaauaaugggcuu

SEQ ID NO: 2384405 - RNA, 20 nt, Human
gaauaaugguaccagauaaa

SEQ ID NO: 2384406 - RNA, 21 nt, Human
gaauaaugguaccagauaaaa

SEQ ID NO: 2384407 - RNA, 20 nt, Human
gaauaauuauuuauuuaaua

SEQ ID NO: 2384408 - RNA, 13 nt, Human
gaauaauuauuua

SEQ ID NO: 2384409 - RNA, 18 nt, Human
gaauaauuauuuauuuaa

SEQ ID NO: 2384410 - RNA, 14 nt, Human
gaauaauguaaaau

SEQ ID NO: 2384411 - RNA, 22 nt, Human
gaauaauguaaaauguugaaua

SEQ ID NO: 2384412 - RNA, 14 nt, Human
gaauacuuuauaaa

SEQ ID NO: 2384413 - RNA, 23 nt, Human
gaauagaaauaaaggaugugauu

SEQ ID NO: 2384414 - RNA, 20 nt, Human
gaauacuuuuuacaauuaaa

SEQ ID NO: 2384415 - RNA, 14 nt, Human
gaauacuuuuuaca

SEQ ID NO: 2384416 - RNA, 19 nt, Human
gaauacuuuugcccuuuga

SEQ ID NO: 2384417 - RNA, 20 nt, Human
gaauacuguuaaaggaaaaa

SEQ ID NO: 2384418 - RNA, 18 nt, Human
gaauacuguuaaaggaaa

SEQ ID NO: 2384419 - RNA, 12 nt, Human
gaaacagaggcu

SEQ ID NO: 2384420 - RNA, 19 nt, Human
gaaacagagacaggcccaa

SEQ ID NO: 2384421 - RNA, 19 nt, Human
gaaacagaggagaguccca

SEQ ID NO: 2384422 - RNA, 17 nt, Human
gaaacagagacaggccc

SEQ ID NO: 2384423 - RNA, 16 nt, Human
gaaacagagacaggcc

SEQ ID NO: 2384424 - RNA, 14 nt, Human
gaaacagagacagg

SEQ ID NO: 2384425 - RNA, 22 nt, Human
gaaacagaaacaaaaacacuaa

SEQ ID NO: 2384426 - RNA, 14 nt, Human
gaaacagaaacaaa

SEQ ID NO: 2384427 - RNA, 15 nt, Human
gaaacacuggggcug

SEQ ID NO: 2384428 - RNA, 16 nt, Human
gaaacacuuugcauaa

SEQ ID NO: 2384429 - RNA, 20 nt, Human
gaaacagaggagagucccag

SEQ ID NO: 2384430 - RNA, 20 nt, Human
gaaacagaucuccuggcaaa

SEQ ID NO: 2384431 - RNA, 18 nt, Human
gaaacagcuaaugggaca

SEQ ID NO: 2384432 - RNA, 20 nt, Human
gaaacagcucgacuuuaaaa

SEQ ID NO: 2384433 - RNA, 15 nt, Human
gaaacagcucgacuu

SEQ ID NO: 2384434 - RNA, 22 nt, Human
gaaacacugggcuucuagaacc

SEQ ID NO: 2384435 - RNA, 18 nt, Human
gaaacacuggggcuggca

SEQ ID NO: 2384436 - RNA, 14 nt, Human
gaaacaccuucucu

SEQ ID NO: 2384437 - RNA, 22 nt, Human
gaaacacccucacacugggacu

SEQ ID NO: 2384438 - RNA, 19 nt, Human
gaaacacccucacacuggg

SEQ ID NO: 2384439 - RNA, 18 nt, Human
gaaacacccucacacugg

SEQ ID NO: 2384440 - RNA, 21 nt, Human
gaaacaccuucucuggagcca

SEQ ID NO: 2384441 - RNA, 20 nt, Human
gaaaaucuuauaauuuaaaa

SEQ ID NO: 2384442 - RNA, 19 nt, Human
gaaaaucaaauacauacuu

SEQ ID NO: 2384443 - RNA, 14 nt, Human
gaaaaucaaauaca

SEQ ID NO: 2384444 - RNA, 15 nt, Human
gaaaaucaaauacau

SEQ ID NO: 2384445 - RNA, 14 nt, Human
gaaacacagaaacc

SEQ ID NO: 2384446 - RNA, 15 nt, Human
gaaaauaugcaucua

SEQ ID NO: 2384447 - RNA, 12 nt, Human
gaaaauaugcau

SEQ ID NO: 2384448 - RNA, 23 nt, Human
gaaaauauacuguaaagaaagag

SEQ ID NO: 2384449 - RNA, 21 nt, Human
gaaaauauacuguaaagaaag

SEQ ID NO: 2384450 - RNA, 12 nt, Human
gaaaauaucacu

SEQ ID NO: 2384451 - RNA, 14 nt, Human
gaaaaucagccugc

SEQ ID NO: 2384452 - RNA, 17 nt, Human
gaaaauauuauguguuu

SEQ ID NO: 2384453 - RNA, 18 nt, Human
gaaaaucagccugcucca

SEQ ID NO: 2384454 - RNA, 16 nt, Human
gaaaaucagccugcuc

SEQ ID NO: 2384455 - RNA, 19 nt, Human
gaaaaucuuauaauuuaaa

SEQ ID NO: 2384456 - RNA, 13 nt, Human
gaaaagcugcuga

SEQ ID NO: 2384457 - RNA, 17 nt, Human
gaaaagcugcugacagu

SEQ ID NO: 2384458 - RNA, 19 nt, Human
gaaaauaacgauaaaagac

SEQ ID NO: 2384459 - RNA, 13 nt, Human
gaaaauaauuguu

SEQ ID NO: 2384460 - RNA, 17 nt, Human
gaaaauaauuguuccaa

SEQ ID NO: 2384461 - RNA, 18 nt, Human
gaaaauauacuguaaaga

SEQ ID NO: 2384462 - RNA, 20 nt, Human
gaaaauauacuguaaagaaa

SEQ ID NO: 2384463 - RNA, 19 nt, Human
gaaaauauacuguaaagaa

SEQ ID NO: 2384464 - RNA, 18 nt, Human
gaaaauaaucauucuuau

SEQ ID NO: 2384465 - RNA, 18 nt, Human
gaaaauaagaauagaaau

SEQ ID NO: 2384466 - RNA, 14 nt, Human
gaaaagcugaaucc

SEQ ID NO: 2384467 - RNA, 20 nt, Human
gaaaagcuauuagccaggau

SEQ ID NO: 2384468 - RNA, 22 nt, Human
gaaaagcuauuagccaggauca

SEQ ID NO: 2384469 - RNA, 11 nt, Human
gaaaagcuauu

SEQ ID NO: 2384470 - RNA, 14 nt, Human
gaaaagcuauuagc

SEQ ID NO: 2384471 - RNA, 17 nt, Human
gaaaagcuauuagccag

SEQ ID NO: 2384472 - RNA, 19 nt, Human
gaaaagcuauuagccagga

SEQ ID NO: 2384473 - RNA, 22 nt, Human
cuuuuuucauggacacuuugaa

SEQ ID NO: 2384474 - RNA, 15 nt, Human
cuuuuuucacuacau

SEQ ID NO: 2384475 - RNA, 14 nt, Human
cuuuuuucuaaagu

SEQ ID NO: 2384476 - RNA, 18 nt, Human
cuuuuuuccuuaauccag

SEQ ID NO: 2384477 - RNA, 18 nt, Human
cuuuugacuuaaagcaga

SEQ ID NO: 2384478 - RNA, 14 nt, Human
cuuuugacaugugg

SEQ ID NO: 2384479 - RNA, 10 nt, Human
cuuuugaccu

SEQ ID NO: 2384480 - RNA, 13 nt, Human
cuuuugacaugug

SEQ ID NO: 2384481 - RNA, 22 nt, Human
cuuuucuuuagagcauugccau

SEQ ID NO: 2384482 - RNA, 16 nt, Human
cuuuugagcauuuaga

SEQ ID NO: 2384483 - RNA, 21 nt, Human
cuuuugagugccuuacacaau

SEQ ID NO: 2384484 - RNA, 20 nt, Human
cuuuuuugaaauaauaaauc

SEQ ID NO: 2384485 - RNA, 13 nt, Human
cuuuuuuccuccu

SEQ ID NO: 2384486 - RNA, 16 nt, Human
cuuuuuucuuuaagau

SEQ ID NO: 2384487 - RNA, 17 nt, Human
cuuuuuugauaaaguuu

SEQ ID NO: 2384488 - RNA, 18 nt, Human
cuuuuuugauaaaguuuc

SEQ ID NO: 2384489 - RNA, 19 nt, Human
cuuuuuugauaaaguuucu

SEQ ID NO: 2384490 - RNA, 16 nt, Human
cuuuuuucuuauuuaa

SEQ ID NO: 2384491 - RNA, 14 nt, Human
cuuuuuuggcugcu

SEQ ID NO: 2384492 - RNA, 15 nt, Human
cuuuuuuggcugcug

SEQ ID NO: 2384493 - RNA, 18 nt, Human
gaaaaagucauccaaucu

SEQ ID NO: 2384494 - RNA, 21 nt, Human
cuuuuuugauaaaguuucuca

SEQ ID NO: 2384495 - RNA, 19 nt, Human
gaaaaaguuaaacauugaa

SEQ ID NO: 2384496 - RNA, 19 nt, Human
gaaaaagucauccaaucua

SEQ ID NO: 2384497 - RNA, 21 nt, Human
gaaaaagucauccaaucuaac

SEQ ID NO: 2384498 - RNA, 12 nt, Human
gaaaaagugaug

SEQ ID NO: 2384499 - RNA, 23 nt, Human
gaaaaagugauggagcagagcaa

SEQ ID NO: 2384500 - RNA, 17 nt, Human
gaaaaaggaugcacaga

SEQ ID NO: 2384501 - RNA, 23 nt, Human
gaaaaaggaugcacagaguuguu

SEQ ID NO: 2384502 - RNA, 12 nt, Human
gaaaacccagag

SEQ ID NO: 2384503 - RNA, 11 nt, Human
gaaaacccacc

SEQ ID NO: 2384504 - RNA, 18 nt, Human
gaaaacguggcugcuuca

SEQ ID NO: 2384505 - RNA, 15 nt, Human
gaaaacguggcugcu

SEQ ID NO: 2384506 - RNA, 16 nt, Human
gaaaacguggcugcuu

SEQ ID NO: 2384507 - RNA, 13 nt, Human
gaaaacccagaga

SEQ ID NO: 2384508 - RNA, 16 nt, Human
gaaaaccaucacauga

SEQ ID NO: 2384509 - RNA, 21 nt, Human
gaaaaccaagccguggcuucc

SEQ ID NO: 2384510 - RNA, 12 nt, Human
gaaaacauuguu

SEQ ID NO: 2384511 - RNA, 18 nt, Human
gaaaaccaagccguggcu

SEQ ID NO: 2384512 - RNA, 19 nt, Human
gaaaaccaagccguggcuu

SEQ ID NO: 2384513 - RNA, 12 nt, Human
gaaaacaucugg

SEQ ID NO: 2384514 - RNA, 20 nt, Human
gaaaacauucugauuuggaa

SEQ ID NO: 2384515 - RNA, 11 nt, Human
gaaaacauugu

SEQ ID NO: 2384516 - RNA, 18 nt, Human
gaaaacauuguuccagau

SEQ ID NO: 2384517 - RNA, 19 nt, Human
gaaaaauaacuucaagcaa

SEQ ID NO: 2384518 - RNA, 15 nt, Human
gaaaacaagugcugg

SEQ ID NO: 2384519 - RNA, 13 nt, Human
gaaaacacauuuu

SEQ ID NO: 2384520 - RNA, 22 nt, Human
gaaaacaauaacgauaaaagac

SEQ ID NO: 2384521 - RNA, 19 nt, Human
gaaaacaucacugaaaugc

SEQ ID NO: 2384522 - RNA, 12 nt, Human
gaaaacaugcua

SEQ ID NO: 2384523 - RNA, 15 nt, Human
gaaaacaugcuacac

SEQ ID NO: 2384524 - RNA, 14 nt, Human
gaaaacaugcuaca

SEQ ID NO: 2384525 - RNA, 13 nt, Human
cuuuucucuuucu

SEQ ID NO: 2384526 - RNA, 14 nt, Human
cuuuucucuuucuc

SEQ ID NO: 2384527 - RNA, 15 nt, Human
cuuuucuccaugagu

SEQ ID NO: 2384528 - RNA, 21 nt, Human
cuuuucuccaauaucagugcu

SEQ ID NO: 2384529 - RNA, 17 nt, Human
cuuuucucugguaauau

SEQ ID NO: 2384530 - RNA, 13 nt, Human
cuuuucucagcug

SEQ ID NO: 2384531 - RNA, 17 nt, Human
cuuuucuccaauaucag

SEQ ID NO: 2384532 - RNA, 21 nt, Human
cuuuucuagcccgaauacaaa

SEQ ID NO: 2384533 - RNA, 13 nt, Human
cuuuucuauuuuc

SEQ ID NO: 2384534 - RNA, 14 nt, Human
cuuuucuauuuucc

SEQ ID NO: 2384535 - RNA, 20 nt, Human
cuuuucuauuuucccucgcu

SEQ ID NO: 2384536 - RNA, 20 nt, Human
cuuuucccugcuuccaggaa

SEQ ID NO: 2384537 - RNA, 18 nt, Human
cuuuucccugcuuccagg

SEQ ID NO: 2384538 - RNA, 17 nt, Human
cuuuucuacccuagcca

SEQ ID NO: 2384539 - RNA, 18 nt, Human
cuuuucuacccuagccau

SEQ ID NO: 2384540 - RNA, 22 nt, Human
cuuuucuacccuagccauuccu

SEQ ID NO: 2384541 - RNA, 18 nt, Human
cuuuucuaggcuacaauu

SEQ ID NO: 2384542 - RNA, 16 nt, Human
cuuuucuacccuagcc

SEQ ID NO: 2384543 - RNA, 13 nt, Human
cuuuucccugcuu

SEQ ID NO: 2384544 - RNA, 14 nt, Human
cuuuucccugcuuc

SEQ ID NO: 2384545 - RNA, 15 nt, Human
cuuuucccugcuucc

SEQ ID NO: 2384546 - RNA, 14 nt, Human
cuuuuccccugucc

SEQ ID NO: 2384547 - RNA, 20 nt, Human
cuuuucccucuuuggcuccc

SEQ ID NO: 2384548 - RNA, 22 nt, Human
cuuuucccucuuuggcuccccu

SEQ ID NO: 2384549 - RNA, 18 nt, Human
cuuuucccacuguuuaag

SEQ ID NO: 2384550 - RNA, 14 nt, Human
cuuuuccccggucc

SEQ ID NO: 2384551 - RNA, 23 nt, Human
cuuuucuguccgagcuuugaaaa

SEQ ID NO: 2384552 - RNA, 18 nt, Human
cuuuucuguccgagcuuu

SEQ ID NO: 2384553 - RNA, 18 nt, Human
cuuuucuggaauguaauc

SEQ ID NO: 2384554 - RNA, 19 nt, Human
cuuuucugcccuggcugcu

SEQ ID NO: 2384555 - RNA, 19 nt, Human
cuuuucuggaauguaauca

SEQ ID NO: 2384556 - RNA, 16 nt, Human
cuuuucuuucagccaa

SEQ ID NO: 2384557 - RNA, 13 nt, Human
cuuuucuguauuu

SEQ ID NO: 2384558 - RNA, 18 nt, Human
cuuuucuugcaugaggcu

SEQ ID NO: 2384559 - RNA, 23 nt, Human
cuuuucuugcaugaggcuagugu

SEQ ID NO: 2384560 - RNA, 13 nt, Human
cuuuucaucuggg

SEQ ID NO: 2384561 - RNA, 16 nt, Human
cuuuucaucugggaaa

SEQ ID NO: 2384562 - RNA, 17 nt, Human
cuuuucaucugggaaag

SEQ ID NO: 2384563 - RNA, 22 nt, Human
cuuuucauaaccuagccuuaga

SEQ ID NO: 2384564 - RNA, 19 nt, Human
cuuuucagcuucugcuggg

SEQ ID NO: 2384565 - RNA, 23 nt, Human
cuuuucagcuucugcugggcugg

SEQ ID NO: 2384566 - RNA, 23 nt, Human
cuuuuacucaugaucuugugaca

SEQ ID NO: 2384567 - RNA, 17 nt, Human
cuuuucacugcuggcug

SEQ ID NO: 2384568 - RNA, 18 nt, Human
cuuuucacugcuggcugc

SEQ ID NO: 2384569 - RNA, 20 nt, Human
cuuuucacugcuggcugccu

SEQ ID NO: 2384570 - RNA, 20 nt, Human
cuuuucauaaccuagccuua

SEQ ID NO: 2384571 - RNA, 23 nt, Human
cuuuucagcgauguaugcagcua

SEQ ID NO: 2384572 - RNA, 21 nt, Human
cuuuucagaagugagcuuugc

SEQ ID NO: 2384573 - RNA, 19 nt, Human
cuuuucagaagugagcuuu

SEQ ID NO: 2384574 - RNA, 14 nt, Human
cuuuucagcuucug

SEQ ID NO: 2384575 - RNA, 16 nt, Human
cuuuucagcuucugcu

SEQ ID NO: 2384576 - RNA, 17 nt, Human
cuuuucagcuucugcug

SEQ ID NO: 2384577 - RNA, 18 nt, Human
cuuuucagcuucugcugg

SEQ ID NO: 2384578 - RNA, 17 nt, Human
cuuuguuucaaccaagu

SEQ ID NO: 2384579 - RNA, 17 nt, Human
cuuuguuucguggggag

SEQ ID NO: 2384580 - RNA, 18 nt, Human
cuuuguuucguggggagg

SEQ ID NO: 2384581 - RNA, 20 nt, Human
cuuuguuuguugucagcuga

SEQ ID NO: 2384582 - RNA, 18 nt, Human
cuuuguuuguugucagcu

SEQ ID NO: 2384583 - RNA, 17 nt, Human
cuuuuacauacugcugu

SEQ ID NO: 2384584 - RNA, 14 nt, Human
cuuuuacauacugc

SEQ ID NO: 2384585 - RNA, 16 nt, Human
cuuuuaccaugccccu

SEQ ID NO: 2384586 - RNA, 14 nt, Human
cuuuuaccaugccc

SEQ ID NO: 2384587 - RNA, 13 nt, Human
cuuuuacauacug

SEQ ID NO: 2384588 - RNA, 14 nt, Human
cuuuuaauuuuccu

SEQ ID NO: 2384589 - RNA, 20 nt, Human
cuuuuacguccaucucuugu

SEQ ID NO: 2384590 - RNA, 15 nt, Human
cuuugggaaaggaga

SEQ ID NO: 2384591 - RNA, 22 nt, Human
cuuugggaaaggagaaguuaag

SEQ ID NO: 2384592 - RNA, 13 nt, Human
cuuugggaagggg

SEQ ID NO: 2384593 - RNA, 17 nt, Human
cuuugggaauauuugaa

SEQ ID NO: 2384594 - RNA, 18 nt, Human
cuuugggaauauuugaau

SEQ ID NO: 2384595 - RNA, 19 nt, Human
cuuugggaauauuugaauc

SEQ ID NO: 2384596 - RNA, 20 nt, Human
cuuugggaauauuugaaucu

SEQ ID NO: 2384597 - RNA, 13 nt, Human
cuuugggaggcca

SEQ ID NO: 2384598 - RNA, 18 nt, Human
cuuuguccccaccgcaga

SEQ ID NO: 2384599 - RNA, 17 nt, Human
cuuuguccuuuuuguua

SEQ ID NO: 2384600 - RNA, 14 nt, Human
cuuugugauuuuug

SEQ ID NO: 2384601 - RNA, 15 nt, Human
cuuugucccggggcu

SEQ ID NO: 2384602 - RNA, 23 nt, Human
cuuugggaauauuugaaucuugu

SEQ ID NO: 2384603 - RNA, 13 nt, Human
cuuugggaauguu

SEQ ID NO: 2384604 - RNA, 22 nt, Human
cuuugggagaaaacgucuugcu

SEQ ID NO: 2384605 - RNA, 22 nt, Human
cuuuguccccaccgcagacagg

SEQ ID NO: 2384606 - RNA, 18 nt, Human
cuuuguucuaaagaugga

SEQ ID NO: 2384607 - RNA, 14 nt, Human
cuuuguucucagcu

SEQ ID NO: 2384608 - RNA, 17 nt, Human
cuuuguucucagcuccc

SEQ ID NO: 2384609 - RNA, 20 nt, Human
cuuuguucucagcucccccu

SEQ ID NO: 2384610 - RNA, 23 nt, Human
cuuuguucucagcucccccuguc

SEQ ID NO: 2384611 - RNA, 18 nt, Human
cuuuguucauagcccagu

SEQ ID NO: 2384612 - RNA, 14 nt, Human
cuuuguucuggcuc

SEQ ID NO: 2384613 - RNA, 15 nt, Human
cuuuguucuggcucu

SEQ ID NO: 2384614 - RNA, 15 nt, Human
cuuugucuaaaacaa

SEQ ID NO: 2384615 - RNA, 19 nt, Human
cuuugucuaaaacaauaaa

SEQ ID NO: 2384616 - RNA, 19 nt, Human
cuuugugauuuuuguaauu

SEQ ID NO: 2384617 - RNA, 18 nt, Human
cuuugugauuuuuguaau

SEQ ID NO: 2384618 - RNA, 17 nt, Human
cuuugugauuuuuguaa

SEQ ID NO: 2384619 - RNA, 17 nt, Human
cuuuggaaggagugaga

SEQ ID NO: 2384620 - RNA, 22 nt, Human
cuuugcugugaggcuguccugu

SEQ ID NO: 2384621 - RNA, 11 nt, Human
cuuugcugcug

SEQ ID NO: 2384622 - RNA, 17 nt, Human
cuuugcugugaggcugu

SEQ ID NO: 2384623 - RNA, 21 nt, Human
cuuugcugugaggcuguccug

SEQ ID NO: 2384624 - RNA, 11 nt, Human
cuuugcugcca

SEQ ID NO: 2384625 - RNA, 18 nt, Human
cuuugcugagccuguaaa

SEQ ID NO: 2384626 - RNA, 19 nt, Human
cuuugcugcugaaggcuca

SEQ ID NO: 2384627 - RNA, 10 nt, Human
cuuugcugcu

SEQ ID NO: 2384628 - RNA, 11 nt, Human
cuuugcugcua

SEQ ID NO: 2384629 - RNA, 13 nt, Human
cuuugcugcuaca

SEQ ID NO: 2384630 - RNA, 16 nt, Human
cuuucccaucuuccaa

SEQ ID NO: 2384631 - RNA, 13 nt, Human
cuuugcuccuccc

SEQ ID NO: 2384632 - RNA, 16 nt, Human
cuuucccauggggagg

SEQ ID NO: 2384633 - RNA, 14 nt, Human
cuuugcucuuucuu

SEQ ID NO: 2384634 - RNA, 13 nt, Human
cuuugcucugggu

SEQ ID NO: 2384635 - RNA, 17 nt, Human
cuuugcucuucaagaaa

SEQ ID NO: 2384636 - RNA, 16 nt, Human
cuuuggcugcaugcga

SEQ ID NO: 2384637 - RNA, 20 nt, Human
cuuuggaccuaaauggccuc

SEQ ID NO: 2384638 - RNA, 19 nt, Human
cuuuggacccugaggccca

SEQ ID NO: 2384639 - RNA, 17 nt, Human
cuuuggacccugaggcc

SEQ ID NO: 2384640 - RNA, 18 nt, Human
cuuuggacccugaggccc

SEQ ID NO: 2384641 - RNA, 15 nt, Human
cuuuggacccugagg

SEQ ID NO: 2384642 - RNA, 16 nt, Human
cuuuggacccugaggc

SEQ ID NO: 2384643 - RNA, 21 nt, Human
cuuuggacagaagcagcucuu

SEQ ID NO: 2384644 - RNA, 20 nt, Human
cuuuggacagaagcagcucu

SEQ ID NO: 2384645 - RNA, 19 nt, Human
cuuuggacagaagcagcuc

SEQ ID NO: 2384646 - RNA, 18 nt, Human
cuuuggacagaagcagcu

SEQ ID NO: 2384647 - RNA, 13 nt, Human
cuuggaagcuccg

SEQ ID NO: 2384648 - RNA, 13 nt, Human
cuuggaggaagga

SEQ ID NO: 2384649 - RNA, 19 nt, Human
cuuggaagagccugcaggu

SEQ ID NO: 2384650 - RNA, 13 nt, Human
cuuggagcugagc

SEQ ID NO: 2384651 - RNA, 15 nt, Human
cuuggaagagccugc

SEQ ID NO: 2384652 - RNA, 21 nt, Human
cuuggaaacuggaugagguca

SEQ ID NO: 2384653 - RNA, 20 nt, Human
cuuggaaagcaucaccucag

SEQ ID NO: 2384654 - RNA, 22 nt, Human
cuuggaaagcaucaccucaggc

SEQ ID NO: 2384655 - RNA, 21 nt, Human
cuuggaaagcaucaccucagg

SEQ ID NO: 2384656 - RNA, 15 nt, Human
cuuggaaaccugccc

SEQ ID NO: 2384657 - RNA, 16 nt, Human
cuuggaaaccugcccu

SEQ ID NO: 2384658 - RNA, 17 nt, Human
cuuggaaaccugcccug

SEQ ID NO: 2384659 - RNA, 18 nt, Human
cuuggaaaccugcccugc

SEQ ID NO: 2384660 - RNA, 20 nt, Human
cuuggaaaccugcccugccu

SEQ ID NO: 2384661 - RNA, 21 nt, Human
cuuggaaaccugcccugccug

SEQ ID NO: 2384662 - RNA, 22 nt, Human
cuuggaaaccugcccugccuga

SEQ ID NO: 2384663 - RNA, 23 nt, Human
cuuggaaaccugcccugccugag

SEQ ID NO: 2384664 - RNA, 15 nt, Human
cuuggaaaggaccag

SEQ ID NO: 2384665 - RNA, 23 nt, Human
cuuggaaagcaucaccucaggcc

SEQ ID NO: 2384666 - RNA, 21 nt, Human
cuuggaaagaaacaaccguug

SEQ ID NO: 2384667 - RNA, 16 nt, Human
cuuggaaaugggagac

SEQ ID NO: 2384668 - RNA, 14 nt, Human
cuuggaaaccugcc

SEQ ID NO: 2384669 - RNA, 22 nt, Human
cuuggaaaaauccagaaagaaa

SEQ ID NO: 2384670 - RNA, 20 nt, Human
cuuggaaaaauccagaaaga

SEQ ID NO: 2384671 - RNA, 16 nt, Human
cuuggaaaaagugaug

SEQ ID NO: 2384672 - RNA, 15 nt, Human
cuugcuuauuugaca

SEQ ID NO: 2384673 - RNA, 17 nt, Human
cuugcuuuucuguauuu

SEQ ID NO: 2384674 - RNA, 14 nt, Human
cuuggaaaaaguga

SEQ ID NO: 2384675 - RNA, 20 nt, Human
cuugcuucaaccccaugaga

SEQ ID NO: 2384676 - RNA, 18 nt, Human
cuugcuguuuuguucugu

SEQ ID NO: 2384677 - RNA, 16 nt, Human
cuugcucugcugacag

SEQ ID NO: 2384678 - RNA, 17 nt, Human
cuugcucugcugacaga

SEQ ID NO: 2384679 - RNA, 16 nt, Human
cuugcuguccuaggcc

SEQ ID NO: 2384680 - RNA, 19 nt, Human
cuugcccugaccucccagc

SEQ ID NO: 2384681 - RNA, 14 nt, Human
cuugcccugaccuc

SEQ ID NO: 2384682 - RNA, 15 nt, Human
cuugcccugaccucc

SEQ ID NO: 2384683 - RNA, 17 nt, Human
cuugcccugaccuccca

SEQ ID NO: 2384684 - RNA, 18 nt, Human
cuugcccugaccucccag

SEQ ID NO: 2384685 - RNA, 20 nt, Human
cuugcuguccuaggccacac

SEQ ID NO: 2384686 - RNA, 17 nt, Human
cuugcuguccuaggcca

SEQ ID NO: 2384687 - RNA, 12 nt, Human
cuugcccugacc

SEQ ID NO: 2384688 - RNA, 13 nt, Human
cuugcccugaccu

SEQ ID NO: 2384689 - RNA, 20 nt, Human
cuugcccggauucugggagg

SEQ ID NO: 2384690 - RNA, 18 nt, Human
cuugcccggauucuggga

SEQ ID NO: 2384691 - RNA, 18 nt, Human
cuugccccggccccggcc

SEQ ID NO: 2384692 - RNA, 21 nt, Human
cuugccccggccccggcccca

SEQ ID NO: 2384693 - RNA, 17 nt, Human
cuugcccggauucuggg

SEQ ID NO: 2384694 - RNA, 13 nt, Human
cuugcucugcuga

SEQ ID NO: 2384695 - RNA, 14 nt, Human
cuugcucugcugac

SEQ ID NO: 2384696 - RNA, 22 nt, Human
cuugcccagagaugccuccacc

SEQ ID NO: 2384697 - RNA, 23 nt, Human
cuugcccagagaugccuccaccg

SEQ ID NO: 2384698 - RNA, 16 nt, Human
cuugccccccacccca

SEQ ID NO: 2384699 - RNA, 15 nt, Human
cuugccccccacccc

SEQ ID NO: 2384700 - RNA, 14 nt, Human
cuugccccccaccc

SEQ ID NO: 2384701 - RNA, 13 nt, Human
cuugccccccacc

SEQ ID NO: 2384702 - RNA, 19 nt, Human
cuugccccccaccccagcc

SEQ ID NO: 2384703 - RNA, 21 nt, Human
cuugcccagagaugccuccac

SEQ ID NO: 2384704 - RNA, 19 nt, Human
cuugcccagagaugccucc

SEQ ID NO: 2384705 - RNA, 13 nt, Human
cuugcccagagau

SEQ ID NO: 2384706 - RNA, 22 nt, Human
cuugcccaccccacccccaccc

SEQ ID NO: 2384707 - RNA, 14 nt, Human
cuugcccacaccga

SEQ ID NO: 2384708 - RNA, 14 nt, Human
cuugcccaccccac

SEQ ID NO: 2384709 - RNA, 15 nt, Human
cuugcccaccccacc

SEQ ID NO: 2384710 - RNA, 17 nt, Human
cuucuccacccugcucu

SEQ ID NO: 2384711 - RNA, 18 nt, Human
cuucuccacccugcucuc

SEQ ID NO: 2384712 - RNA, 21 nt, Human
cuucuccacccugcucuccga

SEQ ID NO: 2384713 - RNA, 13 nt, Human
cuugccacugccu

SEQ ID NO: 2384714 - RNA, 18 nt, Human
cuucucauuucaccccuc

SEQ ID NO: 2384715 - RNA, 16 nt, Human
cuugccagacaugugg

SEQ ID NO: 2384716 - RNA, 12 nt, Human
cuugccagagau

SEQ ID NO: 2384717 - RNA, 11 nt, Human
cuugccagaga

SEQ ID NO: 2384718 - RNA, 14 nt, Human
cuugccacugccuc

SEQ ID NO: 2384719 - RNA, 15 nt, Human
cuugccacugccucu

SEQ ID NO: 2384720 - RNA, 23 nt, Human
cuugccagagauccaaaagaagc

SEQ ID NO: 2384721 - RNA, 16 nt, Human
cuugccagagauccaa

SEQ ID NO: 2384722 - RNA, 20 nt, Human
cuuggcuuuuacugaagccu

SEQ ID NO: 2384723 - RNA, 22 nt, Human
cuuggcuuucauuauuaguacu

SEQ ID NO: 2384724 - RNA, 11 nt, Human
cuugggaaaua

SEQ ID NO: 2384725 - RNA, 12 nt, Human
cuugggaaauau

SEQ ID NO: 2384726 - RNA, 19 nt, Human
cuugggaaauaugaaugcc

SEQ ID NO: 2384727 - RNA, 13 nt, Human
cuuggcuggugca

SEQ ID NO: 2384728 - RNA, 15 nt, Human
cuuggcuuucauguu

SEQ ID NO: 2384729 - RNA, 14 nt, Human
cuuggcugcaggga

SEQ ID NO: 2384730 - RNA, 22 nt, Human
cuuggaguauuggggucugacc

SEQ ID NO: 2384731 - RNA, 14 nt, Human
cuuggcugcuuggc

SEQ ID NO: 2384732 - RNA, 17 nt, Human
cuuggcugcuuggccuu

SEQ ID NO: 2384733 - RNA, 17 nt, Human
cuuggcugcagggaguc

SEQ ID NO: 2384734 - RNA, 14 nt, Human
cuugggaggaagca

SEQ ID NO: 2384735 - RNA, 15 nt, Human
cuugggaggaagcag

SEQ ID NO: 2384736 - RNA, 16 nt, Human
cuugggaggaagcaga

SEQ ID NO: 2384737 - RNA, 14 nt, Human
cuugggcagagcug

SEQ ID NO: 2384738 - RNA, 17 nt, Human
cuugggaggaagcagaa

SEQ ID NO: 2384739 - RNA, 18 nt, Human
cuugggaggaagcagaau

SEQ ID NO: 2384740 - RNA, 15 nt, Human
cuugggcagagcugg

SEQ ID NO: 2384741 - RNA, 18 nt, Human
cuugggcagagcuggcuc

SEQ ID NO: 2384742 - RNA, 19 nt, Human
cuugggcagagcuggcucu

SEQ ID NO: 2384743 - RNA, 20 nt, Human
cuugggcagagcuggcucug

SEQ ID NO: 2384744 - RNA, 15 nt, Human
cuugggacuggguuu

SEQ ID NO: 2384745 - RNA, 17 nt, Human
cuugggacuggguuugg

SEQ ID NO: 2384746 - RNA, 23 nt, Human
cuugggaccgccagauggggccu

SEQ ID NO: 2384747 - RNA, 18 nt, Human
cuugggaauggauccugg

SEQ ID NO: 2384748 - RNA, 10 nt, Human
cuugggaaug

SEQ ID NO: 2384749 - RNA, 22 nt, Human
cuugggaagcugaggcgggaga

SEQ ID NO: 2384750 - RNA, 24 nt, Human
cuuggaggguugguccucuugccu

SEQ ID NO: 2384751 - RNA, 18 nt, Human
cuuggaguauuggggucu

SEQ ID NO: 2384752 - RNA, 17 nt, Human
cuuggagguagcuuuga

SEQ ID NO: 2384753 - RNA, 16 nt, Human
cuuggcugcagggagu

SEQ ID NO: 2384754 - RNA, 15 nt, Human
cuuggagggucccaa

SEQ ID NO: 2384755 - RNA, 15 nt, Human
cuuggaggcugucuu

SEQ ID NO: 2384756 - RNA, 14 nt, Human
cuuggagggaccaa

SEQ ID NO: 2384757 - RNA, 17 nt, Human
cuuggagggucccaagc

SEQ ID NO: 2384758 - RNA, 18 nt, Human
cuuggagggucccaagcu

SEQ ID NO: 2384759 - RNA, 19 nt, Human
cuuggagggucccaagcug

SEQ ID NO: 2384760 - RNA, 21 nt, Human
cuuggagggucccaagcuggg

SEQ ID NO: 2384761 - RNA, 22 nt, Human
cuuggagggucccaagcugggc

SEQ ID NO: 2384762 - RNA, 23 nt, Human
cuuggagggucccaagcugggcc

SEQ ID NO: 2384763 - RNA, 18 nt, Human
cuuggaggguugguccuc

SEQ ID NO: 2384764 - RNA, 19 nt, Human
cuuggaggguugguccucu

SEQ ID NO: 2384765 - RNA, 15 nt, Human
cuuggaggccagcca

SEQ ID NO: 2384766 - RNA, 21 nt, Human
cuuggagcugagccucucacc

SEQ ID NO: 2384767 - RNA, 18 nt, Human
cuuggagcugagccucuc

SEQ ID NO: 2384768 - RNA, 15 nt, Human
cuuggagcugagccu

SEQ ID NO: 2384769 - RNA, 22 nt, Human
cuuggaggaaggaaacccagcu

SEQ ID NO: 2384770 - RNA, 23 nt, Human
cuuggagggcaugaagacagaua

SEQ ID NO: 2384771 - RNA, 12 nt, Human
cuuggagggcau

SEQ ID NO: 2384772 - RNA, 18 nt, Human
cuuggggaacaagggugg

SEQ ID NO: 2384773 - RNA, 16 nt, Human
cuuggggaauuuccuc

SEQ ID NO: 2384774 - RNA, 23 nt, Human
cuugggcuuccauuugugugugu

SEQ ID NO: 2384775 - RNA, 19 nt, Human
cuugggcuuccauuugugu

SEQ ID NO: 2384776 - RNA, 20 nt, Human
cuuggggacaggggcaggag

SEQ ID NO: 2384777 - RNA, 22 nt, Human
cuugggcuucauccuccucaga

SEQ ID NO: 2384778 - RNA, 20 nt, Human
cuuggggaccagagcugcca

SEQ ID NO: 2384779 - RNA, 21 nt, Human
cuuggggaccagagcugccac

SEQ ID NO: 2384780 - RNA, 14 nt, Human
cuugggccacugug

SEQ ID NO: 2384781 - RNA, 19 nt, Human
cuugggaggaagcagaaua

SEQ ID NO: 2384782 - RNA, 22 nt, Human
cuugggcagagcuggcucugag

SEQ ID NO: 2384783 - RNA, 23 nt, Human
cuugggcagagcuggcucugagc

SEQ ID NO: 2384784 - RNA, 13 nt, Human
cuugggcuucauc

SEQ ID NO: 2384785 - RNA, 15 nt, Human
cuuggggggcugagg

SEQ ID NO: 2384786 - RNA, 18 nt, Human
cuugggggacagggcugg

SEQ ID NO: 2384787 - RNA, 21 nt, Human
cuugggggacagggcuggccc

SEQ ID NO: 2384788 - RNA, 22 nt, Human
cuugggggacagggcuggccca

SEQ ID NO: 2384789 - RNA, 20 nt, Human
cuuggggaguuaagaccugg

SEQ ID NO: 2384790 - RNA, 19 nt, Human
cuuggggaguuaagaccug

SEQ ID NO: 2384791 - RNA, 15 nt, Human
cuuggggacaucucu

SEQ ID NO: 2384792 - RNA, 17 nt, Human
cuuggggaauuuccucu

SEQ ID NO: 2384793 - RNA, 18 nt, Human
cuuggggaauuuccucua

SEQ ID NO: 2384794 - RNA, 22 nt, Human
cuuggggaccagagcugccacc

SEQ ID NO: 2384795 - RNA, 22 nt, Human
cuuggggggcugaggugggagg

SEQ ID NO: 2384796 - RNA, 16 nt, Human
cuuggggggcugaggu

SEQ ID NO: 2384797 - RNA, 19 nt, Human
cuuguaaaggaauuuaaaa

SEQ ID NO: 2384798 - RNA, 14 nt, Human
cuuuacuuuuaaac

SEQ ID NO: 2384799 - RNA, 14 nt, Human
cuuuagucugcaaa

SEQ ID NO: 2384800 - RNA, 15 nt, Human
cuuuagucugcaaaa

SEQ ID NO: 2384801 - RNA, 20 nt, Human
cuuuagugaacguggacucc

SEQ ID NO: 2384802 - RNA, 20 nt, Human
cuuuagugaucacagcagcu

SEQ ID NO: 2384803 - RNA, 14 nt, Human
cuuuaguggcuuca

SEQ ID NO: 2384804 - RNA, 17 nt, Human
cuuuagugguggccauu

SEQ ID NO: 2384805 - RNA, 15 nt, Human
cuuuacuguuuguua

SEQ ID NO: 2384806 - RNA, 14 nt, Human
cuuuacuguuuguu

SEQ ID NO: 2384807 - RNA, 20 nt, Human
cuuuaaagggauggcaagau

SEQ ID NO: 2384808 - RNA, 14 nt, Human
cuuuaaaggaaaaa

SEQ ID NO: 2384809 - RNA, 18 nt, Human
cuuuaaaggaaaaaaugu

SEQ ID NO: 2384810 - RNA, 19 nt, Human
cuuuaaaggaaaaaauguu

SEQ ID NO: 2384811 - RNA, 13 nt, Human
cuuuaaaggaaaa

SEQ ID NO: 2384812 - RNA, 21 nt, Human
cuuuaaaggaaaaaauguugg

SEQ ID NO: 2384813 - RNA, 18 nt, Human
cuuuaaagggauggcaag

SEQ ID NO: 2384814 - RNA, 18 nt, Human
cuuguuuucuugccaaug

SEQ ID NO: 2384815 - RNA, 17 nt, Human
cuuguuuucuugccaau

SEQ ID NO: 2384816 - RNA, 14 nt, Human
cuuguuuucuugcc

SEQ ID NO: 2384817 - RNA, 14 nt, Human
cuuguuuucuggga

SEQ ID NO: 2384818 - RNA, 18 nt, Human
cuuguuuuuccacuacug

SEQ ID NO: 2384819 - RNA, 12 nt, Human
cuuguuuuugca

SEQ ID NO: 2384820 - RNA, 16 nt, Human
cuuguuuuugcacaug

SEQ ID NO: 2384821 - RNA, 19 nt, Human
cuuguuuuuuuuuuccacu

SEQ ID NO: 2384822 - RNA, 20 nt, Human
cuuguuuuuuuuuuccacuu

SEQ ID NO: 2384823 - RNA, 21 nt, Human
cuuguuuuuuuuuuccacuua

SEQ ID NO: 2384824 - RNA, 13 nt, Human
cuuuaaacucagg

SEQ ID NO: 2384825 - RNA, 15 nt, Human
cuuuaaacucaggga

SEQ ID NO: 2384826 - RNA, 16 nt, Human
cuuuaaacucagggac

SEQ ID NO: 2384827 - RNA, 19 nt, Human
cuuuaaacucagggacaga

SEQ ID NO: 2384828 - RNA, 22 nt, Human
cuuuaaacucagggacagagcc

SEQ ID NO: 2384829 - RNA, 14 nt, Human
cuuguggccuggga

SEQ ID NO: 2384830 - RNA, 22 nt, Human
cuuguggauguuuuaauuccau

SEQ ID NO: 2384831 - RNA, 13 nt, Human
cuuguaaauacac

SEQ ID NO: 2384832 - RNA, 12 nt, Human
cuuguggagccc

SEQ ID NO: 2384833 - RNA, 13 nt, Human
cuuguggagcccc

SEQ ID NO: 2384834 - RNA, 14 nt, Human
cuuguggagcccca

SEQ ID NO: 2384835 - RNA, 16 nt, Human
cuuguggagccccaca

SEQ ID NO: 2384836 - RNA, 19 nt, Human
cuuguggagccccacacug

SEQ ID NO: 2384837 - RNA, 15 nt, Human
cuuguggauguuuua

SEQ ID NO: 2384838 - RNA, 16 nt, Human
cuuguggauguuuuaa

SEQ ID NO: 2384839 - RNA, 20 nt, Human
cuuguguguuuauugucaaa

SEQ ID NO: 2384840 - RNA, 15 nt, Human
cuuguaaauaaagcc

SEQ ID NO: 2384841 - RNA, 16 nt, Human
cuuguaaauaaagccc

SEQ ID NO: 2384842 - RNA, 17 nt, Human
cuuguaaauaaagcccu

SEQ ID NO: 2384843 - RNA, 19 nt, Human
cuuguaaauaaagcccugg

SEQ ID NO: 2384844 - RNA, 12 nt, Human
cuuguaaauaaa

SEQ ID NO: 2384845 - RNA, 24 nt, Human
cuugggggaugacuagaggcaggg

SEQ ID NO: 2384846 - RNA, 23 nt, Human
cuugggggacagggcuggcccag

SEQ ID NO: 2384847 - RNA, 16 nt, Human
cuuguggacuaaaaga

SEQ ID NO: 2384848 - RNA, 17 nt, Human
cuuguggacuaaaagau

SEQ ID NO: 2384849 - RNA, 18 nt, Human
cuuguggacuaaaagaua

SEQ ID NO: 2384850 - RNA, 19 nt, Human
cuuguggacuaaaagauau

SEQ ID NO: 2384851 - RNA, 12 nt, Human
cuuguaaauaca

SEQ ID NO: 2384852 - RNA, 15 nt, Human
cuuguaaauacacca

SEQ ID NO: 2384853 - RNA, 15 nt, Human
cuuguggacuaaaag

SEQ ID NO: 2384854 - RNA, 23 nt, Human
cuuguuggauuuuugucuugugu

SEQ ID NO: 2384855 - RNA, 18 nt, Human
cuuguugggauuccugac

SEQ ID NO: 2384856 - RNA, 20 nt, Human
cuuguugggauuccugaccc

SEQ ID NO: 2384857 - RNA, 21 nt, Human
cuuguugggauuccugaccca

SEQ ID NO: 2384858 - RNA, 22 nt, Human
cuuguugggauuccugacccag

SEQ ID NO: 2384859 - RNA, 13 nt, Human
cuuguuguuguua

SEQ ID NO: 2384860 - RNA, 14 nt, Human
cuuguuuucaguuu

SEQ ID NO: 2384861 - RNA, 19 nt, Human
cuuguuuacagcacuacuc

SEQ ID NO: 2384862 - RNA, 22 nt, Human
cuuguuuacagcacuacucugu

SEQ ID NO: 2384863 - RNA, 19 nt, Human
cuuguuguuuuacuaaaga

SEQ ID NO: 2384864 - RNA, 21 nt, Human
cuuguuguuuuacuaaagaaa

SEQ ID NO: 2384865 - RNA, 16 nt, Human
cuuguuguuuuacuaa

SEQ ID NO: 2384866 - RNA, 19 nt, Human
cuuguguguuucacuuuua

SEQ ID NO: 2384867 - RNA, 19 nt, Human
cuuguguguuuugagagua

SEQ ID NO: 2384868 - RNA, 21 nt, Human
cuuguuggauuuuugucuugu

SEQ ID NO: 2384869 - RNA, 18 nt, Human
cuuguuggagccugcagg

SEQ ID NO: 2384870 - RNA, 19 nt, Human
cuuguuggagccugcaggg

SEQ ID NO: 2384871 - RNA, 21 nt, Human
cuuguguguuuauugucaaag

SEQ ID NO: 2384872 - RNA, 19 nt, Human
cuuguguuaaguaugugua

SEQ ID NO: 2384873 - RNA, 13 nt, Human
cuuguguguuuca

SEQ ID NO: 2384874 - RNA, 17 nt, Human
cuuguguguuucacuuu

SEQ ID NO: 2384875 - RNA, 18 nt, Human
cuuguguguuucacuuuu

SEQ ID NO: 2384876 - RNA, 17 nt, Human
cuuucauaaucuuugcu

SEQ ID NO: 2384877 - RNA, 18 nt, Human
cuuucauaaucuuugcuu

SEQ ID NO: 2384878 - RNA, 15 nt, Human
cuuucagugaaagca

SEQ ID NO: 2384879 - RNA, 17 nt, Human
cuuucagugaaagcauc

SEQ ID NO: 2384880 - RNA, 17 nt, Human
cuuucauacugaagaug

SEQ ID NO: 2384881 - RNA, 18 nt, Human
cuuucauuucuugaggua

SEQ ID NO: 2384882 - RNA, 18 nt, Human
cuuucauuuacuguggcu

SEQ ID NO: 2384883 - RNA, 17 nt, Human
cuuucauccacuagugc

SEQ ID NO: 2384884 - RNA, 14 nt, Human
cuuucauauuuuag

SEQ ID NO: 2384885 - RNA, 18 nt, Human
cuuucaucaaucauugua

SEQ ID NO: 2384886 - RNA, 22 nt, Human
cuuucaucaaucauuguacagu

SEQ ID NO: 2384887 - RNA, 20 nt, Human
cuuucaucaaucauuguaca

SEQ ID NO: 2384888 - RNA, 21 nt, Human
cuuucaucaaucauuguacag

SEQ ID NO: 2384889 - RNA, 17 nt, Human
cuuucauuuucuguuug

SEQ ID NO: 2384890 - RNA, 14 nt, Human
cuuucauuuucugu

SEQ ID NO: 2384891 - RNA, 13 nt, Human
cuuucauuuucug

SEQ ID NO: 2384892 - RNA, 20 nt, Human
cuuucauuuuuuuccaggcu

SEQ ID NO: 2384893 - RNA, 22 nt, Human
cuuucauuuuuuuccaggcugg

SEQ ID NO: 2384894 - RNA, 15 nt, Human
cuuucauuuuuuucc

SEQ ID NO: 2384895 - RNA, 16 nt, Human
cuuucauuuuuuucca

SEQ ID NO: 2384896 - RNA, 19 nt, Human
cuuucauuuuuuuccaggc

SEQ ID NO: 2384897 - RNA, 21 nt, Human
cuuuccacccccucccuggcc

SEQ ID NO: 2384898 - RNA, 16 nt, Human
cuuuccacccccuccc

SEQ ID NO: 2384899 - RNA, 15 nt, Human
cuuuccacccccucc

SEQ ID NO: 2384900 - RNA, 14 nt, Human
cuuuccacccccuc

SEQ ID NO: 2384901 - RNA, 21 nt, Human
cuuuccacaccuggcacugcu

SEQ ID NO: 2384902 - RNA, 20 nt, Human
cuuuccacccccucccuggc

SEQ ID NO: 2384903 - RNA, 17 nt, Human
cuuuccacccccucccu

SEQ ID NO: 2384904 - RNA, 16 nt, Human
cuuucccaacucuagc

SEQ ID NO: 2384905 - RNA, 15 nt, Human
cuuuccaaggcuucu

SEQ ID NO: 2384906 - RNA, 15 nt, Human
cuuuccaccacagcc

SEQ ID NO: 2384907 - RNA, 17 nt, Human
cuuuccaccacagccag

SEQ ID NO: 2384908 - RNA, 21 nt, Human
cuuuccaccacagccagcacc

SEQ ID NO: 2384909 - RNA, 22 nt, Human
cuuuccaccacagccagcaccu

SEQ ID NO: 2384910 - RNA, 23 nt, Human
cuuuccaccacagccagcaccug

SEQ ID NO: 2384911 - RNA, 22 nt, Human
cuuuccaaaugcccagcuuaaa

SEQ ID NO: 2384912 - RNA, 13 nt, Human
cuuuccacagaag

SEQ ID NO: 2384913 - RNA, 19 nt, Human
cuuuccaaaugcccagcuu

SEQ ID NO: 2384914 - RNA, 18 nt, Human
cuuuccaaaugcccagcu

SEQ ID NO: 2384915 - RNA, 14 nt, Human
cuuuauugugaucu

SEQ ID NO: 2384916 - RNA, 23 nt, Human
cuuuauuguguuugucauuagcc

SEQ ID NO: 2384917 - RNA, 19 nt, Human
cuuuauuguguuugucauu

SEQ ID NO: 2384918 - RNA, 20 nt, Human
cuuuauuguguuugucauua

SEQ ID NO: 2384919 - RNA, 16 nt, Human
cuuuauuguguuuguc

SEQ ID NO: 2384920 - RNA, 18 nt, Human
cuuuauuguguuugucau

SEQ ID NO: 2384921 - RNA, 18 nt, Human
cuuuauuggcugagauau

SEQ ID NO: 2384922 - RNA, 13 nt, Human
cuuuauugagaaa

SEQ ID NO: 2384923 - RNA, 15 nt, Human
cuuuauugagaaaga

SEQ ID NO: 2384924 - RNA, 16 nt, Human
cuuuauugagaaagag

SEQ ID NO: 2384925 - RNA, 23 nt, Human
cuuuauuccagaaugcuguacau

SEQ ID NO: 2384926 - RNA, 16 nt, Human
cuuuauuggcugagau

SEQ ID NO: 2384927 - RNA, 12 nt, Human
cuuucagguacu

SEQ ID NO: 2384928 - RNA, 21 nt, Human
cuuucagggggguugugaggc

SEQ ID NO: 2384929 - RNA, 11 nt, Human
cuuuauuuucu

SEQ ID NO: 2384930 - RNA, 21 nt, Human
cuuuauuuucuauaauuuaaa

SEQ ID NO: 2384931 - RNA, 16 nt, Human
cuuuauucaaguaaaa

SEQ ID NO: 2384932 - RNA, 20 nt, Human
cuuuauuccagaaugcugua

SEQ ID NO: 2384933 - RNA, 20 nt, Human
cuuuauucuggcagaggagg

SEQ ID NO: 2384934 - RNA, 15 nt, Human
cuuuauuaaucacua

SEQ ID NO: 2384935 - RNA, 22 nt, Human
cuuuauuacccccuccuucaga

SEQ ID NO: 2384936 - RNA, 20 nt, Human
cuuuauuacccccuccuuca

SEQ ID NO: 2384937 - RNA, 14 nt, Human
cuuuauuacccccu

SEQ ID NO: 2384938 - RNA, 20 nt, Human
cuuuauuaaucacuauuguu

SEQ ID NO: 2384939 - RNA, 13 nt, Human
cuuuauuaaaauc

SEQ ID NO: 2384940 - RNA, 18 nt, Human
cuuuauuaaaaucuuaaa

SEQ ID NO: 2384941 - RNA, 21 nt, Human
cuuuauuaaauacaaaacuuc

SEQ ID NO: 2384942 - RNA, 22 nt, Human
cuuuauguugcggugagaacuc

SEQ ID NO: 2384943 - RNA, 20 nt, Human
cuuuauguuacuacaugcac

SEQ ID NO: 2384944 - RNA, 13 nt, Human
cuuuaguuuuugu

SEQ ID NO: 2384945 - RNA, 15 nt, Human
cuuuaguuuuuguga

SEQ ID NO: 2384946 - RNA, 13 nt, Human
cuuuauaaacuuu

SEQ ID NO: 2384947 - RNA, 11 nt, Human
cuuuauaaaua

SEQ ID NO: 2384948 - RNA, 13 nt, Human
cuuuauaaauaaa

SEQ ID NO: 2384949 - RNA, 12 nt, Human
cuuuauaaacuu

SEQ ID NO: 2384950 - RNA, 18 nt, Human
cuuuauguggaaaacaga

SEQ ID NO: 2384951 - RNA, 23 nt, Human
cuuuauguggaaaacagaacauc

SEQ ID NO: 2384952 - RNA, 12 nt, Human
cuuuauguguaa

SEQ ID NO: 2384953 - RNA, 14 nt, Human
cuuuauguguaaau

SEQ ID NO: 2384954 - RNA, 20 nt, Human
cuguauuuuguauuguuuca

SEQ ID NO: 2384955 - RNA, 21 nt, Human
cuguauuuuuaccuuuuuccu

SEQ ID NO: 2384956 - RNA, 20 nt, Human
cuguauuuuguuuuugucuu

SEQ ID NO: 2384957 - RNA, 17 nt, Human
cuguauuuaugugugag

SEQ ID NO: 2384958 - RNA, 14 nt, Human
cuguauuuaauuuu

SEQ ID NO: 2384959 - RNA, 15 nt, Human
cuguauuuaauuuug

SEQ ID NO: 2384960 - RNA, 21 nt, Human
cuguauugaaucauguaguau

SEQ ID NO: 2384961 - RNA, 15 nt, Human
cuguauugaugacag

SEQ ID NO: 2384962 - RNA, 13 nt, Human
cuguauugaauca

SEQ ID NO: 2384963 - RNA, 14 nt, Human
cuguauugaaucau

SEQ ID NO: 2384964 - RNA, 17 nt, Human
cuguauugaaucaugua

SEQ ID NO: 2384965 - RNA, 20 nt, Human
cuguauugaaucauguagua

SEQ ID NO: 2384966 - RNA, 17 nt, Human
cugucaaacaaagccag

SEQ ID NO: 2384967 - RNA, 14 nt, Human
cugucaaacaaagc

SEQ ID NO: 2384968 - RNA, 16 nt, Human
cugucaaaauaauuuu

SEQ ID NO: 2384969 - RNA, 17 nt, Human
cugucaaaauaauuuua

SEQ ID NO: 2384970 - RNA, 13 nt, Human
cugucaauuacag

SEQ ID NO: 2384971 - RNA, 18 nt, Human
cuguauuuuuuuuucuaa

SEQ ID NO: 2384972 - RNA, 21 nt, Human
cuguauuuuuuuuucuaagag

SEQ ID NO: 2384973 - RNA, 22 nt, Human
cuguauuuuuuuuucuaagaga

SEQ ID NO: 2384974 - RNA, 19 nt, Human
cugucaaaacaaguuuuuc

SEQ ID NO: 2384975 - RNA, 21 nt, Human
cugucaaaacaaguuuuucug

SEQ ID NO: 2384976 - RNA, 15 nt, Human
cugucaauuacagga

SEQ ID NO: 2384977 - RNA, 16 nt, Human
cugucaauuacaggaa

SEQ ID NO: 2384978 - RNA, 21 nt, Human
cuguaucccaugagccucagc

SEQ ID NO: 2384979 - RNA, 22 nt, Human
cuguaucccaugagccucagca

SEQ ID NO: 2384980 - RNA, 17 nt, Human
cuguauuagucacagag

SEQ ID NO: 2384981 - RNA, 19 nt, Human
cuguauuagucacagagau

SEQ ID NO: 2384982 - RNA, 13 nt, Human
cuguauucucaaa

SEQ ID NO: 2384983 - RNA, 18 nt, Human
cuguauucucaaacacag

SEQ ID NO: 2384984 - RNA, 21 nt, Human
cuguauucucaaacacaguua

SEQ ID NO: 2384985 - RNA, 12 nt, Human
cuguauugaauc

SEQ ID NO: 2384986 - RNA, 20 nt, Human
cuguaucccaugagccucag

SEQ ID NO: 2384987 - RNA, 14 nt, Human
cuguauaaauagga

SEQ ID NO: 2384988 - RNA, 15 nt, Human
cuguauaaauaggag

SEQ ID NO: 2384989 - RNA, 16 nt, Human
cuguauaaauaggaga

SEQ ID NO: 2384990 - RNA, 19 nt, Human
cuguauaaauaggagagga

SEQ ID NO: 2384991 - RNA, 20 nt, Human
cuguauaaauaggagaggau

SEQ ID NO: 2384992 - RNA, 13 nt, Human
cuguauaaauagg

SEQ ID NO: 2384993 - RNA, 19 nt, Human
cuguauaaaaucagccaau

SEQ ID NO: 2384994 - RNA, 11 nt, Human
cuguauaaaau

SEQ ID NO: 2384995 - RNA, 17 nt, Human
cuguauaaaaucagcca

SEQ ID NO: 2384996 - RNA, 21 nt, Human
cuguaguuuuaucacauguau

SEQ ID NO: 2384997 - RNA, 22 nt, Human
cuguaguuuuaucacauguaug

SEQ ID NO: 2384998 - RNA, 23 nt, Human
cuguaguuuuaucacauguaugu

SEQ ID NO: 2384999 - RNA, 14 nt, Human
cuguacgucugaca

SEQ ID NO: 2385000 - RNA, 15 nt, Human
cuguacgucugacag

SEQ ID NO: 2385001 - RNA, 16 nt, Human
cuguacgucugacagg

SEQ ID NO: 2385002 - RNA, 18 nt, Human
cuguacgucugacaggca

SEQ ID NO: 2385003 - RNA, 21 nt, Human
cuguacaugaaaacacauuuu

SEQ ID NO: 2385004 - RNA, 20 nt, Human
cuguacaugaaaacacauuu

SEQ ID NO: 2385005 - RNA, 17 nt, Human
cuguacaugaaaacaca

SEQ ID NO: 2385006 - RNA, 16 nt, Human
cuguaauuguguguga

SEQ ID NO: 2385007 - RNA, 13 nt, Human
cuguaauuuaguu

SEQ ID NO: 2385008 - RNA, 16 nt, Human
cuguaauuuaguuauu

SEQ ID NO: 2385009 - RNA, 19 nt, Human
cuguaauuuaguuauugau

SEQ ID NO: 2385010 - RNA, 19 nt, Human
cuguacauagccuauauuu

SEQ ID NO: 2385011 - RNA, 20 nt, Human
cuguacauauuugagacuag

SEQ ID NO: 2385012 - RNA, 14 nt, Human
cuguacaucuauuu

SEQ ID NO: 2385013 - RNA, 23 nt, Human
cuguaccuuuugaggagccccag

SEQ ID NO: 2385014 - RNA, 13 nt, Human
cuguacucaggag

SEQ ID NO: 2385015 - RNA, 13 nt, Human
cuguacuagagau

SEQ ID NO: 2385016 - RNA, 17 nt, Human
cuguacuagagaucugg

SEQ ID NO: 2385017 - RNA, 14 nt, Human
cuguacuccuccca

SEQ ID NO: 2385018 - RNA, 19 nt, Human
cuguacgucugacaggcaa

SEQ ID NO: 2385019 - RNA, 20 nt, Human
cuguacgucugacaggcaau

SEQ ID NO: 2385020 - RNA, 22 nt, Human
cuguaguuaggaaauaaaaccu

SEQ ID NO: 2385021 - RNA, 21 nt, Human
cuguaguuaggaaauaaaacc

SEQ ID NO: 2385022 - RNA, 20 nt, Human
cuguacucaggaggcugagg

SEQ ID NO: 2385023 - RNA, 21 nt, Human
cuguacuagagaucugguuuu

SEQ ID NO: 2385024 - RNA, 17 nt, Human
cuguacucgcuugugca

SEQ ID NO: 2385025 - RNA, 20 nt, Human
cuguaguugcguggacucug

SEQ ID NO: 2385026 - RNA, 12 nt, Human
cuguaguuuuau

SEQ ID NO: 2385027 - RNA, 18 nt, Human
cuguacucgcuugugcag

SEQ ID NO: 2385028 - RNA, 15 nt, Human
cuguacuccucccag

SEQ ID NO: 2385029 - RNA, 16 nt, Human
cuguacuccucccagg

SEQ ID NO: 2385030 - RNA, 19 nt, Human
cuguacuccucccaggcgc

SEQ ID NO: 2385031 - RNA, 21 nt, Human
cuguacuccucccaggcgccc

SEQ ID NO: 2385032 - RNA, 15 nt, Human
cuguaaucccagcac

SEQ ID NO: 2385033 - RNA, 17 nt, Human
cuguaaucccagcacuu

SEQ ID NO: 2385034 - RNA, 14 nt, Human
cuguaaucccagca

SEQ ID NO: 2385035 - RNA, 13 nt, Human
cuguaaucccagc

SEQ ID NO: 2385036 - RNA, 14 nt, Human
cuguaaucccagcu

SEQ ID NO: 2385037 - RNA, 20 nt, Human
cuguaaucccagcaugcuga

SEQ ID NO: 2385038 - RNA, 16 nt, Human
cuguaaucccagcacu

SEQ ID NO: 2385039 - RNA, 19 nt, Human
cuguaaucccagcacuugg

SEQ ID NO: 2385040 - RNA, 20 nt, Human
cuguaaucccagcacuuugg

SEQ ID NO: 2385041 - RNA, 19 nt, Human
cuguaauccuagcacuuug

SEQ ID NO: 2385042 - RNA, 23 nt, Human
cuggugucugcuuucuccauugu

SEQ ID NO: 2385043 - RNA, 23 nt, Human
cugguuagaaaugcagaauccua

SEQ ID NO: 2385044 - RNA, 16 nt, Human
cuggugugaacuaaac

SEQ ID NO: 2385045 - RNA, 14 nt, Human
cugguuagaaaugc

SEQ ID NO: 2385046 - RNA, 22 nt, Human
cugguuagagguucccuuugac

SEQ ID NO: 2385047 - RNA, 21 nt, Human
cugguuagagguucccuuuga

SEQ ID NO: 2385048 - RNA, 20 nt, Human
cugguguccugaccacccuc

SEQ ID NO: 2385049 - RNA, 21 nt, Human
cugguguccugaccacccucc

SEQ ID NO: 2385050 - RNA, 22 nt, Human
cugguguccugaccacccuccc

SEQ ID NO: 2385051 - RNA, 17 nt, Human
cuggugucugcuuucuc

SEQ ID NO: 2385052 - RNA, 19 nt, Human
cuguaaucccagcuacucg

SEQ ID NO: 2385053 - RNA, 19 nt, Human
cuguaaucccagcuacuca

SEQ ID NO: 2385054 - RNA, 15 nt, Human
cuguaaucccagcag

SEQ ID NO: 2385055 - RNA, 22 nt, Human
cuguaaucccagcuacucggga

SEQ ID NO: 2385056 - RNA, 18 nt, Human
cuguaaucccagcuacuu

SEQ ID NO: 2385057 - RNA, 16 nt, Human
cuguaauuccuaccuc

SEQ ID NO: 2385058 - RNA, 22 nt, Human
cuguaauuccuaccucccugca

SEQ ID NO: 2385059 - RNA, 15 nt, Human
cuguaauuugugaua

SEQ ID NO: 2385060 - RNA, 14 nt, Human
cuguaauuugugau

SEQ ID NO: 2385061 - RNA, 14 nt, Human
cuguacagagccca

SEQ ID NO: 2385062 - RNA, 15 nt, Human
cuguacagagcccac

SEQ ID NO: 2385063 - RNA, 18 nt, Human
cuguacagagcccacgcc

SEQ ID NO: 2385064 - RNA, 22 nt, Human
cuguacagagcccacgccccca

SEQ ID NO: 2385065 - RNA, 12 nt, Human
cugguguccuga

SEQ ID NO: 2385066 - RNA, 15 nt, Human
cuggugucacuuacu

SEQ ID NO: 2385067 - RNA, 18 nt, Human
cuggugucacuuacuguu

SEQ ID NO: 2385068 - RNA, 13 nt, Human
cugguguccugac

SEQ ID NO: 2385069 - RNA, 14 nt, Human
cugguguccugacc

SEQ ID NO: 2385070 - RNA, 15 nt, Human
cugguguccugacca

SEQ ID NO: 2385071 - RNA, 16 nt, Human
cugguguccugaccac

SEQ ID NO: 2385072 - RNA, 17 nt, Human
cugguguccugaccacc

SEQ ID NO: 2385073 - RNA, 18 nt, Human
cugguguccugaccaccc

SEQ ID NO: 2385074 - RNA, 19 nt, Human
cugguguccugaccacccu

SEQ ID NO: 2385075 - RNA, 20 nt, Human
cuggugguugcuguuuuccu

SEQ ID NO: 2385076 - RNA, 16 nt, Human
cuggugguuucacggu

SEQ ID NO: 2385077 - RNA, 15 nt, Human
cuggugguugcuguu

SEQ ID NO: 2385078 - RNA, 21 nt, Human
cuggugguuucacggugccag

SEQ ID NO: 2385079 - RNA, 18 nt, Human
cuggugguuucacggugc

SEQ ID NO: 2385080 - RNA, 20 nt, Human
cuggugguuucacggugcca

SEQ ID NO: 2385081 - RNA, 23 nt, Human
cuggugguucacucuuggagccu

SEQ ID NO: 2385082 - RNA, 21 nt, Human
cuggugguucacucuuggagc

SEQ ID NO: 2385083 - RNA, 20 nt, Human
cuggugguucacucuuggag

SEQ ID NO: 2385084 - RNA, 12 nt, Human
cuggugguucac

SEQ ID NO: 2385085 - RNA, 14 nt, Human
cugguauuccugcc

SEQ ID NO: 2385086 - RNA, 15 nt, Human
cugguauuccugccu

SEQ ID NO: 2385087 - RNA, 17 nt, Human
cugguauuccugccucc

SEQ ID NO: 2385088 - RNA, 17 nt, Human
cugguggcagcucaccu

SEQ ID NO: 2385089 - RNA, 18 nt, Human
cugguggcagcucaccuc

SEQ ID NO: 2385090 - RNA, 15 nt, Human
cugguggcagcugcg

SEQ ID NO: 2385091 - RNA, 20 nt, Human
cugguggcagcucaccucuc

SEQ ID NO: 2385092 - RNA, 14 nt, Human
cugguggcaguggg

SEQ ID NO: 2385093 - RNA, 18 nt, Human
cugguggcagugggagcu

SEQ ID NO: 2385094 - RNA, 22 nt, Human
cugggcccugacauuggagccu

SEQ ID NO: 2385095 - RNA, 13 nt, Human
cugggccugcaga

SEQ ID NO: 2385096 - RNA, 15 nt, Human
cugggcuccuccagg

SEQ ID NO: 2385097 - RNA, 14 nt, Human
cugggcuccuccag

SEQ ID NO: 2385098 - RNA, 14 nt, Human
cugggcucuccacc

SEQ ID NO: 2385099 - RNA, 13 nt, Human
cugggcucuccac

SEQ ID NO: 2385100 - RNA, 12 nt, Human
cugggcucucca

SEQ ID NO: 2385101 - RNA, 17 nt, Human
cugggcucgucuuugca

SEQ ID NO: 2385102 - RNA, 16 nt, Human
cugggcucggaggcug

SEQ ID NO: 2385103 - RNA, 17 nt, Human
cugggcucggaggcugc

SEQ ID NO: 2385104 - RNA, 18 nt, Human
cugggcucggaggcugcc

SEQ ID NO: 2385105 - RNA, 21 nt, Human
cugggcucggaggcugccccc

SEQ ID NO: 2385106 - RNA, 17 nt, Human
cugggcuccuccagggu

SEQ ID NO: 2385107 - RNA, 13 nt, Human
cugggcucggagg

SEQ ID NO: 2385108 - RNA, 15 nt, Human
cugggcucggaggcu

SEQ ID NO: 2385109 - RNA, 23 nt, Human
cugggcucugccccagcucuggc

SEQ ID NO: 2385110 - RNA, 21 nt, Human
cugggcucugccacccuaccu

SEQ ID NO: 2385111 - RNA, 15 nt, Human
cugggcucugggagc

SEQ ID NO: 2385112 - RNA, 18 nt, Human
cugggcucugggagcagc

SEQ ID NO: 2385113 - RNA, 16 nt, Human
cugggcucugggagca

SEQ ID NO: 2385114 - RNA, 13 nt, Human
cugggcucugugg

SEQ ID NO: 2385115 - RNA, 18 nt, Human
cugggcucugccccagcu

SEQ ID NO: 2385116 - RNA, 17 nt, Human
cugggcucugccccagc

SEQ ID NO: 2385117 - RNA, 13 nt, Human
cugggcucugccc

SEQ ID NO: 2385118 - RNA, 17 nt, Human
cugggcucugccacccu

SEQ ID NO: 2385119 - RNA, 20 nt, Human
cugggcucugccacccuacc

SEQ ID NO: 2385120 - RNA, 21 nt, Human
cugggcucuccaccucagccu

SEQ ID NO: 2385121 - RNA, 20 nt, Human
cugggcucuccaccucagcc

SEQ ID NO: 2385122 - RNA, 19 nt, Human
cugggcucuccaccucagc

SEQ ID NO: 2385123 - RNA, 18 nt, Human
cugggcucuccaccucag

SEQ ID NO: 2385124 - RNA, 17 nt, Human
cugggcucuccaccuca

SEQ ID NO: 2385125 - RNA, 16 nt, Human
cugggcucuccaccuc

SEQ ID NO: 2385126 - RNA, 15 nt, Human
cugggcucuccaccu

SEQ ID NO: 2385127 - RNA, 22 nt, Human
cugggcucugcaauuccccucu

SEQ ID NO: 2385128 - RNA, 23 nt, Human
cugggcucugcaauuccccucug

SEQ ID NO: 2385129 - RNA, 13 nt, Human
cugggcucugcca

SEQ ID NO: 2385130 - RNA, 14 nt, Human
cugggcucugccac

SEQ ID NO: 2385131 - RNA, 15 nt, Human
cugggcucugccacc

SEQ ID NO: 2385132 - RNA, 13 nt, Human
cugggcugagaga

SEQ ID NO: 2385133 - RNA, 12 nt, Human
cugggcugagcc

SEQ ID NO: 2385134 - RNA, 13 nt, Human
cugggcugagccc

SEQ ID NO: 2385135 - RNA, 14 nt, Human
cugggcugagcccc

SEQ ID NO: 2385136 - RNA, 15 nt, Human
cugggcugacuggga

SEQ ID NO: 2385137 - RNA, 22 nt, Human
cugggcucugugggcugcacuc

SEQ ID NO: 2385138 - RNA, 12 nt, Human
cugggcugacug

SEQ ID NO: 2385139 - RNA, 18 nt, Human
cugggcugaacacuccaa

SEQ ID NO: 2385140 - RNA, 20 nt, Human
cugggcucugugggcugcac

SEQ ID NO: 2385141 - RNA, 21 nt, Human
cugggcucugugggcugcacu

SEQ ID NO: 2385142 - RNA, 14 nt, Human
cugggcucuguggg

SEQ ID NO: 2385143 - RNA, 15 nt, Human
cugggcucugugggc

SEQ ID NO: 2385144 - RNA, 16 nt, Human
cugggcucugugggcu

SEQ ID NO: 2385145 - RNA, 18 nt, Human
cugggcucugugggcugc

SEQ ID NO: 2385146 - RNA, 23 nt, Human
cugggcugagggagccuggcccc

SEQ ID NO: 2385147 - RNA, 19 nt, Human
cugggcugagggagccugg

SEQ ID NO: 2385148 - RNA, 18 nt, Human
cugggcugagggagccug

SEQ ID NO: 2385149 - RNA, 16 nt, Human
cugggcugagggagcc

SEQ ID NO: 2385150 - RNA, 13 nt, Human
cugggcugaggga

SEQ ID NO: 2385151 - RNA, 12 nt, Human
cugggcugaggg

SEQ ID NO: 2385152 - RNA, 15 nt, Human
cugggcugagccccu

SEQ ID NO: 2385153 - RNA, 17 nt, Human
cugggcugagccccuac

SEQ ID NO: 2385154 - RNA, 18 nt, Human
cugggcugagccccuacc

SEQ ID NO: 2385155 - RNA, 19 nt, Human
cugggcugagccccuaccc

SEQ ID NO: 2385156 - RNA, 19 nt, Human
cugggauguuucugucaca

SEQ ID NO: 2385157 - RNA, 22 nt, Human
cugggauguggcugcagcagcg

SEQ ID NO: 2385158 - RNA, 20 nt, Human
cugggauuacaggcaugagc

SEQ ID NO: 2385159 - RNA, 18 nt, Human
cugggauuacaggcguga

SEQ ID NO: 2385160 - RNA, 21 nt, Human
cugggauuacaagcgugagcc

SEQ ID NO: 2385161 - RNA, 14 nt, Human
cugggauguuucug

SEQ ID NO: 2385162 - RNA, 15 nt, Human
cugggauguggcugc

SEQ ID NO: 2385163 - RNA, 20 nt, Human
cugggauguggcugcagcag

SEQ ID NO: 2385164 - RNA, 21 nt, Human
cugggauguccacagaugccu

SEQ ID NO: 2385165 - RNA, 14 nt, Human
cugggauguccaca

SEQ ID NO: 2385166 - RNA, 21 nt, Human
cugcuccacaguguuggcgag

SEQ ID NO: 2385167 - RNA, 16 nt, Human
cugggaugggccugcu

SEQ ID NO: 2385168 - RNA, 21 nt, Human
cugcuccacccuuggccuguc

SEQ ID NO: 2385169 - RNA, 20 nt, Human
cugcuccacccuuggccugu

SEQ ID NO: 2385170 - RNA, 22 nt, Human
cugggaugggccugcuuccugu

SEQ ID NO: 2385171 - RNA, 18 nt, Human
cugcguggggacagggcu

SEQ ID NO: 2385172 - RNA, 19 nt, Human
cugcuccacagccauccca

SEQ ID NO: 2385173 - RNA, 12 nt, Human
cugcuccacagu

SEQ ID NO: 2385174 - RNA, 13 nt, Human
cugcuccacagug

SEQ ID NO: 2385175 - RNA, 14 nt, Human
cugcuccacagugu

SEQ ID NO: 2385176 - RNA, 16 nt, Human
cugcuccacaguguug

SEQ ID NO: 2385177 - RNA, 11 nt, Human
cugcuccaccc

SEQ ID NO: 2385178 - RNA, 16 nt, Human
cugcuccaccacaucc

SEQ ID NO: 2385179 - RNA, 13 nt, Human
cugcuccaccaca

SEQ ID NO: 2385180 - RNA, 11 nt, Human
cugcuccacca

SEQ ID NO: 2385181 - RNA, 19 nt, Human
cugcuccacccuuggccug

SEQ ID NO: 2385182 - RNA, 18 nt, Human
cugcuccacccuuggccu

SEQ ID NO: 2385183 - RNA, 17 nt, Human
cugcuccacccuuggcc

SEQ ID NO: 2385184 - RNA, 16 nt, Human
cugcuccacccuuggc

SEQ ID NO: 2385185 - RNA, 15 nt, Human
cugcuccacccuugg

SEQ ID NO: 2385186 - RNA, 14 nt, Human
cugcuccacccuug

SEQ ID NO: 2385187 - RNA, 13 nt, Human
cugcuccacccuu

SEQ ID NO: 2385188 - RNA, 12 nt, Human
cugcuccacccu

SEQ ID NO: 2385189 - RNA, 14 nt, Human
cugggauuccuccc

SEQ ID NO: 2385190 - RNA, 17 nt, Human
cugggauucccaccaag

SEQ ID NO: 2385191 - RNA, 15 nt, Human
cugggauucccacca

SEQ ID NO: 2385192 - RNA, 17 nt, Human
cugggauucuacuuuaa

SEQ ID NO: 2385193 - RNA, 20 nt, Human
cugggauucccaccaagguc

SEQ ID NO: 2385194 - RNA, 18 nt, Human
cugggauucuacuuuaag

SEQ ID NO: 2385195 - RNA, 21 nt, Human
cugggauucuacuuuaagcac

SEQ ID NO: 2385196 - RNA, 22 nt, Human
cugggauucuacuuuaagcacu

SEQ ID NO: 2385197 - RNA, 23 nt, Human
cugggauucuacuuuaagcacua

SEQ ID NO: 2385198 - RNA, 18 nt, Human
cugggcaacagagcaaga

SEQ ID NO: 2385199 - RNA, 15 nt, Human
cugggcaacagagca

SEQ ID NO: 2385200 - RNA, 15 nt, Human
cugggcaaagccuag

SEQ ID NO: 2385201 - RNA, 17 nt, Human
cugggauuuacacuuga

SEQ ID NO: 2385202 - RNA, 19 nt, Human
cugggccccugccucucug

SEQ ID NO: 2385203 - RNA, 15 nt, Human
cugggcaaggaggcc

SEQ ID NO: 2385204 - RNA, 21 nt, Human
cugggcaaggaggccacguga

SEQ ID NO: 2385205 - RNA, 18 nt, Human
cugggcccucucugcucu

SEQ ID NO: 2385206 - RNA, 15 nt, Human
cugggcccucucugc

SEQ ID NO: 2385207 - RNA, 14 nt, Human
cugggcccucucug

SEQ ID NO: 2385208 - RNA, 13 nt, Human
cugggcccucucu

SEQ ID NO: 2385209 - RNA, 20 nt, Human
cugggccccugccucucugc

SEQ ID NO: 2385210 - RNA, 23 nt, Human
cugggccccugccucucugcagg

SEQ ID NO: 2385211 - RNA, 20 nt, Human
cugggguggggauagggagc

SEQ ID NO: 2385212 - RNA, 16 nt, Human
cuggggguugcggggg

SEQ ID NO: 2385213 - RNA, 21 nt, Human
cugggguaccaagagacuccu

SEQ ID NO: 2385214 - RNA, 17 nt, Human
cugggggugggccaggc

SEQ ID NO: 2385215 - RNA, 16 nt, Human
cugggguaccaagaga

SEQ ID NO: 2385216 - RNA, 20 nt, Human
cuggggguucuuucuuccuc

SEQ ID NO: 2385217 - RNA, 23 nt, Human
cuggggguucuuucuuccucugc

SEQ ID NO: 2385218 - RNA, 15 nt, Human
cugggguucagcccc

SEQ ID NO: 2385219 - RNA, 13 nt, Human
cugggguucagcc

SEQ ID NO: 2385220 - RNA, 19 nt, Human
cuggggugugggaggcccg

SEQ ID NO: 2385221 - RNA, 16 nt, Human
cuggggugugggaggc

SEQ ID NO: 2385222 - RNA, 14 nt, Human
cuggggugggguca

SEQ ID NO: 2385223 - RNA, 13 nt, Human
cuggggugggguc

SEQ ID NO: 2385224 - RNA, 20 nt, Human
cugggguggggucaugcccu

SEQ ID NO: 2385225 - RNA, 22 nt, Human
cugggguucagccccuccucug

SEQ ID NO: 2385226 - RNA, 16 nt, Human
cuggguaaaugcagcg

SEQ ID NO: 2385227 - RNA, 23 nt, Human
cugggguucagccccuccucugc

SEQ ID NO: 2385228 - RNA, 21 nt, Human
cugggguucagccccuccucu

SEQ ID NO: 2385229 - RNA, 20 nt, Human
cugggguucagccccuccuc

SEQ ID NO: 2385230 - RNA, 19 nt, Human
cugggguucagccccuccu

SEQ ID NO: 2385231 - RNA, 17 nt, Human
cugggguucagccccuc

SEQ ID NO: 2385232 - RNA, 22 nt, Human
cuggguccaggggaugggaggu

SEQ ID NO: 2385233 - RNA, 21 nt, Human
cuggguccaggggaugggagg

SEQ ID NO: 2385234 - RNA, 18 nt, Human
cuggguccuugcaccccu

SEQ ID NO: 2385235 - RNA, 23 nt, Human
cuggguccuugcaccccucacuc

SEQ ID NO: 2385236 - RNA, 13 nt, Human
cugggucgcccug

SEQ ID NO: 2385237 - RNA, 17 nt, Human
cugguaauuuguaucug

SEQ ID NO: 2385238 - RNA, 15 nt, Human
cugguaauauugacu

SEQ ID NO: 2385239 - RNA, 19 nt, Human
cugguaauauugacuugua

SEQ ID NO: 2385240 - RNA, 15 nt, Human
cugguaaucuugcuc

SEQ ID NO: 2385241 - RNA, 18 nt, Human
cugguauauccaaaagcu

SEQ ID NO: 2385242 - RNA, 20 nt, Human
cugguauauccaaaagcuuu

SEQ ID NO: 2385243 - RNA, 19 nt, Human
cugguauauccaaaagcuu

SEQ ID NO: 2385244 - RNA, 18 nt, Human
cugguaacaguucauguu

SEQ ID NO: 2385245 - RNA, 16 nt, Human
cugguaaacuauuugu

SEQ ID NO: 2385246 - RNA, 19 nt, Human
cugguaaacuauuugucuu

SEQ ID NO: 2385247 - RNA, 20 nt, Human
cuggguuuucuuaaccaucu

SEQ ID NO: 2385248 - RNA, 23 nt, Human
cuggguuuggaccccagcuggga

SEQ ID NO: 2385249 - RNA, 20 nt, Human
cuggguuuuguauucucuga

SEQ ID NO: 2385250 - RNA, 22 nt, Human
cuggguuuuguauucucugagc

SEQ ID NO: 2385251 - RNA, 15 nt, Human
cugggucgcccugga

SEQ ID NO: 2385252 - RNA, 19 nt, Human
cuggguuuggaccccagcu

SEQ ID NO: 2385253 - RNA, 19 nt, Human
cuggguccuuuucagaagu

SEQ ID NO: 2385254 - RNA, 20 nt, Human
cuggguuuggaccccagcug

SEQ ID NO: 2385255 - RNA, 21 nt, Human
cuggguuuggaccccagcugg

SEQ ID NO: 2385256 - RNA, 22 nt, Human
cuggguuuggaccccagcuggg

SEQ ID NO: 2385257 - RNA, 19 nt, Human
cugggcuuggggcuuccua

SEQ ID NO: 2385258 - RNA, 20 nt, Human
cugggcuuggggcuuccuaa

SEQ ID NO: 2385259 - RNA, 23 nt, Human
cugggcuuuuuuuuucucuuucu

SEQ ID NO: 2385260 - RNA, 16 nt, Human
cugggggccucuucug

SEQ ID NO: 2385261 - RNA, 14 nt, Human
cugggggugccagg

SEQ ID NO: 2385262 - RNA, 16 nt, Human
cugggggugggccagg

SEQ ID NO: 2385263 - RNA, 15 nt, Human
cugggggugggccag

SEQ ID NO: 2385264 - RNA, 14 nt, Human
cugggggugggcca

SEQ ID NO: 2385265 - RNA, 19 nt, Human
cugggggugccaggaccag

SEQ ID NO: 2385266 - RNA, 15 nt, Human
cugggggugccagga

SEQ ID NO: 2385267 - RNA, 18 nt, Human
cugggggcugggcagagg

SEQ ID NO: 2385268 - RNA, 14 nt, Human
cugggggcugggca

SEQ ID NO: 2385269 - RNA, 18 nt, Human
cugggcuugucuguagau

SEQ ID NO: 2385270 - RNA, 22 nt, Human
cugggcuuggggaccagagcug

SEQ ID NO: 2385271 - RNA, 15 nt, Human
cugggcuucaguggc

SEQ ID NO: 2385272 - RNA, 14 nt, Human
cugggcuguuggca

SEQ ID NO: 2385273 - RNA, 15 nt, Human
cugggcuguuggcac

SEQ ID NO: 2385274 - RNA, 13 nt, Human
cugggcugugcua

SEQ ID NO: 2385275 - RNA, 13 nt, Human
cugggcuguuggc

SEQ ID NO: 2385276 - RNA, 21 nt, Human
cugggcugguggcucccggag

SEQ ID NO: 2385277 - RNA, 22 nt, Human
cugggcugggugcgaccccauc

SEQ ID NO: 2385278 - RNA, 12 nt, Human
cugggcugugcu

SEQ ID NO: 2385279 - RNA, 15 nt, Human
cugggcuggggccug

SEQ ID NO: 2385280 - RNA, 18 nt, Human
cugggcuggggccugaug

SEQ ID NO: 2385281 - RNA, 20 nt, Human
cugggcuggggccugauggg

SEQ ID NO: 2385282 - RNA, 12 nt, Human
cugggcugggug

SEQ ID NO: 2385283 - RNA, 18 nt, Human
cugggcugggugcgaccc

SEQ ID NO: 2385284 - RNA, 19 nt, Human
cugggcugcuacccagaaa

SEQ ID NO: 2385285 - RNA, 20 nt, Human
cugggcugccaugugaagag

SEQ ID NO: 2385286 - RNA, 17 nt, Human
cugggcugccaugugaa

SEQ ID NO: 2385287 - RNA, 12 nt, Human
cugggcuggcuc

SEQ ID NO: 2385288 - RNA, 16 nt, Human
cugggcuggcucccuc

SEQ ID NO: 2385289 - RNA, 18 nt, Human
cugggcuggcucccucuu

SEQ ID NO: 2385290 - RNA, 20 nt, Human
cugugggaacgagaggggaa

SEQ ID NO: 2385291 - RNA, 21 nt, Human
cugugggaacgagaggggaag

SEQ ID NO: 2385292 - RNA, 23 nt, Human
cugugggaacgagaggggaagag

SEQ ID NO: 2385293 - RNA, 20 nt, Human
cugugggaaggccagcugcc

SEQ ID NO: 2385294 - RNA, 18 nt, Human
cugugggaaggccagcug

SEQ ID NO: 2385295 - RNA, 15 nt, Human
cugugggaaggccag

SEQ ID NO: 2385296 - RNA, 16 nt, Human
cugugggaaggccagc

SEQ ID NO: 2385297 - RNA, 14 nt, Human
cugugggagccugc

SEQ ID NO: 2385298 - RNA, 18 nt, Human
cuguggcuuucagccucu

SEQ ID NO: 2385299 - RNA, 19 nt, Human
cuguggcuuucagccucug

SEQ ID NO: 2385300 - RNA, 22 nt, Human
cuguggcuucuuaaucuuuuca

SEQ ID NO: 2385301 - RNA, 11 nt, Human
cuguggccugg

SEQ ID NO: 2385302 - RNA, 21 nt, Human
cuguggccguuaucuggaagu

SEQ ID NO: 2385303 - RNA, 19 nt, Human
cuguggccguuaucuggaa

SEQ ID NO: 2385304 - RNA, 20 nt, Human
cuguggccguuaucuggaag

SEQ ID NO: 2385305 - RNA, 22 nt, Human
cugugggugaagacagagggaa

SEQ ID NO: 2385306 - RNA, 23 nt, Human
cuguggggugugcacaucucugc

SEQ ID NO: 2385307 - RNA, 15 nt, Human
cuguggguaguauga

SEQ ID NO: 2385308 - RNA, 21 nt, Human
cuguggguuucuaaagcugcc

SEQ ID NO: 2385309 - RNA, 20 nt, Human
cugugggcaggugggagcuu

SEQ ID NO: 2385310 - RNA, 22 nt, Human
cugugggcacgcugugggcagg

SEQ ID NO: 2385311 - RNA, 23 nt, Human
cugugggggugagggucccaugu

SEQ ID NO: 2385312 - RNA, 24 nt, Human
cugugggggugagggucccaugug

SEQ ID NO: 2385313 - RNA, 14 nt, Human
cugugggaugggau

SEQ ID NO: 2385314 - RNA, 22 nt, Human
cugugggaucccucugggcacu

SEQ ID NO: 2385315 - RNA, 22 nt, Human
cuguggugcaaaagcagaaaau

SEQ ID NO: 2385316 - RNA, 23 nt, Human
cuguggugcaaaagcagaaaaua

SEQ ID NO: 2385317 - RNA, 14 nt, Human
cugugguguguccc

SEQ ID NO: 2385318 - RNA, 22 nt, Human
cuguggugugucccccucuguc

SEQ ID NO: 2385319 - RNA, 15 nt, Human
cuguggugugucccc

SEQ ID NO: 2385320 - RNA, 23 nt, Human
cugugguaguacuccugcaaaau

SEQ ID NO: 2385321 - RNA, 15 nt, Human
cugugggugacccag

SEQ ID NO: 2385322 - RNA, 22 nt, Human
cuguggguuucuaaagcugcca

SEQ ID NO: 2385323 - RNA, 22 nt, Human
cugugguccugaauucuuuccc

SEQ ID NO: 2385324 - RNA, 16 nt, Human
cuguggucacagcgga

SEQ ID NO: 2385325 - RNA, 22 nt, Human
cuguggagguacacucuuauag

SEQ ID NO: 2385326 - RNA, 15 nt, Human
cuguggaucagagau

SEQ ID NO: 2385327 - RNA, 17 nt, Human
cuguggaugagcccuca

SEQ ID NO: 2385328 - RNA, 15 nt, Human
cuguggaugagcccu

SEQ ID NO: 2385329 - RNA, 21 nt, Human
cuguggccccacccugggccc

SEQ ID NO: 2385330 - RNA, 16 nt, Human
cuguggccccacccug

SEQ ID NO: 2385331 - RNA, 17 nt, Human
cuguggccccacccugg

SEQ ID NO: 2385332 - RNA, 18 nt, Human
cuguggccccacccuggg

SEQ ID NO: 2385333 - RNA, 20 nt, Human
cuguggccccacccugggcc

SEQ ID NO: 2385334 - RNA, 23 nt, Human
cuguggagcccgcacccccaccc

SEQ ID NO: 2385335 - RNA, 14 nt, Human
cuguggaggaagga

SEQ ID NO: 2385336 - RNA, 15 nt, Human
cuguggaggaaggau

SEQ ID NO: 2385337 - RNA, 22 nt, Human
cuguggagcccgcacccccacc

SEQ ID NO: 2385338 - RNA, 15 nt, Human
cuguggagcccgcac

SEQ ID NO: 2385339 - RNA, 14 nt, Human
cuguggagacuggg

SEQ ID NO: 2385340 - RNA, 16 nt, Human
cuguggaggaaggauu

SEQ ID NO: 2385341 - RNA, 17 nt, Human
cuguggaggaaggauug

SEQ ID NO: 2385342 - RNA, 19 nt, Human
cuguggaggaaggauugua

SEQ ID NO: 2385343 - RNA, 20 nt, Human
cuguggaggaaggauuguaa

SEQ ID NO: 2385344 - RNA, 21 nt, Human
cuguggaggaaggauuguaaa

SEQ ID NO: 2385345 - RNA, 22 nt, Human
cuguggaggaaggauuguaaaa

SEQ ID NO: 2385346 - RNA, 23 nt, Human
cuguggaggaaggauuguaaaaa

SEQ ID NO: 2385347 - RNA, 14 nt, Human
cuguggaucaaauc

SEQ ID NO: 2385348 - RNA, 24 nt, Human
cuguggaucaaauccagccugcug

SEQ ID NO: 2385349 - RNA, 12 nt, Human
cugugccucugc

SEQ ID NO: 2385350 - RNA, 13 nt, Human
cugugccucugcc

SEQ ID NO: 2385351 - RNA, 14 nt, Human
cugugccucugccu

SEQ ID NO: 2385352 - RNA, 15 nt, Human
cugugccucugccug

SEQ ID NO: 2385353 - RNA, 15 nt, Human
cugugcccucuugau

SEQ ID NO: 2385354 - RNA, 11 nt, Human
cugugcccugg

SEQ ID NO: 2385355 - RNA, 18 nt, Human
cugugccuaacaccagcg

SEQ ID NO: 2385356 - RNA, 17 nt, Human
cugugcccugguggaga

SEQ ID NO: 2385357 - RNA, 17 nt, Human
cugugcccuuauucagg

SEQ ID NO: 2385358 - RNA, 12 nt, Human
cugugcccuggu

SEQ ID NO: 2385359 - RNA, 13 nt, Human
cugugcccuggug

SEQ ID NO: 2385360 - RNA, 15 nt, Human
cugugcccuggugga

SEQ ID NO: 2385361 - RNA, 16 nt, Human
cugugcccugguggag

SEQ ID NO: 2385362 - RNA, 16 nt, Human
cugugccucugccugu

SEQ ID NO: 2385363 - RNA, 17 nt, Human
cugugccucugccuguc

SEQ ID NO: 2385364 - RNA, 16 nt, Human
cuguggaagggacuag

SEQ ID NO: 2385365 - RNA, 14 nt, Human
cuguggaagggacu

SEQ ID NO: 2385366 - RNA, 18 nt, Human
cuguggaaucuggaguga

SEQ ID NO: 2385367 - RNA, 13 nt, Human
cuguggaagggac

SEQ ID NO: 2385368 - RNA, 23 nt, Human
cuguggaaaguguaaagcauucc

SEQ ID NO: 2385369 - RNA, 12 nt, Human
cuguggaagcaa

SEQ ID NO: 2385370 - RNA, 13 nt, Human
cuguggagaaaua

SEQ ID NO: 2385371 - RNA, 13 nt, Human
cugugugaaaaug

SEQ ID NO: 2385372 - RNA, 20 nt, Human
cugugucuuucacagcuccu

SEQ ID NO: 2385373 - RNA, 21 nt, Human
cugugugaaauaccagugugg

SEQ ID NO: 2385374 - RNA, 19 nt, Human
cugugugaaauaccagugu

SEQ ID NO: 2385375 - RNA, 12 nt, Human
cugugugaaaua

SEQ ID NO: 2385376 - RNA, 20 nt, Human
cugugucuuuuuucacuaca

SEQ ID NO: 2385377 - RNA, 13 nt, Human
cuguguaacagcu

SEQ ID NO: 2385378 - RNA, 14 nt, Human
cuguguaacagcuc

SEQ ID NO: 2385379 - RNA, 15 nt, Human
cuguguaaaguuagu

SEQ ID NO: 2385380 - RNA, 18 nt, Human
cuguguaaaguuagucua

SEQ ID NO: 2385381 - RNA, 17 nt, Human
cuguguaacagcuccuu

SEQ ID NO: 2385382 - RNA, 15 nt, Human
cuguguaacagcucc

SEQ ID NO: 2385383 - RNA, 16 nt, Human
cuguguaacagcuccu

SEQ ID NO: 2385384 - RNA, 17 nt, Human
cuguguaaaaagagagc

SEQ ID NO: 2385385 - RNA, 11 nt, Human
cuguguaaagu

SEQ ID NO: 2385386 - RNA, 12 nt, Human
cuguguaaaguu

SEQ ID NO: 2385387 - RNA, 13 nt, Human
cuguguaaaguua

SEQ ID NO: 2385388 - RNA, 14 nt, Human
cuguguaaaguuag

SEQ ID NO: 2385389 - RNA, 16 nt, Human
cuguguaaaaagagag

SEQ ID NO: 2385390 - RNA, 22 nt, Human
cugugguuuuccccucccuggg

SEQ ID NO: 2385391 - RNA, 23 nt, Human
cugugguuuuccccucccugggu

SEQ ID NO: 2385392 - RNA, 18 nt, Human
cugugguuuuccccuccc

SEQ ID NO: 2385393 - RNA, 19 nt, Human
cugugguuuuccccucccu

SEQ ID NO: 2385394 - RNA, 20 nt, Human
cugugguuuuccccucccug

SEQ ID NO: 2385395 - RNA, 21 nt, Human
cugugguuuuccccucccugg

SEQ ID NO: 2385396 - RNA, 21 nt, Human
cugugguuguuuuagcuccuu

SEQ ID NO: 2385397 - RNA, 16 nt, Human
cugugguuuuccccuc

SEQ ID NO: 2385398 - RNA, 19 nt, Human
cugugugacaucaguggca

SEQ ID NO: 2385399 - RNA, 18 nt, Human
cugugugacucaaaccaa

SEQ ID NO: 2385400 - RNA, 15 nt, Human
cugugugaugaacuu

SEQ ID NO: 2385401 - RNA, 16 nt, Human
cugugugaugaacuuu

SEQ ID NO: 2385402 - RNA, 18 nt, Human
cugugugcaagugugugc

SEQ ID NO: 2385403 - RNA, 22 nt, Human
cugugugauugacagcuuugcu

SEQ ID NO: 2385404 - RNA, 23 nt, Human
cugugugauugacagcuuugcug

SEQ ID NO: 2385405 - RNA, 21 nt, Human
cugugugauugacagcuuugc

SEQ ID NO: 2385406 - RNA, 18 nt, Human
cugugugaugaacuuucu

SEQ ID NO: 2385407 - RNA, 19 nt, Human
cugugugaugaacuuucuc

SEQ ID NO: 2385408 - RNA, 15 nt, Human
cugugugcagugaag

SEQ ID NO: 2385409 - RNA, 17 nt, Human
cugugugcagugaaggu

SEQ ID NO: 2385410 - RNA, 16 nt, Human
cugugugcacaaauau

SEQ ID NO: 2385411 - RNA, 21 nt, Human
cugugugcaccuuaccaacuu

SEQ ID NO: 2385412 - RNA, 14 nt, Human
cugugugcucagga

SEQ ID NO: 2385413 - RNA, 22 nt, Human
cuguguguccaaaacugccuca

SEQ ID NO: 2385414 - RNA, 17 nt, Human
cugugugugaugugcau

SEQ ID NO: 2385415 - RNA, 21 nt, Human
cuguguguccaaaacugccuc

SEQ ID NO: 2385416 - RNA, 19 nt, Human
cuguguguccaaaacugcc

SEQ ID NO: 2385417 - RNA, 15 nt, Human
cuguguguccaaaac

SEQ ID NO: 2385418 - RNA, 14 nt, Human
cugugugccuucgc

SEQ ID NO: 2385419 - RNA, 15 nt, Human
cuguguuuuugaaau

SEQ ID NO: 2385420 - RNA, 22 nt, Human
cuguguuuugaaugguguugua

SEQ ID NO: 2385421 - RNA, 19 nt, Human
cuguguugucucuagagca

SEQ ID NO: 2385422 - RNA, 20 nt, Human
cuguguugcgugucgugggu

SEQ ID NO: 2385423 - RNA, 14 nt, Human
cuguguugucucua

SEQ ID NO: 2385424 - RNA, 18 nt, Human
cuguguugcgugucgugg

SEQ ID NO: 2385425 - RNA, 14 nt, Human
cuguguugccaugu

SEQ ID NO: 2385426 - RNA, 21 nt, Human
cuguguugccaagcuccaagc

SEQ ID NO: 2385427 - RNA, 14 nt, Human
cuguguugccaagc

SEQ ID NO: 2385428 - RNA, 16 nt, Human
cuguguugccaagcuc

SEQ ID NO: 2385429 - RNA, 17 nt, Human
cuguguugccaagcucc

SEQ ID NO: 2385430 - RNA, 19 nt, Human
cuguguugccaagcuccaa

SEQ ID NO: 2385431 - RNA, 16 nt, Human
cuguuaaaagaugaaa

SEQ ID NO: 2385432 - RNA, 15 nt, Human
cuguuaaaagaugaa

SEQ ID NO: 2385433 - RNA, 19 nt, Human
cuguuaaaagaugaaaaua

SEQ ID NO: 2385434 - RNA, 23 nt, Human
cuguguuuuugcuaucacacagu

SEQ ID NO: 2385435 - RNA, 19 nt, Human
cuguguguuuucauaauaa

SEQ ID NO: 2385436 - RNA, 18 nt, Human
cuguguguuuucauaaua

SEQ ID NO: 2385437 - RNA, 16 nt, Human
cuguguguuuucauaa

SEQ ID NO: 2385438 - RNA, 21 nt, Human
cuguguguguguauguggggg

SEQ ID NO: 2385439 - RNA, 20 nt, Human
cuguguucuggugaggccuu

SEQ ID NO: 2385440 - RNA, 13 nt, Human
cuguguugccaag

SEQ ID NO: 2385441 - RNA, 20 nt, Human
cuguguucgacucagccuca

SEQ ID NO: 2385442 - RNA, 21 nt, Human
cuguguucgacucagccucag

SEQ ID NO: 2385443 - RNA, 22 nt, Human
cuguguucgacucagccucagg

SEQ ID NO: 2385444 - RNA, 12 nt, Human
cuguguuccugg

SEQ ID NO: 2385445 - RNA, 13 nt, Human
cuguguuccuggc

SEQ ID NO: 2385446 - RNA, 18 nt, Human
cuguguucgacucagccu

SEQ ID NO: 2385447 - RNA, 14 nt, Human
cuguguguguguau

SEQ ID NO: 2385448 - RNA, 16 nt, Human
cuguguguguguaugu

SEQ ID NO: 2385449 - RNA, 15 nt, Human
cuguguguguguaug

SEQ ID NO: 2385450 - RNA, 20 nt, Human
cuguguguuuaugugugugu

SEQ ID NO: 2385451 - RNA, 18 nt, Human
cuguguguuuaugugugu

SEQ ID NO: 2385452 - RNA, 20 nt, Human
cuguguguguguaugugggg

SEQ ID NO: 2385453 - RNA, 18 nt, Human
cuguguguguguaugugg

SEQ ID NO: 2385454 - RNA, 17 nt, Human
cugugaugccacacaga

SEQ ID NO: 2385455 - RNA, 18 nt, Human
cugugaugcuuugaagua

SEQ ID NO: 2385456 - RNA, 16 nt, Human
cugugaugccacacag

SEQ ID NO: 2385457 - RNA, 14 nt, Human
cugugaugccacac

SEQ ID NO: 2385458 - RNA, 22 nt, Human
cugugaugaggggaggggggca

SEQ ID NO: 2385459 - RNA, 17 nt, Human
cugugaugauccucaua

SEQ ID NO: 2385460 - RNA, 15 nt, Human
cugugauggggcccu

SEQ ID NO: 2385461 - RNA, 12 nt, Human
cugugaggcugu

SEQ ID NO: 2385462 - RNA, 17 nt, Human
cugugaggccccuggac

SEQ ID NO: 2385463 - RNA, 18 nt, Human
cugugaggccccuggaca

SEQ ID NO: 2385464 - RNA, 15 nt, Human
cugugaggcuguccu

SEQ ID NO: 2385465 - RNA, 16 nt, Human
cugugaggcuguccug

SEQ ID NO: 2385466 - RNA, 17 nt, Human
cugugaggcuguccugu

SEQ ID NO: 2385467 - RNA, 16 nt, Human
cugugauugugccuac

SEQ ID NO: 2385468 - RNA, 23 nt, Human
cugugauggggcccugccuccuu

SEQ ID NO: 2385469 - RNA, 16 nt, Human
cugugauggggcccug

SEQ ID NO: 2385470 - RNA, 21 nt, Human
cugugauggggcccugccucc

SEQ ID NO: 2385471 - RNA, 12 nt, Human
cugugagccuug

SEQ ID NO: 2385472 - RNA, 15 nt, Human
cugugagccuuggcu

SEQ ID NO: 2385473 - RNA, 14 nt, Human
cugugagccccugg

SEQ ID NO: 2385474 - RNA, 15 nt, Human
cugugagccccuggu

SEQ ID NO: 2385475 - RNA, 16 nt, Human
cugugagccccugguc

SEQ ID NO: 2385476 - RNA, 21 nt, Human
cugugagccccugguccugag

SEQ ID NO: 2385477 - RNA, 18 nt, Human
cugugaggcaggggcgga

SEQ ID NO: 2385478 - RNA, 15 nt, Human
cugugaggccccugg

SEQ ID NO: 2385479 - RNA, 14 nt, Human
cugugaggcagggg

SEQ ID NO: 2385480 - RNA, 13 nt, Human
cugugaggcaggg

SEQ ID NO: 2385481 - RNA, 17 nt, Human
cugugagccuuggcugu

SEQ ID NO: 2385482 - RNA, 18 nt, Human
cugugaacauggacucuu

SEQ ID NO: 2385483 - RNA, 16 nt, Human
cugugaacgauuuaga

SEQ ID NO: 2385484 - RNA, 15 nt, Human
cugugagcccagcug

SEQ ID NO: 2385485 - RNA, 13 nt, Human
cugugagccccug

SEQ ID NO: 2385486 - RNA, 17 nt, Human
cugugagcccagcuggg

SEQ ID NO: 2385487 - RNA, 23 nt, Human
cugugaaacuggcacugaauuaa

SEQ ID NO: 2385488 - RNA, 16 nt, Human
cugugaaaugcuggca

SEQ ID NO: 2385489 - RNA, 12 nt, Human
cugugaaauagu

SEQ ID NO: 2385490 - RNA, 15 nt, Human
cugugaaacuggcac

SEQ ID NO: 2385491 - RNA, 19 nt, Human
cugugaaaaaaaaaaugcu

SEQ ID NO: 2385492 - RNA, 18 nt, Human
cugugaaaguacauuugg

SEQ ID NO: 2385493 - RNA, 16 nt, Human
cugugaaaggaaagag

SEQ ID NO: 2385494 - RNA, 22 nt, Human
cugugaaaggaaagagggaggu

SEQ ID NO: 2385495 - RNA, 14 nt, Human
cugugcagccccgc

SEQ ID NO: 2385496 - RNA, 22 nt, Human
cugugcagccccgccuccaggc

SEQ ID NO: 2385497 - RNA, 17 nt, Human
cugugcagccgcugagc

SEQ ID NO: 2385498 - RNA, 16 nt, Human
cugugcagccgcugag

SEQ ID NO: 2385499 - RNA, 13 nt, Human
cugugcagggagg

SEQ ID NO: 2385500 - RNA, 23 nt, Human
cugugcagccuguccugggcugg

SEQ ID NO: 2385501 - RNA, 21 nt, Human
cugugcagccgcugagcgagg

SEQ ID NO: 2385502 - RNA, 19 nt, Human
cugugcagccgcugagcga

SEQ ID NO: 2385503 - RNA, 22 nt, Human
cugugauuccacuacaccuggc

SEQ ID NO: 2385504 - RNA, 16 nt, Human
cugugcaaauccuuga

SEQ ID NO: 2385505 - RNA, 21 nt, Human
cugugcacaucugugucuugu

SEQ ID NO: 2385506 - RNA, 18 nt, Human
cugugcacgcaguggccu

SEQ ID NO: 2385507 - RNA, 14 nt, Human
cugugcacugccca

SEQ ID NO: 2385508 - RNA, 14 nt, Human
cugugcaccaagca

SEQ ID NO: 2385509 - RNA, 12 nt, Human
cugugcacgcag

SEQ ID NO: 2385510 - RNA, 17 nt, Human
cugugcacgcaguggcc

SEQ ID NO: 2385511 - RNA, 22 nt, Human
cugugcagggaggagguggcag

SEQ ID NO: 2385512 - RNA, 15 nt, Human
cugugcagggaggag

SEQ ID NO: 2385513 - RNA, 16 nt, Human
cugugcagucacugga

SEQ ID NO: 2385514 - RNA, 18 nt, Human
cugugcagucacuggagg

SEQ ID NO: 2385515 - RNA, 23 nt, Human
cugugccacccugggcucugugg

SEQ ID NO: 2385516 - RNA, 21 nt, Human
cugugccacucaccgaagcca

SEQ ID NO: 2385517 - RNA, 14 nt, Human
cugugccaugugcc

SEQ ID NO: 2385518 - RNA, 17 nt, Human
cugugccccaugccugu

SEQ ID NO: 2385519 - RNA, 20 nt, Human
cugugcccaugggcacugcu

SEQ ID NO: 2385520 - RNA, 21 nt, Human
cugugcccaugggcacugcug

SEQ ID NO: 2385521 - RNA, 17 nt, Human
cugugcccagagauggg

SEQ ID NO: 2385522 - RNA, 13 nt, Human
cugugcccauggg

SEQ ID NO: 2385523 - RNA, 15 nt, Human
cugugcccaugggca

SEQ ID NO: 2385524 - RNA, 18 nt, Human
cugugcccaugggcacug

SEQ ID NO: 2385525 - RNA, 21 nt, Human
cugugccccaugccuguccag

SEQ ID NO: 2385526 - RNA, 19 nt, Human
cugugcccuaaaguguauu

SEQ ID NO: 2385527 - RNA, 12 nt, Human
cugugcccaugg

SEQ ID NO: 2385528 - RNA, 23 nt, Human
cugugcccacaucccaggcuuca

SEQ ID NO: 2385529 - RNA, 19 nt, Human
cugugcccacaucccaggc

SEQ ID NO: 2385530 - RNA, 22 nt, Human
cugugcccacaucccaggcuuc

SEQ ID NO: 2385531 - RNA, 23 nt, Human
cugugcccacccuccacucuccu

SEQ ID NO: 2385532 - RNA, 17 nt, Human
cugugcccacccuccac

SEQ ID NO: 2385533 - RNA, 15 nt, Human
cugugccaugugcca

SEQ ID NO: 2385534 - RNA, 22 nt, Human
cugugccauuuuguauuuuacu

SEQ ID NO: 2385535 - RNA, 14 nt, Human
cugugcccaaguug

SEQ ID NO: 2385536 - RNA, 18 nt, Human
cugugcccacaucccagg

SEQ ID NO: 2385537 - RNA, 14 nt, Human
cugucugccagggc

SEQ ID NO: 2385538 - RNA, 21 nt, Human
cugucugccagccagcagcca

SEQ ID NO: 2385539 - RNA, 20 nt, Human
cugucugccagccagcagcc

SEQ ID NO: 2385540 - RNA, 17 nt, Human
cugucugccagccagca

SEQ ID NO: 2385541 - RNA, 16 nt, Human
cugucugccagccagc

SEQ ID NO: 2385542 - RNA, 15 nt, Human
cugucugccagccag

SEQ ID NO: 2385543 - RNA, 23 nt, Human
cugucauuugagcagggcucagc

SEQ ID NO: 2385544 - RNA, 14 nt, Human
cugucugccagcca

SEQ ID NO: 2385545 - RNA, 17 nt, Human
cugucugaucugugcuu

SEQ ID NO: 2385546 - RNA, 16 nt, Human
cugucugaucugugcu

SEQ ID NO: 2385547 - RNA, 21 nt, Human
cugucugaucugugcuuucca

SEQ ID NO: 2385548 - RNA, 21 nt, Human
cugucauuugagcagggcuca

SEQ ID NO: 2385549 - RNA, 22 nt, Human
cugucauuugagcagggcucag

SEQ ID NO: 2385550 - RNA, 18 nt, Human
cugucaauuacaggaagu

SEQ ID NO: 2385551 - RNA, 20 nt, Human
cugucauuugagcagggcuc

SEQ ID NO: 2385552 - RNA, 15 nt, Human
cugucuguuacacug

SEQ ID NO: 2385553 - RNA, 20 nt, Human
cugucugucucuccaucugu

SEQ ID NO: 2385554 - RNA, 16 nt, Human
cugucugucucuccau

SEQ ID NO: 2385555 - RNA, 16 nt, Human
cugucuguagagggcc

SEQ ID NO: 2385556 - RNA, 19 nt, Human
cugucuguagagggcccug

SEQ ID NO: 2385557 - RNA, 20 nt, Human
cugucuguagagggcccugg

SEQ ID NO: 2385558 - RNA, 22 nt, Human
cugucuguagagggcccuggug

SEQ ID NO: 2385559 - RNA, 23 nt, Human
cugucugguggccccguuucugg

SEQ ID NO: 2385560 - RNA, 23 nt, Human
cugucugguuucaccgaggacau

SEQ ID NO: 2385561 - RNA, 16 nt, Human
cugucugguuuuaaca

SEQ ID NO: 2385562 - RNA, 17 nt, Human
cugucugguuuuaacaa

SEQ ID NO: 2385563 - RNA, 18 nt, Human
cugucugguuuuaacaau

SEQ ID NO: 2385564 - RNA, 14 nt, Human
cugucuguaccuaa

SEQ ID NO: 2385565 - RNA, 15 nt, Human
cugucugcucagaca

SEQ ID NO: 2385566 - RNA, 20 nt, Human
cugucuggcugaggauuuca

SEQ ID NO: 2385567 - RNA, 15 nt, Human
cugucuggccaggcc

SEQ ID NO: 2385568 - RNA, 13 nt, Human
cugucugguggcc

SEQ ID NO: 2385569 - RNA, 15 nt, Human
cugucugguggcccc

SEQ ID NO: 2385570 - RNA, 16 nt, Human
cugucuuuaaggaaaa

SEQ ID NO: 2385571 - RNA, 15 nt, Human
cugucuuucagauac

SEQ ID NO: 2385572 - RNA, 20 nt, Human
cugucuuucagauacauggu

SEQ ID NO: 2385573 - RNA, 16 nt, Human
cugucuuucagauaca

SEQ ID NO: 2385574 - RNA, 14 nt, Human
cugucuuuccuaga

SEQ ID NO: 2385575 - RNA, 13 nt, Human
cugucuuuccuag

SEQ ID NO: 2385576 - RNA, 11 nt, Human
cugucuuuccu

SEQ ID NO: 2385577 - RNA, 21 nt, Human
cugucuucuucaggguccuga

SEQ ID NO: 2385578 - RNA, 21 nt, Human
cugucuuuuuucuaaaguaaa

SEQ ID NO: 2385579 - RNA, 15 nt, Human
cugugaaaggaaaga

SEQ ID NO: 2385580 - RNA, 23 nt, Human
cugucuuucugagcacacuuuag

SEQ ID NO: 2385581 - RNA, 20 nt, Human
cugucuuuccuagauggcag

SEQ ID NO: 2385582 - RNA, 18 nt, Human
cugucuucaguaagccgu

SEQ ID NO: 2385583 - RNA, 19 nt, Human
cugucuucacagcucugug

SEQ ID NO: 2385584 - RNA, 14 nt, Human
cugucuucaagggc

SEQ ID NO: 2385585 - RNA, 17 nt, Human
cugucuucaacagcucc

SEQ ID NO: 2385586 - RNA, 16 nt, Human
cugucuguuacacugg

SEQ ID NO: 2385587 - RNA, 18 nt, Human
cugucuguuacacuggag

SEQ ID NO: 2385588 - RNA, 18 nt, Human
cugucuucacaacagauu

SEQ ID NO: 2385589 - RNA, 23 nt, Human
cugucuucacagcucuguguugc

SEQ ID NO: 2385590 - RNA, 15 nt, Human
cugucuucaagggcu

SEQ ID NO: 2385591 - RNA, 17 nt, Human
cugucuucaccugauuc

SEQ ID NO: 2385592 - RNA, 19 nt, Human
cugucuucauagcagauuu

SEQ ID NO: 2385593 - RNA, 22 nt, Human
cugucuucaccugauucaacua

SEQ ID NO: 2385594 - RNA, 18 nt, Human
cugucuucaccugauuca

SEQ ID NO: 2385595 - RNA, 22 nt, Human
cugucuucauagcagauuuuaa

SEQ ID NO: 2385596 - RNA, 11 nt, Human
cugucuuccca

SEQ ID NO: 2385597 - RNA, 12 nt, Human
cugucuucccag

SEQ ID NO: 2385598 - RNA, 13 nt, Human
cugucuucccagg

SEQ ID NO: 2385599 - RNA, 14 nt, Human
cugucuucccaggg

SEQ ID NO: 2385600 - RNA, 18 nt, Human
cugucuuccugcauucac

SEQ ID NO: 2385601 - RNA, 15 nt, Human
cugucuucccagggu

SEQ ID NO: 2385602 - RNA, 16 nt, Human
cugucuucccagggua

SEQ ID NO: 2385603 - RNA, 23 nt, Human
cugucuucccaggguagcccgcc

SEQ ID NO: 2385604 - RNA, 17 nt, Human
cugucuucucaggcucu

SEQ ID NO: 2385605 - RNA, 16 nt, Human
cugucuuccugcauuc

SEQ ID NO: 2385606 - RNA, 14 nt, Human
cugucuuccugcau

SEQ ID NO: 2385607 - RNA, 18 nt, Human
cugucuucccaggguagc

SEQ ID NO: 2385608 - RNA, 13 nt, Human
cuucacaguguuu

SEQ ID NO: 2385609 - RNA, 12 nt, Human
cuucacaguguu

SEQ ID NO: 2385610 - RNA, 17 nt, Human
cuucacacacaggcaac

SEQ ID NO: 2385611 - RNA, 16 nt, Human
cuucacacacaggcaa

SEQ ID NO: 2385612 - RNA, 23 nt, Human
cuucacaaagcccaagggaucug

SEQ ID NO: 2385613 - RNA, 15 nt, Human
cuucacaaauucuca

SEQ ID NO: 2385614 - RNA, 14 nt, Human
cuucacaacagauu

SEQ ID NO: 2385615 - RNA, 12 nt, Human
cuucacaacaga

SEQ ID NO: 2385616 - RNA, 17 nt, Human
cuucacaaagcccaagg

SEQ ID NO: 2385617 - RNA, 15 nt, Human
cuucacaaagcccaa

SEQ ID NO: 2385618 - RNA, 14 nt, Human
cuucacaaagccca

SEQ ID NO: 2385619 - RNA, 23 nt, Human
cuucaaggauccugagccagauu

SEQ ID NO: 2385620 - RNA, 21 nt, Human
cuucaaggauccugagccaga

SEQ ID NO: 2385621 - RNA, 22 nt, Human
cuucaaggauccugagccagau

SEQ ID NO: 2385622 - RNA, 17 nt, Human
cuucagaucagugcuug

SEQ ID NO: 2385623 - RNA, 15 nt, Human
cuucagaucagugcu

SEQ ID NO: 2385624 - RNA, 18 nt, Human
cuucagauggaaacucuu

SEQ ID NO: 2385625 - RNA, 20 nt, Human
cuucagaucagugcuugagu

SEQ ID NO: 2385626 - RNA, 18 nt, Human
cuucagauuuguguuaua

SEQ ID NO: 2385627 - RNA, 12 nt, Human
cuucagagcagg

SEQ ID NO: 2385628 - RNA, 22 nt, Human
cuucagagagcugguaguuagu

SEQ ID NO: 2385629 - RNA, 16 nt, Human
cuucagagagcuggua

SEQ ID NO: 2385630 - RNA, 15 nt, Human
cuucagagagcuggu

SEQ ID NO: 2385631 - RNA, 14 nt, Human
cuucagagagcugg

SEQ ID NO: 2385632 - RNA, 23 nt, Human
cuucagaggcccucgcugccagc

SEQ ID NO: 2385633 - RNA, 21 nt, Human
cuucagaggcccucgcugcca

SEQ ID NO: 2385634 - RNA, 12 nt, Human
cuucagagcuga

SEQ ID NO: 2385635 - RNA, 14 nt, Human
cuucagagcugaca

SEQ ID NO: 2385636 - RNA, 18 nt, Human
cuucagagcugacacagg

SEQ ID NO: 2385637 - RNA, 20 nt, Human
cuucagagcugacacaggau

SEQ ID NO: 2385638 - RNA, 20 nt, Human
cuucacauccuguguuucua

SEQ ID NO: 2385639 - RNA, 13 nt, Human
cuucacauaguuu

SEQ ID NO: 2385640 - RNA, 14 nt, Human
cuucacauaguuuu

SEQ ID NO: 2385641 - RNA, 14 nt, Human
cuucacaguguuuc

SEQ ID NO: 2385642 - RNA, 20 nt, Human
cuucacauaagcucagaauc

SEQ ID NO: 2385643 - RNA, 22 nt, Human
cuucacauaagcucagaaucca

SEQ ID NO: 2385644 - RNA, 17 nt, Human
cuucacauacccucccc

SEQ ID NO: 2385645 - RNA, 21 nt, Human
cuucacauccuguguuucuag

SEQ ID NO: 2385646 - RNA, 11 nt, Human
cuucagagagc

SEQ ID NO: 2385647 - RNA, 23 nt, Human
cuucacauauugauuuccguuaa

SEQ ID NO: 2385648 - RNA, 14 nt, Human
cuucacauauugau

SEQ ID NO: 2385649 - RNA, 20 nt, Human
cuucaacugaccagccucca

SEQ ID NO: 2385650 - RNA, 23 nt, Human
cuucaacugaccagccuccaugc

SEQ ID NO: 2385651 - RNA, 17 nt, Human
cuucaacugaccagccu

SEQ ID NO: 2385652 - RNA, 23 nt, Human
cuucaacagacccccucuagaaa

SEQ ID NO: 2385653 - RNA, 16 nt, Human
cuucaacucccugccc

SEQ ID NO: 2385654 - RNA, 18 nt, Human
cuucaagaacucugggcu

SEQ ID NO: 2385655 - RNA, 17 nt, Human
cuucaagaccuucacca

SEQ ID NO: 2385656 - RNA, 18 nt, Human
cuucaagaucauguaccc

SEQ ID NO: 2385657 - RNA, 17 nt, Human
cuucaaggauccugagc

SEQ ID NO: 2385658 - RNA, 18 nt, Human
cuucaaggauccugagcc

SEQ ID NO: 2385659 - RNA, 19 nt, Human
cuucaaggauccugagcca

SEQ ID NO: 2385660 - RNA, 20 nt, Human
cuucaaggauccugagccag

SEQ ID NO: 2385661 - RNA, 15 nt, Human
cuucaaauauuuccc

SEQ ID NO: 2385662 - RNA, 17 nt, Human
cuucaaauccuugaaga

SEQ ID NO: 2385663 - RNA, 13 nt, Human
cuucaaauuagaa

SEQ ID NO: 2385664 - RNA, 19 nt, Human
cuucaaauuagaagacauu

SEQ ID NO: 2385665 - RNA, 17 nt, Human
cuucaaauccauccaga

SEQ ID NO: 2385666 - RNA, 23 nt, Human
cuuagucacugccugcagagguc

SEQ ID NO: 2385667 - RNA, 14 nt, Human
cuucaaauccaucc

SEQ ID NO: 2385668 - RNA, 16 nt, Human
cuucaaauccauccag

SEQ ID NO: 2385669 - RNA, 21 nt, Human
cuuagucacugagacagcccg

SEQ ID NO: 2385670 - RNA, 20 nt, Human
cuuagucacugagacagccc

SEQ ID NO: 2385671 - RNA, 23 nt, Human
cuuaguaaugcuacgugugauuu

SEQ ID NO: 2385672 - RNA, 13 nt, Human
cuuagucacugcc

SEQ ID NO: 2385673 - RNA, 14 nt, Human
cuuagucacugccu

SEQ ID NO: 2385674 - RNA, 15 nt, Human
cuuagucacugccug

SEQ ID NO: 2385675 - RNA, 16 nt, Human
cuuagucacugccugc

SEQ ID NO: 2385676 - RNA, 17 nt, Human
cuuagucacugccugca

SEQ ID NO: 2385677 - RNA, 22 nt, Human
cuuagucacugagacagcccgg

SEQ ID NO: 2385678 - RNA, 18 nt, Human
cuucaggucaggaguucg

SEQ ID NO: 2385679 - RNA, 16 nt, Human
cuucaggagggagcau

SEQ ID NO: 2385680 - RNA, 13 nt, Human
cuucagcuucuuc

SEQ ID NO: 2385681 - RNA, 19 nt, Human
cuucagcuguacuucgucu

SEQ ID NO: 2385682 - RNA, 18 nt, Human
cuucagcuucuucaucuu

SEQ ID NO: 2385683 - RNA, 16 nt, Human
cuucagguggaaaaac

SEQ ID NO: 2385684 - RNA, 20 nt, Human
cuucagguuaucgaaauaac

SEQ ID NO: 2385685 - RNA, 21 nt, Human
cuucagguuaucgaaauaaca

SEQ ID NO: 2385686 - RNA, 22 nt, Human
cuucagguuaucgaaauaacaa

SEQ ID NO: 2385687 - RNA, 14 nt, Human
cuucaguaagccgu

SEQ ID NO: 2385688 - RNA, 22 nt, Human
cuucagccugaggcugagacug

SEQ ID NO: 2385689 - RNA, 20 nt, Human
cuucagccugaggcugagac

SEQ ID NO: 2385690 - RNA, 16 nt, Human
cuucagccugaggcug

SEQ ID NO: 2385691 - RNA, 15 nt, Human
cuucagccugaggcu

SEQ ID NO: 2385692 - RNA, 16 nt, Human
cuucagcgguuuauau

SEQ ID NO: 2385693 - RNA, 19 nt, Human
cuucagcugacuuuucugu

SEQ ID NO: 2385694 - RNA, 15 nt, Human
cuucagcugacuuuu

SEQ ID NO: 2385695 - RNA, 16 nt, Human
cuucagccucccgagu

SEQ ID NO: 2385696 - RNA, 20 nt, Human
cuucagccucccgaguagcu

SEQ ID NO: 2385697 - RNA, 14 nt, Human
cuucagccugaggc

SEQ ID NO: 2385698 - RNA, 20 nt, Human
cuucagccucuuucuguccc

SEQ ID NO: 2385699 - RNA, 20 nt, Human
cuucagccuccccaccuucu

SEQ ID NO: 2385700 - RNA, 15 nt, Human
cuucagccugaaaga

SEQ ID NO: 2385701 - RNA, 14 nt, Human
cuucagccucccga

SEQ ID NO: 2385702 - RNA, 18 nt, Human
cuucagcauauuuauagc

SEQ ID NO: 2385703 - RNA, 21 nt, Human
cuucagcaguaccuauaaagu

SEQ ID NO: 2385704 - RNA, 22 nt, Human
cuucaguauguugucaaagaga

SEQ ID NO: 2385705 - RNA, 19 nt, Human
cuucagguucuuaguguca

SEQ ID NO: 2385706 - RNA, 15 nt, Human
cuucagguucuuagu

SEQ ID NO: 2385707 - RNA, 15 nt, Human
cuucaguaagccgug

SEQ ID NO: 2385708 - RNA, 14 nt, Human
cuucagugccaaaa

SEQ ID NO: 2385709 - RNA, 23 nt, Human
cuucaguauguugucaaagagag

SEQ ID NO: 2385710 - RNA, 19 nt, Human
cuucagugcaucugggaag

SEQ ID NO: 2385711 - RNA, 13 nt, Human
cuucagugcccac

SEQ ID NO: 2385712 - RNA, 11 nt, Human
cuucagugccc

SEQ ID NO: 2385713 - RNA, 15 nt, Human
cuucagugcccacca

SEQ ID NO: 2385714 - RNA, 23 nt, Human
cuucauggaugggggaacucaga

SEQ ID NO: 2385715 - RNA, 21 nt, Human
cuucauggcagaaggcaaacc

SEQ ID NO: 2385716 - RNA, 15 nt, Human
cuucauggcagaagg

SEQ ID NO: 2385717 - RNA, 20 nt, Human
cuucauuaagcccucuucca

SEQ ID NO: 2385718 - RNA, 16 nt, Human
cuucauuaauaauaaa

SEQ ID NO: 2385719 - RNA, 20 nt, Human
cuucaugucaacuucuggcu

SEQ ID NO: 2385720 - RNA, 23 nt, Human
cuucaugucaacuucuggcuccu

SEQ ID NO: 2385721 - RNA, 13 nt, Human
cuucauuuuuccu

SEQ ID NO: 2385722 - RNA, 14 nt, Human
cuucauuuuuccua

SEQ ID NO: 2385723 - RNA, 16 nt, Human
cuucauuuuuccuaac

SEQ ID NO: 2385724 - RNA, 17 nt, Human
cuucauuuuuccuaaca

SEQ ID NO: 2385725 - RNA, 17 nt, Human
cuucauuaauaauaaau

SEQ ID NO: 2385726 - RNA, 20 nt, Human
cuucauuaccuuuuuugaua

SEQ ID NO: 2385727 - RNA, 15 nt, Human
cuucauuagagcagg

SEQ ID NO: 2385728 - RNA, 24 nt, Human
cuucauuugggaugcuacucuagu

SEQ ID NO: 2385729 - RNA, 16 nt, Human
cuucauuagagcaggc

SEQ ID NO: 2385730 - RNA, 11 nt, Human
cuucauuugug

SEQ ID NO: 2385731 - RNA, 13 nt, Human
cuucauuuguguc

SEQ ID NO: 2385732 - RNA, 14 nt, Human
cuucauuuguguca

SEQ ID NO: 2385733 - RNA, 18 nt, Human
cuucauuugugucaaugg

SEQ ID NO: 2385734 - RNA, 13 nt, Human
cuuccaaagcaca

SEQ ID NO: 2385735 - RNA, 13 nt, Human
cuuccacaagagc

SEQ ID NO: 2385736 - RNA, 14 nt, Human
cuuccacaagagcc

SEQ ID NO: 2385737 - RNA, 15 nt, Human
cuuccacaagagccc

SEQ ID NO: 2385738 - RNA, 15 nt, Human
cuucucauccugcag

SEQ ID NO: 2385739 - RNA, 16 nt, Human
cuucucauccugcagg

SEQ ID NO: 2385740 - RNA, 17 nt, Human
cuucucauccugcaggc

SEQ ID NO: 2385741 - RNA, 12 nt, Human
cuucucaucugu

SEQ ID NO: 2385742 - RNA, 13 nt, Human
cuucucaucacuc

SEQ ID NO: 2385743 - RNA, 18 nt, Human
cuucucaucacuccccuc

SEQ ID NO: 2385744 - RNA, 14 nt, Human
cuucucaugaucca

SEQ ID NO: 2385745 - RNA, 14 nt, Human
cuucucauuucacc

SEQ ID NO: 2385746 - RNA, 20 nt, Human
cuucucauuccaacagugag

SEQ ID NO: 2385747 - RNA, 21 nt, Human
cuucucauuccaacagugagu

SEQ ID NO: 2385748 - RNA, 15 nt, Human
cuucucauuucaccc

SEQ ID NO: 2385749 - RNA, 17 nt, Human
cuucucauuucaccccu

SEQ ID NO: 2385750 - RNA, 21 nt, Human
cuucucacugccaugccagcu

SEQ ID NO: 2385751 - RNA, 22 nt, Human
cuucucagaaggcaaaugacuu

SEQ ID NO: 2385752 - RNA, 13 nt, Human
cuucucagaaucu

SEQ ID NO: 2385753 - RNA, 16 nt, Human
cuucucagaaggcaaa

SEQ ID NO: 2385754 - RNA, 23 nt, Human
cuucgugggaucugccccucccu

SEQ ID NO: 2385755 - RNA, 16 nt, Human
cuucucacugccaugc

SEQ ID NO: 2385756 - RNA, 18 nt, Human
cuucggggaacuccugga

SEQ ID NO: 2385757 - RNA, 16 nt, Human
cuucgggcugugcccg

SEQ ID NO: 2385758 - RNA, 19 nt, Human
cuucggggaacuccuggaa

SEQ ID NO: 2385759 - RNA, 12 nt, Human
cuucguacaguu

SEQ ID NO: 2385760 - RNA, 13 nt, Human
cuucguacaguuc

SEQ ID NO: 2385761 - RNA, 22 nt, Human
cuucgucuuucccauggggagg

SEQ ID NO: 2385762 - RNA, 21 nt, Human
cuucgugcggaaucagcuucu

SEQ ID NO: 2385763 - RNA, 21 nt, Human
cuucgugggaucugccccucc

SEQ ID NO: 2385764 - RNA, 22 nt, Human
cuucgugggaucugccccuccc

SEQ ID NO: 2385765 - RNA, 14 nt, Human
cuucgucuuuccca

SEQ ID NO: 2385766 - RNA, 21 nt, Human
cuucgucuuucccauggggag

SEQ ID NO: 2385767 - RNA, 14 nt, Human
cuucguacaguucu

SEQ ID NO: 2385768 - RNA, 16 nt, Human
cuucguacaguucuuc

SEQ ID NO: 2385769 - RNA, 23 nt, Human
cuucguacaguucuucgggaaga

SEQ ID NO: 2385770 - RNA, 19 nt, Human
cuucggaaaccuuggugua

SEQ ID NO: 2385771 - RNA, 22 nt, Human
cuucgcgguggaaggcccgagg

SEQ ID NO: 2385772 - RNA, 20 nt, Human
cuucggccuccauccugagg

SEQ ID NO: 2385773 - RNA, 19 nt, Human
cuucgggaggucgaggcag

SEQ ID NO: 2385774 - RNA, 15 nt, Human
cuucgggaagagagg

SEQ ID NO: 2385775 - RNA, 17 nt, Human
cuucgggaagagaggag

SEQ ID NO: 2385776 - RNA, 18 nt, Human
cuucgggaagagaggagu

SEQ ID NO: 2385777 - RNA, 21 nt, Human
cuucgggaagagaggaguuca

SEQ ID NO: 2385778 - RNA, 22 nt, Human
cuucgggaagagaggaguucaa

SEQ ID NO: 2385779 - RNA, 23 nt, Human
cuucgggaagagaggaguucaau

SEQ ID NO: 2385780 - RNA, 15 nt, Human
cuuccuucaccucug

SEQ ID NO: 2385781 - RNA, 21 nt, Human
cuuccuuaauucacucccaca

SEQ ID NO: 2385782 - RNA, 14 nt, Human
cuuccuguucugaa

SEQ ID NO: 2385783 - RNA, 19 nt, Human
cuuccuuaauucacuccca

SEQ ID NO: 2385784 - RNA, 23 nt, Human
cuuccuguuuuucacauuuuccu

SEQ ID NO: 2385785 - RNA, 23 nt, Human
cuuccuguguguccaaaacugcc

SEQ ID NO: 2385786 - RNA, 15 nt, Human
cuuccugugugucca

SEQ ID NO: 2385787 - RNA, 18 nt, Human
cuuccuguuuuucacauu

SEQ ID NO: 2385788 - RNA, 17 nt, Human
cuuccuguuuuucacau

SEQ ID NO: 2385789 - RNA, 16 nt, Human
cuuccuguuuuucaca

SEQ ID NO: 2385790 - RNA, 16 nt, Human
cuuccuguuugggccc

SEQ ID NO: 2385791 - RNA, 13 nt, Human
cuuccuuggcuuu

SEQ ID NO: 2385792 - RNA, 19 nt, Human
cuuccuuggcaucacaggg

SEQ ID NO: 2385793 - RNA, 12 nt, Human
cuuccuucccac

SEQ ID NO: 2385794 - RNA, 13 nt, Human
cuuccuucccacc

SEQ ID NO: 2385795 - RNA, 16 nt, Human
cuuccuucauuuccuc

SEQ ID NO: 2385796 - RNA, 15 nt, Human
cuuccuucauuuccu

SEQ ID NO: 2385797 - RNA, 13 nt, Human
cuuccuucauuuc

SEQ ID NO: 2385798 - RNA, 22 nt, Human
cuuccuuuguuuuuuuuuccug

SEQ ID NO: 2385799 - RNA, 18 nt, Human
cuuccuuucuuucucucu

SEQ ID NO: 2385800 - RNA, 21 nt, Human
cuuccuuuuagccuaguucau

SEQ ID NO: 2385801 - RNA, 17 nt, Human
cuuccuuuuaucaguag

SEQ ID NO: 2385802 - RNA, 21 nt, Human
cuucgauacaccgggccugga

SEQ ID NO: 2385803 - RNA, 16 nt, Human
cuucgauacaccgggc

SEQ ID NO: 2385804 - RNA, 14 nt, Human
cuucgccaccuggg

SEQ ID NO: 2385805 - RNA, 20 nt, Human
cuucgcaucaaaagacaauu

SEQ ID NO: 2385806 - RNA, 21 nt, Human
cuucgcaucaaaagacaauuc

SEQ ID NO: 2385807 - RNA, 22 nt, Human
cuucgcaucaaaagacaauucu

SEQ ID NO: 2385808 - RNA, 23 nt, Human
cuucgcaucaaaagacaauucuu

SEQ ID NO: 2385809 - RNA, 14 nt, Human
cuuccuuuucccug

SEQ ID NO: 2385810 - RNA, 16 nt, Human
cuucgcaggcaugucc

SEQ ID NO: 2385811 - RNA, 15 nt, Human
cuucgcaucaaaaga

SEQ ID NO: 2385812 - RNA, 16 nt, Human
cuucgcaucaaaagac

SEQ ID NO: 2385813 - RNA, 17 nt, Human
cuucgcaucaaaagaca

SEQ ID NO: 2385814 - RNA, 19 nt, Human
cuucgcaucaaaagacaau

SEQ ID NO: 2385815 - RNA, 16 nt, Human
cuucgcuccugugucu

SEQ ID NO: 2385816 - RNA, 15 nt, Human
cuucgcuucuugccu

SEQ ID NO: 2385817 - RNA, 16 nt, Human
cuucgcuucuugccuc

SEQ ID NO: 2385818 - RNA, 17 nt, Human
cuucgcuucuugccucu

SEQ ID NO: 2385819 - RNA, 18 nt, Human
cuucgcuucuugccucug

SEQ ID NO: 2385820 - RNA, 20 nt, Human
cuucgcuucuugccucugug

SEQ ID NO: 2385821 - RNA, 21 nt, Human
cuucgcuucuugccucugugc

SEQ ID NO: 2385822 - RNA, 17 nt, Human
cuucgcuccugugucuu

SEQ ID NO: 2385823 - RNA, 19 nt, Human
cuucgcgugcccucgcugc

SEQ ID NO: 2385824 - RNA, 15 nt, Human
cuucgccaccugggu

SEQ ID NO: 2385825 - RNA, 15 nt, Human
cuucccauuguggcu

SEQ ID NO: 2385826 - RNA, 18 nt, Human
cuucccauuguggcuccu

SEQ ID NO: 2385827 - RNA, 23 nt, Human
cuucccaugacccaggcugggca

SEQ ID NO: 2385828 - RNA, 16 nt, Human
cuuccccaaauaauau

SEQ ID NO: 2385829 - RNA, 15 nt, Human
cuuccccacccucag

SEQ ID NO: 2385830 - RNA, 11 nt, Human
cuuccccacug

SEQ ID NO: 2385831 - RNA, 18 nt, Human
cuuccccacugcacacac

SEQ ID NO: 2385832 - RNA, 19 nt, Human
cuuccccagaaaggagacu

SEQ ID NO: 2385833 - RNA, 22 nt, Human
cuuccccacugccugcccaccc

SEQ ID NO: 2385834 - RNA, 20 nt, Human
cuuccccacugccugcccac

SEQ ID NO: 2385835 - RNA, 19 nt, Human
cuuccccacugccugccca

SEQ ID NO: 2385836 - RNA, 16 nt, Human
cuuccccacugccugc

SEQ ID NO: 2385837 - RNA, 14 nt, Human
cuuccccacugccu

SEQ ID NO: 2385838 - RNA, 23 nt, Human
cuuccccacugcacacaccucag

SEQ ID NO: 2385839 - RNA, 21 nt, Human
cuuccacuuuuuuuuguaugu

SEQ ID NO: 2385840 - RNA, 15 nt, Human
cuuccagaaguguga

SEQ ID NO: 2385841 - RNA, 16 nt, Human
cuuccagaagugugau

SEQ ID NO: 2385842 - RNA, 17 nt, Human
cuuccagaagugugauu

SEQ ID NO: 2385843 - RNA, 16 nt, Human
cuuccagaaucccaag

SEQ ID NO: 2385844 - RNA, 17 nt, Human
cuuccagaaucccaaga

SEQ ID NO: 2385845 - RNA, 18 nt, Human
cuuccagagaguccucug

SEQ ID NO: 2385846 - RNA, 21 nt, Human
cuuccagagaguccucuggau

SEQ ID NO: 2385847 - RNA, 20 nt, Human
cuuccagagaguccucugga

SEQ ID NO: 2385848 - RNA, 20 nt, Human
cuuccacuuuuuuuuguaug

SEQ ID NO: 2385849 - RNA, 18 nt, Human
cuuccacugagggcaguc

SEQ ID NO: 2385850 - RNA, 15 nt, Human
cuuccacugagggca

SEQ ID NO: 2385851 - RNA, 20 nt, Human
cuucccccgcaaugugcccc

SEQ ID NO: 2385852 - RNA, 13 nt, Human
cuucccuaccuca

SEQ ID NO: 2385853 - RNA, 16 nt, Human
cuucccuaccucaggc

SEQ ID NO: 2385854 - RNA, 15 nt, Human
cuucccuaccucagg

SEQ ID NO: 2385855 - RNA, 16 nt, Human
cuucccccucccaggg

SEQ ID NO: 2385856 - RNA, 15 nt, Human
cuucccccuccaauc

SEQ ID NO: 2385857 - RNA, 23 nt, Human
cuucccuagaggguuccuguaga

SEQ ID NO: 2385858 - RNA, 20 nt, Human
cuucccuagaggguuccugu

SEQ ID NO: 2385859 - RNA, 21 nt, Human
cuucccuagcuuuagacccug

SEQ ID NO: 2385860 - RNA, 22 nt, Human
cuucccuagcuuuagacccugg

SEQ ID NO: 2385861 - RNA, 20 nt, Human
cuucccuaccucaggcagga

SEQ ID NO: 2385862 - RNA, 17 nt, Human
cuucccuaccucaggca

SEQ ID NO: 2385863 - RNA, 16 nt, Human
cuucccuaucuuugcc

SEQ ID NO: 2385864 - RNA, 18 nt, Human
cuucccuaucuuugccac

SEQ ID NO: 2385865 - RNA, 17 nt, Human
cuucccuaucuuugcca

SEQ ID NO: 2385866 - RNA, 12 nt, Human
cuuccccauggg

SEQ ID NO: 2385867 - RNA, 13 nt, Human
cuuccccauggga

SEQ ID NO: 2385868 - RNA, 14 nt, Human
cuuccccaugggaa

SEQ ID NO: 2385869 - RNA, 14 nt, Human
cuuccccagccucu

SEQ ID NO: 2385870 - RNA, 13 nt, Human
cuuccccagccuc

SEQ ID NO: 2385871 - RNA, 14 nt, Human
cuuccccagcgucc

SEQ ID NO: 2385872 - RNA, 18 nt, Human
cuuccccaucuucuaaac

SEQ ID NO: 2385873 - RNA, 16 nt, Human
cuucccccauagccac

SEQ ID NO: 2385874 - RNA, 15 nt, Human
cuucccccauagcca

SEQ ID NO: 2385875 - RNA, 14 nt, Human
cuucccccauagcc

SEQ ID NO: 2385876 - RNA, 18 nt, Human
cuucccccauagccaccc

SEQ ID NO: 2385877 - RNA, 12 nt, Human
cuucccccucca

SEQ ID NO: 2385878 - RNA, 16 nt, Human
cuuccugugacuucag

SEQ ID NO: 2385879 - RNA, 20 nt, Human
cuuccugucuuccugcauuc

SEQ ID NO: 2385880 - RNA, 21 nt, Human
cuuccugucccaccucuucuc

SEQ ID NO: 2385881 - RNA, 13 nt, Human
cuuccugugacuu

SEQ ID NO: 2385882 - RNA, 18 nt, Human
cuuccuguccagcuccaa

SEQ ID NO: 2385883 - RNA, 17 nt, Human
cuuccugucccaccucu

SEQ ID NO: 2385884 - RNA, 22 nt, Human
cuuccugucccaccucuucucu

SEQ ID NO: 2385885 - RNA, 22 nt, Human
cuuccuggagacugcccagcua

SEQ ID NO: 2385886 - RNA, 14 nt, Human
cuuccuggagacug

SEQ ID NO: 2385887 - RNA, 15 nt, Human
cuuccugcguccucc

SEQ ID NO: 2385888 - RNA, 19 nt, Human
cuuccugcccuacagaggu

SEQ ID NO: 2385889 - RNA, 16 nt, Human
cuuccugcguccuccu

SEQ ID NO: 2385890 - RNA, 17 nt, Human
cuuccugcccuacagag

SEQ ID NO: 2385891 - RNA, 14 nt, Human
cuuccucacuucca

SEQ ID NO: 2385892 - RNA, 16 nt, Human
cuuccucacugcccaa

SEQ ID NO: 2385893 - RNA, 13 nt, Human
cuuccucacuucc

SEQ ID NO: 2385894 - RNA, 21 nt, Human
cuuccugcguccuccucaccu

SEQ ID NO: 2385895 - RNA, 18 nt, Human
cuuccugcguccuccuca

SEQ ID NO: 2385896 - RNA, 20 nt, Human
cuuccugcguccuccucacc

SEQ ID NO: 2385897 - RNA, 18 nt, Human
cuuccuauaugcacuuau

SEQ ID NO: 2385898 - RNA, 22 nt, Human
cuuccuaguuuucuccucccag

SEQ ID NO: 2385899 - RNA, 13 nt, Human
cuuccucacugcc

SEQ ID NO: 2385900 - RNA, 18 nt, Human
cuucccugggcugugcua

SEQ ID NO: 2385901 - RNA, 23 nt, Human
cuuccuaguuuucuccucccagg

SEQ ID NO: 2385902 - RNA, 17 nt, Human
cuuccuaguuuucuccu

SEQ ID NO: 2385903 - RNA, 15 nt, Human
cuuccuaguuuucuc

SEQ ID NO: 2385904 - RNA, 12 nt, Human
cuucccuggcuu

SEQ ID NO: 2385905 - RNA, 12 nt, Human
cuucccugggcu

SEQ ID NO: 2385906 - RNA, 13 nt, Human
cuucccugggcug

SEQ ID NO: 2385907 - RNA, 17 nt, Human
cuucccugggcugugcu

SEQ ID NO: 2385908 - RNA, 11 nt, Human
cuucccuggcu

SEQ ID NO: 2385909 - RNA, 10 nt, Human
cuucccuggc

SEQ ID NO: 2385910 - RNA, 14 nt, Human
cuucccugacucau

SEQ ID NO: 2385911 - RNA, 23 nt, Human
cuucccuagcuuuagacccuggg

SEQ ID NO: 2385912 - RNA, 23 nt, Human
cuucccuaucuuugccacccuca

SEQ ID NO: 2385913 - RNA, 22 nt, Human
cuucccuaucuuugccacccuc

SEQ ID NO: 2385914 - RNA, 20 nt, Human
cuucccugacucauucugaa

SEQ ID NO: 2385915 - RNA, 13 nt, Human
cuucccugacuca

SEQ ID NO: 2385916 - RNA, 18 nt, Human
cuguuugucuucucccca

SEQ ID NO: 2385917 - RNA, 22 nt, Human
cuguuuuacaaaaaagaaaaga

SEQ ID NO: 2385918 - RNA, 14 nt, Human
cuguuuuauaauuu

SEQ ID NO: 2385919 - RNA, 12 nt, Human
cuguuuguuaug

SEQ ID NO: 2385920 - RNA, 16 nt, Human
cuguuugucuucuccc

SEQ ID NO: 2385921 - RNA, 17 nt, Human
cuguuugucuucucccc

SEQ ID NO: 2385922 - RNA, 11 nt, Human
cuguuugucau

SEQ ID NO: 2385923 - RNA, 20 nt, Human
cuguuugggccccucuccca

SEQ ID NO: 2385924 - RNA, 16 nt, Human
cuguuugggccccucu

SEQ ID NO: 2385925 - RNA, 18 nt, Human
cuguuuuagguuaaaaaa

SEQ ID NO: 2385926 - RNA, 15 nt, Human
cuguuuuauaauuuu

SEQ ID NO: 2385927 - RNA, 13 nt, Human
cuguuuucccuga

SEQ ID NO: 2385928 - RNA, 16 nt, Human
cuguuuuccucccuuc

SEQ ID NO: 2385929 - RNA, 15 nt, Human
cuguuuuccucccuu

SEQ ID NO: 2385930 - RNA, 14 nt, Human
cuguuuuccucccu

SEQ ID NO: 2385931 - RNA, 12 nt, Human
cuguuuuccucc

SEQ ID NO: 2385932 - RNA, 23 nt, Human
cuguuuuccucccuucugcuacu

SEQ ID NO: 2385933 - RNA, 14 nt, Human
cuguuuuccuuucu

SEQ ID NO: 2385934 - RNA, 16 nt, Human
cuguuuuccuuucuca

SEQ ID NO: 2385935 - RNA, 18 nt, Human
cuguuuuccuuucucacc

SEQ ID NO: 2385936 - RNA, 21 nt, Human
cuguuuuccucccuucugcua

SEQ ID NO: 2385937 - RNA, 20 nt, Human
cuguuuuccucccuucugcu

SEQ ID NO: 2385938 - RNA, 19 nt, Human
cuguuuuccucccuucugc

SEQ ID NO: 2385939 - RNA, 17 nt, Human
cuguuuuccucccuucu

SEQ ID NO: 2385940 - RNA, 16 nt, Human
cuguuuuuaagcuguu

SEQ ID NO: 2385941 - RNA, 17 nt, Human
cuguuuuuaagcuguuu

SEQ ID NO: 2385942 - RNA, 18 nt, Human
cuguuuuuaagcuguuuc

SEQ ID NO: 2385943 - RNA, 19 nt, Human
cuguuuuuaagcuguuucc

SEQ ID NO: 2385944 - RNA, 23 nt, Human
cuguuuuuaagcuguuuccauag

SEQ ID NO: 2385945 - RNA, 13 nt, Human
cuguuuuuaccca

SEQ ID NO: 2385946 - RNA, 22 nt, Human
cuguuuuuacccauauccccuc

SEQ ID NO: 2385947 - RNA, 15 nt, Human
cuguuuuuaagcugu

SEQ ID NO: 2385948 - RNA, 17 nt, Human
cuguuuuuaaaaaucau

SEQ ID NO: 2385949 - RNA, 23 nt, Human
cuguuuuccuuucucaccgcagu

SEQ ID NO: 2385950 - RNA, 21 nt, Human
cuguuuucucucggcucccca

SEQ ID NO: 2385951 - RNA, 17 nt, Human
cuuaaaaaguggaaaaa

SEQ ID NO: 2385952 - RNA, 16 nt, Human
cuuaaaaaguggaaaa

SEQ ID NO: 2385953 - RNA, 17 nt, Human
cuguuuuucagggaggu

SEQ ID NO: 2385954 - RNA, 15 nt, Human
cuguuuuucacauuu

SEQ ID NO: 2385955 - RNA, 13 nt, Human
cuguuuuucacau

SEQ ID NO: 2385956 - RNA, 12 nt, Human
cuguuuuucaca

SEQ ID NO: 2385957 - RNA, 15 nt, Human
cuguuuuuacccaua

SEQ ID NO: 2385958 - RNA, 20 nt, Human
cuguuuuuacccauaucccc

SEQ ID NO: 2385959 - RNA, 17 nt, Human
cuguugccagagaugga

SEQ ID NO: 2385960 - RNA, 13 nt, Human
cuguugccagaga

SEQ ID NO: 2385961 - RNA, 17 nt, Human
cuguugcccaggcuggc

SEQ ID NO: 2385962 - RNA, 17 nt, Human
cuguuuagauaauacac

SEQ ID NO: 2385963 - RNA, 14 nt, Human
cuguuuagauaaua

SEQ ID NO: 2385964 - RNA, 18 nt, Human
cuguuuagauaauacacc

SEQ ID NO: 2385965 - RNA, 15 nt, Human
cuguugcccacguuu

SEQ ID NO: 2385966 - RNA, 20 nt, Human
cuguuuagcagcagccuuua

SEQ ID NO: 2385967 - RNA, 17 nt, Human
cuguuuagcagcagccu

SEQ ID NO: 2385968 - RNA, 17 nt, Human
cuguuucaaacuuuacu

SEQ ID NO: 2385969 - RNA, 15 nt, Human
cuguuucaaacuuua

SEQ ID NO: 2385970 - RNA, 17 nt, Human
cuguuucaacacagacc

SEQ ID NO: 2385971 - RNA, 16 nt, Human
cuguuuauuuuauauu

SEQ ID NO: 2385972 - RNA, 12 nt, Human
cuguuucccagc

SEQ ID NO: 2385973 - RNA, 12 nt, Human
cuguuugacaaa

SEQ ID NO: 2385974 - RNA, 16 nt, Human
cuguuucugucaggag

SEQ ID NO: 2385975 - RNA, 22 nt, Human
cuguuugaggauauauuuucac

SEQ ID NO: 2385976 - RNA, 15 nt, Human
cuguuugacaaaccu

SEQ ID NO: 2385977 - RNA, 23 nt, Human
cuguuugaggauauauuuucacu

SEQ ID NO: 2385978 - RNA, 23 nt, Human
cuguuuggaggagcaaaggcuga

SEQ ID NO: 2385979 - RNA, 17 nt, Human
cuguuugcuaagugagg

SEQ ID NO: 2385980 - RNA, 19 nt, Human
cuguuugcuaagugaggau

SEQ ID NO: 2385981 - RNA, 18 nt, Human
cuguucuuaagacgugau

SEQ ID NO: 2385982 - RNA, 17 nt, Human
cuguucuguuuugccug

SEQ ID NO: 2385983 - RNA, 13 nt, Human
cuguucugugucu

SEQ ID NO: 2385984 - RNA, 14 nt, Human
cuguucugugucuu

SEQ ID NO: 2385985 - RNA, 11 nt, Human
cuguucugugu

SEQ ID NO: 2385986 - RNA, 23 nt, Human
cuguucuguggaaaguguaaagc

SEQ ID NO: 2385987 - RNA, 15 nt, Human
cuguucuguggaaag

SEQ ID NO: 2385988 - RNA, 20 nt, Human
cuguucuguggaaaguguaa

SEQ ID NO: 2385989 - RNA, 21 nt, Human
cuguucuguggaaaguguaaa

SEQ ID NO: 2385990 - RNA, 22 nt, Human
cuguucuguggaaaguguaaag

SEQ ID NO: 2385991 - RNA, 16 nt, Human
cuguuaaauugcugug

SEQ ID NO: 2385992 - RNA, 18 nt, Human
cuguuaaauugcugugua

SEQ ID NO: 2385993 - RNA, 19 nt, Human
cuguuaaauugcuguguau

SEQ ID NO: 2385994 - RNA, 20 nt, Human
cuguuaaauugcuguguauc

SEQ ID NO: 2385995 - RNA, 22 nt, Human
cuguuaaauugcuguguaucug

SEQ ID NO: 2385996 - RNA, 16 nt, Human
cuguuaauaguucagg

SEQ ID NO: 2385997 - RNA, 21 nt, Human
cuguucuuucuggcuaugcau

SEQ ID NO: 2385998 - RNA, 14 nt, Human
cuguucuuucuggc

SEQ ID NO: 2385999 - RNA, 13 nt, Human
cuguucuuucugg

SEQ ID NO: 2386000 - RNA, 21 nt, Human
cuguucuuuccaaaguacacu

SEQ ID NO: 2386001 - RNA, 19 nt, Human
cuguucuuuccaaaguaca

SEQ ID NO: 2386002 - RNA, 16 nt, Human
cuguucuuuccaaagu

SEQ ID NO: 2386003 - RNA, 15 nt, Human
cuguucuuuccaaag

SEQ ID NO: 2386004 - RNA, 12 nt, Human
cuguucuugaag

SEQ ID NO: 2386005 - RNA, 20 nt, Human
cuguugacauccaagcuucc

SEQ ID NO: 2386006 - RNA, 17 nt, Human
cuguugacacaggucuu

SEQ ID NO: 2386007 - RNA, 22 nt, Human
cuguugacacaggucuuuccua

SEQ ID NO: 2386008 - RNA, 14 nt, Human
cuguugaaaauuau

SEQ ID NO: 2386009 - RNA, 21 nt, Human
cuguugaaaauuauuuuaaac

SEQ ID NO: 2386010 - RNA, 22 nt, Human
cuguugaaaauuauuuuaaaca

SEQ ID NO: 2386011 - RNA, 12 nt, Human
cuguugaaaauu

SEQ ID NO: 2386012 - RNA, 13 nt, Human
cuguucuuuaauu

SEQ ID NO: 2386013 - RNA, 16 nt, Human
cuguucuuuaauuuau

SEQ ID NO: 2386014 - RNA, 13 nt, Human
cuguucuuggggc

SEQ ID NO: 2386015 - RNA, 15 nt, Human
cuguucuuggggccc

SEQ ID NO: 2386016 - RNA, 23 nt, Human
cuguucuuucuggcuaugcauuu

SEQ ID NO: 2386017 - RNA, 23 nt, Human
cuguugacauccaagcuuccuuu

SEQ ID NO: 2386018 - RNA, 21 nt, Human
cuguugacacaggucuuuccu

SEQ ID NO: 2386019 - RNA, 17 nt, Human
cuguugacgaagucucu

SEQ ID NO: 2386020 - RNA, 20 nt, Human
cuguugagcuguuuucccug

SEQ ID NO: 2386021 - RNA, 15 nt, Human
cuguugagcuguuuu

SEQ ID NO: 2386022 - RNA, 15 nt, Human
cuguugauugcagga

SEQ ID NO: 2386023 - RNA, 14 nt, Human
cuguugauugcuaa

SEQ ID NO: 2386024 - RNA, 15 nt, Human
cuguugauugcuaaa

SEQ ID NO: 2386025 - RNA, 17 nt, Human
cuguugauugcuaaaug

SEQ ID NO: 2386026 - RNA, 18 nt, Human
cuguugauugcuaaaugu

SEQ ID NO: 2386027 - RNA, 19 nt, Human
cuguugauugcuaaaugua

SEQ ID NO: 2386028 - RNA, 20 nt, Human
cuguugauugcuaaauguaa

SEQ ID NO: 2386029 - RNA, 17 nt, Human
cuguugaugaggccucu

SEQ ID NO: 2386030 - RNA, 20 nt, Human
cuguugaugaggccucuugg

SEQ ID NO: 2386031 - RNA, 21 nt, Human
cuguugaugaggccucuugga

SEQ ID NO: 2386032 - RNA, 13 nt, Human
cuguugccacaac

SEQ ID NO: 2386033 - RNA, 12 nt, Human
cuguugcauggg

SEQ ID NO: 2386034 - RNA, 12 nt, Human
cuguugcaguga

SEQ ID NO: 2386035 - RNA, 12 nt, Human
cuguugcccagg

SEQ ID NO: 2386036 - RNA, 19 nt, Human
cuguugcaaacucagccuc

SEQ ID NO: 2386037 - RNA, 13 nt, Human
cuguugcacccag

SEQ ID NO: 2386038 - RNA, 22 nt, Human
cuguugauugcuaaauguaaca

SEQ ID NO: 2386039 - RNA, 23 nt, Human
cuguugauugcuaaauguaacag

SEQ ID NO: 2386040 - RNA, 17 nt, Human
cuguugauuucuuucca

SEQ ID NO: 2386041 - RNA, 20 nt, Human
cuguugauuucuuuccagag

SEQ ID NO: 2386042 - RNA, 23 nt, Human
cuguugcacccagcccuggucuc

SEQ ID NO: 2386043 - RNA, 20 nt, Human
cuguugcacccagcccuggu

SEQ ID NO: 2386044 - RNA, 21 nt, Human
cuguugcacccagcccugguc

SEQ ID NO: 2386045 - RNA, 14 nt, Human
cuguugcacccagc

SEQ ID NO: 2386046 - RNA, 17 nt, Human
cuguugcacccagcccu

SEQ ID NO: 2386047 - RNA, 18 nt, Human
cuguugcacccagcccug

SEQ ID NO: 2386048 - RNA, 19 nt, Human
cuguugcacccagcccugg

SEQ ID NO: 2386049 - RNA, 13 nt, Human
cuguugcccaggc

SEQ ID NO: 2386050 - RNA, 14 nt, Human
cuguugcccaggcu

SEQ ID NO: 2386051 - RNA, 15 nt, Human
cuguugcccaggcug

SEQ ID NO: 2386052 - RNA, 16 nt, Human
cuguugcccaggcugg

SEQ ID NO: 2386053 - RNA, 16 nt, Human
cuuagaaauugcauuu

SEQ ID NO: 2386054 - RNA, 23 nt, Human
cuuagaaguggaccaggacagga

SEQ ID NO: 2386055 - RNA, 22 nt, Human
cuuagaaguggaccaggacagg

SEQ ID NO: 2386056 - RNA, 21 nt, Human
cuuagaaguggaccaggacag

SEQ ID NO: 2386057 - RNA, 20 nt, Human
cuuagaaguggaccaggaca

SEQ ID NO: 2386058 - RNA, 18 nt, Human
cuuagaaguggaccagga

SEQ ID NO: 2386059 - RNA, 17 nt, Human
cuuagaaguggaccagg

SEQ ID NO: 2386060 - RNA, 17 nt, Human
cuuagaagucacacagu

SEQ ID NO: 2386061 - RNA, 20 nt, Human
cuuagaagucacacaguauu

SEQ ID NO: 2386062 - RNA, 20 nt, Human
cuuagaaaaaccaccaccau

SEQ ID NO: 2386063 - RNA, 19 nt, Human
cuuagaaaauucacuauug

SEQ ID NO: 2386064 - RNA, 14 nt, Human
cuuagaaagcaggg

SEQ ID NO: 2386065 - RNA, 16 nt, Human
cuuagaaagcaggggc

SEQ ID NO: 2386066 - RNA, 18 nt, Human
cuuagaaagcaggggcua

SEQ ID NO: 2386067 - RNA, 17 nt, Human
cuuagaaagcaggggcu

SEQ ID NO: 2386068 - RNA, 21 nt, Human
cuuaccuucaauaaaguaucu

SEQ ID NO: 2386069 - RNA, 18 nt, Human
cuuaccuucaauaaagua

SEQ ID NO: 2386070 - RNA, 17 nt, Human
cuuaccuucaauaaagu

SEQ ID NO: 2386071 - RNA, 16 nt, Human
cuuaccuucaauaaag

SEQ ID NO: 2386072 - RNA, 15 nt, Human
cuuaccuucaauaaa

SEQ ID NO: 2386073 - RNA, 20 nt, Human
cuuaccuguaugucuccagu

SEQ ID NO: 2386074 - RNA, 19 nt, Human
cuuaccugggcauucuugu

SEQ ID NO: 2386075 - RNA, 16 nt, Human
cuuaauuuugguugua

SEQ ID NO: 2386076 - RNA, 18 nt, Human
cuuaauuuucaguauaau

SEQ ID NO: 2386077 - RNA, 11 nt, Human
cuuaauuuugg

SEQ ID NO: 2386078 - RNA, 14 nt, Human
cuuaauuuucagua

SEQ ID NO: 2386079 - RNA, 19 nt, Human
cuuaauuuugguuguauuc

SEQ ID NO: 2386080 - RNA, 20 nt, Human
cuuaccugccaggaagccag

SEQ ID NO: 2386081 - RNA, 12 nt, Human
cuuacugaaggu

SEQ ID NO: 2386082 - RNA, 15 nt, Human
cuuacucuucuugaa

SEQ ID NO: 2386083 - RNA, 22 nt, Human
cuuaccuucaauaaaguaucua

SEQ ID NO: 2386084 - RNA, 13 nt, Human
cuuaccuuuuuau

SEQ ID NO: 2386085 - RNA, 13 nt, Human
cuuacugcagaau

SEQ ID NO: 2386086 - RNA, 12 nt, Human
cuuacugcaaau

SEQ ID NO: 2386087 - RNA, 21 nt, Human
cuuacugauuuuuaaguuauu

SEQ ID NO: 2386088 - RNA, 21 nt, Human
cuuacugauauauuuuacaau

SEQ ID NO: 2386089 - RNA, 19 nt, Human
cuuacugauauauuuuaca

SEQ ID NO: 2386090 - RNA, 15 nt, Human
cuuacugauauauuu

SEQ ID NO: 2386091 - RNA, 12 nt, Human
cuuacugauaua

SEQ ID NO: 2386092 - RNA, 19 nt, Human
cuuacucuucuugaaauuu

SEQ ID NO: 2386093 - RNA, 16 nt, Human
cuuagaccucagccug

SEQ ID NO: 2386094 - RNA, 15 nt, Human
cuuagaccucagccu

SEQ ID NO: 2386095 - RNA, 14 nt, Human
cuuagaccucagcc

SEQ ID NO: 2386096 - RNA, 13 nt, Human
cuuagaccucagc

SEQ ID NO: 2386097 - RNA, 12 nt, Human
cuuagaccucag

SEQ ID NO: 2386098 - RNA, 18 nt, Human
cuuagaaguuuguuguga

SEQ ID NO: 2386099 - RNA, 11 nt, Human
cuuagaauaaa

SEQ ID NO: 2386100 - RNA, 15 nt, Human
cuuagaauaaaauug

SEQ ID NO: 2386101 - RNA, 16 nt, Human
cuuagaauaaaauugu

SEQ ID NO: 2386102 - RNA, 17 nt, Human
cuuagaauaaaauugua

SEQ ID NO: 2386103 - RNA, 17 nt, Human
cuuagaauccaaacuug

SEQ ID NO: 2386104 - RNA, 16 nt, Human
cuuagaauccaaacuu

SEQ ID NO: 2386105 - RNA, 12 nt, Human
cuuagaauccaa

SEQ ID NO: 2386106 - RNA, 20 nt, Human
cuuagaauaaaauuguaaaa

SEQ ID NO: 2386107 - RNA, 19 nt, Human
cuuagaauuaguggcacuu

SEQ ID NO: 2386108 - RNA, 16 nt, Human
cuuagacuugaaauac

SEQ ID NO: 2386109 - RNA, 16 nt, Human
cuuagacuucugcuuu

SEQ ID NO: 2386110 - RNA, 20 nt, Human
cuuagacuucgacucaggau

SEQ ID NO: 2386111 - RNA, 14 nt, Human
cuuagacuucugcu

SEQ ID NO: 2386112 - RNA, 19 nt, Human
cuuagacuucgacucagga

SEQ ID NO: 2386113 - RNA, 18 nt, Human
cuuagaccuuccauaaug

SEQ ID NO: 2386114 - RNA, 18 nt, Human
cuuagaccucagccugug

SEQ ID NO: 2386115 - RNA, 17 nt, Human
cuuagaccucagccugu

SEQ ID NO: 2386116 - RNA, 20 nt, Human
cuuagaccucagccugugcu

SEQ ID NO: 2386117 - RNA, 16 nt, Human
cuuagaccuuccauaa

SEQ ID NO: 2386118 - RNA, 17 nt, Human
cuuagacuugaaauacu

SEQ ID NO: 2386119 - RNA, 20 nt, Human
cuuagagaauguucuccuaa

SEQ ID NO: 2386120 - RNA, 22 nt, Human
cuuagagacaguugggugagaa

SEQ ID NO: 2386121 - RNA, 11 nt, Human
cuuagagcagu

SEQ ID NO: 2386122 - RNA, 19 nt, Human
cuuagagcaguuucugucc

SEQ ID NO: 2386123 - RNA, 22 nt, Human
cuuagagcaguuucuguccugc

SEQ ID NO: 2386124 - RNA, 12 nt, Human
cuuagagccagg

SEQ ID NO: 2386125 - RNA, 14 nt, Human
cuuagagccaggca

SEQ ID NO: 2386126 - RNA, 15 nt, Human
cuuagagccaggcac

SEQ ID NO: 2386127 - RNA, 16 nt, Human
cuuagagccaggcaca

SEQ ID NO: 2386128 - RNA, 17 nt, Human
cuuagagccaggcacac

SEQ ID NO: 2386129 - RNA, 23 nt, Human
cuuagagccaggcacacacugug

SEQ ID NO: 2386130 - RNA, 16 nt, Human
cuuagagccucccuca

SEQ ID NO: 2386131 - RNA, 17 nt, Human
cuuagagccucccucaa

SEQ ID NO: 2386132 - RNA, 21 nt, Human
cuuagguuggcaaaaaggcag

SEQ ID NO: 2386133 - RNA, 23 nt, Human
cuuagguuggcaaaaaggcagga

SEQ ID NO: 2386134 - RNA, 20 nt, Human
cuuaguaaugcuacguguga

SEQ ID NO: 2386135 - RNA, 21 nt, Human
cuuaguaaugcuacgugugau

SEQ ID NO: 2386136 - RNA, 22 nt, Human
cuuaguaaugcuacgugugauu

SEQ ID NO: 2386137 - RNA, 23 nt, Human
cuuagagccucccucaauucccc

SEQ ID NO: 2386138 - RNA, 14 nt, Human
cuuaguacugaguu

SEQ ID NO: 2386139 - RNA, 17 nt, Human
cuuaauaguauuuauga

SEQ ID NO: 2386140 - RNA, 16 nt, Human
cuuaauaguauuuaug

SEQ ID NO: 2386141 - RNA, 20 nt, Human
cuuaauagaaacauugaaga

SEQ ID NO: 2386142 - RNA, 21 nt, Human
cuuaauaccugggugauuaca

SEQ ID NO: 2386143 - RNA, 17 nt, Human
cuuaauacacacaguua

SEQ ID NO: 2386144 - RNA, 18 nt, Human
cuuaauacuaccuugaaa

SEQ ID NO: 2386145 - RNA, 16 nt, Human
cuuaauacuaccuuga

SEQ ID NO: 2386146 - RNA, 22 nt, Human
cuuaaguaagcaacagcauaac

SEQ ID NO: 2386147 - RNA, 14 nt, Human
cuuaaggggcagcu

SEQ ID NO: 2386148 - RNA, 15 nt, Human
cuuaaggggcagcuu

SEQ ID NO: 2386149 - RNA, 12 nt, Human
cuuaaggggcag

SEQ ID NO: 2386150 - RNA, 20 nt, Human
cuuaaggauugugauauuuu

SEQ ID NO: 2386151 - RNA, 16 nt, Human
cuuaaggcacucuguu

SEQ ID NO: 2386152 - RNA, 18 nt, Human
cuuaaggggcagcuucua

SEQ ID NO: 2386153 - RNA, 21 nt, Human
cuuaaggauggagccagcucu

SEQ ID NO: 2386154 - RNA, 20 nt, Human
cuuaaggacaaaaaugaacu

SEQ ID NO: 2386155 - RNA, 12 nt, Human
cuuaagcuuccg

SEQ ID NO: 2386156 - RNA, 18 nt, Human
cuuaaauuuuaauuuauu

SEQ ID NO: 2386157 - RNA, 17 nt, Human
cuuaaauuuuaauuuau

SEQ ID NO: 2386158 - RNA, 20 nt, Human
cuuaaaaaucauugauuguc

SEQ ID NO: 2386159 - RNA, 23 nt, Human
cuuaacaauuucuguccuucaga

SEQ ID NO: 2386160 - RNA, 13 nt, Human
cuuaacauauuua

SEQ ID NO: 2386161 - RNA, 15 nt, Human
cuuaacauauuuacu

SEQ ID NO: 2386162 - RNA, 17 nt, Human
cuuaacauauuuacuaa

SEQ ID NO: 2386163 - RNA, 17 nt, Human
cuuaacauucuguaaaa

SEQ ID NO: 2386164 - RNA, 14 nt, Human
cuuaacauucugua

SEQ ID NO: 2386165 - RNA, 17 nt, Human
cuuaaccagaucauugu

SEQ ID NO: 2386166 - RNA, 18 nt, Human
cuuaagaauuuugagcag

SEQ ID NO: 2386167 - RNA, 23 nt, Human
cuuaagaagacugcauuauauuu

SEQ ID NO: 2386168 - RNA, 15 nt, Human
cuuaauguuuauucc

SEQ ID NO: 2386169 - RNA, 16 nt, Human
cuuaauguuuauuccu

SEQ ID NO: 2386170 - RNA, 11 nt, Human
cuuaauuauua

SEQ ID NO: 2386171 - RNA, 15 nt, Human
cuuaauuauuauuug

SEQ ID NO: 2386172 - RNA, 18 nt, Human
cuuaauuauuauuugugu

SEQ ID NO: 2386173 - RNA, 20 nt, Human
cuuaauuaaaagaauauuuu

SEQ ID NO: 2386174 - RNA, 19 nt, Human
cuuaauuaaaagaauauuu

SEQ ID NO: 2386175 - RNA, 19 nt, Human
cuuaauuauuauuuguguu

SEQ ID NO: 2386176 - RNA, 23 nt, Human
cuuaauguuuauuccugauaaua

SEQ ID NO: 2386177 - RNA, 17 nt, Human
cuuaauuccuuucucau

SEQ ID NO: 2386178 - RNA, 20 nt, Human
cuuaauucuuagcucauucu

SEQ ID NO: 2386179 - RNA, 15 nt, Human
cuuaauugcacucua

SEQ ID NO: 2386180 - RNA, 19 nt, Human
cuuaauuccuuucucaucc

SEQ ID NO: 2386181 - RNA, 16 nt, Human
cuuaauuguucauuuu

SEQ ID NO: 2386182 - RNA, 19 nt, Human
cuuaauuguucauuuugag

SEQ ID NO: 2386183 - RNA, 23 nt, Human
cuuaauuguucauuuugagcuga

SEQ ID NO: 2386184 - RNA, 14 nt, Human
cuuaauauguuaac

SEQ ID NO: 2386185 - RNA, 19 nt, Human
cuuaauauauauauccaga

SEQ ID NO: 2386186 - RNA, 17 nt, Human
cuuaaucuuuucacaaa

SEQ ID NO: 2386187 - RNA, 18 nt, Human
cuuaaucuuuucacaaau

SEQ ID NO: 2386188 - RNA, 19 nt, Human
cuuaaucuuuucacaaaua

SEQ ID NO: 2386189 - RNA, 20 nt, Human
cuuaaucuuuucacaaauaa

SEQ ID NO: 2386190 - RNA, 21 nt, Human
cuuaaucuuuucacaaauaaa

SEQ ID NO: 2386191 - RNA, 12 nt, Human
cuuaaugaaguu

SEQ ID NO: 2386192 - RNA, 14 nt, Human
cuuaaugaaguuug

SEQ ID NO: 2386193 - RNA, 15 nt, Human
cuuaaugaaguuuga

SEQ ID NO: 2386194 - RNA, 17 nt, Human
cuuaaugaaguuugaau

SEQ ID NO: 2386195 - RNA, 18 nt, Human
cuuaaugaaguuugaaug

SEQ ID NO: 2386196 - RNA, 19 nt, Human
cuuaaugaaguuugaaugu

SEQ ID NO: 2386197 - RNA, 20 nt, Human
cuuaaugaaguuugaauguu

SEQ ID NO: 2386198 - RNA, 21 nt, Human
cuuaaugaaguuugaauguua

SEQ ID NO: 2386199 - RNA, 23 nt, Human
cuuaaugaaguuugaauguuaaa

SEQ ID NO: 2386200 - RNA, 22 nt, Human
cuuaaugaaguuugaauguuaa

SEQ ID NO: 2386201 - RNA, 20 nt, Human
cuuaauguucugaauaauuu

SEQ ID NO: 2386202 - RNA, 22 nt, Human
cuuaauguucugaauaauuucu

SEQ ID NO: 2386203 - RNA, 12 nt, Human
cuuaauguuuau

SEQ ID NO: 2386204 - RNA, 14 nt, Human
cuuaauguuuauuc

SEQ ID NO: 2386205 - RNA, 17 nt, Human
cuuaauuaaaagaauau

SEQ ID NO: 2386206 - RNA, 16 nt, Human
cuuaauuaaaagaaua

SEQ ID NO: 2386207 - RNA, 17 nt, Human
ccuaaaagcacacucau

SEQ ID NO: 2386208 - RNA, 16 nt, Human
ccguguggccccuuca

SEQ ID NO: 2386209 - RNA, 18 nt, Human
ccuaaaagcacacucauc

SEQ ID NO: 2386210 - RNA, 22 nt, Human
ccuaaaaggaaaucucacccca

SEQ ID NO: 2386211 - RNA, 15 nt, Human
ccguguggccccuuc

SEQ ID NO: 2386212 - RNA, 14 nt, Human
ccguguggccccuu

SEQ ID NO: 2386213 - RNA, 13 nt, Human
ccguguggccccu

SEQ ID NO: 2386214 - RNA, 16 nt, Human
ccgugugcccucgggc

SEQ ID NO: 2386215 - RNA, 22 nt, Human
ccuaaaagugggcuugauucug

SEQ ID NO: 2386216 - RNA, 15 nt, Human
ccuaaaaguaaacau

SEQ ID NO: 2386217 - RNA, 18 nt, Human
ccuaaaauaauugguucu

SEQ ID NO: 2386218 - RNA, 23 nt, Human
ccuaaaaggaaaucucaccccau

SEQ ID NO: 2386219 - RNA, 14 nt, Human
ccuaaaaguaaaca

SEQ ID NO: 2386220 - RNA, 13 nt, Human
ccgugugcccucg

SEQ ID NO: 2386221 - RNA, 22 nt, Human
ccgugugagaagugaaugcugg

SEQ ID NO: 2386222 - RNA, 23 nt, Human
ccgugugagaagugaaugcuggg

SEQ ID NO: 2386223 - RNA, 23 nt, Human
ccgugcuuguuugcucaccuggg

SEQ ID NO: 2386224 - RNA, 20 nt, Human
ccgugcuuguuugcucaccu

SEQ ID NO: 2386225 - RNA, 15 nt, Human
ccgugcuuccucagu

SEQ ID NO: 2386226 - RNA, 22 nt, Human
ccgugcuuguuugcucaccugg

SEQ ID NO: 2386227 - RNA, 20 nt, Human
ccgugguguuauuuaaagaa

SEQ ID NO: 2386228 - RNA, 14 nt, Human
ccgugguccuuugg

SEQ ID NO: 2386229 - RNA, 16 nt, Human
ccguguaaaccaaagc

SEQ ID NO: 2386230 - RNA, 15 nt, Human
ccuaaaauucagugg

SEQ ID NO: 2386231 - RNA, 16 nt, Human
ccuaaauauauuuuaa

SEQ ID NO: 2386232 - RNA, 14 nt, Human
ccuaaaguguauuu

SEQ ID NO: 2386233 - RNA, 18 nt, Human
ccuaaauauauuuuaaga

SEQ ID NO: 2386234 - RNA, 21 nt, Human
ccuacaagagcagccuguggc

SEQ ID NO: 2386235 - RNA, 18 nt, Human
ccuacaagagcagccugu

SEQ ID NO: 2386236 - RNA, 17 nt, Human
ccuacaagagcagccug

SEQ ID NO: 2386237 - RNA, 19 nt, Human
ccuacaagagcagccugug

SEQ ID NO: 2386238 - RNA, 21 nt, Human
ccuacaccauuaucuuggaaa

SEQ ID NO: 2386239 - RNA, 15 nt, Human
ccuacaagacacagu

SEQ ID NO: 2386240 - RNA, 23 nt, Human
ccuaauuucuccucccuuccuuu

SEQ ID NO: 2386241 - RNA, 20 nt, Human
ccuaauuucuccucccuucc

SEQ ID NO: 2386242 - RNA, 12 nt, Human
ccuauaaugaag

SEQ ID NO: 2386243 - RNA, 12 nt, Human
ccuauaaaacag

SEQ ID NO: 2386244 - RNA, 20 nt, Human
ccuaguuuucuccucccagg

SEQ ID NO: 2386245 - RNA, 23 nt, Human
ccuauaaaacaggucaauacagu

SEQ ID NO: 2386246 - RNA, 17 nt, Human
ccuauaaaguaaagcua

SEQ ID NO: 2386247 - RNA, 20 nt, Human
ccuauaaaacaggucaauac

SEQ ID NO: 2386248 - RNA, 18 nt, Human
ccuauagucccagcuacu

SEQ ID NO: 2386249 - RNA, 13 nt, Human
ccuauagucccag

SEQ ID NO: 2386250 - RNA, 22 nt, Human
ccuauacgcagcgugcuuuaaa

SEQ ID NO: 2386251 - RNA, 22 nt, Human
ccuauauuguuuucaguguaca

SEQ ID NO: 2386252 - RNA, 24 nt, Human
ccuauauuuacagugaaaauguaa

SEQ ID NO: 2386253 - RNA, 14 nt, Human
ccuaugcaauauau

SEQ ID NO: 2386254 - RNA, 18 nt, Human
ccuauaugauuuauaguu

SEQ ID NO: 2386255 - RNA, 15 nt, Human
ccuauauuggcuaaa

SEQ ID NO: 2386256 - RNA, 13 nt, Human
ccuauauuuacag

SEQ ID NO: 2386257 - RNA, 15 nt, Human
ccuauauuuacagug

SEQ ID NO: 2386258 - RNA, 14 nt, Human
ccuauauguaguau

SEQ ID NO: 2386259 - RNA, 16 nt, Human
ccuauauaguuuauug

SEQ ID NO: 2386260 - RNA, 18 nt, Human
ccuauauaauaaagcuac

SEQ ID NO: 2386261 - RNA, 18 nt, Human
ccuauauuguuuucagug

SEQ ID NO: 2386262 - RNA, 23 nt, Human
ccuaguggggucucccucuccug

SEQ ID NO: 2386263 - RNA, 15 nt, Human
ccuaggggucaggga

SEQ ID NO: 2386264 - RNA, 18 nt, Human
ccuaggggucagggacca

SEQ ID NO: 2386265 - RNA, 24 nt, Human
ccuaguggggucucccucuccugc

SEQ ID NO: 2386266 - RNA, 21 nt, Human
ccuaguucauccaauccucac

SEQ ID NO: 2386267 - RNA, 13 nt, Human
ccuaguuccacca

SEQ ID NO: 2386268 - RNA, 21 nt, Human
ccuaguuccaccaucaagcca

SEQ ID NO: 2386269 - RNA, 23 nt, Human
ccuaguuccaccaucaagccacc

SEQ ID NO: 2386270 - RNA, 19 nt, Human
ccuaguucuguagaaaugg

SEQ ID NO: 2386271 - RNA, 14 nt, Human
ccuaguuucccuga

SEQ ID NO: 2386272 - RNA, 18 nt, Human
ccuaguucuguagaaaug

SEQ ID NO: 2386273 - RNA, 19 nt, Human
ccuaguuuucuccucccag

SEQ ID NO: 2386274 - RNA, 18 nt, Human
ccuaguuuucuccuccca

SEQ ID NO: 2386275 - RNA, 16 nt, Human
ccuaguuuucuccucc

SEQ ID NO: 2386276 - RNA, 15 nt, Human
ccuaguuuucuccuc

SEQ ID NO: 2386277 - RNA, 15 nt, Human
ccuaguuuuccaugc

SEQ ID NO: 2386278 - RNA, 13 nt, Human
ccuaguuuuccau

SEQ ID NO: 2386279 - RNA, 12 nt, Human
ccuaguuuucca

SEQ ID NO: 2386280 - RNA, 20 nt, Human
ccuaccggcaauuuccggcc

SEQ ID NO: 2386281 - RNA, 13 nt, Human
ccuacccacaccu

SEQ ID NO: 2386282 - RNA, 16 nt, Human
ccuacccacaccucug

SEQ ID NO: 2386283 - RNA, 12 nt, Human
ccuaccucagcc

SEQ ID NO: 2386284 - RNA, 21 nt, Human
ccuaccggcaauuuccggcca

SEQ ID NO: 2386285 - RNA, 13 nt, Human
ccuaccucagccu

SEQ ID NO: 2386286 - RNA, 16 nt, Human
ccuaccucagccuaga

SEQ ID NO: 2386287 - RNA, 14 nt, Human
ccuaccucagccua

SEQ ID NO: 2386288 - RNA, 22 nt, Human
ccuaccgagucucuucuccacu

SEQ ID NO: 2386289 - RNA, 23 nt, Human
ccuaccgagucucuucuccacug

SEQ ID NO: 2386290 - RNA, 19 nt, Human
ccuaccagcgcccgcuggg

SEQ ID NO: 2386291 - RNA, 20 nt, Human
ccuaccagcgcccgcugggc

SEQ ID NO: 2386292 - RNA, 21 nt, Human
ccuaccagcgcccgcugggcu

SEQ ID NO: 2386293 - RNA, 22 nt, Human
ccuaccagcgcccgcugggcug

SEQ ID NO: 2386294 - RNA, 23 nt, Human
ccuaccagcgcccgcugggcuga

SEQ ID NO: 2386295 - RNA, 16 nt, Human
ccuaccaucagggaca

SEQ ID NO: 2386296 - RNA, 22 nt, Human
ccuaccaucagggacaggauga

SEQ ID NO: 2386297 - RNA, 15 nt, Human
ccuacccaaccacuc

SEQ ID NO: 2386298 - RNA, 16 nt, Human
ccuaccacagugucug

SEQ ID NO: 2386299 - RNA, 15 nt, Human
ccuaccacagugucu

SEQ ID NO: 2386300 - RNA, 14 nt, Human
ccuaccacaugcca

SEQ ID NO: 2386301 - RNA, 13 nt, Human
ccuaccaccccuu

SEQ ID NO: 2386302 - RNA, 14 nt, Human
ccuaccacaguguc

SEQ ID NO: 2386303 - RNA, 13 nt, Human
ccuaccacagugu

SEQ ID NO: 2386304 - RNA, 16 nt, Human
ccuaccaaugcaugca

SEQ ID NO: 2386305 - RNA, 22 nt, Human
ccuaccaaugcaugcagccacu

SEQ ID NO: 2386306 - RNA, 18 nt, Human
ccuaccaccuccccagcc

SEQ ID NO: 2386307 - RNA, 13 nt, Human
ccuaccacugucu

SEQ ID NO: 2386308 - RNA, 16 nt, Human
ccuaccagcgcccgcu

SEQ ID NO: 2386309 - RNA, 17 nt, Human
ccuaccagcgcccgcug

SEQ ID NO: 2386310 - RNA, 13 nt, Human
ccuaccaccuccc

SEQ ID NO: 2386311 - RNA, 17 nt, Human
ccuaccaccccuuccug

SEQ ID NO: 2386312 - RNA, 18 nt, Human
ccuaccaccccuuccugu

SEQ ID NO: 2386313 - RNA, 20 nt, Human
ccuacacccuuggacuugag

SEQ ID NO: 2386314 - RNA, 13 nt, Human
ccuacaccauucc

SEQ ID NO: 2386315 - RNA, 17 nt, Human
ccuacacccuuggacuu

SEQ ID NO: 2386316 - RNA, 19 nt, Human
ccuaccaauagauucccca

SEQ ID NO: 2386317 - RNA, 23 nt, Human
ccuaccaauagauuccccauugc

SEQ ID NO: 2386318 - RNA, 12 nt, Human
ccuaccaaugca

SEQ ID NO: 2386319 - RNA, 13 nt, Human
ccuaccaaugcau

SEQ ID NO: 2386320 - RNA, 15 nt, Human
ccuaccaaugcaugc

SEQ ID NO: 2386321 - RNA, 13 nt, Human
ccuacuuccugug

SEQ ID NO: 2386322 - RNA, 21 nt, Human
ccuacuuccccuuccuaauuc

SEQ ID NO: 2386323 - RNA, 21 nt, Human
ccuaccucagccuagacccuc

SEQ ID NO: 2386324 - RNA, 18 nt, Human
ccuaccucagccuagacc

SEQ ID NO: 2386325 - RNA, 15 nt, Human
ccuaccucaggcagg

SEQ ID NO: 2386326 - RNA, 12 nt, Human
ccuaccucaggu

SEQ ID NO: 2386327 - RNA, 15 nt, Human
ccuacuuccugugac

SEQ ID NO: 2386328 - RNA, 13 nt, Human
ccuaccucagguu

SEQ ID NO: 2386329 - RNA, 12 nt, Human
ccuacuucucca

SEQ ID NO: 2386330 - RNA, 14 nt, Human
ccuacuucuccagc

SEQ ID NO: 2386331 - RNA, 19 nt, Human
ccuacuucuccagccuaga

SEQ ID NO: 2386332 - RNA, 15 nt, Human
ccuacuuugacuuuu

SEQ ID NO: 2386333 - RNA, 14 nt, Human
ccuacuuugacuuu

SEQ ID NO: 2386334 - RNA, 22 nt, Human
ccuacuucuuuugcucuuagcu

SEQ ID NO: 2386335 - RNA, 16 nt, Human
ccuacuucuuuugcuc

SEQ ID NO: 2386336 - RNA, 17 nt, Human
ccuaggggacacuuccc

SEQ ID NO: 2386337 - RNA, 18 nt, Human
ccuaggggacacuucccu

SEQ ID NO: 2386338 - RNA, 16 nt, Human
ccuagggccuggucca

SEQ ID NO: 2386339 - RNA, 14 nt, Human
ccuagggccugguc

SEQ ID NO: 2386340 - RNA, 14 nt, Human
ccuagggaaaaguu

SEQ ID NO: 2386341 - RNA, 23 nt, Human
ccuagggaagggugguggagcca

SEQ ID NO: 2386342 - RNA, 22 nt, Human
ccuagggaagggugguggagcc

SEQ ID NO: 2386343 - RNA, 20 nt, Human
ccuagggauguucuggcccu

SEQ ID NO: 2386344 - RNA, 17 nt, Human
ccuagggccacugaaga

SEQ ID NO: 2386345 - RNA, 17 nt, Human
ccuaggcugaccuugaa

SEQ ID NO: 2386346 - RNA, 18 nt, Human
ccuaggcuccaccccauc

SEQ ID NO: 2386347 - RNA, 17 nt, Human
ccuaggcuccaccccau

SEQ ID NO: 2386348 - RNA, 23 nt, Human
ccuacuucuuugcuuugcccagc

SEQ ID NO: 2386349 - RNA, 21 nt, Human
ccuacuuugacuuuuugcauu

SEQ ID NO: 2386350 - RNA, 15 nt, Human
ccuaggcuccacccc

SEQ ID NO: 2386351 - RNA, 14 nt, Human
ccuauagucccagc

SEQ ID NO: 2386352 - RNA, 21 nt, Human
ccgcaaaccacacuggacucc

SEQ ID NO: 2386353 - RNA, 21 nt, Human
ccgcaaacccccuuugugcug

SEQ ID NO: 2386354 - RNA, 15 nt, Human
ccgcaaaccacacug

SEQ ID NO: 2386355 - RNA, 16 nt, Human
ccgcaaaccacacugg

SEQ ID NO: 2386356 - RNA, 14 nt, Human
ccgauuucccaggc

SEQ ID NO: 2386357 - RNA, 13 nt, Human
ccgauucacccug

SEQ ID NO: 2386358 - RNA, 22 nt, Human
ccgaugcugcuuuccccugugg

SEQ ID NO: 2386359 - RNA, 21 nt, Human
ccgauucaucucucagaaggg

SEQ ID NO: 2386360 - RNA, 16 nt, Human
ccgauucaccugagca

SEQ ID NO: 2386361 - RNA, 13 nt, Human
ccgaguccaagcu

SEQ ID NO: 2386362 - RNA, 20 nt, Human
ccgaugcugcuuuccccugu

SEQ ID NO: 2386363 - RNA, 21 nt, Human
ccgaugcugcuuuccccugug

SEQ ID NO: 2386364 - RNA, 23 nt, Human
ccgaugcugcuuuccccuguggg

SEQ ID NO: 2386365 - RNA, 20 nt, Human
ccgaguagcugggacuacag

SEQ ID NO: 2386366 - RNA, 12 nt, Human
ccgaguccaagc

SEQ ID NO: 2386367 - RNA, 20 nt, Human
ccgagucauucguucugugg

SEQ ID NO: 2386368 - RNA, 19 nt, Human
ccgagucauucguucugug

SEQ ID NO: 2386369 - RNA, 22 nt, Human
ccgaggccuaccccgcagacac

SEQ ID NO: 2386370 - RNA, 17 nt, Human
ccgaguagcugggacua

SEQ ID NO: 2386371 - RNA, 20 nt, Human
cccugguuucacuggcccaa

SEQ ID NO: 2386372 - RNA, 15 nt, Human
cccugguuucacugg

SEQ ID NO: 2386373 - RNA, 17 nt, Human
cccugguucucaucuuu

SEQ ID NO: 2386374 - RNA, 23 nt, Human
cccugguucugaugaugugccug

SEQ ID NO: 2386375 - RNA, 17 nt, Human
cccugguuuccugcccu

SEQ ID NO: 2386376 - RNA, 16 nt, Human
cccugguuuccugccc

SEQ ID NO: 2386377 - RNA, 20 nt, Human
cccugguggcagcucaccuc

SEQ ID NO: 2386378 - RNA, 15 nt, Human
cccugguucucaucu

SEQ ID NO: 2386379 - RNA, 16 nt, Human
cccugguucucaucuu

SEQ ID NO: 2386380 - RNA, 15 nt, Human
cccuggucucugguc

SEQ ID NO: 2386381 - RNA, 13 nt, Human
cccuggucucugg

SEQ ID NO: 2386382 - RNA, 14 nt, Human
cccuggucucuggu

SEQ ID NO: 2386383 - RNA, 20 nt, Human
ccgaggcagggucaggagag

SEQ ID NO: 2386384 - RNA, 11 nt, Human
ccgaggccagu

SEQ ID NO: 2386385 - RNA, 14 nt, Human
ccgaggcaggguca

SEQ ID NO: 2386386 - RNA, 14 nt, Human
ccgaggccuucucu

SEQ ID NO: 2386387 - RNA, 19 nt, Human
cccugguuuccugcccugg

SEQ ID NO: 2386388 - RNA, 18 nt, Human
cccugguuuccugcccug

SEQ ID NO: 2386389 - RNA, 22 nt, Human
cccugguucugaugaugugccu

SEQ ID NO: 2386390 - RNA, 20 nt, Human
ccgcggggacauugggaagg

SEQ ID NO: 2386391 - RNA, 17 nt, Human
ccgcgucgcccucccag

SEQ ID NO: 2386392 - RNA, 19 nt, Human
ccgcgucgcccucccaggc

SEQ ID NO: 2386393 - RNA, 22 nt, Human
ccgcgugaucaaagccacacuc

SEQ ID NO: 2386394 - RNA, 17 nt, Human
ccgcgucuggugacaac

SEQ ID NO: 2386395 - RNA, 21 nt, Human
ccgcuaagagggagggagggc

SEQ ID NO: 2386396 - RNA, 17 nt, Human
ccgcguuguaaaauaua

SEQ ID NO: 2386397 - RNA, 13 nt, Human
ccgcguuguaaaa

SEQ ID NO: 2386398 - RNA, 11 nt, Human
ccgcucagccc

SEQ ID NO: 2386399 - RNA, 17 nt, Human
ccgcuagaggccugagg

SEQ ID NO: 2386400 - RNA, 18 nt, Human
ccgcuagaggccugagga

SEQ ID NO: 2386401 - RNA, 19 nt, Human
ccgcuagaggccugaggau

SEQ ID NO: 2386402 - RNA, 12 nt, Human
ccgcucagcccu

SEQ ID NO: 2386403 - RNA, 13 nt, Human
ccgcucagcccuc

SEQ ID NO: 2386404 - RNA, 23 nt, Human
ccgcuaagagggagggagggcuc

SEQ ID NO: 2386405 - RNA, 15 nt, Human
ccgcuagaggccuga

SEQ ID NO: 2386406 - RNA, 16 nt, Human
ccgcuagaggccugag

SEQ ID NO: 2386407 - RNA, 22 nt, Human
ccgccugguacucaagcccgcg

SEQ ID NO: 2386408 - RNA, 14 nt, Human
ccgcacuaggggau

SEQ ID NO: 2386409 - RNA, 14 nt, Human
ccgcacucacccau

SEQ ID NO: 2386410 - RNA, 17 nt, Human
ccgccuguucccccgcc

SEQ ID NO: 2386411 - RNA, 20 nt, Human
ccgccuguucccccgccgcu

SEQ ID NO: 2386412 - RNA, 23 nt, Human
ccgccuucacuccggugugccug

SEQ ID NO: 2386413 - RNA, 22 nt, Human
ccgcgccaaauaaugucucugu

SEQ ID NO: 2386414 - RNA, 16 nt, Human
ccgcgccuccuuccuu

SEQ ID NO: 2386415 - RNA, 16 nt, Human
ccgcgcccgcgcccuc

SEQ ID NO: 2386416 - RNA, 18 nt, Human
ccgcgcgcgucccccugc

SEQ ID NO: 2386417 - RNA, 21 nt, Human
ccgcaaugugcccccagacgc

SEQ ID NO: 2386418 - RNA, 15 nt, Human
ccgcaauacaggaac

SEQ ID NO: 2386419 - RNA, 15 nt, Human
ccgcacccccacccu

SEQ ID NO: 2386420 - RNA, 17 nt, Human
ccgcaccccagagugug

SEQ ID NO: 2386421 - RNA, 13 nt, Human
ccgcaccccagag

SEQ ID NO: 2386422 - RNA, 11 nt, Human
ccgcaccccag

SEQ ID NO: 2386423 - RNA, 13 nt, Human
ccgcaccccccaa

SEQ ID NO: 2386424 - RNA, 16 nt, Human
ccgcacccccacccuu

SEQ ID NO: 2386425 - RNA, 19 nt, Human
ccgcacugggcuuggggac

SEQ ID NO: 2386426 - RNA, 14 nt, Human
ccgcacugggcuug

SEQ ID NO: 2386427 - RNA, 19 nt, Human
ccgcuuguccagcgccuag

SEQ ID NO: 2386428 - RNA, 18 nt, Human
ccgcuuguccagcgccua

SEQ ID NO: 2386429 - RNA, 23 nt, Human
ccggcugguuuuguaagaugcug

SEQ ID NO: 2386430 - RNA, 20 nt, Human
ccgggaagggggcugggaca

SEQ ID NO: 2386431 - RNA, 17 nt, Human
ccgggaccccgagccug

SEQ ID NO: 2386432 - RNA, 19 nt, Human
ccgcuuucuacccagcgag

SEQ ID NO: 2386433 - RNA, 15 nt, Human
ccggcuggccuggcc

SEQ ID NO: 2386434 - RNA, 17 nt, Human
ccggcuggccuggcccc

SEQ ID NO: 2386435 - RNA, 18 nt, Human
ccggcuggccuggccccu

SEQ ID NO: 2386436 - RNA, 17 nt, Human
ccgcuuguccagcgccu

SEQ ID NO: 2386437 - RNA, 16 nt, Human
ccgcuuguccagcgcc

SEQ ID NO: 2386438 - RNA, 22 nt, Human
ccgcugcccggcgcccucuguc

SEQ ID NO: 2386439 - RNA, 19 nt, Human
ccgcugcccggcgcccucu

SEQ ID NO: 2386440 - RNA, 20 nt, Human
ccgcugcccggcgcccucug

SEQ ID NO: 2386441 - RNA, 12 nt, Human
ccgcuuucuacc

SEQ ID NO: 2386442 - RNA, 14 nt, Human
ccgcugccacccac

SEQ ID NO: 2386443 - RNA, 12 nt, Human
ccgcugccaccc

SEQ ID NO: 2386444 - RNA, 11 nt, Human
ccgcugccacc

SEQ ID NO: 2386445 - RNA, 22 nt, Human
ccgcugauucucagggucucug

SEQ ID NO: 2386446 - RNA, 17 nt, Human
ccgcugaguggacugga

SEQ ID NO: 2386447 - RNA, 19 nt, Human
ccgcugaguggacuggagu

SEQ ID NO: 2386448 - RNA, 13 nt, Human
ccgcugauucuca

SEQ ID NO: 2386449 - RNA, 15 nt, Human
ccgcugauucucagg

SEQ ID NO: 2386450 - RNA, 20 nt, Human
ccgcugccacccaccucccu

SEQ ID NO: 2386451 - RNA, 17 nt, Human
ccgcugccacccaccuc

SEQ ID NO: 2386452 - RNA, 16 nt, Human
ccgcugccacccaccu

SEQ ID NO: 2386453 - RNA, 15 nt, Human
ccgcugccacccacc

SEQ ID NO: 2386454 - RNA, 24 nt, Human
ccgcugccacccaccucccugccu

SEQ ID NO: 2386455 - RNA, 23 nt, Human
ccgcugccacccaccucccugcc

SEQ ID NO: 2386456 - RNA, 20 nt, Human
ccgcugccacguuggagaag

SEQ ID NO: 2386457 - RNA, 15 nt, Human
ccgcucagcccuccc

SEQ ID NO: 2386458 - RNA, 19 nt, Human
ccgcucagcccucccugcc

SEQ ID NO: 2386459 - RNA, 21 nt, Human
ccgcucagcccucccugcccc

SEQ ID NO: 2386460 - RNA, 22 nt, Human
ccgcucagcccucccugccccu

SEQ ID NO: 2386461 - RNA, 23 nt, Human
ccgcugagcgaggagaugcuccu

SEQ ID NO: 2386462 - RNA, 14 nt, Human
ccgcucuggaccaa

SEQ ID NO: 2386463 - RNA, 13 nt, Human
ccgcugaguggac

SEQ ID NO: 2386464 - RNA, 20 nt, Human
ccgcucugcaugcggcccag

SEQ ID NO: 2386465 - RNA, 21 nt, Human
ccgcucugcaugcggcccagc

SEQ ID NO: 2386466 - RNA, 22 nt, Human
ccgcucugcaugcggcccagcc

SEQ ID NO: 2386467 - RNA, 20 nt, Human
ccggguuuggcgggccaagg

SEQ ID NO: 2386468 - RNA, 19 nt, Human
ccggguuuggcgggccaag

SEQ ID NO: 2386469 - RNA, 17 nt, Human
ccggguucuagucuccu

SEQ ID NO: 2386470 - RNA, 20 nt, Human
ccggguucuagucuccuuug

SEQ ID NO: 2386471 - RNA, 22 nt, Human
ccggguuuggcgggccaaggac

SEQ ID NO: 2386472 - RNA, 21 nt, Human
ccggguuuggcgggccaagga

SEQ ID NO: 2386473 - RNA, 22 nt, Human
ccgguaaacacgccugcaaacg

SEQ ID NO: 2386474 - RNA, 15 nt, Human
ccggguuccagcacc

SEQ ID NO: 2386475 - RNA, 12 nt, Human
ccggguuccagc

SEQ ID NO: 2386476 - RNA, 14 nt, Human
ccgggucugccucu

SEQ ID NO: 2386477 - RNA, 14 nt, Human
ccgggugggcggca

SEQ ID NO: 2386478 - RNA, 20 nt, Human
ccgggugggcggcacagccu

SEQ ID NO: 2386479 - RNA, 15 nt, Human
ccggggaaaggcaag

SEQ ID NO: 2386480 - RNA, 17 nt, Human
ccgggcugccugggcug

SEQ ID NO: 2386481 - RNA, 18 nt, Human
ccgggcugccugggcugu

SEQ ID NO: 2386482 - RNA, 21 nt, Human
ccgggcugccugggcuguugg

SEQ ID NO: 2386483 - RNA, 20 nt, Human
ccgugcugacagcugcuccu

SEQ ID NO: 2386484 - RNA, 14 nt, Human
ccgugcuuccucag

SEQ ID NO: 2386485 - RNA, 21 nt, Human
ccgugcugacagcugcuccua

SEQ ID NO: 2386486 - RNA, 19 nt, Human
ccgugcugacagcugcucc

SEQ ID NO: 2386487 - RNA, 18 nt, Human
ccgugcugacagcugcuc

SEQ ID NO: 2386488 - RNA, 17 nt, Human
ccgugcugacagcugcu

SEQ ID NO: 2386489 - RNA, 16 nt, Human
ccgugcugacagcugc

SEQ ID NO: 2386490 - RNA, 14 nt, Human
ccgugcugacagcu

SEQ ID NO: 2386491 - RNA, 17 nt, Human
ccgugcucgccccagca

SEQ ID NO: 2386492 - RNA, 16 nt, Human
ccgugcucgccccagc

SEQ ID NO: 2386493 - RNA, 16 nt, Human
ccgggcucucugcugu

SEQ ID NO: 2386494 - RNA, 14 nt, Human
ccgggcucucugcu

SEQ ID NO: 2386495 - RNA, 22 nt, Human
ccgggcucugccucccaucacc

SEQ ID NO: 2386496 - RNA, 13 nt, Human
ccgggcugggagc

SEQ ID NO: 2386497 - RNA, 12 nt, Human
ccgggcugccug

SEQ ID NO: 2386498 - RNA, 15 nt, Human
ccgggcugccugggc

SEQ ID NO: 2386499 - RNA, 16 nt, Human
ccgggcugccugggcu

SEQ ID NO: 2386500 - RNA, 18 nt, Human
ccgggcugggagcucugc

SEQ ID NO: 2386501 - RNA, 19 nt, Human
ccgggcugggagcucugca

SEQ ID NO: 2386502 - RNA, 13 nt, Human
ccgggcucucugc

SEQ ID NO: 2386503 - RNA, 21 nt, Human
ccgggcucagggaccacagca

SEQ ID NO: 2386504 - RNA, 22 nt, Human
ccgggcucagggaccacagcaa

SEQ ID NO: 2386505 - RNA, 20 nt, Human
ccgggcucagggaccacagc

SEQ ID NO: 2386506 - RNA, 16 nt, Human
ccgggcguggugguga

SEQ ID NO: 2386507 - RNA, 20 nt, Human
ccgggcgcgguggcucacgc

SEQ ID NO: 2386508 - RNA, 18 nt, Human
ccgggaccccgagccugg

SEQ ID NO: 2386509 - RNA, 17 nt, Human
ccgggaccuggugcugc

SEQ ID NO: 2386510 - RNA, 12 nt, Human
ccgcucccagug

SEQ ID NO: 2386511 - RNA, 12 nt, Human
ccucccugccuc

SEQ ID NO: 2386512 - RNA, 13 nt, Human
ccucccugccccu

SEQ ID NO: 2386513 - RNA, 12 nt, Human
ccucccugcugu

SEQ ID NO: 2386514 - RNA, 15 nt, Human
ccucccugccuccag

SEQ ID NO: 2386515 - RNA, 14 nt, Human
ccucccugccucca

SEQ ID NO: 2386516 - RNA, 22 nt, Human
ccucccugccccucccuucaac

SEQ ID NO: 2386517 - RNA, 24 nt, Human
ccucccugccccucccuucaacca

SEQ ID NO: 2386518 - RNA, 14 nt, Human
ccuccucagaucuu

SEQ ID NO: 2386519 - RNA, 20 nt, Human
ccucccucagccccucuugc

SEQ ID NO: 2386520 - RNA, 10 nt, Human
ccucccuccc

SEQ ID NO: 2386521 - RNA, 16 nt, Human
ccucccucagccccuc

SEQ ID NO: 2386522 - RNA, 15 nt, Human
ccucccucagccccu

SEQ ID NO: 2386523 - RNA, 14 nt, Human
ccucccucagcccc

SEQ ID NO: 2386524 - RNA, 18 nt, Human
ccucccugccccucccuu

SEQ ID NO: 2386525 - RNA, 21 nt, Human
ccucccugccccucccuucaa

SEQ ID NO: 2386526 - RNA, 19 nt, Human
ccucccgaguagcugggac

SEQ ID NO: 2386527 - RNA, 16 nt, Human
ccuccccuugggcggc

SEQ ID NO: 2386528 - RNA, 23 nt, Human
ccuccccuugggcggcugagagc

SEQ ID NO: 2386529 - RNA, 11 nt, Human
ccucccgcccc

SEQ ID NO: 2386530 - RNA, 12 nt, Human
ccucccucagcc

SEQ ID NO: 2386531 - RNA, 11 nt, Human
ccucccucagc

SEQ ID NO: 2386532 - RNA, 16 nt, Human
ccucccgccccuuccc

SEQ ID NO: 2386533 - RNA, 18 nt, Human
ccucccgccccuucccac

SEQ ID NO: 2386534 - RNA, 15 nt, Human
ccucccggcauggga

SEQ ID NO: 2386535 - RNA, 19 nt, Human
ccucccggcaugggaaagc

SEQ ID NO: 2386536 - RNA, 20 nt, Human
ccucccgaguagcugggacu

SEQ ID NO: 2386537 - RNA, 21 nt, Human
ccucccgaguagcugggacua

SEQ ID NO: 2386538 - RNA, 15 nt, Human
ccuccccccacugca

SEQ ID NO: 2386539 - RNA, 20 nt, Human
ccuccccugcugcaggggcu

SEQ ID NO: 2386540 - RNA, 16 nt, Human
ccuccccccacugcag

SEQ ID NO: 2386541 - RNA, 16 nt, Human
ccuccccugcugcagg

SEQ ID NO: 2386542 - RNA, 13 nt, Human
ccuccccugggga

SEQ ID NO: 2386543 - RNA, 15 nt, Human
ccucccccagagggg

SEQ ID NO: 2386544 - RNA, 23 nt, Human
ccuccccauuucccaucugcacc

SEQ ID NO: 2386545 - RNA, 15 nt, Human
ccucccccacugcca

SEQ ID NO: 2386546 - RNA, 14 nt, Human
ccuccccccacugc

SEQ ID NO: 2386547 - RNA, 13 nt, Human
ccuccccccacug

SEQ ID NO: 2386548 - RNA, 17 nt, Human
ccuccccuucccugcaa

SEQ ID NO: 2386549 - RNA, 23 nt, Human
ccuccccuggggacagcaagggc

SEQ ID NO: 2386550 - RNA, 14 nt, Human
ccuccccuggggac

SEQ ID NO: 2386551 - RNA, 20 nt, Human
ccuccccuggggacagcaag

SEQ ID NO: 2386552 - RNA, 12 nt, Human
ccuccccuuggg

SEQ ID NO: 2386553 - RNA, 13 nt, Human
ccuccccuugggc

SEQ ID NO: 2386554 - RNA, 14 nt, Human
ccuccccuugggcg

SEQ ID NO: 2386555 - RNA, 15 nt, Human
ccuccugcuacucug

SEQ ID NO: 2386556 - RNA, 11 nt, Human
ccuccugcuca

SEQ ID NO: 2386557 - RNA, 18 nt, Human
ccuccugcgcgcaugugc

SEQ ID NO: 2386558 - RNA, 20 nt, Human
ccuccugcgcgcaugugcgc

SEQ ID NO: 2386559 - RNA, 23 nt, Human
ccuccugcgcgcaugugcgcaca

SEQ ID NO: 2386560 - RNA, 15 nt, Human
ccuccugaccuguca

SEQ ID NO: 2386561 - RNA, 18 nt, Human
ccuccugaccugaggcuc

SEQ ID NO: 2386562 - RNA, 12 nt, Human
ccuccugagaaa

SEQ ID NO: 2386563 - RNA, 23 nt, Human
ccuccugccucgaacuggcugca

SEQ ID NO: 2386564 - RNA, 16 nt, Human
ccuccugaccugaggc

SEQ ID NO: 2386565 - RNA, 14 nt, Human
ccuccugggcuaag

SEQ ID NO: 2386566 - RNA, 20 nt, Human
ccuccugcugcagaggggca

SEQ ID NO: 2386567 - RNA, 21 nt, Human
ccuccugcugcagaggggcag

SEQ ID NO: 2386568 - RNA, 11 nt, Human
ccuccugcugc

SEQ ID NO: 2386569 - RNA, 12 nt, Human
ccuccugcugca

SEQ ID NO: 2386570 - RNA, 17 nt, Human
ccuccugcugcagaggg

SEQ ID NO: 2386571 - RNA, 18 nt, Human
ccuccugcugcagagggg

SEQ ID NO: 2386572 - RNA, 19 nt, Human
ccuccugguggguccaggg

SEQ ID NO: 2386573 - RNA, 20 nt, Human
ccuccugguggguccagggg

SEQ ID NO: 2386574 - RNA, 21 nt, Human
ccuccugguggguccaggggc

SEQ ID NO: 2386575 - RNA, 22 nt, Human
ccuccuguaaaugguguacaua

SEQ ID NO: 2386576 - RNA, 15 nt, Human
ccuccugucucuggc

SEQ ID NO: 2386577 - RNA, 16 nt, Human
ccuccugucuucccag

SEQ ID NO: 2386578 - RNA, 17 nt, Human
ccuccugucuucccagg

SEQ ID NO: 2386579 - RNA, 15 nt, Human
ccuccuccacaccag

SEQ ID NO: 2386580 - RNA, 19 nt, Human
ccuccuccaaaggcccccu

SEQ ID NO: 2386581 - RNA, 20 nt, Human
ccuccucuggacggcaggcu

SEQ ID NO: 2386582 - RNA, 12 nt, Human
ccuccucaggga

SEQ ID NO: 2386583 - RNA, 13 nt, Human
ccuccucaucccg

SEQ ID NO: 2386584 - RNA, 20 nt, Human
ccuccucaucccguguucuc

SEQ ID NO: 2386585 - RNA, 23 nt, Human
ccuccucaucccguguucuccuu

SEQ ID NO: 2386586 - RNA, 12 nt, Human
ccuccucaugua

SEQ ID NO: 2386587 - RNA, 13 nt, Human
ccuccucagggau

SEQ ID NO: 2386588 - RNA, 23 nt, Human
ccuccucaucugggggaguggaa

SEQ ID NO: 2386589 - RNA, 20 nt, Human
ccuccucauguacauacccu

SEQ ID NO: 2386590 - RNA, 21 nt, Human
ccuccucauguacauacccug

SEQ ID NO: 2386591 - RNA, 16 nt, Human
ccuccucuguccaggg

SEQ ID NO: 2386592 - RNA, 15 nt, Human
ccuccucuguccagg

SEQ ID NO: 2386593 - RNA, 12 nt, Human
ccuccucugucc

SEQ ID NO: 2386594 - RNA, 21 nt, Human
ccuccucuggacggcaggcuc

SEQ ID NO: 2386595 - RNA, 22 nt, Human
ccuccucuggacggcaggcuca

SEQ ID NO: 2386596 - RNA, 14 nt, Human
ccuccucugucccu

SEQ ID NO: 2386597 - RNA, 13 nt, Human
ccuccucugucug

SEQ ID NO: 2386598 - RNA, 18 nt, Human
ccuccucuguccagggcc

SEQ ID NO: 2386599 - RNA, 11 nt, Human
ccuccucugug

SEQ ID NO: 2386600 - RNA, 17 nt, Human
ccuccucugucugcccu

SEQ ID NO: 2386601 - RNA, 14 nt, Human
ccuccucugucugc

SEQ ID NO: 2386602 - RNA, 16 nt, Human
ccuccucugucugccc

SEQ ID NO: 2386603 - RNA, 21 nt, Human
ccuccugaaacuuacacacaa

SEQ ID NO: 2386604 - RNA, 17 nt, Human
ccuccucuucugacgug

SEQ ID NO: 2386605 - RNA, 20 nt, Human
ccuccugaaacuuacacaca

SEQ ID NO: 2386606 - RNA, 13 nt, Human
ccuccucugugaa

SEQ ID NO: 2386607 - RNA, 14 nt, Human
ccuccucuucugac

SEQ ID NO: 2386608 - RNA, 12 nt, Human
ccuccucuguga

SEQ ID NO: 2386609 - RNA, 22 nt, Human
ccuccucugugaccaaugucuu

SEQ ID NO: 2386610 - RNA, 19 nt, Human
ccucgugguccccaacagc

SEQ ID NO: 2386611 - RNA, 15 nt, Human
ccucgugguccccaa

SEQ ID NO: 2386612 - RNA, 18 nt, Human
ccucgugguccccaacag

SEQ ID NO: 2386613 - RNA, 23 nt, Human
ccucguggccuuccccagccucu

SEQ ID NO: 2386614 - RNA, 22 nt, Human
ccucguggccuuccccagccuc

SEQ ID NO: 2386615 - RNA, 19 nt, Human
ccucguggccuuccccagc

SEQ ID NO: 2386616 - RNA, 18 nt, Human
ccucguggccuuccccag

SEQ ID NO: 2386617 - RNA, 18 nt, Human
ccucgguguggagaagcg

SEQ ID NO: 2386618 - RNA, 14 nt, Human
ccucgggucuccuc

SEQ ID NO: 2386619 - RNA, 15 nt, Human
ccucgggucuccuca

SEQ ID NO: 2386620 - RNA, 17 nt, Human
ccucgggucuccucacu

SEQ ID NO: 2386621 - RNA, 18 nt, Human
ccucgggucuccucacuc

SEQ ID NO: 2386622 - RNA, 15 nt, Human
ccucgguacucccau

SEQ ID NO: 2386623 - RNA, 18 nt, Human
ccucguggccagcccggc

SEQ ID NO: 2386624 - RNA, 22 nt, Human
ccucguggccagcccggcuggu

SEQ ID NO: 2386625 - RNA, 13 nt, Human
ccucuaaccccag

SEQ ID NO: 2386626 - RNA, 23 nt, Human
ccucuaaagcaauaaugguccca

SEQ ID NO: 2386627 - RNA, 15 nt, Human
ccucuaaccccaggc

SEQ ID NO: 2386628 - RNA, 16 nt, Human
ccucuaaccccaggcc

SEQ ID NO: 2386629 - RNA, 17 nt, Human
ccucuaaccccaggccc

SEQ ID NO: 2386630 - RNA, 18 nt, Human
ccucuaaccccaggcccc

SEQ ID NO: 2386631 - RNA, 19 nt, Human
ccucuaaccccaggccccg

SEQ ID NO: 2386632 - RNA, 21 nt, Human
ccucuaaccccaggccccgag

SEQ ID NO: 2386633 - RNA, 14 nt, Human
ccucuagaggcaag

SEQ ID NO: 2386634 - RNA, 19 nt, Human
ccucuagaaauuuuucaga

SEQ ID NO: 2386635 - RNA, 15 nt, Human
ccucuagaagccaag

SEQ ID NO: 2386636 - RNA, 16 nt, Human
ccucuagaagccaagg

SEQ ID NO: 2386637 - RNA, 18 nt, Human
ccucuagaagccaaggga

SEQ ID NO: 2386638 - RNA, 14 nt, Human
ccuccuucccaaag

SEQ ID NO: 2386639 - RNA, 22 nt, Human
ccuccuucagacacccucaacc

SEQ ID NO: 2386640 - RNA, 15 nt, Human
ccuccuucagacacc

SEQ ID NO: 2386641 - RNA, 16 nt, Human
ccuccuuccaccuccc

SEQ ID NO: 2386642 - RNA, 17 nt, Human
ccuccuuccaccucccu

SEQ ID NO: 2386643 - RNA, 18 nt, Human
ccuccuuccaccucccuc

SEQ ID NO: 2386644 - RNA, 19 nt, Human
ccuccuuccaccucccucc

SEQ ID NO: 2386645 - RNA, 14 nt, Human
ccuccuucagacac

SEQ ID NO: 2386646 - RNA, 13 nt, Human
ccuccuucagaca

SEQ ID NO: 2386647 - RNA, 18 nt, Human
ccuccugucuucccaggg

SEQ ID NO: 2386648 - RNA, 19 nt, Human
ccuccugucuucccagggu

SEQ ID NO: 2386649 - RNA, 22 nt, Human
ccucgggcgagucacugccucu

SEQ ID NO: 2386650 - RNA, 14 nt, Human
ccuccuucucuguc

SEQ ID NO: 2386651 - RNA, 19 nt, Human
ccucgggcgagucacugcc

SEQ ID NO: 2386652 - RNA, 17 nt, Human
ccuccuucucccuuuuu

SEQ ID NO: 2386653 - RNA, 16 nt, Human
ccuccuucucccuuuu

SEQ ID NO: 2386654 - RNA, 15 nt, Human
ccuccuucucccuuu

SEQ ID NO: 2386655 - RNA, 20 nt, Human
ccuccuuccuugcuguccua

SEQ ID NO: 2386656 - RNA, 20 nt, Human
ccuccuuccuugaccagcag

SEQ ID NO: 2386657 - RNA, 18 nt, Human
ccuccuuccuugaccagc

SEQ ID NO: 2386658 - RNA, 15 nt, Human
ccuccuuccuugacc

SEQ ID NO: 2386659 - RNA, 14 nt, Human
ccuccuuccuugac

SEQ ID NO: 2386660 - RNA, 14 nt, Human
ccucgguguggaga

SEQ ID NO: 2386661 - RNA, 16 nt, Human
ccucggugccuuccuc

SEQ ID NO: 2386662 - RNA, 16 nt, Human
ccucuauuuagcauga

SEQ ID NO: 2386663 - RNA, 21 nt, Human
ccucuauuuauguuugcacuu

SEQ ID NO: 2386664 - RNA, 17 nt, Human
ccucuauuuauguuugc

SEQ ID NO: 2386665 - RNA, 20 nt, Human
ccucuauugauguacagucu

SEQ ID NO: 2386666 - RNA, 23 nt, Human
ccucuauugauguacagucuguc

SEQ ID NO: 2386667 - RNA, 13 nt, Human
ccucuaucccaau

SEQ ID NO: 2386668 - RNA, 19 nt, Human
ccucuaugaacuauggacg

SEQ ID NO: 2386669 - RNA, 14 nt, Human
ccucuauugaugua

SEQ ID NO: 2386670 - RNA, 18 nt, Human
ccucucauuccagaggaa

SEQ ID NO: 2386671 - RNA, 12 nt, Human
ccucuccaaggg

SEQ ID NO: 2386672 - RNA, 23 nt, Human
ccucucaucaguguccucuugcu

SEQ ID NO: 2386673 - RNA, 15 nt, Human
ccucuagugcccucc

SEQ ID NO: 2386674 - RNA, 14 nt, Human
ccucuagugcccuc

SEQ ID NO: 2386675 - RNA, 13 nt, Human
ccucuagugcccu

SEQ ID NO: 2386676 - RNA, 20 nt, Human
ccucuagggaccccuccucc

SEQ ID NO: 2386677 - RNA, 18 nt, Human
ccucuagggaccccuccu

SEQ ID NO: 2386678 - RNA, 19 nt, Human
ccucuagggaccccuccuc

SEQ ID NO: 2386679 - RNA, 12 nt, Human
ccucuagggacc

SEQ ID NO: 2386680 - RNA, 22 nt, Human
ccucuagcugugggggugaggg

SEQ ID NO: 2386681 - RNA, 16 nt, Human
ccucuaggaggucucu

SEQ ID NO: 2386682 - RNA, 17 nt, Human
ccucccgaauagcuggg

SEQ ID NO: 2386683 - RNA, 17 nt, Human
ccuccacguucaccccu

SEQ ID NO: 2386684 - RNA, 18 nt, Human
ccuccacguucaccccuc

SEQ ID NO: 2386685 - RNA, 14 nt, Human
ccuccaccucuuca

SEQ ID NO: 2386686 - RNA, 15 nt, Human
ccuccaccugccgug

SEQ ID NO: 2386687 - RNA, 17 nt, Human
ccuccaccccccagaac

SEQ ID NO: 2386688 - RNA, 13 nt, Human
ccuccacccucug

SEQ ID NO: 2386689 - RNA, 14 nt, Human
ccuccacccucuga

SEQ ID NO: 2386690 - RNA, 15 nt, Human
ccuccacccucugag

SEQ ID NO: 2386691 - RNA, 16 nt, Human
ccuccacccucugagc

SEQ ID NO: 2386692 - RNA, 20 nt, Human
ccuccacccucugagcuuug

SEQ ID NO: 2386693 - RNA, 22 nt, Human
ccuccacccucugagcuuugca

SEQ ID NO: 2386694 - RNA, 15 nt, Human
ccuccaccaccacug

SEQ ID NO: 2386695 - RNA, 17 nt, Human
ccuccaccaccacuggc

SEQ ID NO: 2386696 - RNA, 18 nt, Human
ccuccaccaccacuggcc

SEQ ID NO: 2386697 - RNA, 19 nt, Human
ccuccaccaccacuggcca

SEQ ID NO: 2386698 - RNA, 20 nt, Human
ccuccaccaccacuggccac

SEQ ID NO: 2386699 - RNA, 21 nt, Human
ccuccaccaccacuggccacc

SEQ ID NO: 2386700 - RNA, 23 nt, Human
ccuccaccaccacuggccaccag

SEQ ID NO: 2386701 - RNA, 15 nt, Human
ccuccaccgcugccu

SEQ ID NO: 2386702 - RNA, 14 nt, Human
ccuccaccgcugcc

SEQ ID NO: 2386703 - RNA, 13 nt, Human
ccuccaccgcugc

SEQ ID NO: 2386704 - RNA, 17 nt, Human
ccuccaccgccauggcu

SEQ ID NO: 2386705 - RNA, 19 nt, Human
ccuccaccgccauggcuuc

SEQ ID NO: 2386706 - RNA, 21 nt, Human
ccuccaccgccauggcuucca

SEQ ID NO: 2386707 - RNA, 11 nt, Human
ccuccacccug

SEQ ID NO: 2386708 - RNA, 14 nt, Human
ccuccacccugucc

SEQ ID NO: 2386709 - RNA, 15 nt, Human
ccuccacccuguccc

SEQ ID NO: 2386710 - RNA, 16 nt, Human
ccuccacccugucccc

SEQ ID NO: 2386711 - RNA, 19 nt, Human
ccuccacccugucccccag

SEQ ID NO: 2386712 - RNA, 20 nt, Human
ccuccacccugucccccagc

SEQ ID NO: 2386713 - RNA, 21 nt, Human
ccuccacccugucccccagcu

SEQ ID NO: 2386714 - RNA, 24 nt, Human
ccuccacccugucccccagcucug

SEQ ID NO: 2386715 - RNA, 22 nt, Human
ccuccagaagccucuggcuaga

SEQ ID NO: 2386716 - RNA, 21 nt, Human
ccuccagaagccucuggcuag

SEQ ID NO: 2386717 - RNA, 20 nt, Human
ccuccagaagccucuggcua

SEQ ID NO: 2386718 - RNA, 19 nt, Human
ccuccagaagccucuggcu

SEQ ID NO: 2386719 - RNA, 18 nt, Human
ccuccagaagccucuggc

SEQ ID NO: 2386720 - RNA, 11 nt, Human
ccuccacuccu

SEQ ID NO: 2386721 - RNA, 20 nt, Human
ccuccacucccacuucccug

SEQ ID NO: 2386722 - RNA, 13 nt, Human
ccuccacucccac

SEQ ID NO: 2386723 - RNA, 14 nt, Human
ccuccacucccacu

SEQ ID NO: 2386724 - RNA, 15 nt, Human
ccuccacucccacuu

SEQ ID NO: 2386725 - RNA, 18 nt, Human
ccuccacucccacuuccc

SEQ ID NO: 2386726 - RNA, 21 nt, Human
ccuccacguucugcucaucau

SEQ ID NO: 2386727 - RNA, 23 nt, Human
ccuccaccucuucaccccccacu

SEQ ID NO: 2386728 - RNA, 12 nt, Human
ccuccacuccca

SEQ ID NO: 2386729 - RNA, 18 nt, Human
ccuccacguucugcucau

SEQ ID NO: 2386730 - RNA, 17 nt, Human
ccuccacguucugcuca

SEQ ID NO: 2386731 - RNA, 20 nt, Human
ccuccagggccacgugccag

SEQ ID NO: 2386732 - RNA, 19 nt, Human
ccuccagggccacgugcca

SEQ ID NO: 2386733 - RNA, 18 nt, Human
ccuccagggccacgugcc

SEQ ID NO: 2386734 - RNA, 17 nt, Human
ccuccagggccacgugc

SEQ ID NO: 2386735 - RNA, 16 nt, Human
ccuccagggccacgug

SEQ ID NO: 2386736 - RNA, 14 nt, Human
ccuccagggccacg

SEQ ID NO: 2386737 - RNA, 12 nt, Human
ccuccagggcca

SEQ ID NO: 2386738 - RNA, 14 nt, Human
ccuccagccucugu

SEQ ID NO: 2386739 - RNA, 15 nt, Human
ccuccagccucuguu

SEQ ID NO: 2386740 - RNA, 11 nt, Human
ccuccagccuc

SEQ ID NO: 2386741 - RNA, 12 nt, Human
ccuccagccucu

SEQ ID NO: 2386742 - RNA, 13 nt, Human
ccuccagccucug

SEQ ID NO: 2386743 - RNA, 13 nt, Human
ccuccagcaggga

SEQ ID NO: 2386744 - RNA, 22 nt, Human
ccuccagggccacgugccaggc

SEQ ID NO: 2386745 - RNA, 21 nt, Human
ccuccagggccacgugccagg

SEQ ID NO: 2386746 - RNA, 12 nt, Human
ccuccagggcug

SEQ ID NO: 2386747 - RNA, 13 nt, Human
ccuccagggcugg

SEQ ID NO: 2386748 - RNA, 16 nt, Human
ccuccagggcuggacu

SEQ ID NO: 2386749 - RNA, 17 nt, Human
ccuccagggcuggacug

SEQ ID NO: 2386750 - RNA, 18 nt, Human
ccuccagggcuggacuga

SEQ ID NO: 2386751 - RNA, 20 nt, Human
ccuccagggcuggacugagg

SEQ ID NO: 2386752 - RNA, 21 nt, Human
ccuccagggcuggacugaggc

SEQ ID NO: 2386753 - RNA, 19 nt, Human
ccuccaggugcacaagcuc

SEQ ID NO: 2386754 - RNA, 21 nt, Human
ccuccaggugcacaagcucca

SEQ ID NO: 2386755 - RNA, 18 nt, Human
ccuccaucuaaacugccc

SEQ ID NO: 2386756 - RNA, 12 nt, Human
ccuccagguuuu

SEQ ID NO: 2386757 - RNA, 24 nt, Human
ccuccaucucauguaucaucugga

SEQ ID NO: 2386758 - RNA, 19 nt, Human
ccuccaucuccaagaaugc

SEQ ID NO: 2386759 - RNA, 21 nt, Human
ccuccaucuccaagaaugcug

SEQ ID NO: 2386760 - RNA, 14 nt, Human
ccuccauccugagg

SEQ ID NO: 2386761 - RNA, 22 nt, Human
ccuccaggugcacaagcuccaa

SEQ ID NO: 2386762 - RNA, 14 nt, Human
ccuccaggugugca

SEQ ID NO: 2386763 - RNA, 19 nt, Human
ccuccaggugugcacgugg

SEQ ID NO: 2386764 - RNA, 11 nt, Human
ccuccagguuu

SEQ ID NO: 2386765 - RNA, 22 nt, Human
ccuccagggcuggacugaggcc

SEQ ID NO: 2386766 - RNA, 23 nt, Human
ccuccaugugggcuaguugggcu

SEQ ID NO: 2386767 - RNA, 14 nt, Human
ccuccaugcugccu

SEQ ID NO: 2386768 - RNA, 19 nt, Human
ccuccaugacugcacagua

SEQ ID NO: 2386769 - RNA, 23 nt, Human
ccuccaucuccaagaaugcugaa

SEQ ID NO: 2386770 - RNA, 18 nt, Human
ccuccaucuucuuugcag

SEQ ID NO: 2386771 - RNA, 15 nt, Human
ccucccaaagugcug

SEQ ID NO: 2386772 - RNA, 16 nt, Human
ccuccagguuuuucaa

SEQ ID NO: 2386773 - RNA, 15 nt, Human
ccuccaugcugccuc

SEQ ID NO: 2386774 - RNA, 22 nt, Human
ccucccccaacccccaccccac

SEQ ID NO: 2386775 - RNA, 19 nt, Human
ccucccccaacccccaccc

SEQ ID NO: 2386776 - RNA, 18 nt, Human
ccucccccaacccccacc

SEQ ID NO: 2386777 - RNA, 13 nt, Human
ccucccccaaccc

SEQ ID NO: 2386778 - RNA, 21 nt, Human
ccuccccauuagagucagccu

SEQ ID NO: 2386779 - RNA, 14 nt, Human
ccuccccauuuccc

SEQ ID NO: 2386780 - RNA, 15 nt, Human
ccuccccauuuccca

SEQ ID NO: 2386781 - RNA, 20 nt, Human
ccuccccauuucccaucugc

SEQ ID NO: 2386782 - RNA, 21 nt, Human
ccuccccauuucccaucugca

SEQ ID NO: 2386783 - RNA, 22 nt, Human
ccuccccauuucccaucugcac

SEQ ID NO: 2386784 - RNA, 15 nt, Human
ccuccauucugacca

SEQ ID NO: 2386785 - RNA, 22 nt, Human
ccuccccaggggagagggucug

SEQ ID NO: 2386786 - RNA, 20 nt, Human
ccuccccauuagagucagcc

SEQ ID NO: 2386787 - RNA, 16 nt, Human
ccuccccauggagcca

SEQ ID NO: 2386788 - RNA, 16 nt, Human
ccucccaaagugcugg

SEQ ID NO: 2386789 - RNA, 12 nt, Human
ccuccacagcuu

SEQ ID NO: 2386790 - RNA, 11 nt, Human
ccuccacagcu

SEQ ID NO: 2386791 - RNA, 17 nt, Human
ccuccacagccgcagcc

SEQ ID NO: 2386792 - RNA, 16 nt, Human
ccuccacagccgcagc

SEQ ID NO: 2386793 - RNA, 15 nt, Human
ccuccacagccgcag

SEQ ID NO: 2386794 - RNA, 20 nt, Human
ccuccacauccuccacguuc

SEQ ID NO: 2386795 - RNA, 12 nt, Human
ccuccacauccu

SEQ ID NO: 2386796 - RNA, 14 nt, Human
ccuccaccaccacu

SEQ ID NO: 2386797 - RNA, 16 nt, Human
ccuccacauccuuucu

SEQ ID NO: 2386798 - RNA, 16 nt, Human
ccuccacauccuccac

SEQ ID NO: 2386799 - RNA, 15 nt, Human
ccuccacauccucca

SEQ ID NO: 2386800 - RNA, 14 nt, Human
ccuccacauccucc

SEQ ID NO: 2386801 - RNA, 17 nt, Human
ccuccacaguucagugg

SEQ ID NO: 2386802 - RNA, 23 nt, Human
ccuccacaguucgaccugcggcu

SEQ ID NO: 2386803 - RNA, 20 nt, Human
ccucaucugggggaguggaa

SEQ ID NO: 2386804 - RNA, 15 nt, Human
ccucaucuucuucac

SEQ ID NO: 2386805 - RNA, 18 nt, Human
ccucaucuucuucaccau

SEQ ID NO: 2386806 - RNA, 20 nt, Human
ccucaucucucugcccaacc

SEQ ID NO: 2386807 - RNA, 13 nt, Human
ccucaucugcuca

SEQ ID NO: 2386808 - RNA, 19 nt, Human
ccucaucugcucagcagcu

SEQ ID NO: 2386809 - RNA, 17 nt, Human
ccucaucugucccuccg

SEQ ID NO: 2386810 - RNA, 15 nt, Human
ccucaucugucccuc

SEQ ID NO: 2386811 - RNA, 23 nt, Human
ccuccaaucccaccaacccucag

SEQ ID NO: 2386812 - RNA, 17 nt, Human
ccucaucuucuucacca

SEQ ID NO: 2386813 - RNA, 17 nt, Human
ccucaucuuucaucaau

SEQ ID NO: 2386814 - RNA, 15 nt, Human
ccuccaauccugccc

SEQ ID NO: 2386815 - RNA, 16 nt, Human
ccuccaauccugcccc

SEQ ID NO: 2386816 - RNA, 20 nt, Human
ccucaguggacuuuccaccc

SEQ ID NO: 2386817 - RNA, 12 nt, Human
ccucauauuuaa

SEQ ID NO: 2386818 - RNA, 18 nt, Human
ccucaguggacuuuccac

SEQ ID NO: 2386819 - RNA, 16 nt, Human
ccucaguggacuuucc

SEQ ID NO: 2386820 - RNA, 13 nt, Human
ccucauauuuaaa

SEQ ID NO: 2386821 - RNA, 13 nt, Human
ccucaucaggaug

SEQ ID NO: 2386822 - RNA, 14 nt, Human
ccucaucaggauga

SEQ ID NO: 2386823 - RNA, 22 nt, Human
ccucauccaccccaucccuccc

SEQ ID NO: 2386824 - RNA, 14 nt, Human
ccucauccagggcu

SEQ ID NO: 2386825 - RNA, 15 nt, Human
ccucauccagggcuc

SEQ ID NO: 2386826 - RNA, 15 nt, Human
ccucaucaggaugaa

SEQ ID NO: 2386827 - RNA, 19 nt, Human
ccucaucaggaugaaccca

SEQ ID NO: 2386828 - RNA, 21 nt, Human
ccucaucaggaugaacccagg

SEQ ID NO: 2386829 - RNA, 23 nt, Human
ccucaucaggaugaacccaggac

SEQ ID NO: 2386830 - RNA, 20 nt, Human
ccucauccgaggcaggguca

SEQ ID NO: 2386831 - RNA, 17 nt, Human
ccucauccgaggcaggg

SEQ ID NO: 2386832 - RNA, 15 nt, Human
ccucauccgaggcag

SEQ ID NO: 2386833 - RNA, 14 nt, Human
ccucauccgaggca

SEQ ID NO: 2386834 - RNA, 20 nt, Human
ccucaucccgagcaccucca

SEQ ID NO: 2386835 - RNA, 20 nt, Human
ccucaucccguguucuccuu

SEQ ID NO: 2386836 - RNA, 14 nt, Human
ccucaucccgagca

SEQ ID NO: 2386837 - RNA, 23 nt, Human
ccucauccagggcucugaccagu

SEQ ID NO: 2386838 - RNA, 21 nt, Human
ccucaucuccccaucauuggu

SEQ ID NO: 2386839 - RNA, 19 nt, Human
ccucaucucucugcccaac

SEQ ID NO: 2386840 - RNA, 17 nt, Human
ccucaucucucugccca

SEQ ID NO: 2386841 - RNA, 21 nt, Human
ccucaucgcguccuccuaccg

SEQ ID NO: 2386842 - RNA, 13 nt, Human
ccucaucucauuc

SEQ ID NO: 2386843 - RNA, 13 nt, Human
ccucauccucaua

SEQ ID NO: 2386844 - RNA, 20 nt, Human
ccucauccucauacccaccc

SEQ ID NO: 2386845 - RNA, 20 nt, Human
ccucauaguaugguggcugg

SEQ ID NO: 2386846 - RNA, 22 nt, Human
ccucauagcccucacccugggg

SEQ ID NO: 2386847 - RNA, 21 nt, Human
ccucauagcccucacccuggg

SEQ ID NO: 2386848 - RNA, 18 nt, Human
ccucauagcccucacccu

SEQ ID NO: 2386849 - RNA, 17 nt, Human
ccucauagcccucaccc

SEQ ID NO: 2386850 - RNA, 13 nt, Human
ccucauacccacc

SEQ ID NO: 2386851 - RNA, 21 nt, Human
ccucauaguaugguggcuggg

SEQ ID NO: 2386852 - RNA, 22 nt, Human
ccucauaguaugguggcugggu

SEQ ID NO: 2386853 - RNA, 13 nt, Human
ccucaucaccaac

SEQ ID NO: 2386854 - RNA, 14 nt, Human
ccucaucaccaacg

SEQ ID NO: 2386855 - RNA, 20 nt, Human
ccucagucuggcccuuccuu

SEQ ID NO: 2386856 - RNA, 11 nt, Human
ccucagugcca

SEQ ID NO: 2386857 - RNA, 12 nt, Human
ccucauacccac

SEQ ID NO: 2386858 - RNA, 20 nt, Human
ccuaugcugccuaggcugac

SEQ ID NO: 2386859 - RNA, 19 nt, Human
ccucagucuggcccuuccu

SEQ ID NO: 2386860 - RNA, 19 nt, Human
ccuaugcagagguccacaa

SEQ ID NO: 2386861 - RNA, 14 nt, Human
ccuaugcacauaug

SEQ ID NO: 2386862 - RNA, 20 nt, Human
ccuaugcacauauggacucu

SEQ ID NO: 2386863 - RNA, 21 nt, Human
ccuaugcacauauggacucug

SEQ ID NO: 2386864 - RNA, 21 nt, Human
ccuaugcaugguguagaugcc

SEQ ID NO: 2386865 - RNA, 22 nt, Human
ccuaugcaauauaucuaaauug

SEQ ID NO: 2386866 - RNA, 17 nt, Human
cccacaacuccugucua

SEQ ID NO: 2386867 - RNA, 13 nt, Human
cccacaaguggug

SEQ ID NO: 2386868 - RNA, 20 nt, Human
cccacaagaaaugaaagcag

SEQ ID NO: 2386869 - RNA, 23 nt, Human
cccacaaguggugguaacccugg

SEQ ID NO: 2386870 - RNA, 22 nt, Human
cccacaaguggugguaacccug

SEQ ID NO: 2386871 - RNA, 22 nt, Human
cccacaauauaaaacuguacuu

SEQ ID NO: 2386872 - RNA, 22 nt, Human
cccacaaucuuaaggggcagcu

SEQ ID NO: 2386873 - RNA, 20 nt, Human
cccacaaguggugguaaccc

SEQ ID NO: 2386874 - RNA, 16 nt, Human
cccacaagugguggua

SEQ ID NO: 2386875 - RNA, 14 nt, Human
cccacaaguggugg

SEQ ID NO: 2386876 - RNA, 14 nt, Human
cccacacacacaca

SEQ ID NO: 2386877 - RNA, 13 nt, Human
cccacacacacac

SEQ ID NO: 2386878 - RNA, 11 nt, Human
cccacacacac

SEQ ID NO: 2386879 - RNA, 10 nt, Human
cccacacaca

SEQ ID NO: 2386880 - RNA, 16 nt, Human
cccaaugcacuuuguu

SEQ ID NO: 2386881 - RNA, 20 nt, Human
cccaaugcacuuuguucugg

SEQ ID NO: 2386882 - RNA, 13 nt, Human
cccacaagaaaug

SEQ ID NO: 2386883 - RNA, 13 nt, Human
cccacacacagau

SEQ ID NO: 2386884 - RNA, 19 nt, Human
cccacagcgcuggccggga

SEQ ID NO: 2386885 - RNA, 20 nt, Human
cccacacacacacacaugca

SEQ ID NO: 2386886 - RNA, 19 nt, Human
cccacacacacacacaugc

SEQ ID NO: 2386887 - RNA, 18 nt, Human
cccacacacacacacaug

SEQ ID NO: 2386888 - RNA, 17 nt, Human
cccacacacacacacau

SEQ ID NO: 2386889 - RNA, 13 nt, Human
cccacacacccca

SEQ ID NO: 2386890 - RNA, 23 nt, Human
cccacaaucuuaaggggcagcuu

SEQ ID NO: 2386891 - RNA, 17 nt, Human
cccacagcucccacccc

SEQ ID NO: 2386892 - RNA, 15 nt, Human
cccacagcucccacc

SEQ ID NO: 2386893 - RNA, 14 nt, Human
cccacagcucccac

SEQ ID NO: 2386894 - RNA, 12 nt, Human
cccacagcuccc

SEQ ID NO: 2386895 - RNA, 20 nt, Human
cccacagcucccaccccacc

SEQ ID NO: 2386896 - RNA, 19 nt, Human
cccacagcucccaccccac

SEQ ID NO: 2386897 - RNA, 20 nt, Human
cccacaggaagccugcaguc

SEQ ID NO: 2386898 - RNA, 22 nt, Human
cccacaggaagccugcaguccu

SEQ ID NO: 2386899 - RNA, 23 nt, Human
cccacaggaagccugcaguccug

SEQ ID NO: 2386900 - RNA, 14 nt, Human
cccacauuggaccc

SEQ ID NO: 2386901 - RNA, 14 nt, Human
cccacauuccgaca

SEQ ID NO: 2386902 - RNA, 21 nt, Human
cccaccaacaucccauugccc

SEQ ID NO: 2386903 - RNA, 21 nt, Human
cccacaggagguggucuggga

SEQ ID NO: 2386904 - RNA, 19 nt, Human
cccacaugugacacauaug

SEQ ID NO: 2386905 - RNA, 16 nt, Human
cccacaugugacacau

SEQ ID NO: 2386906 - RNA, 16 nt, Human
cccacaggaggugguc

SEQ ID NO: 2386907 - RNA, 20 nt, Human
cccacaggacauuucucuaa

SEQ ID NO: 2386908 - RNA, 19 nt, Human
cccacaggacauuucucua

SEQ ID NO: 2386909 - RNA, 17 nt, Human
cccaccucccugccucc

SEQ ID NO: 2386910 - RNA, 15 nt, Human
cccaccucugugacc

SEQ ID NO: 2386911 - RNA, 17 nt, Human
cccaccucugugaccuc

SEQ ID NO: 2386912 - RNA, 18 nt, Human
cccaccucugugaccuca

SEQ ID NO: 2386913 - RNA, 12 nt, Human
cccaccucuucu

SEQ ID NO: 2386914 - RNA, 20 nt, Human
cccaccucugugaccucagg

SEQ ID NO: 2386915 - RNA, 21 nt, Human
cccaccucugugaccucaggc

SEQ ID NO: 2386916 - RNA, 22 nt, Human
cccaccucucucacuccuugaa

SEQ ID NO: 2386917 - RNA, 16 nt, Human
cccaccucccugccuc

SEQ ID NO: 2386918 - RNA, 15 nt, Human
cccaccucccugccu

SEQ ID NO: 2386919 - RNA, 14 nt, Human
cccaccucccugcc

SEQ ID NO: 2386920 - RNA, 17 nt, Human
cccaccucagccuccug

SEQ ID NO: 2386921 - RNA, 11 nt, Human
cccaccuccac

SEQ ID NO: 2386922 - RNA, 10 nt, Human
cccaccuccc

SEQ ID NO: 2386923 - RNA, 13 nt, Human
cccaccuccccac

SEQ ID NO: 2386924 - RNA, 12 nt, Human
cccaccucccug

SEQ ID NO: 2386925 - RNA, 14 nt, Human
cccaccuccccacg

SEQ ID NO: 2386926 - RNA, 15 nt, Human
cccaccuccccacgc

SEQ ID NO: 2386927 - RNA, 16 nt, Human
cccaccuccccacgcc

SEQ ID NO: 2386928 - RNA, 17 nt, Human
cccaccuccccacgccc

SEQ ID NO: 2386929 - RNA, 17 nt, Human
cccaccucagccucccg

SEQ ID NO: 2386930 - RNA, 23 nt, Human
cccaccgggcugggagcucugca

SEQ ID NO: 2386931 - RNA, 23 nt, Human
cccaccacuaggacucugaggcu

SEQ ID NO: 2386932 - RNA, 20 nt, Human
cccaccacggccacuggcca

SEQ ID NO: 2386933 - RNA, 21 nt, Human
cccaccacggccacuggccau

SEQ ID NO: 2386934 - RNA, 24 nt, Human
cccaccacgauguggcccuggccu

SEQ ID NO: 2386935 - RNA, 14 nt, Human
cccaccacggccac

SEQ ID NO: 2386936 - RNA, 20 nt, Human
cccaccacgauguggcccug

SEQ ID NO: 2386937 - RNA, 19 nt, Human
cccaccacgauguggcccu

SEQ ID NO: 2386938 - RNA, 13 nt, Human
cccaccaggcugc

SEQ ID NO: 2386939 - RNA, 16 nt, Human
cccaccaggcugcuca

SEQ ID NO: 2386940 - RNA, 17 nt, Human
cccaccaggcugcucag

SEQ ID NO: 2386941 - RNA, 22 nt, Human
cccaccaggcugcucagggcug

SEQ ID NO: 2386942 - RNA, 22 nt, Human
cccaccaccuaggccacuccuc

SEQ ID NO: 2386943 - RNA, 21 nt, Human
cccaccaccuaggccacuccu

SEQ ID NO: 2386944 - RNA, 20 nt, Human
cccaccaccuaggccacucc

SEQ ID NO: 2386945 - RNA, 19 nt, Human
cccaccaccuaggccacuc

SEQ ID NO: 2386946 - RNA, 16 nt, Human
cccaccaccuaggcca

SEQ ID NO: 2386947 - RNA, 13 nt, Human
cccaccaccuagg

SEQ ID NO: 2386948 - RNA, 18 nt, Human
cccaccaccccagcugcu

SEQ ID NO: 2386949 - RNA, 15 nt, Human
cccaccaccccagcu

SEQ ID NO: 2386950 - RNA, 13 nt, Human
cccaccacagcag

SEQ ID NO: 2386951 - RNA, 12 nt, Human
cccaccacagca

SEQ ID NO: 2386952 - RNA, 17 nt, Human
cccaccacacccucccu

SEQ ID NO: 2386953 - RNA, 19 nt, Human
cccaccgcagacaggacca

SEQ ID NO: 2386954 - RNA, 20 nt, Human
cccaccgcagacaggaccag

SEQ ID NO: 2386955 - RNA, 22 nt, Human
cccaccgcaugcccccucgugc

SEQ ID NO: 2386956 - RNA, 18 nt, Human
cccaccgcaugcccccuc

SEQ ID NO: 2386957 - RNA, 20 nt, Human
cccaccgcaugcccccucgu

SEQ ID NO: 2386958 - RNA, 14 nt, Human
cccaccgcaugccc

SEQ ID NO: 2386959 - RNA, 19 nt, Human
cccacgcuggagugcagug

SEQ ID NO: 2386960 - RNA, 14 nt, Human
cccacgcuggagug

SEQ ID NO: 2386961 - RNA, 20 nt, Human
cccacgcuggagugcaguga

SEQ ID NO: 2386962 - RNA, 21 nt, Human
cccacgcuggagugcagugag

SEQ ID NO: 2386963 - RNA, 23 nt, Human
cccacuugagaauuacccuuuug

SEQ ID NO: 2386964 - RNA, 12 nt, Human
cccacuucugcc

SEQ ID NO: 2386965 - RNA, 15 nt, Human
cccacuuuggccucc

SEQ ID NO: 2386966 - RNA, 20 nt, Human
cccagaaaaaaaaaaacuua

SEQ ID NO: 2386967 - RNA, 13 nt, Human
cccacuugccucu

SEQ ID NO: 2386968 - RNA, 14 nt, Human
cccacuugccucuu

SEQ ID NO: 2386969 - RNA, 15 nt, Human
cccacuugccucuuc

SEQ ID NO: 2386970 - RNA, 21 nt, Human
cccacuugccucuuccuugaa

SEQ ID NO: 2386971 - RNA, 21 nt, Human
cccaccuuuauuaaaaucuua

SEQ ID NO: 2386972 - RNA, 20 nt, Human
cccaccuuguuggagccugc

SEQ ID NO: 2386973 - RNA, 21 nt, Human
cccaccuuguuggagccugca

SEQ ID NO: 2386974 - RNA, 17 nt, Human
cccaccuuguuggagcc

SEQ ID NO: 2386975 - RNA, 18 nt, Human
cccaccuuguuggagccu

SEQ ID NO: 2386976 - RNA, 19 nt, Human
cccaccuuguuggagccug

SEQ ID NO: 2386977 - RNA, 16 nt, Human
cccaccuggccucugc

SEQ ID NO: 2386978 - RNA, 21 nt, Human
cccacgacugcccggcagggu

SEQ ID NO: 2386979 - RNA, 20 nt, Human
cccacgacugcccggcaggg

SEQ ID NO: 2386980 - RNA, 23 nt, Human
cccaccugcccaucacaggguug

SEQ ID NO: 2386981 - RNA, 20 nt, Human
cccaccugcccaucacaggg

SEQ ID NO: 2386982 - RNA, 13 nt, Human
cccaccugcccau

SEQ ID NO: 2386983 - RNA, 17 nt, Human
cccaccuggccucugca

SEQ ID NO: 2386984 - RNA, 19 nt, Human
cccaccuggccucugcacu

SEQ ID NO: 2386985 - RNA, 21 nt, Human
cccaccuggccucugcacucc

SEQ ID NO: 2386986 - RNA, 16 nt, Human
cccugggccccaccac

SEQ ID NO: 2386987 - RNA, 20 nt, Human
cccugggccccaccaccuag

SEQ ID NO: 2386988 - RNA, 18 nt, Human
cccugggccccaccaccu

SEQ ID NO: 2386989 - RNA, 13 nt, Human
cccugggcccugg

SEQ ID NO: 2386990 - RNA, 16 nt, Human
cccugggcccugggcu

SEQ ID NO: 2386991 - RNA, 18 nt, Human
cccugggcccugggcugg

SEQ ID NO: 2386992 - RNA, 22 nt, Human
cccugggccccaccaccuaggc

SEQ ID NO: 2386993 - RNA, 19 nt, Human
cccugggcccugggcugga

SEQ ID NO: 2386994 - RNA, 17 nt, Human
cccugggcucggaggcu

SEQ ID NO: 2386995 - RNA, 18 nt, Human
cccuggcuuuucacugcu

SEQ ID NO: 2386996 - RNA, 17 nt, Human
cccuggcuuuucacugc

SEQ ID NO: 2386997 - RNA, 15 nt, Human
cccuggacugugugc

SEQ ID NO: 2386998 - RNA, 19 nt, Human
cccuggcuuuucacugcug

SEQ ID NO: 2386999 - RNA, 22 nt, Human
cccuggcuuuucacugcuggcu

SEQ ID NO: 2387000 - RNA, 13 nt, Human
cccuggacuggga

SEQ ID NO: 2387001 - RNA, 14 nt, Human
cccuggacugggag

SEQ ID NO: 2387002 - RNA, 18 nt, Human
cccugggaggcagugaug

SEQ ID NO: 2387003 - RNA, 17 nt, Human
cccugguccuuccaggc

SEQ ID NO: 2387004 - RNA, 16 nt, Human
cccugguccuuccagg

SEQ ID NO: 2387005 - RNA, 13 nt, Human
cccuggucucagc

SEQ ID NO: 2387006 - RNA, 17 nt, Human
cccuggucucagcagcg

SEQ ID NO: 2387007 - RNA, 20 nt, Human
cccuggucucagcagcgacc

SEQ ID NO: 2387008 - RNA, 15 nt, Human
cccugguggcagcuc

SEQ ID NO: 2387009 - RNA, 16 nt, Human
cccugguggcagcuca

SEQ ID NO: 2387010 - RNA, 17 nt, Human
cccugguggcagcucac

SEQ ID NO: 2387011 - RNA, 13 nt, Human
cccugguccuucc

SEQ ID NO: 2387012 - RNA, 15 nt, Human
cccugguccugaggg

SEQ ID NO: 2387013 - RNA, 18 nt, Human
cccugguccagggaagcu

SEQ ID NO: 2387014 - RNA, 16 nt, Human
cccugguccagggaag

SEQ ID NO: 2387015 - RNA, 15 nt, Human
cccugguagggcagu

SEQ ID NO: 2387016 - RNA, 15 nt, Human
cccugggcucugccc

SEQ ID NO: 2387017 - RNA, 13 nt, Human
cccugggcucugc

SEQ ID NO: 2387018 - RNA, 16 nt, Human
cccugggcucugcccc

SEQ ID NO: 2387019 - RNA, 14 nt, Human
cccugggcucugug

SEQ ID NO: 2387020 - RNA, 23 nt, Human
cccugguaauaaguacuguguac

SEQ ID NO: 2387021 - RNA, 23 nt, Human
cccuggguucagaaaugcugccu

SEQ ID NO: 2387022 - RNA, 22 nt, Human
cccuggguucagaaaugcugcc

SEQ ID NO: 2387023 - RNA, 17 nt, Human
cccugggcucugugggc

SEQ ID NO: 2387024 - RNA, 20 nt, Human
cccugggcucugugggcugc

SEQ ID NO: 2387025 - RNA, 12 nt, Human
cccugccagcuc

SEQ ID NO: 2387026 - RNA, 20 nt, Human
cccugccacucacuaggccc

SEQ ID NO: 2387027 - RNA, 13 nt, Human
cccugccagcucu

SEQ ID NO: 2387028 - RNA, 18 nt, Human
cccugcuggccgccucac

SEQ ID NO: 2387029 - RNA, 18 nt, Human
cccugcccaccuggccuc

SEQ ID NO: 2387030 - RNA, 16 nt, Human
cccugcuggguguggc

SEQ ID NO: 2387031 - RNA, 21 nt, Human
cccugcuggguguggcgcagc

SEQ ID NO: 2387032 - RNA, 13 nt, Human
cccugcccaccug

SEQ ID NO: 2387033 - RNA, 21 nt, Human
cccugccagacccccuggaga

SEQ ID NO: 2387034 - RNA, 13 nt, Human
cccugccagaccc

SEQ ID NO: 2387035 - RNA, 14 nt, Human
cccugcccaccugg

SEQ ID NO: 2387036 - RNA, 17 nt, Human
cccugcccaccuggccu

SEQ ID NO: 2387037 - RNA, 18 nt, Human
cccugcuuugggcugccc

SEQ ID NO: 2387038 - RNA, 19 nt, Human
cccugcuuugggcugcccu

SEQ ID NO: 2387039 - RNA, 17 nt, Human
cccugcuuugggcugcc

SEQ ID NO: 2387040 - RNA, 13 nt, Human
cccugcuggcucu

SEQ ID NO: 2387041 - RNA, 14 nt, Human
cccugcuggcucuu

SEQ ID NO: 2387042 - RNA, 15 nt, Human
cccugcuggcucuuc

SEQ ID NO: 2387043 - RNA, 22 nt, Human
cccugcuggguguggcgcagca

SEQ ID NO: 2387044 - RNA, 17 nt, Human
cccuggacaagcagagg

SEQ ID NO: 2387045 - RNA, 20 nt, Human
cccugcuggcucuucugccc

SEQ ID NO: 2387046 - RNA, 21 nt, Human
cccugcuggcucuucugccca

SEQ ID NO: 2387047 - RNA, 18 nt, Human
cccuggaagccggcggcc

SEQ ID NO: 2387048 - RNA, 22 nt, Human
cccuggaagccggcggcccaag

SEQ ID NO: 2387049 - RNA, 20 nt, Human
cccugcuuugggcugcccug

SEQ ID NO: 2387050 - RNA, 23 nt, Human
cccuggaccaguggucucacaug

SEQ ID NO: 2387051 - RNA, 21 nt, Human
cccuggaccaguggucucaca

SEQ ID NO: 2387052 - RNA, 17 nt, Human
cccuggaccaguggucu

SEQ ID NO: 2387053 - RNA, 16 nt, Human
cccuggaccagugguc

SEQ ID NO: 2387054 - RNA, 20 nt, Human
cccucuguccaggcacugag

SEQ ID NO: 2387055 - RNA, 13 nt, Human
cccucuguccuga

SEQ ID NO: 2387056 - RNA, 24 nt, Human
cccucuguccaggcacugagauac

SEQ ID NO: 2387057 - RNA, 18 nt, Human
cccugaaaacccagagag

SEQ ID NO: 2387058 - RNA, 17 nt, Human
cccugaaaacccagaga

SEQ ID NO: 2387059 - RNA, 16 nt, Human
cccugaaaacccagag

SEQ ID NO: 2387060 - RNA, 15 nt, Human
cccugaaaacccaga

SEQ ID NO: 2387061 - RNA, 18 nt, Human
cccucuguguauuugcuu

SEQ ID NO: 2387062 - RNA, 14 nt, Human
cccucuguccugac

SEQ ID NO: 2387063 - RNA, 15 nt, Human
cccucuguccugacu

SEQ ID NO: 2387064 - RNA, 16 nt, Human
cccucuggggcuguuc

SEQ ID NO: 2387065 - RNA, 18 nt, Human
cccucuggucgcuccugc

SEQ ID NO: 2387066 - RNA, 19 nt, Human
cccucuggucgcuccugcc

SEQ ID NO: 2387067 - RNA, 20 nt, Human
cccucuggucgcuccugccc

SEQ ID NO: 2387068 - RNA, 22 nt, Human
cccucuggucgcuccugcccac

SEQ ID NO: 2387069 - RNA, 16 nt, Human
cccugaaagcccugag

SEQ ID NO: 2387070 - RNA, 14 nt, Human
cccugaaacuuauu

SEQ ID NO: 2387071 - RNA, 15 nt, Human
cccugaaacuuauuu

SEQ ID NO: 2387072 - RNA, 17 nt, Human
cccugaaacuuauuuuu

SEQ ID NO: 2387073 - RNA, 13 nt, Human
cccugaggcccag

SEQ ID NO: 2387074 - RNA, 24 nt, Human
cccugaaaauguuuuucugccagg

SEQ ID NO: 2387075 - RNA, 23 nt, Human
cccugaaaauguuuuucugccag

SEQ ID NO: 2387076 - RNA, 22 nt, Human
cccugaaaauguuuuucugcca

SEQ ID NO: 2387077 - RNA, 15 nt, Human
cccugaaagcccuga

SEQ ID NO: 2387078 - RNA, 14 nt, Human
cccugaggcccaga

SEQ ID NO: 2387079 - RNA, 15 nt, Human
cccugaggcccagag

SEQ ID NO: 2387080 - RNA, 16 nt, Human
cccugaggcccagagg

SEQ ID NO: 2387081 - RNA, 17 nt, Human
cccugaggcccagaggg

SEQ ID NO: 2387082 - RNA, 18 nt, Human
cccugaggcccagagggc

SEQ ID NO: 2387083 - RNA, 19 nt, Human
cccugaggcccagagggcc

SEQ ID NO: 2387084 - RNA, 20 nt, Human
cccugaggcccagagggccu

SEQ ID NO: 2387085 - RNA, 23 nt, Human
cccugaggcccagagggccugca

SEQ ID NO: 2387086 - RNA, 19 nt, Human
cccugcacuugcagacucu

SEQ ID NO: 2387087 - RNA, 13 nt, Human
cccugccacucac

SEQ ID NO: 2387088 - RNA, 18 nt, Human
cccugccacucacuaggc

SEQ ID NO: 2387089 - RNA, 19 nt, Human
cccugccacucacuaggcc

SEQ ID NO: 2387090 - RNA, 12 nt, Human
cccugcacuugc

SEQ ID NO: 2387091 - RNA, 16 nt, Human
cccugcacuguccugc

SEQ ID NO: 2387092 - RNA, 17 nt, Human
cccugcacuguccugcu

SEQ ID NO: 2387093 - RNA, 18 nt, Human
cccugcacuguccugcuc

SEQ ID NO: 2387094 - RNA, 19 nt, Human
cccugcacuguccugcucc

SEQ ID NO: 2387095 - RNA, 20 nt, Human
cccugcacuguccugcucca

SEQ ID NO: 2387096 - RNA, 21 nt, Human
cccugcacuguccugcuccac

SEQ ID NO: 2387097 - RNA, 22 nt, Human
cccugcacuguccugcuccaca

SEQ ID NO: 2387098 - RNA, 23 nt, Human
cccugcacuguccugcuccacag

SEQ ID NO: 2387099 - RNA, 22 nt, Human
cccugcacuggaguccagucuc

SEQ ID NO: 2387100 - RNA, 13 nt, Human
cccugcacuggag

SEQ ID NO: 2387101 - RNA, 23 nt, Human
cccugcacuggaguccagucucu

SEQ ID NO: 2387102 - RNA, 15 nt, Human
cccugcacuguccug

SEQ ID NO: 2387103 - RNA, 13 nt, Human
cccugcacugucc

SEQ ID NO: 2387104 - RNA, 13 nt, Human
cccugcacgucau

SEQ ID NO: 2387105 - RNA, 15 nt, Human
cccugcacgucaugg

SEQ ID NO: 2387106 - RNA, 14 nt, Human
cccugcacgucaug

SEQ ID NO: 2387107 - RNA, 10 nt, Human
cccugcacug

SEQ ID NO: 2387108 - RNA, 16 nt, Human
cccugcaaaggacugu

SEQ ID NO: 2387109 - RNA, 15 nt, Human
cccugcaaaggacug

SEQ ID NO: 2387110 - RNA, 23 nt, Human
cccugcacaaagcccuuccaugu

SEQ ID NO: 2387111 - RNA, 20 nt, Human
cccugcaaagcccagcuuga

SEQ ID NO: 2387112 - RNA, 19 nt, Human
cccugcaaagcccagcuug

SEQ ID NO: 2387113 - RNA, 17 nt, Human
cccugcaaagcccagcu

SEQ ID NO: 2387114 - RNA, 16 nt, Human
cccugcaaagcccagc

SEQ ID NO: 2387115 - RNA, 20 nt, Human
cccugaggugaaagggagcu

SEQ ID NO: 2387116 - RNA, 15 nt, Human
cccugaggugugggg

SEQ ID NO: 2387117 - RNA, 19 nt, Human
cccugaggugugggggcug

SEQ ID NO: 2387118 - RNA, 18 nt, Human
cccugaggugaaagggag

SEQ ID NO: 2387119 - RNA, 17 nt, Human
cccugaggggucccuga

SEQ ID NO: 2387120 - RNA, 18 nt, Human
cccugaggcucagggaaa

SEQ ID NO: 2387121 - RNA, 12 nt, Human
cccugaggcuca

SEQ ID NO: 2387122 - RNA, 22 nt, Human
cccugaaacuuauuuuuuucug

SEQ ID NO: 2387123 - RNA, 23 nt, Human
cccugaaacuuauuuuuuucuga

SEQ ID NO: 2387124 - RNA, 17 nt, Human
cccugagucaccaggaa

SEQ ID NO: 2387125 - RNA, 16 nt, Human
cccugagucaccagga

SEQ ID NO: 2387126 - RNA, 22 nt, Human
cccugaguaaucgcuuaaagau

SEQ ID NO: 2387127 - RNA, 20 nt, Human
cccugaggugugggggcugc

SEQ ID NO: 2387128 - RNA, 21 nt, Human
cccugaggugugggggcugca

SEQ ID NO: 2387129 - RNA, 22 nt, Human
cccugaggugugggggcugcag

SEQ ID NO: 2387130 - RNA, 23 nt, Human
cccugaggugugggggcugcagc

SEQ ID NO: 2387131 - RNA, 15 nt, Human
cccugcaaagcccag

SEQ ID NO: 2387132 - RNA, 19 nt, Human
cccugaguggaucuccaag

SEQ ID NO: 2387133 - RNA, 20 nt, Human
cccugaguggaucuccaagg

SEQ ID NO: 2387134 - RNA, 23 nt, Human
cccugcaaaauuugaugccagga

SEQ ID NO: 2387135 - RNA, 15 nt, Human
cccuaguaaaaauac

SEQ ID NO: 2387136 - RNA, 17 nt, Human
cccuaguaagugccuuc

SEQ ID NO: 2387137 - RNA, 18 nt, Human
cccuaguaagugccuucc

SEQ ID NO: 2387138 - RNA, 16 nt, Human
cccuagucccuucccc

SEQ ID NO: 2387139 - RNA, 20 nt, Human
cccuaguaagugccuuccau

SEQ ID NO: 2387140 - RNA, 23 nt, Human
cccuaguaagugccuuccauguc

SEQ ID NO: 2387141 - RNA, 22 nt, Human
cccuaggucagcuugcugcccu

SEQ ID NO: 2387142 - RNA, 22 nt, Human
cccuagucccuuccccucccug

SEQ ID NO: 2387143 - RNA, 17 nt, Human
cccuagucccuuccccu

SEQ ID NO: 2387144 - RNA, 19 nt, Human
cccuaguucuaccucaggc

SEQ ID NO: 2387145 - RNA, 21 nt, Human
cccuagugacccggaggccac

SEQ ID NO: 2387146 - RNA, 19 nt, Human
cccuagugacccggaggcc

SEQ ID NO: 2387147 - RNA, 23 nt, Human
cccuauauguaguauaaagaaaa

SEQ ID NO: 2387148 - RNA, 15 nt, Human
cccuccacaucccug

SEQ ID NO: 2387149 - RNA, 19 nt, Human
cccuauccacccagcccau

SEQ ID NO: 2387150 - RNA, 12 nt, Human
cccuccacccug

SEQ ID NO: 2387151 - RNA, 14 nt, Human
cccuccacccuguc

SEQ ID NO: 2387152 - RNA, 18 nt, Human
cccuauccacccagccca

SEQ ID NO: 2387153 - RNA, 16 nt, Human
cccuauccacccagcc

SEQ ID NO: 2387154 - RNA, 14 nt, Human
cccuauccacccag

SEQ ID NO: 2387155 - RNA, 14 nt, Human
cccuccacaucccu

SEQ ID NO: 2387156 - RNA, 16 nt, Human
cccuccacccuguccc

SEQ ID NO: 2387157 - RNA, 22 nt, Human
cccuccacccugucccccagcu

SEQ ID NO: 2387158 - RNA, 18 nt, Human
cccuccacguucaccccu

SEQ ID NO: 2387159 - RNA, 17 nt, Human
cccuccacuccuuccug

SEQ ID NO: 2387160 - RNA, 12 nt, Human
cccuccacuccu

SEQ ID NO: 2387161 - RNA, 12 nt, Human
cccuccacuguc

SEQ ID NO: 2387162 - RNA, 23 nt, Human
cccuccacucuccucuuccaggc

SEQ ID NO: 2387163 - RNA, 13 nt, Human
cccuccaccugcu

SEQ ID NO: 2387164 - RNA, 13 nt, Human
cccuccccagggg

SEQ ID NO: 2387165 - RNA, 12 nt, Human
cccuccccaggg

SEQ ID NO: 2387166 - RNA, 16 nt, Human
cccuccccaucccaug

SEQ ID NO: 2387167 - RNA, 16 nt, Human
cccucccccaaccccc

SEQ ID NO: 2387168 - RNA, 14 nt, Human
cccuccccauggag

SEQ ID NO: 2387169 - RNA, 14 nt, Human
cccuccccagggga

SEQ ID NO: 2387170 - RNA, 14 nt, Human
cccucccccacugc

SEQ ID NO: 2387171 - RNA, 18 nt, Human
cccucccccccaugcacu

SEQ ID NO: 2387172 - RNA, 15 nt, Human
cccucccccccaugc

SEQ ID NO: 2387173 - RNA, 22 nt, Human
cccucccagggccagggcccug

SEQ ID NO: 2387174 - RNA, 13 nt, Human
cccucccaucugg

SEQ ID NO: 2387175 - RNA, 15 nt, Human
cccuccccagagcac

SEQ ID NO: 2387176 - RNA, 15 nt, Human
cccucccauuaggac

SEQ ID NO: 2387177 - RNA, 16 nt, Human
cccuccccagagcacu

SEQ ID NO: 2387178 - RNA, 14 nt, Human
cccucccaucuggg

SEQ ID NO: 2387179 - RNA, 16 nt, Human
cccucccaucugggag

SEQ ID NO: 2387180 - RNA, 17 nt, Human
cccucccaucugggagu

SEQ ID NO: 2387181 - RNA, 13 nt, Human
cccucccauuagg

SEQ ID NO: 2387182 - RNA, 13 nt, Human
cccucuccugccu

SEQ ID NO: 2387183 - RNA, 12 nt, Human
cccucuccugcc

SEQ ID NO: 2387184 - RNA, 17 nt, Human
cccucuccugccuacuc

SEQ ID NO: 2387185 - RNA, 20 nt, Human
cccucccccccaugcacugu

SEQ ID NO: 2387186 - RNA, 21 nt, Human
cccucccccgccacuccugaa

SEQ ID NO: 2387187 - RNA, 17 nt, Human
cccucucucuucugcuc

SEQ ID NO: 2387188 - RNA, 15 nt, Human
cccucucucuucugc

SEQ ID NO: 2387189 - RNA, 14 nt, Human
cccucucucuucug

SEQ ID NO: 2387190 - RNA, 13 nt, Human
cccucucucuucu

SEQ ID NO: 2387191 - RNA, 12 nt, Human
cccucucucuga

SEQ ID NO: 2387192 - RNA, 13 nt, Human
cccucucucugac

SEQ ID NO: 2387193 - RNA, 15 nt, Human
cccucucucugacuc

SEQ ID NO: 2387194 - RNA, 18 nt, Human
cccucucucugacucuca

SEQ ID NO: 2387195 - RNA, 13 nt, Human
cccucucuccucc

SEQ ID NO: 2387196 - RNA, 23 nt, Human
cccucucucuucugcuccacccu

SEQ ID NO: 2387197 - RNA, 22 nt, Human
cccucucucuucugcuccaccc

SEQ ID NO: 2387198 - RNA, 19 nt, Human
cccucucucuucugcucca

SEQ ID NO: 2387199 - RNA, 18 nt, Human
cccucucucuucugcucc

SEQ ID NO: 2387200 - RNA, 12 nt, Human
cccucucugcau

SEQ ID NO: 2387201 - RNA, 14 nt, Human
cccucucugcucug

SEQ ID NO: 2387202 - RNA, 18 nt, Human
cccucucugcaucugacc

SEQ ID NO: 2387203 - RNA, 20 nt, Human
cccucucugcaucugaccac

SEQ ID NO: 2387204 - RNA, 14 nt, Human
cccucugccugucc

SEQ ID NO: 2387205 - RNA, 14 nt, Human
cccucugccaccag

SEQ ID NO: 2387206 - RNA, 12 nt, Human
cccucugccacc

SEQ ID NO: 2387207 - RNA, 13 nt, Human
cccucugccacca

SEQ ID NO: 2387208 - RNA, 22 nt, Human
cccucugaaugguccaggguug

SEQ ID NO: 2387209 - RNA, 20 nt, Human
cccucugagaauuccaagga

SEQ ID NO: 2387210 - RNA, 21 nt, Human
cccucugagaauuccaaggag

SEQ ID NO: 2387211 - RNA, 9 nt, Human
cccucugcc

SEQ ID NO: 2387212 - RNA, 15 nt, Human
cccucugaccugcac

SEQ ID NO: 2387213 - RNA, 16 nt, Human
cccucugaccugcacu

SEQ ID NO: 2387214 - RNA, 17 nt, Human
cccucugaccugcacug

SEQ ID NO: 2387215 - RNA, 19 nt, Human
cccucugaccugcacuggg

SEQ ID NO: 2387216 - RNA, 11 nt, Human
cccucucugga

SEQ ID NO: 2387217 - RNA, 16 nt, Human
cccucucugcucugcg

SEQ ID NO: 2387218 - RNA, 15 nt, Human
cccucucugcucugc

SEQ ID NO: 2387219 - RNA, 23 nt, Human
cccucucuugcacccgccucucc

SEQ ID NO: 2387220 - RNA, 13 nt, Human
cccucucuugcac

SEQ ID NO: 2387221 - RNA, 18 nt, Human
cccucucuugcacccgcc

SEQ ID NO: 2387222 - RNA, 19 nt, Human
cccucugaaugguccaggg

SEQ ID NO: 2387223 - RNA, 14 nt, Human
cccucugaccugca

SEQ ID NO: 2387224 - RNA, 23 nt, Human
cccucugccugucccucucaggc

SEQ ID NO: 2387225 - RNA, 16 nt, Human
cccucugccugucccu

SEQ ID NO: 2387226 - RNA, 15 nt, Human
cccucugccuguccc

SEQ ID NO: 2387227 - RNA, 14 nt, Human
cccucugcugcugu

SEQ ID NO: 2387228 - RNA, 15 nt, Human
cccucugcugcuguc

SEQ ID NO: 2387229 - RNA, 12 nt, Human
cccucuggaggg

SEQ ID NO: 2387230 - RNA, 21 nt, Human
cccucuggagggguguggcuc

SEQ ID NO: 2387231 - RNA, 22 nt, Human
cccucuggagggguguggcucc

SEQ ID NO: 2387232 - RNA, 13 nt, Human
cccucuggccagg

SEQ ID NO: 2387233 - RNA, 13 nt, Human
cccucuggaucaa

SEQ ID NO: 2387234 - RNA, 12 nt, Human
cccucuggccag

SEQ ID NO: 2387235 - RNA, 18 nt, Human
cccucuggaguggccacu

SEQ ID NO: 2387236 - RNA, 22 nt, Human
cccucuggaguggccacuaagc

SEQ ID NO: 2387237 - RNA, 21 nt, Human
cccucuggaguggccacuaag

SEQ ID NO: 2387238 - RNA, 14 nt, Human
cccucuggcccugc

SEQ ID NO: 2387239 - RNA, 13 nt, Human
cccucuggcccug

SEQ ID NO: 2387240 - RNA, 22 nt, Human
cccucuggccaggauggagggg

SEQ ID NO: 2387241 - RNA, 18 nt, Human
cccucuggccaggaugga

SEQ ID NO: 2387242 - RNA, 12 nt, Human
cccucuggggcu

SEQ ID NO: 2387243 - RNA, 18 nt, Human
cccgccgccugguacuca

SEQ ID NO: 2387244 - RNA, 19 nt, Human
cccgccgcuuuucuccucu

SEQ ID NO: 2387245 - RNA, 20 nt, Human
cccgccgcuuuucuccucuu

SEQ ID NO: 2387246 - RNA, 15 nt, Human
cccgccccacauucc

SEQ ID NO: 2387247 - RNA, 20 nt, Human
cccgccccuuccccgaggga

SEQ ID NO: 2387248 - RNA, 17 nt, Human
cccgcccccugcccucc

SEQ ID NO: 2387249 - RNA, 16 nt, Human
cccgcccccugcccuc

SEQ ID NO: 2387250 - RNA, 19 nt, Human
cccgccccacauuccgaca

SEQ ID NO: 2387251 - RNA, 21 nt, Human
cccgagucauucguucugugg

SEQ ID NO: 2387252 - RNA, 22 nt, Human
cccgaguagcugggacuacagg

SEQ ID NO: 2387253 - RNA, 12 nt, Human
cccgccucuccc

SEQ ID NO: 2387254 - RNA, 13 nt, Human
cccgccucucccg

SEQ ID NO: 2387255 - RNA, 21 nt, Human
cccgccucucccgucagggcc

SEQ ID NO: 2387256 - RNA, 11 nt, Human
cccgccugcca

SEQ ID NO: 2387257 - RNA, 12 nt, Human
cccgccugccag

SEQ ID NO: 2387258 - RNA, 12 nt, Human
cccgccugcccu

SEQ ID NO: 2387259 - RNA, 13 nt, Human
cccgccugccagu

SEQ ID NO: 2387260 - RNA, 14 nt, Human
cccgccugccaguc

SEQ ID NO: 2387261 - RNA, 16 nt, Human
cccgccugccaguccu

SEQ ID NO: 2387262 - RNA, 19 nt, Human
cccgcugucagccauuccu

SEQ ID NO: 2387263 - RNA, 20 nt, Human
cccgcugucagccauuccug

SEQ ID NO: 2387264 - RNA, 12 nt, Human
cccgcugggcug

SEQ ID NO: 2387265 - RNA, 15 nt, Human
cccgcugggcugagc

SEQ ID NO: 2387266 - RNA, 21 nt, Human
cccgcugggcugagccccuac

SEQ ID NO: 2387267 - RNA, 11 nt, Human
cccgcuugccu

SEQ ID NO: 2387268 - RNA, 12 nt, Human
cccgcuugccuc

SEQ ID NO: 2387269 - RNA, 15 nt, Human
cccgcuugccucggc

SEQ ID NO: 2387270 - RNA, 17 nt, Human
cccgcuugccucggcuc

SEQ ID NO: 2387271 - RNA, 19 nt, Human
cccgcuugccucggcuccu

SEQ ID NO: 2387272 - RNA, 20 nt, Human
cccgcuugccucggcuccug

SEQ ID NO: 2387273 - RNA, 21 nt, Human
cccgcuugccucggcuccugc

SEQ ID NO: 2387274 - RNA, 22 nt, Human
cccgcuugccucggcuccugcu

SEQ ID NO: 2387275 - RNA, 23 nt, Human
cccgcuugccucggcuccugcug

SEQ ID NO: 2387276 - RNA, 13 nt, Human
cccgggaggggcc

SEQ ID NO: 2387277 - RNA, 23 nt, Human
cccgggaggggcccgcuugccuc

SEQ ID NO: 2387278 - RNA, 15 nt, Human
cccgggaggggcccg

SEQ ID NO: 2387279 - RNA, 17 nt, Human
cccgggaggggcccgcu

SEQ ID NO: 2387280 - RNA, 18 nt, Human
cccgggaggggcccgcuu

SEQ ID NO: 2387281 - RNA, 22 nt, Human
cccgggaggggcccgcuugccu

SEQ ID NO: 2387282 - RNA, 12 nt, Human
cccgggcucugc

SEQ ID NO: 2387283 - RNA, 20 nt, Human
cccgggcccguugaggauga

SEQ ID NO: 2387284 - RNA, 22 nt, Human
cccgggcccguugaggaugagg

SEQ ID NO: 2387285 - RNA, 17 nt, Human
cccgggcccucccuugg

SEQ ID NO: 2387286 - RNA, 18 nt, Human
cccgggcccucccuugga

SEQ ID NO: 2387287 - RNA, 19 nt, Human
cccgggcgcggccagcccc

SEQ ID NO: 2387288 - RNA, 21 nt, Human
cccgggcgcggccagccccgg

SEQ ID NO: 2387289 - RNA, 20 nt, Human
cccgggcucagggaccacag

SEQ ID NO: 2387290 - RNA, 21 nt, Human
cccgggcucagggaccacagc

SEQ ID NO: 2387291 - RNA, 14 nt, Human
cccgggcucugccu

SEQ ID NO: 2387292 - RNA, 15 nt, Human
cccgggcucugccuc

SEQ ID NO: 2387293 - RNA, 18 nt, Human
cccagagggcccaggcag

SEQ ID NO: 2387294 - RNA, 16 nt, Human
cccagagggcccaggc

SEQ ID NO: 2387295 - RNA, 15 nt, Human
cccagagggcccagg

SEQ ID NO: 2387296 - RNA, 14 nt, Human
cccagagggcccag

SEQ ID NO: 2387297 - RNA, 14 nt, Human
cccagagggccugc

SEQ ID NO: 2387298 - RNA, 21 nt, Human
cccgaggccuucucugaagga

SEQ ID NO: 2387299 - RNA, 15 nt, Human
cccagagggccugca

SEQ ID NO: 2387300 - RNA, 14 nt, Human
cccagaaccugucc

SEQ ID NO: 2387301 - RNA, 22 nt, Human
cccagaacacacuccaucagcu

SEQ ID NO: 2387302 - RNA, 18 nt, Human
cccagaacacacuccauc

SEQ ID NO: 2387303 - RNA, 14 nt, Human
cccagaacacacuc

SEQ ID NO: 2387304 - RNA, 17 nt, Human
cccagaaaggagacuag

SEQ ID NO: 2387305 - RNA, 15 nt, Human
cccagaaaggagacu

SEQ ID NO: 2387306 - RNA, 14 nt, Human
cccagaaaggagac

SEQ ID NO: 2387307 - RNA, 16 nt, Human
cccagaaaaggacaga

SEQ ID NO: 2387308 - RNA, 17 nt, Human
cccagaaaaggacagaa

SEQ ID NO: 2387309 - RNA, 15 nt, Human
cccagaaaaggacag

SEQ ID NO: 2387310 - RNA, 13 nt, Human
cccagagggccca

SEQ ID NO: 2387311 - RNA, 16 nt, Human
cccagaggcuggguga

SEQ ID NO: 2387312 - RNA, 23 nt, Human
cccagaaggcagggaaaggcucu

SEQ ID NO: 2387313 - RNA, 13 nt, Human
cccagaaggcagg

SEQ ID NO: 2387314 - RNA, 19 nt, Human
cccagaaggaccuccugag

SEQ ID NO: 2387315 - RNA, 19 nt, Human
cccagaacuggacucagga

SEQ ID NO: 2387316 - RNA, 17 nt, Human
cccagaaccuguccuug

SEQ ID NO: 2387317 - RNA, 15 nt, Human
cccagaaccuguccu

SEQ ID NO: 2387318 - RNA, 19 nt, Human
cccagaaccuguccuugca

SEQ ID NO: 2387319 - RNA, 20 nt, Human
cccagaacuggacucaggau

SEQ ID NO: 2387320 - RNA, 23 nt, Human
cccagagggcccaggcaggccac

SEQ ID NO: 2387321 - RNA, 22 nt, Human
cccagagggcccaggcaggcca

SEQ ID NO: 2387322 - RNA, 19 nt, Human
cccgaggcugcccacuaug

SEQ ID NO: 2387323 - RNA, 14 nt, Human
cccgaggcugccca

SEQ ID NO: 2387324 - RNA, 20 nt, Human
cccgagggaugaugccacac

SEQ ID NO: 2387325 - RNA, 22 nt, Human
cccgagggaugaugccacacca

SEQ ID NO: 2387326 - RNA, 13 nt, Human
cccgaguagcugg

SEQ ID NO: 2387327 - RNA, 14 nt, Human
cccgaguagcuggg

SEQ ID NO: 2387328 - RNA, 15 nt, Human
cccgaguagcuggga

SEQ ID NO: 2387329 - RNA, 16 nt, Human
cccgaguagcugggac

SEQ ID NO: 2387330 - RNA, 17 nt, Human
cccgaguagcugggacu

SEQ ID NO: 2387331 - RNA, 18 nt, Human
cccgaguagcugggacua

SEQ ID NO: 2387332 - RNA, 21 nt, Human
cccgaguagcugggacuacag

SEQ ID NO: 2387333 - RNA, 20 nt, Human
cccgucgaggggcucucagc

SEQ ID NO: 2387334 - RNA, 19 nt, Human
cccgucccauauccugccu

SEQ ID NO: 2387335 - RNA, 12 nt, Human
cccgucucagug

SEQ ID NO: 2387336 - RNA, 13 nt, Human
cccgucucagugu

SEQ ID NO: 2387337 - RNA, 12 nt, Human
cccgucucucuc

SEQ ID NO: 2387338 - RNA, 15 nt, Human
cccgucucucuccca

SEQ ID NO: 2387339 - RNA, 18 nt, Human
cccgucauguuccucaaa

SEQ ID NO: 2387340 - RNA, 22 nt, Human
cccgucagggcccaagucccug

SEQ ID NO: 2387341 - RNA, 19 nt, Human
cccgucaggacguugagga

SEQ ID NO: 2387342 - RNA, 17 nt, Human
cccgucagggcccaagu

SEQ ID NO: 2387343 - RNA, 13 nt, Human
cccguccugccug

SEQ ID NO: 2387344 - RNA, 18 nt, Human
cccguccacggcucuagg

SEQ ID NO: 2387345 - RNA, 16 nt, Human
cccgucccauauccug

SEQ ID NO: 2387346 - RNA, 14 nt, Human
cccguccugccugu

SEQ ID NO: 2387347 - RNA, 15 nt, Human
cccguccugccugug

SEQ ID NO: 2387348 - RNA, 16 nt, Human
cccguccugccugugg

SEQ ID NO: 2387349 - RNA, 17 nt, Human
cccguccugccuguggc

SEQ ID NO: 2387350 - RNA, 12 nt, Human
cccgucuucagc

SEQ ID NO: 2387351 - RNA, 17 nt, Human
cccguggccccagccug

SEQ ID NO: 2387352 - RNA, 21 nt, Human
cccgucugggguucagccccu

SEQ ID NO: 2387353 - RNA, 20 nt, Human
cccgucugggguucagcccc

SEQ ID NO: 2387354 - RNA, 23 nt, Human
cccgucugggguucagccccucc

SEQ ID NO: 2387355 - RNA, 22 nt, Human
cccgucucugguuccuccccuc

SEQ ID NO: 2387356 - RNA, 16 nt, Human
cccgucucucucccau

SEQ ID NO: 2387357 - RNA, 19 nt, Human
cccgucucucucccaugga

SEQ ID NO: 2387358 - RNA, 15 nt, Human
cccgugggguuccuc

SEQ ID NO: 2387359 - RNA, 18 nt, Human
cccguggccccagccugg

SEQ ID NO: 2387360 - RNA, 20 nt, Human
cccguggccccagccuggcc

SEQ ID NO: 2387361 - RNA, 21 nt, Human
cccguggccccagccuggccc

SEQ ID NO: 2387362 - RNA, 22 nt, Human
cccguggccccagccuggccca

SEQ ID NO: 2387363 - RNA, 23 nt, Human
cccguggccccagccuggcccag

SEQ ID NO: 2387364 - RNA, 20 nt, Human
cccggggcagcugccagaga

SEQ ID NO: 2387365 - RNA, 19 nt, Human
cccggggcagcugccagag

SEQ ID NO: 2387366 - RNA, 14 nt, Human
cccggggcagcugc

SEQ ID NO: 2387367 - RNA, 12 nt, Human
cccggggcagcu

SEQ ID NO: 2387368 - RNA, 17 nt, Human
cccggggacccugugac

SEQ ID NO: 2387369 - RNA, 18 nt, Human
cccggggacccugugaca

SEQ ID NO: 2387370 - RNA, 21 nt, Human
cccggggacccugugacaugg

SEQ ID NO: 2387371 - RNA, 22 nt, Human
cccggggaaaggcaagguccgg

SEQ ID NO: 2387372 - RNA, 17 nt, Human
cccgggcugccugggcu

SEQ ID NO: 2387373 - RNA, 23 nt, Human
cccgggcugccugggcuguuggc

SEQ ID NO: 2387374 - RNA, 15 nt, Human
cccggggacccugug

SEQ ID NO: 2387375 - RNA, 16 nt, Human
cccggggacccuguga

SEQ ID NO: 2387376 - RNA, 17 nt, Human
cccgggcucucugcugu

SEQ ID NO: 2387377 - RNA, 16 nt, Human
cccgggcucucugcug

SEQ ID NO: 2387378 - RNA, 12 nt, Human
cccgggcugccu

SEQ ID NO: 2387379 - RNA, 13 nt, Human
cccgggcugccug

SEQ ID NO: 2387380 - RNA, 15 nt, Human
cccgggcugccuggg

SEQ ID NO: 2387381 - RNA, 16 nt, Human
cccgggcugccugggc

SEQ ID NO: 2387382 - RNA, 16 nt, Human
cccgggcucugccucc

SEQ ID NO: 2387383 - RNA, 20 nt, Human
cccggguuuggcgggccaag

SEQ ID NO: 2387384 - RNA, 18 nt, Human
cccgggguccuguggcag

SEQ ID NO: 2387385 - RNA, 22 nt, Human
cccgggguccuguggcaggcag

SEQ ID NO: 2387386 - RNA, 21 nt, Human
cccggggcagcugccagagaa

SEQ ID NO: 2387387 - RNA, 17 nt, Human
cccgggguccuguggca

SEQ ID NO: 2387388 - RNA, 18 nt, Human
cccgucaccaucucaggc

SEQ ID NO: 2387389 - RNA, 17 nt, Human
cccgucaccaucucagg

SEQ ID NO: 2387390 - RNA, 14 nt, Human
cccguaaugcuuag

SEQ ID NO: 2387391 - RNA, 15 nt, Human
cccgucacagccuca

SEQ ID NO: 2387392 - RNA, 22 nt, Human
cccggucccuugagaccucagc

SEQ ID NO: 2387393 - RNA, 15 nt, Human
cccgguucuuccagu

SEQ ID NO: 2387394 - RNA, 22 nt, Human
cccggguuuggcgggccaagga

SEQ ID NO: 2387395 - RNA, 21 nt, Human
cccggggugcccacaggccgc

SEQ ID NO: 2387396 - RNA, 18 nt, Human
cccggugcccaagaauag

SEQ ID NO: 2387397 - RNA, 12 nt, Human
cccuaaugccug

SEQ ID NO: 2387398 - RNA, 15 nt, Human
cccuaaucuaugguc

SEQ ID NO: 2387399 - RNA, 17 nt, Human
cccuaaugcgcaggcug

SEQ ID NO: 2387400 - RNA, 22 nt, Human
cccuaaugcgcaggcuggcccu

SEQ ID NO: 2387401 - RNA, 21 nt, Human
cccuaaugcgcaggcuggccc

SEQ ID NO: 2387402 - RNA, 18 nt, Human
cccguguggccccuucac

SEQ ID NO: 2387403 - RNA, 17 nt, Human
cccguucugcuggccug

SEQ ID NO: 2387404 - RNA, 19 nt, Human
cccguucugcuggccugga

SEQ ID NO: 2387405 - RNA, 22 nt, Human
cccuaaucuauggucgggagac

SEQ ID NO: 2387406 - RNA, 22 nt, Human
cccguguggccccuucacuucu

SEQ ID NO: 2387407 - RNA, 17 nt, Human
cccguguggccccuuca

SEQ ID NO: 2387408 - RNA, 14 nt, Human
cccguguggccccu

SEQ ID NO: 2387409 - RNA, 12 nt, Human
cccguggucucu

SEQ ID NO: 2387410 - RNA, 19 nt, Human
cccguguccccggccucag

SEQ ID NO: 2387411 - RNA, 15 nt, Human
cccguguccugccug

SEQ ID NO: 2387412 - RNA, 20 nt, Human
cccuaccaccuccccagccu

SEQ ID NO: 2387413 - RNA, 19 nt, Human
cccuaccaccuccccagcc

SEQ ID NO: 2387414 - RNA, 17 nt, Human
cccuaccaccuccccag

SEQ ID NO: 2387415 - RNA, 14 nt, Human
cccuacauguauug

SEQ ID NO: 2387416 - RNA, 13 nt, Human
cccuacaccuuga

SEQ ID NO: 2387417 - RNA, 17 nt, Human
cccuaccacugucuucu

SEQ ID NO: 2387418 - RNA, 20 nt, Human
cccuaccacugucuucuuca

SEQ ID NO: 2387419 - RNA, 20 nt, Human
cccuaccagcgcccgcuggg

SEQ ID NO: 2387420 - RNA, 21 nt, Human
cccuaccagcgcccgcugggc

SEQ ID NO: 2387421 - RNA, 22 nt, Human
cccuaccagcgcccgcugggcu

SEQ ID NO: 2387422 - RNA, 23 nt, Human
cccuaccagcgcccgcugggcug

SEQ ID NO: 2387423 - RNA, 19 nt, Human
cccuaccccacaccaggcc

SEQ ID NO: 2387424 - RNA, 21 nt, Human
cccuaccccacaccaggccgu

SEQ ID NO: 2387425 - RNA, 20 nt, Human
cccuacaguugaaaaacagc

SEQ ID NO: 2387426 - RNA, 18 nt, Human
cccuacaccccuccccug

SEQ ID NO: 2387427 - RNA, 16 nt, Human
cccguugucucccugg

SEQ ID NO: 2387428 - RNA, 23 nt, Human
cccuaaugcgcaggcuggcccug

SEQ ID NO: 2387429 - RNA, 21 nt, Human
cccuaggucagcuugcugccc

SEQ ID NO: 2387430 - RNA, 19 nt, Human
cccuaggggacacuucccu

SEQ ID NO: 2387431 - RNA, 17 nt, Human
cccuaggggacacuucc

SEQ ID NO: 2387432 - RNA, 18 nt, Human
cccuaggggacacuuccc

SEQ ID NO: 2387433 - RNA, 14 nt, Human
cccuaggggacacu

SEQ ID NO: 2387434 - RNA, 21 nt, Human
cccuagcuuuagacccugggu

SEQ ID NO: 2387435 - RNA, 14 nt, Human
cccuaggagaccaa

SEQ ID NO: 2387436 - RNA, 22 nt, Human
cccuagcuuagagccucccuca

SEQ ID NO: 2387437 - RNA, 17 nt, Human
cccuagcuuuagacccu

SEQ ID NO: 2387438 - RNA, 18 nt, Human
cccuagcuuuagacccug

SEQ ID NO: 2387439 - RNA, 19 nt, Human
cccuagcuuuagacccugg

SEQ ID NO: 2387440 - RNA, 20 nt, Human
cccuagcuccacacccucuc

SEQ ID NO: 2387441 - RNA, 18 nt, Human
cccuagcccaggagagag

SEQ ID NO: 2387442 - RNA, 23 nt, Human
cccuaccugauuggugcaacccu

SEQ ID NO: 2387443 - RNA, 22 nt, Human
cccuaccugauuggugcaaccc

SEQ ID NO: 2387444 - RNA, 16 nt, Human
cccuaccucaggcagg

SEQ ID NO: 2387445 - RNA, 23 nt, Human
cccuacuauucaguggcgagaaa

SEQ ID NO: 2387446 - RNA, 19 nt, Human
cccuaccuguucagugucc

SEQ ID NO: 2387447 - RNA, 14 nt, Human
cccuaccugugccu

SEQ ID NO: 2387448 - RNA, 13 nt, Human
cccuaccucaggc

SEQ ID NO: 2387449 - RNA, 21 nt, Human
cccuaccgagucucuucucca

SEQ ID NO: 2387450 - RNA, 14 nt, Human
cccuaccccaccac

SEQ ID NO: 2387451 - RNA, 18 nt, Human
cccuaccgagucucuucu

SEQ ID NO: 2387452 - RNA, 14 nt, Human
cccugcacuguccu

SEQ ID NO: 2387453 - RNA, 13 nt, Human
ccuggaagggcua

SEQ ID NO: 2387454 - RNA, 24 nt, Human
ccuggaagggcuagaaccuguaga

SEQ ID NO: 2387455 - RNA, 16 nt, Human
ccuggacacucagacc

SEQ ID NO: 2387456 - RNA, 17 nt, Human
ccuggacacucagaccu

SEQ ID NO: 2387457 - RNA, 21 nt, Human
ccuggaagcuguguccuugca

SEQ ID NO: 2387458 - RNA, 12 nt, Human
ccuggaagggcu

SEQ ID NO: 2387459 - RNA, 11 nt, Human
ccuggaagggc

SEQ ID NO: 2387460 - RNA, 18 nt, Human
ccuggaauauauaaccag

SEQ ID NO: 2387461 - RNA, 22 nt, Human
ccuggagaguucaauggcugcu

SEQ ID NO: 2387462 - RNA, 23 nt, Human
ccuggagaguucaauggcugcug

SEQ ID NO: 2387463 - RNA, 21 nt, Human
ccuggagagcuagaaccugga

SEQ ID NO: 2387464 - RNA, 22 nt, Human
ccuggagagcuagaaccuggag

SEQ ID NO: 2387465 - RNA, 13 nt, Human
ccuggagauccuc

SEQ ID NO: 2387466 - RNA, 15 nt, Human
ccuggagauccuccu

SEQ ID NO: 2387467 - RNA, 14 nt, Human
ccuggagagccaga

SEQ ID NO: 2387468 - RNA, 21 nt, Human
ccuggagagccagaaccugga

SEQ ID NO: 2387469 - RNA, 22 nt, Human
ccuggagagccagaaccuggag

SEQ ID NO: 2387470 - RNA, 23 nt, Human
ccuggagagccagaaccuggagg

SEQ ID NO: 2387471 - RNA, 13 nt, Human
ccuggagagcuag

SEQ ID NO: 2387472 - RNA, 14 nt, Human
ccuggagagcuaga

SEQ ID NO: 2387473 - RNA, 19 nt, Human
ccuggagagcuagaaccua

SEQ ID NO: 2387474 - RNA, 21 nt, Human
ccuggagagcuagaaccuaga

SEQ ID NO: 2387475 - RNA, 19 nt, Human
ccuggagacuaaccccacc

SEQ ID NO: 2387476 - RNA, 18 nt, Human
ccuggagacugcccagcu

SEQ ID NO: 2387477 - RNA, 19 nt, Human
ccuggagacuuagggcacc

SEQ ID NO: 2387478 - RNA, 23 nt, Human
ccuggagacuuagggcaccaggg

SEQ ID NO: 2387479 - RNA, 23 nt, Human
ccuggcagaacugagcuccucug

SEQ ID NO: 2387480 - RNA, 20 nt, Human
ccuggcagaacugagcuccu

SEQ ID NO: 2387481 - RNA, 13 nt, Human
ccuggcagaaugc

SEQ ID NO: 2387482 - RNA, 18 nt, Human
ccuggcagaacugagcuc

SEQ ID NO: 2387483 - RNA, 17 nt, Human
ccuggcagaacugagcu

SEQ ID NO: 2387484 - RNA, 23 nt, Human
ccuggcacuaacguugagccccu

SEQ ID NO: 2387485 - RNA, 12 nt, Human
ccuggcagcccc

SEQ ID NO: 2387486 - RNA, 13 nt, Human
ccuggcagccccu

SEQ ID NO: 2387487 - RNA, 22 nt, Human
ccuggcacccggccccugcugg

SEQ ID NO: 2387488 - RNA, 16 nt, Human
ccuggagauccuccug

SEQ ID NO: 2387489 - RNA, 17 nt, Human
ccuggagauccuccugc

SEQ ID NO: 2387490 - RNA, 18 nt, Human
ccuggagauccuccugca

SEQ ID NO: 2387491 - RNA, 19 nt, Human
ccuggagauccuccugcag

SEQ ID NO: 2387492 - RNA, 22 nt, Human
ccuggcacgguggcucaggccu

SEQ ID NO: 2387493 - RNA, 18 nt, Human
ccuggcacgguggcucag

SEQ ID NO: 2387494 - RNA, 14 nt, Human
ccuggcagaacuga

SEQ ID NO: 2387495 - RNA, 23 nt, Human
ccuggcacccggccccugcuggu

SEQ ID NO: 2387496 - RNA, 13 nt, Human
ccuggcagcucug

SEQ ID NO: 2387497 - RNA, 12 nt, Human
ccuggcagcucu

SEQ ID NO: 2387498 - RNA, 21 nt, Human
ccuggcagccgugccuucagc

SEQ ID NO: 2387499 - RNA, 22 nt, Human
ccuggcagccgugccuucagcu

SEQ ID NO: 2387500 - RNA, 17 nt, Human
ccuggcaggaugacccu

SEQ ID NO: 2387501 - RNA, 23 nt, Human
ccuggcagcucuggacagcccca

SEQ ID NO: 2387502 - RNA, 21 nt, Human
ccuggcagcucuggacagccc

SEQ ID NO: 2387503 - RNA, 20 nt, Human
ccuggcagcucuggacagcc

SEQ ID NO: 2387504 - RNA, 19 nt, Human
ccuggcagcucuggacagc

SEQ ID NO: 2387505 - RNA, 17 nt, Human
ccuggcagcucuggaca

SEQ ID NO: 2387506 - RNA, 15 nt, Human
ccuggcagcucugga

SEQ ID NO: 2387507 - RNA, 14 nt, Human
ccuggcagcucugg

SEQ ID NO: 2387508 - RNA, 14 nt, Human
ccuggccagaggcu

SEQ ID NO: 2387509 - RNA, 13 nt, Human
ccuggccagaggc

SEQ ID NO: 2387510 - RNA, 12 nt, Human
ccuggccagagg

SEQ ID NO: 2387511 - RNA, 20 nt, Human
ccuggcuccaaacccucgag

SEQ ID NO: 2387512 - RNA, 15 nt, Human
ccuggccagaugcac

SEQ ID NO: 2387513 - RNA, 23 nt, Human
ccuggccagacacaggcccuccc

SEQ ID NO: 2387514 - RNA, 19 nt, Human
ccuggccagacacaggccc

SEQ ID NO: 2387515 - RNA, 18 nt, Human
ccuggccagacacaggcc

SEQ ID NO: 2387516 - RNA, 16 nt, Human
ccuggccagacacagg

SEQ ID NO: 2387517 - RNA, 15 nt, Human
ccuggccagacacag

SEQ ID NO: 2387518 - RNA, 14 nt, Human
ccuggccagacaca

SEQ ID NO: 2387519 - RNA, 13 nt, Human
ccuggccagacac

SEQ ID NO: 2387520 - RNA, 12 nt, Human
ccuggccagaca

SEQ ID NO: 2387521 - RNA, 23 nt, Human
ccuggcucccacaggcccuuccu

SEQ ID NO: 2387522 - RNA, 18 nt, Human
ccuggcugcagccugcgc

SEQ ID NO: 2387523 - RNA, 17 nt, Human
ccuggcucccacaggcc

SEQ ID NO: 2387524 - RNA, 16 nt, Human
ccuggcucccacaggc

SEQ ID NO: 2387525 - RNA, 18 nt, Human
ccuggcucccacaggcag

SEQ ID NO: 2387526 - RNA, 19 nt, Human
ccuggcucccacaggcagc

SEQ ID NO: 2387527 - RNA, 20 nt, Human
ccuggcucccacaggcagcu

SEQ ID NO: 2387528 - RNA, 15 nt, Human
ccuggcuccaggcca

SEQ ID NO: 2387529 - RNA, 22 nt, Human
ccuggcuccaaacccucgaggc

SEQ ID NO: 2387530 - RNA, 17 nt, Human
ccuggcuccaggccagg

SEQ ID NO: 2387531 - RNA, 16 nt, Human
ccuggcuccaggccag

SEQ ID NO: 2387532 - RNA, 19 nt, Human
ccuggcugcccuggcccug

SEQ ID NO: 2387533 - RNA, 17 nt, Human
ccuggcugcccuggccc

SEQ ID NO: 2387534 - RNA, 18 nt, Human
ccuggcugcccuggcccu

SEQ ID NO: 2387535 - RNA, 20 nt, Human
ccuggcugcccuggcccuga

SEQ ID NO: 2387536 - RNA, 21 nt, Human
ccuggcucccacaggcagcuu

SEQ ID NO: 2387537 - RNA, 24 nt, Human
ccuggcugagguuccucugccugc

SEQ ID NO: 2387538 - RNA, 12 nt, Human
ccuggcugcccu

SEQ ID NO: 2387539 - RNA, 13 nt, Human
ccuggcugcccug

SEQ ID NO: 2387540 - RNA, 14 nt, Human
ccuggcugcccugg

SEQ ID NO: 2387541 - RNA, 15 nt, Human
ccuggcugcccuggc

SEQ ID NO: 2387542 - RNA, 16 nt, Human
ccuggcugcccuggcc

SEQ ID NO: 2387543 - RNA, 13 nt, Human
ccuggcugcugcc

SEQ ID NO: 2387544 - RNA, 14 nt, Human
ccuggcugcugccc

SEQ ID NO: 2387545 - RNA, 15 nt, Human
ccuggcugcugcccc

SEQ ID NO: 2387546 - RNA, 16 nt, Human
ccuggcugcugccccc

SEQ ID NO: 2387547 - RNA, 17 nt, Human
ccuggcugcugccccca

SEQ ID NO: 2387548 - RNA, 18 nt, Human
ccuggcugcugcccccac

SEQ ID NO: 2387549 - RNA, 20 nt, Human
ccuggcugcugcccccaccc

SEQ ID NO: 2387550 - RNA, 21 nt, Human
ccuggcugcugcccccacccc

SEQ ID NO: 2387551 - RNA, 22 nt, Human
ccuggcugcugcccccaccccg

SEQ ID NO: 2387552 - RNA, 14 nt, Human
ccuggucagcccaa

SEQ ID NO: 2387553 - RNA, 12 nt, Human
ccuggucagccc

SEQ ID NO: 2387554 - RNA, 20 nt, Human
ccuggucacagggcaugccc

SEQ ID NO: 2387555 - RNA, 22 nt, Human
ccuggucacaggacucugccuc

SEQ ID NO: 2387556 - RNA, 23 nt, Human
ccuggucacaggacucugccucc

SEQ ID NO: 2387557 - RNA, 21 nt, Human
ccuggucacaggacucugccu

SEQ ID NO: 2387558 - RNA, 20 nt, Human
ccugguauauccaaaagcuu

SEQ ID NO: 2387559 - RNA, 18 nt, Human
ccugguauauccaaaagc

SEQ ID NO: 2387560 - RNA, 17 nt, Human
ccuggugaccccuuuuc

SEQ ID NO: 2387561 - RNA, 14 nt, Human
ccuggugaccccuu

SEQ ID NO: 2387562 - RNA, 21 nt, Human
ccugguccagggaagcuggcc

SEQ ID NO: 2387563 - RNA, 14 nt, Human
ccugguccagggaa

SEQ ID NO: 2387564 - RNA, 22 nt, Human
ccugguccagggaagcuggccg

SEQ ID NO: 2387565 - RNA, 10 nt, Human
ccuggugccc

SEQ ID NO: 2387566 - RNA, 15 nt, Human
ccugguacucaagcc

SEQ ID NO: 2387567 - RNA, 17 nt, Human
ccugguacccuccuggc

SEQ ID NO: 2387568 - RNA, 16 nt, Human
ccugguacucaagccc

SEQ ID NO: 2387569 - RNA, 19 nt, Human
ccugguacucaagcccgcg

SEQ ID NO: 2387570 - RNA, 19 nt, Human
ccugguaggagugugugau

SEQ ID NO: 2387571 - RNA, 13 nt, Human
ccugguagggcag

SEQ ID NO: 2387572 - RNA, 17 nt, Human
ccugguagaauagauau

SEQ ID NO: 2387573 - RNA, 14 nt, Human
ccugguacccagcc

SEQ ID NO: 2387574 - RNA, 15 nt, Human
ccugguacccagcca

SEQ ID NO: 2387575 - RNA, 17 nt, Human
ccugguacccagccauc

SEQ ID NO: 2387576 - RNA, 13 nt, Human
ccugguacccagc

SEQ ID NO: 2387577 - RNA, 14 nt, Human
ccugguacccuccu

SEQ ID NO: 2387578 - RNA, 15 nt, Human
ccugguacccuccug

SEQ ID NO: 2387579 - RNA, 18 nt, Human
ccugguacccagccaucu

SEQ ID NO: 2387580 - RNA, 19 nt, Human
ccugguacccagccaucug

SEQ ID NO: 2387581 - RNA, 20 nt, Human
ccugguacccagccaucugc

SEQ ID NO: 2387582 - RNA, 22 nt, Human
ccugguacccagccaucugccc

SEQ ID NO: 2387583 - RNA, 17 nt, Human
ccuggguggggcugcuc

SEQ ID NO: 2387584 - RNA, 16 nt, Human
ccuggguggggcugcu

SEQ ID NO: 2387585 - RNA, 15 nt, Human
ccuggguggggcugc

SEQ ID NO: 2387586 - RNA, 15 nt, Human
ccugggugggcucug

SEQ ID NO: 2387587 - RNA, 16 nt, Human
ccugggugggcucugu

SEQ ID NO: 2387588 - RNA, 17 nt, Human
ccugggugggcucugug

SEQ ID NO: 2387589 - RNA, 16 nt, Human
ccugggugcuggcugc

SEQ ID NO: 2387590 - RNA, 17 nt, Human
ccuggguucccuuuccu

SEQ ID NO: 2387591 - RNA, 16 nt, Human
ccuggguuuaagggga

SEQ ID NO: 2387592 - RNA, 19 nt, Human
ccuggguuuuguauucucu

SEQ ID NO: 2387593 - RNA, 23 nt, Human
ccuggguuuuguauucucugagc

SEQ ID NO: 2387594 - RNA, 22 nt, Human
ccuggguuuuguauucucugag

SEQ ID NO: 2387595 - RNA, 21 nt, Human
ccuggguuuuguauucucuga

SEQ ID NO: 2387596 - RNA, 20 nt, Human
ccuggguuuuguauucucug

SEQ ID NO: 2387597 - RNA, 24 nt, Human
ccuggcugggacguggcucagcca

SEQ ID NO: 2387598 - RNA, 22 nt, Human
ccuggcugggacguggcucagc

SEQ ID NO: 2387599 - RNA, 21 nt, Human
ccuggcugggacguggcucag

SEQ ID NO: 2387600 - RNA, 20 nt, Human
ccuggcugggacguggcuca

SEQ ID NO: 2387601 - RNA, 16 nt, Human
ccuggcuucuggagcc

SEQ ID NO: 2387602 - RNA, 15 nt, Human
ccuggcuucuggagc

SEQ ID NO: 2387603 - RNA, 14 nt, Human
ccuggcuucuggag

SEQ ID NO: 2387604 - RNA, 13 nt, Human
ccuggcuucugga

SEQ ID NO: 2387605 - RNA, 13 nt, Human
ccuggcuucuccu

SEQ ID NO: 2387606 - RNA, 20 nt, Human
ccuggcuuuucacugcuggc

SEQ ID NO: 2387607 - RNA, 18 nt, Human
ccuggcuuuucacugcug

SEQ ID NO: 2387608 - RNA, 21 nt, Human
ccuggcuuuucacugcuggcu

SEQ ID NO: 2387609 - RNA, 22 nt, Human
ccuggcuuuucacugcuggcug

SEQ ID NO: 2387610 - RNA, 23 nt, Human
ccuggcuuuucacugcuggcugc

SEQ ID NO: 2387611 - RNA, 24 nt, Human
ccuggcuuuucacugcuggcugcc

SEQ ID NO: 2387612 - RNA, 15 nt, Human
ccugggcauugcuuu

SEQ ID NO: 2387613 - RNA, 14 nt, Human
ccugggcauugcuu

SEQ ID NO: 2387614 - RNA, 23 nt, Human
ccugggcauauccaccaccuccc

SEQ ID NO: 2387615 - RNA, 16 nt, Human
ccugggcauccuucuu

SEQ ID NO: 2387616 - RNA, 23 nt, Human
ccugggccacagggcgagacucc

SEQ ID NO: 2387617 - RNA, 17 nt, Human
ccuggcuucuggagccc

SEQ ID NO: 2387618 - RNA, 17 nt, Human
ccugggcauacuaauaa

SEQ ID NO: 2387619 - RNA, 22 nt, Human
ccugggcauauccaccaccucc

SEQ ID NO: 2387620 - RNA, 14 nt, Human
ccugggccccacca

SEQ ID NO: 2387621 - RNA, 13 nt, Human
ccugggccccacc

SEQ ID NO: 2387622 - RNA, 17 nt, Human
ccugggcauugcuuucc

SEQ ID NO: 2387623 - RNA, 16 nt, Human
ccugggcauugcuuuc

SEQ ID NO: 2387624 - RNA, 15 nt, Human
ccugggccccaccac

SEQ ID NO: 2387625 - RNA, 14 nt, Human
ccugggggugccag

SEQ ID NO: 2387626 - RNA, 18 nt, Human
ccuggggguucuuucuuc

SEQ ID NO: 2387627 - RNA, 16 nt, Human
ccugggggugccagga

SEQ ID NO: 2387628 - RNA, 15 nt, Human
ccugggggugccagg

SEQ ID NO: 2387629 - RNA, 23 nt, Human
ccugggugcuggcugcccagacc

SEQ ID NO: 2387630 - RNA, 15 nt, Human
ccugggugacauuug

SEQ ID NO: 2387631 - RNA, 13 nt, Human
ccugggugacauu

SEQ ID NO: 2387632 - RNA, 14 nt, Human
ccugggugacauuu

SEQ ID NO: 2387633 - RNA, 21 nt, Human
ccugggucugugucucuuuuc

SEQ ID NO: 2387634 - RNA, 17 nt, Human
ccugggucugugucucu

SEQ ID NO: 2387635 - RNA, 16 nt, Human
ccugggucugugucuc

SEQ ID NO: 2387636 - RNA, 15 nt, Human
ccugggucugugucu

SEQ ID NO: 2387637 - RNA, 14 nt, Human
ccugggucuguguc

SEQ ID NO: 2387638 - RNA, 18 nt, Human
ccugggucuaagggguug

SEQ ID NO: 2387639 - RNA, 14 nt, Human
ccuggguccuuuuc

SEQ ID NO: 2387640 - RNA, 21 nt, Human
ccuggggguucuuucuuccuc

SEQ ID NO: 2387641 - RNA, 22 nt, Human
ccuggggguucuuucuuccucu

SEQ ID NO: 2387642 - RNA, 23 nt, Human
ccuggggguucuuucuuccucug

SEQ ID NO: 2387643 - RNA, 21 nt, Human
ccugggguauaaaacuuuccu

SEQ ID NO: 2387644 - RNA, 22 nt, Human
ccugggguaccaagagacuccu

SEQ ID NO: 2387645 - RNA, 22 nt, Human
ccugcgcccaguccuuccaccu

SEQ ID NO: 2387646 - RNA, 14 nt, Human
ccugcgcgcaugug

SEQ ID NO: 2387647 - RNA, 20 nt, Human
ccugcgcgcaugugcgcaca

SEQ ID NO: 2387648 - RNA, 16 nt, Human
ccugcggagugaagag

SEQ ID NO: 2387649 - RNA, 17 nt, Human
ccugcggagugaagagg

SEQ ID NO: 2387650 - RNA, 18 nt, Human
ccugcggagugaagaggg

SEQ ID NO: 2387651 - RNA, 19 nt, Human
ccugcggagugaagagggg

SEQ ID NO: 2387652 - RNA, 20 nt, Human
ccugcggagugaagaggggc

SEQ ID NO: 2387653 - RNA, 22 nt, Human
ccugcggagugaagaggggcag

SEQ ID NO: 2387654 - RNA, 19 nt, Human
ccugcgggcuuuuccccgg

SEQ ID NO: 2387655 - RNA, 16 nt, Human
ccugcggcugcugugu

SEQ ID NO: 2387656 - RNA, 20 nt, Human
ccugcggcugcugugugccu

SEQ ID NO: 2387657 - RNA, 17 nt, Human
ccugcggccugcuggag

SEQ ID NO: 2387658 - RNA, 23 nt, Human
ccugcggagugaagaggggcagc

SEQ ID NO: 2387659 - RNA, 16 nt, Human
ccugcggccugcugga

SEQ ID NO: 2387660 - RNA, 22 nt, Human
ccugcgggucacaggagggagg

SEQ ID NO: 2387661 - RNA, 18 nt, Human
ccugcgggucacaggagg

SEQ ID NO: 2387662 - RNA, 21 nt, Human
ccugcgggcuuuuccccgguc

SEQ ID NO: 2387663 - RNA, 21 nt, Human
ccugcggcugcugugugccuu

SEQ ID NO: 2387664 - RNA, 23 nt, Human
ccugcgggugaacaaagcagcca

SEQ ID NO: 2387665 - RNA, 24 nt, Human
ccugcgggugaacaaagcagccac

SEQ ID NO: 2387666 - RNA, 20 nt, Human
ccugcggguggggcuugggg

SEQ ID NO: 2387667 - RNA, 23 nt, Human
ccugcgguagaugggagggaggc

SEQ ID NO: 2387668 - RNA, 21 nt, Human
ccugcggguggggcuuggggc

SEQ ID NO: 2387669 - RNA, 24 nt, Human
ccugcggguggggcuuggggcuca

SEQ ID NO: 2387670 - RNA, 16 nt, Human
ccugcggugcuaucuc

SEQ ID NO: 2387671 - RNA, 17 nt, Human
ccugcggugcuaucucc

SEQ ID NO: 2387672 - RNA, 20 nt, Human
ccugcgcccaccccgcucug

SEQ ID NO: 2387673 - RNA, 21 nt, Human
ccugcgcccaccccgcucugc

SEQ ID NO: 2387674 - RNA, 22 nt, Human
ccugcgcccaccccgcucugca

SEQ ID NO: 2387675 - RNA, 18 nt, Human
ccugcgcccaguccuucc

SEQ ID NO: 2387676 - RNA, 20 nt, Human
ccugcgcccaguccuuccac

SEQ ID NO: 2387677 - RNA, 18 nt, Human
ccugcgauuuugccugug

SEQ ID NO: 2387678 - RNA, 19 nt, Human
ccugcgcccaccccgcucu

SEQ ID NO: 2387679 - RNA, 20 nt, Human
ccugcgccaccgcccagaga

SEQ ID NO: 2387680 - RNA, 17 nt, Human
ccugcgaaggggcccug

SEQ ID NO: 2387681 - RNA, 15 nt, Human
ccugcgaaggggccc

SEQ ID NO: 2387682 - RNA, 20 nt, Human
ccugcgaaggggcccugguc

SEQ ID NO: 2387683 - RNA, 19 nt, Human
ccugcgaaggggcccuggu

SEQ ID NO: 2387684 - RNA, 15 nt, Human
ccugccuucuguccu

SEQ ID NO: 2387685 - RNA, 16 nt, Human
ccugccuucuguccug

SEQ ID NO: 2387686 - RNA, 19 nt, Human
ccugccuucuguccuggug

SEQ ID NO: 2387687 - RNA, 21 nt, Human
ccugccuucuguccugguguc

SEQ ID NO: 2387688 - RNA, 18 nt, Human
ccugccuucuucggggaa

SEQ ID NO: 2387689 - RNA, 22 nt, Human
ccugccuucuucuuuuugcugu

SEQ ID NO: 2387690 - RNA, 13 nt, Human
ccugccuugaagc

SEQ ID NO: 2387691 - RNA, 22 nt, Human
ccugccuuccuccugggcccuc

SEQ ID NO: 2387692 - RNA, 17 nt, Human
ccugccuuccuccuggg

SEQ ID NO: 2387693 - RNA, 16 nt, Human
ccugccuuccuccugg

SEQ ID NO: 2387694 - RNA, 14 nt, Human
ccugccuuccuccu

SEQ ID NO: 2387695 - RNA, 21 nt, Human
ccugccuugaagccacugaag

SEQ ID NO: 2387696 - RNA, 19 nt, Human
ccugccuugaagccacuga

SEQ ID NO: 2387697 - RNA, 17 nt, Human
ccugccuugaagccacu

SEQ ID NO: 2387698 - RNA, 16 nt, Human
ccugccuugaagccac

SEQ ID NO: 2387699 - RNA, 23 nt, Human
ccugccuugaagccacugaagcu

SEQ ID NO: 2387700 - RNA, 22 nt, Human
ccugccuugaagccacugaagc

SEQ ID NO: 2387701 - RNA, 23 nt, Human
ccugccuucuucuuuuugcuguu

SEQ ID NO: 2387702 - RNA, 22 nt, Human
ccugccuggccaggcagaucug

SEQ ID NO: 2387703 - RNA, 18 nt, Human
ccugccuggccaggcaga

SEQ ID NO: 2387704 - RNA, 23 nt, Human
ccugccuggccaggcagaucugu

SEQ ID NO: 2387705 - RNA, 18 nt, Human
ccugccugguccucacac

SEQ ID NO: 2387706 - RNA, 17 nt, Human
ccugccuggcccccugu

SEQ ID NO: 2387707 - RNA, 23 nt, Human
ccugccuggggcgggccccucau

SEQ ID NO: 2387708 - RNA, 19 nt, Human
ccugccuuagagccaggca

SEQ ID NO: 2387709 - RNA, 16 nt, Human
ccugccuuaucuugca

SEQ ID NO: 2387710 - RNA, 20 nt, Human
ccugccuuagagccaggcac

SEQ ID NO: 2387711 - RNA, 21 nt, Human
ccugccuuagagccaggcaca

SEQ ID NO: 2387712 - RNA, 23 nt, Human
ccugccuguugggccaggagccu

SEQ ID NO: 2387713 - RNA, 14 nt, Human
ccugccuggccagg

SEQ ID NO: 2387714 - RNA, 13 nt, Human
ccugccuggccag

SEQ ID NO: 2387715 - RNA, 12 nt, Human
ccugccuggcca

SEQ ID NO: 2387716 - RNA, 11 nt, Human
ccugccuggcc

SEQ ID NO: 2387717 - RNA, 14 nt, Human
ccugccuggcaggc

SEQ ID NO: 2387718 - RNA, 11 nt, Human
ccugccucagc

SEQ ID NO: 2387719 - RNA, 21 nt, Human
ccugccucacagcuggccguc

SEQ ID NO: 2387720 - RNA, 23 nt, Human
ccugccccgucaccaucucaggc

SEQ ID NO: 2387721 - RNA, 22 nt, Human
ccugccccgucaccaucucagg

SEQ ID NO: 2387722 - RNA, 20 nt, Human
ccugccccgcccccaguccc

SEQ ID NO: 2387723 - RNA, 22 nt, Human
ccugccccgcccagcugcaccu

SEQ ID NO: 2387724 - RNA, 13 nt, Human
ccugccccgcccc

SEQ ID NO: 2387725 - RNA, 18 nt, Human
ccugccccgcccccaguc

SEQ ID NO: 2387726 - RNA, 16 nt, Human
ccugccccgcccagcu

SEQ ID NO: 2387727 - RNA, 23 nt, Human
ccugcccccuucucccacacugc

SEQ ID NO: 2387728 - RNA, 22 nt, Human
ccugcccccuucucccacacug

SEQ ID NO: 2387729 - RNA, 21 nt, Human
ccugcccccuucucccacacu

SEQ ID NO: 2387730 - RNA, 20 nt, Human
ccugcccccuucucccacac

SEQ ID NO: 2387731 - RNA, 19 nt, Human
ccugcccccuucucccaca

SEQ ID NO: 2387732 - RNA, 18 nt, Human
ccugcccccuucucccac

SEQ ID NO: 2387733 - RNA, 17 nt, Human
ccugcccccuucuccca

SEQ ID NO: 2387734 - RNA, 18 nt, Human
ccugcccccagccccggg

SEQ ID NO: 2387735 - RNA, 20 nt, Human
ccugcccccaggacugggcc

SEQ ID NO: 2387736 - RNA, 22 nt, Human
ccugcccccaggacugggccac

SEQ ID NO: 2387737 - RNA, 16 nt, Human
ccugcccccaggacug

SEQ ID NO: 2387738 - RNA, 17 nt, Human
ccugcccccaggacugg

SEQ ID NO: 2387739 - RNA, 18 nt, Human
ccugcccccaggacuggg

SEQ ID NO: 2387740 - RNA, 19 nt, Human
ccugcccccaggacugggc

SEQ ID NO: 2387741 - RNA, 21 nt, Human
ccugccuaggaauucccagcc

SEQ ID NO: 2387742 - RNA, 23 nt, Human
ccugccguggacuuggggucaga

SEQ ID NO: 2387743 - RNA, 20 nt, Human
ccugccuaagggagaguggu

SEQ ID NO: 2387744 - RNA, 23 nt, Human
ccugccgguaaacacgccugcaa

SEQ ID NO: 2387745 - RNA, 22 nt, Human
ccugccgguaaacacgccugca

SEQ ID NO: 2387746 - RNA, 21 nt, Human
ccugccgguaaacacgccugc

SEQ ID NO: 2387747 - RNA, 20 nt, Human
ccugccgguaaacacgccug

SEQ ID NO: 2387748 - RNA, 15 nt, Human
ccugccggccggggc

SEQ ID NO: 2387749 - RNA, 15 nt, Human
ccugccccucccaga

SEQ ID NO: 2387750 - RNA, 14 nt, Human
ccugccccucccag

SEQ ID NO: 2387751 - RNA, 15 nt, Human
ccugccgguaaacac

SEQ ID NO: 2387752 - RNA, 22 nt, Human
ccugccccucaacucuccucca

SEQ ID NO: 2387753 - RNA, 20 nt, Human
ccugcguccuccucaccuca

SEQ ID NO: 2387754 - RNA, 22 nt, Human
ccugcuauuacuaaggaguaau

SEQ ID NO: 2387755 - RNA, 22 nt, Human
ccugcggugcuaucucccccag

SEQ ID NO: 2387756 - RNA, 18 nt, Human
ccugcguccuccucaccu

SEQ ID NO: 2387757 - RNA, 19 nt, Human
ccugcguccuccucaccuc

SEQ ID NO: 2387758 - RNA, 13 nt, Human
ccugcguccuccu

SEQ ID NO: 2387759 - RNA, 15 nt, Human
ccugcguccuccuca

SEQ ID NO: 2387760 - RNA, 16 nt, Human
ccugcguccuccucac

SEQ ID NO: 2387761 - RNA, 17 nt, Human
ccugcguccuccucacc

SEQ ID NO: 2387762 - RNA, 21 nt, Human
ccugcucuccgaccagacacc

SEQ ID NO: 2387763 - RNA, 21 nt, Human
ccugcucgaugcucacagggc

SEQ ID NO: 2387764 - RNA, 18 nt, Human
ccugcuccuucccaggag

SEQ ID NO: 2387765 - RNA, 22 nt, Human
ccugcuccucccuggcugcccu

SEQ ID NO: 2387766 - RNA, 15 nt, Human
ccugcuccagaccug

SEQ ID NO: 2387767 - RNA, 14 nt, Human
ccugcuccagaccu

SEQ ID NO: 2387768 - RNA, 13 nt, Human
ccugcuccagacc

SEQ ID NO: 2387769 - RNA, 12 nt, Human
ccugcuccagac

SEQ ID NO: 2387770 - RNA, 11 nt, Human
ccugcuccaga

SEQ ID NO: 2387771 - RNA, 14 nt, Human
ccugcuccacagug

SEQ ID NO: 2387772 - RNA, 15 nt, Human
ccugcuccacagugu

SEQ ID NO: 2387773 - RNA, 12 nt, Human
ccugcuccacag

SEQ ID NO: 2387774 - RNA, 19 nt, Human
ccugcuccacagccauccc

SEQ ID NO: 2387775 - RNA, 20 nt, Human
ccugcuccacagccauccca

SEQ ID NO: 2387776 - RNA, 13 nt, Human
ccugcuccacagu

SEQ ID NO: 2387777 - RNA, 22 nt, Human
ccugcucuccgaccagacaccu

SEQ ID NO: 2387778 - RNA, 22 nt, Human
ccugcucuccaagucucagugg

SEQ ID NO: 2387779 - RNA, 23 nt, Human
ccugcucuccaagucucaguggc

SEQ ID NO: 2387780 - RNA, 16 nt, Human
ccugcucuccucuugc

SEQ ID NO: 2387781 - RNA, 18 nt, Human
ccugcucuccucuugcca

SEQ ID NO: 2387782 - RNA, 19 nt, Human
ccugcucuccucuugccac

SEQ ID NO: 2387783 - RNA, 21 nt, Human
ccugcucuccucuugccacug

SEQ ID NO: 2387784 - RNA, 20 nt, Human
ccugcugagagacccaagga

SEQ ID NO: 2387785 - RNA, 21 nt, Human
ccugcugagagacccaaggag

SEQ ID NO: 2387786 - RNA, 17 nt, Human
ccugcugagagacccaa

SEQ ID NO: 2387787 - RNA, 22 nt, Human
ccugcucuccucuugccacugc

SEQ ID NO: 2387788 - RNA, 23 nt, Human
ccugcugaaugauuuccaaagag

SEQ ID NO: 2387789 - RNA, 21 nt, Human
ccugcugaagguggggauugc

SEQ ID NO: 2387790 - RNA, 22 nt, Human
ccuggaaauaucaguuacucag

SEQ ID NO: 2387791 - RNA, 21 nt, Human
ccugcuuuucacugcugcaag

SEQ ID NO: 2387792 - RNA, 15 nt, Human
ccugcuuuucacugc

SEQ ID NO: 2387793 - RNA, 21 nt, Human
ccugcuuccaggaaacuccac

SEQ ID NO: 2387794 - RNA, 19 nt, Human
ccugcuuuucacugcugca

SEQ ID NO: 2387795 - RNA, 23 nt, Human
ccuggaaaucaggguuaguauug

SEQ ID NO: 2387796 - RNA, 17 nt, Human
ccuggaacuuggggagu

SEQ ID NO: 2387797 - RNA, 16 nt, Human
ccuggaacuuggggag

SEQ ID NO: 2387798 - RNA, 13 nt, Human
ccuggaacuuggg

SEQ ID NO: 2387799 - RNA, 20 nt, Human
ccuggaacugucucucauga

SEQ ID NO: 2387800 - RNA, 18 nt, Human
ccuggaacugucucucau

SEQ ID NO: 2387801 - RNA, 22 nt, Human
ccuggaacaucaucaaggcacu

SEQ ID NO: 2387802 - RNA, 15 nt, Human
ccuggaagacagaga

SEQ ID NO: 2387803 - RNA, 22 nt, Human
ccuggaagacagagaccuccug

SEQ ID NO: 2387804 - RNA, 12 nt, Human
ccuggaagacag

SEQ ID NO: 2387805 - RNA, 13 nt, Human
ccuggaagacaga

SEQ ID NO: 2387806 - RNA, 14 nt, Human
ccuggaagacagag

SEQ ID NO: 2387807 - RNA, 20 nt, Human
ccuggaagcuguguccuugc

SEQ ID NO: 2387808 - RNA, 18 nt, Human
ccuggaagcuguguccuu

SEQ ID NO: 2387809 - RNA, 17 nt, Human
ccuggaagcuguguccu

SEQ ID NO: 2387810 - RNA, 23 nt, Human
ccuggaagcuguguccuugcacc

SEQ ID NO: 2387811 - RNA, 13 nt, Human
ccuggaagcugug

SEQ ID NO: 2387812 - RNA, 17 nt, Human
ccuggaagccagcuuuc

SEQ ID NO: 2387813 - RNA, 15 nt, Human
ccuggaagccagcuu

SEQ ID NO: 2387814 - RNA, 14 nt, Human
ccugcuucaaauau

SEQ ID NO: 2387815 - RNA, 23 nt, Human
ccugcugugauuccacuacaccu

SEQ ID NO: 2387816 - RNA, 14 nt, Human
ccugcuguguuccc

SEQ ID NO: 2387817 - RNA, 21 nt, Human
ccugcugagggaccagccaag

SEQ ID NO: 2387818 - RNA, 15 nt, Human
ccugcuguccccucu

SEQ ID NO: 2387819 - RNA, 19 nt, Human
ccugcuguccccucuugcc

SEQ ID NO: 2387820 - RNA, 22 nt, Human
ccugcuguccccucuugcccca

SEQ ID NO: 2387821 - RNA, 20 nt, Human
ccugcugugauuccacuaca

SEQ ID NO: 2387822 - RNA, 19 nt, Human
ccugcugagggaccagcca

SEQ ID NO: 2387823 - RNA, 17 nt, Human
ccugcugagggaccagc

SEQ ID NO: 2387824 - RNA, 15 nt, Human
ccugcugagucccag

SEQ ID NO: 2387825 - RNA, 20 nt, Human
ccugcuuugggcugcccugg

SEQ ID NO: 2387826 - RNA, 19 nt, Human
ccugcuuugggcugcccug

SEQ ID NO: 2387827 - RNA, 14 nt, Human
ccugcuucaugcuc

SEQ ID NO: 2387828 - RNA, 16 nt, Human
ccugcuucaugcucag

SEQ ID NO: 2387829 - RNA, 17 nt, Human
ccugcuucaugcucagc

SEQ ID NO: 2387830 - RNA, 18 nt, Human
ccugcuuccaccucaccc

SEQ ID NO: 2387831 - RNA, 19 nt, Human
ccugcuuccaccucacccc

SEQ ID NO: 2387832 - RNA, 20 nt, Human
ccugcuuccaccucacccca

SEQ ID NO: 2387833 - RNA, 21 nt, Human
ccugcuuugggcugcccuggu

SEQ ID NO: 2387834 - RNA, 22 nt, Human
ccugcuuugggcugcccuggug

SEQ ID NO: 2387835 - RNA, 23 nt, Human
ccugcuuugggcugcccuggugc

SEQ ID NO: 2387836 - RNA, 21 nt, Human
ccugcuuccaccucaccccac

SEQ ID NO: 2387837 - RNA, 14 nt, Human
ccugcuuccaggaa

SEQ ID NO: 2387838 - RNA, 16 nt, Human
ccugcaggccaggcca

SEQ ID NO: 2387839 - RNA, 15 nt, Human
ccugcagggccaagc

SEQ ID NO: 2387840 - RNA, 19 nt, Human
ccugcaggguggugcuggg

SEQ ID NO: 2387841 - RNA, 20 nt, Human
ccugcaggguggugcuggga

SEQ ID NO: 2387842 - RNA, 21 nt, Human
ccugcaggguggugcugggac

SEQ ID NO: 2387843 - RNA, 22 nt, Human
ccugcaggguggugcugggacu

SEQ ID NO: 2387844 - RNA, 23 nt, Human
ccugcaggguggugcugggacug

SEQ ID NO: 2387845 - RNA, 15 nt, Human
ccugcaggugcugcu

SEQ ID NO: 2387846 - RNA, 17 nt, Human
ccugcaggugcugcugc

SEQ ID NO: 2387847 - RNA, 18 nt, Human
ccugcaggugcugcugcg

SEQ ID NO: 2387848 - RNA, 18 nt, Human
ccugcaguacuuuaccuc

SEQ ID NO: 2387849 - RNA, 20 nt, Human
ccugcaggugcugcugcgug

SEQ ID NO: 2387850 - RNA, 16 nt, Human
ccugcagguugggcca

SEQ ID NO: 2387851 - RNA, 17 nt, Human
ccugcagguugggccau

SEQ ID NO: 2387852 - RNA, 21 nt, Human
ccugcagguugggccauacug

SEQ ID NO: 2387853 - RNA, 15 nt, Human
ccugcagucaucuug

SEQ ID NO: 2387854 - RNA, 16 nt, Human
ccugcagucuggcuga

SEQ ID NO: 2387855 - RNA, 15 nt, Human
ccugcagucacagcu

SEQ ID NO: 2387856 - RNA, 20 nt, Human
ccugcaguacuuuaccuccu

SEQ ID NO: 2387857 - RNA, 18 nt, Human
ccugcaggccaggccagc

SEQ ID NO: 2387858 - RNA, 12 nt, Human
ccugcaggccag

SEQ ID NO: 2387859 - RNA, 22 nt, Human
ccugcaggccaagagcagaggc

SEQ ID NO: 2387860 - RNA, 21 nt, Human
ccugcaggccaagagcagagg

SEQ ID NO: 2387861 - RNA, 16 nt, Human
ccugcaggccaagagc

SEQ ID NO: 2387862 - RNA, 21 nt, Human
ccugcacuaauuugauguuua

SEQ ID NO: 2387863 - RNA, 19 nt, Human
ccugcacgucaugggaggg

SEQ ID NO: 2387864 - RNA, 23 nt, Human
ccugcacgucaugggagggggcu

SEQ ID NO: 2387865 - RNA, 17 nt, Human
ccugcacggugggccuu

SEQ ID NO: 2387866 - RNA, 18 nt, Human
ccugcacggugggccuug

SEQ ID NO: 2387867 - RNA, 19 nt, Human
ccugcacggugggccuugc

SEQ ID NO: 2387868 - RNA, 20 nt, Human
ccugcacggugggccuugcu

SEQ ID NO: 2387869 - RNA, 21 nt, Human
ccugcacggugggccuugcug

SEQ ID NO: 2387870 - RNA, 22 nt, Human
ccugcacggugggccuugcugg

SEQ ID NO: 2387871 - RNA, 23 nt, Human
ccugcacggugggccuugcuggg

SEQ ID NO: 2387872 - RNA, 18 nt, Human
ccugcacgucaugggagg

SEQ ID NO: 2387873 - RNA, 21 nt, Human
ccugcaccuccccccacugca

SEQ ID NO: 2387874 - RNA, 20 nt, Human
ccugcaaugaagucucugaa

SEQ ID NO: 2387875 - RNA, 22 nt, Human
ccugcaccuccccccacugcag

SEQ ID NO: 2387876 - RNA, 14 nt, Human
ccugcaccugugca

SEQ ID NO: 2387877 - RNA, 15 nt, Human
ccugcaccugugcag

SEQ ID NO: 2387878 - RNA, 16 nt, Human
ccugcacggugggccu

SEQ ID NO: 2387879 - RNA, 19 nt, Human
ccugcaaugaagucucuga

SEQ ID NO: 2387880 - RNA, 17 nt, Human
ccugcaagucaguccag

SEQ ID NO: 2387881 - RNA, 20 nt, Human
ccugcaagggcuccccacug

SEQ ID NO: 2387882 - RNA, 21 nt, Human
ccugcaaugaagucucugaag

SEQ ID NO: 2387883 - RNA, 19 nt, Human
ccugcaauuucauaugcug

SEQ ID NO: 2387884 - RNA, 14 nt, Human
ccugcaagaacaag

SEQ ID NO: 2387885 - RNA, 17 nt, Human
ccugcaacucaaggacu

SEQ ID NO: 2387886 - RNA, 17 nt, Human
ccugcaaacucacugcu

SEQ ID NO: 2387887 - RNA, 20 nt, Human
ccugcaaacucacugcucaa

SEQ ID NO: 2387888 - RNA, 22 nt, Human
ccugcaaaauuugaugccagga

SEQ ID NO: 2387889 - RNA, 14 nt, Human
ccugcaaacucacu

SEQ ID NO: 2387890 - RNA, 15 nt, Human
ccugcaaacucacug

SEQ ID NO: 2387891 - RNA, 16 nt, Human
ccugcaaacucacugc

SEQ ID NO: 2387892 - RNA, 12 nt, Human
ccugcaacucau

SEQ ID NO: 2387893 - RNA, 12 nt, Human
ccugcaaggacu

SEQ ID NO: 2387894 - RNA, 17 nt, Human
ccugcaagggcucccca

SEQ ID NO: 2387895 - RNA, 18 nt, Human
ccugcaacucaaggacuu

SEQ ID NO: 2387896 - RNA, 20 nt, Human
ccugcaacucaaggacuuug

SEQ ID NO: 2387897 - RNA, 13 nt, Human
ccugcaaggacua

SEQ ID NO: 2387898 - RNA, 14 nt, Human
ccugcaaaauuuua

SEQ ID NO: 2387899 - RNA, 18 nt, Human
ccugcaaaaugagacccu

SEQ ID NO: 2387900 - RNA, 19 nt, Human
ccugcaaaaggacucucag

SEQ ID NO: 2387901 - RNA, 20 nt, Human
ccugauuguguauauucaua

SEQ ID NO: 2387902 - RNA, 17 nt, Human
ccugcaaaaggacucuc

SEQ ID NO: 2387903 - RNA, 22 nt, Human
ccugauuuuuuuuccuuuuaau

SEQ ID NO: 2387904 - RNA, 17 nt, Human
ccugauugugucucuug

SEQ ID NO: 2387905 - RNA, 19 nt, Human
ccugauugugucucuuggu

SEQ ID NO: 2387906 - RNA, 22 nt, Human
ccugcaaccugauugugucucu

SEQ ID NO: 2387907 - RNA, 21 nt, Human
ccugcaaccugauugugucuc

SEQ ID NO: 2387908 - RNA, 22 nt, Human
ccugcaaacgcugccugcccgu

SEQ ID NO: 2387909 - RNA, 21 nt, Human
ccugcaaacgcugccugcccg

SEQ ID NO: 2387910 - RNA, 22 nt, Human
ccugcaaacgcugccugcccac

SEQ ID NO: 2387911 - RNA, 19 nt, Human
ccugcaaacgcugccugcc

SEQ ID NO: 2387912 - RNA, 18 nt, Human
ccugcaaacgcugccugc

SEQ ID NO: 2387913 - RNA, 17 nt, Human
ccugcaaacgcugccug

SEQ ID NO: 2387914 - RNA, 16 nt, Human
ccugcaaacgcugccu

SEQ ID NO: 2387915 - RNA, 15 nt, Human
ccugcaaacgcugcc

SEQ ID NO: 2387916 - RNA, 11 nt, Human
ccugaggcccu

SEQ ID NO: 2387917 - RNA, 12 nt, Human
ccugaggcccuu

SEQ ID NO: 2387918 - RNA, 19 nt, Human
ccugaugcuucuucagaga

SEQ ID NO: 2387919 - RNA, 20 nt, Human
ccugaugcuucuucagagac

SEQ ID NO: 2387920 - RNA, 21 nt, Human
ccugaugcuucuucagagacu

SEQ ID NO: 2387921 - RNA, 22 nt, Human
ccugaugcuucuucagagacuc

SEQ ID NO: 2387922 - RNA, 14 nt, Human
ccugaggcccuucu

SEQ ID NO: 2387923 - RNA, 19 nt, Human
ccugauucggcugucucag

SEQ ID NO: 2387924 - RNA, 17 nt, Human
ccugauugccaagcuca

SEQ ID NO: 2387925 - RNA, 15 nt, Human
ccugauugugucucu

SEQ ID NO: 2387926 - RNA, 16 nt, Human
ccugccaggcauggug

SEQ ID NO: 2387927 - RNA, 11 nt, Human
ccugccaggga

SEQ ID NO: 2387928 - RNA, 23 nt, Human
ccugccaggaagccagcaggcuc

SEQ ID NO: 2387929 - RNA, 21 nt, Human
ccugccaggagcuuuggaccu

SEQ ID NO: 2387930 - RNA, 18 nt, Human
ccugccaggaagccagca

SEQ ID NO: 2387931 - RNA, 19 nt, Human
ccugccaggaagccagcag

SEQ ID NO: 2387932 - RNA, 21 nt, Human
ccugccaggaagccagcaggc

SEQ ID NO: 2387933 - RNA, 22 nt, Human
ccugccaggaagccagcaggcu

SEQ ID NO: 2387934 - RNA, 22 nt, Human
ccugcccccagaccuuuuaucc

SEQ ID NO: 2387935 - RNA, 13 nt, Human
ccugcccccagcc

SEQ ID NO: 2387936 - RNA, 14 nt, Human
ccugcccccagccc

SEQ ID NO: 2387937 - RNA, 14 nt, Human
ccugcccccacuuc

SEQ ID NO: 2387938 - RNA, 15 nt, Human
ccugcccccacuucc

SEQ ID NO: 2387939 - RNA, 17 nt, Human
ccugcccccacuuccug

SEQ ID NO: 2387940 - RNA, 12 nt, Human
ccugcccccagg

SEQ ID NO: 2387941 - RNA, 15 nt, Human
ccugcccccagcccc

SEQ ID NO: 2387942 - RNA, 17 nt, Human
ccugcccccagccccgg

SEQ ID NO: 2387943 - RNA, 14 nt, Human
ccugcccccaggac

SEQ ID NO: 2387944 - RNA, 15 nt, Human
ccugcccccaggacu

SEQ ID NO: 2387945 - RNA, 16 nt, Human
ccugccagggacagag

SEQ ID NO: 2387946 - RNA, 23 nt, Human
ccugcccccaccacggccacugg

SEQ ID NO: 2387947 - RNA, 12 nt, Human
ccugccagggac

SEQ ID NO: 2387948 - RNA, 13 nt, Human
ccugccagggaca

SEQ ID NO: 2387949 - RNA, 14 nt, Human
ccugccagggacag

SEQ ID NO: 2387950 - RNA, 15 nt, Human
ccugccagggacaga

SEQ ID NO: 2387951 - RNA, 19 nt, Human
ccugcaucugaccagcagc

SEQ ID NO: 2387952 - RNA, 22 nt, Human
ccugcauccguaguucccugaa

SEQ ID NO: 2387953 - RNA, 19 nt, Human
ccugcauccguaguucccu

SEQ ID NO: 2387954 - RNA, 18 nt, Human
ccugcaucugaccagcag

SEQ ID NO: 2387955 - RNA, 21 nt, Human
ccugcagucuggcugagcccu

SEQ ID NO: 2387956 - RNA, 22 nt, Human
ccugcagucuggcugagcccug

SEQ ID NO: 2387957 - RNA, 18 nt, Human
ccugcauccccuuggcug

SEQ ID NO: 2387958 - RNA, 21 nt, Human
ccugcauccccuuggcuguga

SEQ ID NO: 2387959 - RNA, 23 nt, Human
ccugcauccccuuggcugugagg

SEQ ID NO: 2387960 - RNA, 24 nt, Human
ccugcauccccuuggcugugaggc

SEQ ID NO: 2387961 - RNA, 23 nt, Human
ccugccacuuugguacauggcca

SEQ ID NO: 2387962 - RNA, 22 nt, Human
ccugcauucugccgugugcccu

SEQ ID NO: 2387963 - RNA, 19 nt, Human
ccugcauucacccagacag

SEQ ID NO: 2387964 - RNA, 14 nt, Human
ccugccagaccccc

SEQ ID NO: 2387965 - RNA, 23 nt, Human
ccugccacucaggcccaaagccu

SEQ ID NO: 2387966 - RNA, 22 nt, Human
ccugccacucaggcccaaagcc

SEQ ID NO: 2387967 - RNA, 17 nt, Human
ccugcauucacccagac

SEQ ID NO: 2387968 - RNA, 16 nt, Human
ccugcauucacccaga

SEQ ID NO: 2387969 - RNA, 15 nt, Human
ccugcauucacccag

SEQ ID NO: 2387970 - RNA, 14 nt, Human
ccugccacucaggc

SEQ ID NO: 2387971 - RNA, 23 nt, Human
ccugcauguaaacacgccugcaa

SEQ ID NO: 2387972 - RNA, 22 nt, Human
ccugcauguaaacacgccugca

SEQ ID NO: 2387973 - RNA, 21 nt, Human
ccugcauguaaacacgccugc

SEQ ID NO: 2387974 - RNA, 20 nt, Human
ccugcauguaaacacgccug

SEQ ID NO: 2387975 - RNA, 17 nt, Human
ccugccagccuggcuuc

SEQ ID NO: 2387976 - RNA, 16 nt, Human
ccugccagccuggcuu

SEQ ID NO: 2387977 - RNA, 15 nt, Human
ccugccagccuggcu

SEQ ID NO: 2387978 - RNA, 14 nt, Human
ccugccagccuggc

SEQ ID NO: 2387979 - RNA, 19 nt, Human
ccugccagacggcacccac

SEQ ID NO: 2387980 - RNA, 13 nt, Human
ccugccagccugg

SEQ ID NO: 2387981 - RNA, 12 nt, Human
ccugcauucuuu

SEQ ID NO: 2387982 - RNA, 21 nt, Human
ccugccagccuggcuucugga

SEQ ID NO: 2387983 - RNA, 12 nt, Human
ccugccagcugc

SEQ ID NO: 2387984 - RNA, 14 nt, Human
ccugccagcugcac

SEQ ID NO: 2387985 - RNA, 13 nt, Human
ccugccagcugca

SEQ ID NO: 2387986 - RNA, 23 nt, Human
ccugccagcugcacugaugcugc

SEQ ID NO: 2387987 - RNA, 18 nt, Human
ccugccagcugcacugau

SEQ ID NO: 2387988 - RNA, 17 nt, Human
ccugccagcugcacuga

SEQ ID NO: 2387989 - RNA, 16 nt, Human
ccugccagcugcacug

SEQ ID NO: 2387990 - RNA, 13 nt, Human
ccugccaggaagc

SEQ ID NO: 2387991 - RNA, 14 nt, Human
ccugccaggaagcc

SEQ ID NO: 2387992 - RNA, 15 nt, Human
ccugccaggaagcca

SEQ ID NO: 2387993 - RNA, 17 nt, Human
ccugccaggaagccagc

SEQ ID NO: 2387994 - RNA, 16 nt, Human
ccugagcuuggccaga

SEQ ID NO: 2387995 - RNA, 14 nt, Human
ccugagcuuucugc

SEQ ID NO: 2387996 - RNA, 11 nt, Human
ccugagcccca

SEQ ID NO: 2387997 - RNA, 20 nt, Human
ccugagcaaugucugugcua

SEQ ID NO: 2387998 - RNA, 13 nt, Human
ccugagccaagcu

SEQ ID NO: 2387999 - RNA, 23 nt, Human
ccugagccaagcuagaauucccu

SEQ ID NO: 2388000 - RNA, 20 nt, Human
ccugagccagauuucacucu

SEQ ID NO: 2388001 - RNA, 12 nt, Human
ccugagccagau

SEQ ID NO: 2388002 - RNA, 13 nt, Human
ccugaggaugagc

SEQ ID NO: 2388003 - RNA, 20 nt, Human
ccugaggacagcuguccucu

SEQ ID NO: 2388004 - RNA, 21 nt, Human
ccugaggcccagagggccugc

SEQ ID NO: 2388005 - RNA, 20 nt, Human
ccugaggaugagcuggaagg

SEQ ID NO: 2388006 - RNA, 15 nt, Human
ccugaggaugagcug

SEQ ID NO: 2388007 - RNA, 16 nt, Human
ccugaggaugagcugg

SEQ ID NO: 2388008 - RNA, 17 nt, Human
ccugaggaugagcugga

SEQ ID NO: 2388009 - RNA, 23 nt, Human
ccugaggaagcgugaaggccgag

SEQ ID NO: 2388010 - RNA, 12 nt, Human
ccugaggaagcg

SEQ ID NO: 2388011 - RNA, 18 nt, Human
ccugaggaagaugggggc

SEQ ID NO: 2388012 - RNA, 15 nt, Human
ccugaggacagcugu

SEQ ID NO: 2388013 - RNA, 16 nt, Human
ccugaggacagcuguc

SEQ ID NO: 2388014 - RNA, 17 nt, Human
ccugaggacagcugucc

SEQ ID NO: 2388015 - RNA, 18 nt, Human
ccugagcuuggccagaag

SEQ ID NO: 2388016 - RNA, 18 nt, Human
ccugaggaacccuuacag

SEQ ID NO: 2388017 - RNA, 19 nt, Human
ccugaggaagagggacugu

SEQ ID NO: 2388018 - RNA, 21 nt, Human
ccugagcuuggccagaagggg

SEQ ID NO: 2388019 - RNA, 17 nt, Human
ccugagcuuggccagaa

SEQ ID NO: 2388020 - RNA, 16 nt, Human
ccugagcuuucugcua

SEQ ID NO: 2388021 - RNA, 19 nt, Human
ccugagcaaugucugugcu

SEQ ID NO: 2388022 - RNA, 23 nt, Human
ccugagcaacucuugauuaucca

SEQ ID NO: 2388023 - RNA, 18 nt, Human
ccugagcaacucuugauu

SEQ ID NO: 2388024 - RNA, 15 nt, Human
ccugagcaacucuug

SEQ ID NO: 2388025 - RNA, 14 nt, Human
ccugagcaacucuu

SEQ ID NO: 2388026 - RNA, 13 nt, Human
ccugagcaacucu

SEQ ID NO: 2388027 - RNA, 16 nt, Human
ccugacauuggagccu

SEQ ID NO: 2388028 - RNA, 21 nt, Human
ccugacagaugucagccgagc

SEQ ID NO: 2388029 - RNA, 20 nt, Human
ccugacagaugucagccgag

SEQ ID NO: 2388030 - RNA, 18 nt, Human
ccugacagucuugugcuu

SEQ ID NO: 2388031 - RNA, 16 nt, Human
ccugacagaaggacuc

SEQ ID NO: 2388032 - RNA, 15 nt, Human
ccugacacuuuaauu

SEQ ID NO: 2388033 - RNA, 14 nt, Human
ccugacacuuuaau

SEQ ID NO: 2388034 - RNA, 13 nt, Human
ccugacacuuuaa

SEQ ID NO: 2388035 - RNA, 20 nt, Human
ccugacaagcacugcuaggc

SEQ ID NO: 2388036 - RNA, 13 nt, Human
ccugacacucccu

SEQ ID NO: 2388037 - RNA, 22 nt, Human
ccugacacugcggggcuuggcu

SEQ ID NO: 2388038 - RNA, 23 nt, Human
ccugacaacacucauugaccuga

SEQ ID NO: 2388039 - RNA, 18 nt, Human
ccugacaaccacuggucu

SEQ ID NO: 2388040 - RNA, 19 nt, Human
ccugacaaccacuggucug

SEQ ID NO: 2388041 - RNA, 14 nt, Human
ccugacaagcacug

SEQ ID NO: 2388042 - RNA, 19 nt, Human
ccugacaagcacugcuagg

SEQ ID NO: 2388043 - RNA, 15 nt, Human
ccucuccacccuccc

SEQ ID NO: 2388044 - RNA, 17 nt, Human
ccucuccacccucccag

SEQ ID NO: 2388045 - RNA, 22 nt, Human
ccucuccacccucccagaccug

SEQ ID NO: 2388046 - RNA, 17 nt, Human
ccucuccaccuaguggc

SEQ ID NO: 2388047 - RNA, 23 nt, Human
ccucuccaccuaguggcugucca

SEQ ID NO: 2388048 - RNA, 22 nt, Human
ccucuccaagggcuucugcacc

SEQ ID NO: 2388049 - RNA, 23 nt, Human
ccucuccaagggcuucugcaccc

SEQ ID NO: 2388050 - RNA, 13 nt, Human
ccucuccaagggc

SEQ ID NO: 2388051 - RNA, 18 nt, Human
ccucuccaagggcuucug

SEQ ID NO: 2388052 - RNA, 19 nt, Human
ccucuccaagggcuucugc

SEQ ID NO: 2388053 - RNA, 21 nt, Human
ccucuccaagggcuucugcac

SEQ ID NO: 2388054 - RNA, 15 nt, Human
ccugaggcagguccc

SEQ ID NO: 2388055 - RNA, 16 nt, Human
ccugcauucuuucugu

SEQ ID NO: 2388056 - RNA, 23 nt, Human
cgccaggcugaccacagcacagc

SEQ ID NO: 2388057 - RNA, 21 nt, Human
cgccaggcugaccacagcaca

SEQ ID NO: 2388058 - RNA, 22 nt, Human
cgccaggggaaaaucagccugc

SEQ ID NO: 2388059 - RNA, 20 nt, Human
cgccaggcugaccacagcac

SEQ ID NO: 2388060 - RNA, 17 nt, Human
cgccaggcugaccacag

SEQ ID NO: 2388061 - RNA, 16 nt, Human
cgccaggcugaccaca

SEQ ID NO: 2388062 - RNA, 23 nt, Human
cgccaggauggaacacggccaca

SEQ ID NO: 2388063 - RNA, 22 nt, Human
cgcagcccuagagccugccugg

SEQ ID NO: 2388064 - RNA, 21 nt, Human
cgccaggauggaacacggcca

SEQ ID NO: 2388065 - RNA, 19 nt, Human
cgcagcccuagagccugcc

SEQ ID NO: 2388066 - RNA, 20 nt, Human
cgcagcccuagagccugccu

SEQ ID NO: 2388067 - RNA, 17 nt, Human
cgccagauucuuuccug

SEQ ID NO: 2388068 - RNA, 19 nt, Human
cgccagauucuuuccugag

SEQ ID NO: 2388069 - RNA, 20 nt, Human
cgccagauucuuuccugagg

SEQ ID NO: 2388070 - RNA, 21 nt, Human
cgccagauucuuuccugaggc

SEQ ID NO: 2388071 - RNA, 19 nt, Human
cgcacccccacccuuuggg

SEQ ID NO: 2388072 - RNA, 15 nt, Human
cgcacccccacccuu

SEQ ID NO: 2388073 - RNA, 16 nt, Human
cgcacccuccccuccc

SEQ ID NO: 2388074 - RNA, 12 nt, Human
cgcagaccuccc

SEQ ID NO: 2388075 - RNA, 17 nt, Human
cgcaccccccaagcugu

SEQ ID NO: 2388076 - RNA, 19 nt, Human
cgcagaccuccccagcccc

SEQ ID NO: 2388077 - RNA, 20 nt, Human
cgcagaccuccccagccccu

SEQ ID NO: 2388078 - RNA, 15 nt, Human
cgcagaccuccccag

SEQ ID NO: 2388079 - RNA, 16 nt, Human
cgcagaccuccccagc

SEQ ID NO: 2388080 - RNA, 17 nt, Human
cgcagaccuccccagcc

SEQ ID NO: 2388081 - RNA, 18 nt, Human
cgcagaccuccccagccc

SEQ ID NO: 2388082 - RNA, 15 nt, Human
cgcagacaggaccag

SEQ ID NO: 2388083 - RNA, 16 nt, Human
cgcagacaggaccagg

SEQ ID NO: 2388084 - RNA, 10 nt, Human
cgcagcccug

SEQ ID NO: 2388085 - RNA, 17 nt, Human
cgcagcccuagagccug

SEQ ID NO: 2388086 - RNA, 18 nt, Human
cgcagcccuagagccugc

SEQ ID NO: 2388087 - RNA, 14 nt, Human
cgcagcccugcaga

SEQ ID NO: 2388088 - RNA, 12 nt, Human
cgcagagaggcc

SEQ ID NO: 2388089 - RNA, 14 nt, Human
cgcagagaggccag

SEQ ID NO: 2388090 - RNA, 18 nt, Human
cgcaaaccacacuggacu

SEQ ID NO: 2388091 - RNA, 19 nt, Human
cgcaaagggcugaaagcca

SEQ ID NO: 2388092 - RNA, 15 nt, Human
cgcaaaccacacugg

SEQ ID NO: 2388093 - RNA, 16 nt, Human
cgcaaaccacacugga

SEQ ID NO: 2388094 - RNA, 23 nt, Human
cgauucaucucucagaagggagg

SEQ ID NO: 2388095 - RNA, 13 nt, Human
cgauuuugccugu

SEQ ID NO: 2388096 - RNA, 13 nt, Human
cgauuuuguaucu

SEQ ID NO: 2388097 - RNA, 17 nt, Human
cgauuuuguaucugcag

SEQ ID NO: 2388098 - RNA, 18 nt, Human
cgauuuuguaucugcagg

SEQ ID NO: 2388099 - RNA, 23 nt, Human
cgauuuuguaucugcaggcagac

SEQ ID NO: 2388100 - RNA, 15 nt, Human
cgauucauauugaau

SEQ ID NO: 2388101 - RNA, 22 nt, Human
cgauucaccugagcaggaccuc

SEQ ID NO: 2388102 - RNA, 14 nt, Human
cgauuugucccagg

SEQ ID NO: 2388103 - RNA, 20 nt, Human
cgauuucuguuuagauaaua

SEQ ID NO: 2388104 - RNA, 12 nt, Human
cgcacagagcug

SEQ ID NO: 2388105 - RNA, 13 nt, Human
cgcacagagcugg

SEQ ID NO: 2388106 - RNA, 20 nt, Human
cgcacacacacacacaggag

SEQ ID NO: 2388107 - RNA, 15 nt, Human
cgcacacacacacac

SEQ ID NO: 2388108 - RNA, 22 nt, Human
cgcaagagccauguagaagcug

SEQ ID NO: 2388109 - RNA, 20 nt, Human
cgcaaacccccuuugugcug

SEQ ID NO: 2388110 - RNA, 14 nt, Human
cgcacccccacccu

SEQ ID NO: 2388111 - RNA, 13 nt, Human
cgcacccccaccc

SEQ ID NO: 2388112 - RNA, 14 nt, Human
cgcaccccagagug

SEQ ID NO: 2388113 - RNA, 14 nt, Human
cgcaccauucugac

SEQ ID NO: 2388114 - RNA, 15 nt, Human
cgcaccauucugacu

SEQ ID NO: 2388115 - RNA, 13 nt, Human
cgcacagucucuc

SEQ ID NO: 2388116 - RNA, 15 nt, Human
cgcacagucucucuc

SEQ ID NO: 2388117 - RNA, 17 nt, Human
cgcacagagcuggggcu

SEQ ID NO: 2388118 - RNA, 13 nt, Human
cgcacagcaguuc

SEQ ID NO: 2388119 - RNA, 19 nt, Human
cgcacagcaugagaggcuc

SEQ ID NO: 2388120 - RNA, 16 nt, Human
cgauguggcccuggcc

SEQ ID NO: 2388121 - RNA, 15 nt, Human
cgauguggcccuggc

SEQ ID NO: 2388122 - RNA, 13 nt, Human
cgauguggcccug

SEQ ID NO: 2388123 - RNA, 11 nt, Human
cgauguggccc

SEQ ID NO: 2388124 - RNA, 18 nt, Human
cgauguggcccuggccug

SEQ ID NO: 2388125 - RNA, 17 nt, Human
cgauguggcccuggccu

SEQ ID NO: 2388126 - RNA, 22 nt, Human
cgauguggcccuggccugcugg

SEQ ID NO: 2388127 - RNA, 16 nt, Human
cgauucacccugucca

SEQ ID NO: 2388128 - RNA, 21 nt, Human
cgauucacccuguccaaacug

SEQ ID NO: 2388129 - RNA, 17 nt, Human
cgauuauuaucuaaagu

SEQ ID NO: 2388130 - RNA, 18 nt, Human
cgauguaggcauucugga

SEQ ID NO: 2388131 - RNA, 19 nt, Human
cgauguaugcagcuaucug

SEQ ID NO: 2388132 - RNA, 20 nt, Human
cgauguaugcagcuaucugg

SEQ ID NO: 2388133 - RNA, 23 nt, Human
cgauguggaaaaaugagagaagg

SEQ ID NO: 2388134 - RNA, 15 nt, Human
cgagcccugguggca

SEQ ID NO: 2388135 - RNA, 16 nt, Human
cgagcccugguggcag

SEQ ID NO: 2388136 - RNA, 18 nt, Human
cgagcaugccuggauggg

SEQ ID NO: 2388137 - RNA, 15 nt, Human
cgagcauccuggcca

SEQ ID NO: 2388138 - RNA, 19 nt, Human
cgagccaugauguggagug

SEQ ID NO: 2388139 - RNA, 18 nt, Human
cgagccaugauguggagu

SEQ ID NO: 2388140 - RNA, 17 nt, Human
cgccaugcuccuggccc

SEQ ID NO: 2388141 - RNA, 14 nt, Human
cgaauacaaaauug

SEQ ID NO: 2388142 - RNA, 14 nt, Human
cgaaguugaugcaa

SEQ ID NO: 2388143 - RNA, 13 nt, Human
cgaaguguugcau

SEQ ID NO: 2388144 - RNA, 13 nt, Human
cgaagacacagac

SEQ ID NO: 2388145 - RNA, 18 nt, Human
cgaagaaggguccuuccc

SEQ ID NO: 2388146 - RNA, 15 nt, Human
cgaacuccuugauuu

SEQ ID NO: 2388147 - RNA, 16 nt, Human
cgaacuguuguauaaa

SEQ ID NO: 2388148 - RNA, 12 nt, Human
cgaacuggcugc

SEQ ID NO: 2388149 - RNA, 14 nt, Human
cgaacuggcugcaa

SEQ ID NO: 2388150 - RNA, 13 nt, Human
cgaaccccaagga

SEQ ID NO: 2388151 - RNA, 16 nt, Human
cgaacccaccugcuga

SEQ ID NO: 2388152 - RNA, 15 nt, Human
cgaaccaggagcugc

SEQ ID NO: 2388153 - RNA, 23 nt, Human
cgaacccaccugcugagagaccc

SEQ ID NO: 2388154 - RNA, 15 nt, Human
cgaaccuccucugug

SEQ ID NO: 2388155 - RNA, 16 nt, Human
cgaaccuccucuguga

SEQ ID NO: 2388156 - RNA, 16 nt, Human
cgaacgacaauagcuu

SEQ ID NO: 2388157 - RNA, 14 nt, Human
cgaacuccugaccu

SEQ ID NO: 2388158 - RNA, 14 nt, Human
cgaacccaccugcu

SEQ ID NO: 2388159 - RNA, 14 nt, Human
cgaaccaauauuug

SEQ ID NO: 2388160 - RNA, 12 nt, Human
cgaaccaggagc

SEQ ID NO: 2388161 - RNA, 23 nt, Human
cgaaaggauguaaacagugccug

SEQ ID NO: 2388162 - RNA, 22 nt, Human
cgaaaggauguaaacagugccu

SEQ ID NO: 2388163 - RNA, 22 nt, Human
cgaaagggacuuggaagcuccg

SEQ ID NO: 2388164 - RNA, 20 nt, Human
cgaaaggaugaaagugacca

SEQ ID NO: 2388165 - RNA, 19 nt, Human
cgaaagggacuuggaagcu

SEQ ID NO: 2388166 - RNA, 21 nt, Human
cgaaagaacaguccauugaaa

SEQ ID NO: 2388167 - RNA, 12 nt, Human
cgaaagaacagu

SEQ ID NO: 2388168 - RNA, 15 nt, Human
ccuuuuauguuauuu

SEQ ID NO: 2388169 - RNA, 15 nt, Human
ccuuuuauugacaca

SEQ ID NO: 2388170 - RNA, 15 nt, Human
ccuuuucacuacacc

SEQ ID NO: 2388171 - RNA, 18 nt, Human
ccuuuuuuuccaucuuua

SEQ ID NO: 2388172 - RNA, 23 nt, Human
ccuuuucagcgauguaugcagcu

SEQ ID NO: 2388173 - RNA, 17 nt, Human
ccuuuucagcuucugcu

SEQ ID NO: 2388174 - RNA, 20 nt, Human
ccuuuucagcuucugcuggg

SEQ ID NO: 2388175 - RNA, 21 nt, Human
ccuuuucagcuucugcugggc

SEQ ID NO: 2388176 - RNA, 18 nt, Human
ccuuuuacauacugcugu

SEQ ID NO: 2388177 - RNA, 21 nt, Human
ccuuuuagccuaguucaucca

SEQ ID NO: 2388178 - RNA, 21 nt, Human
ccuuuuauaaaccucuaauuu

SEQ ID NO: 2388179 - RNA, 22 nt, Human
ccuuuuauguaguaauugacau

SEQ ID NO: 2388180 - RNA, 11 nt, Human
ccuuuuauagc

SEQ ID NO: 2388181 - RNA, 16 nt, Human
ccuuuuauagcuauua

SEQ ID NO: 2388182 - RNA, 17 nt, Human
ccuuuuacauacugcug

SEQ ID NO: 2388183 - RNA, 22 nt, Human
ccuuugaccugccucccuucau

SEQ ID NO: 2388184 - RNA, 21 nt, Human
ccuuugaccugccucccuuca

SEQ ID NO: 2388185 - RNA, 22 nt, Human
ccuuugacgccaucccagcccc

SEQ ID NO: 2388186 - RNA, 20 nt, Human
ccuuugacgccaucccagcc

SEQ ID NO: 2388187 - RNA, 21 nt, Human
ccuuugacgccaucccagccc

SEQ ID NO: 2388188 - RNA, 22 nt, Human
cgaaaaccaggccuuaucucca

SEQ ID NO: 2388189 - RNA, 13 nt, Human
cgaaaaccaggcc

SEQ ID NO: 2388190 - RNA, 19 nt, Human
cgaaaaauccucuuccucu

SEQ ID NO: 2388191 - RNA, 15 nt, Human
cgaaaacguggcugc

SEQ ID NO: 2388192 - RNA, 18 nt, Human
cgaaaacguggcugcuuc

SEQ ID NO: 2388193 - RNA, 19 nt, Human
cgaaaacguggcugcuuca

SEQ ID NO: 2388194 - RNA, 18 nt, Human
cgaaaccuugccuuucuc

SEQ ID NO: 2388195 - RNA, 18 nt, Human
cgaaaccugggauucagg

SEQ ID NO: 2388196 - RNA, 13 nt, Human
cgaaacagcgcug

SEQ ID NO: 2388197 - RNA, 17 nt, Human
cgaaacacagaaaccuu

SEQ ID NO: 2388198 - RNA, 14 nt, Human
cgaaaccccaucuc

SEQ ID NO: 2388199 - RNA, 22 nt, Human
cgaaacaggcuacucuccucgg

SEQ ID NO: 2388200 - RNA, 16 nt, Human
cgaaaccaaagaagaa

SEQ ID NO: 2388201 - RNA, 21 nt, Human
cgaaaaauccucuuccucuga

SEQ ID NO: 2388202 - RNA, 22 nt, Human
cgaaaaguuggugucaaugaau

SEQ ID NO: 2388203 - RNA, 20 nt, Human
cgaaaacguggcugcuucaa

SEQ ID NO: 2388204 - RNA, 16 nt, Human
cgagaccagccuggcc

SEQ ID NO: 2388205 - RNA, 15 nt, Human
cgagaccagccuggc

SEQ ID NO: 2388206 - RNA, 14 nt, Human
cgagaccagccugg

SEQ ID NO: 2388207 - RNA, 13 nt, Human
cgagaccagccug

SEQ ID NO: 2388208 - RNA, 15 nt, Human
cgagaagcaagaaag

SEQ ID NO: 2388209 - RNA, 13 nt, Human
cgagaagcaagaa

SEQ ID NO: 2388210 - RNA, 16 nt, Human
cgagaagcugcucugg

SEQ ID NO: 2388211 - RNA, 18 nt, Human
cgagaagcugcucuggaa

SEQ ID NO: 2388212 - RNA, 17 nt, Human
cgagaccaaccugacca

SEQ ID NO: 2388213 - RNA, 20 nt, Human
cgagaagcugcucuggaauu

SEQ ID NO: 2388214 - RNA, 14 nt, Human
cgagacacuugccu

SEQ ID NO: 2388215 - RNA, 17 nt, Human
cgagaccagccuggcca

SEQ ID NO: 2388216 - RNA, 13 nt, Human
cgagaccagucug

SEQ ID NO: 2388217 - RNA, 22 nt, Human
cgagaggggaagaguguacugg

SEQ ID NO: 2388218 - RNA, 18 nt, Human
cgagagguaugccuguac

SEQ ID NO: 2388219 - RNA, 14 nt, Human
cgagaggugggcca

SEQ ID NO: 2388220 - RNA, 15 nt, Human
cgagaggugggccag

SEQ ID NO: 2388221 - RNA, 19 nt, Human
cgagaggugggccagucug

SEQ ID NO: 2388222 - RNA, 20 nt, Human
cgagaggugggccagucugu

SEQ ID NO: 2388223 - RNA, 15 nt, Human
cgagagucugucuca

SEQ ID NO: 2388224 - RNA, 14 nt, Human
cgagagucugucuc

SEQ ID NO: 2388225 - RNA, 20 nt, Human
cgagaguagccgagagccug

SEQ ID NO: 2388226 - RNA, 19 nt, Human
cgagaguagccgagagccu

SEQ ID NO: 2388227 - RNA, 22 nt, Human
cgagaggugggccagucugugg

SEQ ID NO: 2388228 - RNA, 23 nt, Human
cgagaggugggccagucugugga

SEQ ID NO: 2388229 - RNA, 17 nt, Human
cgagaucacgccacugc

SEQ ID NO: 2388230 - RNA, 18 nt, Human
cgagauagccaaggccaa

SEQ ID NO: 2388231 - RNA, 19 nt, Human
cgacugugaccugugggga

SEQ ID NO: 2388232 - RNA, 17 nt, Human
cgacugugaccuguggg

SEQ ID NO: 2388233 - RNA, 18 nt, Human
cgacuugaauuuucccac

SEQ ID NO: 2388234 - RNA, 19 nt, Human
cgacuugaauuuucccacu

SEQ ID NO: 2388235 - RNA, 20 nt, Human
cgacuugaauuuucccacug

SEQ ID NO: 2388236 - RNA, 21 nt, Human
cgacuugaauuuucccacugc

SEQ ID NO: 2388237 - RNA, 19 nt, Human
cgaauacuuuugcccuuug

SEQ ID NO: 2388238 - RNA, 11 nt, Human
cgacugucucc

SEQ ID NO: 2388239 - RNA, 13 nt, Human
cgaauagcuggga

SEQ ID NO: 2388240 - RNA, 14 nt, Human
cgaauagcugggac

SEQ ID NO: 2388241 - RNA, 13 nt, Human
cgacuuuauuuuc

SEQ ID NO: 2388242 - RNA, 17 nt, Human
cgacuuuguacccccca

SEQ ID NO: 2388243 - RNA, 16 nt, Human
cgacuuucugccugga

SEQ ID NO: 2388244 - RNA, 23 nt, Human
cgacuuuguaccccccaaccccu

SEQ ID NO: 2388245 - RNA, 20 nt, Human
cgagaaauaaaguuugcuua

SEQ ID NO: 2388246 - RNA, 16 nt, Human
cgagaacuuucauuuu

SEQ ID NO: 2388247 - RNA, 17 nt, Human
cgagaacuuucauuuuu

SEQ ID NO: 2388248 - RNA, 16 nt, Human
cgacuugcauuuuugc

SEQ ID NO: 2388249 - RNA, 22 nt, Human
cgacuugaauuuucccacugca

SEQ ID NO: 2388250 - RNA, 21 nt, Human
cgacuugcuguuuuguucugu

SEQ ID NO: 2388251 - RNA, 19 nt, Human
cgacuuguuuuugcacaug

SEQ ID NO: 2388252 - RNA, 13 nt, Human
cgacuuucugccu

SEQ ID NO: 2388253 - RNA, 14 nt, Human
cgacuuucugccug

SEQ ID NO: 2388254 - RNA, 15 nt, Human
cgacuuucugccugg

SEQ ID NO: 2388255 - RNA, 23 nt, Human
cgagcaguccugccucagccucc

SEQ ID NO: 2388256 - RNA, 21 nt, Human
cgagcaguccugccucagccu

SEQ ID NO: 2388257 - RNA, 17 nt, Human
cgagcaguccugccuca

SEQ ID NO: 2388258 - RNA, 15 nt, Human
cgagcaguccugccu

SEQ ID NO: 2388259 - RNA, 18 nt, Human
cgagcagggugcuguggg

SEQ ID NO: 2388260 - RNA, 20 nt, Human
cgagcaggcuucuucccccc

SEQ ID NO: 2388261 - RNA, 18 nt, Human
cgagcaggcuacugucag

SEQ ID NO: 2388262 - RNA, 14 nt, Human
cgagcaugccugga

SEQ ID NO: 2388263 - RNA, 13 nt, Human
cgagcaugccugg

SEQ ID NO: 2388264 - RNA, 16 nt, Human
cgagcaugccuggaug

SEQ ID NO: 2388265 - RNA, 17 nt, Human
cgagcaugccuggaugg

SEQ ID NO: 2388266 - RNA, 16 nt, Human
cgagaucacgccacug

SEQ ID NO: 2388267 - RNA, 18 nt, Human
cgagaucacgccacugca

SEQ ID NO: 2388268 - RNA, 20 nt, Human
cgagaucacgccacugcacu

SEQ ID NO: 2388269 - RNA, 20 nt, Human
cgagauugcaccacugcacu

SEQ ID NO: 2388270 - RNA, 13 nt, Human
cgagcaccuccac

SEQ ID NO: 2388271 - RNA, 14 nt, Human
cgagcaaagaucaa

SEQ ID NO: 2388272 - RNA, 15 nt, Human
cgagcaaagaucaaa

SEQ ID NO: 2388273 - RNA, 20 nt, Human
cgagcaaagaucaaaauaaa

SEQ ID NO: 2388274 - RNA, 20 nt, Human
cgagcaaagucuaaaguuua

SEQ ID NO: 2388275 - RNA, 23 nt, Human
cgagcaaagaucaaaauaaaaag

SEQ ID NO: 2388276 - RNA, 19 nt, Human
cgagcaaagucuaaaguuu

SEQ ID NO: 2388277 - RNA, 23 nt, Human
ccuuccuuuucccugcuuccagg

SEQ ID NO: 2388278 - RNA, 20 nt, Human
ccuuccuuuucccugcuucc

SEQ ID NO: 2388279 - RNA, 21 nt, Human
ccuuccuuuucccugcuucca

SEQ ID NO: 2388280 - RNA, 16 nt, Human
ccuuccuuuucccugc

SEQ ID NO: 2388281 - RNA, 17 nt, Human
ccuuccuuuucccugcu

SEQ ID NO: 2388282 - RNA, 18 nt, Human
ccuuccuuuucccugcuu

SEQ ID NO: 2388283 - RNA, 19 nt, Human
ccuuccuuuucccugcuuc

SEQ ID NO: 2388284 - RNA, 16 nt, Human
ccuucgcuucuugccu

SEQ ID NO: 2388285 - RNA, 17 nt, Human
ccuucgcuucuugccuc

SEQ ID NO: 2388286 - RNA, 18 nt, Human
ccuucgcuucuugccucu

SEQ ID NO: 2388287 - RNA, 15 nt, Human
ccuuccuuuucccug

SEQ ID NO: 2388288 - RNA, 13 nt, Human
ccuuccuuuuccc

SEQ ID NO: 2388289 - RNA, 20 nt, Human
ccuuccuugcuguccuaggc

SEQ ID NO: 2388290 - RNA, 18 nt, Human
ccuuccuugcucugcacc

SEQ ID NO: 2388291 - RNA, 19 nt, Human
ccuuccuugcucugcaccc

SEQ ID NO: 2388292 - RNA, 23 nt, Human
ccuuccuugaccagcagauccca

SEQ ID NO: 2388293 - RNA, 15 nt, Human
ccuuccuucccuggg

SEQ ID NO: 2388294 - RNA, 14 nt, Human
ccuuccuugcuaau

SEQ ID NO: 2388295 - RNA, 20 nt, Human
ccuucggccuccauccugag

SEQ ID NO: 2388296 - RNA, 19 nt, Human
ccuucggccuccauccuga

SEQ ID NO: 2388297 - RNA, 14 nt, Human
ccuucggccuccau

SEQ ID NO: 2388298 - RNA, 19 nt, Human
ccuucgcuucuugccucug

SEQ ID NO: 2388299 - RNA, 20 nt, Human
ccuucgcuucuugccucugu

SEQ ID NO: 2388300 - RNA, 21 nt, Human
ccuucgcuucuugccucugug

SEQ ID NO: 2388301 - RNA, 23 nt, Human
ccuucgcuucuugccucugugcu

SEQ ID NO: 2388302 - RNA, 19 nt, Human
ccuuccaacaggagcuggg

SEQ ID NO: 2388303 - RNA, 16 nt, Human
ccuuccaacaggagcu

SEQ ID NO: 2388304 - RNA, 18 nt, Human
ccuucagugcccaccaac

SEQ ID NO: 2388305 - RNA, 15 nt, Human
ccuuccaagagccug

SEQ ID NO: 2388306 - RNA, 17 nt, Human
ccuuccaagagccugag

SEQ ID NO: 2388307 - RNA, 16 nt, Human
ccuuccaagagccuga

SEQ ID NO: 2388308 - RNA, 16 nt, Human
ccuucagugcccacca

SEQ ID NO: 2388309 - RNA, 15 nt, Human
ccuucagugcccacc

SEQ ID NO: 2388310 - RNA, 14 nt, Human
ccuucagugcccac

SEQ ID NO: 2388311 - RNA, 12 nt, Human
ccuucagugccc

SEQ ID NO: 2388312 - RNA, 18 nt, Human
ccuucagcccucaccccu

SEQ ID NO: 2388313 - RNA, 22 nt, Human
ccuucauuuggcauuccccacu

SEQ ID NO: 2388314 - RNA, 21 nt, Human
ccuuccucuccacugccuucg

SEQ ID NO: 2388315 - RNA, 17 nt, Human
ccuuccucucuccagau

SEQ ID NO: 2388316 - RNA, 15 nt, Human
ccuuccucucuccag

SEQ ID NO: 2388317 - RNA, 16 nt, Human
ccuuccucugagccuu

SEQ ID NO: 2388318 - RNA, 15 nt, Human
ccuuccucugagccu

SEQ ID NO: 2388319 - RNA, 16 nt, Human
ccuuccuugaccagca

SEQ ID NO: 2388320 - RNA, 16 nt, Human
ccuuccuucccuggcu

SEQ ID NO: 2388321 - RNA, 15 nt, Human
ccuuccuucccuggc

SEQ ID NO: 2388322 - RNA, 13 nt, Human
ccuuccucugagg

SEQ ID NO: 2388323 - RNA, 20 nt, Human
ccuuccucugagccuuggga

SEQ ID NO: 2388324 - RNA, 16 nt, Human
ccuucagauggaaacu

SEQ ID NO: 2388325 - RNA, 20 nt, Human
ccuucagacacccucaaccu

SEQ ID NO: 2388326 - RNA, 17 nt, Human
ccuucagacacccucaa

SEQ ID NO: 2388327 - RNA, 18 nt, Human
ccuucagacuuugcuucc

SEQ ID NO: 2388328 - RNA, 21 nt, Human
ccuucagacuuugcuucccau

SEQ ID NO: 2388329 - RNA, 13 nt, Human
ccuucagcccuca

SEQ ID NO: 2388330 - RNA, 22 nt, Human
ccuucagauguucucucccagg

SEQ ID NO: 2388331 - RNA, 23 nt, Human
ccuucagauguucucucccaggg

SEQ ID NO: 2388332 - RNA, 12 nt, Human
ccuucagccuga

SEQ ID NO: 2388333 - RNA, 19 nt, Human
ccuucauuuggcauucccc

SEQ ID NO: 2388334 - RNA, 14 nt, Human
ccuucagugccaaa

SEQ ID NO: 2388335 - RNA, 11 nt, Human
ccuucagugcc

SEQ ID NO: 2388336 - RNA, 10 nt, Human
ccuucagugc

SEQ ID NO: 2388337 - RNA, 14 nt, Human
ccuucagcccucac

SEQ ID NO: 2388338 - RNA, 15 nt, Human
ccuucagcccucacc

SEQ ID NO: 2388339 - RNA, 20 nt, Human
ccuucacauccuguguuucu

SEQ ID NO: 2388340 - RNA, 12 nt, Human
ccuucacagugu

SEQ ID NO: 2388341 - RNA, 14 nt, Human
ccuuagacaguccc

SEQ ID NO: 2388342 - RNA, 17 nt, Human
ccuucacagaugggugc

SEQ ID NO: 2388343 - RNA, 19 nt, Human
ccuucaccuuuguccccac

SEQ ID NO: 2388344 - RNA, 20 nt, Human
ccuucaccuuuguccccacc

SEQ ID NO: 2388345 - RNA, 20 nt, Human
ccuucacuccggugugccug

SEQ ID NO: 2388346 - RNA, 14 nt, Human
ccuucacuccggug

SEQ ID NO: 2388347 - RNA, 17 nt, Human
ccuucacauacccuccc

SEQ ID NO: 2388348 - RNA, 17 nt, Human
ccuucaccccaguggcc

SEQ ID NO: 2388349 - RNA, 14 nt, Human
ccuucaccucugaa

SEQ ID NO: 2388350 - RNA, 21 nt, Human
ccuucaccuuuguccccaccg

SEQ ID NO: 2388351 - RNA, 22 nt, Human
ccuucacuucugaccacacuuc

SEQ ID NO: 2388352 - RNA, 18 nt, Human
ccuucagaaccauccaua

SEQ ID NO: 2388353 - RNA, 20 nt, Human
ccuucacuucugaccacacu

SEQ ID NO: 2388354 - RNA, 11 nt, Human
ccuucagacac

SEQ ID NO: 2388355 - RNA, 10 nt, Human
ccuucagaca

SEQ ID NO: 2388356 - RNA, 23 nt, Human
ccuucacuccggugugccugcag

SEQ ID NO: 2388357 - RNA, 14 nt, Human
ccuucacugccuuu

SEQ ID NO: 2388358 - RNA, 18 nt, Human
ccuucacugccuuugcuc

SEQ ID NO: 2388359 - RNA, 14 nt, Human
ccuucacuuaggaa

SEQ ID NO: 2388360 - RNA, 21 nt, Human
ccuuggcuuuuacugaagccu

SEQ ID NO: 2388361 - RNA, 12 nt, Human
ccuugggacccc

SEQ ID NO: 2388362 - RNA, 17 nt, Human
ccuugcaacacacagac

SEQ ID NO: 2388363 - RNA, 16 nt, Human
ccuugcaacacacaga

SEQ ID NO: 2388364 - RNA, 14 nt, Human
ccuugauugggacu

SEQ ID NO: 2388365 - RNA, 23 nt, Human
ccuugcaaagaccauaaagucca

SEQ ID NO: 2388366 - RNA, 22 nt, Human
ccuugcaacacacagacacacg

SEQ ID NO: 2388367 - RNA, 18 nt, Human
ccuugcaacacacagaca

SEQ ID NO: 2388368 - RNA, 17 nt, Human
ccuugcaacuucauguc

SEQ ID NO: 2388369 - RNA, 15 nt, Human
ccuugggaggcccca

SEQ ID NO: 2388370 - RNA, 23 nt, Human
ccuugggaggaagcagaauaaag

SEQ ID NO: 2388371 - RNA, 21 nt, Human
ccuugggaggaagcagaauaa

SEQ ID NO: 2388372 - RNA, 22 nt, Human
ccuugggaggaagcagaauaaa

SEQ ID NO: 2388373 - RNA, 20 nt, Human
ccuugggaggccccacuggg

SEQ ID NO: 2388374 - RNA, 19 nt, Human
ccuugggaggccccacugg

SEQ ID NO: 2388375 - RNA, 14 nt, Human
ccuugggaggaagc

SEQ ID NO: 2388376 - RNA, 15 nt, Human
ccuugggaggaagca

SEQ ID NO: 2388377 - RNA, 16 nt, Human
ccuugggaggaagcag

SEQ ID NO: 2388378 - RNA, 17 nt, Human
ccuugggaggaagcaga

SEQ ID NO: 2388379 - RNA, 18 nt, Human
ccuugggaggaagcagaa

SEQ ID NO: 2388380 - RNA, 19 nt, Human
ccuugggaggaagcagaau

SEQ ID NO: 2388381 - RNA, 20 nt, Human
ccuugggaggaagcagaaua

SEQ ID NO: 2388382 - RNA, 20 nt, Human
ccuugauuuuagccuucucu

SEQ ID NO: 2388383 - RNA, 22 nt, Human
ccuugauuuuagccuucucugu

SEQ ID NO: 2388384 - RNA, 21 nt, Human
ccuugauuuuagccuucucug

SEQ ID NO: 2388385 - RNA, 14 nt, Human
ccuugaugugccug

SEQ ID NO: 2388386 - RNA, 19 nt, Human
ccuugauggagauauuuac

SEQ ID NO: 2388387 - RNA, 23 nt, Human
ccuugauuguucgggugugcaau

SEQ ID NO: 2388388 - RNA, 14 nt, Human
ccuugaugaagaag

SEQ ID NO: 2388389 - RNA, 14 nt, Human
ccuugagugggguu

SEQ ID NO: 2388390 - RNA, 22 nt, Human
ccuugagugggguuaucucugu

SEQ ID NO: 2388391 - RNA, 23 nt, Human
ccuugagugggguuaucucugug

SEQ ID NO: 2388392 - RNA, 12 nt, Human
ccuugggcccuu

SEQ ID NO: 2388393 - RNA, 17 nt, Human
ccuugggcccuuugagu

SEQ ID NO: 2388394 - RNA, 14 nt, Human
ccuugggcccuuug

SEQ ID NO: 2388395 - RNA, 16 nt, Human
ccuuggggcaggcagu

SEQ ID NO: 2388396 - RNA, 15 nt, Human
ccuuggggcaggcag

SEQ ID NO: 2388397 - RNA, 14 nt, Human
ccuuggggcaggca

SEQ ID NO: 2388398 - RNA, 22 nt, Human
ccuuggggauucuuccaucuga

SEQ ID NO: 2388399 - RNA, 18 nt, Human
ccuuggggauucuuccau

SEQ ID NO: 2388400 - RNA, 19 nt, Human
ccuuggggcugaugcaguu

SEQ ID NO: 2388401 - RNA, 21 nt, Human
ccuuggugucgggcaugacac

SEQ ID NO: 2388402 - RNA, 22 nt, Human
ccuuggugucgggcaugacacg

SEQ ID NO: 2388403 - RNA, 21 nt, Human
ccuugguuaggcauuguggga

SEQ ID NO: 2388404 - RNA, 22 nt, Human
ccuugguuaggcauugugggaa

SEQ ID NO: 2388405 - RNA, 22 nt, Human
ccuuguuugauuuuagcugcag

SEQ ID NO: 2388406 - RNA, 19 nt, Human
ccuuguuggagccugcagg

SEQ ID NO: 2388407 - RNA, 14 nt, Human
ccuuguuucaaaca

SEQ ID NO: 2388408 - RNA, 20 nt, Human
ccuuguuucaaacacaaaug

SEQ ID NO: 2388409 - RNA, 22 nt, Human
ccuuguuucaaacacaaaugca

SEQ ID NO: 2388410 - RNA, 19 nt, Human
ccuuguuuacacauacccu

SEQ ID NO: 2388411 - RNA, 17 nt, Human
ccuuguuggagccugca

SEQ ID NO: 2388412 - RNA, 18 nt, Human
ccuuguuggagccugcag

SEQ ID NO: 2388413 - RNA, 15 nt, Human
ccuuguucacacucu

SEQ ID NO: 2388414 - RNA, 21 nt, Human
ccuuguucugauaaugaaaau

SEQ ID NO: 2388415 - RNA, 21 nt, Human
ccuuguuccuagaguagagug

SEQ ID NO: 2388416 - RNA, 16 nt, Human
ccuuguuggagccugc

SEQ ID NO: 2388417 - RNA, 13 nt, Human
ccuuguugcauga

SEQ ID NO: 2388418 - RNA, 21 nt, Human
ccuuguuauuucucagacuuu

SEQ ID NO: 2388419 - RNA, 19 nt, Human
ccuuguuacuucugaggua

SEQ ID NO: 2388420 - RNA, 16 nt, Human
ccuuguuacuucugag

SEQ ID NO: 2388421 - RNA, 18 nt, Human
ccuuguuacuucugaggu

SEQ ID NO: 2388422 - RNA, 19 nt, Human
ccuuggugugacccucuga

SEQ ID NO: 2388423 - RNA, 15 nt, Human
ccuugguggcaagag

SEQ ID NO: 2388424 - RNA, 17 nt, Human
ccuugguggcaagagcc

SEQ ID NO: 2388425 - RNA, 14 nt, Human
ccuuguccacccac

SEQ ID NO: 2388426 - RNA, 16 nt, Human
ccuugucacugguaga

SEQ ID NO: 2388427 - RNA, 14 nt, Human
ccuuguccccugcc

SEQ ID NO: 2388428 - RNA, 21 nt, Human
ccuuguccccacacuccuaca

SEQ ID NO: 2388429 - RNA, 15 nt, Human
ccuuguccccugccu

SEQ ID NO: 2388430 - RNA, 14 nt, Human
ccuuguccuuuccc

SEQ ID NO: 2388431 - RNA, 16 nt, Human
ccuuguccacccaccu
